United States Patent 11,931,406 (FLAVIVIRUS VACCINE) - sequence listing, part 71

SEQ ID NO: 24567 - RNA, 9879 nt, Artificial Sequence
  derived and/or modified CDS sequence (opt11) from DENV-1__EU482489__SS-prME
uccgucaccaugcugcucaugcucaugcccaccgcgcuggccuuccaccucacuacccggggcggcgaaccccacaugauugugagcaagcaggagcggggcaaaaguuuacuguucaaaaccuccgcaggcgugaacaugugcacgcugaucgcuauggacuugggggaacugugcgaggacaccaugaccuacaagugcccacggaucaccgagacagagccugacgacguggacugcugguguaacgcaacggacaccugggugacguaugggaccugcucccagacgggcgagcaccggagggacaagcggucaguggccuuagcgccccaugugggcuuaggacuggaaacccgcaccgagaccuggaugagcuccgaaggcgcguggaagcagauacagcgggucgagacgugggcccuccggcaccccggguuuacacugaucgcgcuguuucucgcgcacgcgaucggcaccagcaucacccagaaagggaucaucuucauccugcucaugcucguaacgcccuccauggcuaugcggugcgucggcaucgggucgcgcgacuucgucgagggccuguccggcgccacuuggguggacguuguccuggagcacgggaguugcguuaccaccauggccaaggacaagcccacgcucgacaucgaacugcuaaagaccgaggugacaaacccggccguucuccguaagcuuugcaucgaggcgaaaaucuccaauaccacgaccgacagccgcugcccgacccagggugaagccacccugguggaagagcaggacgccaacuuuguaugccgacgcacguucguagacagggguuggggcaacggcugcggccuguucggcaagggaucccugauuacuugcgccaaguucaagugcguaaccaagcuggagggcaagaucgugcaauaugagaaucucaaguacucagucaucguaaccguacauacgggcgaccagcaccaagucgggaaugaguccacugagcacggaaccacggccaccaucacgccccaggcgccaaccaccgagauacagcugacugacuacggcgcccugacgcucgacugcagcccccgaacgggccuggacuucaacgagauggugcugcucaccaugaaggaaaagucuuggcugguccacaagcagugguuccuggaccuaccccugcccuggaccaguggggccagcacgucacaagagaccuggaaucggcaagaccugcuugugacauucaagaccgcacaugcuaagaagcaggagguggucguacugggcucgcaagagggagcgaugcacacggcccugacgggcgccacagagauccagaccuccggcacgaccacgaucuucgccgggcacuugaaaugccggcugaagauggacaagcuuacccuuaagggcaugaguuacgugaugugcacgggguccuucaaguuagaaaaagaacucgccgagacccagcauggcacgguccuggugcagaucaaguacgaagguacugaugcucccugcaagauacccuuuagcacgcaggacgagaaaggggugacccaaaacggcagacuuaucaccgccaacccgaucguuaccgacaaggagaagccaguuaacauugaggccgagccgcccuucggggagaguuacauagugaucggcgccggcgagaaagcgcugaaauugagcugguucaagaagggguccagcauaggcaagauguuugaggcuacggcccguggcgcgcggcggauggcgauccucggcgacacagcgugggauuuugguucuauagggggugucuucacuagcguggggaagcucguucaccaaaucuucggaaccgccuacggcguccuguucuccggcgugucuuggacgaugaaaaucgggauaggcgugcuccugaccuggcuaggccucaauucccgcagcaccucccuaagcaugacaugcaucgccguuggccuggugacgcucuaccuaggcgucaugguccaggccgacucagggugcgugaucaacuggaagggacgcgagcugaagugcggaagcggcauuuucgugaccaacgagguccauaccuggaccgagcaguacaaguuucaggcugacagcccgaagcgcuuguccgcggcuaucggcaaggcuugggaagaggggguaugcgguauccggucugccacaaggcuagagaacauaauguggaagcagauuuccaacgagcugaaccacauccuccucgaaaacgauaugaaguucacgguggucguaggggacguagcagggauccucgcucaggggaagaagaugaucaggccccagccuauggaguauaaauacagcuggaaguccuggggcaaggcuaagaucaucggagccgacguccagaacaccacauucaucauagacggccccaacacgccagagugccccgacgaucagagggccuggaacaucugggagguggaggacuacggauucggcaucuucacgacgaacaucuggcucaagcugcgggauagcuacacccaggugugcgaccaucgccugauguccgcggcgaucaaggauagcaaggccguccacgcugauaugggcuacuggaucgaaucugagaagaacgagaccuggaagcuagcccgggcuagcuucauagaagucaagacguguauauggcccaagucgcacacccucuggagcaacggcguguuagaguccgagaugaucauacccaagaucuacgguggcccaaucagccagcacaacuaccgcccuggguacuucacacagacggccggccccuggcaccucggaaagcuggagcuggacuucgaccuaugcgagggcacgaccguggugguagacgagcacuguggaaaccgcgggcccucgcugcgcaccaccacgguuaccggcaaaaucauacacgaguggugcugccggagcuguacccugcccccacugcgcuuccgcggagaagacggcugcugguacgguauggagauccgccccgugaaggagaaggaggaaaaccuggucaaauccauggucucggccggcucaggcgaaguggacaguuuuagccuggggcucuugugcaucuccaucaugaucgaagaagugaugcgcagccgcuggagucggaagaugcugaugaccgguacgcucgcgguuuucuuccugcucaucaugggacaacuuaccuggaacgaucugauccgccuaugcaucauggugggcgccaacgcaagcgaccgcauggggaugggcacgacauaccucgcccugauggccacuuucaagaugcggccgauguucgccgucggccuccucuuccgccggcuuacaucgcgggagguccuacucuuaaccaucggauuaagccuaguggccuccguggagcugcccaauagccuugaggaacucggcgacggacuggcuauggggauuaugauccugaagcuccugaccgacuuccagucccaccaacugugggccacgcuccugagccugaccuucaucaagaccacguuuucccuccauuacgcauggaagacgauggcaaugguacucucaauugugagccuguucccucucugucugagcaccaccucucagaagaccacguggcugcccguccuccugggcucccugggcugcaaacccuuaaccauguuccugaucgcggaaaacaagaucuggggucggagauccuggccccugaacgaggggaucauggccgucggcauaguuagcauccugcugucgucccugcuaaagaaugauguccccuuagccgggccacucaucgcaggcggcaugcucaucgccugcuacgugauuaguggauccagcgcggaccucucccuggagaaggcggccgaagugucaugggaggaggaggcggagcacuccggcgcgagccacaacaucuuggucgagguacaggacgacggcaccaugaagauaaaagacgaggagcgggacgacacccugacaauacugcucaaggcgaccuuauuagcugugucaggcguuuacccguugaguauccccgccacccuguucgucugguacuucuggcaaaagaagaagcagcgcagugggguguugugggacacccccucgccuccagaggucgagcgagccguccuggacgacgguaucuaucguaucaugcagaggggcuuacugggucgcucacaggugggugucgggguguuucaggagaacguguuccacaccauguggcacgucacgcggggagccguguuaauguaccagggcaagcgccucgagcccucaugggcauccgugaagaaggaccugaucucguacggcggcggguggcgucugcagggcuccuggaacacaggagaggaggugcaggugaucgccgucgagcccggcaagaaccccaagaacgugcagacugcgccggggaccuuuaagacaccagagggcgaagugggcgccauugcccucgacuucaagcccgggaccagcggcucccccaucguuaaucgcgaggggaagaucguuggccuauacggcaacgggguaguuaccacuaguggaacguacguguccgcgaucgcgcaggcuaaggccucucaggaggggccgcuccccgagauugaagacgagguguuccgcaagcguaaucucaccaucauggaccugcaccccggcucugguaagacccgccgcuaccugccggcgaucgugcgggaggccaucaagcgcaagcuucgcacccucauacuggcccccacgagagucguggccuccgaaauggcggaggcccugaaggggaugccuaucagguaccaaacgaccgccgucaaaagcgaacacacaggcaaagagauugucgaccugaugugucacgcuacguucaccaugcggcugcucagucccgugcgcgugccgaacuacaauaugauuaucauggacgaagcccacuuuacugaccccuccuccauugcagcucgcggguauaucuccacccgggucggaaugggggaagccgccgccaucuucaugacggccacuccgcccgguuccguagaagcguucccgcagagcaacgcugugauccaggacgaagagcgggacauccccgagcgguccuggaacagcggauaugaguggaucaccgauuuucccggcaagaccguaugguucgugcccagcauaaaaagcggcaaugacauagccaauugucugcggaagaacgggaagcgaguuauccaguugucccgcaaaacguucgacacggaauaccagaagaccaagaacaacgacugggacuacgucgugaccacggauaucagcgagaugggcgccaacuuccgcgcggaucgggugaucgacccccgccggugccuuaagcccgucauccugaaggacggaccggagcgugugauucuggccggacccaugccagugaccguagcauccgccgcccagcggcgugggcggaucggccguaaccacaacaaggagggcgaucaguacaucuauauggggcagccacugaacaacgaugaggaccaugcgcacuggacugaggcgaagaugcugcuggacaacauaaacaccccagaggguaucauccccgcccucuucgagccggagcgcgaaaaguccgcggccaucgacggagaguacaggcuacgcggcgaggcgaggaagacguucguagagcugaugcgccgcggugaccuccccgucuggcuguccuacaagguggccagcgaggguuuucaguacagcgaucgccguuggugcuucgacggagagcgcaacaaucagguccuggaggagaacauggacgucgagauuuggaccaaagaaggggaacggaaaaagcuccgcccccgguggcuggaugcccgcaccuacuccgauccccuagcccuccgggaguuuaaggaguucgcggcgggccgccggucaguguccggggacuugauccuggagaucggcaagcucccgcagcaccugacccaacgcgcacagaacgccuuagacaaccucgucaugcugcacaacagcgagcagggggggcgggccuaccgccacgcgauggaagaacugcccgauacgauagaaacgcuaauguuacuggcccucaucgccguacuaaccgggggggugacgcuguucuuccucuccggccggggucuggguaaaaccucuaucggguuacuauguguaauggccuccucuguccugcuuuggauggccuccguagagccccacuggaucgcggcgagcaucauccucgaguucuuccuaauggugcugcucauccccgagccggaucgccagcggacgccccaagacaaucaacuggccuacgucgugaucgggcuacucuucaugauccucaccgucgccgccaacgagaugggucugcucgagacuaccaaaaaggaccuggggaucggccacgucgcgguggagaaucaccaucacgcugccaugcuggacgucgaccugcaccccgcaucagcguggacgcuguacgcgguggcaacgacgaucaucaccccgaugaugcggcacacgaucgagaacaccaccgccaacauaucccuuacugccaucgcuaaccaagcggccauccucauggggcuggacaaaggguggcccaucucaaagauggauauuggcgugccccuccuagcccuggggugcuacagucagguaaacccucugacucucacugccgcgguccugaugcugguggcccauuacgccaucaucggaccggggcuccaagccaaggcaacccgcgaggcucagaaaaggacugccgcgggcaucaugaagaacccgacgguggacgggauugucgccaucgaccuggaccccguaguguacgacgccaaguucgaaaaacagcucggccagauuaugcuccugauucucugcaccucacagauccuacugaugcgaaccaccugggcccuuugcgaaagcaucacgcucgcaacggggccccuuaccaccuuaugggaaggguccccggguaaauucuggaauacgaccaucgcagucagcauggccaacauauucaggggcucauaccucgcaggcgcgggccuggccuucagccuuaugaaaucccucgggggggggcgacgggguaccggugcccagggggagacucuaggggagaaauggaagcgccagcugaaccagcucuccaagagcgaguucaacacuuacaaacgauccgggaucauggagguggaccgcagcgaagccaaagagggccugaagcgcggcgaaaccaccaagcacgcgguaucccguggcacggcuaagcugcguugguuuguggagcgcaaucugguaaagcccgaggggaaagugaucgaccucgguugcggccggggcggauggagcuacuacugcgccgggcuaaagaaggucacggaggugaagggauacaccaagggcggacccggccacgaggaaccgauaccaauggccaccuacggguggaaccuggugaaacuccacuccgguaaggaugucuucuuuaucccuccggaaaagugcgauacccuccuuugcgauaucggcgagagcucuccuaacccuacgaucgaagagggaaggacauugcgggugcugaaaaugguggagcccugguugcgcgggaaucaguucugcauuaagauccucaaccccuacaugcccagugucgucgaaacccuggagcagaugcagcggaagcacggaggcaugcugguacgcaacccgcucucccgcaauuccacccaugagauguacugggucuccugcgggaccggcaacauugugagcgccguaaauaugacgucccgcaugcugcugaaccgcuucaccauggcgcaccgaaagcccacguacgagcgcgacgucgaccuuggcgccggaacccggcacguggcaguggaacccgaggucgccaaucuggacauaauuggccagcgcaucgagaacauuaagcacgagcacaaauccaccuggcacuacgacgaggacaacccuuauaagaccugggcauaccacgggucguacgaggugaagccgagcggguccgcgagcagcauggugaacggggucgugaaacugcucaccaagcccugggacgucauccccauggucacccagaucgccaugacagacaccacccccuucggccagcagcggguguucaaggagaaggucgacaccagaacgccgaaagcaaaaagagggaccgcccagaucauggaggucacugccaagugguuauggggguuccugucccggaacaagaagccccggaucugcacccgcgaggaguuuacccggaaggugaggucgaacgcugccaucggcgccguuuuuguugacgagaaccaauggaauuccgcuaaagaagcgguggaggaugagcguuucugggaccucguccacagggagcgggagcuccacaagcaagggaagugcgcgaccugcguguacaacaugaugggcaagcgagagaagaagcugggagaauucggaaaggccaaagggagccgggccauaugguacauguggcucggcgcccguuuccuggaguucgaggcacugggcuucaugaaugaagaccacugguucucccgcgagaacucgcucuccgguguggagggcgaaggguugcacaagcugggcuauauccugcgcgacaucucuaagauuccggggggcaacauguacgcagaugacaccgcuggcugggacacccggaucacggaggaugaucuacagaacgaggcccgcaucaccgacaucauggagccggagcacgcccugcucgccaagucgaucuuuaaacugacauaccagaacaaggucgugcgcguacaacggcccgccaagaacgggaccgucauggaugugaucucacgccgggaccaaagaggcuccgggcaggucgggacguacggccuaaacaccuuuacgaacauggaagcccaguuaaucagacagauggagagcgagggaaucuucucccccagcgaacuagagacccccaaucuggccgaacgcguuuuagauuggcuggagaaguacggcguugagcgccugaaacgcauggccaucucgggggacgauuguguggugaagccgauugaugaccgguucgcgacggcauuaaccgcccugaacgacauggggaaggugcgcaaggauaucccgcagugggaaccgagcaaggguuggaacgacuggcagcagguccccuuuugcagccaucacuuucaucagcugaucaugaaggaugggcgggagaucguugugccgugccggaaccaggacgaacucgugggccgugcucgcgucucgcagggugcgggcuggagcuugcgcgagaccgcgugccugggcaaauccuacgcgcagauguggcagcucauguauuuccaucgccgcgaucugagacuggccgcuaaugcgaucugcuccgccgugcccguggacuggauccccacaucccggaccaccuggaguauccacgcccaccaccaguggaugacuacagaagacaugcucuccgucuggaacaggguguggaucgaggagaaucccuggauggaggacaaaacgcauaucucgagcuggggggauguaccguaccuggggaagcgcgaggaccaguggugcggcagccugaucggucucaccgcgcgggcaaccugggcgacaaacauccagguugcaaucaaccaagugcggcgacugaucgggaacgagaacuauuuagacuauaugaccucaaugaaacgcuucaagaacgagucagaucccgagggcgcccucugguga

SEQ ID NO: 24568 - RNA, 9879 nt, Artificial Sequence
  derived and/or modified CDS sequence (opt11) from DENV-1__EU482490__SS-prME
ucaguaaccaugcugcucaugcugaugcccaccgcacuagcguuccaccucaccacccggggcggggaaccccacaugaucguaagcaagcaggaacggggcaagagcuuacuguuuaagaccagcgccggggugaacaugugcacccucaucgcaauggaccucggcgagcucugcgaggacaccaugaccuauaagugcccccggaucacggagaccgagcccgacgacguggacugcugguguaacgccaccgacaccugggugaccuacgggacgugcucacagacgggcgagcaucggcgggauaaaagguccguggccuuggcgccccaugugggacuaggccuggagacccgcacggaaaccuggaugagcuccgagggggccuggaaacagauucagcgggucgaaacuugggccuuacgucaccccggguucaccguuaucgcccuguuccuggcccacgcgaucgggaccagcauaacacagaaggggaucaucuucauccuccugauguuggugacgcccuccauggccaugagaugcgugggcaucggcucacgggacuucguggaaggguuauccggcgccaccuggguggacgucgugcucgagcacgggagcugcguuaccaccauggccaaggacaagcccacgcuggacaucgaacuccugaagaccgaggucaccaaucccgccgugcugcggaagcuaugcauagaggcgaagauauccaacaccacgaccgacagccgcugcccgacccagggagaggccaccuuagucgaggagcaggacgccaacuucgucugccgucgcacguucguggaccggggaugggggaacggcugcggacuguuuggcaaggggucacucauaaccugcgccaaguuuaagugugugaccaagcuggagggcaagaucguccaauacgagaaucugaaguauagcgugaucgugacuguccauacgggagaccagcaucaagugggcaacgaaucuacggagcacgggaccaccgccaccauaacgccccaggcgcccacgacugaaauccagcucaccgacuauggggcccugacgcuggacugcuccccacgcaccggacuagacuucaaugagaugguacugcugaccaugaaggagaaauccugguuggugcauaagcaaugguuccuggaccugccacuccccuggaccaguggagcuagcacgucccaagagaccuggaaccggcaggaccuguuggugacuuuuaaaaccgcccacgcaaagaagcaggaggucguggugcuuggcagccaggagggggcgaugcacacggcgcugacaggugccacugagauccaaacuuccggcacaaccaccauauuugccgggcaucuaaagugccgccucaagauggacaaacuuacgcugaaggguauguccuacgucaugugcacgggguccuucaagcucgagaaggaggucgccgagacucaacacggcaccgugcugguccaaaucaaguacgaggguacagacgcucccugcaagauacccuucuccacgcaggacgagaagggggugacccagaauggccggcugaucaccgcuaauccaaucgugaccgacaaggagaagccggucaauaucgaggccgagccucccuucggcgaguccuacaucacgauuggagccggcgagaaggcgcugaaacugagcugguucaagaaaggguccagcaucggcaaaauguucgaggccaccgcccguggugcccggcgcauggccauccugggggacaccgccugggacuucggguccaucgguggcguguucacaagcgugggaaaacuuguccaccagaucuucggcacggccuacggggugcuguucucaggcguaagcuggaccaugaaaaucgguaucggaguucugcugacuuggcucggacugaacucccgcucgaccuccuuaagcaugacaugcaucgcgguggggcucgugacacuguaccugggggucaugguacaggcugauuccgggugugugaucaacuggaaaggccgcgagcucaagugugggucaggcaucuucgucacgaacgagguucacacauggaccgagcaguacaaauuccaggccgacagcccgaagcggcucucagcugccauaggcaaagccugggaagaggggguguguggcauccgcagcgccacgaggcuggagaacaucauguggaagcagaucagcaacgagcuuaaccacauccugcuggagaaugacaugaaguucaccgucguggugggcgacguagcggguauccucgcccaggggaaaaagaugauccggccacaacccauggaauacaaguacagcuggaaguccuggggcaaggccaagaucauaggugcagacguacaaaacacaaccuucaucaucgacgggccgaacacgcccgagugccccgacgaccagcgcgccuggaacaucugggagguggaggacuacggcuucggcaucuucaccacuaacauauggcugaagcugcgggacucauacacccaggucugcgaucaccgccucaugucugcggcaauuaaagacagcaaagcgguccacgccgacaugggcuacuggauugaguccgagaagaacgagacuuggaagcuggcccgagccagcuucaucgaggugaagaccugcaucuggccaaagucccacacgcuguggagcaacggcguccucgaguccgagaugauaauccccaagaucuaugggggcccgauaagccaacacaacuaccgccccggguacuucacccaaacggcgggcccauggcaccuggggaaacuggaacuggacuucgaccugugcgaagguaccacugugguugucgaugagcauugugguaaccgugggccgucccugcgcaccacgaccgugaccggcaaaaucauucacgaguggugcugucggucaugcacccugccgccccuccgcuuccgcggggaggacggcuguugguacgggauggagaucaggcccgugaaagagaaggaggagaaucuggucaagaguauggugagcgccggcagcggcgagguugacucauucagccucgggcugcugugcaucuccaucaugaucgaggaggucaugaggucccgcuggucccguaagaugcuaaugacgggaacgcucgccguguuuuuccugcucaucaugggucaguuaacauggaacgaccugauccgccucugcaucaugguaggagccaacgcgucagaccgcauggggaugggcacgacauacuuggcacucauggccaccuucaagaugcggccgauguucgcaguuggccuccuguuccgacggcugaccucccgcgaggugcuccugcugaccauagggcucagccugguagccuccgucgaguugcccaauucucuagaggagcugggcgacgggcuugcaauggguauaaugauccucaaguuacugacggacuuccagucccaccagcucugggccacccugcuuagccuaacuuucauuaaaaccacguucucccugcacuacgccuggaagacgauggccauggugcugagcauagucucucucuucccccugugccugagcaccaccucccagaagacgaccugguuacccgugcuguugggcagccuagggugcaaaccgcugaccauguucuuaaucgcggagaacaagaucuggggccggagaucuuggccccucaacgaagggaucauggccgugggcaucgucagcauccugcuguccucccugcugaagaacgacgugccacuggccggaccccuaaucgcgggcggcaugcugauagccuguuaugugaucaguggguccagcgcggaccugucccuugagaaggccgccgaggucagcugggaggaggaggccgagcacuccggagcaagccacaacauccugguggagguucaggacgacgggaccaugaagaucaaggacgaggaacgagacgacacguuaacuauccuacugaaagcuacccugcucgcugucagcggcguguacccgcuuucaauccccgcaaccuuauucgugugguauuucuggcaaaagaagaaacagcgguccggggucuuaugggauacucccagcccgcccgaagucgagagggccguccuagacgauggcauauaccgcauaaugcagcggggccucuuagggcgcucccaggucgguguggggguuuuccaagagaacgucuuccacacgauguggcacguaaccagaggggcuguucugauguaccaggggaagcgcuuagagcccagcugggcgucugucaagaaggaccugauaagcuacggcggcggguggcggcuccagggcuccuggaacaccggggaggaaguccagguuaucgccguagagcccggcaagaaccccaagaacgugcagacagcccccgggacguucaagacccccgagggcgaagugggcgccaucgcccuagacuucaaacccgggaccucaggcucacccauugucaaucgcgaggggaaaaucguggggcuauauggcaacgguguggucaccacgucgggcacguacgugagcgcgaucgcucaggccaaggcuucccaggaaggaccgcuccccgagaucgaggacgagguguuccggaagaggaaccugacgaucauggaccugcacccgggcucugggaagacccgucgcuacuuaccggcgaucguucgggaggccaucaaacgcaaacuccgcacucugauucuagcccccacacgggugguugccucagagauggccgaggcgcuuaagggcaugcccauccgcuaccagacaaccgccgucaagagcgagcacaccggcaaggagauuguggaccugaugugccaugccaccuucaccaugcggcuccuaucccccgugcgcgucccgaacuacaacaugaucaucauggacgaggcccacuucaccgaccccagcuccaucgcggcucgcggguauaucagcacgcgcgucggcaugggggaggcugccgccaucuuuaugacagcgacgccgccgggauccguggaggcguucccacagagcaaugcagucauacaggacgaggagcgugacauucccgagcgcuccuggaacagcggguacgaguggaucaccgauuuuccugguaaaacgguuugguucgugcccuccauuaagucaggcaaugacaucgccaacugccugcgcaagaacgggaagcgugugauccaacucucccggaagaccuuugacaccgaguaccagaagaccaagaauaaugacugggacuacguggugacgacugacaucucggaaaugggcgccaauuuccgcgcggaccguguaaucgacccccgccggugccuaaagccugugauccuaaaagacgggcccgagcgcgugauccucgccggacccaugccggucaccguggccagugccgcucagcggcgcgggcggauuggcagaaaucauaauaaagagggcgaucaguacaucuacauggggcagccccugaacaaugacgaggaccaugcgcauuggaccgaggcaaagauguuacucgacaacaucaacacgcccgagggcaucaucccagcguuguucgagccggagcgcgagaagucugcagccauagacggagaguacagacuacgcggcgaagcucggaagaccuucguagagcucaugcggcgcggugaccucccgguguggcuuaguuacaaaguggccagcgagggcuuucaguacagcgaccgccgguggugcuucgacggagagcgcaacaaccagguccucgaggagaacauggacguggagaucuggaccaaagagggggagcguaagaaacuccgcccccggugguuggaugcccgcaccuacucugauccccucgcccugagagaguucaaggaguucgccgccggccgccgguccgugaguggggacuugauccucgagauuggaaagcugccgcagcaccuaacgcagcgcgcacagaacgcccucgacaaccuggucaugcugcauaacagcgagcagggcgggcgggccuacagacacgcaauggaggagcuccccgacaccauagagacccugaugcuguuggcgcugauagccgugcugaccggagggguuacccucuuuuuccuguccggacggggguuaggcaagacgagcaucggccuccuguguguuauggccaguagcguccugcucuggauggccuccguggaaccccacuggaucgcagcgaguauuauccuggaguucuuccugauggucuuguugauccccgagccggaucgccagcggacgccccaggacaaccaguuagccuacgugguuaucgggcugcuguucaugauacugacggucgccgccaacgagaugggccuccuagagaccaccaagaaggaccuuggaaucgggcacguggcgguagagaaucaccaucacgccgccauguuggacgucgaccugcaccccgccuccgccuggacccuauaugcgguggccaccacuauaaucacuccgaugaugcgucacaccaucgaaaacaccaccgccaauaucagccucacggccauugccaaccaggccgcaauccuuauggggcuggacaaaggauggcccaucuccaagauggauaucggcgugccccuccuggcccuggggugcuacucccaggucaacccccucacacugacggccgcgguccucaugcuaguggcccauuacgccaucauaggcccugggcugcaggccaaggccacccgcgaggcgcagaagcggacggccgcuggcaucaugaaaaaccccacaguggacgggauaguggccaucgacuuggacccaguggucuacgacgccaaguucgagaagcagcucggccagaucaugcuacugauccucugcaccucccagauacuguugaugagaaccacgugggcacuuugugagucuauuacccuggccacuggccccuuaaccacgcucugggagggguccccgggcaaguucuggaacaccacaauagccguguccauggccaacaucuuuagaggguccuaccucgccggcgcgggccuggccuucagccuuaugaaaucccuugggggcgggcgcagggggacaggggcccagggcgagacgcugggcgagaaguggaagcgucagcucaaccaacugaguaaaagcgaauuuaacaccuauaaacggagcgggaucauggagguggaccgcagcgaggccaaggagggccugaagcgcggggagaccaccaagcacgccgucucccgcggcacggccaagcuccguugguucguggagcgcaaccuggugaaacccgaagguaagguuaucgaccugggcugugguagagggggcuggucauacuacugcgccgggcugaaaaaggugaccgaggugaagggcuauaccaagggcggccccggccaugaggagcccauccccauggcuaccuacggguggaaccucgucaagcugcacuccggcaaggacguguucuuuaucccgcccgagaaaugcgacacgcugcucugcgacaucggggagucuucccccaauccgacuaucgaggaggggcgcacgcugcgggugcugaagaugguggagccguggcuacgcgggaaccaauucugcaucaagaucuugaaucccuacaugcccagcgucguggaaacccuugaacagaugcaacggaaacauggugguaugcuaguccguaauccgcugucccgaaauagcacgcacgagauguacuggguguccugcgggacaggcaacaucguuagcgccgucaauaugaccucccgcauguuauugaaccgcuucacgauggcgcaccggaagccuaccuacgagcgcgacguagaccuaggggccgguacgagacacguugccgucgagcccgagguggccaaccuggauaucaucggccagaggauagagaacaucaagcaugaacacaagagcaccuggcacuacgacgaggacaacccguauaagaccugggccuaccacgguuccuaugaggugaagccgagcggaucugcgagcagcauggucaacgggguggucaagcuccuaaccaaacccugggacgugauucccauggugacgcagauagcuaugaccgacaccacccccuucggccagcagagagucuucaaagagaagguggacacccgcacuccgaaggccaagcgggggacggcccagaucauggaggugaccgccaaguggcuguggggcuuccucucccgcaacaagaagcccaggaucugcacgcgcgaggaguucacucggaaggugcgcagcaaugcggccauaggagcgguguucguggacgagaaccaguggaacagcgccaaggaagcuguggaggacgagcgguucugggaccugguccaucgugagcgggaacuccacaagcaggggaagugcgcgacgugcguguacaacaugaugggcaagcgugagaagaagcugggagaguucgguaaggcaaaggggagcagagccauaugguauauguggcugggcgcccgcuuccucgaguucgaagcucucggcuucaugaaugaggaccauugguucucacgggagaacagccuuucugguguagagggcgaggggcuacacaaacuugguuacauccuacgcgacaucucaaagauccccggaggcaacauguacgcugacgacaccgccggcugggacacgaggaucaccgaggaugaccuucagaacgaagcuagaaucacugacauuauggagccagagcacgcuuugcuggcgaagucaauauuuaaguuaaccuaccaaaacaaggugguacgcguccagcggcccgccaaaaacgggacggucauggacgugaucagccgccgggaccagcggggcuccgggcaggucgggaccuacggccucaacaccuucacaaacauggaagcccagcugauacggcagauggaaucggaggggaucuucucccccagugaguuagagacgcccaaccucgccgagagaguguuagacuggcuggagaaguacgguguugagcggcucaagcgcauggccauaucaggggacgauugcgucgugaagcccaucgacgaccgguucgcgaccgcuuuaaccgcccugaacgacaugggcaagguacgcaaggauaucccccagugggagcccucuaagggguggaacgacuggcaacaggucccuuucugcucccaccacuuccaccaauuaauuaugaaggauggccgggagaucguggugccuugccgcaaccaggacgagcuggugggccgagccagaguuagccagggggccggcuggagccugcgagagacggccugucucgggaaguccuacgcccagauguggcagcugauguauuuccaccgccgugacuuacgccuagccgccaacgcgaucugcagcgcugugccugucgacuggauccccacgucccgaaccacuuggaguauccaugcccaucaccaguggaugacgacagaggauaugcuguccguguggaaccgcguguggaucgaggagaacccauggauggaggacaaaacccauaucagcuccuggggagacguaccguaccugggaaaacgugaggaucaguggugcgggucccucaucggccugaccgcucgggccaccugggcgacaaacauucagguugccaucaaucaggugaggcggcugaucgggaaugagaauuaucucgacuauaugaccucaaugaagcgcuucaagaacgagagcgauccggagggagcccugugguga

SEQ ID NO: 24569 - RNA, 9879 nt, Artificial Sequence
  derived and/or modified CDS sequence (opt11) from DENV-1__EU482491__SS-prME
ucagucaccaugcuacuuauguugaugccgacagcacuugccuuccaccugacaacacguggcggggaaccacacaugauagucucgaaacaggaaagggggaaaagucuacuauucaaaacguccgcagggguaaauaugugcaccuugauagccauggaccuaggcgaguucugugaagauaccaugaccuacaaaugcccgcgaauaaccgaagcagaaccggacgaugucgacugcuggugcaaugcaacagacacaugggugaccuacggcacaugcacgcaaauaggggagcaccgacgggacaaacgaucaguagcgcucgcgccgcacgugggccuaggccuagaaacucgaaccgagacauggaugucaucagagggggcguggaagcagauccaaaggguggagacuugggcccugcgucacccuggauuuacggucauagcacucuuucuagcacacgcgaucggaacaagcauaacacaaaaagggaucauuuuuauccuacucaugcuagcaacucccucaauggcaaugcgaugcgucgggaucggcagccgggacuucguagaaggccucaguggagcgacgugggucgacgugguccuggagcacggcucgugcgugacuacgauggccaaagacaagccaaccuuagacauugaacugcugaaaacggaaguaaccaacccggcaguacuacggaaauuauguauugaagcuaaaauuucgaacaccacaacggacaguagauguccgacgcaaggggaagccacacucguagaagaacaggacgcaaacuucgucuguaggcgcacauucguggauagagguuggggcaauggaugcggucuuuucggcaaaggaagucucauaacaugcgcaaaauuuaaaugcguaaccaagcucgaaggaaaaaucguccaauaugagaaccugaaauacagcgucaucgucacaguccacacaggcgaccaacaccaaguagggaaugagucaacagaacauggaacaaucgccacuaucacaccacaagcccccuccacagagauacagcuaacggacuacggagcuuugacacuagacuguagcccaagaacaggccucgacuuuaacgagaugguuuuacucaccaugaaagaaaagucuuggcugguccacaaacaaugguuccuagaccuuccucuacccuggaccucaggagccagcacgagucaagagacguggaaucgacaagacuuauuggucacguucaagaccgcucacgcgaagaaacaagaggugguggugcucggcucgcaggaaggggcaaugcacacagccuugacaggagcgacggaaauucaaacuucagggaccacgacuaucuucgcuggccaccucaagugccgacuaaaaauggacaaacugacauuaagggguaugagcuaugugaugugcacagggagcuuuaaacuugaaaaagaaguagcagagacacaacaugggacaguccuagugcaaaucaaguaugaggguacugaugccccaugcaaaauaccuuucuccacccaagacgagaaaggaguaacacagaacgggcgacuaauaacggccaauccgauagucaccgauaaagaaaaaccagugaacauugaagcagaacccccauucggggaaaguuauaucguaaucggcgccggagaaaaggcuuuaaaacugaguugguucaaaaagggcuccuccaucggaaaaauguucgaagcaaccgcacgcggggcucggagaauggcgauucugggcgacacggcaugggauuucggaucaauugggggcguauucaccagcguaggcaagcuaguucaccagauauucggcaccgccuauggagugcuauucagcggcguaagcuggacaaugaaaaucgguaucgggguucuacuuacauggcuaggccuaaacagccgaucgaccagucuguccaugacguguaucgcaguuggucuugugacacuguaucucggaguuaugguucaagcagauagcggcugcguuaucaacuggaaagguagagagcuaaaaugcggcucugguaucuucguaaccaacgagguacacaccuggacggaacaguacaaauuccaagccgacucuccaaaacgacugagcgcagccauaggcaaagcaugggaagaaggcgucugcggcauacggucugcuaccagacuggaaaacauaauguggaaacaaaucagcaaugagcuaaaccacauccuacuugaaaaugacaugaaacugacggucguuguaggugauguggcagguauacuugcucaagguaagaaaaugauaagaccccagccgauggaauauaaauacucauggaaaauuugggggaaggcuaaaauaauaggggcagacguccagaacacaacauucaucauagacggaccaaauacacccgaguguccagacgaccagcgugcauggaacauaugggaaguagaggacuauggauucggcaucuucacuaccaauauuuggcucaagcugcgagauucguacacacaaguaugcgaccauagacucauguccgcggccauaaaagauagcaaagcuguucaugcggacaugggguacuggaucgaaagcgagaaaaacgaaacauggaaacuugcucgcgccucauuuaucgagguaaaaacgugcauauggcccaagucgcauacccuguggagcaauggcguccucgagagcgaaaugaucaucccgaaaaucuacggaggccccauuucacaacacaacuauagacccggauacuuuacgcaaaccgccggccccuggcaccucgguaagcucgaacuagacuucgaccugugcgaggggacaaccguagucgucgaugaacacugcgggaacaggggaccgucacucagaacgaccaccguaacagguaaaaucauccacgaauggugcugccgcuccugcacgcuaccgccauugcgcuucaaaggggaagacggauguugguauggaauggaaaucagaccaguaaaagagaaagaagaaaaccucgugaaaagcauggucucggccggcagcggugaaguggauagcuucagccucggccuccucuguaucuccauuaugauagaagaggugaugcgcagccgauggagccgaaagaugcugaugacugggacccuagcuguauucuuccugcucauaaugggacaacugacauggaacgaccuaauccgucuguguauaauggugggugcuaacgcuucggaucgaauggguaugggcacaaccuaccuugcccuaauggcgacguucaaaaugcggccgauguucgcggugggacuacuauuuagacgccuaacuucccgcgagguccuucuccuaacgaucgggcucucucugguugcgucaguggaacuuccaaacagccucgaggaacucggcgauggacuagcaauggggauaaugauacuaaaacuacuaacggacuuccagagccaucaacucugggcgacacuucuuucucugacauucauccgaacaacauuuucacugcacuaugcguggaaaacaauggcgauggugcucagcauugucagccucuucccucugugucuauccacgacaagccagaaaacaacuuggcuacccguacuccugggcucguuaggauguaaaccccuuacaauguuccuaauagcagagaauaagauuuggggacgaaagaguuggccgcuaaaugaaggaauaauggcggucgguauagugagcauacuccuaagcagccuccuaaagaacgaugucccacuugccggcccucuaauagcaggagggauguuaauagcuugcuauguaauuucaggaagcuccgcggacuuaagccuggagaaagccgcggagguaagcugggaagaggaggcagagcauuccggugcaagccauaacauucuuguagaaguucaagaugacggaaccaugaaaauaaaagacgaggagcgcgacgauacccuaacgauccuacucaaggcuacacuccucgcggucaguggagucuacccacucuccaucccugcaacacucuucgucugguauuucuggcagaaaaagaagcagcgauccggaguacuaugggacacaccaaguccgccagagguagaacgcgcaguacucgaugacggaaucuaccggauaaugcagagaggcuugcucggacggucacaagugggugucggaguguuccaggaaaauguauuucauaccauguggcacgugacacgaggcgcaguucuaauguaucagggcaaacgcuuagaacccuccugggcaucagucaaaaaggauuugauuaguuacggggguggcuggagauuacaggggagcuggaauaccggcgaagaaguucaagucaucgcugucgaaccuggcaaaaacccgaaaaacguacagaccgcuccagggacauuuaaaacaagugagggugaggugggcgcaauagcgcucgacuucaaaccgggcacaagcggaucgccaaucguaaacagagaggguaaaaucgucggacucuacggcaacggugucguuacaaccucgggaacauacguuuccgcuauagcucaagcaaaagcaagccaagaaggaccccugccagaaauagaggaugaaguauuccgcaagcggaaccucacuaucauggaccuucacccgggcuccggcaaaacgcgccgauaccuacccgccauuguaagggaagcgauaaaacgccgucuacguacacuuauucuggcuccaacccgaguagucgccagcgaaauggcggaggcccugaaggguaugccaauccgauaucagacaaccgcugucaagagugaacacacagggaaagaaauaguagaccuaaugugccacgcuaccuucacgaugcggcuccucucacccguucgagugcccaauuacaacaugauaaucauggacgaggcccacuucacggauccaagcuccauagcagcccgcggcuauaucuccacgcgaguaggcaugggagaggccgcagcuaucuucaugacggcuacgccuccaggcuccgucgaggcuuuuccccaaucuaacgcugucauccaagacgaagaacgcgacauaccggaacgaucauggaacagcggauaugaauggauaacugacuuccccggcaagacgguaugguuugucccgucgauaaagagcggcaaugauauugcaaacugccuucgaaagaauggaaaaagagucauccagcugagcagaaaaacauuugacacagaauaccagaagacuaaaaacaaugauugggauuacguagucacaacugacauauccgagaugggagcgaacuuucgagccgaccgagucaucgacccccgacguugccugaagcccgucauacucaaggacggacccgaacggguaauccuagcggguccaaugcccguaacaguagcaagcgcagcacaaagacguggacgcauaggacggaaucauaauaaagagggggaccaauauauuuauauggggcagccacuaaauaaugaugaagaccacgcccacuggacagaagcaaagaugcuguuggacaacauaaauacccccgagggaaucauuccagcacuauuugaaccagaacgcgagaagagugcagcgauagacggggaguaccggcuccgcggugaggccaggaaaaccuucguggagcuuaugaggcgcggagaccucccgguaugguugucuuacaaagucgccagcgaaggguuccaauacagcgaucgucgauggugcuucgacggcgaacggaacaaccaagucuuagaagaaaacauggacgucgagauauggacgaaagaaggcgagagaaagaaguuaagaccgagguggcucgacgcacgaaccuauuccgacccgcuugcgcucagggaguuuaaggaguucgcagcagggcgacgcagcgucagcggggaccugauccuugaaauaggcaagcucccccagcaccucacccaacgggcccagaacgcccucgacaaccuaguaaugcuacauaacagugagcaaggagggcgcgcauaccgacaugccauggaggaauuaccagauacaauagagacccugauguugcuugcacuaaucgcuguacucaccgggggagucacccuauucuuucuaucgggacggggccuaggcaagaccaguauagggcugcuuugcguaauggccagcucgguguuacuguggauggccucgguagagccccacuggaucgcagcgucgauuauacucgaguucuuccugaugguauuacuaauaccggaaccagaccgccagagaacgccgcaagacaaccagcuggcguacgucgugauaggacugcuauucaugauauugacggucgcagcaaacgaaaugggucuucuagaaaccaccaaaaaggaccuggguaucgggcacguggcggucgaaaaccaucaccacgccgcuaugcuagacguugaccuacacccggccagugcguggacccuguacgcagucgcuacuacgaucaucacgccaaugaugcgucauacaaucgagaacacgacggcgaacauaucgcugaccgccauugcaaaccaagcggcgauacucaugggacucgacaaaggcuggcccauaucgaagauggacaucgguguaccgcuacucgcgcugggguguuacagccaaguuaacccccugacauugacggccgcggugcuaaugcucguugcacacuacgcaauaauaggcccaggacugcaagcgaaagcgacgagagaggcacaaaagcggacagcggccgggauuaugaagaaucccacgguagacggcauaguggcaaucgaccucgaccccgucgucuaugacgcaaaguucgaaaaacaacuagggcaaaucaugcugcugauccucugcacuucccagauccucuugaugcggacgaccugggcccucugugaaagcaucacccucgcgacggguccgcugacaacccuaugggagggaucccccggcaaauucuggaauaccaccaucgcgguuucgauggccaacaucuuccggggguccuaccuagccggcgcaggccucgcguucagucuuaugaaaagccucggaggcggcagacgagguacaggcgcacagggagaaacauugggagaaaaauggaaaagacaguuaaaccaacucuccaaguccgaauuuaacacauacaaacgcagcggaaucauggagguggaccguuccgaagcgaaggaaggcuuaaaaaggggcgagacgacaaagcaugcagucucccgcggaacggccaaacuccgcugguucgucgagaggaaucuagucaagcccgaagggaagguaaucgauuuaggaugugggcguggaggguggucauauuacugcgcaggacucaagaagguaaccgaggugaaaggcuacacaaaggguggcccggggcaugaggagccaaucccgauggccaccuauggguggaaccuugugaagcugcacucaggaaaggauguguucuucauuccaccggaaaaaugcgacacccugcuaugcgacaucggagaguccuccccaaacccaacgaucgaagaagguaggacccugcgaguacucaaaaugguggagccuuggcugcgaggcaaucaguucuguauaaaaauacuaaaccccuacaugcccagugucguagaaaccuuagagcagaugcagcgcaagcacggcgggaugcucguacgaaauccccugagcaggaacuccacgcacgaaauguacuggguauccuguggcacuggcaacauugugucagccgugaauaugaccagcaggaugcuccugaauagguucacaauggcacacaggaaaccgacguacgaacgcgacguagacuuaggcgccggcacgcgacacguggccguagaaccggaagucgcaaaucuagacaucaucgggcaacgaauagaaaacaucaaacacgaacacaaaucgaccuggcacuacgaugaagauaaccccuacaagaccugggccuaucacgggaguuacgaagucaaacccaguggcuccgcuuccagcauggucaacggagucgucaaacuacucacaaaacccugggaugucauacccauggucacgcagauugccaugaccgacaccacaccguucggacaacagcggguguuuaaggagaaagucgacacacgcacaccgaaagcgaagcgcggaaccgcgcaaauaauggaggucaccgccaaauggcuguggggcuuuuuaucaagaaacaaaaagcccaggaucugcacacgagaggaguucacgcgaaaggucaggagcaacgcagcaaucggagcggucuucguggacgaaaaucaauggaacuccgccaaggaggcgguugaggaugaacgcuuuugggaucuggugcaucgagaacgugaacuacacaaacaaggcaagugcgcaaccugcgucuauaauaugauggggaaacgcgagaagaaguugggagaauuugggaaagcuaaagggucgcgcgcgaucugguacauguggcucggagcgagguuccucgaguucgaagcacucggcuuuaugaacgaggaccauugguucucucgcgaaaacaguuuguccgguguagaaggagagggacuacacaaguugggguacauacugagagacaucagcaaaauaccaggaggaaacauguacgcagacgacacggcggguugggacacgcgcauaaccgaagacgacuuacagaaugaggcuaaaaucacggacauuauggagccggagcaugcccuacuagccaaaucaaucuuuaaacuuacguaccaaaacaaggugguucgaguccaaagacccgccaagaauggaacggugauggauguaauaagucguagggaccaacguggauccgggcaagucggaaccuacggauugaauaccuuuaccaauauggaagcacagcugaucaggcagauggaaucugaaggaauuuuuagcccgagcgagcuagaaacgccaaaccuggcaggccgcguccucgacuggcuagagaagcacggugucgaacgacuaaaacgaauggccaucagcggggaugacugugucguuaaaccgaucgacgaccgcuuugcgacagcacucacagcccuaaacgacaugggaaagguacgaaaggacauaccgcaaugggaacccucgaaaggauggaacgacuggcaacaagucccguucugcagccaccauuuucaccagcucaucaugaaggauggccgagagauaguggucccuugccggaaccaagacgaacuggucgggcgggcaagggugagucaaggagccgguuggucccuaagagaaacugcgugccugggaaagagcuacgcacaaauguggcaacucauguauuuucacagacgcgaccucagacuggccgccaacgcuaucugcagugccguucccguggacugggugccaacgagccguacgacguggucgauccacgcccaccaucaauggaugaccaccgaagauaugcuaucaguuuggaaccgcguauggaucgaggagaauccauggauggaagacaaaacucacguaucaucauggggagauguccccuaccucggaaaacgcgaagaucaguggugugggucgcucauuggacucacggcacgagccacuugggcuacaaauauacaagucgcuauaaaucagguaagaaggcuucuagguaaugagaacuacuuagacuauaugacaagcaugaagcgcuucaagaaugaaagcgauccggaaggagcgcuaugguga

SEQ ID NO: 24570 - RNA, 9879 nt, Artificial Sequence
  derived and/or modified CDS sequence (opt11) from DENV-1__EU482493__SS-prME
ucgguuacuaugcuucucaugcugaugccuaccgcucuugcuuuccaccugacgaccagaggaggggaaccucacaugauuguaucgaaacaggaacgggggaaaucucugcuguucaaaaccucagcuggggugaacaugugcacccucaucgcaauggaccuuggagaacugugcgaggacaccaugacauacaaaugcccucggaucacugaaacagaacccgaugacguggacuguuggugcaacgcgacugacaccugggugacauauggaaccugcucccagacgggcgagcaucggcgggauaagcgcagcguggcucucgcuccccaugugggccucggccuggagacccgcacugagaccuggauguccagcgagggcgccuggaagcagauccaacgggucgaaacgugggcccucaggcaucccggcuuuacggugaucgcgcuauucuuggcccacgcuauugggaccucuaucacccagaaggggaucaucuuuauccugcugauguuagugacgcccuccauggccaugaggugugucgggaucggcagccgcgacuucguggagggguuauccggcgccaccuggguagaugucguacuggaacacgggucuugugugaccaccauggcaaaggacaagccgacguuggauauagaauuacuaaagaccgaggugacgaaccccgccguacugcggaagcucugcauugaggcaaagauauccaacaccacgaccgacucacgcuguccgacccagggcgaggcgacucucguggaggagcaagacgccaacuucgucugucgucggacauucguggaccgcggcugggggaacggcugcgguuuguucggcaaagggucccucaucacgugcgccaaguucaaaugugugaccaagcuggagggcaagaucguccaguacgagaaccugaaguacagcguuauagugacaguucacacgggcgaccaacaccagguggggaacgaguccaccgagcacgguacuaccgcaacuaucacgccccaggcgccuaccacggagauacaguugaccgacuacggcgcccuaacgcuagacugcagcccccgcacgggccucgacuucaacgagaugguccuccugacaaugaaggagaaguccuggcucgugcacaagcagugguuuuuggaccugccccuucccuggaccuccggggccagcacuucccaggagaccuggaaucggcaggaccugcuagugaccuuuaaaaccgcccacgcgaagaagcaggaagucguuguacucggcagccaagagggcgcgaugcacacugccuugaccggggcuaccgaaauccagacauccgggacgaccaccaucuucgccgggcaccugaagugccgucucaagauggauaagcucacccugaagggcaugucuuacguaaugugcacgggguccuuuaagcuggagaaggagcuggccgaaacccagcacgggaccguccugguucagaucaaguacgaagguacggacgcgcccugcaaaauccccuucagcacccaggacgagaaaggggucacgcagaacgggcgacugauaaccgccaacccgaucguaacggacaaggaaaagcccgugaacauugaggcggagccacccuucggggaaucuuacaucgucauuggcgcuggggagaaggcccuuaagcugucuugguucaagaaagggucuucuaucggcaagauguucgaggcuaccgcccgcggggcccggaggauggcaauccugggcgacaccgcgugggauuucggguccaucggcggcguguucaccucaguugggaagcucgugcaccaaaucuucggcaccgcauacgggguacuguucuccggcguaagcuggaccaugaagauuggcaucggcguccugcucaccuggcugggcuugaacucccgcuccaccucccucagcaugacguguaucgccguggggcuagugacguuguaccucggugucaugguucaggccgacuccgggugcgugauaaacuggaagggccgggaacuaaagugcggaagcggaaucuucgugaccaaugaggugcacaccuggacagagcaauacaaguuucaggccgacagccccaagcgccuauccgcugcaaucggcaaggccugggaggagggggugugcggcauucguagcgcgacccgccucgagaacaucauguggaagcagaucucaaacgagcugaaucauauccuccucgagaacgacaugaaguucacggucguggugggagaugucgccgggauacuggcacagggaaagaagaugaucaggccccagccgauggaacacaaauacuccuggaaauccuggggcaaggcuaaaaucaucggcgccgaugugcagaacacgaccuucauuauagacggucccaauacuccggaaugcccggaugaccaacgcgccuggaauaucugggaaguagaggacuauggguucgguauuuucacgaccaacaucuggcugaagcugcgggacagcuauacucaggucugcgaccaucgccucaugucggcggcuauaaaggacagcaaggccgugcacgccgauaugggcuauuggaucgagucugagaagaacgagaccuggaagcuggcccgggcgagcuucaucgagguuaagacgugcaucuggccaaagucccacacccucuggagcaacggcguccuggaaucugagaugauuaucccuaagauauacggagggccgaucagccagcacaacuaccgaccgggguacuuuacccagacugccggcccguggcaucuugggaaacucgaacuugauuucgaucugugcgagggaacaaccgucgucgucgacgagcacuguggcaaccgggggccgagccuccgcacaacuacggugaccggcaagauuauccaugaauggugcugccggucuugcacccugccgccuuuaagauucagaggggaagauggcugcugguacgguauggaaauccggccugugaaggaaaaagaggaaaaccuggucaaaagcauggucagcgccgguagcggggaaguugauuccuucagccuggggcugcucugcaucuccauaaugauugaggagguuaugcggagccgguggucccggaaaauguuaaugaccggaacucuagccgucuucuuccuccuaaucgugggccaguuaaccuggaacgacuugauccgccuauguaucauggucggcgccaacgcgagcgaccggaugggaaugggcaccaccuaccucgcccucauggccacguuuaaaaugcggccgauguucgccgucggcuugcuuuuucguagacucacaagccgugaggucuugcugcugacaaucgggcugagccuagucgccaguguggaacuccccaauucguuagaagaacugggggauggacucgcgaugggcauaaugauccugaaacugcucacggacuuucaaagucaccagcucugggccacacugcucagcuugaccuucaucaaaaccaccuucucucugcacuacgcuuggaagacuauggccaugguccucagcguggugagucuauucccgcugugucucucuacaacgucccagaagacuacauggcugcccguucuucuuggcagccuagguugcaagccguuaacuauguuccuaaucgcggagaacaaaaucuggggcagacgcuccuggccgcugaaugaagggauaauggccgugggcauagugucuaucuuacugagcucccuacugaagaacgauguaccgcucgccgggccgcugauugccggcggcaugcugaucgcaugcuacgucaucagcgguuccagcgcagaccuaucccuugagaaggccgccgaagugucuugggaggaggaggccgagcacuccggugccagccacaacauccuaguugaggugcaggacgauggcacuaugaagauuaaagaugaggaacgggacgauacccucaccaucuugcugaaagccacucuccuagcuguguccggugucuacccccugagcaucccugcgacacucuucguuugguacuucuggcagaagaagaaacagcgcuccggggugcugugggauacaccaagcccacccgaggucgaacgggccgugcuggacgacggcaucuacaggaucaugcaaaggggccugcuugggcgcucccaagucgggguagggguguuccaggagaauguauuccacaccauguggcauguuacgcgaggugccgugcugauguaccaggggaagcgacuggagcccagcugggcuucagugaagaaggaccucaucagcuacgggggcggguggcgccugcagggguccuggaacaccggggaggagguccaggugaucgccguugagcccgggaagaaucccaagaauguccagacggcccccggcaccuucaagacgccggagggggaggugggagcgaucgcccuggacuucaagccgggaaccagcggcucccccaucgugaaccgagaggguaaaaucguuggucuguauggcaacgggguggucaccacuuccgggaccuacgucagcgccaucgcgcaagccaaggccucccaagaggggccguuaccugagaucgaggacgaggucuuccggaagcgcaaccugaccaucauggaccuccaucccggcucggggaaaacccggcgcuacuuaccggcgaucgugcgggaagccaucaagcguaaacugcgaaccuugauccuugccccaacucgggucguugccagcgaaauggccgaggcgcucaaaggcaugcccauccgcuaccagacuaccgcggucaagagcgagcauacagguaaggaaaucgucgaccucaugugccacgccacguucaccaugaggcuacuuucccccgugagaguaccgaauuacaauaugaucaucauggacgaggcccacuuuaccgaccccagcuccauugccgcgcggggguacaucucgacaagggucgggaugggggaggcugccgccauauucaugaccgccacacccccaggcaguguggaggcuuucccacaaagcaacgccguuauccaagaugaggagcgggacauuccugagagauccuggaacagcgguuaugaguggaucaccgacuuccccggcaagacgguaugguuuguacccuccaucaagagcggaaacgauaucgccaauugccucaggaaaaacgggaagagagugauccaacuaagucgcaagacguuugacaccgaguaucagaagacaaagaauaaugacugggacuacguggugacuacggacaucagcgaaaugggcgccaacuuucgcgcggaucgggugaucgacccacgccgcugccuuaagcccgucauccucaaggacgggccagagcgcgugaucuuggccgguccuaugccggucacgguggcauccgcagcgcagcggcgcgggagaauuggcagaaaccauaacaaagaaggcgaccaguauaucuacauggggcagccacugaauaacgacgaggaucacgcgcacuggacagaggccaagaugcucuuagacaacaucaauaccccagaagggauuauccccgcuuuauucgaaccggagcgugagaagagugcagcaaucgacggggaguaccggcuacgcggcgaagcccggaagacauucguagaacuaaugcgccgcggggacuugcccguguggcucucguacaaaguugccagugagggauuccaguauagcgacagacggugguguuucgacggcgagagaaacaaccagguacuagaagagaacauggacgucgagaucuggacuaaggaaggggagcggaagaaacugcgcccgagguggcuugacgcgcgaacuuauuccgacccguuagcccugcgagaguucaaggaguuugccgcuggacgccggucgguguccggggaccuuauccuggagaucggcaagcugccccagcaccugacgcagcgcgcgcagaacgcgcuggacaaucuagugauguuacacaacagcgagcaggguggucgggccuaucgccacgcgauggaggagcuccccgacacgaucgagacucugaugcuccuggcucugauugccguacugacgggcggggugacccuguucuuccuguccggccggggacucggcaagaccucaaucgggcuucugugcguuauggcuuccagcguccuccuguggauggccagcgucgagccgcacuggaucgcggccagcaucauacuugaguucuucuugauggugcuguuaauacccgagccggaucgacagcgcacaccccaagauaaccagcucgcuuacgucgucauagggcugcuguucaugauccuaacaguugcagcaaaugagaugggccuccuggagacaaccaagaaggaccucgggauaggucacgucgcgguggagaaccaccaccacgccgccaugcucgauguggaccugcaucccgccagugcuuggacgcucuacgcgguggccaccaccaucaucacuccgaugaugagacauaccaucgagaacaccacagccaacaucagccugaccgccaucgccaaccaagcugccauccugaugggauuagacaagggcuggccaaucucaaagauggauaucggcgugccccuccuggcccucggaugcuauagccaggugaacccucugacucugaccgccgcaguccuaaugcuuguagcucauuacgccaucauaggccccggucugcaggcuaaggcuacucgugaggcgcagaagcggacugccgccggcaucaugaagaacccaaccguggacgggaucgucgccaucgaccuugaccccgucgucuaugacgcaaaguucgagaagcaguuaggccagauaaugcucuuaauccugugcaccagccagaucuuacucaugcguaccacuugggcgcugugcgaguccauuacacuggcuaccggcccucucaccacacugugggagggcucgccugguaaauucuggaacacgaccaucgccgucagcauggcgaacauauuccgcggaaguuaccuggcgggcgcuggccucgccuucucccugaugaagucccucgggggcgggcgcagggggaccggugcacagggugagaccuugggugaaaaauggaagcgccagcugaaucagcucuccaagagcgaguucaacacguacaaacggagugggaucauggagguggaucgcagcgaggcgaaggagggccucaagcguggggagacuaccaagcacgcuguguccaggggcaccgcgaagcugcggugguucgucgagcgcaaccugguuaagccugagggcaagguaauagaccucggaugcggcaggggcggcuggagcuacuacugcgccgggcucaagaaggucacugaaguaaagggcuacaccaaagggggccccggccacgaggagccgauaccuauggcgacguacggguggaaucuugugaagcugcauuccggcaaggacgucuucuucauacccccugaaaagugcgacacacugcugugcgauauaggggaaaguuccccuaacccgacgaucgaggaaggccgcacccuucgggugcucaagaugguggaaccuuggcuucgcgggaaccaauucuguaucaaaaucuuaaaccccuacaugcccucugucguggagacccucgagcaaaugcaacguaaacacggcgggaugcugguacggaacccgcuuucccgcaacagcacccacgagauguauugggugagcugcgggaccggcaacaucgugagcgccguaaacaugacaucccggaugcuccuaaaccgcuuuaccauggcgcaccggaaacccaccuacgagcgcgacguggaccuuggggccgggacucgccacguggcagucgagcccgaagucgccaaccucgacaucaucggucagcgcaucgagaacaucaagcacgaacacaagucaaccuggcacuacgaugaggacaacccuuacaaaaccugggccuaucauggguccuacgaaguaaagccgucugggagugcgagcagcauggucaacggggugguuaaacugcugacgaaacccugggacgucauccccauggugacgcagaucgccaugacagauacuacccccuucggucagcagcggguguucaaggagaaggucgacacgagaacgccgaaagcgaaacgggggaccgcccagauaauggaggugaccgccaaguggcucuggggauuccugucccgcaacaagaagccccguaucugcacccgcgaggaguucacgagaaaggugagaagcaacgcggccauuggugccgucuucguggacgagaaccaguggaacagugcaaaggaggcuguggaggacgagcguuuuugggacuugguccaccgcgagcgggaacugcacaagcaggguaagugugcgaccugcguguacaacaugaugggcaaacgggagaagaaacugggggaguucggcaaggccaaggggagccgggccaucugguacauguggcugggcgcccguuuccuagaguuugaagcucuggguuucaugaacgaggaccacugguucuccagagagaacagccucuccgguguggagggcgaggggcuucacaaauugggguacauauugcgcgacaucuccaagauuccaggggguaauauguacgccgaugacaccgcaggcugggacacccggauuacugaggacgaucuccaaaacgaggcgcgcauaaccgacauuauggagccggagcacgcccuuuuggcgaaguccaucuucaagcucaccuaccaaaacaagguagugagagugcagcgccccgccaagaacgggacggucauggacgugaucagucgucgggaccaaaggggauccggccagguagggacguacggucugaacaccuucacaaacauggaggcccagcuuaucaggcaaauggagagcgaggggaucuucaguccaucugagcucgaaacccccaaucuggcagagcgcguccucgacugguuagagaaguacggcguggagcgauugaagcgcauggcgaucucaggagaugauugugugguuaaaccgaucgaugaccgguucgcgacggcccugacugcccucaacgauaugggcaaggugcgcaaggauaucccacagugggaacccagcaagggguggaacgauuggcaacaaguccccuuuugcucccaccauuuccaccagcugaucaugaaggaugggcgagaaauugugguaccuugucgcaaccaggacgaacuggugggacgcgccagagucagccagggagcaggguggagcuugcgggagacugcgugccuagggaaguccuacgcccagauguggcagcugauguacuuccaccgucgggaccugcggcuggccgcgaaugcaauuuguucggcggugcccguggacuggauccccaccucccgaacgaccuggagcauccacgcacaccaccaauggaugacgacggaggacauguuauccgucuggaaccgcguguggauugaggagaaccccuggauggaagacaagacgcacauaucuuccuggggagacgugccguaccucggcaagcgcgaggaccaguggugcggcagcuugaucggacugacggcccgggcuaccugggcaaccaacauccaggucgccaucaaccagguucgccggcuuaucgggaacgagaauuaccuggacuauaugaccuccaugaagcguuucaagaacgagagcgaccccgagggggcccuaugguag

SEQ ID NO: 24571 - RNA, 9879 nt, Artificial Sequence
  derived and/or modified CDS sequence (opt11) from DENV-1__EU482494__SS-prME
uccguuaccaugcugcuaaugcugaugccgaccgcacuugccuuucaccucacgacacgggggggggaaccacacaugaucgugagcaagcaggaacgggguaagucucugcuguucaagaccagugcuggggugaacaugugcacgcucaucgccauggacuugggcgagcugugcgaggacacuaucacuuacaaaugcccucgcaucaccgagaccgagccggacgacguggacugcuggugcaacgccacagauaccuggguuacguacgggaccugcucacaaaccggcgagcaucgucgugacaaacgguccguggcacucgcuccccacgugggccugggauuggaaacgcggaccgagaccuggaugagcuccgagggcgcauggaagcagauccagcgggucgaaacgugggcccuccgccauccggguuuuaccgugauagcccuguucuuggcccacgcgaucgguacuagcaucacccagaaggggaucaucuuuauucuccugaugcuggccacgcccuccauggccaugcggugcguggggaucggcucacgugacuucguggaagggcuuuccggcgccacuuggguggaugugguccuggaacacgggagcugcguuaccaccauggccaaagacaagcccacgcuggacaucgagcuacugaaaaccgaggugaccaaccccgcuguucugcggaagcucugcaucgaggcaaagaucuccaauaccacgacggacagcaggugccccacacagggcgaagcgacgcugguagaagagcaggaugcgaacuucgugugccgacgaacauucgucgaccggggcuggggaaacgggugcggacuguucggcaaggguucccuaauaacgugcgcuaaguucaagugcguaacuaaacucgagggcaagaucguccaauacgaaaaccucaaguauagugucaucgugaccgugcacaccggcgaccagcaccagguggggaacgagucaacagagcauggcacuaccgcgaccauaacgccccaggcccccacgacagagauccaacucacggacuauggagcccugacgcuggauugcagcccaaggaccggacucgauuuuaaugagauggugcugcugacaaugaaggagaaguccugguuaguccacaagcagugguuccuggaccugccguuaccauggaccagcggggccucaacgucccaggagaccuggaacaggcaagaccuccugguuaccuucaagacugcccacgcgaagaaacaagagguggucgugcucggaagucaagagggugcuaugcacacggcucucaccggggccaccgaaauccagaccuccggcacgaccacaaucuucgcagggcaccuaaaaugucgccuuaagauggauaagcuuacccuacgaggaaugucguaugugaugugcacgggcuccuucaagcucgaaaaggaggucgcugagacccagcacggcacuguauugguacaaaucaaguacgagggcaccgaugcucccugcaagauaccauucagcacgcaggacgagaagggggucacgcaaaacggccgccugauuaccgccaacccgaucguuacagacaaagaaaagcccgucaacauagaagcagagccgccauucggggaauccuacauagucaucggcgcgggcgagaaggcccugaagcugagcugguucaagaaaggcuccagcaucgguaagauguucgaggccacggcccgcggggcccgucgaauggcuauacugggggacaccgccugggacuucggcuccaucggaggcguguucacaucaguggguaagcuuguccaucaaaucuucggcacugccuacgggguucuguucuccggcgugucuuggacgaugaaaauugggauuggcguacugcugacuuggcuuggccuuaacucgaggucgaccuccuuaaguaugaccugcaucgccguagggcucgugacgcuguaccuaggcgucauggugcaggccgauuccggguguguaauaaacuggaaggggagagagcucaaaugcgggagcggcaucuucgucaccaacgaggugcacaccuggaccgagcaguacaaguuccaggcggacagcccaaagcgauugucagccgcaaucggcaaggccugggaggagggugugugcggcauucgcuccgccacccggcuggaaaacaucauguggaagcaaauaucuaacgagcucaaucacauacugcucgagaaugacaugaaguuuacugucgucgugggggacguugcggggauccucgcccagggcaagaagaugauccgcccucagccgauggaacacaaguacagcuggaaguccuggggcaaagccaagaucauuggcgcagacguucaaaacaccaccuucaucaucgacgggccaaauaccccugaaugccccgacgaccagcgggcuuggaacaucugggagguggaggacuacggcuucgguaucuucacaaccaacaucuggcugaagcugcgagacagcuacacccagguaugcgaccauaggcucauguccgccgccauaaaggacaguaaggccgugcacgcggacaugggcuacuggaucgaguccgaaaaaaacgaaacauggaagcuggcgcgcgccaguuucauugaggugaagacguguauuuggccgaagucacacacccuauggucaaacggcguccuagagagugagaugaucauaccuaagaucuacgggggaccuaucucacagcacaauuacagacccggcuacuucacccagaccgcaggccccuggcaccuggggaagcuggaacucgacuuugaccugugcgaaggcacgaccgugguggucgaugagcacugugguaaccgcgggccgucguuacggaccaccacggugaccggaaagaucauccacgaauggugcugccgcagcugcacccugccgccucuccgguuucguggggaagacggauguugguacggaauggagaucaggcccguuaaggaaaaagaggagaaucuagucaaauccauggugagcgccggcucaggugaaguggauaguuucagucucggacugcugugcauuuccaucaugaucgaagaagucaugcgcagccgguggagccgcaagaugcucaugaccggcacgcuggccguguucuucuuacuaaucaugggucagcugaccuggaacgaccugauccgucucuguaucauggugggcgcgaacgccagcgaccggauggggauggguacuaccuaccuggcccuaauggcuacguuuaagaugcgaccaauguucgccgucggucuucuguuccggcgacugaccucccgggaagugcucuuacugacuaucgggcucagcuugguugcgucggucgaacugcccaacagccucgaggagcugggcgacggacuggcgaugggcaucaugauccugaagcugcugaccgacuuccagucccaccagcuaugggccacgcugcugagccuaacguucaucaagaccacuuuuagucugcacuacgccuggaagaccauggcaauggugcucucaauugucucccucuucccacugugccugagcacgaccucccagaaaaccacguggcuccccgugcugcugggaagccucggguguaagccgcugacuauguuucugaucgcagagaacaaaaucuggggccggcgguccuggccauugaacgaggggaucauggccguaggcaucgucucgauacuguugucuucccugcugaagaacgacguuccccuggccgguccccucauagccggcggcaugcugauugcgugcuacgugaucagcggaagcagcgcagaccugucccucgagaaggccgcugaggucucaugggaagaggaggccgagcacucgggcgccagccauaacauacuggucgaagugcaagacgacgggacaaugaaaauaaaggaugaagagcgcgacgacacgcugaccauccucuugaaagccacgcuguuggccgucucgggaguguacccuuuaucuauaccggccacgcucuucgugugguacuucuggcagaagaaaaagcagcgaagcgggguccugugggacaccccgagcccacccgaggucgagcgcgccguucucgaugacggcaucuaucggaucaugcagagggguuuacuggggcgcagccaagucggaguggguguguuccaggagaacgucuuccacaccauguggcacguuacgcgcggcgccgugcucauguaccaggggaaacggcuggaacccagcugggccuccgugaagaaggacuugaucagcuacggcggaggguggcgacuccagggcuccuggaacaccggcgaagagguccaggugaucgccgucgagcccggaaagaaucccaaaaacgugcagacagcccccgggaccuucaaaacacccgagggagagguuggcgccaucgcucuggacuucaagcccgguacuucgggcuccccuaucguaaaccgggaggggaagaucguuggacuauacggcaacgggguggucaccaccagcggcacauacgugucggccauugcccaagccaaggcgagucaagaggggccgcugcccgagaucgaggacgaggucuuccgcaaacggaaccugaccauaauggaccuucaucccggcagcgggaagacccgccguuaccucccggcaaucgucagagaagcuaucaagcguaaguugcggacccugauccucgccccgacgcgagugguggcuucagagauggcggaggcacugaagggaaugcccauccgguaucagacgaccgcugucaagagcgagcacacuggcaaagaaaucguggaccuuaugugucacgcuacguucacuaugcgccuccugucccccgugcgugucccgaacuauaacaugauaaucauggaugaggcucacuuuaccgacccaagcuccaucgcggcccgcggguacaucucuacccgggugggcaugggggaagccgccgcgaucuucaugacagcgacgccgcccggcuccguggaagccuucccgcagaguaacgccgucauccaggacgaggagcgggacauucccgagcggucguggaacucagguuacgaguggaucaccgacuuccccggcaagaccguaugguucgugcccuccaucaaguccggcaaugacauugcuaacuguuugcgcaagaacgguaagcgugucauccagcuuagccgcaagacuuucgacaccgaauaccagaagaccaaaaacaacgacugggacuacguggugaccacggacauuagcgaaaugggggcgaacuuccgcgccgaccgcguaauugacccgcggaggugccugaagcccguaauacugaaggacgggcccgaacgggugauacucgccggcccuaugccgguaaccguagccuccgcagcucaacgucgcgggcgcaucgguaggaaccacaacaaggagggcgaccaguacaucuauauggggcagccccugaacaacgacgaggaucacgcgcacuggacggaggccaaaaugcugcucgacaacaucaacacccccgaaggcaucauucccgcccucuucgagccugagcgggagaagucugccgcgaucgacggugaguaccgccuacgcggcgaagcaaggaagacguucguugaauuaaugcgccgcggugacuugcccguauggcugucguacaagguugccagcgagggguuccaguacucggaccggcgcuggugcuucgacggcgagcguaauaaccaaguccucgaggaaaacauggacguggagaucuggaccaaggagggcgagcgcaagaagcugcggccccgcuggcuggacgcccgaacguacuccgacccccuagcccugcgugaauucaaagaauucgccgccgggcggcgcucugucuccggggaccugauucucgaaauaggcaagcucccgcagcaccucacccagcgggcccagaacgcccuugacaaccugguaaugcugcacaacagcgagcagggagggcgugcguauaggcacgccauggaggagcuccccgacacgaucgagacuuugaugcuacucgcucugaucgccgugcugacaggaggggugacccucuucuuccuguccggccgcgggcugggcaagacuagcaucggccuccuuugcguuauggccuccaguguguuacucuggauggcgaguguggaaccccacuggaucgccgcuucgaucauccuggaguucuuccugaugguccucuuaauuccugaaccggaccggcagcggaccccccaggacaaccagcuggccuacgugguuauugggcuucuguucaugaucuugaccguagccgcaaacgaaaugggccugcuggagaccacgaagaaggaccuggggaucggccauguugccguagagaaccaccaccacgcugcuaugcuggacgucgaccugcaccccgccucagccuggacgcuguacgccguagccaccacgaucaucaccccaaugaugcgccacacgaucgagaacacaacugcaaacaucucgcucacggccaucgcuaaccaggcggcgaucuugauggggcuggacaagggcuggccuauauccaagauggacaucggcguaccucuccuggcgcucggaugcuacagccaggucaacccccuaacgcugaccgccgccguucugaugcuaguggcccauuacgccauuaucggcccggggcuacaggcaaaggcgacccgagaggcgcagaaacgcaccgccgcaggcaucaugaaaaaccccacgguugacgggaucguggcuaucgaccuagaucccguggucuacgaugccaaguucgagaaacagcucggccagaucaugcugcugauccuuugcacgucccagauuuugcugaugcggaccacaugggcccucugcgaaucgaucacccuugccaccggcccccugacuacccuaugggagggaucgcccggcaaguucuggaacacuaccaucgccguaagcauggccaacauauuucggggguccuaccuggcgggcgccggccucgccuucucacucaugaaaucccuagggggcgggcggcgagggaccggcgcccagggggagacacugggcgagaaguggaagcggcagcuaaaucagcuguccaaaagcgaguuuaacacauacaagcgcagcgggauaauggaaguggaccggagcgaagcgaaggagggccuuaaaaggggggaaacgacaaagcacgccguaucccggggcaccgcgaaacuccgcugguucgucgagagaaaccugguuaagcccgagggcaaggucauagaccucggcugcggcagagggggcugguccuauuacugcgcaggacugaaaaaggugacggaggugaagggcuacaccaaaggcggaccuggccacgaggagccaauaccgauggcaacauacggguggaacuuggugaagcugcauucugguaaggacguuuucuucaucccccccgaaaagugcgauacgcugcucugcgacauaggggaaagcucgcccaacccaacgauagaggaagggcggacccugcggguuuuaaagaugguggagcccuggcuacgggggaaccaauucugcaucaagauccucaaccccuacaugccuucuguaguagaaaccuuagagcagaugcaacgcaagcacggugggaugcucguacggaacccucucuccaggaacucuacccacgaaauguauuggguuuccugcggaacugggaacaucgugucugcggucaacaugacgucccgcaugcuccucaaccgguucaccauggcccaccgcaagcccacauacgagcgggauguggauuuaggcgcgggcacccgacacguggccgucgaaccugagguggcuaaccuugacaucauaggccagcggauagagaacaucaagcacgagcacaagagcaccuggcacuaugacgaagacaacccauauaagaccugggcguaccauggaucuuaugagguaaagccgagcgguagcgccagcucaauggucaacggggucguaaagcuccuuaccaagcccugggacgucauccccauggugacgcagaucgccaugacggacaccacccccuucggucaacagcgcguauucaaagagaaggucgacacccguacuccgaaagcaaagcgcgggaccgcacagaucauggaagugaccgcuaaguggcuuuggggcuuccuaucccggaacaagaagcccagaauuugcaccagagaggaauucacacgcaagguccggagcaaugcugcuauaggggccgucuucguugaugaaaaccaguggaauuccgcgaaggaagccgucgaagacgagcgcuuuugggaccugguucaccgugagcgagagcugcacaaacaggggaagugcgcgaccugcguguacaauaugaugggcaagcgagagaagaagcuaggggaauucgggaaggccaaaggaagccgcgccauaugguacauguggcugggggcgcgguuccuugaguucgaggccuuaggcuuuaugaacgaggaccacugguucucucgugagaacagccuuucugggguugagggagagggguugcacaagcucggcuacauccugcgggacaucagcaagauuccaggggggaacauguacgccgacgacaccgccggcugggauaccagaaucacggaggaugacuuacagaaugaggcccgcaucacugacaucauggaaccugagcacgccuugcuggcuaaguccauuuucaagcuuaccuaccagaacaaagucgugcggguucagcgccccgccaagaacgggacugugauggacgucaucucgagacgcgaccagcgggggucagggcaggucgguaccuauggacuaaauaccuucaccaacauggaggcccagcugauucgccagauggagagcgaagggaucuucucccccuccgagcuggagacccccaaucucgccgagcgggucuuggacuggcucgagaaguacggcguugagagacuaaagcggauggcuaucucgggcgacgacugcgucgugaaaccgaucgaugaccgcuucgccaccgcucugaccgcccugaacgacaugggcaaggugcguaaggacaucccccagugggagccaucaaagggguggaacgacuggcagcaagucccauucugcagccaccauuuccaccaacucauuaugaaggauggcagagaaauaguggucccgugccgcaaucaggacgagcugguuggccgcgcccgggucagccagggugccggcuggucccugcgcgagacugccugucucggaaaauccuacgcucaaauguggcaacugauguauuuccacaggcgcgaccugcggcuagccgcgaaugccaucuguagcgccgugcccgucgauuggauucccacuucuaggacuaccuggagcauucacgcccaccaucaguggaugaccaccgaggauauguugaguguguggaacagaguguggauagaggagaaccccuggauggaggacaaaacgcauaucuccuccuggggugaugucccguaccuggggaagcgugaagaucaauggugcgguucacucaucggccugaccgccagggcaacuugggccaccaacauccagguagccaucaaccaagugcggcgcuuaaucggcaacgagaacuaccucgacuacaugacgaguaugaagagguucaagaacgagagugaccccgagggcgcauugugguag

SEQ ID NO: 24572 - RNA, 9879 nt, Artificial Sequence
  derived and/or modified CDS sequence (opt11) from DENV-1__EU482495__SS-prME
agcgugacgaugcuacuuaugcugaugcccaccgcucuagcuuuucaucugacgacgcgaggaggggaaccgcauaugauagucaguaaacaggaaaggggcaaaagccuccuguucaaaacgucugcgggggucaacaugugcacucuuauagccauggaccugggagaacuaugcgaggauacgaugacauauaaguguccacgaaucacggaaguagagcccgacgacgucgauuguuggugcaacacuaccgacaccugggugacuuacggcacauguagccaaacaggggaacacagacgggacaaaagaucaguagcacucgcaccccauguaggccuagggcuggaaacacgcgcagagacuuggaugagcucggaaggagccuggaaacaaauacaaaaggucgagaccugggcgcuccggcacccgggcuuuacagucauagcacucuuccucgcccacgcaaucgggacaucgaucacacagaaggguauaauauuuauacugcuaaugcuggucacacccuccauggcaaugagaugcguaggaaucggaagccgagacuucguugagggccuaucaggggcaaccuggguagacguggugcucgaacacggcuccugcguaaccacaauggcuaaagacaaaccaacuuuggauauagaacuguuaaaaaccgaggugacgaauccggccguccugcgaaaacuaugcauagaagcgaagauuuccaacacgacaacugacucgaggugcccgacccaaggggaagccacccugguggaggaacaggaugcuaacuucguaugcagaagaacauucguggaucgaggguggggaaauggaugcggccucuucggaaaaggaucgcuaauaaccugcgcaaaauucaaaugugucacaaaauuagaaggcaagauaguccaauacgaaaaucucaaauacagcguuauagucacaguucacaccggagaucaacaucaaguaggaaacgaaagcaccgagcacgggaccacagccacgauaacaccccaagcuccaacaagugaaauacaacuaacagauuacggagcccucacccuagacugcucaccuagaacagguuuagauuucaacgaaauggugcuauuaacaaugaaagaaaaaucguggcugguacacaagcaaugguuccuagaccuaccacugccauggacauccggggccucaacaucccaagaaacguggaaccgucaggaccugcuugugacauucaaaacagcacacgccaagaaacaggaaguagugguccuuggcagccaagagggggccaugcacacggcccucacuggugccaccgagauucaaacaagcggcacaaccacaaucuucgccggucaccuaaaaugccgccucaaaauggacaagcugacgcucaaaggaaugucauacguaauguguaccggacucuucaaacucgagaaagagguagcggagacucaacacggaacuguuuuaguacagauuaaauacgaaggaaccgacgcaccaugcaagauucccuucagcacacaagaugaaaaaggagugacccagaacggacggcucauuacggcuaauccaaucgucacggacaaagaaaaaccggugaacauagaagccgaaccucccuucggcgagagcuacaucgucaucggagcuggggaaaaagcccuaaaacucuccugguucaagaaaggcagcagcaucgguaaaauguucgaggccacugcgcguggggcccgcaggauggcgauccugggggauaccgcgugggauuucggcagcaucgggggagucuucacaagcguaggaaagcuaguacaccaaauauucgguacagcguacggagugcuauucucaggagugagcuggacaaugaagaucggcaucggaguacuccugaccuggcucgggcuaaauuccagauccacgagucuuucgaugacaugcaucgccguaggccuaguaacccuguacuugggugucauggugcaagcagacucuggaugugucauuaacuggaagggacgggaacugaaaugcggaagugggauauucguuacaaacgagguucacacguggacugagcaauauaaauuucaggcggacucgccaaaacggcuaucggcggcgaucgggaaagcaugggaagaagguguaugcgguauccguucagcgacacgccucgagaacauaauguggcgccaaauuaguaaugagcuaaaccauauucuccucgaaaacgacaugaaguucacaguggucguaggcgacgucgucggcauacuugcccaaggcaagaagaugauuagaccacagccaauggaacauaaguacucauggaaaagcuggggaaaagccaagauaaucggcgcagacguccaaaacacaacauuuauaauugaugggccgaauacccccgaaugccccgaugaucagagagccuggaacauaugggaaguggaggauuacgguuuugggauauuuacaacuaacauauggcucaaauuacgggacagcuacacucagguuugcgaccaucgccuuaugucugcggcuaucaaagacuccaaggcgguccacgcagauaugggcuacuggauugagagcgagaaaaaugaaaccuggaaacuggcccgcgccagcuucauugaaguaaaaacgugcauauggccaaaaucccacacauuauggaguaauggcgugcuggaaucggaaaugaucauaccaaaaauauacgggggccccauuucacaacacaacuaccgucccgguuacuucacacaaaccgcaggaccauggcaccucgggaagcuagaacuggacuucgaccucugcgaagggacgaccgucguaguggacgagcacugcggaaaccgcggcccaagucuucggacgaccacggugacgggcaaaauaauucaugaauggugcuguagaaguugcacacucccaccccuucgguuuaaaggagaagacggaugcugguacggaauggaaauacggcccgugaaagaaaaggaggaaaaucugguuaaaucaaugguauccgcgggcucgggagaagucgacucauucuccuuaggacuauuguguaucucuaucaugaucgaagaggugaugcgcucccgauggucacgaaaaaugcuuaugacgggcacgcucgcaguguucuuccugcugauuauggggcagcucacguggaacgacuugauacgcagcugcauaaugguaggcgcaaaugccucagaccgaaugggcaugggcacuacauauuuggcccugauggcgacauucaagaugcguccaauguucgcgguggggcuacuguuuaggagacugacuucucgagaaguguuacuccuaacaauuggccugucacucguggcgucagucgaauugcccaauucucuagaggagcuaggggacggccuugcaauggggauuaugauccuaaagcuauuaacagacuuccaauccuaucaacucugggcuacgcugcuuucgcucacuuuuaucaaaaccacuuuuucacuccacuaugcauggaaaacaauggcaauggugcugaguauugucucguuauugccguuaugccuaaguaccacgagucagaaaacaacuuggcuaccaguccuacucggcagccuagggugcaagccccucacgauguuccugauagcagaaaacaagauuugggggcguaagucauggccauuaaacgagggaauaauggcggucggaauuguuaguauccuacucucaucauuacuaaagaacgauguuccccucgcagguccccucauugcgggcggcaugcuuaucgcgugcuacguaaucucuggcucauccgcagaucucucgcuagaaaaggcggccgagguaucaugggaagaggaagcggaacacucuggagcgagucacaacauacuugucgagguccaagacgacggaaccaugaaaaucaaagacgaagaacgggacgauacacuaacaauacuacugaaggccacacugcuagcagugaguggaguauacccacucagcaucccagccacgcucuuugucugguacuucuggcagaagaagaaacagcgcaguggagugcuaugggacacaccaucaccgccagagguggaacgugcugugcucgaugacggcauauacaggaucaugcaaagaggccuucuaggacguucgcaagugggcguaggcguguuccaagagaacguguuucacaccauguggcacgugacgcgaggcgcaguacugauguaccaaggaaaacggcuggaaccguccugggcguccgucaagaaagaucugaucagcuaugggggaggauggcgccuccaaggauccuggaacacgggcgaggaaguucagguuauugccguagagccagggaagaaccccaagaaugugcaaaccgccccggggaccuucaaaacgccagagggagaagucggggcgauagcccuagacuucaagcccggcacaaguggaucccccaucgucaaccgagagggaaaaauaguaggccuauacggaaacggagucgugacuacaagcggcacguacguaagcgcgauagcacaagcgaaggcgagucaagagggaccccuaccggagauugaagacgaaguuuucagaaagaggaaccuuacgauaauggaccuacaccccggcaguggaaaaacccgacgauacuuaccugccauugucagggaagcaauaaagaggaaguuaagaacguuaauacuggccccaacccgcgucguagccagcgaaauggccgaagcguugaaagggaugccaaucagauaucagacaacagcgguaaagucugagcacacgggacgcgagaucguggaccucaugugccaugcgaccuucacaaugcggcuccuuagcccggugagagucccgaacuacaacaugaucaucauggacgaagcccauuucaccgacccaucaucgaucgccgccagaggauacauuagcacgcgcguaggcaugggcgaggcggccgcgaucuucaugacagcgacacccccgggaaguguggaagccuuuccgcaaucaaacgccguaauccaagacgaggagagggauauaccagaacguuccuggaacucuggcuacgaguggauaacggauuucccaggcaagaccgugugguucguaccuaguaucaagagcggcaacgacauagccaacugucuccggaaaaacgggaaaaggguaauccaauuaagccggaagaccuucgauacagaauaccagaagaccaaaaacaacgacugggacuacguaguaacgacggacaucucagaaaugggggccaacuuccgagcagauagggugaucgacccaaggcggugccuaaaaccggucauccuaaaagacgguccugaacgagucauacuagcaggaccgaugccagugaccguagcaucggccgcccaaagacggggccggaucgggcguaaucacaacaaggagggggaucaauacauuuacaugggacaaccauuaaauaacgaugaagaccacgcccacuggaccgaagccaaaaugcuccucgacaacauaaacacaccagaaggaaucaucccagcacuguuugagccggaacgagaaaaauccgcagccauagacggcgaauaucgcuugcgcggggaggcccgcaagacuuucguugaacuaaugaggagaggggaccuaccagucuggcucucuuauaaaguggccucggaaggauuccaauacagcgaccggcgcuggugcuucgacggcgaacgaaacaaccaaguauuagaagaaaacauggacgucgaaauauggaccaaagaaggcgaacgaaagaaacugcgcccacgguggcuagacgcccgaacguauagcgacccacucgcacugcgagaguucaaagaguucgcagccggcaggagaucaguaucuggugaucugauauuagagauaggaaaacugccacaacacuugacgcagcgcgcacagaaugcccucgauaacuuagucauguugcacaacuccgagcaaggagggcgcgcguacaggcacgcuauggaagaacuucccgacacgauagagacucugaugcuccuagcgcuaaucgccguccucaccggggguguuacacucuucuuccuaucugggcguggccuaggcaaaacaagcauuggucugcuaugcgucauggcaucgagugcccugcuauggauggccucgguagagccccacuggauagcggcuuccauaauacucgaguucuuccucaugguucuucuuauccccgagccagacaggcaacgaacuccacaggauaaucaauuagcguauguggucaucggucugcuguucaugauccucacuguggcagccaacgaaaugggacuacucgaaacuacgaagaaagaccuuggcaucgggcauguagcagucgagaaccaucaccacgcaacuaugcuugacaucgacuuacaccccgcgagcgcauggacuuuauacgccguagcuaccacgauuaucacgcccaugaugcgccacaccauugaaaacacaacagcaaacaucucucugacagcuauagccaaucaagcagcgauauuaaugggacucgauaaaggcuggccaaucaguaaaauggacauaggcgucccuuuacuugcacugggaugcuacucccaaguuaacccacugacacugacggccgccguacugaugcugguggcgcacuacgcaaucaucgggccaggacuacaagcaaaggcgacgcgagaagcacagaaacgcacagcggcuggcaucaugaaaaacccgaccguagacggcaucguagcgaucgacuuggacccagucgucuacgacgcaaaauucgaaaaacagcugggacaaaucaugcugcucauacuaugcacgagccagaucuuacugaugcguacaacuugggcccuaugcgaaucuauaacucuggcuacgggaccccuaacaacacuaugggagggaagccccgggaaguucuggaauacgacgaucgcaguguccauggccaacauauuccgagguucuuaccuagcgggggcggggcuagcuuuuucccugaugaaaagucuaggagggggccggcgggggacuggggcacagggggagacucuuggagaaaaguggaaaaggcaacuaaaccaacugagcaagucggaguucaauaccuacaaacgcagcggaaucauggaggucgacagaucugaggcaaaggaagggcuucgccgaggcgaaacgacaaagcacgcagugucgcgcgguacagcgaaacucaggugguucgucgaaagaaaucucgugaaaccggaaggcaaaguuaucgaucuaggaugcggccgagggggauggagcuacuacugcgccggcuuaaagaaaguaacagaagugaaaggcuacacuaaaggaggaccagggcacgaggaaccaaucccgauggccacguacggguggaaucuugucaaacuccacaguggcaaagacgucuuuuucauaccacccgaaaaaugugacacucuuuugugcgauaucggagaaucaagcccgaacccaaccaucgaagaaggaagaacgcugaggguacucaagauggucgaacccugguuaaggggaaaccaguucugcauaaaaauccucaauccauauaugccaagcguugucgagacacuggagcagaugcaacgaaaacacggaggaauguuggucagaaacccacucuccagaaacuccacgcacgaaauguacuggguuagcugcgguacgggcaacauagugucagcggucaauaugacaucacgcaugcuauuaaaucgcuucacaauggcacaccggaagccgacuuaugaacgcgacguagaccucggggcaggcacaagacauguggcugucgagccggaaguagccaacuuagacauuaucggacaacgcaucgaaaacauaaagcaugagcauaaaaguaccuggcacuaugacgaagacaauccauacaaaaccugggccuaccacggcucauaugagguaaaaccaucuggaucggcaucaaguauggucaacggcguggucaagcuacugacaaagccgugggacguaauccccaugguaacgcaaaucgcgaugacagacaccaccccauucggacaacaaaggguguuuaaagagaagguggacacccggaccccaaaagcaaaaagaggaaccgcccaaaucauggaagugacugcgcgauggcuguggggguuucucagucgaaauaagaagccccguaucuguacacgagaggaguucacgagaaaaguccggucgaacgccgccaucggggccguuuucguagacgagaaucaguggaacagugcuaaagaagcgguggaagaugaacgcuucugggaucucguccaucgugaaagagaauuacacaaacagggaaagugcgcuacaugcgucuacaacaugaugggaaaaagggaaaagaaguugggagaguucggaaaagccaaaggcagccgcgcaauaugguauauguggcucggggcaagguuccuggaguucgaagcccuggguuucaugaacgaagaccauugguuuucgcgcgaaaacucccugucugggguggaaggggaaggccuccacaaacuaggguacauacugagggacauuagcaagaucccuggcgguaauauguacgcagaugauacagccggcugggacacgcggauaacagaggacgaucuacaaaacgaagcuaaaauuaccgacaucauggagccugagcaugcccuacucgccacguccauauucaaacugacguaucaaaacaaagucguacggguacaacgcccggcccgaaacggaaccguaauggacguaauuagucgcagagaccaaagagggaguggucaggugggcacuuaugggcugaauacauucacaaacauggaagcccaacugauaagacagauggaaagcgagggaauauuuagccccucagagcuggaaaccccaaacuuggcggaacgaguacuggauugguuagagaaacacgggguagaacgacuuaagcggauggcgaucaguggagacgacugugucgucaaaccgaucgaugaccguuucgcaacagcacuaucggcucucaacgacauggggaaaguacgaaaagacaucccgcaaugggagccaagcaaggguuggaacgacuggcaacaagucccguucuguucucaccacuuucaccaacugauaaugaaggauggucgcgaaauaguagucccaugccgcaaccaagacgaacugguaggccgggcaagagucucgcagggggccggauggucguugcgggaaacggcaugucucgggaaaagcuacgcacaaauguggcagcuaauguacuuccacaggcgagaccuacgacuagcggcgaacgcaauaugcagugcggugcccgucgacuggguacccaccagccggacaaccuggagcauacacgcgcaccaucaguggaugaccaccgaggauaugcucuccguauggaacaggguauggauagaggaaaaucccuggauggaagauaaaacucacauaagcagcuggggcgacgugccauaccuuggcaaacgagaggaccaguggugugguucacucauaggccuaacggcccgcgcuacgugggcuacuaacauacaaguggccauuaaccagguacguaggcuaaucggaaaugaaaacuaucucgauuacaugacauccaugaaacguuucaaaaacgacucagaccccgaaggagcacuaugguaa

SEQ ID NO: 24573 - RNA, 9879 nt, Artificial Sequence
  derived and/or modified CDS sequence (opt11) from DENV-1__EU482496__SS-prME
agcgugaccauguugcucauguuaaugcccacggcccuggccuuccaccucaccacuagaggcggggaaccccacaugaucgugagcaagcaagagagagguaagagccugcuguucaagaccagugccggggugaacaugugcacccucauugccauggaccugggcgagcuuugcgaggauacaaugaccuacaagugcccccggaucacugagacagagccagacgaugucgacugcuggugcaacgccacugauaccuggguuaccuacgggacgugcucccagacgggcgagcaccgucgggacaagagauccguggccuuggcgccccacguggggcuggggcuggagacccgcaccgagacguggaugagcuccgagggagccuggaagcagauacagcggguagagaccugggcccuccggcaccccggguuuaccgugaucgcucuguuccuggcccaugcgaucgguaccagcaucacccagaaggggauaaucuucauccuucugaugcuggugacacccuccauggcuaugcggugugucggcaucggcucacgagacuuuguggaggggcuguccggcgcuaccuggguagacgucgugcuggagcacgggagcugcgugaccacgauggcgaaagacaagcccacauuggacaucgaauugcugaagaccgaggucaccaaccccgcaguccuacggaagcucugcauugaggcgaagaucuccaacaccacgaccgacagccgcugcccuacccagggcgaagccacccugguggaggaacaagacgccaacuucgugugccggcgcacguucguggaccgggguugggggaacggaugcgggcuguucggcaaggggucacuaauaacuugcgcgaaauucaaaugcgugacaaagcuggagggcaagaucguccaguaugagaaccugaaguauagcgugaucgugaccguacacacgggagaccagcaccaaguagggaaugaguccaccgagcacggcaccacugcaaccaucacgccccaggcuccgaccaccgagauccagcucaccgacuauggcgcccucacgcuugacugcagcccccgcaccggccuugacuuuaacgagauggucuuacugaccaugaaggagaagucauggcucgugcauaaacaaugguuucuggaccuuccccuccccuggaccucuggggccagcacgucgcaggagaccuggaaccggcaagaucucuuggugaccuucaagacagcucacgccaagaaacaggaggucgucgugcugggcagccaggagggcgcuaugcacacggcccugaccggggcuaccgagauccaaaccuccggcacuaccaccauuuucgcugggcaucuaaagugccgccuaaagauggacaaacugacccuaaagggcaugucuuaugugaugugcacgggguccuuuaaacuugaaaaagagguggccgagacccagcauggcacgguucugguucagauaaaguacgaaggcacugacgcgcccuguaagauccccuucagcacgcaagacgagaagggggugacccaaaacgggcggcugauaacugccaacccuaucgugaccgacaaggagaagcccgucaacaucgaggccgagccgcccuucggggagucauacauuaucaucggugcgggcgagaaggcucucaagcucagcugguucaagaaaggguccagcauuggcaagauguuugaagccacagcccgcggagcacgucgaauggccauccugggagauaccgcgugggacuucggguccauagggggcguuuucaccagcguugggaaguugguccaccaaaucuucggcaccgccuacggggugcuguucuccggcguuagcuggacgaugaagaucgguaucggcguucugcugaccuggcugggucuaaauucccgcagcaccagccuuuccaugaccugcaucgccgucggacucgugaccuuguaccugggcgucauggugcaggccgacucgggguguguuaucaacuggaagggucgggaacucaagugcgggagcggcaucuucgucaccaacgaggugcacaccuggacugagcaauacaaauuccaggcugacagcccgaagcgccucuccgcggcaaucggaaaggccugggaggaggggguuugcggcauccggagcgccacccgccuggagaacaucauguggaagcagauauccaacgaguugaaccauauccuucuugagaacgacaugaaguucacgguugucgucggggacguagccggcauccucgcgcaagguaagaagaugauacguccccaaccaauggaauacaaguacagcuggaagucauggggcaaggccaagauaauuggcgccgacgugcaaaauaccacguucaucauagacggccccaacaccccggagugccccgacgaccagcgcgccuggaacaucugggagguggaggacuacggguuugguauuuuuacgaccaacaucuggcugaagcucagggacuccuacacccaggucugcgaccaccgacucaugucugcggcuaucaaggauagcaaggccguacacgccgacaugggcuauuggaucgagucugagaagaaugagacuuggaagcuagcccgggcgagcuucauagaagugaagacgugcaucuggcccaagucacacacccuguggagcaacggcguccucgagagcgagaugauuauuccgaaaauauacgggggcccuaucagucagcacaacuaucgaccaggauauuucacccagacagccggcccuuggcaccuggggaaguuggagcuggacuucgaccugugcgagggcacgacaguggugguggacgagcacugcgggaaucggggcccaucccugcgcaccacgacaguaaccggcaagauaauccacgagugguguugccgaagcugcacccugccgccguuacgcuuccgcggggaggacggcuguugguacgggauggagauacgccccgucaaggagaaggaagagaaccuugugaaguccauggugagcgccggcagcggggagguggacucauucagccucgggcuguugugcaucuccaucaugaucgaggaggucaugcggagcagauggucccguaaaaugcucaugaccggcacgcuggcuguguucuuccugcugauuaugggacagcuaaccuggaacgaccugauacgccucugcauaauggugggagccaaugcuagcgaccgcauggggaugggcaccaccuaucuggcccugauggccacguucaagaugcggcccauguuugccgucggguuacuguuccgccgguugacgucccgcgagguccucuuacuaaccauagggcucagccugguggcguccgucgagcugcccaacagccucgaggagcugggcgacgggcuggccaugggcaucaugauccucaagcugcugaccgauuuccagagccaucagcucugggccacgcuccugucccucacauucaucaagaccacguucagucugcacuacgccuggaagaccauggccaugguucugagcaucgucuccuuguucccccugugccugaguacaaccucccagaagaccacguggcuccccgugcugcugggcucccucggguguaagccgcugacuauguuccugaucgcggagaacaagaucugggggcggcgcuccuggccacugaacgaggggaucauggccgugggcaucgucagcauccucuugagcucccuccuuaagaacgacgugccacuugcggggccgcucaucgccggcgggaugcugaucgccuguuacgugaucucuggguccagcgcggaccugucccucgaaaaagccgccgaggucagcugggaggaggaggccgaacacucuggcgccucccacaacauucugguggaagugcaggacgaugggacgaugaagaucaaagacgaggaacgggacgacacccugaccauccuccugaaggccacgcugcucgcggucuccggcguguacccucugagcauccccgccacccuguucguaugguacuucuggcagaagaagaagcagcgcagcgggguccuaugggacacccccucgccgcccgagguggagcgggccguccuggacgacggcaucuaccgcaucaugcagcggggccugcuggggcgcucccaagucggcgugggcguguuccaggagaacgucuuccacaccauguggcauguaacgcggggcgcagugcucauguaccaggguaagcgccuggaacccagcugggcgagugucaagaaggaccugaucagcuacggcgguggguggcggcuccaggggagcuggaacaccggggaggagguccagguaauagcggucgagcccggcaagaaccccaagaacgugcagacugccccggguaccuucaagacgcccgagggcgaggugggagccaucgcucucgacuucaagccggggaccucaggcucccccaucgucaaccgcgagggcaagaucguggggcuguacgguaacggcguggucacaacuagcgggacguacgugucugcgaucgcucaggccaaagccucgcaagaggguccgcucccugagauugaggaugagguguuccggaaacgaaaccugaccaucauggaccugcacccuggcucugggaagacacggcgcuaccucccugcuaucgugcgggaggcaauuaagcgaaagcugcggacacugauacucgcccccacucgggugguggccuccgagauggccgaggcgcugaaaggcaugcccauccgcuaccagaccaccgcugucaagagcgagcacaccggcaaggagaucguggaccugaugugccaugccacguucacuaugaggcucuugagccccgugcgcguuccuaacuauaacaugauaaucauggacgaggcccauuucaccgaccccagcuccaucgcagcgcggggguacaucagcacacgcgugggcaugggugaagcggccgcaaucuucaugacugcgacgccucccggcuccguagaggcguucccgcagagcaacgccgucauacaggacgaggaacgggacaucccggagcgcucuuggaacucgggauaugaguggaucaccgacuuccccgguaagaccguuugguuuguucccuccaucaaguccggcaaugacaucgccaacugccuacggaagaaugggaagcgcgucauucaauugucccggaagacguuugacacugaguaccaaaagacgaagaacaacgauugggacuauguggugaccacggacaucagcgaaaugggcgcgaacuuccgcgcggacagagucaucgacccuaggcggugccugaaacccguaauucuaaaggacgggcccgagcgcgugauacucgccggccccaugccgguuacaguugccagcgccgcgcagaggcgcgggaggaucggccgcaaucacaacaaagagggcgaccaguacaucuacauggggcagccccuaaacaacgacgaggaccacgcccacuggaccgaggccaaaaugcuucucgacaacauaaacacacccgagggcaucauccccgcacuguucgagccggagcgcgagaaguccgccgccaucgacggggaguaccggcugcgcggagaggcgcggaaaacguucgucgagcuaaugcgccgcggggauuuacccguguggcuguccuacaagguggccagcgaggguuuccaguacagcgaccgccgauggugcuucgacggugagcgcaacaaccagguccucgaggagaacauggacgucgagaucuggaccaaggaaggggagcggaagaaguugcgccccagauggcuggaugcccgcacuuauagcgacccccucgcccuuagggaguucaaagaguuugccgcgggccgccgcagcguguccggcgaccugauucucgaaaucgguaagcugccgcagcaucugacccagcgcgcccagaaugcgcucgacaacuuggucaugcuccacaacagcgagcagggcgggcgggccuaccgccacgcuauggaggagcucccugacacaauugagacccucauguugcuagcccugaucgccguccuuacaggcgggguaacccucuucuuccuguccggccggggacugggcaagacaaguauaggacugcugugcgucauggccuccuccgugcuccucuggauggccaguguagagccccacuggauagcugccagcaucauccuagaguucuucuuaaugguucuccugauucccgagccagaucgccagcggacgccucaggacaaccaguuggccuacgucgugaucgggcuccuuuucaugauccugaccgucgccgccaacgaaaugggcuuacuggagaccacgaagaaggaucugggcaucggccacguugcgguggaaaaccaccaccacgccgccauguuagacguugaccugcaccccgcguccgcauggacgcuguacgcgguggccaccaccaucaucacgccgaugaugcgccauacaauagagaacaccaccgccaacaucucccucaccgccaucgcgaaccaggcggccauccugauggguuuagacaagggcuggccgauauccaagauggacaucggcgugccccuccuggcccuggggugcuacagccaggucaauccucucacgcugaccgccgcgguguuaaugcucguggcccacuacgccauuaucggcccggggcugcaggcgaaggcgacacgcgaggcgcagaagcggaccgccgcaggcaucaugaagaaccccacggucgaugggaucguugcaauagaccuggaccccguugucuaugacgccaaguucgagaagcagcucggccaaaucaugcugcugauacucugcaccucacaaauccugcugaugcgaaccaccugggcucucugugagaguaucacgcuugcaaccggaccucugaccacccuuugggaggggucccccgggaaguuuuggaacacgaccauugccgucagcauggcuaacauuuuccgggguuccuaucuggccggcgccggccucgcauucucacucaugaagucccucggaggagggcgcagggggaccggagcccagggggaaacacugggagagaaguggaagcgccagcucaaccagcuauccaagagcgaguucaacacuuacaaacguagcgggaucauggagguggaccgcuccgaggccaaagagggccugaagcgcggugagaccaccaagcaugcggucagucgcggaaccgcuaagcuccggugguucguggaacguaacuuagugaagcccgagggcaaggugaucgaccugggcugugggcgaggaggcuggagcuacuacugugccggcuuaaagaaggugacugaggugaagggcuacacaaaagguggacccggccacgaggaaccaauccccauggccaccuacggguggaaccuugucaaguuacauagcggcaaggacguguucuucaucccgccagagaagugcgacacccuccucugcgacaucggggagaguucccccaacccgacgaucgaggaaggccgcacacugcgcgugcugaagauggucgagcccuggcuccgcgggaaucaguuuugcaucaagauccugaaucccuacaugccgagcguggucgagacccuggagcagaugcagcggaaacacggcggcaugcucguccgcaauccgcugagucggaacaguacccacgagauguacuggguuuccugcgggacgggcaacaucgugagcgccgugaacaugacgucccgcauguuacucaaucgauucacaauggcccaccggaagcccacauacgagcgcgacguggaccugggggccggcacccggcauguggccguugagcccgagguggcaaaccuggacauuaucggccagcgcauugagaacaucaagcacgaacacaaaagcacuuggcacuacgacgaggacaauccauacaaaacgugggccuaccauggauccuacgaggugaagccgagcggcuccgcgagcucaauggucaacgggguggugaagcucuuaaccaagcccugggacgugauccccauggugacccagaucgccaugacggacaccacccccuucggccagcagagagucuucaaggagaagguggauacccgcacgccgaaagccaagagagggaccgcccagauuauggaaguuacggccaaguggcuguggggcuucuuauccaggaacaagaagccccggauuugcacgcgagaggaguucacucggaagguucgcucaaaugcggcaaucggcgcuguauuuguugacgaaaaccaguggaacuccgccaaggaggcggucgaggaugagcgguucugggaccuggugcaccgcgagcgcgagcugcacaaacaagggaagugcgcuaccugcguguacaacaugaugggcaagcgcgagaagaaguuaggggaguucggcaaagccaaggggagccgagccaucugguacauguggcuaggcgcgcgcuuccuggaguucgaggcucugggcuuuaugaacgaggaccauugguuuagccgggagaacagccuguccgggguggagggcgaggggcugcacaagcugggcuacauccuucgggauaucagcaaaauucccggaggcaacauguaugccgacgauaccgccggaugggacacccgcauaacggaagacgaccugcagaacgaagccagaaucaccgacaucauggagccagagcacgcucuccuggcaaaguccaucuuuaagcugacauaccagaacaaggugguucguguccagcggcccgcgaaaaacgggaccgugauggacgugaucagcagacgggaccagcgcggcuccgggcagguaggcacguacggucucaacaccuucaccaacauggaggcacagcugaucaggcagauggaguccgaggguaucuucucccccagcgaacuggaaacccccaaucuagccgagcgcgugcuggacuggcugaaaaaguauggcgucgagcggcucaagcggauggccauauccggugacgacugcgucguuaaaccgauugacgacagauucgcgacugcacuuacugcccugaaugacaugggcaagguccgcaaggacauuccccagugggagccgagcaaaggguggaacgacuggcaacagguccccuucugcucccaccacuuccaccagcugaucaugaaggauggucgcgaaaucguugugccgugcaggaaccaggacgagcuagucggucgggcccgaguuucacagggggcuggauggagccugcgggaaaccgcgugucucggcaaguccuaugcccagauguggcagcugauguacuuccaucgccgggaccugcgguuggccgcaaacgcgaucugcagcgccgugcccgucgacuggaucccgacaucccggacaacuuggucgauccacgcccaucaccaguggaugaccaccgaggacauguugucgguguggaaccgcguguggaucgaggagaaucccuggauggaagauaaaacgcauaucagcaguuggggugacguccccuaccuugggaaacgcgaggaccaauggugcggcagccucauuggccugaccgcgcgagccacuugggcgaccaacauccagguggccauaaaccaggugcgacgguuaaucgguaacgagaauuaccucgacuauaugaccuccaugaagcgguucaagaaugagagcgaucccgagggcgccuugugguga

SEQ ID NO: 24574 - RNA, 9879 nt, Artificial Sequence
  derived and/or modified CDS sequence (opt11) from DENV-1__EU482497__SS-prME
agcguaacuaugcuguugaugcugaugccaacagcacuggccuuucaccugacuacccggggaggggagccccacaugaucgucucaaagcaggagcggggcaagagccugcuguucaagaccucggccggcguuaacaugugcacccucaucgccauggaccucggcgaacugugcgaggauaccaugaccuacaaaugcccuaggaucaccgagacggagccagacgacguggacuguuggugcaacgccacggacacuugggucaccuacgggaccuguagccagacgggagagcaucggcgcgacaagcgguccguggcccucgcuccacacguggggcuagggcuggagacucgcaccgagaccuggaugucguccgagggagcguggaagcagauacagcggguggaaacgugggcccuccgccaucccggguucaccguaaucgccuuauucuuagcacaugcuaucgguaccagcaucacccagaaagggauuaucuucauucugcuaaugcucgugacgcccucgauggcaaugcggugcgucggcauuggcucucgcgacuucguggaagggcuuuccggugcgaccuggguggacgucgugcuggagcacgggagcugugugaccaccauggccaaggacaagcccacgcuggacauagagcuccugaagaccgagguaacuaaucccgccguccugcggaaguugugcaucgaggcgaagauauccaacaccacgaccgacucgcggugccccacccagggcgaggcuacccugguggaagaacaggaugccaacuucgucugccggcgcaccuucguggaucggggcugggggaacggcugugggcuauuuggcaaagggucccucaucaccugugcgaaguucaagugcgugacuaagcuggagggcaagauuguccaguacgagaaccugaaguacagcgugaucgugaccguccacacgggcgaccaacaucagguggggaacgagucgaccgaacacggcaccaccgcgaccauuacgccccaagcgcccaccaccgaaauccagcucaccgauuacggggcacugacguuggauugcagcccccguaccgggcucgacuucaaugaaaugguccugcugaccaugaaggaaaaguccuggcuggugcacaagcaaugguuccucgacuugcccuuacccuggaccagcggggcuagcaccucgcagggcaccuggaaucggcaggaccugcucgugaccuucaagaccgcacacgccaagaaacaggaagucguuguguuaggcagccaggagggggcgaugcauacggcccugaccggcgccaccgagauccagaccucgggcaccaccaccaucuuugccggccaccugaaguguaggcucaaaauggacaaacuaacccugaaagguaugagcuacgugaugugcacuggcuccuuuaaguuagaaaaggagguggcugagacccagcacggcaccgugcuaguccagaucaaguacgaggggaccgacgccccauguaagaucccauucagcacgcaggacgagaaaggcgugacacagaacgggcggcuaauuaccgcgaacccgauuguuaccgauaaggagaaacccguuaacauagaggccgagccgcccuucggcgagagcuauauagugaucggcgccggagaaaaggcgcugaaacucagcugguucaagaaggguuccagcaucgguaagauguuugaggccacggcccgcggcgcucggcgcauggccauucuaggugacaccgcgugggauuucggcucaauuggcgggguguucaccagcguugguaaguugguacaccagaucuucgggaccgcauacggcguacuuuucuccggugucagcuggacgaugaagaucggcauaggcgugcuacucaccuggcucgggcugaacucucgcagcaccuccuuaagcaugaccuguauagcgguagggcuggucacuuuauaccugggggucauggugcaggccgauucaggaugugucaucaauuggaaagggcgggagcucaaaugcggcagcggcaucuucgugacgaaugaggugcauaccuggaccgagcaauacaaauuccaggccgauagcccgaaacgccugucugccgccaucgguaaggccugggaggaggguguguguggcauccggagcgccacucgccuggagaacauuauguggaagcaaauuuccaacgagcucaaccacauacugcuggagaacgacaugaaguucaccguaguggucggcgauguggccgggauccuugcgcagggcaagaagaugauccggccccaacccauggaguacaaguacagcuggaaaucguggggcaaggccaagaucauuggggccgacgugcagaacaccaccuucaucauagaugggccuaacaccccggagugucccgacgaccagcgcgccuggaauaucugggagguggaagacuacggguucggcaucuucacgaccaacaucuggcugaaguugcgggacagcuauacccaggugugcgaccaccgccucaugucugcggcuaucaaggacucaaaggcagugcacgcugacaugggcuauuggaucgagucagagaaaaacgagaccuggaagcuagcccgcgcgagcuucaucgagguaaaaacguguaucuggccaaagucccacaccuuguggaguaacggggugcuagaguccgagaugaucauaccgaagaucuacggugggcccaucagccagcacaauuaccgcccuggauacuucacucagaccgcugggccguggcacuugggcaagcuggagcuugacuucgaccugugcgaggguacgaccguggucguggacgagcacugcgggaaccggggcccuagccugcgcaccacgacuguuaccggaaagauaauacaugaguggugcugccggucaugcacccugccaccccuccgcuuccggggcgaggacggguguugguacggcauggaaauccgacccgucaaggagaaggaggagaaccuggucaaauccauggugagcgccggcuccggugagguugacuccuucagccucggccugcuguguauuagcauaaugaucgaggaggugaugcggagccgcuggagccggaagaugcucaugaccgggacucuggcuguuuucuuccugcucaucaugggccagcuuaccuggaaugaucugauaagguuaugcauuauggugggugccaacgcuagcgaccgcaugggcaugggcaccaccuaccuggcccuuauggccacguucaaaaugcggccgauguucgcugugggguuguuauuccgccggcugaccucucgcgaggugcuccuacugaccaucgggcucagccugguggccucuguggaguuaccaaacagccucgaggaguuaggggacggccuggccaugggcaucaugauccucaagcugcucaccgauuuccagucccaccaacucugggccacgcugcugagccucaccuucaucaaaaccaccuucucucuacacuacgccuggaaaacgauggcaaugguccugagcaucgugucccuuuuuccauuaugccuaucaacuacgucccagaagaccacgugguuacccgugcugcuggggagccucggcugcaagccgcugaccauguuccuaauugccgagaacaagaucugggggcgccgcuccuggccgcuuaacgagggcauaauggccguagguaucgugagcauacugcuguccagccuacugaagaaugacgugccacucgcaggcccccuuaucgcuggcgggaugcuaaucgccugcuacgucaucucaggguccagcgcggaccugagucucgagaaggccgccgaggugagcugggaagaggaggcggagcauuccggcgccagccacaacauccugguagaaguccaggacgacggcaccaugaaaaucaaggacgaggaacgggacgacacacugaccauccuacugaaagcgacgcuguuggccguguccgggguguacccgcugagcauccccgcaacccuguuugugugguacuucuggcaaaagaagaaacagcgcuccggcguccucugggauacacccagcccacccgagguagaacgggcaguccuggaugacggcauuuaccgcauuaugcaacgggguuugcuaggacgcucccagguuggggugggugucuuccaggagaacguguuccacaccauguggcaugugacgcgaggugccguccuuauguaccagggcaagcgccuggagccgagcugggcguccgugaagaaggaucuuaucucauacggcgggggcuggcggcuccaggguagcuggaauacuggcgaggaagugcaggucauugcuguggagcccgguaagaaucccaagaacgugcagaccgccccaggcaccuucaaaacgcccgagggcgaggucggggccaucgcccuggacuuuaagcccggcaccagcgguucacccauugugaaccgcgagggaaagauugugggucucuaugggaacggcguugucacuacaagcgggacguacgucucugccaucgcccaggcgaaggccucccaggagggcccacuccccgaaaucgaggacgagguguuccgcaagcguaaccugaccaucauggaccugcacccgggguccggcaagacccgucgcuaccuaccagcaaucguccgggaggccaucaagcgcaaauugaggacccugauccucgcgcccacgcgggugguggcguccgagauggcugaagcauuaaagggaaugcccauccgauaucagacuaccgcagugaaaucagagcacaccgggaaggagaucguugaccugaugugccacgccaccuuuaccaugcggcuccucucccccguacgcguccccaacuacaacaugauaaucauggacgaagcucacuucacggaccccaguuccaucgccgcgcggggcuacauaaguacucgcguggggaugggcgaggccgccgccaucuucaugaccgccacgccgcccgggucaguagaggcguucccgcagaguaacgcagucauacaggacgaggaacgcgacauccccgagcgcucguggaacaguggcuacgaguggaucaccgacuuccccgggaagacugucugguuuguccccuccaucaagagcgggaacgacaucgcaaacugccugagaaagaacggcaagcgcgugauacaacucuccaggaagacguucgacaccgaguaucagaagaccaagaacaaugacugggacuacguggucaccacggacaucagcgagaugggagccaacuuccgcgcggaucgggugauugaucccagaaggugucucaagcccgugauucugaaagacgggccagagcgcgucauccucgccgguccuaugccggugaccguggccuccgccgcccagcggcguggccggauaggcaggaaccacaacaaagagggggaccaguacaucuacaugggacagccccugaacaacgacgaggaccacgcgcacuggaccgaggccaaaaugcuauuagauaauaucaauacccccgaggggauuaucccagcucuguucgagccggagcgcgagaaaagugccgccauagacggggaguaccggcugcgcggggaggcacggaagaccuucguggaacucaugagacguggugaccuaccaguguggcuguccuauaaagucgccucugagggcuuucaauacagcgaccggcgguggugcuucgacggggagcgcaacaaccaggugcucgaggaaaacauggacguggagaucuggaccaaggaaggcgagcgaaagaagcugcgcccccgguggcucgacgcucgcaccuauucggauccgcucgcacugcgggaguucaaggaguucgcggcggggcgccguagcgucuccggcgaucucauccucgaaauaggcaaacuuccacagcaccugacucagcgcgcacaaaacgccuuagacaaccuagugaugcugcacaacagcgagcaagggggccgggccuaucgccacgcgauggaagaacuccccgacacaaucgagaccuuaaugcugcuugcacugaucgccguucugacgggcggcgugacccucuucuuccuguccgggcggggccuggguaagacaucaauagggcuccuuugugucauggccuccagcguacugcuuuggauggccuccgucgagccacacuggauugcggcauccauaauccuagaguuuuuccuuaugguucuacugauccccgagccggaccgccagcggacgccucaagacaaccagcuggccuacguggucauugggcuucuguucaugauccugaccguagcugcaaacgaaauggggcuacuggagacgacuaagaaggaccugggcaucgggcacguggcgguggaaaaccaccaucacgcagccaugcucgacguggaucuacaucccgcuuccgccuggacccuguacgcgguggcaaccaccauaaucaccccaaugaugcgacauacgauugagaacacaacugccaauaucagccucacggccaucgcgaaucaggcggccauucugaugggccucgacaagggcuggcccaucuccaaaauggauauuggggucccccuccuugcccugggcuguuacucccaagugaacccccucacacucaccgccgcggugcugaugcucgucgcccauuaugccaucauaggcccgggccugcaggccaaggccacccgcgaggcgcagaaacggacggccgccgguauuaugaagaaccccacggucgauggcaucgucgcaauugaccuggacccggucguguaugaugcgaaguucgaaaagcagcugggccagaucaugcugcugauccucugcaccucucagauccugcugaugcggaccaccugggcgcucugcgagagcaucacacuugccaccggaccccuaaccacacucugggagggcuccccggggaaguuuuggaacacgaccaucgcugugagcauggccaacaucuuccggggcuccuaccuagccggcgcggggcuggcguucagcuuaaugaagucccugggcggagggcgccgcgggaccggagcucaaggcgaaaccuugggggagaaguggaaacgccagcucaaucaacugagcaagagcgaguucaauacguacaagcgguccggcaucauggaggucgauagaagcgaggccaaggaggggcuuaagagaggggagaccacuaagcacgcgguuucucgcgguacggccaagcuccggugguucguagagcgcaaccuggugaaacccgagggcaaggugaucgaccugggaugcgggcggggcggguggagcuacuacugcgccggccugaagaaagugaccgaggucaaaggguacacgaaaggcggcccagggcaugaggagccuauuccgauggccacauacggcuggaacuuaguaaagcugcauaguggaaaggacguguucuucaucccgccggagaagugcgacacgcugcucugcgauauuggcgaaaguagccccaacccaacgauugaggaggggcgcacccugagaguccugaagauggucgagcccuggcuccgggguaaucaauucugcaucaaaauccucaaccccuacaugcccuccguagucgagacucuggaacagaugcagcggaagcauggcggcaugcuugugcgcaauccccugucccggaacaguacccaugagauguacugggugaguugcggcaccgguaauauagucucagcggugaacaugacgagccgcaugcuacucaaccgguuuacgauggcucaccgcaagcccaccuaugagcgcgauguagaucugggcgccggcacccgucaugucgcuguugagcccgaaguggccaaccuggacaucauuggccagcgcaucgagaacaucaagcacgagcacaagagcacguggcacuacgacgaggacaaccccuacaagaccugggccuaucaugguuccuacgaggucaagccuagcgggagugcuagcagcaugguuaacggcgucgugaaacuccuuaccaagccuugggacgugauccccauggucacccaaaucgcaaugacggacaccacccccuuuggccagcagagagucuucaaggagaagguggacacccgaacgccgaaggcuaagagagggaccgcccagaucauggaggugacugcuaaguggcuaugggguuuucugucucgcaacaagaagccgcggauaugcacccgcgaggaguucacacggaaggugagaagcaacgcggcaaucggagcuguauucguugacgagaaucaguggaacuccgccaaggaggcgguugaagaugaacgguucugggaccuggugcaccgcgagcgggagcugcacaagcagggcaagugcgcgaccugcgucuacaacaugaugggaaagcgcgagaagaaacuuggagaguuugggaaggcuaagggcagccgggccaucugguacauguggcugggcgcccgauuucucgaguucgaggccuuaggguucaugaacgaggaccauugguuuucccgggagaacucccugucuggcgucgagggggagggcuugcacaagcugggcuauauccugcgcgacaucagcaagaucccgggcgggaacauguacgcggacgacacagcgggcugggacacccggaucacggaggacgacuuacagaacgaggcccgcaucaccgacaccauggagccggagcacgcacuccuggcgcgcuccaucuucaagcugaccuaccagaacaaggucgucagagugcagcggcccgcuaaaaaugguacggugauggacgucaucucuaggcgcgaccagcggggguccggccagguaggcaccuacggucucaacaccuuuacaaacauggaggcccagcugaucagacagauggaaagcgagggcaucuucucgccaagcgaguuggagacgcccaacuuagccgagaggguguuggauuggcuggagaaguacgggguggaacgccuuaagcggauggccauauccggcgacgacugcguuguuaagccgaucgacgaucgcuuugcgacugcccugaccgcccucaacgacauggggaagguccggaaggauaucccacagugggagcccagcaagggauggaacgacuggcaacagguccccuucugcucgcaccacuuucaccagcucaucaugaaagacggccgcgagaucguggucccgugucggaaccaggacgagcugguggggcgcgcccgggugagccaaggagccggguggagccuucgcgagaccgcgugcuugggcaagagcuaugcgcaaauguggcaacugauguacuuccaucggcgcgacuugcggcucgcggccaaugcgaucugcuccgccguccccguggacuggauccccacguccaggaccaccuggucgauccacgcucaccaccaguggaugaccaccgaggacaugcuuuccguguggaaccgcgucuggaucgaggagaacccguggauggaggacaagacccacaucuccuccuggggcgaugugccuuaccuggggaagcgugaagaccagugguguggcagccucaucggccugacugcacgcgccaccugggcuacaaacauccagguugccauaaaucagguccgccgccugauagggaaugagaacuacuuggacuacaugaccuccaugaagcgguuuaaaaacgagagcgacccggagggggcccugugguaa

SEQ ID NO: 24575 - RNA, 9879 nt, Artificial Sequence
  derived and/or modified CDS sequence (opt11) from DENV-1__EU482499__SS-prME
agcgugacgaugcuauuaaugcugaugcccaccgcguuagccuuccaucucacgacccgcgggggagaaccccacaugauagugagcaaacaggagcgggggaagucccugcuguucaagaccagcgccggggugaacauguguacguuaaucgccauggaccugggcgagcugugugaggacaccaugacauacaaaugcccucggaucacagagaccgagcccgacgacguugacugcuggugcaacgccacggacaccugggucaccuacggcaccugcagccagacgggcgagcaucggcgggacaaacgguccgucgcccucgcgccccacgugggacuggggcuugagacacgcaccgagaccuggaugagcuccgagggagccuggaagcagauccagcgcguugagacgugggcccuacggcauccuggguucacggugaucgcccuguuccuggcccaugcgauugggaccagcauuacccagaaggggaucaucuucauucuccuuauguuagugacgcccuccauggccaugcggugcgucggcaucgguagccgcgacuucguggagggguuguccggagcaacguggguggacgucguguuggagcacgggagcugcguaaccaccauggcaaaagacaagcccacuuuagacaucgaacuccugaagaccgaggucacaaacccugccgugcugcggaaguuaugcaucgaagcgaagauuuccaacaccacgacggauagucguugcccgacccaaggcgaggccacucugguggaggagcaggacgccaacuucguuugcaggcgcacauucguagaucgggggugggggaacgguugcgggcuguucggcaaggggucccuuaucacgugugcuaaguucaagugugugaccaaacuggagggaaagaucguacaguacgagaaccugaaauacagcgugauaguaaccguccacacgggcgaccagcaccagguggggaacgagucuaccgagcauggcaccaccgcaaccauaacaccccaggcgccgaccaccgagauccaauugacggacuacggggcccugacguuggacugcaguccaagaaccggccucgauuucaacgagauggucuugcugaccaugaaggagaagucuuggcucgugcacaagcagugguuucuggaccucccccuccccuggaccaguggggcgagcacaucucaggagacauggaaccggcaggaucugcuggugaccuucaagaccgcucacgcuaagaagcaagaggucgucguacucggcucacaggagggcgcgaugcacacggcgcuaaccggggccaccgaaauccagaccuccggcacgaccaccaucuucgccgggcaucuaaagugccgccucaagauggacaagcugacccugaagggcaugagcuacgucaugugcacggggucauucaagcucgaaaaggagguagcagagacccaacauggcacggugcuggugcagaucaaguacgagggcaccgacgcucccuguaagauccccuucucgacgcaagaugagaaggggguuacccagaacggccgguuaauuaccgccaauccgaucgugaccgauaaggagaaacccgucaacauagaggccgagccgccguuuggggaguccuacauaaucaucggugccggugagaaggcacugaagcucagcugguucaagaagggguccagcaucgggaagauguucgaagccacggcccgcggagcucggcgcauggccauccugggcgacaccgcuugggacuucgggucgaucggcggaguguucacuaguguggggaagcugguccaccagaucuucggcaccgccuacgggguguuguucagcggcguaucguggacgaugaagaucgggaucgguguccugcuaaccuggcucggacugaacucccgcagcaccucccugagcaugacuugcaucgccgugggguuggugacguuauaccucgguguaauggugcaagccgauagugggugcguaauuaacuggaaaggccgggaguuaaagugcgggagcggcaucuucguuaccaacgagguccauaccuggaccgaacaauacaaguuccaggccgauucaccgaagcgccuguccgcugccauaggaaaagccugggaagagggggugugcggcaucagaagcgccacacggcucgagaacaucauguggaagcagauaucaaacgagcuaaaccacauccugcuggagaaugacaugaaguucacggucguaguuggggacgucgccgguauccucgcgcaagggaagaagaugauccggccccagcccauggaguacaaauauagcuggaaguccuggggcaaggccaagaucaucggcgcggacguccagaauaccacuuucaucaucgaugggcccaauacaccggaaugccccgacgaucagcgcgccuggaacaucugggaggucgaggacuacgguuucgguaucuucacgaccaauaucuggcuaaaacugcgggauagccacacccaggucugugaccaccgccucaugucggcugccaucaaggacagcaaggccgugcacgccgacaugggguacuggaucgaauccgagaagaacgagaccuggaagcuggcaagagcgagcuucaucgaagugaagacgugcauuuggccgaagucccacacccuguggagcaacgggguccucgagagcgagaugauuaucccgaagaucuaugggggcccgaucagucagcacaacuaccgccccggguacuucacccaaacagccggaccuuggcaccugggaaagcuggagcucgacuucgaccugugcgagggcacgacggugguuguugacgagcacugcgguaaccgggggccgucccugagaaccaccacgguuaccggcaaaauaauacacgagugguguuguaggagcuguacucuuccgccgcuccgcuuccggggggaggacggaugcugguacgggauggagauccgucccgugaaggagaaagaggaaaaccuaguaaagucuaugguuagcgccggcagcggagaaguggacucguucagccucgggcugcugugcauuuccauuaugaucgaggaggucaugcggagccgcuggagccggaagaugcucaugaccggcacgcuggccguguucuuccuuuuaaucauggggcaguuaaccuggaaugaucugauccgccucugcaucauggugggcgcgaaugcgagcgaccgcauggggaugggcaccacauaccuggccuuaauggccacguucaaaaugcgaccgauguucgccgucggccucuuguuccgccggcugaccuccagagaggugcuccugcugaccauagggcucagucugguugccuccguagaacugcccaacucucucgaggagcuaggugacgggcuggcgaugggcaucaugauccucaagcuacugaccgacuuccagagccaccagcucugggccacgcugcuaucucucaccuuuauuaagaccacuuucucccugcacuacgcguggaagacaauggcaaugguccuaagcauagucucccucuucccccugugucugagcaccacaucccagaaaacaacguggcuccccgugcuuuuaggcagccucgguugcaagcccuuaaccauguuccuuaucgcggagaauaagaucuggggccggcguuccuggccacucaacgaggggaucauggccguggguaucgucagcauccuguuaagcucccuccugaagaacgaugugccccuagccgggccccucauagccggcggcaugcugaucgccugcuacgugaucaguggauccucagcggaucugucccucgagaaggccgccgaagucucgugggaggaggaggccgagcacuccggcgccagccacaacauccuggucgagguccaggacgacgggaccaugaagaucaaggaugaggagcgggacgacacccugaccauacuccugaaggcuacgcugcucgcugucuccggcguguacccccuuagcaucccggccacccuuuucguaugguauuucuggcagaaaaagaagcagcgcucagggguccucugggacacccccagcccgccagaggucgagcgggcaguucucgacgacggcaucuaccgaaucaugcagagggggcuguuagggcggucucagguaggcguggggguguuccaggaaaacguguuccacaccauguggcacgugacgcggggcgccgugcuaauguaccaagggaaacgcuuggagcccucuugggcgagcgucaagaaggaccugauuagcuacggcggcgguuggcgccugcaaggcucuuggaacacaggggaggagguccaggucaucgcuguggagcccggcaaaaacccaaagaacgugcagaccgcucccgggaccuucaaaacgcccgagggcgaaguaggcgccauugccuuggacuucaagcccgguaccagcggcucgccaaucgugaacagagaggggaagauugucggccuguauggcaacgggguggucacaaccucuggcaccuacguuucugcgauagcucaggcgaaggccucccaagaggggccauuaccagaaaucgaggacgagguguucagaaagcguaaccugaccaucauggaccugcaucccgggucaggcaagacccggcgcuaccugccggcgaucguccgggaggccaucaagcgcaagcugcgcacccuaaucuuggcccccacgagagucguggcaagcgagauggccgaggcgcugaagggcaugcccauccgcuaccaaacuacagccguaaagagcgagcacaccggcaaggaaaucguggaccugaugugccaugccacguuuacgaugcggcuucugucccccguuagggucccuaacuacaacaugaucaucauggaugaagcccacuucaccgaccccucauccauagccgcgcggggguauaucagcacccgcgucggcaugggggaggcagccgcuaucuucaugacugccacgcccccaggcucgguggaagcguucccgcagagcaacgccgugauccaggacgaggagcgcgacauccccgaacgcuccuggaacagcggguacgaguggaucaccgacuuucccgguaagaccgugugguucgugccuuccauuaaguccggcaacgacaucgccaacugccugcguaaaaacgggaaacgcgucauccagcucucccggaagacauucgacacugaauaccaaaagaccaagaacaaugacugggacuacguggugaccacagauaucagcgagaugggcgccaacuuccgcgcugaccgggucauagauccgcgcagaugccugaagcccguaauucugaaagacgggcccgagcgugucauccucgcgggcccaaugccggucacgguagccuccgcggcccagcggcgcgggcgcaucggccgcaaccacaacaaggaaggcgaccaguacaucuacauggggcagccguugaacaaugaugaagaccacgcucacuggacagaggcgaagaugcugcucgacaacaucaauacacccgagggcaucaucccggccuuguucgagccggagcgcgaaaaguccgcggccauagauggcgaauaccgccuacgcggcgaggcccggaagacguucgucgaguuaaugcgccgaggugaccugcccguguggcuuuccuacaaggucgccagcgagggguuccaguacucggacaggcgguggugcuuugauggcgagcgcaacaaccagguguuagaggagaauauggacguggagauauggaccaaggaaggugagcggaagaagcugaggccccgguggcuugacgcccgcaccuacuccgacccccucgcucugcgggaguucaaggaauuugccgcgggcaggcggagcguguccggggaucugauccuugagaucggcaagcugccgcagcacuugacccagcgcgcccagaacgcccuagauaaccuggucaugcugcacaacagugagcagggcgggcgggccuaccgccaugcgauggaggagcuccccgacacgaucgagacccuuaugcuuuuggcccugaucgccgugcugaccggcgggguuacccucuucuucuuauccggacggggcuugggaaaaaccagcaucggacuccuuugcguaauggccuccagugugcugcucuggauggccuccguggagccacacuggauugcagccucaauaauccuagaguucuuccugaugguccuacugauccccgagccggacaggcagcggacgccccaggacaaccagcuggccuacguggugaucgggcuccuauuuaugauccugacaguugccgccaacgagauggggcuucuggagacaaccaagaaggaccuggggaucggccacguggcgguggagaaccaccaccacgccgccaugcucgacgucgaucugcaccccgccuccgcguggacgcuguacgcgguggccaccaccaucauuaccccgaugaugcgccacacgaucgaaaacaccaccgccaacaucagccuaaccgccaucgccaaccaggcggccauucucauggggcuggacaaaggcuggcccaucuccaaaauggacaucggagugccacuccuggcauuggggugcuauucucaggucaacccgcucacccugaccgccgcuguacuuaugcucgucgcccacuacgccaucaucggcccggggcuucaggccaaggccaccagagaggcucagaagaggaccgcagcaggcaucaugaagaauccuaccgucgacgggaucguugccaucgaccuggaucccgugguguacgacgccaaguucgagaagcagcucggacagaucauguugcuuauccucugcaccagccagauccugcuaaugcgcaccaccugggcguuaugugaguccaucacucuggcaaccggcccgcugaccacccucugggagggaucuccggggaaguucuggaacacgaccaucgccgugagcauggccaauaucuuccggggaagcuaccucgccggcgcgggccucgcuuucagccucaugaagucacucgggggcgggcgccgggggaccggggcccagggcgagacguuaggcgaaaaguggaagcggcagcucaaucaacugucuaagucagaguucaauacguacaagagguccgggaucauggagguggaccgaagcgaggccaaggagggccugaagcggggugaaacuaccaagcaugcgguuucgaggggcaccgcgaagcuccggugguucguagaacgaaaccuggugaaacccgaggggaaagucauugaccugggcuguggccgcggaggcuggagcuacuacugcgccgggcucaagaaggugacggaggugaaaggcuacaccaaaggcggccccggccacgaggagcccaucccgauggccacauacggguggaaucucguuaagcugcacagugggaaggacgucuucuucauuccgcccgaaaaaugcgacacucugcucugcgacauuggggaaagcucacccaacccaacaauagaagagggccgaacccugaggguguugaagauggucgagcccuggcuccgcggcaaccaguucuguauaaaaauucugaaccccuacaugcccagcgugguggaaacccuggagcagaugcagcggaagcacggcgggaugcucguacguaacccgcugucccguaacucaacucaugagauguauugggugaguugcgggaccggcaacaucgugagcgccgucaacaugacguccagaaugcugcucaacagauucacgauggcacaccggaagcccacuuacgagcgcgacguggaccugggggccggcacccgccacguggccguggaacccgagguggcgaaccuggacaucaucgggcagcgcauugaaaacauuaagcacgagcauaaaagcacauggcauuacgaugaagacaacccguacaagacgugggcguaccacggguccuacgaggugaagccgagcggguccgcgucuucgauggucaacgggguggucaagcuccugacaaagcccugggaugugaucccgauggugacccagaucgccaugacagacaccacccccuucggccagcagcgggucuucaaggagaaggucgacaccaggaccccgaaggccaagcgggggaccgcccagaucauggaagucacagcaaaauggcuguggggcuuccucucccgcaacaaaaaaccccgaaucuguacccgcgaggaauucacccggaagguccgcagcaacgcggccauuggagcgguauucguggacgagaaccaguggaacuccgccaaggaggcgguggaagaugagcgguucugggaccuggugcaccgcgagcgggaacugcacaaacaagggaagugcgcgaccugcguguacaauaugaugggaaagcgcgaaaagaagcucggugaguucggcaaagccaaggggagucgggccaucugguacauguggcugggcgcaagguuccuugaguucgaggcguuaggguucaugaacgaggaccacugguucagcagagagaacucgcuaucugggguugagggcgaggggcugcauaaacucggcuauauucuacgcgacaucucuaaaauacccggcggcaacauguaugccgacgacaccgccggcugggacaccaggaucacggaagacgaccugcagaacgaggcgcggaucaccgacauaauggagccggagcacgcucuauuggcaaaauccaucuuuaaguuaaccuaucaaaacaagguggugcgugugcagcggcccgccaagaacgggaccgucauggaugucauuagucgccgggaccaaagggguuccgggcaggucggaacguaugggcucaacacguuuaccaacauggaagcucagcugauccgacagauggagagugaggggauuuucucccccagcgagcucgagacccccaaucucgccgagcgcgugcuggacuggcuuaagaaauacgguguugagaggcucaagcgcauggccaucuccggggacgauuguguugugaagccgaucgacgaccgauuugcgacugcccugaccgcccugaaugacaugggcaaggugcgcaaggacaucccccagugggagcccagcaagggguggaaugacuggcaacagguccccuucuguucccaucacuuccaccaacucauuaugaaagacggucgggagaucguggugccgugccguaaccaggaugagcugguaggccgggcacguguuagccaaggggccggcuggagccugcgggagacggcgugccucggcaagagcuacgcccagauguggcagcugauguacuuccaccgccgggaucugcgcuuagccgccaacgcgauauguagcgccguacccgucgacuggauccccaccuccagaacaacuuggucgauccacgcgcaccaccaguggaugaccaccgaggacaugcuguccguauggaacagaguguggaucgaagagaaccccuggauggaggacaaaacgcauaucagcuccugggaagaugucccuuaccugggaaagcgcgaggaucaguggugcgggagccucaucggccugacagcccgggccaccugggcgacgaacauccaggucgcuauuaaucagguccgccgguugaucgguaacgagaacuaccucgacuauaugaccuccaugaagcgcuuuaaaaacgagggggaccccgagggcgcacuaugguga

SEQ ID NO: 24576 - RNA, 9879 nt, Artificial Sequence
  derived and/or modified CDS sequence (opt11) from DENV-1__EU482500__SS-prME
agcgugaccauguuguugaugcugaugcccaccgcccuggccuuucaucucaccacccggggcggagaaccccacaugaucguaagcaaacaagagcggggcaaaagccugcuguucaagaccucagccggggugaacauguguacucucaucgccauggaccucggcgagcugugcgaggacacuaugaccuacaaguguccccggauaaccgagaccgagcccgaugacguggacugcuggugcaacgccacggacaccugggugaccuaugggaccugcucucaaacgggugagcaccgccgcgacaagcgguccguugcccucgcgccgcacguggguuuggggcuggagacacgcaccgaaaccuggauguccuccgagggugccuggaaacagauccaacggguugaaaccugggcuuuacggcaccccggguucaccgugaucgcacuguuccuggcucacgcgaucggcacaaguaucacacagaaagggauaaucuucauccuccuuaugcucgugacgcccucuauggccaugcggugcguaggaaucggaagccgcgauuucguggaggggcuguccggggccacuuggguggaugucguucuggagcaugggagcugugugaccaccauggcaaaggacaagcccacgcuugacaucgaacuccugaagaccgaggucacuaaccccgcaguacugcgcaagcucugcaucgaggcgaaaauauccaacacgaccaccgacucucgcugcccgacccagggugaggccacccugguugaggaacaggaugcaaauuucguaugccggcgcacguucguggaccggggcugggguaacggcugcggguuguucgguaaggggucccuuauuacgugugccaaguucaagugcgugacaaaacuggagggcaagaucguccaguacgagaaccugaaguacucagucaucguuacuguccacacuggggaucaacaucagguugggaacgaauccaccgaacacgggaccaccgccacaauuacgccgcaggcgcccaccaccgagauccaguuaacagacuacggggcauugacgcuggauuguucuccccgaaccggauuagacuuuaacgagaugguccugcugaccaugaaggaaaagucauggcucgugcauaaacagugguucuuggaccugccucuccccuggacuucaggggccagcacgucacaggagaccuggaaccggcaggacuuacucgugacauuuaagaccgcccaugcuaagaagcaggaggugguggugcucggcagccaggagggcgcgaugcacaccgcgcugaccggggccaccgaaauccagaccagcggaacgaccaccaucuuugcaggccaucugaagugccgccucaagauggacaaacuuacacuaaaaggcaugagcuacgucaugugcacgggauccuucaagcucgagaaggaggucgccgagacccagcacggcacgguacuugugcagauuaaguacgagggcacggacgcgcccugcaaaauacccuucucaacgcaggacgagaagggagugacccagaacggccggcugaucaccgccaacccuaucgucaccgacaaggagaagcccgucaacaucgaggcagagccgcccuucggggaauccuauaucauuaucggcgccggcgagaaggcgcugaagcucuccugguucaagaagggguccagcaucgggaagauguucgaagcuacugcccgaggggcaaggcgaauggcgauacugggcgacaccgcgugggauuucggguccaucggcggcguguucaccagcguagggaagcugguccaccagauuuucggcacagccuauggcguacuguucaguggcgugagcuggacgaugaagauaggcaucggcgugcugcugaccuggcucggguuaaacucacgcucuaccagccugagcaugaccugcaucgcugugggccucguuacacuguaccugggcgucaugguucaggccgauuccgggugcgugaucaauuggaagggccgggagcuuaagugcggaucgggcaucuucgucaccaacgaggugcacaccuggaccgagcaguacaaguuccaggcugauagcccgaagcgucuguccgcggcuaucgggaaagccugggaggaagggguaugcggcaucaggagcgccacacgccuggagaauaucauguggaaacagauaaguaacgaacuuaaucacauccuacuggagaacgauaugaaguucaccguuguggugggggacgucgcaggcauacucgcgcaggggaagaagaugauccggccgcagccaauggaguacaaguacucguggaaguccuggggcaaagccaagauaaucggcgcggacgugcagaacaccaccuucaucaucgacggacccaacaccccggagugucccgacgaccaacgcgcuuggaacaucugggaaguggaggacuacgguuucggcaucuucacgaccaacaucuggcugaagcuacgggacucacacacccaaguuugcgaccacaggcucaugucagcugcuaucaaggacucuaaggcggugcacgccgacaugggcuacuggauagaaucggagaagaacgagaccuggaagcuggcucgggccaguuucaucgaggugaagacgugcaucuggccaaaaucccacacucuguggagcaacggcguauuagaguccgagaugaucauccccaagauuuaugggggcccaaucucccagcacaauuaucgccccggguacuucacccaaacugcgggccccuggcaccuggggaagcuggagcucgacuuugaucuuugugagggcacaaccgugguagucgacgagcauugcggcaaccgggggccgucccugcgcaccacaacgguaacagggaaaaucauccacgaguggugcugccggaguugcacacugccaccccuaagauucagaggggaagacggcuguugguacggaauggaaauccgccccgugaaggagaaggaggaaaaccuggucaagucaaugguaagcgccggcagcggagagguggacuccuucucgcucgggcugcuauguaucucaaucaugaucgaggaggucaugcggagccgcuggucccggaagaugcucaugacuggcacgcuggccguguucuuccugcucauaauggggcaacugaccuggaacgaccugauacgccucugcaucauggugggugccaacgcgucagauaggauggggaugggcaccaccuaccuggcacugauggcaacguucaagaugagaccgauguuugcuguuggccuccucuuucgccggcugaccucccgcgaggugcuccugcucaccaucgggcucagcuuaguagccuccguggagcugcccaauagccucgaagaacugggcgacggcuuagcgaugggcaucaugauccucaagcuacugaccgacuuucagucacaccagcucugggccacgcuucugagccucacauucaucaagaccaccuucagucugcacuacgccuggaagacaauggccauggugcugagcaucguuucccucuucccccugugccuguccaccacuucccagaagaccacguggcuccccgugcucuugggcaguuuggggugcaaaccacugaccauguuccugaucgcggagaauaagaucuggggccgccguuccuggcccuugaacgaggggaucauggcgguggggaucgucagcauucuccugagcucgcuucucaaaaacgaugugcccuuggccgggccgcucauugcuggcggcaugcuaaucgccugcuacgugaucucagggucauccgcggaccuguccuuggagaaagccgcugaagugagcugggaggaggaggccgagcacuccggcgcuagccacaacaucuuggucgaggugcaggacgaugggaccaugaagaucaaggacgaggagcgggacgauacccuaaccaucuugcucaaagcgacgcugcucgccgucaguggcguguacccgcugagcauccccgccacguuauuugugugguacuuuuggcagaaaaagaaacagcguuccggaguccucugggacacccccagcccgcccgagguggagcgggcugugcuggaugacggcauuuaucgcaucaugcagcggggacugcuggggcgcucccaggucggcguggggguguuccaggagaauguuuuccauacgauguggcacgugacccggggcgccguucucauguaccaggggaagcgccuggagccuagcugggcaucagucaagaaagaccugaucucguacggcggcgguuggcgguuacaggggaguuggaacaccggggaggagguacagguaaucgccgucgagccaggcaagaaccccaaaaacgugcaaaccgcccccgggaccuucaaaacacccgagggggaggugggcgccaucgcccuugacuucaaaccagggacgagcggcagucccaucgucaaucgcgagggaaagaucguuggccuuuacggcaacgggguugucaccaccucuggcacguacgugagcgcgauagcccaggccaaagccucccaggaggggccucucccugagaucgaggaugagguguuccgaaagcgaaaucugaccaucauggaccugcaccccggcuccggcaagaccagacgcuaccuccccgcaaucguccgugaggccauaaaaaggaaguugcgcacacugauccucgcaccuacccgggucguggccuccgagauggccgaggcucugaagggcaugcccaucagauaccaaaccaccgccgucaagagcgagcauaccggcaaggagaucgucgaccugaugugccacgccacguucacgaugcgacucuuguccccgguucgugucccuaacuacaacaugaucaucauggacgaggcccacuucacggacccuagcuccaucgccgcucggggguacauaucgaccagggugggcaugggagaggccgcggccaucuucaugacggccacaccacccggcuccguugaggcguuuccgcagagcaacgccguaauacaggaugaggaacgggacauccccgagcgcuccuggaacagcggguacgaauggauaaccgacuucccuggcaagacugugugguucgugcccucaaucaagagcggcaacgacaucgccaauugcuugcggaagaacgggaagcgcgugauucagcugucacggaagaccuucgauacugaauaucagaagaccaagaacaacgacugggacuacguggugaccacggauauaagcgagaugggcgcuaacuuccgcgcagaucgggucaucgacccccgccggugccugaaaccagugaucuuaaaggacgggccggaaagggugauccuggccggccccaugccgguaaccguggccuccgcggcccagcgccgcgggcguaucggccgcaaccacaauaaggagggggaccaguacaucuacauggggcaaccccugaauaacgacgaagaucacgcucacuggaccgaggcgaaaaugcuucucgacaacaucaacacuccagaggggaucaucccagcacuguucgagccugaacgcgagaagucugcagccaucgacggagaguacaggcugaggggcgaggcgaggaagacguucgucgaguugaugcggcgcggagaccuccccguguggcuguccuacaagguggcgagugaaggcuuccaauacucagaucgccggugguguuuugauggcgagcgcaacaaccagguucucgaggagaacauggacgucgagaucuggaccaaggagggggagcggaagaaacuucgccccagauggcuggacgcgcgcaccuacuccgacccccucgcacugcgggaguucaaggaguucgccgcgggcagacggagcgucuccggggaucugauccuagagauuggcaaguuaccgcagcaucugacgcaacgagcccagaacgcccucgacaaccuggugaugcugcauaauagcgagcaaggcggccgcgccuaucgucacgccauggaggagcuccccgacacgaucgagacccuaaugcuguuagcacugauugccgugcugaccggcggggugacccucuucuuucuguccggccggggacugggcaagacuagcaucggccuccucugcgucauggccuccucggugcugcucuggauggcuuccguggaaccccacuggauugcugccagcaucauccuggaguucuuccugauggucuuacucauuccggaaccggaccgucagcggacgccccaggacaaccagcuggccuacgucguaaucgggcuacucuucaugauccucaccgucgccgccaacgagaugggccuccuugagaccaccaagaaggacuuagggaucggacacguagcgguggagaaccaucaccacgcagccaugcuugacgucgaucugcaucccgcuuccgccuggacgcuguacgcuguggccaccaccaucaucacuccgaugaugcgccacaccaucgaaaacacaacugcgaauaucagcuugaccgccaucgccaaccaggccgccauucucauggggcuugacaagggcuggcccaucucgaagauggacaucggcgucccccuacuggcgcuggggugcuacucucaggucaacccccucacgcugaccgcugcggugcugaugcucguugcgcauuacgcaaucauuggccccgggcugcaggccaaggccacgcgcgaggcacagaagcggaccgccgccggcaucaugaagaaccccacggucgacgggauuguggccauagaccuggacccggugguauaugaugccaaguucgagaagcagcucggccagauuaugcugcugauccucugcaccucccaaauccugcuuaugcgcaccaccugggcguugugugagagcaucacucuggccacgggcccccugacuacccugugggaggguucgccgggcaaauucuggaacacuaccaucgccgugagcauggcaaacaucuuucggggguccuaccuggcgggagccggccuggcguucucacucaugaagucacucgggggcgguaggcggggaacgggggcccagggggagacccugggcgagaaauggaaacgccaauugaaccaguuauccaagagcgaguucaacacguacaaacggagugggaucauggagguggaccgcagcgaagcaaaggagggacugaagcgcggggagacaaccaagcacgccgugucccgcgguaccgccaagcuccggugguucguggagcgcaaccuggugaagccugaaggcaaggucauagaccugggcugcggucgcgggggcuggagcuauuacugcgccggcuugaagaaggugacggaggugaagggcuauaccaaggguggcccgggccacgaggagcccauccccauggcaaccuauggguggaacuugguaaaacugcacagcggcaaggacguuuucuuuaucccgcccgagaagugugacacccuguuaugcgacauaggggaaagcucccccaacccgacgauagaggagggacgcacgcuccgggugcugaagauggucgagcccuggcucagggguaaccaguucugcaucaagauccuuaacccauacaugccgagcgugguggaaacacuggaacagaugcagcggaagcacggugggaugcucgugcgcaauccucugucccggaacagcacccaugagauguacugggucuccugcgggacuggcaacauagugagcgccgucaacaugacgucccguaugcuucucaaccgcuuuacgauggcccaccguaagcccaccuaugaacgcgacguggaucugggcgccggaacccggcacguggcugucgaaccugaaaucgccaaccuggacaucaucggacagcgcaucgagaacaucaagcacgagcacaaaagcacguggcacuacgaugaagacaaccccuauaagaccugggccuaccacggauccuacgaggugaaaccgagcggcuccgcgagcagcauggugaacggggucgugaaguuacugaccaagcccugggacgucaucccgauggugacucaaaucgccaugacugacacgacccccuucggccagcaacggguguucaaggagaaaguugacacucgcacaccgaaggccaaacggggaacggcccaaaucauggaagugacugccaaguggcuuugggguuuccucuccaggaacaagaagccccgcaucuguaccagggaggaguucacgcgaaaggugagaaguaacgcugcuauaggcgccgucuucguugacgaaaaucaguggaacagcgccaaagaggcuguggaggacgaacgauucugggaccugguccacagagagcgugaguuacauaaacaggggaaaugcgcgaccugcgucuacaacaugaugggcaagcgcgagaagaagcucggggaguuuggcaaagcuaaagggucacgggccauaugguauaugugguugggcgcccgcuuuuuggaguuugaggcgcucggcuuuaugaacgaggaucauugguucucacgcgagaacagccugucagggguggagggugaagggcugcauaagcucggauacauccugcgcgacauuagcaagauccccggugguaauauguaugccgaugauacagcgggcugggacacucgcauuacggaggaugaccugcaaaacgaagcucgcaucaccgacaucauggaggccgagcacgcacuccuggccaaguccaucuucaaacugaccuaucaaaacaagguggugaggguacagcggccggccaaaaacgggaccgucauggacgugaucagccgcagggaccaacgcgguuccggccaggucgggacguacggccugaauacguuuaccaacauggaggcgcagcugauccggcagauggaaagcgaagggaucuuuucgcccucagaacuugaaacaccgaaccuggccgagcgcguccuggacuggcuggagaaguacggcguggagcggcuuaaacgcauggcaauuuccggggacgacugcgucguaaagcccauagacgaccgguucgccacugcauugaccgcccuaaacgacaugggcaaagugcggaaggacaucccgcagugggagcccucgaagggcuggaacgacuggcagcagguucccuucugcucccaccacuuccaccaacucaucaugaaggacggccgggagauaguugugcccugccgaaaccaggacgagcuggucggacgcgcucgcgugagccaaggggcgggauggucucugagggagaccgcgugcuuaggcaaaaguuaugcccagauguggcagcugauguauuuccaucgcagagaccugaggcuagcggcuaaugcaauuugcagcgccgugccaguggacuggauccccaccuccaggacgaccuggagcauccacgcccaccaccaguggaugaccacagaggacaugcuauccguauggaaccggguauggaucgaggagaaucccuggauggaggacaaaacgcacaucucgaguuggggugacguacccuaccuggggaagcgcgaggaccaaugguguggcagccuuaucggccuuaccgcccgggcgaccugggccacaaauauccaaguggccauuaaccaagugcgccgguuaaucgggaacgaaaauuacuuagacuacaugaccucuaugaagcgcuucaagaaugaaggcgacccggagggggcucugugguaa

SEQ ID NO: 24577 - RNA, 9879 nt, Artificial Sequence
  derived and/or modified CDS sequence (opt11) from DENV-1__EU482501__SS-prME
agcguaacuaugcuguuaaugcugaugccaaccgcucuugcuuuccaucucaccaccagaggcggggaaccccacaugaucgucuccaagcaggagcgggguaagagccuccuguucaagaccagcgcagggguaaacauguguacccucauagccauggaccugggcgagcugugcgaggacaccaugaccuacaaaugcccccggaucaccgagacggagcccgacgacguagacugcuggugcaaugcuacggacaccugggucacuuacgggaccugcagccagacuggcgagcaccggcgcgacaagagguccguggcccucgcgccgcaugugggccuugggcuggagaccagaaccgagaccuggaugagcuccgagggcgccuggaagcaaauccaacggguggagacaugggcccuccgccaccccggcuucaccgucaucgcccuguuccuggcacacgcgaucgguaccucgaucacccaaaaggguauaauuuucauucuccugaugcuggucacacccuccauggccaugcggugugucggcaucgguucucgcgacuuuguagagggccucucaggagccacauggguggacgucguucuugagcacggcuccugcgugaccacaauggcgaaggacaagcccacauuggacaucgaguugcugaagaccgagguuacuaacccggccgugcuccggaagcucuguaucgaggcgaagauuuccaauacaacgaccgacagucgcugcccgacccagggcgaagccaccuuaguggaggagcaagacgccaauuucgugugccggcguacguuugucgaccggggcugggggaacggcugugggcuguucggcaaggggucccucaucacaugugcuaaauucaagugcgugaccaaacuggaggggaagauaguucaguacgagaaccugaaguauagcgugaucgucaccguccauacgggcgaccagcaccaaguggggaaugagucuaccgaacacggcaccacagcuaccaucacgccccaggcgcccaccaccgagauucagcucaccgacuacggggcauugacgcucgacugcagcccccgcacaggccucgauuucaaugagaugguccugcugacuaugaaagagaagaguuggcucguucacaagcagugguuccuggaccugccccuccccuggaccagcggggcaucuacgucacaagaaacuuggaaccggcaggaccugcuagugaccuuuaagaccgcccacgccaagaaacaagaggucguggugcugggcagccaggagggggcgaugcacacggcccucaccggggcuaccgagauccaaaccucuggcacgacaaccauuuuugccgggcaccuuaagugccgccuuaagauggacaagcucacacugaagggcaugagcuaugucaugugcacgggauccuuuaaacucgagaaggaggucgccgagacccagcacggcacagugcugguccagaucaaauacgagggcaccgacgcacccugcaagaucccuuucucgacccaggacgagaagggagugacccagaacggccggcugaucacggcuaacccgaucgugacugacaaggagaagccugucaacauugaggccgagccucccuuuggcgaguccuacaucgugaucggagccggcgagaaagcgcugaagcuaaguugguucaaaaaaggguccagcauagguaagauguuugaggccaccgcccgcggggcccgcaggauggccauccugggcgacacugcaugggacuucggauccaucggcggcguguucaccagcguugggaaguuagugcaccagaucuucggcaccgcguaugggguccucuuuucuggggucagcuggacgaugaagaucgggaucggcgugcugcugaccuggcuuggacugaauucccguuccaccucccugagcaugacuugcaucgccguggggcucguaacucuuuaccugggcgugauggugcaagcggacuccgggugcguaaucaacuggaaaggccgggaacucaagugugggaguggcauuuucgugaccaacgaggugcacaccuggacugagcaguauaaauuccaagccgauucaccgaagcgccugucagcggccaucgggaaggccugggaggagggugucugcggcauccggagugccacccgguuagagaacaucauguggaagcaaaucucuaacgagcucaaccacauucuguuggagaacgauaugaaguucacuguggucgucggggacguggccggcauccucgcgcaagggaagaagaugauccggccccagccaauggaguacaaguacucguggaaguccuggggcaaggccaagaucaucggggccgacgugcagaacacaaccuucaucaucgaugggccgaauacuccggagugucccgacgaccagagagccuggaacaucugggagguagaggacuacggcuucgggaucuucacgaccaacauauggcugaagcugcgggacagcuauacccaagugugcgaccacagacucaugagcgcggccaucaaggacucgaaggccgugcaugcggacaugggcuacuggaucgaguccgagaagaacgaaacuuggaagcuggcccgggcguccuuuaucgaggucaagaccugcaucuggccgaagucccacacgcuguggagcaacggcguccucgagucagagaugauaauucccaagaucuacggggguccgaucagccagcauaacuaccgucccggguacuucacccaaaccgcaggccccuggcaucuggggaaguuagaacucgacuucgaccugugcgagggcacgaccguggugguagacgagcacugcggcaaccgggggccgucacuucguaccaccacggugaccggcaagaucauucacgaguggugcugccggagcugcacacugccgccccugcgcuucagaggcgaggacggcugcugguacgggauggagauccgaccugucaaggagaaggaggagaaccuggugaaguccauggugucggccggcagcggcgaggucgacagcuucagccucgggcugcucugcaucuccaucaugauagaggaggugaugcggagcagauggucccgaaagaugcucaugaccggcacguuggccguguucuuccugcucaucaugggucagcugacguggaacgaccugauucgccucugcaucauggucggcgcaaacgccagcgaccgcauggggauggggacuaccuaucuggccuuaauggcuaccuucaaaaugcguccaauguucgcuguaggguuacuguucaggagacugaccuccagagaggugcuccugcugaccaucggguugagccuggucgccuccguugagcugcccaacucgcucgaggagcucggggacgggcucgcgauggggaucaugauacucaagcuguugaccgacuuucagucacaccagcuuugggccacgcugcugucucugaccuuuaucaagaccaccuucaguuuacacuaugcuuggaagacgauggccaugguccugagcauagugagccucuucccccugugcuuguccaccacgucccagaagacaacguggcuccccguucugcuggguagcuuaggguguaagccguuaaccauguuucugaucgcggagaacaagaucuggggucggcgguccuggccccucaacgaaggcaucauggcagucggcaucgugagcauucuccugucuucgcuccugaagaaugacgugccucuugccgggccccucaucgccggcggcaugcugaucgccuguuacgucaucagcgggucgagcgcggaccugucccucgagaaggcggcggagguuaguugggaggaggaagccgagcacuccggcgccagccacaacauucugguggagguccaggacgacgggaccaugaagaucaaggaugaggagcgggacgacacccugaccauccuacucaaggccacgcugcucgccguuuccggcgucuacccgcugucgauccccgccacucuguucgucugguacuucuggcagaaaaagaagcagcgcucaggggugcucugggacacccccagcccgcccgaggugggccgggccgugcuggacgacggcaucuaucggaucaugcagcggggucugcugggccgcagucagguggggguaggcgucuuccaggagaacguguuccacaccauguggcacgugacacgcggagccguccucauguaccagggcaagcgacuggagccaucgugggcguccgugaagaaggaucugaucagcuacggcgggggguggcggcuccagggguccuggaacaccggcgaggagguacagguaaucgccguggaacccggcaagaaucccaagaacgugcagacggcaccgggcaccuucaaaacgcccgagggcgaggugggggcgaucgcgcuggauuucaagcccggcaccagcggcucccccauaguuaaccgcgaaggcaagauagugggacuguacgguaacggcgucgugaccaccagcgggacguaugugagcgcgaucgcccaggccaaggccucucaagaggguccgcuccccgagaucgaagacgagguauuucggaagcgcaaccugaccauaauggacuuacaccccgggagcggaaagacucgucgcuaccucccagcgaucgugcgggaggccauaaagcgcaagcugcgcacccuuauauuggcgcccacgcguguggucgcuuccgagauggccgaggcgcugaagggcaugcccaucagguaccagacuaccgcagucaagagcgagcacaccggcaaggagaucguggaucugaugugucacgcgacguucaccaugcguuuacuaucgcccguccgcguuccgaacuacaauaugaucaucauggacgaagcccauuucaccgauccaagcuccauagccgcgcggggcuacauuucgacacgcguggggaugggggaggccgccgccaucuucaugacggccacgccgcccgggagcguugaggcguucccgcagagcaacgcugugauucaagaugaggagcgugacauccccgagagauccuggaacagcggcuaugaguggaucaccgacuuuccgggcaagaccgucugguucguccccucgauaaagagcgggaaugacaucgccaacugccugcggaagaacggcaagcgcgucauccaguuaucccggaagacguucgacaccgaauaucagaaaaccaagaacaacgauugggacuacguggucaccacggacaucagcgagaugggggccaacuuccgcgcggaucgggugaucgacccgaggaggugccugaaaccggugauccucaaggacggcccagagcguguaauuuuagccgggccuaugccgguaaccguugccuccgccgcgcaacggagaggccggaucggccgcaaccacaacaaggagggagaccaauauaucuacaugggccaaccccugaauaacgaugaagaccacgcgcacuggaccgaggccaagaugcugcucgacaacaucaauacucccgaagggaucauccccgcccuguucgagccggaacgcgagaaguccgcggccaucgacggcgaguaccgguuacgcggcgaggcgcguaagacguuuguggagcucaugcgccggggggaccugcccguguggcuguccuacaaggucgcguccgagggcuuccaguauagcgaccgccguuggugcuucgacggggaacgcaacaaucaagugcuggaggagaacauggacgucgagauuuggaccaaggagggagagcggaaaaagcugcgcccucgguggcuggacgcccgcaccuacuccgacccccucgcccuccgggaauucaaggaguucgcagcggggcgacggaguguguccggcgacuuaauccucgagauaggcaaacuaccgcaacaccugacccagcgugcccagaacgcccucgacaaucuggugaugcugcacaacagcgaacagggugggcgugccuaucgucacgcgauggaagagcuccccgacacaaucgagacucugaugcugcuugcccugauugccgugcugaccgggggcgucacacucuucuuccugucugggcggggccuggggaagaccagcaucgggcuccucugcguuauggccuccagcgugcucuuauggauggccuccgucgagccccacuggaucgcugccagcaucauccuugaauucuuccugaugguguugcugaucccggaaccggacagacagcggacgccccaagacaaccagcuggccuacguggucaucggccuccuguucaugauccugacuguggcugccaacgagauggggcuccuggagaccacgaagaaggaccugggcaucgggcacguggcggucgagaaucaccaccaugcagccaugcucgauguggaccugcacccggccucggccuggacgcuguacgcgguggcgaccacgauuauuaccccuaugaugcgccacacgaucgaaaacaccacagccaacauaagccucaccgccaucgccaaccaggcggccauccucaugggccucgacaagggcuggcccaucuccaagauggacauaggggucccccuacuggcccugggcuguuacagccaagugaacccauugacgcugacugcugcgguacugaugcuggucgcccauuaugccaucauugggccgggccuccaggccaaagccacacgcgaggcgcagaaacggaccgccgccgggaucaugaagaacccgacgguggacggaaucguggcgauagaccuagaccccgugguguaugaugccaaguucgagaagcaacugggccagauaaugcuucugauccucugcaccucucagauccugcugaugcgcaccacgugggcgcucugcgaaagcaucacccuggccaccggucccuuaacuacucucugggagggcuccccgggaaaguucuggaacacgaccaucgccgugagcauggccaacaucuuccgcggcuccuaccuggccggcgcggggcuggcguucucacucaugaagucccucggcgggggccgccgggguaccggagcccagggagagacccugggugagaaguggaaacgacaacuuaaccagcuguccaaguccgaguucaacacuuacaagcgauccgguaucauggaaguagaccggagcgaggccaaggagggguuaaagcgcggggagaccaccaagcacgccgugucccgcgggaccgccaaacugcggugguucguagagcgcaaccuggucaagcccgagggcaagguaaucgacuuaggcugcgggcggggcggcuggagcuacuacugcgccggccugaagaaagugacagaggugaagggguacaccaagggcggcccagggcaugaggagcccaucccgauggcuaccuacgguuggaaccucgugaaacugcacagcgggaaggacguguucuucauaccgccagagaagugcgacacgcugcucugcgacaucggcgagagcucgcccaacccgacgauagaggaagggcguacccugcggguccugaagaugguggagccgugguuacgcggcaaccaguucuguauaaagauccucaaccccuacaugcccagcguagucgagacgcuggagcagaugcagaggaagcauggcgggaugcucgucaggaacccgcugucacggaacagcacccacgagauguacuggguguccugcggcaccggcaacaucgucucagcagugaauaugacgucccgcaugcuucucaaccguuucaccauggcgcaccggaagcccaccuaugagcgcgacguggaccugggagccggaacuaggcaugucgccguagagcccgagguggccaaccuugacaucaucggccagcgcauugagaacaucaagcacgagcacaagagcacguggcacuaugacgaggacaaccccuauaagaccugggccuaccacggcuccuaugaggucaaacccagcggguccgccagcucuauggugaacggagucgucaagcuccugacuaagcccugggacgugauccccaugguuacccagauagccaugacggacaccacacccuucgggcaacaacggguguucaaagagaaaguggacacacgaacaccgaaggcuaagcggggcacagcccagauuauggaaguaaccgcgaagugguuguggggcuuccucucccgcaacaagaagcccagaaucugcacucgcgaagaauucacgcggaagguaaggagcaacgcggccaucggggccguguucguagacgagaaccaauggaacucggccaaggaggcaguugaagaugagcgguucugggaucugguacaucgcgagcgggaacuccauaagcagggaaagugcgcaaccugcgucuacaacaugauggggaagcgcgagaagaagcucggcgaguucgggaaagccaaaggcucacgggccaucugguacauguggcugggggcacgcuuucuggaauuugaggcgcugggauucaugaacgaggaccacugguucucucgggaaaacagccugaguggcguggagggagagggacuacacaaacuaggguacauccugcgcgacaucagcaagauccccggcggcaacauguaugccgacgacacagcagggugggacaccaggaucacggaggaugaccugcaaaacgaggcccgcaucacggacaucauggaaccggaacacgccuuauuagcaaagaguauauucaaacuuaccuaccaaaacaaggugguccgagugcaacggccugccaagaauggcaccgugauggacgucauuagccgccgggaccagcgcggcuccggacagguugguacauacgggcuuaacaccuucacgaacauggaagcgcagcuuauccggcagauggaaagcgaggggauauucucccccagcgagcuggagacccccaaccuagccgagcgcguucuggacugguuagagaaauacggagucgagcggcucaagcgcauggcuaucuccggggaugauugcgugguaaaaccgaucgacgaucgguucgcuacggcccugaccgcccugaacgacauggggaaggucaggaaggacauuccccagugggagccaagcaaaggcuggaacgacuggcagcaagugcccuuuuguucccaccauuuucaccagcucaucaugaaggauggucgggaaaucguggucccgugccgcaaccaagacgagcuggugggacgcgccagggugagucaaggcgccgguuggagccugcgugagaccgcgugccucggcaaguccuacgcccagauguggcaguugauguacuuucacaggcgagaucugcgccucgccgcaaaugcgaucuguagcgccguccccguggacuggauacccaccucacggacaacauggagcauccacgcccaccaccaguggaugacgaccgaggacaugcugucuguuuggaaucgcguauggaucgaggagaaccccuggauggaggacaagacgcacaucagcucauggggcgacgugccguaucugggcaagcgcgaggaccaguggugcggaucucugauagggcugaccgcccgcgccaccugggcgacgaacauacagguggccauaaaccaggucagacggcugaucggcaacgagaauuaccucgacuacaugaccuccaugaaacgcuucaagaacgagagcgacccagagggggcgcugugguaa

SEQ ID NO: 24578 - RNA, 9879 nt, Artificial Sequence
  derived and/or modified CDS sequence (opt11) from DENV-1__EU482504__SS-prME
ucuguaacgaugcuucuaaugcuaaugcccacggcacuggcguuccaucucaccacgagagguggggaaccccacaugauugugagcaaacaagaacgugggaaaagccuccuguuuaaaacgagcgcgggcguaaacauguguacccucauagcaauggaccuaggagaauuaugcgaagauacaaugacguacaaaugcccccgcaucaccgaaaccgaacccgacgaugucgauugcugguguaacgcgacagacacauggguaaccuacgggacgugcucgcagacgggcgaacaccgaagagauaaacggagcgucgcgcuagcuccccacgucggccuaggacuggagacacgaacggaaacuuggaugucaucggaaggggcguggaaacagauccagcgcgucgagaccugggcccucaggcacccugguuucaccguaaucgcgcuguuccucgcacacgccaucggaaccagcaucacacagaaagggaucaucuucauccuacuaaugcuuguuacuccguccauggcgaugcgguguguagggaucggaucacgggauuuuguugagggacucuccggagccacguggguggacguuguacuagagcacggaucaugugugacaacgauggccaaagacaaaccgacucuagauauagagcuccugaaaacagaaguaacgaauccagccguccuaagaaaacuaugcaucgaagcaaagauuuccaauacaaccacggacagccgaugcccaacacaaggggaagcgacccugguagaagaacaagaugcaaacuucgugugucggcgcacguucgucgaccggggguggggaaacggcuguggacucuucgggaagggaaguuuaauaaccugugcgaaauucaaaugcgugacaaaacucgaaggaaagaucguacaguacgaaaaccuaaaauacuccguaaucguaaccguacacaccggggaccagcaucaagucgggaacgagucgaccgagcacggaacaaccgcuacaaucacgccccaagcucccacgacggaaauccagcuaaccgacuacggggcgcugacacuggauugcucaccgcgaacgggccucgauuucaaugaaaugguccuacuuacuaugaaggagaaauccugguuggugcacaagcagugguucuuagaccuaccccucccguggacgucgggcgccagcaccucacaggaaacguggaaccgucaggaccugcuagugacauuuaaaacagcgcacgcgaaaaagcaagaagugguagugcucggaucgcaggaaggagcaaugcacacagcccucacaggugccacggagauacagacaucgggcacaaccaccaucuucgcggggcaccugaaaugccgccuaaaaauggauaaacuuacacucaagggcaugucauacgucaugugcacugggucuuuuaaacuagaaaaagaggucgccgaaacgcagcacggaacgguacuuguccaaauaaaauacgagggaacagacgcaccgugcaaaauaccuuucaguacgcaagaugagaagggcgucacacagaacgggcgacuaaucacggcaaaccccauagucacagauaaagaaaagccuguaaacauagaagcugaaccaccuuucggagaaucguauaucguuaucggagccggugaaaaagcguuaaaauugagcugguucaagaaaggaucguccaucggaaaaauguucgaagcaacugcgaggggcgcgagaagaauggccauacuaggcgacaccgcuugggacuucgggucgaucgguggaguguuuacguccgucggaaaacucgugcaucaaaucuucggaacggcauacggcguucuauucagcggcgucucguggaccaugaaaauugggauaggagucuuacucacgugguuaggguugaacagcaggucuacauccuuaagcaugacaugcaucgcagugggacucgucacgcuauaccuugggguaaugguccaagcggacucgggcugugucauuaacuggaagggaagagagcuaaaaugugggaguggaauauucgucaccaacgaagugcacacauggacagaacaauacaaguuccaagccgacucaccaaaacggcuauccgcagcaaucggcaaggccugggaagaaggcguuugcggaauaagaagugcgacacgacucgagaacauuauguggaaacagauuucgaaugaauuaaaccacaucuuacuggagaacgacaugaaauucaccguaguagucggagaugucgccggaauacucgcgcagggaaagaaaaugauucgcccccagccgauggaauacaaguauagcuggaaaaguuggggaaaagccaagauuaucggagcggacgugcaaaauacuaccuucauaaucgacggccccaacacgccagagugcccagacgaucagcgcgccuggaacaucugggaaguagaagacuauggauuugggaucuuuacaaccaacaucuggcugaaacuacgagacuccuauacccaaguaugcgaccacagguuaaugagugccgcaaucaaagauaguaaggccguacacgcagacaugggguacuggauagagucagagaaaaaugaaacguggaagcuagcccgagcguccuuuauagagguaaaaacgugcauauggccgaagucccacacauuauggucaaacggaguccuggaauccgaaaugauaaucccuaaaaucuacggcgggccaaucucgcaacacaauuaccgaccgggcuacuucacgcaaacagcuggccccuggcacuugggaaaacuugagcuggacuucgaccugugcgagggcacaacgguagugguggaugagcacugcggcaaccgaggacccucccuacgaaccacaaccgugacagggaagaucauccaugaauggugcuguagaucgugcaccuugccaccccugagguucagaggagaggacggcuguugguauggaauggaaauaagaccagugaaagaaaaggaagagaaccucguaaaauccauggucucugcgggaaguggugagguugacagcuucagccugggacuccuuugcaucucgauaaugaucgaggaaguaaugcgaaguaggugguccagaaagauguuaaugacaggcacgcucgcgguauucuuccuccuaauaaugggccaacuaacauggaaugaucuaauaagacuaugcauaaugguaggcgcgaacgcaucugaucggauggguaugggaacgacauaucuggcucucauggcuaccuuuaagaugcggccgauguucgcgguaggccuccuguuccgacgccucacgagcagagagguucuauuacucaccaucgggcuuagucuaguagccagcguggagcucccgaacagccuugaagaacugggggacggucuagcgauggguauuaugauccugaaacuguuaacagacuuccaaagucaccagcucuggguaacgcuccucagcuugacauucauaaagacgaccuuuucgcugcacuaugcuuggaagacaauggcaauggugcuaucaauagucagccucuucccacuaugccuaucaacaaccagccaaaagacgaccuggcugccgguccugcuagggucucugggcugcaaaccauugacaauguuucucauagcagaaaauaaaauaugggggcgcagaagcuggccauugaacgagggaauuauggccgucgggauagucuccaucuuauuaucgucccuccucaaaaacgacguaccacuagcgggaccgcuuauagcaggcggcauguugauagccugcuaugugauaagcgggagcagcgcagacuuaucacuggaaaaagcagcugaaguaagcugggaggaagaagcagaacauucaggagcuagccacaacauccuaguagaaguccaagacgacggaacgaugaagauaaaagacgaggaacgcgaugacacucucaccauacuccuaaaagccacucuacucgcaguaucuggggucuacccccuaagcauuccggcuacccuauucgugugguacuucuggcaaaagaaaaagcaaagaaguggaguccugugggauacgccgaguccgcccgaaguagaacgcgcaguguuggacgaugggaucuaucgaaucaugcaacgaggccuguuggggcggucgcaaguggggguggggguauuccaagagaauguuuuccauaccauguggcacguaacaagaggggccguacucauguaccaggguaagcggcucgaaccgucuugggcaagcgugaagaaagaccuaauaaguuacggcgggggauggaggcuccagggcucuuggaauacgggugaagagguacaagucauagccguugaaccagggaagaacccuaagaacguacaaacugcccccgguacguucaaaacacccgagggagaagucggagcgaucgcuuuggacuucaagccaggaacuagcgggagcccgauagucaaucgggagggcaaaauagucggauuauacggcaacggaguagucacaacauccggcaccuauguaagugcaaucgcucaagcaaaagccucacaagaagggcccuuaccugagauagaggacgaagucuuuagaaaacggaaccucacgaucauggaccuccaccccggcucuggaaaaacuagacgguaucugcccgccaucguucgggaagcaaucaaacguaaacucaggacacugauccuugcuccgacccgaguggucgccagcgaaauggcggaggcguugaaaggcaugccaauaagauaccaaacgacagcaguaaaguccgagcacaccggaaaagaaauuguggaccucaugugucaugcgacauuuacaaugagacugcuaucaccgguaagggugcccaacuacaauaugaucaucauggaugaggcucacuuuacggacccuaguucaaucgcagcacggggcuacaucucgacaagggugggaaugggcgaagcggcagccauauuuaugaccgcuacaccacccggguccgucgaggcuuucccucaaagcaacgcagucauccaagaugaggaacgggacauuccggagaggucguggaacucgggguacgaauggauaaccgacuucccugggaagacagucugguuuguccccagcaucaagucugggaaugacaucgcaaacugccuacgcaagaacgggaaacgaguaauccaacucagccggaaaacguucgacaccgaauaccagaagacuaaaaacaacgauugggacuaugucguaacuaccgacauuagcgaaaugggagcuaacuucagagccgauaggguuauagauccgcgcagaugccucaaaccaguaauauugaaagacggucccgagcggguaauacuggcaggaccuaugccggucaccgucgccagugccgcacagaggcgaggccguauagggcggaaccauaacaaagaaggcgaccaauacauauacaugggacaaccauugaauaacgacgaggaccacgcacacuggacagaagcaaagaugcuccuggacaauauuaacacccccgaagggaucaucccagcacucuucgaaccagaacgagagaaaagcgcugcuaucgauggggaauaccggcuaaggggagaagccagaaaaacuuucguggaguugaugaggcgcggagaccuccccguauggcucagcuacaaaguggcaagcgaaggauuccaguacagcgaucgccgguggugcuucgacggagagagaaauaaccaaguucuagaggagaacauggacguagagauuuggacaaaggagggcgaacgaaagaaauugcggccgcggugguuagacgcucggacauauagcgauccccuggcacuccgcgaguucaaagaguucgcagcgggaagacgcucggucucuggagauuuaauaagugagauaggcaagcucccacaacaucuuacacaacgcgcucaaaacgcauuagacaaccuggugaugcuucacaauucggaacaagggggacgugcguaucgccaugcaauggaagaacuaccggacacaauagagacuuuaaugcugcuagcacucaucgccguucugaccggaggggugacccuauucuuucuaagcgggcgcggccucggaaagacguccaucggacugcuaugcguaauggccuccucaguacuccuuuggauggcaucaguugaaccacacuggaucgccgccaguaucauauuggaguucuucuuaaugguccuucugaucccagagcccgaccgacagcguacaccacaggacaaccagcuagccuauguggugauugggcuacucuucaugauacuaacggucgccgcgaacgaaauggguuugcucgaaacaaccaagaaagaccugggaauuggacacguagccgucgaaaaccaccaccaugccgcuaugcuggauguagaccugcacccagcuucugcguggacguuauacgcagucgcaacgacgaucauaacgccaaugaugcgucacacgaucgagaacaccaccgccaacaucucccuaacagcaauugcuaaccaagcggcaauacugaugggccucgacaagggcuggcccauaucaaaaauggacauagguguuccccuuuuagcacugggauguuacagccaagugaacccacucacgcucacagcagcgguccuaaugcugguggcccacuacgcaaucaucgguccaggguugcaagcaaaggcaacucgcgaggcacaaaaacggacagcggcaggaauuaugaaaaacccgacagucgacggcauagucgcuauagaccuggaccccguugucuaugaugcuaaguucgaaaaacagcuagggcaaaucauguuacucauacuauguacaagucaaauacucuuaaugcgaaccaccugggcccugugcgagagcauaacacuggcaaccggcccgcuaacaacacuaugggagggaagcccggguaaguucuggaacacuacuaucgccgugagcauggcgaacauuuuuagggggaguuaccucgcgggcgcgggacuugcguuuucccuaaugaaaucacucgguggcggccgcagagggacuggcgcacagggggaaacccuaggggaaaaguggaaacgucaacuuaaccaguuaaguaagucagaguucaauaccuauaaaagaucugggaucauggagguggaucggagcgaagccaaagaaggacugaaacggggagaaacuaccaaacacgccguuuccaggggcaccgcgaaauuacguugguucgucgaacgaaauuuagugaagcccgagggcaagguuauugaucuaggcugcggacggggcggcuggagcuacuacugcgcuggguuaaagaaaguaacggaagugaaaggguacaccaaagggggaccgggccacgaggagcccauccccauggcaacguacggcuggaaccuagucaaacuccacucgggcaaagacguauucuuuauaccacccgaaaaaugcgauacgcuccuuugcgauaucggcgaauccagccccaacccaaccaucgaggaggggcgcacgcuuagaguccuaaaaaugguggagccaugguuaagggggaaccaauucugcaucaaaauccugaacccguacaugccaucgguaguagaaacacuggaacaaaugcaaaggaaacauggcggcaugcuaguuagaaacccacucucgcgaaacucgacccacgaaauguauugggucucgugcggcacgggaaauaucguuagcgcagugaacaugacgucacgaaugcuucuaaacagauucacgauggcacaccgcaaaccgacguacgagagggacgucgaccucggggcggggacacggcauguggccguggagccagaaguagcgaaucucgauaucauaggacaaagaauugaaaacauuaaacacgaacacaaaucuacguggcacuacgacgaagacaauccguacaagacaugggccuaccacggcagcuacgaagugaaaccguccgggagcgcgagcuccaugguaaacgggguagugaagcuccuaacgaaacccugggacguaauacccauggucacccaaaucgccaugaccgauacuacacccuuugggcagcaacgcguauuuaaagagaaggucgauacccggacgccaaaggccaagcgcgggacagcgcagaucauggagguaaccgcgaaguggcuauggggauuccugagcagaaacaagaaaccacggaucuguacgcgggaagaguucacccgaaagguacgcagcaacgcggcaaucggagcaguauucguagacgagaaccaauggaacucggccaaggaagcagucgaggacgagagauucugggaccuaguacaccgcgaacgcgagcugcauaaacagggaaaaugcgcuacaugcguauacaacaugaugggaaaaagagagaaaaagcucggagaguucggcaaggccaagggcucacgugcgauuugguauauguggcucggcgcacguuuccucgaguucgaggcccuuggguuuaugaacgaagaucauugguuuagccgcgaaaacagucucucagggguggagggagaaggauugcauaaacuaggauacauacucagagacauaaguaaaauaccgggcggaaacauguaugccgacgacacugccggcugggacacccggaucacggaagacgauuuacagaaugaagcccgaaucacugauauaauggaacccgagcacgcgcuucuugcaaaaagcaucuuuaaacuaaccuaccagaacaaggucgugcgaguccagaggccagcuaagaacggaacgguaauggacguaaucucccgcagagaccaaagggggagcggacaagucgggacauacggacucaauaccuucaccaauauggaggcgcagcuaauacgacaaauggagagugaaggcaucuucuccccaagugaacucgagacaccaaaccuugccgaacgaguucucgauugguuagaaaaauacggaaucgaaaggcuaaaacgcauggccauaucgggugacgauugcguagugaaacccaucgacgauagguucgcgaccgcuuuaacagcccucaacgacaugggcaaaguacguaaggauauaccacaaugggaaccaucgaaaggguggaacgacuggcagcaagucccuuuuugcucccaccacuuccaccagcucauaaugaaagacggaagggaaauaguaguuccgugccggaaccaggaugaacucgucggcagagcccgaguaagccaaggcgcuggguggucccuaagagagaccgcaugccuagggaaaucauaugcgcaaauguggcaguuaauguacuuccaucgcagagaccuacggcuagccgcaaacgcgaucuguuccgcagucccaguagacuggaucccaacauccagaacuacgugguccauacacgcccaccaucaguggaugacgaccgaggacaugcuaagcguauggaauaggguguggaucgaagaaaaccccuggauggaagauaaaacgcauaucagcagcuggggcgacguuccauaucuggguaaacgggaggaccaauggugcggcucccucaucggccucacggccagagcuaccugggcaaccaacauacaagucgccaucaaccaagucagacggcugaucggcaaugagaacuaccuagacuacaugacaucaaugaaacgcuucaaaaacgagagcgacccggaaggagcccuuugguga

SEQ ID NO: 24579 - RNA, 9879 nt, Artificial Sequence
  derived and/or modified CDS sequence (opt11) from DENV-1__EU482505__SS-prME
agcgugaccaugcugcucaugcugaugcccacagcgcuggccuuccacuugacgacccggggcggggaaccucacaugaucguguccaagcaggagcggggcaagagccugcuguucaagacauccgcgggggugaacauguguacccucauugccauggaccugggcgaguucugcgaggacacgaugaccuacaagugcccccgcaucaccgaagccgagcccgacgacguggauugcuggugcaaugccaccgacacgugggucaccuacgggaccugcucucagaccggggaacaccggagggauaagcgguccguggcauuggcgccgcacgugggccuggggcuggaaacgcgcacggaaaccuggaugagcuccgagggagcguggaagcagauacagcgggucgaaaccugggcucugcgccauccgggguucacggugaucgcccuuuuccuggcgcacgcgaucggaaccagcauuacucagaaggggaucaucuucauccugcucaugcuggugacgcccuccauggccaugcggugcguuggcaucggcagccgcgacuucguggaggggcugaguggcgccacguggguugacgucguccucgagcacggcagcugugugaccaccauggccaaggacaagccgacccuggauaucgagcugcucaaaacagagguaacgaaccccgcgguucugagaaaacugugcaucgaggccaagaucuccaacaccaccacggacagccgaugcccgacccagggcgaagcuacccucguggaggaacaagacgccaacuucguaugccgccgcaccuucguggaccggggaugggggaacggcugcgggcuguuuggcaagggcucccugaucacgugcgccaaguucaaaugcgugaccaagcucgagggcaagaccguccaauacgagaaccugaaguacucugugaucgugacuguccacacgggcgaccagcaucagguggggaacgaguccaccgagcacggcaccaccgcgaccaucacgccccaggcccccucaaccgaaauucagcugacagacuacggcgcccuaacccuggacugcagccccagaacaggccuggacuucaaugaaaugguccuccugacaaugaaggagaaggccuggcuggugcacaaacagugguucuuggaccugcccuuaccauggaccucaggggccagcacaucccaggagacguggaaccggaaagaccuucugguaacguuuaaaacugcccacgccaagaagcaggaggucguggugcugggcagccaggagggagcaaugcauaccgcucuuacgggggcaaccgagauccagaccuccggcaccacgaccaucuuugcaggccaccugaaaugccgccugaagauggacaaguugacgcugaagggcaugagcuacgucaugugcaccggguccuuuaagcuggaaaaggagguggcugagacccagcacggaaccgugcucguacagauaaaguacgagggcaccgacgcaccaugcaagauccccuucagcacccaggacgagaagggggugacgcagaacggccggcugaucaccgccaacccgaucgugaccgacaaggagaagcccgucaauaucgaggcggagcccccguucggggaguccuacaucguuaucggcgccggcgaaaaggcacugaagcucagcugguucaagaaggguuccaguaucggcaagauguucgaagccacugcccgcggggcacggcguauggccauacuaggggauaccgccugggacuucggguccaucggcggcguuuucaccucggucgggaagcugguacaccagaucuucggcacagcguacggugugcuuuucucgggcgucaguuggaccaugaaaaucgggaucggcguauuacugacgugguuaggccucaauucucgcagcaccucccugucgaugaccugcaucgccguggggcuugucacccucuauuuaggugugaugguucaggcggacucugggugcgugaucaacuggaagggccgggagcuaaagugcgggagcggcauauucgugacaaaugaggugcauaccuggacggagcaauauaaguuccaggccgacucaccgaagcgcuuguccgccgccauugggaaggccugggaggagggcgucugcggaauccggucagcgacacgccuggagaauaucauguggaagcaaauuuccaacgagcugaaccacauacuccuggagaaugauaugaaguucaccgugguggucggcgacguggccggcauacuggcacaggggaagaagaugauucgcccacagccuauggagcauaaguacagcuggaaaagcuggggaaaggccaaaaucaucggggcagacguucagaacgcgacguucaucaucgacgggcccaacaccccggaaugcccggaugaccagcgcgccuggaacaucugggaggucgaggacuacggauucgggaucuucaccaccaacaucuggcucaaguuaagggacucuuacacucaaguuugcgaccacagacugaugucggccgcuauuaaggacaguaaggcugugcacgcagauaugggcuauuggauagaguccgagaagaaugagaccuggaaacucgcccgagccaguuucauugaggucaagaccugcaucuggcccaaaucucauacgcuguggagcaacggcguucuggagucggagaugauuauccccaagaucuacggcgguccgaucagccaacacaacuaccgccccggguacuucacucagaccgcuggccccuggcaccucgggaagcuggaguuggacuucgaccucugcgagggcaccaccguggucguggacgagcacugcggcaaccggggaccguccuugcgcacgacaacggugaccggcaaaauaauccacgaaugguguugccggagcugcacgcugccgccccugcgcuucaagggugaggacggcugcugguacggaauggagauccggcccgucaaggagaaggaggaaaaccuggugaaguccauggugagcgcuggcagcggcgagguggacuccuucagccuggggcuccucugcaucuccaucaugauagaagaagugaugcgcagccgguggucccgaaaaauguugaugaccggcacccucgccguguucuuccugcugaucauggggcagcucaccuggaacgaccugauccggcuaugcaucauggucggcgccaacgccagcgaucgcauggggaugggcacaacguaccucgcccuaauggcgacuuucaaaaugcggccgauguucgcuguggggcuccuguuccggcgccugacgucgcgcgagguauuacuccuuaccaucgggcugagccucgucgcuuccguggaacugcccaauagccuggaggagcucggcgacggacuggcaaugggcauaaugauucuuaaguuacuuaccgacuuccagucccaccagcucugggcgacccuccugagccugacauuuaucaagacgacauucucucuccauuacgccuggaagacaauggcuaugguccuguccaucgucucccucuucccccucugucuaagcaccacgucccagaagaccacuugguuacccguacuccugggcagccuggggugcaagccuuuaaccauguucuugauagccgaaaauaagaucuggggucguaagagcuggccccugaacgagggaaucauggccgucggcaucguuucaauccuccuuagcucccuccucaagaacgacgugcccuuagcugguccgcugaucgccggaggcaugcucaucgccugcuacgucaucagcggguccagcgccgaucugucccuggagaaggccgcggaggugucuugggaggaagaggcagagcacuccggcgccagccauaacauccucguggagguccaagacgauggcaccaugaagaucaaggacgaggagcgggacgacacccugaccauccuacucaaggcuacacuguuagccguauccggcguuuacccgcucucgauccccgcgacccuguucgucugguacuucuggcagaaaaagaagcagagaucggggguccugugggacacgcccuccccgcccgagguggagcgggccgugcucgacgacggcaucuaucgaaucaugcagcggggcuuacuggggcgcagucaggugggcguuggggucuuccaggagaacguguuccacaccauguggcacgugacccggggcgccguccugauguaccaaggcaagcgccucgagcccagcugggcuuccgugaagaaggaccugaucagcuacggaggaggguggcggcugcaaggcagcuggaauaccggggaggaggugcaggucaucgcaguggaacccggcaagaacccuaagaacgugcagacggcgcccgggaccuuuaaaaccagcgagggagaggucggcgccaucgcccuggacuucaagcccgggaccuccggcagccccaucguuaaccgcgaggggaagaucgugggucuguacgguaauggggucgugacgaccagcggcaccuacguguccgccaucgcgcaagccaaggccagccaggaggggccgcucccugagauugaagacgaggucuuccgcaagcggaaccucacgaucauggaccugcacccgggcuccggcaagacgcggcgcuaucugcccgccauagugcgggaggccaucaagcgaaaacuaagaacccugauccuagcgccgacccgcguggucgccagcgaaauggccgaggcccucaaaggcaugcccauccgcuaccaaaccacggcugugaaguccgaacacaccggcaaggagaucguggaccugaugugccacgcgaccuucaccaugagacuguuaagccccguccgcgugcccaauuacaacaugauaaucauggacgaggcccacuucacggacccguccucgauagcugcccggggguacaucuccacucgggugggcaugggagaggcugcggcaauauucaugacagcuacuccgcccggcagcgucgaggcuuucccacaguccaaugcaguaauccaggaugaggaacgugacauuccugagcgcagcuggaacuccgguuacgaguggaucacggacuucccgggcaagaccgugugguucgucccaucaauaaaguccggcaacgacaucgcuaauugccugcggaagaacgggaagcgcgugauccaacugucacggaaaaccuucgacaccgaguaccagaaaacuaagaacaacgacugggauuacguggucaccaccgacaucagugagaugggcgccaacuuucgcgccgaucgggucaucgacccgcgccgguguuuaaagccugugauccugaaggacgggcccgagcgcgucauacuggccggccccaugcccgugaccguggcgagcgccgcccagcggcgcgggcggaucggccgcaaccacaacaaggagggugaccaguacaucuacaugggccagccgcucaacaacgaugaggaccacgcccacuggacggaggccaagaugcugcuggacaacaucaacacacccgagggcaucauccccgcacuguucgagcccgagcgggagaagucagccgccauagacggggaauaccgcuuacgcggggaggcacggaagacauucguagagcugaugcgccgaggggaccucccggugugguuaagcuacaaggucgccagcgagggguuccaguacuccgaccgccggugguguuuugacggggagcgcaacaaccagguucuagaggagaacauggacguggagaucuggaccaaggaaggagagaggaagaagcuccgcccccguuggcuggacgcgcgcacuuacucagacccccuggcacuccgggaguucaaggaguuugccgccggccgccgauccgucuccggggacuuaauacuggagaucggcaaguuaccccagcaccugacccagcgcgcgcagaacgcuuuggacaaccucgugaugcugcacaacuccgaacagggcggucgggccuaccgccaugccauggaggaacugccggacaccaucgagacccucaugcugcuugcccuaauugcggugcuaacgggcgguguuacacucuucuuccucagcggccgggggcucggcaagaccuccaucggacugcucuguguaauggccagcuccgugcugcucuggauggccuccgucgagccccacuggaucgcggccuccaucaucuuagaguucuuccugauggugcuccucauaccagagccagaccgccagcggacuccgcaggacaaccaauuagcguauguggucaucggccuguuauucaugauccuaaccguggccgccaacgagaugggguuauuggaaacgaccaaaaaggaccuggggaucggccacguggccgucgagaaccaccaccacgccgcgaugcuagacguagaucugcacccagccagcgcauggacccuguacgccguagcaaccacgaucaucacccccaugaugcgacacacuaucgagaauaccacggcgaacauauccuuaacggccaucgcgaaccaggcggccauccucaugggguuggauaagggcuggccaauuagcaagauggacaucggcgucccucugcucgcccuggggugcuacucucaggucaauccgcugacccucaccgccgccgugcugaugcucgucgcccacuacgccaucauuggucccgggcuucaggccaaggcuacacgggaggcgcagaagcgaaccgccgcaggaaucaugaagaauccaaccguugacgggaucguggccaucgacuuggaccccgucguguacgacacaaaguucgagaagcagcugggacagaucaugcuccugauccuuugcacgagccagauccuucugaugcggaccaccugggcccuaugcgaguccaucacccucgcgacgggccccuuaaccacucugugggaggggagccccggcaaguucuggaacaccacgaucgccguguccauggcgaacaucuuccgggggucauaccucgccggcgccggccucgccuucagccucaugaagucgcucgggggcgggcggcggggcaccggagcccagggcgagacucugggcgagaaauggaagcgccaacugaaccaacuaagcaaauccgaguucaacaccuacaagcggagcgggaucauggaggucgaccggucggaggcgaaggagggccugaagcgcggggagacgaccaaacacgcagugagccgcggcaccgccaaguugaggugguucguggagcgcaaccucgugaagccugaggggaaggugaucgaccugggcugcggcagaggcgggugguccuacuacugugccgggcugaagaaggugaccgaggucaagggguacacgaaggguggccccggucacgaggaacccauacccauggcgaccuacggcuggaaccuggugaagcuccacagcggcaaggauguuuucuucauuccacccgaaaaaugcgacacucugcuaugcgauauaggggagucuagcccuaaccccaccauugaggagggccgcacgcuccgggucuuaaaaaugguggagccguggcugcgcgggaaccaguuuugcaucaagauucucaacccuuacaugcccucgguagucgagacgcuggagcagaugcagcggaagcacggcggcaugcuggugcgcaacccccucucuagaaauuccacccacgagauguacugggugagcuguggcaccggcaacaucgucuccgccguaaacaugaccagccgcaugcugcugaaccgguucacgauggcccaccgcaaaccuaccuacgaaagggacguggaccucggggccggcaccagacacgucgccguggaaccggagguggcgaaccuggacauaauugggcagcggauugagaacaucaagcacgagcacaaguccaccuggcacuacgaugaggacaauccguacaagacgugggccuaucacggaagcuacgaggucaaacccuccggaagcgcaagcuccauggugaauggggucguuaagcugcucacuaagcccugggaugugaucccgauggucacccaaaucgcaaugaccgacacgacccccuucggccagcaacggguguucaaggagaagguggacacgcgcacccccaaggccaagcggggaacggcccaaauuauggaggucaccgccaaguggcuguggggauuccugagccgcaauaagaagccucggaucugcacccgcgaggaguucacccggaaggugcgcagcaacgcugccaucggcgcgguguucgucgacgagaaccaguggaacagcgccaaggaggcgguggaggaugagcguuucugggaucucgugcaccgggagcgggaacugcacaagcagggaaagugcgccacaugcguauacaacaugaugggcaaacgcgagaagaagcugggggaguucgguaaggccaaagggucacgggcgauuugguacauguggcucggcgcccgcuucuuggaguucgaggcccugggauucaugaacgaggaucacugguucaaccgggaaaacagccucuccgggguggagggcgagggacugcacaagcucggcuacauccuccgcgacaucucaaagauucccgggggcaacauguacgcugacgacacagccggcugggacacacgcaucacagaggacgaccugcagaacgaagcgaagaucacggacaucauggagcccgagcacgcccuguuggccaagaguaucuuuaaguugacauaccaaaacaaggugguacgagugcaaagaccggccaagaacgggaccgugauggaugucaucagccgccgcgaccagcgggggucgggccaggugggcaccuacggucucaacacguucacgaacauggaggcucagcucauacgacaaauggagucagaagggaucuucucccccagugagcuggagacccccaaccuggcgggucggguccucgacuggcuggagaagcacgggguugagcgcuugaagcggauggccaucuccggcgacgacuguguggugaaacccaucgacgaccgauucgccacagcgcucaccgcccuaaacgacauggggaagguccggaaggacauaccgcagugggagcccagcaagggguggaaugauuggcaacagguccccuucugcucucaccauuuccaccagcugaucaugaaggacggacgcgagaucguggucccaugucggaaccaagacgaacucguggggagggcccgcgugagccagggcgcaggguggagcuuacgcgaaacggccugucuggggaaguccuacgcccagauguggcaacucauguacuuccaccggcgcgaucugagacuggcggccaaugccaucugcagugccgucccaguggacugggugccuacuucgcgcaccacguggagcauacaugcccaccaucaauggaugaccaccgaggacauguuauccguguggaaccggguguggauugaggagaaccccuggauggaggacaagacccauauaagcucguggggcgacgugccguaccugggcaaacgcgaggaccaguggugcgggagccugaucggacucacggcucgggccaccugggccaccaacauccagguugccaucaaucaagugcgccgccugaucgguaacgagaacuaucuggacuacaugacuuccaugaagagauuuaaaaacgaaaucgacccggagggcgcccuaugguga

SEQ ID NO: 24580 - RNA, 9879 nt, Artificial Sequence
  derived and/or modified CDS sequence (opt11) from DENV-1__EU482506__SS-prME
agcgugacuaugcugcugaugcugaugcccaccgcccuagccuuccaccucaccacucgggguggugaaccccacaugauagugagcaaacaggaacgggguaagagccugcuuuucaagaccuccgcuggggugaauaugugcaccuugaucgcgauggaucugggugagcugugcgaggacacuaugaccuauaaaugcccgagaaucaccgagaccgagcccgaugauguagacugcugguguaacgcgacggauaccuggguaaccuaugggacauguagccagacgggcgagcaucggagagacaaacgguccgucgccuuggcaccccacguuggacucggucuggagacccgcaccgagaccuggauguccagcgagggcgcguggaagcaaauccaacggguggaaaccugggcacuccgccaccccggguucaccgugaucgcccuauuuuuggcucacgcgaucggaacuagcaucacacaaaagggaauuaucuucaucuugcugauguuaguaacgcccuccauggcgaugcguugugucggcaucggcucgcgggacuucgucgagggguuaaguggcgccacuuggguagacgucgugcuggagcaugguucaugcgugaccaccauggccaaggacaagcccacgcuggauaucgagcuccugaaaacagagguuaccaaucccgccguccuucgaaagcucuguauugaagcgaagaucucgaacacaacgaccgacagccguugcccgacucaaggcgaggccacccugguggaggagcaggaugccaacuuugucugccggagaacuuucguggaucgaggaugggggaauggcugcgggcuguuuggcaagggaucccucaucacgugcgccaaguucaagugcgugacuaagcuggagggcaagauaguucaguacgagaaucugaaguacagcguuauuguuaccguacacaccggcgaccagcaccaaguggggaaugaaucaaccgagcacggcaccacggccaccauuacaccccaggcgccgacaacugagauccagcugaccgacuacggggcgcugacgcuggacuguagcccuagaaccggccucgacuucaaugaaaugguccugcugaccaugaaggagaaguccuggcuagugcacaaacagugguuccucgaccuuccccuccccuggacgucaggagccagcacgucacaagagaccuggaaccgacaggaccugcucgugacguucaagacggcgcacgcgaagaagcaggaggucguggugcucggcagccaggagggugcuaugcauacagccuuaaccggcgccacugagauccaaacgaguggcacgaccaccauuuucgcuggacaccugaagugccggcucaagauggacaaguugacccugaagggaaugucauacguaaugugcacaggcuccuucaaguuagagaaggaaguagccgagacacaacacgggacagugcugguccaaauaaaguacgaggggaccgaugcacccuguaagauccccuucuuaacgcaggacgagaaaggcguaacccagaacgggcgguuaaucaccgcaaacccuaucgugaccgauaaggagaaacccgucaauaucgaggccgagccgcccuucggcgaaucguauaucaucaucggcgcaggggaaaaagcccuuaagcuauccugguucaagaaaggaucauccaucggcaagauguuugaagccacggcccgcggggcucgccgcauggccauccugggcgacaccgcgugggacuucgggagcaucgguggcgucuucaccucuguggggaaguugguccaccagaucuucggcaccgcuuacgggguguuguucagcgggguuuccuggacgaugaaaaucgggaucggcauccuccucacguggcuuggguuaaauucgcgcuccaccagucuauccaugaccugcaucgccgucgggcucgugacccuguaccucggcgugaugguucaggccgacagugggugcguuaucaauuggaagggacgggagcugaagugugggaguggcaucuuugugaccaacgaaguucacacuuggaccgagcaguacaaguuccaggcggacagcccgaaacgccuaagcgcggcuaucggaaaagcaugggaggagggggugugcggcaucagguccgcgacacgccucgagaacaucauguggaagcaaaucagcaaugagcugaaccacauccuccuugaaaacgacaugaaguucacgguggucgugggggacguggccggaauacuggcccaggggaaaaagaugauccggccacagcccauggaguacaaauacucguggaaguccuggggcaaagccaagaucaucggcgcagauguccagaacaccacguucaucauagacgggccaaacacuccggagugccccgaugaucagcgugcguggaacauaugggaaguggaagacuacgguuucgggauuuucacgaccaacaucuggcugaaacuccgggacuccuacacacaggugugcgaccaccgccugaugagcgcggcaaucaaggacucuaaggccguccacgccgacaugggcuauuggauugagucugagaagaacgagaccuggaaacuagcccgcgcgagcuuuaucgaggugaagacguguauuuggccuaaaagccauacccucugguccaauggugugcucgaguccgagaugaucauccccaagauauaugggggcccuaucucgcagcacaacuaccgccccggguacuucacccagaccgcagguccuuggcaccugggcaagcucgagcuggacuuugauuuaugugagggcacaaccgucgugguugacgagcauuguggcaaccggggcccgucacuccgcaccaccacgguaaccggcaaaauuauucaugaguggugcugccggucgugcacccuaccgccucugcgcuuccgcggugaggauggaugcugguacggcauggagauccgccccgugaaagagaaggaggagaaccucgucaagaguaugguguccgccggcucaggggaaguggauagcuuuuccuuagggcuauuaugcauuucgauuaucaucgaggaggugaugcggagccgcuggagucggaagaugcugaugaccggcacacuggcagucuucuuucuucuuaucaugggccaacugacuuggaacgaccugauccggcugugcaucauggugggcgccaacgcguccgaccgcauggggauggguaccacguauuuggcguugauggccacguuuaagaugcggccgauguucgcugugggccugcuguuccgccggcucaccucccgcgagguacugcuacucacaaucgggcuguccuugguggccagcgucgagcuccccaacucccuggaggaacuuggcgacggacuugcgauggggaucaugauucucaagcugcucaccgacuuccagagccaccagcugugggcuacgcugcuguccuugaccuuuaucaagaccaccuuuagucuccacuaugccuggaagacgauggcuauggugcucuccauaguuucucuuuucccccugugccucucaacuaccagccagaaaaccacgugguugcccguccugcucggcagucucggcugcaaaccacucacuauguuccucauagcggagaacaaaaucuggggacggcgaagcuggccauuaaacgaggggaucauggcagucggcaucgucuccauccuccucagcagcuuacugaagaacgaugucccguuagcggggccguugaucgccgguggcaugcugaucgcguguuacgugaucuccgguagcuccgcggaccucucacuggaaaaggccgccgaaguuuccugggaggaggaggcggagcacuccggcgcaucccacaacaucuuggucgaagugcaggacgauggcaccaugaaaaucaaggacgaggagcgggacgacaccuugaccauccuguugaaggcaacgcucuuagcagugagcgguguuuacccccuguccauacccgccacccucuucguaugguacuucuggcagaagaagaaacaaagaagcgggguccugugggacacccccagcccgccggaggucgagcgggcaguguuggacgacggcaucuaccgaauuaugcagcggggccugcucgggcgcagucaggugggcgucgguguguuucaggagaacguguuccacacuauguggcacguuacacgaggggccgugcugauguaccaggggaagcgccuagagcccucuugggcgagcgugaagaaggaccuuaucuccuacggcggcgguuggcggcuucagggcucguggaauacgggagaggagguccaggugauugccgucgagcccgguaagaaccccaagaacguacagacagcccccgggacuuuuaagaccccggagggcgaggugggugccaucgcccucgauuuuaagccggggaccuccggcagccccaucgugaaccgcgaggggaagaucgucgggcucuacggcaacgggguggugaccacgagcgguacguacgucagcgcuaucgcacaggccaaggcuagccaggaggggccgcuccccgaaaucgaggacgagguguuccguaagcggaaccugaccaucauggacuuacaccccggcuccgggaagacccggcgcuaccugccggcgaucgugcgggaggccaucaagcgcaaacugaggacccuuauccuugcacccacgcggguuguagccagugaaauggccgaggcgcugaagggcaugccgaucagauaccagacgacagcugugaaguccgagcauacgggcaaggagaucguugaccugaugugccacgccacguuuacaaugcggcuguuaagccccgugcgugugcccaauuacaacaugaucaucauggacgaggcccacuucacggacccgaguagcauugcugcgcgcggguacaucuccacccgcguuggcaugggugaagcugcagccauuuucaugacugcuacgccacccggcagcguggaggcuuucccccagucaaacgccgugauccaagacgaggagcgcgauauccccgagaggaguuggaauaguggcuacgaguggaucaccgacuuccccggaaagacugucugguucgugcccagcaucaaguccgguaacgacaucgcaaacugccucaggaagaacggcaagagagugauacaguuaagcaggaagacguuugacaccgaauaccagaaaaccaagaacaacgacugggacuacguagugaccacggacaucucggagaugggggccaacuuccgcgccgaccgagucaucgauccaagacgaugccugaaacccguuauccuuaaggacgggcccgaacgcguuauccuugccggaccgaugccgguaacugucgccucggccgcccaacgccguggcagaaucgggcgcaaccacaacaaggagggcgaccaguauaucuauauggggcagccuuuaaacaacgacgaagaccaugcgcacuggaccgaggccaagaugcuccuagacaacaucaacacaccugagggcaucauccccgcccuguucgagccugagcgcgagaaguccgcagccauugacggggaguaccgcuuacgaggagaggcgcggaaaacguucguagaacugaugcgacgcggggaccugcccgucuggcuuuccuauaaggucgccuccgaaggcuuccaguauagcgaccgccgguggugcuucgacggugagagaaacaaccagguuuuggaggagaacauggacgucgagauuuggaccaaggaaggggagcgcaagaagcugcgacccagauggcucgacgcgcgcaccuacagcgauccccuggcccugagagaguucaaggaguucgccgcaggccgccggaguguuucaggcgaccuuauucuggagaucgggaagcugccacagcaccucacccagcgcgcucagaaugcacuggacaaccuggugaugcuucacaauagugagcaaggagggagagccuaccgccaugcuauggaggaguuaccggauaccaucgaaacauugaugcuacuagcacugaucgccgucuuaaccggcggagucacgcuguuuuucuugagcggacgggggcucggcaagaccuccaucggguugcugugcguaauggcaagcuccgucuugcuguggauggcaagugucgagccccacuggauugcugccuccauaaucuuagaauuuuucuuaaugguacugcugauccccgaaccggaccgccagaggacgccccaggacaaucagcucgccuacgucgugaucgggcugcuguucaugauccucacgguugccgccaaugagaugggccuacucgagaccaccaagaaggaucuugguaucggccacgucgcggucgagaaccaucaccacgcugccauguuggauguggaccuacaccccgccuccgcauggacauuguacgcagucgccacuacaaucaucaccccgaugaugcgccacacgaucgagaacacaacagccaauauaagccugaccgccauagccaaccaagcggcgauauugauggggcucgacaagggcuggccuaucucaaagauggacaucggggugccucugcucgcacucgggugcuacucucaggugaacccccucacguugacugccgccguucuaaugcugguggcccacuacgccaucaucggcccggggcugcaggccaaagcaacccgcgaggcgcaaaaacgcaccgccgccggcauuaugaagaaccccacuguggacgggaucguggccaucgaccucgacccggugguguacgacgcgaaguucgagaagcaacuuggccagaucaugcuacuuauucugugcacuagccagauauugcucaugcguaccaccugggcgcugugugagagcaucacgcuggccaccggccccuuaacuacccuaugggaagggagcccgggcaaauucuggaauaccaccauagccgucuccauggcuaacaucuuucgggggagcuaccuggccggcgccggccuggcuuuuucccugaugaagucauuaggcggagggcgccgagggacgggugcccagggcgaaacacucggcgagaaguggaagcgccaacucaaccagcugucuaaaucugaguucaacaccuacaagcggagcgguaucauggaaguggacagguccgaggccaaggagggccugaaacgcggggagaccacgaaacacgcugucucgcgcggaaccgcuaagcugcggugguucgucgaacgcaaccuggugaagcccgaggggaaagugaucgaccugggcuguggccgcggcggguggagcuacuauugugcuggacuaaagaagguuacugaggugaagggguauaccaaagggggcccaggucacgaggagccgauucccauggcuaccuacgguuggaaucuugugaagcugcacucaggcaaggacgucuucuucaucccacccgagaagugugacacccugcugugcgauauuggggaguccagccccaauccgacgaucgaggagggccgcacccugcgagugcuuaagaugguggaacccugguuacgcgggaaccaauuuuguauaaaaauucucaaccccuauaugcccuccgucgucgagacacucgagcagaugcaaaggaaacacggcggaaugcugguaagaaacccguuaucuaggaacuccacccacgagauguacugggugagcuguggaaccggcaauaucgugucggccgugaacaugacgucucguaugcuccucaaccgcuucacgauggcgcaccguaaacccaccuaugagcgugacguugaccuuggggccggcacgcggcacguugccguggagccagaggucgccaaccucgacaucauuggccaacgcaucgagaacauuaagcacgagcauaaaucaacguggcacuacgaugaagacaacccuuauaagaccugggccuaccacgguagcuacgagguaaaaccguccgguagcgcguccagcauggugaaugggguagugaaacuucugaccaagccuugggacgucauccccauggugacucagaucgccaugacggacacaaccccguuugggcaacagcggguuuucaaagagaaggucgauaccaggacgccgaaagccaaacgggggaccgcccaaaucauggaggugacggccaaguggcucuggggcuucuuaucgaggaauaagaaaccccggaucugcacacgcgaggaguucacccggaaagugcguuccaacgcggccauaggugcgguuuucguugacgagaaccaauggaacuccgcuaaggaggcgguggaggacgaaagguucugggaccugguucaccgcgagcgugagcuccauaaacagggcaagugcgcgaccuguguauauaacaugaugggcaagcgcgagaagaagcugggcgaguucggcaaggccaaagggucccgugccaucugguacauguggcugggcgcucgcuuccucgaguucgaagcgcugggcuucaugaaugaggaccacugguucucgcgggagaacaguuuaucggguguggaaggcgaggggcuccacaaacuaggcuacauucucagagacaucuccaagaucccagggggcaacauguacgcagacgauaccgcuggcugggacacgcggaucaccgaggacgauuuacagaacgaggcccgcaucacugauaucauggagccggaacacgcccugcuugccaagagcaucuucaaacuuacuuaccagaacaagguugugcgcgugcaacggcccgccaagaaugggaccgucauggacgucauaucccggcgggaccagcgugguucgggccagguggggacguacggccugaacacguucaccaacauggaagcucagcugauccggcaaauggaguccgaagggaucuuuagccccuccgaguuagagacucccaaucuggccgagcgcguacuagauuggcuugagaaguacggaguggaacggcugaagcgaauggcaaucagcggggacgacugcguggucaagccgaucgaugaccgguucgcgacggcacugaccgcacucaaugacaugggaaaggugagaaaagacauaccccaaugggaacccuccaagggguggaaugacuggcagcaggucccuuucuguucacaccacuuccaccagcugaucaugaaagacggucgggagaucguagugcccugcaggaaccaggaugaacuggugggccgugccagggucucccagggggccggauggaguuugcgggagaccgcgugccugggcaaguccuacgcacagauguggcaacugauguacuuccaccgacgggaccuccgccuggccgcgaaugcgauaugcuccgcggugccgguagacuggauccccaccagccguacgaccugguccauccaugcccaccaccaauggaugacgaccgaggacaugcugucugucuggaaccggguguggaucgaggagaaucccuggauggaggacaagacgcauauaucaagcuggggugaugugccguaccucggaaaacgcgaggaccaguggugcggcagccugaucggccugaccgcucgggccaccugggcgacuaacauccaggucgcuaucaaccaggugcgccggcucauaggaaacgagaacuaucuggacuacaugaccagcaugaagcgauucaagaacgagggcgaccccgaaggugcccugugguaa

SEQ ID NO: 24581 - RNA, 9879 nt, Artificial Sequence
  derived and/or modified CDS sequence (opt11) from DENV-1__EU482509__SS-prME
agugugaccaugcugcugaugcuuaugcccaccgcccuggccuuccaccucaccacucggggcggagagccccacaugaucgucagcaagcaggagcggggcaagagccugcuguucaagaccuccgccggugugaacauguguacccucauagccauggaccugggcgaguugugcgaggacaccaugacauacaagugcccccggauaacugagaccgagcccgacgacguagacugcugguguaacgcuacggacaccugggucaccuaugggaccugcucucagacgggcgagcaccgccgggacaagcgguccguggcacuugcgccccacgugggccuggggcuagagacccgcacagagaccuggaugagcuccgagggcgccuggaagcaaauccagcgggucgagacgugggcccuccggcaccccggguuuaccgugaucgcucuauuuuuggcccaugcgaucggcaccagcaucacccagaaggguauuauuuucauccuccucaugcuggugacgcccucaauggccaugcggugcgucggcauaggcagucgggacuucguggaggggcucuccggcgcgaccuggguagaugucguccuggagcacgggucgugcgugaccaccauggcgaaggacaagcccacgcuggacaucgagcuccugaagaccgaggucaccaaccccgccgugcuacggaagcucugcaucgaggcgaagaucaguaacaccacgacggacucacgcugcccuacccagggcgaggcaacacuuguggaggagcaagacgccaacuucgucugccggcgcacguucguagaucgggggugggggaacggaugugggcuguucggcaaggggucccucaucacgugugccaaguucaagugcguuaccaaacuggagggcaagauaguccaguacgagaaccugaaguacagcgugaucgugaccguccauacgggcgaccagcaccagguggggaacgaguccaccgagcacggcaccaccgccaccaucacgccccaggcgcccaccaccgagauccagcucacagauuacggggcccugacgcuggacugcagcccacgcaccggcuuagauuucaacgagaugguccugcugaccaugaaggagaaguccuggcucgugcacaagcagugguuccuggaccugccccuccccuggacuagcggggcuagcacgucacaggagaccuggaaccggcaggaccuucuggugaccuuuaaaaccgcccacgccaagaagcaagaggucguggugcucggaagccaggagggcgcgaugcauacggcccugaccggggcgaccgagauccagaccagcggcacaaccaccaucuuugcgggacaccugaagugccgccugaagauggacaagcugacccugaaaggaaugagcuacgucaugugcacugggucuuucaagcucgagaaggagguggcagagacucagcacggcaccgugcugguccaaaucaaguacgaaggcacugacgcgccgugcaaaauccccuuccugacccaggacgagaagggggugacccagaauggccgacugaucaccgcgaacccgaucgugaccgacaaggagaagccagucaacaucgaggccgagccacccuucggcgaguccuacaucaucaucggcgccggcgagaaggcucucaagcuguccugguucaagaaggggagcuccaucggcaagauguuugaagccacugcccgcggggccagacgcauggcgauccugggcgacaccgcgugggacuucggaucaaucggcggcguguucaccuccgccgggaagcucgugcaccagaucuucggcaccgccuacgggguccuguucagcggcgugucuuggacuaugaagaucgggauuggcguguuguuaaccuggcugggccugaacucccguuccaccagcuuguccaugaccugcaucgccgucgggcuggugacguuauaccucggcgugaugguccaggccgacagcgggugcguaaucaauuggaagggccgggagcugaagugugggucuggcaucuucgugaccaacgagguccacaccuggacagagcaguacaaguuccaggcggacagcccgaaacgccuaagcgccgccaucggcaaggccugggaagaggggguuugcgguauccgguccgccacccgccucgagaauaucauguggaaacagaucucgaaugagcucaaccauauccugcucgagaacgacaugaaguucaccguggucgugggggacguggcgggcauccuggcucaggggaaaaagaugauccggccccagcccauggaguacaaauacuccuggaaguccuggggcaaggccaagaucaucggggccgacguccagaacaccaccuucaucaucgacgggcccaacaccccggagugcccggacgaccagcgcgcguggaacaucugggaaguggaggacuauggcuucggaaucuuuacaacuaacaucuggcugaagcuccgggacuccuacacccagguuugcgaccaccgccugaugagcgccgccaucaaggacuccaaggccguccacgccgacaugggcuacuggaucgagagcgagaaaaacgagaccuggaaguuggcgcgcgcguccuucaucgaggugaagacgugcauauggcccaagucucacacccucugguccaacggcgugcuggagagcgaaaugaucgucccuaagaucuacgggggcccgaucucccagcacaacuacagaccaggguacuucacccagaccgccggccccuggcaucuggggaagcucgaguuggacuuugaccugugugaaggcacgaccguaguggucgacgagcacugcggcaacagagggcccagucuccgcaccaccacgguaacgggcaagaucauacacgaguggugcugccgguccugcacccugccgccccugcgcuuccgcggagaggacggcugcugguacgggauggagauucgccccguaaaggagaaggaggagaaucucgucaagagcaugguuuccgccggcagcggggagguugacagcuucucccuggggcuacucugcaucagcaucauaaucgaggaggucaugcggucccgcuggagccggaagaugcugaugaccgggacucuggccguauucuuccucuuaaucauggggcagcugaccuggaacgaccucauccgccugugcaucaugguaggcgcaaacgccuccgaccgcaugggcaugggcaccaccuaccuagcacugauggcgacguucaagaugcggccgauguucgccgucggccuucuguuccgccggcugaccagccgugaggugcuacugcucaccaucggguugucccugguagcgagcgucgagcucccaaauucccuggaagagcugggggaugggcucgccauggggaucaugauccugaagcugcucaccgacuuccagagccaucagcuaugggcgacgcugcucucccuaacauucauuaagacaaccuucagccugcacuaugccuggaagacgauggcgauggugcucucaaucgucagccuguucccccugugccucuccaccaccucucagaagaccacguggcugccagugcugcuuggcucccuggggugcaagccgcugaccauguuccugaucgccgagaacaagaucuggggacggcgcaguuggcccuuaaacgaggggaucauggccguggggaucgucuccauucugcucagcagccuucugaagaacgacgugccccucgccgggcccuuaaucgccggcgguauguugauagcgugcuacgugaucuccggcagcuccgccgaccucagccuggagaaggccgccgaggucucgugggaggaggaggccgagcacagcggcgcaucccacaacauccugguggaggugcaggacgacgggaccaugaagaucaaggacgaggagcgggacgacacccucacgauccugcugaaggcuacgcuccuggccguuagcggcguguacccucuguccauccccgccacccucuucgugugguacuucuggcagaagaagaaacagcgcuccgggguccugugggacacccccagcccgcccgagguggagcgggccgugcuggacgacggcaucuaccguaucaugcaacggggccuacucgggcgaucacaagucggcguggggguguuccaggagaacguuuuccacaccauguggcacgugaccagaggcgcggugcugauguaccaagggaaacgccuggagcccuccugggccucugucaagaaggacuugauauccuacggcggcggguggcggcugcagggcuccuggaacaccggggaggagguccaggugaucgcgguugagccagggaagaaccccaagaacgugcagaccgcgcccgguaccuucaagacgcccgagggcgaggugggcgccaucgcgcuggacuucaagcccggcaccuccggcagccccauugucaaccgggaggggaagaucgucggccucuacgguaacggggugguuaccaccuccggaacguacgugagcgccauugcccaggccaaggcgagccaggaggggccgcugcccgagaucgaggacgagguguuccggaagcgcaacuugaccaucauggaccuccacccgggcuccgggaagacccggcgcuaccugccggcaaucgugcgggaggcgaucaagcgcaaguugcgcacauugauccuggcuccaacgcgcgugguggccucagagauggcggaggcccugaagggcaugcccauuagguaccaaaccacagccgucaaauccgaacacaccggaaaggaaaucguggaucucaugugccacgccacguucaccaugcggcugcugucacccgugcgcgucccgaacuacaacaugaucaucauggacgaggcccacuucaccgaccccuccagcauagcggccaggggguacaucuccacgcgcgugggcaugggcgaggccgccgccaucuucaugacggcgacgccgcccggcucaguggaggccuucccacaguccaaugccguuauucaggacgaggagcgggauauccccgagcgcagcuggaacuccggcuaugaguggaucaccgacuuccccggcaaaaccgugugguucgugcccagcaucaaguccggaaacgacaucgccaacugccuccggaagaacgggaagcgcgucauccagcugagccguaagacguucgacacagaguaccagaaaaccaagaacaacgacugggacuauguggugaccacagacaucucagagaugggcgcgaacuuccgcgcagaccgggucaucgacccucgcagaugccuuaagcccgugauccucaaggacgggcccgagcgugugauacuggccggcccgaugccggucaccguggccagcgccgcucagcggcgcgggcggaucggucgcaaccacaacaaggagggcgaccaguacaucuauauggggcaaccacugaacaaugaugaagaccacgcccacuggacggaggccaagaugcugcuggacaacaucaacacucccgagggcaucauccccgcccucuucgagccggagagggagaagucugccgcgaucgacggggaguaccggcuccggggcgaggcccggaagacguucgucgagcugaugcgccggggggaccuacccguguggcucagcuacaagguggccucggagggcuuccaauacagcgaccgccguuggugcuucgauggcgaacgcaacaaccagguccuugaggaaaacauggacguggaaauuuggaccaaagagggggagcggaagaaacugcgaccccgguggcucgacgcgcgcacauacagcgacccccuugcccugcgggaauucaaggaguucgcggccggccgccguuccgugagcggggaccucauccuggaaaucggcaagcugccgcagcaccucacccaacgcgcucagaacgcccuggacaaccuggucaugcuccacaacuccgagcagggcggacgggcuuaucgccacgccauggaggagcugcccgacacgaucgagacccugaugcuccuggcccugaucgccguucucacaggcggggugacccuguucuuccugagcggacggggauuaggaaagaccuccaucggccugcugugcgucauggccagcuccgugcuccuguggauggcgagcguugagccccacuggaucgccgccuccaucauccuagaauuuuuccucauggucuugcugauccccgagccugaccgccaacggaccccgcaagacaaccaacucgccuacgugguaaucggacugcuguucaugauccuuaccgucgccgcgaacgagaugggccuucuggagaccaccaagaaagaccucgggaucggccacgucgccguagagaaccaccaccacgccgcgaugcuggacgucgaccugcacccggcaucggcguggacgcucuacgccguggccaccaccauuauuaccccgaugaugcgccacacgaucgagaacaccaccgccaacaucucccugacggcaaucgcgaaccaggccgccauccugauggggcucgauaagggcuggcccaucagcaagauggacaucggcgugccccuucuggcccucgggugcuacucccaggucaacccccugacgcugaccgcggcugugcucaugcuaguggcacacuacgccaucaucggcccgggacugcaggccaaggcgacccgcgaggcucaaaagcggaccgccgccggaaucaugaaaaaccccacggucgacgggaucguggccaucgaucucgaccccguggucuacgacgcgaaguucgagaagcagcugggccagaucaugcugcuuauccugugcaccagccagaucuugcucaugcgcaccacgugggcccugugugaguccauuacgcuggccaccggccccuugaccacccugugggaggggucgccgggcaaguucuggaacacgacgaucgccguguccauggccaacauauuccggggaagcuaccuggcgggcgccggacucgccuucucccuaaugaagucccucgggggcgggcgccggggaaccggggcccagggugagacucucggcgagaaguggaagcgccagcugaaccagcugagcaaguccgaguucaacacguacaagcggagcgggaucauggaaguggaccgcuccgaggcgaaggagggacucaagcgcggggagaccacaaagcacgccgucagccgcggcaccgccaagcugcggugguucguggagcgcaacuuggugaagcccgagggcaagguuaucgaccugggcugcggccgcggcgggugguccuacuacugcgccgggcucaagaaggugacggaagugaagggguacacuaagggcggccccggccacgaggagcccaucccgauggcuaccuacggguggaacuuagucaagcugcauagcggcaaggacguguuuuucaucccgcccgagaagugcgacacccuccugugcgacaucggggaguccagccccaacccgacgauagaggagggacgcacccugcgggugcucaagauggucgagcccuggcugcgcgggaaccaguuuugcaucaagauccugaaccccuacaugccaagugugguggagacccucgagcagaugcagagaaagcacgguggcaugcugguccgcaacccgcucucucggaacuccacccacgagauguauugggugagcugcgggacuggaaacaucguguccgcggucaacaugacgagccgcaugcuccuuaaccguuucaccauggcacaccggaagcccaccuacgagcgcgacguggaccuuggcgccggcaccagacacgucgccgucgagcccgagguggccaaucucgauauuauuggccagcgcauagagaacaucaagcacgaacacaaguccacguggcacuacgacgaggacaaccccuacaagaccugggcuuaccacgguagcuacgagguaaagccguccggcucggccuccagcaugguuaacgggguggucaagcugcugacgaagccgugggacgugauccccauggugacccagaucgccaugacggacaccacccccuucggccagcagcgggucuucaaggagaagguggacacccgcacgccuaaggccaagcgggggaccgcccagaucauggaggugacggcgaaguggcuuuggggcuuccugagccgcaauaagaagccccggaucugcacgcgcgaggaguucacacggaagguccgcuccaacgccgccaucggcgccguguucguggacgagaaucaguggaacucggcgaaggaggcaguugaggacgagcgguucugggaccuggugcaccgcgagcgggagcuccacaagcaggguaagugugcgaccugcguguacaacaugaugggcaagagagagaagaagcugggggaguucggcaaggcaaaagggucgagagccauuugguacauguggcugggcgcgcgcuuucucgaauucgaggcacuaggcuucaugaaugaagaucacugguucagccgcgagaacuccuugagcggggucgagggcgaggggcuccacaagcugggcuacauccugcgcgacaucuccaagauccccggggguaacauguaugccgacgacaccgccggcugggacacucggaucacggaggacgaccuccagaacgaggcccgcauuaccgacaucauggagccggagcacgcgcugcuggccaaaagcaucuucaagcucaccuaccagaauaaaguggugcgcguacaacggcccgccaagaacggcaccgugauggaugugauuuccagacgugaccagcgcggcagcgggcaggucggcacauacggccugaacaccuucaccaacauggaggcccagcugauccggcaaauggaguccgaagggaucuucucucccuccgagcucgagacccccaaccuggcugagcgcguguuagauugguuggagaaguacggaguggaacggcucaagcgcauggcgaucucgggggacgacugcgucgugaagccgaucgacgaccgguucgccaccgcgcucacagcccucaaugacauggggaaggugcgcaaggacaucccccagugggagcccuccaagggguggaacgacuggcagcaggucccauuuugcagccaccauuuccaccaacugaucaugaaggauggccgugaaaucguggugccaugccgcaaccaggacgagcuggucggccgggccagaguuucccaaggcgcgggcuggagccuacgggagacagccugccuggggaagaguuacgcccagauguggcagcugauguacuuccaccgccgggaccuccgcuuggccgcgaacgccaucugcuccgccgugcccgucgacuggauccccaccagccggacgaccugguccauccacgcccaccaccaauggaugacaaccgaggacaugcuguccguguggaaccgcguuuggauugaggagaaccccuggauggaggacaagacgcacaucuccagcuggggcgaugucccguaccuagggaagcgcgaggaccaauggugcggcucccugaucggccugaccgcccgggcgaccugggccaccaacauccagguggccaucaaccaagugcgccgacucaucggcaaugagaacuaccuggacuacaugaccagcaugaagcgcuuuaagaaugagggcgaacccgagggcgcccugugguga

SEQ ID NO: 24582 - RNA, 9879 nt, Artificial Sequence
  derived and/or modified CDS sequence (opt11) from DENV-1__EU482510__SS-prME
agcgucacaaugcuccucaugcugaugcccaccgcucuggccuuucaccucacgacacgagggggggagccgcacaugaucgugagcaagcaggagcguggcaaaagccuucuguucaagacuuccgcaggugucaauaugugcaccuuaauugcuauggacuuaggcgaguuaugugaggacacgaugacauacaagugcccucgaaucacggaaguugaacccgacgacguugacugcuggugcaauaccacggacaccuggguaacauauggcacgugcucgcagacaggagagcaccggcgagacaagcggagcguggccuuggcgccccacgucggccuggggcuggagacucgagcugagacuuggaugagcuccgagggcgcguggaagcaaauucagaaggucgagaccugggcccuucgacacccaggguucacggugaucgcuuuguuccuugcccacgcgaucggcaccagcauaacccagaagggcauuaucuucaucuuacugaugcuggucacgcccucuauggccaugcgcuguguuggcaucggcagcagggacuuuguggaggggcucuccggagccacgugggucgacgugguacuggagcacgggagcuguguaaccacaauggccaaagacaaacccacucuagacauagagcuccuucgcaccgaggugaccaacccagccguacugcgaaagcucugcaucgaggcgaagauaucaaacaccaccacggauuccagaugcccaacccagggcgaagcaacccuggucgaggagcaggaugcuaacuuuguuugccgcaggacuuucguugaccguggauggggcaacggcugcggccuauucggaaaggggucccugauaacgugcgccaaguucaagugcgucaccaaguuagaggggaaaaucgugcaauacgagaaccugaaguauagcgugaucgucacuguccacaccggagaccagcaucaaguaggcaacgagagcacggagcacggaacuacggcgaccauuacgccccaggcgccgacaagcgaaauccagcucaccgacuacggagcucuaacccuggauugcucuccucggaccggacucgacuucaacgaaaugguccuccugacuaugaaagagaagaguuggcuggugcacaaacagugguuucuggaccugccacuccccuggaccagcggcgcguccacuucucaggaaaccuggaaccggcaagaccugcuggugaccuucaagacugcccacgccaagaagcaggaggucgugguccucggcucccaggaaggcgcgaugcauacggcccugacgggggcaacggagauccagaccucaggcacuaccacgauuuucgccgggcaccugaagugccgccucaagauggacaaacuaacgcugaagggcauguccuacgugaugugcacggggucauucaagcuagagaaggaaguugccgagacccagcacgggacaguccugguccagaucaaguaugaagggacugacgcgccuugcaagaucccguucuccacccaggacgguaagggcguuacacagaacggacggcugaucacugccaacccgauagucaccgauaaggagaagcccgucaacaucgaggcagagccgccuuucggcgagagcuacaucgugaucggcgccggggaaaaagcucucaaauugagcugguucaagaagggcagcucuauaggcaagauguucgaagccacugcccggggggcucggcgaauggccauacucggcgacaccgcgugggacuucggcagcauuggcgggguauuuacuuccguaggcaagcuggugcaucagaucuuugggacggccuacggugucuuguucagcggggugucauggacuaugaagauaggcaucggcguccuguugaccuggcucggucucaacagccgcuccacgagccuguccaugaccuguaucgcggugggccucgucacgcuguauuugggggugaugguccaggcugauagcgguugcgucaucaacuggaagggucgggagcugaaguguggaucuggaauauuugucacuaacgagguccauacguggaccgaacaguacaaguuccaagcugacuccccgaagcgccuaucugcagccaucggcaaggccugggaggagggcguaugugggauccgcuccgccacccgccucgagaacauaauguggagacagaucaguaacgagcucaaccacauccugcuggagaacgacaugaaguucacgguggucgugggcgacguggucgggauacucgcgcaaggcaagaagaugauucgcccccaaccaauggagcacaaauauuccuggaaguccugggguaaggcaaagauaaucggggccgacguucaaaacaccaccuucaucaucgacggccccaacaccccggaaugcccagacgaccagcgggccuggaauaucugggagguagaggacuacggguucggcauauucaccaccaacaucuggcucaaacugcgcgacucguacacacaagucugcgaucaucgguugaugagcgccgcuaucaaggacucuaaggccguucacgcugacaugggcuauuggaucgagagcgagaaaaacgaaaccuggaaacuagcucgagccagcuucaucgaggugaagacuugcaucuggccuaagagccacacgcugugguccaauggaguccucgagagcgagaugaucauaccgaagaucuacggugggccgauaucccagcauaacuauaggcccggcuacuucacacaaaccgcggggccguggcacuuggggaaauuggagcucgacuuugacuuaugcgagggcaccacagugguaguugacgagcauugcggaaaccgggguccgagccugcggaccacaaccgugacggggaagaucauccacgaguggugcuguagguccuguacguugcccccccuccgguuuaagggcgaggacgguugcugguaugguauggagauacgccccgucaaggagaaggaagagaaccucgucaaaagcauggugagcgcaggcaguggagagguugauagcuucucccucggccugcuguguaucagcaucaugauugaggaggucaugcggucccgcuggagcagaaagaugcucaugaccggcacccuggccguuuuuuuccugcucaucaugggccagcugacuuggaaugaccugauccgcuccuguaucaugguuggggccaacgccagcgaucggaugggcauggggacgaccuacuuggcacugauggccaccuucaaaaugcggccgauguucgcaguuggguugcuguuccgcaggcugacaucccgcgaggugcuacuucugacgaucggacugagcuuggucgcauccguagagcugcccaacucccuggaagagcucggggauggccucgcgaugggcaucaugauccugaaacuccugaccgauuuucagagcuaucagcuaugggccacgcucuugagccugacuuucaucaagacgacguucucccuucacuacgccuggaagaccauggccaugguucugagcauagugucccuacuuccccuaugccugagcacuacaagccagaaaaccacguggcuccccguccucuuaggcagucuuggcugcaagccgcugacuauguuucuuauagccgagaacaaaaucuggggucguaagagcuggccccucaacgagggaaucauggcuguugggaucguauccauacugcugagcuccuugcugaagaacgacgugccccuggcuggcccguugaucgccggcgggaugcugaucgccuguuacgugaucucaggcagcagcgccgaccuaucccucgaaaaggcggcggaggucucaugggaagaagaggccgagcacuccggcgcgagucacaacauacuggucgaagugcaggaugaugggacgaugaagaucaaagacgaggagcgcgacgauaccuuaaccauccuccuaaaggccaccuugcucgcgguaucagggguguacccgcugagcaucccagccacacuauucguaugguauuucuggcagaagaagaagcagcggucagguguucucugggacacacccagcccgcccgagguggaacgcgccgugcuagacgaugggaucuacagaaucaugcagcgcggccugcuaggccggucccaggucggggugggcguguuccaagagaacgucuuucacacgauguggcacgugacccgcggggccgugcucauguaccagggaaagagacuggagcccuccugggccuccgucaagaaagaucugaucagcuacggcggcgguuggcgcuugcagggguccuggaacacgggugaagagguccaggugaucgcugucgagcccgggaagaacccaaagaacgugcaaacggcacccggcaccuuuaaaacgccggagggcgaggugggggccaucgcccucgacuucaagcccggcaccuccgguagccccaucguaaacagagagggcaagauagugggacuguauggcaauggcguggucacgaccuccggaaccuacgugagcgccaucgcgcaagcgaaggccucccaggaaggcccguugccggagauagaagacgagguauucaggaaaaggaaucugaccaucauggaccuucaccccggaagcggcaagacgcgccgguaucucccugccaucguccgggaggcgaucaagaggaagcuacgaacccugauccuggcccccacccgcgugguggccuccgagauggccgaggcccugaagggcaugcccauacgguaucagacgacggcgguuaagucugagcacaccggacgcgagaucguggacuugaugugccacgccaccuucaccaugcggcuucugucucccgugagagucccgaauuacaacaugaucaucauggacgaggcccacuucacggauccgagcagcaucgccgcgcggggcuacauuucuaccagggucgggaugggcgaggcggcggccauauucaugaccgcuacgccgcccggguccgucgaggccuucccgcagucaaacgcggucauccaggaugaggagcgggacaucccagagcggaguuggaacagcggauacgaauggauuacggacuucccggguaagacugugugguucguaccuuccaucaaaagcggaaacgacaucgcuaauugccuacggaagaacggcaagcgcgucauccaguugucccggaaaaccuucgacaccgaguaccagaagacaaagaacaacgacugggacuacgugguuaccacugacaucagugagaugggcgcuaacuuccgggccgacagagucaucgacccgcgccgcugccuuaagcccgugauccugaaggaugggcccgaacgcgucauccuagcggggcccaugccggucaccgucgcauccgccgcccagcggcgaggccggauuggccgcaaccauaacaaagagggugaccaguacaucuacaugggccagccguuaaacaacgacgaggaucaugcccacuggacggaggcgaagaugcuacuggacaacaucaacaccccggaggggauuauuccugcccuguuugaaccggagcgcgagaagucagccgccaucgauggcgaguaccggcuucgcggcgaggcgcggaagacuuuuguggaauugaugcgacggggcgaucugccuguguggcugagcuauaaaguggccuccgagggcuuccaguacucugaccgccgauggugcuuugacggggagcgcaacaaccagguccuggaagagaacauggacguggagauuuggaccaaggagggcgagagaaaaaagcugcggccacgguggcuggacgcccgcacguauucagauccgcuagcuuuaagagaguucaaagaauuugccgcggggcgccggaguguguccggugaccugauccuagaaauaggaaaguuaccgcaacaccugacacagagggcgcagaacgcgcuugauaaccugguaaugcugcacaacagcgagcagggcgggcgggccuauagacaugccauggaggagcuccccgacaccaucgagacccucaugcugcucgcgcugaucgccguguuaaccggcggcguaacccucuucuuccuuuccggacggggacugggaaagaccuccaucgggcuccugugcguaauggccucuucggcccugcuuuggauugccuccguggagccccacuggaucgcggccagcauuauccuggaauucuucuuaaugguauuguuaauacccgagccggaccgccagcggacgccccaagacaaccagcuggcuuacguggugaucggccuguuauuuaugauuuuaaccgucgccgccaacgaaaugggguuacuggagacaacaaagaaagaccuugggaucgggcacgucgcgguagagaaucaccaccaugcaacgauguuagacguggaccuccaccccgccuccgccuggacccuuuacgccgucgcgacaaccauaaucaccccaaugaugcgccauacuaucgagaacacgacggccaacaucagccugaccgcgaucgccaaccaggccgcuauccucaugggccuggauaagggcuggccaaucuccaagauggacaucggggugccccuacucgcccugggcugcuacucacaggugaacccccuaacccugacggcagccgugcuaaugcucguggcgcacuacgcuaucaucgguccgggguuacaggccaaggccacccgcgaggcccagaagcgaacugcggccgggaucaugaagaaccccaccguagacgguaucguugccauagaucuggaccccgugguguacgaugccaaguuugagaagcaauuaggacagaucaugcuccuuauccucugcacgucccagauccuccugaugcgcaccacaugggcccucugcgagagcaucacuuuggcaacgggcccccucacaacgcuuugggagggauccccggggaaguucuggaacacgacuauagccgugagcauggccaacaucuucagagguagcuaccuggccggcgccgggcuggcguucucccuuaugaaaucccugggcgggggacgccgugggacaggcgcccaaggggagacccugggggagaaguggaagcgccaacucaaccaguugagcaagagcgaguucaacaccuacaagcgguccggcaucauggaaguggaucgcagcgaggccaaggagggcuuacggcgcggcgaaacgacaaagcacgccguaucccgggggaccgcaaaguuacgcugguucgucgagcgaaaccuggugaagccggagggcaaggugaucgaucuggggugcgggcguggcggguggucuuacuacugcgcgggccuaaagaaggucaccgaggucaagggauauacuaagggcggcccaggacacgaggagccaaucccgauggccaccuauggauggaaccucguaaaacuucauucagguaaggacgucuucuucaucccaccugagaagugcgacacccugcuuugcgacauaggagagaguucacccaaccccaccauagaggaggggcggacacugcgcgugcugaagaugguugagccuuggcuccgaggcaaccaauucugcauaaagauacugaacccguacaugcccagcgucgucgaaacccuggagcaaaugcagcgcaaguacggcgggaugcucgugcgcaauccucugucccgcaauaguacucacgaaauguacugggucaguuguggcacugggaacaucgugucagccgugaacaugacgucacgcaugcuacucaaccgguucacgauggcucaccgcaagcccacuuacgaacgcgacgucgaucugggcgcgggcaccagacacgucgcuguagagcccgaaguagccaaucuggacauuaucgggcagcggauagagaacauuaagcacgaacacaagucuacauggcacuacgacgaggacaaccccuacaaaacgugggccuaucacgguucuuacgaggucaagcccucuggcucugccucaagcauggucaacggcguggugaagcuccugaccaagccgugggacgucauccccauggugacccagaucgccaugacugacaccacccccuuugggcagcagcggguuuucaaggaaaagguggauacccggacuccuaaggccaagcguggcacggcccagaucauggaggugaccgcacguuggcuguggggauuucuaagucgcaacaaaaagccccggaucuguacucgcgaggaguucacccggaagguuaggagcaacgccgccauuggggccguuuucguggacgagaaucaguggaauucggccaaggaagccguggaggacgagcgguuuugggaccugguccaccgcgagcgggagcuucacaagcaggggaaaugugcaacuugcguguacaacaugauggggaagcgcgagaagaagcucggcgaguucgggaaggcgaaggggucccgugccaucugguacauguggcuaggcgcccgcuuccuagaguucgaagcccuuggguuuaugaacgaggaccacugguucucccgggagaacagcuuguccggcguagagggggaggggcugcacaagcucggauauauccucagagacaucagcaaaaucccaggcgguaauauguacgcggacgacaccgccgggugggauacacgcaucacugaggaugaccugcagaaugaagcuaaaauuaccgacaucauggagccggagcaugcccucuuagccacuuccaucuucaaguuaacuuaucagaacaaggugguucgggugcagcgccccgccaagaacggcaccguuauggacgugauaagccggcgcgaucagcggggguccggacagguggggaccuacgggcucaacacguucacuaacauggaagcccagcuaauaaggcagauggagagcgaaggcaucuucuccccgucggaguuggaaacccccaaucucgccgagcgaguucuggacuggcuugagaaguacggcguagagcgccuuaagcggauggccaucucuggcgacgacugcgugguuaaacccaucgacgaccguuucgccacggcgcuuaccgcacugaacgacauggggaaagugcggaaggauauaccccagugggagcccagcaagggcuggaacgauuggcagcagguccccuucuguagccaccacuuccaccagcucaucaugaaggacgggcgcgaaauuguggugccgugccggaaccaggacgaauuagucggccgcgcccgggucucacaaggggcaggauggagccugcgcgagaccgccugccuaggcaaguccuacgcgcagauguggcagcugauguacuuccaccggcgcgaccuaagacucgcagccaaugccaucugcucugcugugcccguggacuggguucccaccuccagaacgacauggagcauccacgcccaucaccaguggaugacgaccgaagauaugcugucaguguggaaccggguguggaucgaggagaacccuuggauggaggacaagacgcacaucagcagcuggggcgacgucccguaucugggcaagcgggaagaccagugguguggcagccucaucggguuaaccgcccgcgccacaugggccaccaacauccagguggcgaucaaccaggugaggcgucugaucggcaaugagaacuaccucgacuacaugaccagcaugaagcgguucaagaaugaaagcgaccccgagggggcacugugguga

SEQ ID NO: 24583 - RNA, 9879 nt, Artificial Sequence
  derived and/or modified CDS sequence (opt11) from DENV-1__EU482511__SS-prME
agcgugaccaugcugcugaugcugaugcccaccgccuuggccuuccaucucacaacccgggguggggagccacacaugaucgucaguaaacaggagcgggggaagucacugcuuuucaagacgagcgccggugugaacaugugcacucugaucgccauggaccugggcgaacugugcgaagacaccaugaccuauaaaugcccccggaucacagagaccgaaccggaugacguagacuguuggugcaacgccacagacaccugggucaccuauggcacuugcagccagacgggcgagcaucgucgggacaagcggagcguggcacuugccccccacgucgggcuggggcucgagacccgcacagaaaccuggaugagcagugagggggccuggaagcagauccagcggguggagaccugggcccuccggcaccccggguucaccgugaucgcccuguucuuggcccacgccaucggcaccagcaucacccagaaggggauuaucuuuauccuccugaugcuggugacgcccuccauggccaugcgaugcguggggauuggcagccgcgacuucguggaggggcucucgggcgccaccuggguggacgucguacuggagcacgggucaugcgugacaacaauggccaaggacaagcccacgcuagacaucgaguuacugaagaccgaggucaccaaccccgccguccuucggaaacucugcauugaggcuaagaucuccaauaccacgacagacagccgcugcccuacccagggagaggccacccugguugaggaacaggacgcgaacuucgucugcaggcgcacguucguggaccggggcugggggaacggcugcggguuauucggcaagggaucccucaucaccugcgcuaaguucaaaugcguaaccaagcuagagggcaagauuguccaguacgagaaccugaaguacucugugaucgugacuguacacacgggggaccagcaccagguggggaacgaguccaccgaacacggaaccaccgccaccaucacaccccaggcgcccacaaccgagauccaacucaccgacuacggggcccugacgcuggacugcucacccaggaccggccucgacuuuaacgaaaugguacugcugacuaugaaggagaagagcugguuagugcacaagcagugguuccuggaccugccccuccccuggaccagcggggcuagcacuucccaggagaccuggaaccggcaggaccugcugguuaccuucaagaccgcccacgccaagaagcaagaggucgugguacucggcagccaggagggcgcgaugcacacggcccugaccggggccaccgagauacagaccuccggcacgacaaccaucuucgccgggcaccugaaaugccggcucaagauggacaagcugacccugaagggcaugagcuacgucauguguaccggguccuucaagcucgagaaggagcuggccgagacccaacacgggacggugcugguacaaauuaaguacgagggaaccgaugcgcccugcaagauccccuucuccacccaggacgagaagggagucacccagaacggccggcugaucaccgccaaccccaucguaaccgacaaggagaaaccaguuaacaucgaggccgagccgcccuucggagagucuuacaucgucaucggcgcuggcgagaaggcguuaaagcugagcugguucaagaagggcuccuccaucggaaagauguucgaggcaacggcccgaggagcucggcgcauggccauccugggcgauaccgcgugggauuucgggagcaucggcggcguguucaccagcgucgguaagcugguucaccagaucuucggcaccgcguacggggugcuauucuccggcguuagcuggacgaugaagauagguaucggaguccugcucaccugguugggccuaaauucccgcaguaccucccuaagcaugaccuguaucgcgguggggcuggugaccuuauaucucggcguuaugguacaggcggauuccgggugugugaucaacuggaagggucgugagcugaagugcggcagcggcauauucguaacgaacgaggugcacaccuggaccgagcaguacaaguuccaagccgauagcccgaagcgccuauccgcggccaucggcaaggcuugggaggaggguguaugcggcauacggagcgccacgagacuugaaaacauuauguggaagcagaucucuaacgagcugaaucacauucugcuagaaaacgacaugaaauucacggucguugucggggacguagccggcauuuuggcgcaggggaaaaagaugauccgaccccagccuauggaguacaaguacagcuggaagucuuggggcaaggccaaaaucaucggcgccgauguccagaauaccacauucaucaucgacggacccaauacgccggagugccccgacgaccagcgcgccuggaacaucugggagguggaggauuacgguuucggcauauucacgaccaacauauggcugaagcuccgggacagcuauacacaggucugugaucaccgccugauguccgcggccaucaaggacagcaaagccgugcacgcagauaugggcuacuggaucgagucagagaagaacgagaccuggaagcuggcgagagcuucuuucaucgaggugaagacgugcauauggcccaagucccacacucucuggagcaacggcguucuggaauccgaaaugauaaucccuaagaucuacgggggcccgaugucgcagcacaacuaccgccccgguuacuucacccagaccgccggccccuggcaccuggggaagcucgagcuggauuucgaccugugcgagggcacgaccgugguggucgacgaacacugcggcaaccgugguccuucucuccgcacuaccacggugaccgguaaaaucauccacgaguggugcuguaggucaugcacccugccgccgcugcgauucagaggcgaggacggcugcugguacgggauggagauccgcccugucaaggagaaggaggagaaccucgucaaguccauggugagcgcaggcagcggggagguggacuccuucucucuggggcugcucugcaucuccaucaugaucgaagagguaaugcggucacgguggucacggaagaugcugaugaccgggacgcuggccguauucuuccuccucaucauggggcagcugaccuggaaugaccucauccgccugugcauaauggugggcgccaacgcgagcgaccgcauggggaugggcaccaccuaucuggcccucauggccacguuuaagaugcgaccgauguucgccguuggccuccuuuuccgucggcucaccuccagggaaguucugcuacucaccauagggcugagccugguggccuccgucgaguugccuaauucacuggaggagcugggcgacgggcuggcgaugggcaucaugaucuuaaaacugcucacugacuuccagucucaccagcugugggccacccugcucagccuuaccuuuaucaagaccacauuuucacugcacuacgccuggaagacgauggccauggugcucagcauagugucccuguucccccugugccuuaguaccacuucgcagaaaaccacgugguugcccgugcuacucggcagccuggggugcaagccguuaacuauguuccucaucgcggagaacaagauauggggucggcgauccuggccccugaacgaagggaucauggcugugggcauugugagcaucuuacucagcucccuguugaagaacgacgugccccuagcugggccucugaucgcaggcggcaugcuaauugcguguuacguuaucagcggguccuccgcggacuuaucccuggagaaggcggccgagguuucaugggaagaggaagccgagcacaguggcgccagccacaauauccuuguugaagugcaggacgacgggaccaugaagaucaaggacgaggagcgcgacgauaccuugaccauauuacugaaggcgacgcuccuagccguuuccggcguguacccgcuuagcauccccgcaacccucuucgugugguacuucuggcagaagaagaagcagcgcuccgggguccuaugggacaccccaagcccgcccgagguggagcgggccgugcuggacgacgguaucuacagaaucaugcagcggggccuucucgggcgcucccaggucggcguggggguguuccaagagaacguguuccacaccauguggcacguuacgcggggcgccgugcugauguaccagggcaagcgacuggaacccagcugggcgaguguaaagaaggaccucaucucguacggcggcggguggcgucuccagggcuccuggaacaccggugaggagguccagguaaucgccgucgagcccgguaagaaccccaagaacgugcagaccgcccccgguaccuucaagacacccgaaggcgaggucggcgccaucgcccuggacuucaaacccggaaccagcggcucgcccaucgucaaccgcgaggggaagaucgugggccucuacggaaacggcguggucaccaccagcggcacauacgugagcgcgauagcccaggccaaggccagucaggagggacccuugcccgagaucgaggacgaggucuuccggaaacgcaaccuuaccaucauggaccuccacccaggaagcgggaagacccggagguaccugccggcgauagugcgggaggcgaucaagcgcaagcugcgcaccuugauccuggcccccacgagagugguggccuccgaaauggccgaagcacugaagggcaugcccauccgcuaccaaaccaccgccguaaagagcgagcacacuggcaaggagaucguggacuuaaugugccaugccacguucacgaugcgacugcugucccccgugcgcgucccgaacuauaacaugaucauuauggaugaggcccacuucacugaucccagcuccauagccgcgagaggcuacaucagcacacgcguaggcaugggggaggccgccgcgaucuuuaugacggccacuccgcccggguccguggaggcguucccgcagagcaacgccgucauucaggacgaggaacgggacauccccgagcgcuccuggaacagcggguacgaguggaucaccgacuuucccgggaagaccgugugguucguccccuccaucaagagcgguaacgacaucgccaacugcuuacggaagaacgguaagcgcgucauacaacugucccgcaagacauucgacaccgaguaccagaagaccaagaacaacgacugggauuauguggugacgacggacaucucggagaugggcgccaacuuccgcgcggaccgagucaucgacccgcggcggugccugaagcccguuauuuuaaaggacgggcccgaacgcgugaucuuggccggcccgaugccggugaccguggccuccgccgcccaacggcgcgggagaauaggccgcaaccacaacaaggagggcgaccaguacauuuacauggggcagccccuaaauaacgaugaggaucacgcgcacuggacagaggccaagaugcuccuugacaacaucaauacccccgaaggcaucauccccgcgcuguucgagccggagcgcgagaaguccgcugccaucgacggcgaguaucggcuccgcggugaggcgagaaagacguucgucgagcugaugcgccgcggggaccugccuguauggcucuccuacaaaguggccucagagggcuuccaguauagcgaucgucgguggugcuuugacggcgagcgcaacaaccaaguccuggaagaaaauauggauguggagaucuggaccaaggagggggagcggaagaagcugcgcccccgcuggcucgacgcccgcaccuacucggacccucuggcccugcgggaguucaaggaguucgccgcgggccgccggagcguguccggggaccugauccuagagauuggaaagcugccgcaacaccucacccagagagcccaaaacgcgcuggacaacuuagucaugcuccauaacagcgaacagggcgggcgugccuaccgccaugcaauggaggaacugcccgacacgaucgaaacgcucaugcucuuagcccucaucgcagugcucaccgggggagugacccuauucuuccugucgggccggggacucgggaagaccagcaucggccugcugugcgucauggccaguucuguguuauuguggauggccuccguggagccccacuggaucgcggccagcaucauccuggaguuuuuccucauggucuugcugauccccgagccggaccgucagcgcacgccccaggacaaccagcucgccuacguggugaucggguugcuuuuuaugauccugaccgucgccgccaacgagaugggccugcuagaaaccaccaaaaaggaccucgguaucggccauguggcgguagagaaucaccaccacgccgccaugcuggacgucgaccugcaucccgccuccgccuggacgcucuacgcgguggccaccaccaucauuacaccgaugaugcgccauacgauagagaacaccaccgcuaacaucagccugaccgcgaucgccaaucaggcggccauccugaugggccucgacaaggguuggccaauaucaaagauggacauaggcguaccccugcuagcccucgggugcuacagccaggucaacccccugacgcugaccgccgcggugcucaugcugguagcccauuacgcgaucaucggcccggggcugcaagcaaaggccacccgcgaggcgcagaagcggaccgccgccgguauaaugaagaacccgacggucgacgggauuguggccaucgaucuggaccccguggucuacgaugccaaguucgagaagcagcucgggcagauuaugcuucucauccuguguaccucucagauccugcucaugcgcacgacuugggcacugugcgagagcaucacgcuggccaccggcccccucaccacccugugggagggguccccagggaaguucuggaacaccacuaucgccgugagcauggcaaacaucuuccgcgggaguuaccuugcgggcgcgggccuggccuucagccugaugaaaagccucggaggcgggagacgggggacuggggcgcagggagaaacucucggcgagaaguggaagcggcaacugaaucagcuguccaagagcgaguucaauacguacaagcgcuccgggauaauggaaguggaccgcagcgaggccaaagagggccucaagcgcggggagaccaccaagcacgcggucucccgcggcaccgccaagcugcggugguucguggaacgcaaccuggugaagcccgaggggaaggucauagacuugggcugcggcagggggggcuggagcuacuacugcgcggggcucaagaaggugacggaggugaagggcuacaccaagggcggcccuggccaugaggaacccauuccgauggcuaccuauggguggaaccugguuaaacugcacuccggcaaggacguguuuuucaucccgcccgagaagugcgauacacuucugugcgauaucggggaaagcucccccaauccaacgaucgaggagggcagaacacugcgugugcucaagauggucgagcccuggcugcgcgggaaccaguucugcauaaagauccugaaccccuacaugccgagcgugguggagacgcucgagcaaaugcaacguaagcacgguggcaugcugguccgcaauccccucucccggaacagcacccacgagauguacugggucucaugcgguaccggaaacaucgucagcgcugucaacaugacaucccgcaugcucuuaaaucgcuucaccauggcgcaccggaagccgacauacgagcgcgacguggaccugggggccggcacccgccacgucgccgucgagcccgagguggccaaucuagauaucaucggucagcgaauagagaacaucaaacacgagcacaaaagcacguggcacuacgacgaagacaaccccuacaagaccugggccuaucaugggaguuacgaggugaagccuagcggcuccgccagcagcaugguaaacggcguggucaagcugcugaccaagcccugggacgugauccccauggugacccagaucgcgaugacugacaccacucccuuuggccagcagcgagucuucaaggagaagguggacacccgcacgccgaaggccaagcggggaacagcccaaaucauggaagugacugccaaguggcucuggggauucuuaucccgcaacaagaaaccccggaucugcacccgugaagaguucacgcggaagguccggagcaacgcagccaucggagccguuuuuguggacgagaaccaguggaacagcgccaaggaggcggucgaagaugaacgguucugggaucuggugcaucgcgagagggagcuccacaagcaggggaagugcgcuaccugcguguacaauaugaugggcaagcgcgagaagaagcugggugaguucggcaaggccaaagggucacgggccauuugguacauguggcugggcgcccgcuuccuagaauucgaggcguuaggcuucaugaacgaggaccacugguuuuccagagagaacagccuguccggggucgagggcgaggggcuccacaaacugggcuacauccugcgcgacaucagcaagauuccggggggcaacauguacgccgaugacaccgcugggugggauacccggaucaccgaggacgaccuccaaaacgaagcucgcauuaccgacaucauggagccggagcacgcccuacuggcuaaauccaucuucaagcucacauaccagaacaagguagugcgcguccagcggccggccaagaauggaaccgugauggacgugaucagucgccgagaccagcgcgggucagggcaggugggcacguacggcuugaauaccuucaccaauauggaggcccagcugauccggcagauggagagcgaggguaucuuuucacccagcgagcuggagacccccaaccucgccaagagaguucuggacuggcucgagaaguacggaguggagcggcugaagcguauggccaucuccggcgacgauugcgucguuaagccgauugacgaccgcuucgcgacggcccugaccgcucucaacgauauggguaagguacgcaaagacaucccucagugggagcccagcaaaggguggaacgauuggcagcagguccccuucugcucccaucacuuccaccagcugaucaugaaagacggccgggagauuguggugccaugccgcaaccaggacgagcuagucggcagggcuagggugagccagggggccggcuggagccucagggagacggcgugccuggguaagagcuaugcccaaauguggcaacugauguauuuccaccgcagggaccuacgccuggccgcgaacgcgaucugcagcgcuguucccgucgacuggauccccaccagccggacgaccuggagcauucacgcccaccaccaguggaugaccaccgaggauaugcuaagcguguggaaccgcguguggaucgaggaaaaccccuggauggaggacaagacacauaucagcuccuggggugacguaccguaccucgggaagcgcgaggaccaguggugcggcagcuuaauuggguuaaccgcccgagccaccugggcuaccaacauccagguggccaucaaccagguacgccggcucauugggaacgaaaacuaccuggacuacaugaccuccaugaagcgcuucaagaacgagucggacccugagggcgcauugugguga

SEQ ID NO: 24584 - RNA, 9879 nt, Artificial Sequence
  derived and/or modified CDS sequence (opt11) from DENV-1__EU482513__SS-prME
agcgucacuaugcuuuugaugcuuaugccaaccgcccuggccuuucaccuaacgaccagaggaggggaaccacacaugauagugagcaaacaggagcgugguaagagccugcuguucaagacuucugccgggguuaacaugugcacccucaucgccauggaccugggcgagcugugugaggauaccaugacuuacaagugcccccgaaucacggaaaccgagccagacgacguggacuguuggugcaacgccacggauacaugggucaccuaugggaccugcucucagacaggggagcaucggcgggauaaaaggaguguggccuuggcuccccacgucggccuaggucuggaaacgaggaccgagacuuggaugucuuccgagggggcauggaagcagauccagcgagucgaaacaugggcucuccggcaccccggguuuaccgugaucgcccucuuuuuagcacacgcaaucggcacaucuaucacccaaaaagggaucauuuuuauacucuuaaugcugguuacucccuccauggccaugcguugcgucggaaucggcagccgugacuucguggagggccucucuggggccacaugggucgacgucgugcuggagcaugggucgugugucaccacgauggcuaaagacaaaccuacgcuggauauagaacuccugaagacagagguuaccaaccccgccgugcugcggaagcugugcaucgaggcgaagaucucuaacacuacaaccgacagccgcugcccgacccagggcgaggccacccugguggaggagcaggacgcaaacuucgucugccgacgcacguucguggaccguggcugggggaacggcugcgguuuauucggcaagggaagucucauuacgugcgcaaaguucaaaugcguuaccaagcucgaaggcaagaucgugcaauacgagaacuuaaaguauagcgugauugucaccguccacacgggggaucagcaccagguggggaacgaguccaccgaacacggcaccaccgcgaccaucacuccccaagcccccaccaccgagauucagcucacagacuauggggcccugacguuagacugcagccccaggacaggccucgacuucaacgagaugguucugcugaccaugaaggaaaaauccuggcuuguccacaagcagugguucuuagacuuaccacugcccuggaccaguggugcuuccacgucccaggagacuuggaaucggcaggauuuacuugugaccuuuaagaccgcccaugccaagaagcaggagguuguggugcuuggcucccaggagggcgcgaugcauacggcccugacgggggcaacagagauccaaaccucuggaacgaccacgaucuuugcagggcacuugaaaugccgccucaagauggacaagcuaacauuaaagggcaugagcuauguuaugugcacugggucuuucaagcucgagaaagagcucgcagaaacgcaacacggcaccgugcuggugcagauaaaguacgagggcacggaugcgcccugcaagauaccuuucucgacucaggaugagaagggugucacucagaauggccggcugaucacggccaauccuauugugaccgacaaggagaagcccgugaacauagaggccgagccacccuucggagagaguuacaucguuaucggcgccggugagaaggcccucaagcucagcugguucaagaaggggagcagcaucggcaagauguucgaggcgacggcuagaggugcccgccgcauggccauccugggagacaccgcgugggauuucgggucaauaggcggagucuucaccucaguugggaaguuaguccaccagaucuucggcaccgcuuacggggugcuuuuuucuggcgucagcuggacgaugaagaucgggaucggcgugcugcucaccugguuggggcugaacucccgcucuacaucccucagcaugacuugcaucgcgguggggcuagugacacuguaccucggcgucaugguucaggcugacuccggaugcgucaucaacuggaagggccgugagcugaaaugcgggagcggcaucuucgugacaaacgaggugcacaccuggaccgagcaguauaaguuccaggcggacucuccgaagcgccugagcgcggcuaucgggaaggcuugggaggagggggugugcggcauccggagcgccacccgacucgaaaacauuauguggaagcagaucuccaacgaacugaaccacauacugcucgagaaugacaugaaguuuacgguagugguuggggauguagcuggaauccuggcgcaagggaagaagaugauccgcccccagccaauggaguacaaguauagcuggaaaagcuggggcaaggccaagauaauaggcgccgaugugcaaaauaccaccuuuaucaucgacgggcccaacaccccugagugucccgaugaccagagggccuggaacaucugggaaguggaggacuaugguuuuggcaucuuuacaacaaacaucuggcugaaacuccgggacagcuacacccaggucugcgaccaccgccugauguccgcggccaucaaagauaguaaagccguucacgccgacaugggauacuggauugaguccgagaaaaaugagaccuggaagcuugcgcgggccagcuucaucgaagugaagacguguaucuggcccaaaucgcacacacucuggagcaacggcguccuggaguccgagaugauuauuccgaagauauacgguggcccgaucagccaacauaacuaccgcccgggguauuucacccagaccgcgggacccuggcacuuggggaagcuugagcuagauuucgaccugugcgaggggacgacgguuguaguagacgagcacugcggaaaucgagggccaucccuccgaaccaccacagugacgggaaagaucauacacgaguggugcugccggucaugcacucugccgccccugcgcuuucgcggugaagacggcugcugguacggcauggagauccgccccgugaaagagaaagaggagaaccucguaaagucuauggugagcgccgguagcggcgagguggacaguuuuucccugggacugcucugcaucaguauuaugauagaagaggucaugcggucgcgcuggucccggaagaugcucaugaccggcacacuggccguguucuuucugcugaucauggggcagcuaaccuggaaugaucucauacgcuuaugcaucaugguuggcgccaacgcgagcgaucggauggguaugggaacgaccuacuuagcauugauggcgaccuucaagaugcgcccgauguuugccguuggacuguuauucagacgguuaacuucacgugaggugcugcuucucacaaucggccugagccugguggccucaguugagcugcccaacucccuggaggaacucggggacggucucgcaaugggcaucaugauacuaaaguuguugacagacuuucaaucccaccaacugugggccacacugcugucgcugaccuucauuaagacuacguuuucgcuccacuacgcguggaagacuauggccauggugcuguccaucgucucacuguucccccugugccuuagcacaaccucccaaaagacuacguggcugcccgugcugcucgggagccuggggugcaaaccgcuaacaauguuccucauugcggagaacaagaucuggggccgucgcuccuggccgcugaacgagggcaucauggccgugggcaucguauccauccugcucaguucuuuacugaagaacgacgugccucucgccgguccacugauugcaggcgggaugcuuaucgcaugcuacgugaucagcggguccagcgcagaccuaucacuggagaaggccgccgaggucucaugggaggaggaagcggagcacuccggagcaucgcauaacauccugguugaagugcaggacgaugggaccaugaagaucaaggacgaggagagagacgauaccuuaaccauccugcucaaggcgacacucuuggccguuaguggugucuauccucugucgauucccgcgacccucuucguaugguauuucuggcagaagaaaaagcagcgcagcggaguccucugggacacccccucgccgcccgaaguggaacgagcuguacuggacgacggcaucuaucgcauaaugcaacggggccugcucggucggucccagguuggcguggggguguuccaggaaaacguauuccauacgauguggcaugugacccggggggccgugcuaauguaucaagggaagagacuugagcccucuugggcguccgucaagaaggaccuaaucagcuauggcggcggcuggcggcugcagggcuccuggaacaccggggaggagguccaggugaucgcugucgaacccggcaagaaucccaagaacgugcagaccgccccugggaccuucaagacgccugagggcgaggugggcgccauagcccuggauuucaaacccgggacauccggcagccccauagucaaccgugaggggaaaaucgugggccuuuacggcaacggaguggucacgaccucugguaccuacgugagcgcgauagcccaggcgaaggccucccaggaggggccgcugcccgaaauugaagacgagguauuucggaaacgcaaccugacaauaauggacuuacaccccggaucggguaaaacuaggcgcuaccuaccagcgaucguccgggaagccauuaaacgcaagcugcgcacuuugauucuggcccccacgcggguggucgcaagcgaaauggcggaagcccuuaaaggcaugcccauccgcuaucagaccaccgcggucaaaagcgagcacacuggcaaggagaucgucgaccugaugugucaugcaacauucaccaugcggcuccuguccccagugcgggugccgaacuauaacaugaucaucauggacgaagcccacuuuaccgaccccagcuccaucgccgcccgggguuacauauccacccggguggguaugggggaagccgcugccaucuucaugacggccacgccgccugggucuguagaagccuucccgcagucaaacgccgucauccaggacgaagaaagagacauccccgagcgcuccuggaauuccggguaugaguggauaaccgauuuccccggcaagaccgugugguucgugccgucuauuaaaucgggaaaugacauugcaaauugccugcggaagaaugggaaaagagucauccagcugagucggaagacuuucgacaccgaguaucagaaaaccaagaauaaugacugggauuacguggucacgacugacaucucugagaugggcgcaaacuuucgcgcggaccgggucaucgacccucggagaugucucaaacccgugauauugaaggacggacccgagagggugauacuggccggucccaugccgguuaccguggccuccgccgcacagcggagggggagaaucggccguaaccacaacaaagaaggcgaccaguacaucuacaugggccagccucuuaauaacgacgaggaccacgcgcacuggacagaagccaaaaugcuccuggacaauauaaauaccccggaggguauuaucccugcccuuuucgagccugagcgagaaaaguccgccgccaucgacggggaguaccggcuuaggggagaagcccggaagacguuugucgagcugaugcggcguggggaccuacccguguggcucuccuacaaggucgccagcgagggauuucaguacucagaucgccgcuggugcuucgacggagagcgcaauaaccagguccuggaggagaacauggauguggaaauuuggaccaaagaaggggagcggaagaaguuacgcccacgguggcucgacgcgagaaccuacuccgacccccuggccuugcgggaguuuaaagaguucgccgcgggacgccggagcguaucuggagaccucauccuggagaucggcaagcucccucagcaccucacccagcgcgcucaaaaugccuuggacaaccuggucaugcuacacaacuccgagcaaggcgggagggcauaccgccaugcuauggaggaauugccugauacgauugaaacuuuaaugcuccuugcucugauagcagugcucacuggaggggucacgcuuuucuucuugucagggcguggccuugggaagacaagcaucggacugcugugcguaauggccuccagcgugcuccuuuggauggccucgguggagccgcauuggauugcggcaagcaucauccuugaauucuucuugaugguccugcuuauccccgagccggaucgccagcguaccccccaggauaaccagcucgccuacguuguuaucggucugcuguucaugaucuuaaccgucgccgccaacgagauggggcuucuggagaccacuaagaaagaccucgggauaggccacguggcgguugagaaccaccaccacgccgcuaugcuagacgucgaccugcaccccgccucagcguggacacuguaugcagucgcgaccacuaucaucaccccgaugaugcgacacacgaucgagaacaccacggccaacaucagccugacugccaucgcaaaccaggcggccauucugauggguuuagacaagggcuggcccauuuccaagauggacaucggcgugccccugcuugcucucggguguuauagccagguaaacccccuuacgcugaccgccgcgguacucaugcuaguggcccacuaugccaucauugguccgggacuccaggccaaagccacccgcgaggcgcagaagcggacagccgcggggauaaugaaaaaccccacggucgacggaaucgucgccaucgaccuugaccccguggucuaugacgccaaguucgagaagcaguuaggccagauaaugcuccucauccugugcaccucucagauucugcucaugaggacaaccugggcgcugugcgagagcauaacgcucgccacgggcccccuaacaaccuuaugggaaggguccccgggcaaguuuuggaauacgacgaucgccgugucaauggcaaacaucuuccggggcuccuaccuggccggcgcgggucucgcuuucucauugaugaaaucccucgggggugggcgccgagggaccggggcacagggagagacccuaggugaaaaauggaagcgccaacucaaccagcugagcaagagcgaguucaacacuuacaagcgguccgggaucauggagguugaccgcucggaggccaaagagggccucaagcgcggggaaacgaccaagcacgcggucucccgcgguaccgccaagcuucguugguucguggagcgaaaccugguuaaacccgaggguaagguuaucgaucuggggugcggcagaggcggguggucguacuacugcgccgggcucaagaaggugaccgaggugaaagguuacacgaagggagguccaggccaugaggagccaaucccgauggcaacguacggauggaaccuggucaagcugcacuccgggaaggacguuuuuuuuaucccccccgagaagugcgacaccuuauugugcgauaucggggagagcuccccgaauccgacuaucgaggagggcagaaccuugcggguguuaaagaugguggagcccuggcugcgugggaaucaguucugcaucaagauccuaaauccauacaugcccagcguuguugagacgcucgagcaaaugcagcguaagcacggcggcaugcugguccgcaacccccugucucggaauagcacccacgagauguacugggucuccugcggcaccggaaauaucgugucugcagucaauaugacgucacgcaugcuccugaaucgcuucaccauggcacaucguaagcccaccuacgaacgcgaugucgaccucggugccggcacucggcacguggcugucgagcccgagguggccaaccuugacaucaucggacagcgcauugagaacaucaaacaugaacacaaaagcacguggcauuacgaugaggauaacccguauaagaccugggcuuaccacgggaguuacgaagucaaaccuagcggcagcgccaguucgauggugaaugggguaguaaagcugcugaccaaaccuugggacguuaucccgauggugacccagaucgcuaugacggacacaacccccuucggccagcaacgcgucuuuaaggagaagguggacacacguaccccgaaggcaaagcgggggacggcccaaaucauggaggucacagcuaaguggcucuggggcuuccugucccgcaacaagaagccacguauaugcaccagggaggaguuuacacgaaaaguccgcaguaaugcggcuaucggcgccguguuuguugaugaaaaccaguggaacuccgccaaggaggcugucgaggacgaacgguucugggaucucgugcaccgugagcgugagcuccacaaacaaggaaagugcgcaacuuguguguacaacaugauggguaagagggagaagaagcugggggaauuuggaaaggccaaggguagcagagccaucugguacaugugguuaggcgcccgcuuucucgaauucgaagcacugggcuuuaugaacgaggaccacugguucucucgggaaaacucccuguccggcgucgaaggagagggucugcacaagcugggcuacauccugcgcgauauaucaaagauccccggggguaacauguaugccgacgacaccgccgguugggacacgcggaucaccgaggacgaccuccagaacgaggcgagaaucaccgacauaauggagccggagcacgcccuacucgcaaaguccaucuuuaagcucacguaccaaaauaaggugguccgcguacaaaggccagccaagaacggcacaguuauggacguuauuagcagacgggaccaacgcggcucaggccaggugggcacguacggccugaacacuuucacgaacauggaggcccagcugauccggcagauggaaucggaaggcaucuucuccccgagugagcuagaaacuccgaaccuggccgagagaguucuggauuggcuugaaaaguauggcguagagcggcugaagcguauggccauaucgggcgacgacugcguggugaagccuauagacgaccgcuucgcgacggcucugaccgcgcucaacgacaugggcaaaguuagaaaggacauuccccaaugggaaccguccaaaggguggaacgacuggcagcaaguccccuucugcucucaccacuuccaccaguuaauaaugaaggacggcagagagauaguggucccaugccguaaccaggaugagcuggugggucgggcgcgcgugagccagggggcgggguggucucucagagagaccgcuugccuuggaaaguccuaugcccagauguggcagcugauguacuuucaccgccgggacuuacgccuggcagcuaaugcgauuuguuccgccgugccggucgacuggaucccuaccucgcggaccacguggagcauccacgcccaccaccaauggaugaccaccgaggauauguuaucaguguggaaccgcguguggaucgaggagaacccguggauggaggacaagacccacauaagcucauggggcgaugucccguaucucgggaagagagaggaccaguggugcggcucucugaucggucucaccgccagggccacuugggcgacuaacauccagguggccaucaaccaggugcgccggcucaucgggaaugagaacuaccuggauuauaugaccuccaugaagcgguucaagaacgagagugaccccgagggagcacuuugguga

SEQ ID NO: 24585 - RNA, 9879 nt, Artificial Sequence
  derived and/or modified CDS sequence (opt11) from DENV-1__EU482515__SS-prME
agcgugaccacccugcugaugcugaugccuaccgcccuggccuuccaccucaccacacggggcggggagccccauaugaucgugucgaagcaggaacgggguaagagccugcuguuuaagaccagcgccgggguuaacaugugcacccucauagcgauggaccugggcgaguugugugaggacacaaugaccuacaaaugccccagaaucaccgagaccgaacccgacgacguggacugcugguguaacgccacagacaccugggucaccuaugggacuugcagccagaccggcgagcaccggcgcgacaagcggucugucgcccucgcgccccacgugggccuggggcuggagacccgcacggagacguggaugagcucagagggcgccuggaaacagauccagcgcgucgaaaccugggcccuccgccaucccggguucaccgugaucgcccuguuccuggcacacgcgaucggcaccagcaucacacagaaggggauuaucuucauccuccugaugcuggugacccccucuauggcuaugcggugcguuggcaucggcagccgcgacuucguggagggucucuccggcgcaacguggguggacgucgugcuggagcacgggagcugcgugaccacuauggcaaaggacaagcccacccuggauauugagcuccugaagaccgaaguaacgaaccccgccgugcugcgaaagcuauguauagaggcgaagaucuccaacacgaccacggauucgagaugccccacccagggcgaggccacgcuuguggaggagcaggacgccaacuucgucugccgccgcaccuucgucgacagagguugggggaauggcugcgggcuguucggcaaagggucccucaucacgugcgccaaguuuaagugcgugaccaagcuggaggggaaaauuguccaguacgagaacuugaaguacagugugaucgugacgguacauaccggcgaucagcaccagguggggaacgagaguaccgaacacggcacgaccgccacuaucacgccacaggcgcccaccacagagauccaguugacugacuacggggcguuaacccuggacugcagcccccgaacugggcuugacuuuaacgagaugguccugcugaccaugaaggagaaguccuggcucgugcacaagcaaugguuccuggaccugcccuugcccuggacgaguggugccagcaccucccaggagaccuggaaccgucaggaccugcuggugaccuucaagacugcccacgcgaagaagcaggaggucgugguccucggcagccaggagggggcgaugcauacagcccugaccggggccaccgagauccagacuagcggcaccaccacaaucuuugccgggcaccugaaaugccgcuuaaagauggacaagcugacgcuaaagggcaugagcuacgucaugugcacaggguccuucaaguuagagaaggagcuggcggagacccagcauggaaccguacuggugcagaucaaguacgagggcacggacgcgcccugcaagauccccuuuagcacccaggacgagaagggggucacccagaacggccggcugaucaccgccaauccgaucgugacugacaaggagaagcccgugaauaucgaggccgagccgcccuucggggagucauacaucgucaucggcgccggcgagaaggcgcucaagcuuagcugguucaaaaagggguccagcaucgggaagauguuugaggcuaccgcccgaggggcucgucgcauggcaauccugggcgacaccgccugggacuucggguccaucgguggcgucuucaccaguguggguaagcucguccaccagauauucggcacggccuaugggguccuguuuuccggcgugagcuggacgaugaaaaucggaaucgggguccugcucacuuggcugggacugaauucccgcagcacgucccucucaaugaccuguauagccguggggcuggugacccuguaccucggcgucauggugcaggccgacuccgggugugugaucaacuggaagggccgggagcugaagugcgggagcggcaucuucgucaccaacgaagugcacaccuggacggagcaauacaaguuucaggcggacaguccgaagcgccuguccgccgccaucggcaaggccugggaggagggggugugcggcaucaggagcgcaacccgacucgagaacaucauguggaaacaaaucuccaaugagcugaaccacauccuguuggagaacgauaugaaguucacugucgucguuggggacgucgcgggcauccuggcgcaaggcaagaagaugauccggccccagccaauggaguacaaguacagcuggaaaagcuggggcaaggcgaaaaucauuggcgcagacgugcagaacaccaccuucaucaucgacggacccaacacgccggaaugucccgacgaccagcgagcuuggaacauuugggagguggaggacuacggcuucgggaucuucaccaccaacaucuggcugaagcugcgggacagcuacacgcaggucugcgaccacaggcugauguccgcugcgaucaaggacagcaaggccgugcaugccgauaugggcuacuggaucgaguccgagaaaaaugagacguggaagcuagcccgggcgagcuucauugaggugaagaccugcaucuggcccaagucccauacgcucuggucuaacggaguccuggaaucagaaaugaucauccccaagaucuacgggggccccaugagccagcacaacuaccgcccgggguacuucacccagaccgcgggcccguggcacuugggcaagcuagaauuggacuucgaccugugcgagggcacgacaguggugguugaugaacacugcggcaaccggggaccgucacuccgcaccacgaccguaaccggcaagaucauccaugaguggugcugccggagcugcacgcugccgccccugcgcuuccgcggggaggacggcugcugguacgggauggagauccggccagugaaggagaaggaggaaaacuuaguuaagagcauggugagcgccggcagcggcgaaguggacuccuucucucugggacugcucugcaucuccaucaugaucgaggaggucaugcggagccgcugguccaagaaaaugcugaugaccggcacccucgcuguuuucuuccuccugaucauggggcagcugaccuggaacgaccucauccggcugugcaucauggugggcgccaacgcaagcgaccgcauggguauggggacaacuuaccuggcacucauggcgacguucaagaugcggccgauguuugccguaggccugcuguuccggcgccuuaccucccgggagguguuacugcugaccaucgggcugagccugguggcaucugucgagcuccccaacagccuagaggaguugggcgacgggcucgcgaugggcaucaugauccugaaguuacucacagauuuccagucccaccagcugugggcuacccugcucagccugacguucaucaagacuacguucagccugcacuacgccuggaagaccauggccauggugcucagcaucgucucccuguucccccugugccucagcaccaccucccagaagacgacguggcugccugugcuguugggcagcuugggaugcaagccgcugacaauguucuugaucgcggaaaacaagauauggggccgccggucuuggccucuaaaugaggggaucauggccgucggaaucgucagcauccuucucagcucccugcugaaaaacgacgugccccucgccgggccccugaucgccggcggcaugcugaucgccugcuacguaaucagcggaaguagcgcggaccugucccuagagaaagccgccgaggucagcugggaggaggaggccgagcacuccggcgccucacacaacauccugguggaggugcaggacgacgggacgaugaagaucaaggacgaggaacgcgacgacacccucaccauccugcugaaggcgacccuucuugccguauccgggguguacccguugagcauccccgccacccucuucgugugguacuucuggcagaagaagaagcaacgguccgggguucugugggacaccccuagcccgcccgaaguggagcgcgccgugcuggacgauggcaucuaucggauaaugcagcgggggcugcucggacggucccagguaggcgugggaguuuuccaggagaacgucuuccacacgauguggcaugugacccgaggcgcggugcucauguaccaggggaagcgguuagagccgagcugggcguccgucaaaaaggaccucaucagcuacggcggcggguggcgccuacaagggaguuggaauaccggggaggaaguccaggugauagccguagagcccggcaagaacccuaagaacgugcagaccgcccccgggacguuuaagacuccagagggcgaggugggcgccaucgcccuugacuucaagccagggaccagcggcucgcccaucguaaaucgggaggggaagaucgugggcuuauacggcaacggggucgucaccacguccgggaccuacgugagcgcgaucgcacaggccaaggccucccaggaagggccucugcccgaaaucgaggacgagguguuccgcaagcggaaccugaccaucauggaccuccacccuggcagcggcaaaacccgcagauaccugccggcgaucguccgcgaggccaucaagcguaagcugcgcacgcucauucuggccccaacccgcgugguggccuccgaaauggcugaggcgcugaagggcaugcccauacgguaucagaccaccgccgucaagagcgagcacacgggcaaggaaaucguggacuuaaugugccacgccacguucacgaugcgccugcuuuccccggugcgggucccgaacuacaacaugaucaucauggacgaagcccacuucacagaccccagcuccaucgcagcgcgcggauacaucagcacgcggguggggaugggugaggccgccgccaucuucaugacagccacgccaccuggcuccguggaagcguucccgcagagcaaugcggucauucaagacgaggagcgagauaucccagaacgcuccuggaacagcgguuacgaauggaucaccgacuuccccggcaagacggugugguucgugcccucgauuaaaagcggcaacgacaucgccaacugccucagaaagaacgggaagcggguuauacagcucuccaggaagaccuucgacaccgaguaccagaagaccaaaaacaaugacugggacuacguggugacaaccgauaucagcgagaugggcgcuaacuuccgggcggaccgcgucauugacccccggcgcugccugaagccugugauccucaaggacggacccgagcgggugauccuggccggccccaugccgguuaccguggccagcgccgcccagcgccgggggcgaaucggacggaaucacaacaaagaaggcgaccaguacauauauauggggcagccccugaacaacgacgaggaccacgcgcacuggaccgaggccaagaugcuccucgacaacaucaacacgcccgagggcaucauccccgcccuguucgaaccggagcgcgagaaguccgccgccaucgacggggaguaccgccuccggggcgaggcgcgcaagaccuucguugagcugaugagacgcggggaccugccgguguggcuuuccuacaagguggccucugagggcuuccaguauuccgaccggcgauggugcuucgauggcgagcgaaacaaccagguccuggaggagaacauggacguggagaucuggaccaaggagggggaacgcaagaagcugcgcccacgcuggcucgacgcacggacguacucagacccccuggcccugcgugaguucaaggaguuugccgcgggccggcggagcguguccggggaccuuauccuggagaucggcaagcucccgcagcaccucacgcagcgggcccagaacgcccuggacaaccuggucaugcuucacaacucugagcagggcgggcgggccuaccggcacgcgauggaagagcugccggacaccaucgagacccugaugcuccuggccuuaaucgccgugcucaccggggggguaacccuauucuuccugaguggccgcgggcucgguaagacgagcaucggacugcugugcgucauggccucuagcgugcuacuguggauggcuuccguggagccccacuggaucgcggccagcaucauauuggaguucuuccuuaugguccugcuaauccccgagccggaccggcagcgcacaccccaggacaaucagcucgccuacgugguaaucgggcuguuauucaugaucuuaacugucgccgcuaacgaaaugggccugcuggagaccacgaagaaggaccucggaauuggccauguagcgguggaaaaccaccaccacgccgccaugcuugaugucgaccugcaccccgcuuccgcguggacccucuacgcgguugcaaccaccaucaucacgccgaugaugcggcacaccaucgagaacaccaccgccaacaucagccuuaccgccaucgccaaucaggcagcuauccugauggggcuugacaaagguuggcccauuuccaagauggacaucggcgugccccugcuggccuuagggugcuacucacaggucaacccgcuuacucugaccgccgcggugcucauguugguagcccacuaugccaucauuggcccggggcuacaggccaaggccacccgcgaagcgcagaaacgcacggccgcaggaaucaugaagaaccccaccgucgacgggaucguggcaauagaccucgacccgguggucuacgacgccaaguucgagaagcaacugggccagaucaugcugcucauacuaugcaccucccagauccuccucaugcggaccacgugggcgcugugcgagucaaucacccuggccaccgguccccucaccacucugugggaggggucccccgguaaguucuggaacaccaccaucgcggugagcauggccaacauuuuucguggguccuaccuagccggcgcggggcuggccuucucgcugaugaaaucccucggcggcgggcggcgcgggacuggggcccagggagagacgcuuggcgagaaguggaagcgccagcugaaccagcuuuccaaguccgaguucaacacauacaagcgcuccgggauuauggagguggaccggagcgaagccaaggaaggccucaaacgcggggagacgacgaaacaugcggucucccggggcacggccaaacuccgcugguucgucgagcggaaccuugugaagcccgaggggaaggucaucgaccucggcugcggcagggggggcuggagcuacuacugugcggggcucaagaaggugaccgaggugaagggcuacacuaaaggcggccccgggcacgaggagcccauuccaauggccaccuacggguggaaccuggucaagcugcacucaggaaaggacguauuuuuuaucccacccgaaaagugcgacacguuguugugcgauaucggggaguccucgcccaacccgaccaucgaggagggccggacccugcgggugcucaagaugguugagcccuggcugcgggggaaccaauucugcaucaagaucuuaaaccccuacaugccgagcgugguugaaacgcucgagcagaugcagcggaagcacggcggcaugcugguacggaacccuuuaucccgcaacagcacccaugagauguacuggguguccugcgggacgggcaacaucguaagcgcagugaacaugaccucccggaugcuccugaaccgcuucacgauggcgcaccgcaagcccacuuacgaacgcgacguggaccucggggccggcacgcgccacguggccgucgaaccagagguggcuaaucuugacauaaucggccagcggaucgagaacaucaagcaugagcacaagagcacauggcacuaugaugaggauaaccccuacaaaaccugggccuaccacggguccuacgaggugaaaccgagcggcagugccagcagcauggucaacgggguggucaaacuccugacuaagcccugggauguuauccccauggugacacagauagccaugacagacaccacccccuuuggccagcagcgcgucuucaaagagaagguggacacgcggacccccaaggcuaagcgcgggaccgcacagaucauggagguaaccgccaaguggcucuggggcuuccuuucccggaacaagaagccccgcaucugcacgcgggaggaguucacacgcaagguccggagcaacgcggccauuggcgccguguucguggaugagaaccaguggaauucagccaaggaagcggucgaggacgagcgguucugggaccuggugcaccgggagcgggagcuccacaagcaggggaaaugcgcgaccugcguguacaacaugaugggcaagcgggagaaaaaguuaggagaguucggcaaggccaaggggagccgcgccauuugguacauguggcugggcgcccgguucuuagaguucgaagcguuaggcuuuaugaaugaggaucacugguucuccagggagaacagccugagcggggucgagggcgaggggcuccacaagcugggcuacauccugcgggacaucagcaagauccccgggggcaacauguaugcagaugauaccgccggcugggacacacgcaucaccgaagaugaccuccagaaugaggcccggaucaccgacaucauggagccugagcaugcccugcuggcuaaguccauauucaagcucaccuaccagaacaaaguggugcgcguccagcgccccgcgaagaacgggacggugauggacgugaucagccggcgcgaccaacggggcagugggcaagucggcacauacggccuuaacaccuucaccaacauggaagcacagcugauccgucaaauggagagcgaagggauauucucccccagcgagcuagagacgcccaaccuggcgaagcggguguuagacuggcucgaaaaguauggcguggagaggcugaagcggauggcgaucuccggggacgacugcgucgugaaaccgaucgacgaccgguucgcgaccgcccuuacggcucucaacgacauggguaaggugcgaaaggacaucccccagugggaacccagcaagggguggaacgacuggcaacagguccccuucugcucccaccacuuccaccagcuaaucaugaaggacggccgcgagaucguggugccgugccggaaccaggacgagcuggucgguagggcccgcgugagccagggugccggcuggucccuccgcgagaccgcgugccuggggaaguccuacgcacagauguggcagcugauguacuuucaccggcgcgaucuaaggcuggccgccaacgccaucugcagcgccgugcccgucgacuggauccccacgucccgcaccacuuggucgauccacgcacaccaucaauggaugaccacggaggacaugcucuccgucuggaaccgggucuggaucgaagaaaauccguggauggaggacaagacccauaucucguccuggggcgaugucccguauuuagggaagcgcgaggaccaauggugcggcagucugaucggccugaccgcccgcgcgaccugggcgacaaacauccagguggccaucaaccaggugcggcgccucaucgggaacgaaaacuacuuggacuauaugacguccaugaaacguuucaagaacgagagcgaccccgaaggagcgcugugguga

SEQ ID NO: 24586 - RNA, 9879 nt, Artificial Sequence
  derived and/or modified CDS sequence (opt11) from DENV-1__EU482516__SS-prME
agcguuaccaugcugcucauguugaugcccaccgcccucgccuuccaccucaccacccguggcggggagccccacaugaucgugagcaagcaggagcgugguaagucccugcuguuuaagaccagcgcgggagugaacaugugcacccucaucgccauggaccucggcgagcugugcgaagacaccaugaccuauaaguguccccggaucaccgagacugagccagacgacguggauugcugguguaaugcgacggacacauggguuacuuacgggaccugcagccagacgggcgagcacaggagggacaaacggagcguggccuuggccccccacgugggacugggacuggagacccgaaccgagacguggaugagcucagagggcgccuggaagcagauccagcggguggaaacgugggcacuccgucaccccggguuuaccguaaucgcccuguuccuggcccaugcaaucgggaccagcaucacucagaaggguaucaucuucauccugcucauguuagugacccccaguauggccaugcgcugcgucggcaucgguagccgugacuucguggagggccucucgggcgcaacguggguggacgucgugcuggagcacgguagcugugucaccacuauggccaaggacaagcccaccuuggacaucgaacuccuaaaaaccgaggucacaaacccggccguguugcgaaagcucugcauagaggccaagauuucgaauaccacgaccgacucucgcugcccaacucagggcgaggccacccugguggaggagcaggaugccaacuucguguguagacguacguucguggaucggggcuggggcaacggauguggacuguuuggcaaggggucccuaaucacaugugccaaguucaagugcguaaccaagcuagaaggcaagaucguccaguaugaaaaccugaaguacucagugaucgucaccguccacacgggagaccagcaccaggugggcaacgaguccacugagcacgggaccaccgccaccauuacgccccaggcucccacuaccgagauccagcuuacggauuauggcgccuuaacgcuggacugcagcccucgcacaggccucgauuucaacgagaugguacugcugaccaugaaggaaaagagcuggcucgugcacaaacagugguuccuugaccugccccucccuuggaccuccggggccagcacuucccaggagacguggaacaggcaggaucugcuggugacauucaaaaccgcccacgccaagaaacaagaggucgugguccuugguagccaggaaggggcgaugcauacggcacugaccggggcuacggagauacagacauccggcacgacaaccaucuucgcagggcaccuaaagugcagacucaaaauggacaagcucacgcugaaaggcaugagcuacgucaugugcacaggguccuucaagcucgagaaggaaguggccgagacucaacauggcacggugcugguccagauuaaguaugagggcaccgacgcgcccugcaagauccccuucagcacucaggacgagaagggggugacgcagaauggccggcugauuacggccaacccgaucgugacggacaaggagaagccgguuaacaucgaagccgaaccgccguucggggagucguacaucgucauaggugccggcgagaaggcccugaagcuaagcugguucaagaaagguuccuccauuggcaagauguuugaggccaccgcccggggggcccgacggauggccauacuuggggacacugcgugggauuucgggucuaucgggggcguguuuacaagcgucgggaagcugguacaccagaucuuuggcacggccuacgggguccucuuuuccggcgucucauggacgaugaagaucggcaucggagugcugcucaccuggcuaggccugaacucucgcagcaccucccuuucuaugaccuguaucgccguggggcucguaacgcuguaccuaggggugauggugcaggcggacuccggaugcguaaucaacuggaaaggccgugagcucaagugcgggaguggcauauucgugacuaaugaagugcacacauggacggagcaguacaaguuccaggcggauucaccgaagagacugucugcggccaucggcaaagccugggaagagggggucugcgguauccggagcgcuacccgccucgagaacaucauguggaagcaaaucuccaaugaacuuaaucauauccugcuggagaacgacaugaaguucacggucguugucggugauguugccggcauccuagcacaggggaagaagaugauccggccccagccuauggaguacaaguacagcuggaagucgugggggaaggccaaaaucauuggcgcugacguacagaacaccaccuuuauaaucgacgggcccaacaccccggagugcccggacgaucaacgcgccuggaacaucugggagguggaagacuauggcuucggaaucuucacgaccaacaucuggcucaagcugcgggacagcuacacccaggugugugaucaccgccuaauguccgcugccauuaaggacagcaaagccgugcacgcggacaugggcuacuggaucgaguccgagaagaacgagacguggaagcuugccagagcaucauucauagaggucaagaccuguauuuggccuaagucccacacgcucuggucgaacggcgugcucgaguccgaaaugaucauacccaagauuuacgggggcccgauuagccaacauaacuauaggccaggguacuuuacccagaccgccggccccuggcaccucgggaagcuggagcucgauuucgaccugugcgaaggcacgacaguggucguagacgagcacugcgggaaccgugggccgucccuacgcaccaccacggucaccggcaagaucauccaugaauggugcugccggaguugcacccugccgccccucagauuccgcggugaggacggcugcugguacgggauggagauccgacccgucaaagagaaggaggagaacuugguaaaguccauggugagcgcgggcagcggcgaggucgacuccuucagcuuagggcugcugugcaucucaaucaugauugaagaagugaugcggagccgcuggucccggaagaugcucaugaccggcacccuggcuguguucuuucugcucauuaugggccagcugacauggaaugauuugauccgccucugcauuauggucggcgcgaacgcaagcgaccgcauggggaugggcacaaccuaucuggcucugauggccacguucaagaugagaccgauguucgcgguggggcuccuguuccgcagacugaccucucgcgagguacuccuacugaccaucgggcucagccuggucgccuccguggaacugcccaauagccuagaggagcugggcgacgggcuagcgaugggaauuaugauccucaagcuccugaccgauuuccagucucaccaacuaugggccacguuacugagccuuaccuucaucaagaccacacugagucugcacuacgccuggaaaacaauggccaugguccucagcaucgugucccuguucccacugugcuuaucaaccaccucucagaagaccacguggcugcccguguuacuaggcucacuggguugcaagccccuaaccauguuccugaucgcggagaacaagaucugggggcggcgcuccuggccccugaacgaggggaucauggccguaggcaucguguccauccugcugagcucacugcuaaagaaugacguaccccuagcagggccgcugauugcaggcggcaugcugaucgccuguuacgucaucagcgguuccagcgcggaccuuuccuuagagaaagccgccgaggugagcugggaagaggaggccgagcauucgggcgccagccauaauauccugguggagguccaggacgacgggaccaugaagaucaaggacgaggagcgggaugauacccugaccauucuccugaaggcgacgcuccuggcaguauccggcgucuauccucugucgauccccgcgacucuuuuugucugguacuucuggcagaagaagaagcagcgcuccgguguccugugggacacccccucaccccccgaggugggucgggcuguccuggacgacggcauauaccgcauaaugcagcgugggcuacucggacgcagccagguggggguaggcguauuccaggagaacguguuccauaccauguggcacguuacgaggggagccguccugauguaccagggcaagcgacuggagccuuccugggcguccguuaagaaggaccucaucagcuacggcgguggauggcggcugcaagggaguuggaacaccggggaggaggugcaggucauugccgucgagcccgggaagaaccccaaaaacgugcaaacggcccccggcaccuucaagacgcccgagggugagguuggggcgaucgcauuggacuuuaagcccgggaccagcggcucccccaucguuaacagagagggcaagaucguugggcuguacgggaacggcguugucacgaccagcggcacguacgucucggcgaucgcccaagccaaggccucccaagaaggcccgcugccggagauugaggacgaggucuuccggaagcgcaaccugaccaucauggaucugcaucccgggagugguaagacgcggcgcuaucugccggcgaucguacgggaggcaauuaagcgcaagcugcguacucuaauuuuggcaccuacccgggugguagcuucagagauggcggaggcccugaagggcaugccgauacgcuaccagaccacagcuguuaaguccgaacacaccgguaaggagaucguggaucugaugugucacgcaacguucaccaugagacuucugucccccguccgcguaccgaacuacaauaugaucaucauggacgaggcccauuucacugacccgagcuccaucgcugcgagagguuacauaagcacucggguggggaugggcgaggccgccgccaucuucaugacugccaccccgcccggguccgucgaggcauucccgcagagcaacgccguuauucaagaugaagagcgggacauccccgagcgcuccuggaacagcggcuacgaguggaucaccgacuuucccgguaagaccgugugguucguccccagcaucaagucaggaaacgacaucgccaacugccuccggaaaaacgggaaacgcgugauccaguugucccggaagacguucgacaccgaguaccagaagaccaagaauaacgauugggacuacguggucaccacagauaucagcgagaugggggcaaacuuccgggccgaccggguaauagacccgcgucgaugccugaagcccguuauacucaaagacggcccggagcgagucauccuggccgggccgaugccggugaccgucgcguccgcagcccagcggcgcggccggaucggccgaaaucacaacaaagagggggaccaguauaucuauaugggucagccccuaaacaacgacgaggaccacgcucacuggaccgaagcuaagaugcuguuggacaacaucaacacccccgagggcaucaucccggcgcuauucgaaccggagcgagaaaagagugccgcgaucgauggcgaauacagacugaggggcgaagcgagaaagacuuuuguggagcuuaugagacgaggcgaccugcccguauggcucuccuacaagguagcgagcgaagguuuccaguacagcgaccgccgguggugcuucgacggggaacgcaacaaccagguauuagaagagaauauggacguagagaucuggaccaaggagggcgagcguaagaaauuacgccccaggugguuagaugcucggaccuacuccgaccccuuggcccuacgggaguucaaagaguucgcugcggggaggcggagugucuccggcgauuuaauccuugagaucgguaagcugccacagcaccucacucagcgagcccagaacgcacuggacaacuuggugaugcuccacaauagcgagcagggcggacgggccuauaggcacgcgauggaggaacugcccgauacgaucgagacccugaugcugcuggccuuaaucgccgugcucacagggggagugaccuuguuuuuccuguccgggcgaggccuugguaagaccucgaucgggcuucuuugcgugauggcgaguucaguacuccuguggauggcuagugucgagccgcacuggauagcagccagcaucauucucgaguuuuuucuaauggucuuacugauucccgaaccggaccgccaaaggacgccgcaggacaaccagcucgccuacgugguuauuggacugcuuuucaugauccucaccguggcggccaacgagaugggccugcuagaaaccaccaagaaggaucucggcaucgggcacguggcggucgagaaucaccaccacgccgccaugcuagauguggaccugcacccagccuccgcuuggacguuauacgcgguagccaccacgauuaucaccccgaugaugagacauacaaucgagaauacuaccgcuaacaucucgcugaccgcuaucgcgaaccaggcggcuauccugaugggcuuggauaagggauggccgaucucgaagauggauaucggggucccccugcuggcgcucggcugcuacagccaagugaacccccugacgcugaccgcggcggugcucaugcuggucgcucacuacgccauuaucgggccggguuuacaggcuaaggcgacccgcgaggcccagaaacggaccgccgccgggaucaugaaaaaucccacaguggaugguauuguugccauugaccuggaucccgucguauacgacgccaaguucgagaagcaacugggccagaucaugcugcuaauccugugcaccucccagauccugcugaugcgcaccaccugggcgcucugcgagagcauaacgcuugccaccgggccauuaacuacccugugggagggcucgccgggcaaguucuggaacacgacaaucgccgugucgauggccaacaucuuucggggcuccuaccuggccggugcggggcucgccuucagccuaaugaagucuuuaggcggaggcagacguggcacaggugcucaaggcgagacccucggugagaaguggaaaaggcaacugaaccaacucuccaagagcgaguuuaacacguacaagcgguccggcaucauggaagucgaccgcucggaggccaaggaggggcuaaagcggggcgagaccaccaagcacgcugugucccgcggaaccgccaagcugcgaugguucguggagcggaaccuggugaagccugagggcaagguaaucgaccugggcugugggcgcggcggguggagcuacuacugugccggccucaaaaagguaacggaagucaagggguacaccaagggcgggccugggcaugaggaacccaucccgauggccacguacggcuggaaccuggugaaacugcauucagggaaggacguguuuuucaucccgcccgagaagugcgauacgcuccugugcgacaucggggagagcuccccaaacccgacgaucgaggaggggaggacccugcgcguccucaagaugguggagcccuggcugaggggaaaccaguucugcauaaagauccugaaccccuacaugcccagcguagucgaaacccuugaacaaaugcagcggaaacacggcgggaugcuggugcgcaacccccuuucgcggaauucuacacacgagauguacuggguguccuguggaaccgggaacauagucagcgccgugaacaugacaucgcgcaugcugcugaacagauuuaccauggcgcaccggaagcccacguacgagcgcgacguagaccuuggcgcaggaacccgccacgucgcggucgagcccgaaguggcgaaccuugacaucauaggacagcgcaucgaaaauaucaagcacgagcacaagagcaccuggcacuacgacgaggacaacccuuacaaaacuugggcuuaccaugguucauaugagguuaagccgagcgggucugcgagcagcauggugaacggagucguuaaguuacugaccaagcccugggaugugaucccaauggucacucagaucgcuaugacggacaccacaccuuucggucagcagcggguguucaaggagaaaguggauacccgcacaccgaaggcuaaacgggggaccgcccagaucauggaggucaccgccaagugguuauggggcuuccugucucgcaauaagaagccacggaucugcacacgcgaggaauucacgcggaagguucgcagcaacgcggcgaucggcgccguguucgucgacgagaaucaguggaauagcgccaaagaagcggucgaggacgagcgguuuugggauuuggugcaucgcgagagagaacuccacaagcaaggcaagugcgcgaccugcgucuacaauaugauggggaagcgcgaaaagaaguuaggugaguucgggaaggcaaaaggcagccgggcgaucugguacauguggcucggggcccgcuuuuuagaauuugaggcgcugggguucaugaacgaggaccacugguucucccgggagaacagucuguccggcguggagggagagggacuccacaagcuuggguauauccugcgcgauaucagcaacauccccggcggcaacauguacgccgaugacaccgccgguugggacacacguaucacggaggacgaccuccaaaacgaggccagaauaaccgacaucauggagccggaacacgcucuccuggcgaaaagcauuuucaagcuaaccuaucagaacaaggugguccgcgugcagcggcccgcaaaaaacggcaccgugauggacgugaucagccgccgggaccagcgagguuccggucagguugguacguacggacugaacaccuucaccaacauggaagcccaauugauucggcagauggaaagcgaaggcaucuucucccccagcgagcuggagacccccaaccuggccgaaagggugcuggauuggcucgagaaguauggggucgagcggcugaagcgcauggcgaucucgggcgacgauugcgucgugaagccgauagacgaccgguucgcgacagcccugacagcccucaacgacauggggaagguccgcaaggacaucccgcagugggaacccucaaaaggcuggaacgauuggcagcaggucccuuucuguucccaccauuuccaccagcugaucaugaaggacggccgggaaauagugguccccugccgcaaccaggacgaacugguggggcgggcacgcguuucucagggagccggguggagccuccgggaaacggcgugccuggguaaauccuacgcccagauguggcagcugauguacuuucaccgucgggaccucaggcuggccgcuaacgccaucugcucagccguccccguggauuggauacccaccucccggacgaccuggagcauacacgcccaucaccaguggaugaccaccgaggacaugcugucgguguggaauagaguauggaucgaggaaaaccccuggauggaggacaagacgcacaucagcuccuggggcgacguaccguauuuaggcaaacgcgaggaccaguggugcggcagccugauaggucugaccgcucgggcuacgugggccaccaauauucagguggcgaucaaccagguccgccggcuaauuggaaacgagaauuaccuagacuauaugaccuccaugaagcgcuucaaaaacgagagcgacccugaaggggcccuuugguga

SEQ ID NO: 24587 - RNA, 9879 nt, Artificial Sequence
  derived and/or modified CDS sequence (opt11) from DENV-1__EU482517__SS-prME
ucggugaccaugcugcugaugcugaugcccaccgccuuggccuuucacuuaaccacacggggcggggagccccacaugaucgugagcaagcaggagcggggcaagucucugcuguucaagacuagcgccggggugaacauguguacacucauagccauggaccugggcgaacugugcgaggacaccaugaccuacaagugcccccggauaacggagacagagccugacgacguggacugcugguguaacgccacggauacuugggugaccuacgguaccugcagccagacgggcgagcauagacgggacaagcggucuguggcgcucgcgccccacguaggcuuagggcuggagacccggaccgagacguggaugaguuccgagggcgcauggaagcagauccagcgugucgagaccugggcgcugcggcaccccggguuuaccgugaucgcccuguuccucgcgcacgcgaucggcaccagcauuacucagaaggggaucaucuucauauuacuuaugcucgugacacccucaauggccaugcggugcgucggcaucggcagccgcgacuucguggaggggcuuaguggcgccaccuggguggacgucgugcuggagcacgggagcugcgugaccaccauggccaaggauaagccaacgcuggacauagagcuccucaagaccgaggucacuaauccggcagugcugcgaaagcucugcaucgaggcgaagaucuccaacaccacuacagacagccgcugccccacccagggagaggcaacccugguggaggaacaggacgcgaacuucgucugccggcgcacguucguugaucgugggugggguaacggcugcgggcuguucggcaagggaucccucaucacuugcgccaaguucaaaugcgugaccaagcuggagggcaagauuguccaguacgaaaaccugaaauacucggugauagugacgguacauacgggcgaccagcaccagguggggaacgagagcaccgagcacgggaccaccgccaccaucacgccacaggcgcccacgaccgagauccaguuaacagacuacggagcgcucacacuugacugcucaccgcgcaccggcuuggacuucaaugagaugguccugcugaccaugaaagagaaaucuugguuagugcacaagcaaugguuucuggaccugccgcucccuuggaccagcggcgccaguacgucccaggagaccuggaaccgccaggaccuguuagugaccuucaacaccgcacaugccaaaaagcaggaagucgugguguugggcagccaggaaggcgccaugcacacagccuuaacuggggccaccgagauacagacauccggcacgaccacgauuuucgccggacaccugaagugccgccucaagauggacaagcugacccugaagggcaugagcuacgucaugugcacgggauccuucaaacucgagaaagagcuggccgagacacagcacggcaccgugcuugugcagauaaaguacgagggaaccgacgcaccuugcaagauucccuucagcacgcaagacgagaaggggguaacgcaaaacggccggcugaucaccgcgaacccgaucgugacggauaaggagaagccugugaacaucgaggcugagccgcccuucggagagagcuacaucgugaucggugcgggcgagaaggcccucaaguuaagcugguucaagaagggguccucuaucggcaagauguuugaggccaccgcccgcggugcccgccgcauggccauauugggcgacaccgcgugggacuucgguagcaucggcggcguguucacuagcguggggaaguugguccaccagaucuucgguacagcuuacggaguacuguucucaggcgugucauggacgaugaagaucggcaucggcguccuguuaaccuggcugggacugaacucccgcagcaccucccucagcaugaccugcaucgcaguggggcuggugacgcuguaccucggugucauggugcaggccgacuccgggugugugauaaacuggaaaggccgggagcuuaagugcgggagcggcaucuucguuacuaaugaggugcacaccuggaccgagcaguacaaguuccaggccgacagcccgaagcgacuguccgcggccauuggcaaggccugggaggagggcgugugcggcauccggagugccacccgccucgagaacaucauguggaaacagaucuccaacgagcugaaucacauccuguuagagaaugacaugaaguuuacggucguggugggagauguagccggcaucuuagcgcaagggaagaagaugauccggccccagcccauggagcacaaguauagcuggaagagcuggggaaaggccaagaucauaggcgcugacgugcagaacaccacauucaucaucgacgggcccaacacccccgagugccccgacgaccagcgcgcuuggaacaucugggagguggaggacuacggcuucgggauuuucacgaccaacauauggcugaaguugcgggacaguuacacacaggucugcgaucaccgccuaauguccgcggccauuaaggacucuaaggccgugcacgccgacaugggcuacuggaucgaguccgagaaaaacgagaccuggaagcuggcccgugcuucuuucauagaggugaaaacgugcaucuggcccaagucccacacucuuuggagcaacggcguucuggagucagaaaugaucauccccaaaaucuacgggggcccgaucagucagcacaacuaccgccccgguuacuucacccagacggccggccccuggcaccuggggaagcuugagcuagacuucgaucugugugagggcacaacggugguggucgacgagcauugcggcaaccgugggccgagccuccggaccaccacagugaccggcaagaucauccacgaguggugcugucgcagcugcacgcugccuccccugcguuuccgcggggaggacggcugcugguacggaauggaaauacgcccugugaaggagaaggaggaaaaucucgucaaguccaugguaucugccggcucaggggagguggacucguucagucugggacugcucuguaucuccaucaugaucgaggaagucaugcguagccgguggagccggaagaugcugaugaccggcacgcuugccguuuucuuccuccucauaauggggcagcugaccuggaacgaucugauccgccugugcaucauggugggcgcaaaugcgagcgaccgcauggggaugggcaccacauaccuggcacucauggccacguucaagaugcggccgauguucgcagucggccugcuguuccgccgguuaaccucccgcgaagugcugcuauugaccaucgggcugagccugguggccuccgucgagcuacccaauagccuugaggagcuuggcgacggacucgcgaugggcaucaugauucugaaguuguugaccgacuuucagucccaccagcugugggccacgcugcucagccugacauucauaaagaccaccuucucccugcacuacgccuggaagacgauggccaugguguuaagcaucgucucccuguucccccugugccucagcaccaccucacagaaaaccacguggcugcccguauugcugggcucucuggggugcaagccgcugaccauguuccucauugcggaaaacaaaaucuggggccggcgcucauggccccugaaugaggggaucauggccgugggaaucguaucaauacugcucaguagucugcugaagaacgacgugccccucgccgggccccugaucgccggcgggaugcugauagcuugcuacgugaucucgggguccagcgcagaccuaagucuggagaaggccgccgaggucagcugggaggaggaggccgaacacucuggcgccagucacaacauccugguggagguacaggacgacgggaccaugaaaaucaaggacgaggaaagagacgacacccucacuauccugcugaaggcgacgcuccuggccgucucgggcguauauccacugagcauccccgcuacccucuucgugugguacuucuggcagaagaaaaagcagcgcuccgggguccugugggacacacccagcccuccagagguggagcgcgcagugcuggaugacggaauauacagaauaaugcaaagaggccugcucgggcgcucccaagugggcguggggguguuucaggagaacgucuuucacacgauguggcacgugacucggggcgccguacugauguaccaggggaagcgccuggagccuagcugggcguccguuaagaaggaccucaucagcuacggcggcggguggcggcugcagggcuccuggaacaccggggaggagguacaagugaucgccgucgagcccggcaagaaccccaagaacgugcagaccgcccccgguaccuucaaaacgcccgagggagaggugggggcuaucgcguuagacuucaagccggggaccagcggcucccccaucgucaaucgcgaggguaagaucgugggccuuuacggcaacgggguggugaccaccagcggcacguacgugucagcgaucgcccaggcaaaggccucccaggagggcccccugcccgagaucgaggacgagguguuuagaaagcgaaaccugacgaucauggaccuccaccccggcagcgggaaaacacggcgcuaucugccggcgaucguccgggaggcgaucaaacggaagcugcgcacccugauccuggccccgacgcgaguaguagcauccgaaauggcagaggcgcugaaggggaugcccauccgcuaccaaaccacugccgucaagagcgagcacaccggcaaggagaucguggaccucaugugccacgccacuuucaccaugcggcugcugagccccguccgggucccuaacuacaacaugaucaucauggacgaggcccacuuuaccgaccccagcuccauugccgcacgcggauacauaagcacccgcgugggcaugggggaagcagccgccaucuucaugacagccacgccacccggcuccgcggaggccuucccgcagagcaacgccgugauccaggacgaggagcgcgauaucccagagcgcuccuggaacagcggguacgaauggaucacagacuuuccgggcaagaccgucugguucgugcccuccaucaagagcggcaacgacaucgccaacugccuccggaagaacgggaagcgcgugauccaauuaucccggaaaacguucgacaccgaauaccagaagacuaagaacaacgacugggacuacguaguuaccacggauaucagcgagaugggugcgaacuuccgggccgaccgggucaucgacccgcgccggugucugaagcccguaauuuugaaagacgggcccgagcgggugauccuggccggacccaugccggugaccguugccuccgccgcccagcgccgggggcggaucggccgcaaccacaacaaggaaggagaccaauacaucuacauggggcagccccugaauaacgaugaggaccacgcccacuggaccgaggcaaagaugcugcuggacaacaucaauacccccgagggcaucauccccgcccuguucgaaccggagcgcgaaaaguccgccgcgauugacggugaguaccgccuccgcggcgaggccaggaaaacguucguggagcugaugcgccgcggggaccugcccgucuggcucuccuacaagguggccagcgaaggcuuccaguacagcgaccgccgguggugcuuugauggcgagcgcaauaaucaggugcuggaggagaauauggacguagagaucuggaccaaagagggagaaaggaaaaagcugcgcccccgguggcucgacgcccgcacauacagugauccgcuggcccugcgcgaguucaaggaguucgcggccggcaggcggaguguguccggggaccucauccuggagaucggcaagcugccgcagcaccucacccagagggcgcagaaugcccuggacaaccuagugaugcuccacaacucagagcagggcgggagagcguaccgucaugccauggaggagcugccugauacgaucgagacgcucauguugcuggcccugauagccguccucaccggcggggugacccuguuuuuccugucgggccggggccuuggcaagacgagcaucggccuucuaugcguaauggccuccagcguccuccuauggauggccuccgucgagccgcauuggaucgccgccagcaucauccuggaguucuuccugauggugcugcuaauuccugagccggaccgccagcggacgccgcaggauaaucaacucgccuacguggugaucgggcugcuauucaugauacucaccguggccgcgaaugaaaugggacuccuggagaccaccaagaaggaucucgggauaggccacguggccgucgaaaaccaccaccacgcagcuaugcuagacguggaccugcaccccgcauccgcguggacgcucuacgccguggccaccaccaucaucaccccgaugaugcgacacacgaucgagaacaccaccgcuaacaucagccugacggccauugcgaaccaggccgccaucuugauggggcuagacaagggcuggcccaucucgaagauggacauaggcguaccccugcuggcccucgggugcuacagccaagugaacccucugacgcucacggcggccguccucauguuaguggcccacuacgcgaucaucggcccggggcugcaagccaaagcgacccgggaggcccagaagcggaccgcagcuggcauuaugaaaaaccccacgguggacgguauuguagcuauugaccucgaccccgugguuuacgaugcgaaguucgagaagcagcugggccaaaucauguuacucauauugugcaccucccagaucuugcucaugcgcaccacaugggcccugugcgagagcaucacgcuggcuacgggcccacucaccacccugugggagggguccccgggcaaguucuggaacacaaccaucgccguaagcauggccaauaucuuucggggguccuacuuagcgggcgccggacuagccuucagccugaugaagagccucggaggcgggcgcagaggcaccggggcccagggcgaaacccucggcgagaaguggaaacgccaguugaaccagcuguccaagucggaauucaacacguauaagcggagugggaucauggaaguggacagauccgaagcgaaggagggccucaagcgcggugagaccaccaagcacgcggugucccgcggcaccgccaaguuacggugguucgucgaacggaacuuagugaagcccgaagggaaggucaucgaccugggcugcggucgcgggggcuggagcuacuauugcgccgggcuaaagaaggucacggaagugaagggcuauacgaaggguggccccggucaugaagagcccaucccaauggccaccuacggguggaaccugguuaaacugcacuccggcaaagacgucuucuucauuccgccagagaagugcgauacccuccugugcgacaucggagaaagcucacccaacccgacgauugaggagggccgcacucugcgggugcucaagaugguggagccauggcucagggggaaccaguucugcauuaagauacugaacccauacaugcccagcgugguggagacccucgaacagaugcaacggaaacauggcggcaugcugguacgcaacccgcuguccaggaauucgacccacgagauguacugggucuccugcgggaccggcaacaucgugagcgcggugaacaugacuucccgcaugcuccuaaaucgauuuaccauggcucaccggaagccaacauacgagcgcgacgucgacuugggggccgguaccagacacguggccguagagccagagguagccaaccucgacauaaucggccaacggauugagaacaucaagcacgagcacaagagcacauggcacuacgacgaagacaaccccuauaagaccugggcguaccauggguccuacgaaguaaagccgucagggagugccuccuccauggugaacggggucgugaagcugcuuaccaagccuugggacguuauccccauggugacucagaucgcgaugacggacaccacucccuucggccagcagaggguguucaaggagaaggucgacacacgcacgcccaaggcaaagcgggggaccgcccagaucauggagguaaccgcgaaguggcucuggggcuuccucagccgcaauaagaagccccggauuugcacccgcgaagaauuuacacgcaaggugagaagcaacgccgccaucggcgcuguuuuuguggacgagaaucaauggaauagugcgaaggaggcgguggaggaugagcgguucugggauuuagugcacagagagcgggagcuccauaagcaggggaaaugcgcgaccugcguguacaacaugaugggcaagagagagaagaagcugggggaguuuggcaaagcgaaggggagucgggccauaugguacauguggcugggcgcgagauuccucgaguucgaagcccugggguucaugaacgaggaccacugguucucccgggagaacagccuguccggagucgagggugaagggcuccacaagcugggcuacauccugcgcgacaucaguaagauccccggggguaauauguaugccgaugauaccgccggcugggacacccggaucaccgaggacgaucuccagaacgaggcccggaucacggacauaauggagccggaacacgcgcuccuggccaagucgaucuucaagcuaacauaucagaacaaggugguucgugugcagcggccagccaagaacggcaccguaauggacguaaucucgcgccgggaccagcgcggcuccggacaggugggaaccuacggccugaauaccuucacuaacauggaggcgcagcugauacggcagauggauagcgagggcaucuuuagcccgagcgagcucgaaaccccgaaucuggccgagcggguccuggacuggcuagagaaguacggagucgaacggcuuaagcgcauggccaucuccggugacgacugcguagucaaaccgaucgacgaccgcuuugccacggcccucaccgccuugaacgacaugggcaaggugcgcaaagacaucccccagugggaacccagcaaaggguggaacgauuggcagcagguccccuucugcucccaccauuuccaccagcugaucaugaaggauggccgggagaucgucgugccuugccgcaaccaggacgagcuggugggccgagcccgggucagccagggagcgggcuggagccuccgggagacggccugccuuggcaaguccuaugcccagauguggcagcuaauguacuuccaucgccgggaccuacgccuggccgcgaaugcaauaugcagugccgugcccguugacuggauacccaccucccggacuaccuggaguauccacgcccaccaccaguggaugaccaccgaggacauguuaucuguuuggaaucgcguguggaucgaggagaaccccuggauggaggacaagacgcauaucagcuccuggggcgacgugccguaccucgggaagcgcgaggaccaguggugcggcagccugauaggccugaccgcccgggccaccugggccaccaacauccaggucgccaucaaucagguccgucgacucauagggaacgagaacuaccuggauuacaugaccucuaugaagcgauucaagaacgagagcgacccagagggggcccugugguga

SEQ ID NO: 24588 - RNA, 9879 nt, Artificial Sequence
  derived and/or modified CDS sequence (opt11) from DENV-1__EU482519__SS-prME
ucggucaccaugcugcucaugcuaaugcccaccgcccuggccuuccaccuuaccaccagggguggggagccccacaugaucguaaccaagcaggagagaggcaaaagccugcuguucaagaccagcgcgggggugaacaugugcacccucaucgccauggacuuaggggagcugugcgaagacacuaugaccuacaagugcccacggauaaccgaggcugagcccgacgauguggacugcuggugcaaugccaccgacaccugggugaccuacgguaccugcagccagacgggggagcaccggcgcgacaaacgguccguugcgcucgcaccacacgugggucucgggcuggagacccgcacggagaccuggauguccucggagggcgccuggaaacaaauccagcgggucgagacgugggcuuugcgccacccgggguucaccgugauggcccucuuccuggcccaugcuaucggcacgagcaucacccagaaggggauuaucuucauacuccugauguuagugacgcccagcauggccaugcggugcgucggcaucggcucccgcgacuucguggaagggcugagcggcgcaaccuggguggacgucguccuggagcacgguuccugcgugacuacuauggccaaggacaaacccacgcucgacaucgagcuccugaagacagagguuaccaacccagcggugcugcggaagcucuguauugaggccaagaucagcaacaccacgaccgacuccagaugccccacgcagggcgaggccacccugauggaggagcaggacgccaauuuugugugccggcgcacguuuguagaccggggcugggggaacggcugcggguuguucggcaaggggagccuuaucacgugugccaaguuuaagugcgugaccaaauuggagggcaaggugguccaguacgaaaaucugaaauacuccgugaucguuaccguacacacaggcgaucagcaccagguggggaacgagagcaccgagcacggcaccacggcgaccauaacuccgcaggcccccacuuccgagauccagcucacggauuacggggccuuaacccuggacuguagcccccgcacgggccucgacuucaacgagaugguauuacugaccaugaaggagaagucauggcucgugcacaaacaaugguuccuggaucugccgcucccuuggaccagcggggccagcaccucccaggaaacguggaaccggcaggaucuacuggucaccuucaagacggcccacgcgaaaaagcaggaggucguggugcucggcucucaggaaggcgccaugcacaccgcccugacgggagccaccgagauccaaaccuccggcaccaccaccaucuucgcagggcauuugaagugccgccuaaagauggauaaacucacccugaaaggcaugagcuacgucaugugcacugguuccuucaagcuggagaaggagguggcggagacgcagcauggcaccguguuaguccagaucaaauacgagggaacggacgcccccugcaagaucccguucagcacccaagacgagaaaggugugauacagaacggccggcuaaucacggccaacccgaucguuaccgacaaggagaaacccgucaacaucgaggcugaaccgccuuuuggugaguccuacauagucaucggcgucggugagaaggcccugaaguuaagcugguucaagaaaggcuccagcaucggaaagauguucgaagccaccgcgcgaggagcccgucgcauggccauccugggcgauaccgccugggacuucggguccauuggcggcguauucacguccguggguaaacuggugcaccagaucuuugguacagcuuacgggguccucuucuccggcgugagcuggaccaugaagaucggaaucggggugcugcucacauggcucggucugaauucccgcagcacuucccuguccaugacgugcaucgccgucgggcucgugacccuguauuuaggagugaugguccaggcagacuccgggugcguaauaaauuggaagggccgagagcucaagugugggucaggcauuuucguuaccaaugagguccacacguggaccgagcaguauaaguuccaagcugacucaccgaagcgccuguccgcggccauuggcaaggccugggaggaagggguaugugguauccgguccgcaacacgccuggagaacaucauguggaagcaaauuucgaacgagcucaaucacauacugcuugagaacgauaugaaguucaccgugguagucggagacgugguaggcauacucgcgcaagggaagaaaaugauacggccccaacccauggagcacaaauauagcuggaaaaguuggggcaaggcgaagaucauuggcgccgacgugcagaacaccacguucaucauagaugggcccaacacgccagagugccccgacgaucagcgcgccuggaacauaugggaggucgaagacuacgguuucggcaucuucaccaccaacaucuggcuaaaguugcgggacagcuacacucaggccugcgaucacagacucaugagugcugcaauaaaggacagcaaagccguccacgcugacaugggcuacuggaucgaguccgagaagaacgagaccuggaagcuggcacgcgcuagcuucaucgaggugaagacaugcauauggccgaagucccacaccuuguggagcaacggcguucucgagagcgagauggugauccccaagaucuacggaggcccgauaagccaacauaacuaccgccccggguauuucacccagaccgccggcccguggcaccugggaaagcuggagcucgacuucgaccugugcgagggaaccaccguagucgucgacgagcacugcggaaaccggggaccgucccugcgcacgacaaccgucaccggcaagauuauccacgaguggugcugccggaguuguacucugccaccccuacgcuucaagggugaggacggcugcugguacgguauggagauacgacccgugaaggagaaagaagagaaccuggucaaauccaugguaagcgcuggcucgggcgagguggacuccuucagccucggacuucugugcaucuccaucaugauagaagaagucaugcgcagcagguggagucgaaagaugcucaugaccggcacccuggcgguguuccuacuacugaucauggggcaacugacauggaacgacuugacgcgacuaugcaucauggugggcgccaacgcgagcgaccgcauggggaugggcacuaccuacuuggcccucauggccaccuucaagaugagaccaauguucgccguaggacugcuuuucagaagacuaacauccagagaagucuuauugcucaccaucgggcugagccucguagccuccguggaacucccuaacagcuuagaagaguugggugacggguuagcgaugggcaucaugaucuuaaaacugcucaccgacuuccagucacaccagcugugggcaacccugcucucacugacguucaucaaaaccacgcuguccuuacacuaugccuggaagaccauggcaaugguacugaguaucgucucacuauuuccccuuugcuuaagcacgaccucccagaaaaccacuuggcugcccgugcuccugggcucccuggguuguaagccguuaacgauguuccugaucgcggagaacaagauauggggccgcaagucguggcccuuaaacgaggguaucauggcugugggagucgugucuauccuucugaguucccugcucaaaaacgacgugcccuuggccgggccucuaaucgcaggaggcaugcucaucgccugcuacgucaucagcgggaguagcgcggaucugucucuagagaaggcagccgaaguaagcugggaggaggaggccgagcacuccggagccagccacaauauccucguugagguccaggacgacgggaccaugaagaucaaggacgaggagcgggacgauacauugaccauccugcugaaggcaaccuugcuggccguauccgguguauacccguuaagcaucccagcaacgcuguucguuugguauuucuggcagaagaagaagcagcgcuccggggugcugugggauacccccagcccgcccgaaguugagagagccgugcuggacgacgguaucuaccgcaucaugcaacguggccuccuggggcgcucccagguaggcgugggggucuuccaggagaacguauuccacaccauguggcaugugacccggggcgccguccugauguaccaggggaagcgccuugaacccagcugggcgagugugaagaaggaccugaucaguuacggcggcggauggcggcugcagggcaguuggaacacgggggaagaggugcagguaauagccguugaaccuggaaagaacccaaaaaacguacaaaccgcccccgggacguucaaaaccccggagggagagguaggcgcaaucgcccucgacuucaagcccgggacgagcggcucccccauagugaaccgcgaggggaagaucgugggccuauauggcaacgguguuguuaccacuuccggcacguaugucagcgcgauagcgcaggcuaaggccucucaggagggcccgcugcccgagauagaggacgaggucuuccggaagcgcaaucucacgaucauggaccuacaccccggaagcgggaaaacccggagauaucugccugcgauaguuagagaagcgaucaagcgcaaacucagaacccugauacuggcccccacccgcguggucgccucggagauggccgaggcgcuuaagggcaugcccauacgcuaccaaacgacagccgucaaaagcgagcacacgggcaaagaaaucgucgaccugaugugccaugcaacauucaccaugcguuugcucuccccggugcgcguuccaaacuauaacaugaucaucauggacgaggcccacuucaccgaccccagcuccaucgccgcgcgggguuauaucagcacccgugucggcaugggggaggccgccgcuauuuucaugaccgcuacgccgccggguuccgucgaggcguucccgcagagcaacgcagugauccaggacgaggagcgggacauccccgagcgcuccuggaacucgggauacgaauggaucacugacuucccuggcaaaaccgugugguucguucccuccaucaagaguggcaacgacaucgccaacugcuugcggaagaacgggaagcgcgugauccagcugucccggaagaccuucgacaccgaguaccagaagacuaagaacaaugacugggacuacguggucaccacagacaucucggagaugggcgccaauuuccgcgcagaccggguuauugacccgagaagaugccucaagcccguaauccugaaagaugguccugaacgcgugauccuggccgggcccaugccggugacugucgccuccgcugcccagcgccgcgggcggaucggacgcaaccauaacaaggaaggcgaucaguacaucuacauggggcagccccuaaacaacgacgaggaccacgcgcacuggaccgaggccaagauguugcuggauaacaucaacacgcccgagggcaucauccccgcccuauucgagcccgagcgugagaaauccgccgccaucgacggcgaguaccgacugcgcggugaagcgcgcaagaccuucguggagcugaugcgacgcggagaccucccagucuggcucuccuauaaggucgcaagcgagggguuccaguacuccgaccgccgguggugcuucgacggcgagcgcaacaaccaagugcucgaggagaacauggacguggaaauauggacgaaggagggggagcggaagaagcuccgcccgcggugguuggaugcccgaacauauagcgacccccuggcccugcgcgaguuuaaagaauuugcagcgggccgccggagcgucaguggggaccugauccuggagaucggcaagcugccucagcaccucacacagcgcgcccagaacgccuuagauaaucucgugaugcugcacaacagcgagcagggcggccgcgcguacaggcacgcgauggaggaauuacccgacaccauagaaacgcuaaugcugcuggcgcucaucgccguccugaccggcggagucacccuguucuuccucagcggccgggggcuggguaaaaccucgaucggguuauuaugugucauggccucaagcguacuccuguggauggcguccgucgagccccacuggauugcugcuuccaucauacuggaguucuuuuugauggugcuacucauccccgaaccggaccgccagcggacgccacaagauaaccagcuggcguauguugucauaggacucuuguucaugauccugacuguggccgccaaugagaugggccuccucgagaccaccaaaaaggaccugggcauuggccacguggcuguugagaaucaccaccacgcaaccaugcuggacguggaucuccacccggccuccgcauggacgcuguaugccguggcgacuaccaucaucacgccaaugaugcgccauacaaucgagaacacuaccgccaacauuagccugaccgccauugcgaaccaggccgcgauccugaugggucuggacaaggguuggcccauauccaagauggacauaggcgucccccugcucgcccuggggugcuacagccaagucaacccccugacgcucaccgccgccgugcugaugcuggucgcgcauuacgccaucaucggcccggggcuacaggccaaggcgacccgcgaggcccagaagcggaccgcggccggcaucaugaaaaaccccacuguagacgggaucguggccaucgaccuggaucccguugucuacgacgccaaguucgaaaaacaacugggccaaaucaugcuccucauucugugcacgucccaaauacucuugaugcgcacuaccugggcccugugcgagaguaucacgcucgcgaccggcccccugaccacccugugggagggaucgccaggaaaguucuggaacacgacgaucgccgugucuauggccaacaucuuccgggggagcuaccuugccggggccggccuggcguucucccugaugaaguccuugggcggagggcgccggggcaccggugcccaaggcgagacccuuggagagaaguggaagcgccagcugaaccagcucucaaaauccgaauuuaacaucuauaagcgguccgguauuauggaaguagaccgcuccgaggccaaggagggccugaagcgcggugagacgacccgccacgccguaucccggggcaccgcgaaauugaggugguucgucgagcggaaccuggucaaacccgaagggaaagugauugaucuugggugcggccgcggcggcuggagcuacuauugcgcuggucugaagaagguuaccgaggucaagggcuacacgaaaggugggcccggccacgaggagccgaucccuauggcuaccuacggguggaaucuaguaaagcuccacucuggaaaggacguguucuucacgccgcccgagaagugcgacacgcuacugugcgauauuggcgagagcagccccaacccgacuauugaggagggccggacccuacgcguccugaagaugguggagcccuggcugcgggggaaucaguucugcaucaaaauccuaaaccccuacaugcccagcgucgucgaaacccuggagcagaugcagcgaaagcacgguggcaugcuggugcgaaacccccuauccaggaauagcacccacgagauguauugggugucguguggcacgggcaacaucgucucggccgugaacaugacauccaggaugcugcuaaaucgcuucacgauggcccaccgcaagcccaccuaugagcgggacguggaccuaggggcgggcacccgccacgucgcugucgaacccgagguugccaaccuggacaucaucggacaaagaauagagaacauaaaacacgagcacaaaagcaccuggcacuacgacgaggacaaccccuacaagaccugggccuaccaugguuccuacgaggucaagccgagcggaagcgccagcagcauggugaacgggguggucaagcugcucacuaagccgugggacgugauacccaugguuacccaaaucgcgaugacugacacgaccccuuucggccaacaacgcguauucaaagagaagguggacacucgaacgccgaaggccaagagagggacggcccaaaucauggaggucaccgcgcgguggcucuggggcuuccuuuccagaaauaaaaagccccggauaugcaccagggaggaguuuacgaggaaggugcgcucgaacgcugcuauuggcgcuguguucgucgacgagaaccaguggaacuccgccaaagaggcgguggaggacgaacgguucugggaccuagugcagaaggaaagagagcuacacaaacaggggaagugcgcgacgugcgucuacaacaugaugggcaagagggaaaagaagcugggagaguucggcaaagcuaaggggagccgcgcgaucugguacauguggcucggcgcccgguuccuggaguucgaggcccugggcuucaugaacgaggaucauugguucagccgcgagaacagcuuguccgggguagagggugaggggcugcacaagcugggcuacauccuccgggacaucucaaaaauccccgggggaaacauguacgcggacgauaccgccggcugggacacccgcaucaccgaggacgaccugcagaacgaggccaaaauuaccgauaucauggagccggagcacgcccuucucgccaccuccauuuucaaacugaccuaccagaacaaggucgugcgggugcagcgcccggccaagaacgggacggugauggacgucaucagccgccgggaccagcgcggcaguggacaggugggcaccuacggauugaacacauucaccaauauggaggcucaacuaauccggcagauggagagugagggcauauuccucccguccgagcuggagacgccgaaccucgccgagcgcgugcuggauuggcuggagaagcacggcgucgagcgacucaagcggauggccaucagcggagacgacugcguugucaagccgaucgacgaccgguucgccacagcgcugaccgcccucaaugacaugggcaagguccguaaggacauaccucagugggagcccucgaagggguggaacgacuggcagcaggucccguucugcagccaucauuuucaccagcucauaaugaaggacggccgggagaucguugucccgugccgcaaccaggacgagcuggugggcagggcucgcgugagccaaggggcgggguggagcuuacgggagacagccugccugggcaagagcuacgcgcagauguggcagcugauguauuuccacagaagagaccugcgacucgcagcgaacgccaucugcuccgcagucccaguggacugggugcccacgagccggacgaccugguccauccacgcccaccaccaauggaugacaacugaggacaugcugucagucuggaaccgaguguggaucgaggaaaaccccuggauggaggauaagacccacgugucuagcuggggcgacguuccguaucuggggaagcgggaggaccaguggugcgggucccucaucggacugacagcgcgagcuaccugggcaagcaauauccagguugcaaucaaucaagugagacggcugaucgggaacgagaacuacuuggacuacaugaccuccaugaagcgauuuaagaacgagggcgaccccgagggggcccugugguag

SEQ ID NO: 24589 - RNA, 9879 nt, Artificial Sequence
  derived and/or modified CDS sequence (opt11) from DENV-1__EU482520__SS-prME
agcguaacaaugcuacucaugcugaugcccaccgcccuggccuuccacuugaccacccggggcggggagccccacaugauugugagcaagcaggagcggggcaaaagccugcuguucaagaccagcgccggggucaacaugugcacauuaaucgccauggaccuaggcgagcuuugcgaagauacaaugaccuacaagugcccccgcaucaccgagaccgaaccagacgauguggacugcuggugcaacgcgacggacacaugggugaccuacgggaccuguagccagacgggcgaacaccggagagauaagcgguccguggcccucgcgccccacgugggucuggggcuggaaacuagaaccgagaccuggaugagcuccgagggcgcguggaaacagauccagcggguagagacgugggcccuccgccaccccggguucaccgugauagcccuguuccucgcccaugcaauuggcacuagcaucacccagaaggggaucaucuucauccuacuuaugcuuguuacgcccucuauggccaugcggugcgucggcaucggaagccgcgacuucguggaggggcucucaggcgcuacuuggguggacgucgugcuggagcaugggagcugcgugaccaccauggccaaggacaaacccacgcuggacaucgaacugcugaagaccgaggucaccaaccccgccgugcugcggaagcucugcaucgaagcgaagauaucuaacaccacgacugacagcaggugcccgacacagggcgaggccacccugguggaggagcaggaugcaaauuucgucugccgccggacguucguggaccgggguuggggcaacggaugcgggcuguucggcaaagguucccucaucacgugcgccaaguucaaaugcgugaccaagcuggagggcaagaucguacaguacgagaaccugaaguacagcgugaucgugaccguccacacgggggaccagcaccaggucggcaacgagucuaccgagcacgggacgaccgccaccaucacgccucaggcgcccacgaccgagauccagcucaccgauuacggggcccugacgcuggacugcuccccccgcaccggccucgauuucaacgagaugguccuccugaccaugcgggagaaaaguuggcucguucauaaacagugguuccuagaucugccacuucccuggaccagcggcgccagcacgucccaggagaccuggaaccgccaggaucugcuggugaccuucaaaaccgcccaugccaagaagcaggaggucguggugcucggcagucaggaaggcgcgaugcacacggcccugaccggagcgaccgagauccagacauccggcacgaccaccaucuucgccgggcaucugaaaugccgcuugaagauggacaagcucacccugaaaggcaugagcuacgucaugugcacgggguccuucaaguuggagaaagaaguagcggagacccagcacggaaccgugcugguccagaucaaguacgagggcaccgacgcgccgugcaaaauacccuucagcacucaagacgagaaaggggugacccagaauggcagacuaaucaccgccaacccgaucgugaccgacaaggaaaagcccgucaacaucgaggccgagccgcccuucggggaguccuacaucgugauaggagccggcgagaaggcgcugaagcugagcugguucaagaaaggguccagcauaggcaagauguucgaggccacggcccggggggcccgccgcauggccauccugggcgacaccgcgugggacuucgggagcaucggcggcgucuucacaucggucgggaagcugguccaccagaucuucggcaccgccuacggggugcuguuuuccgggguuagcuggacgaugaagaucgggaucggcgugcugcugacguggcucggccugaauagccggucaaccucccucagcaugaccugcaucgccgugggccucgucacgcuguaccucggcgugaugguacaagccgacagcgggugcgucauuaacuggaagggacgcgagcucaagugcgggagcggcaucuucgugaccaacgaggugcacacuuggaccgagcaguacaaauuccaggcugacucgccuaagcggcugagugcggcaauaggcaaggccugggaggagggggucuguggcauccgcagugccacccgucuggagaacaucauguggaagcagauuuccaaugaacucaaccacauccugcuggaaaacgacaugaaguucaccguaguggucggggacguggccggaauccucgcgcaggggaagaagaugauccgcccccagcccauggaguacaaguacagcuggaagucuuggggcaaggcgaagaucauuggcgccgacgugcagaacacgacguuuaucaucgacggccccaacaccccggagugccccgacgaccaacgggcuuggaacauuugggaggucgaggacuacggcuucggaaucuucacgaccaacaucuggcugaagcugcgcgacagcuacacccaggugugugaucauagacucauguccgcggccaucaaagacucuaaggccguucacgcugacaugggcuacuggaucgaauccgaaaagaacgagaccuggaaacuggcccgggcgagcuucaucgaagucaagacgugcauuuggccuaagucgcacacccuguggagcaacggcgugcucgaguccgagaugaucauccccaagaucuauggaggcccgauaagccaacacaacuaccggccagguuauuucacccagacugccggccccuggcacuuagggaagcuggaguuagacuucgaccugugcgagggcacgaccguggucguagacggccacugugguaaccgcggcccuucccugcguaccaccacggugacugggaagaucauccacgaguggugcugccgcagcugcacccugccgccgcuucgguuccgcggcgaggaugggugcugguacggcauggagauccggccugucaaagagaaggaggagaaccuagugaaguccauggugagcgccgggagcggggagguugauaguuucagccucggccuacugugcaucucuaucaugaucgaggaagugaugcgcagccggugguccaggaagaugcucaugaccgggauccuggccguauuuuucuuacuuaucaugggccagcugacguggaacgaccuaauucgccucuguaucauggucggggccaacgcgagugaccgcaugggcauggggaccacguaucuagcccugauggcuaccuuuaagaugcgcccaauguucgccguugggcuccuauuccggcgacugacgucccgggaggugcuacugcugaccaucggccucucucuggucgccuccgucgaacugccgaacagcuuggaggagcucggggacggccuggcgaugggcaucaugauccucaagcugcugacagacuuucagucgcaccagcucugggccacccuguugucacucacguuuaucaagacaacguuuucgcugcacuacgccuggaaaacaauggccaugguucugagcaucgugucccucuucccgcugugucuuagcacgaccucacagaagaccaccugguugcccgugcuguuggguagcuuaggcugcaagccgcugacgauguuccugaucgcugaaaacaagauuugggggcgccgguccuggccccucaacgagggcaucauggccgucggaaucgugagcauccugcugagcucccuccugaaaaacgacguaccccucgccggcccccucaucgcgggcgggaugcugaucgccuguuacgucauuagcggauccagcgcggaccugucccucgaaaaggcggccgaggugagcugggaagaggaggccgaacacuccggggccagccacaacauccugguggaggugcaggaugacggcaccaugaagaucaaggacgaggagcgggacgacacccugaccauccuccugaaggcgacccugcuagccguguccgggguguacccgcugagcauccccgccacgcuuuucguuugguacuucuggcagaagaagaagcagagauccggcguguugugggacaccccaagcccgcccgaggugggccgcgcuguucuggacgacgggauuuacaggauuaugcagcgcggccugcuggggcggucccaggugggugucgggguauuucaggagaaugucuuccacaccauguggcacgugacccgcggcgccguccucauguaccagggcaagcggcuggagcccagcugggcguccgugaagaaagaccugaucuccuacggggguggguggcgccuccaaggcuccuggaacaccggcgaggaggugcaggucaucgccgucgagcccggcaagaaccccaagaaugugcagaccgcacccggcacauucaagacccccgaaggggaggucggcgccaucgcccuggacuuuaagcccgggacgucaggcucccccaucgugaaccgggagggcaagaucguggggcuguacggcaacggggucguaaccaccagcggcaccuacgugagcgcgaucgcccaagccaaggccucucaggaggggccgcuccccgagaucgaggacgaagucuuucgcaagcggaauuugacaauaauggaccuucaucccggcagugggaaaacccggagauaccucccggcgaucguucgcgaggccaucaagcgcaagcugcggacccugauccucgcacccacccgcgugguggccucggagauggccgaggcgcugaaagggaugccuauucgguaccagacgaccgccgucaagagcgaacacaccgggaaggagauuguggaucugaugugccaugccaccuucacgaugcgccuccugucccccguccgggugccaaacuacaacaugaucaucauggacgaggcccacuucacugaucccagcuccaucgccgcgcgcggcuacaucagcacccgggugggcaugggggaggccgccgccaucuucaugaccgcuacgccgcccgguuccgucgaggcauuuccgcagucgaacgccgugauccaggacgaagagcgggacauccccgaacggucauggaacaguggcuacgaguggaucaccgacuuucccgguaagaccgugugguucgucccuuccauuaagucuggcaacgacaucgcuaacugucugcgcaagaacgggaagcgugugauccagcucucccgcaaaaccuuugauacggaguaccagaagacgaagaacaacgacugggacuacguggucaccaccgacauuagcgagaugggagccaacuuccgggcggaccgcgugaucgauccacggcgcugccugaagcccgugauccugaaggacgggcccgagagggucauccucgcggggcccaugccggugacgguugcuagcgccgcccagcgucggggccgcaucgggcguaaucacaacaaggagggcgaccaguacaucuacauggggcaaccccugaauaacgacgaggaccacgcgcacuggaccgaggccaagaugcugcucgacaauauuaacacacccgagggcaucauacccgcucucuucgaaccggagagggagaaguccgccgccaucgacggggaguaccgucugcggggcgaggcgagaaaaaccuucgucgaauuaaugcggcgcggugaccugcccguguggcugucguacaaagucgcaagcgagggguuucaauacagugaccggcgcuggugcuucgacggcgaacggaacaaccaggugcucgaggagaacauggacguggaaaucuggacgaaggagggggagcgaaagaagcuucguccccgcuggcuggacgcccggaccuacagugaccccuuagcccugcgcgaauucaaggaguucgccgcgggccgccgcagcguauccggcgaccugauacucgagaucgggaagcugccgcagcaucuaacccagcgagcccagaacgcacucgacaauuuagugaugcugcauaacagcgagcaaggcgggcgcgccuaccggcacgcgauggaggagcucccagauaccauugagacguugaugcuacucgccuugauagccgugcuaaccggcggggucacucucuucuuccuguccggccgcggccuggggaagaccucgaucggccugcugugcguaauggccagcagcgugcuauuguggauggccuccgucgaaccccacuggaucgcugcaagcaucauccuggaguucuuccugauggugcucuuaauccccgagccggaucggcagcguacgccucaagacaaccagcucgcauauguggugaucgggcuccuguucaugauacugacgguggcggccaaugagaugggccuccuggagaccaccaagaaagaccugggcaucggucacguggcggucgagaaccaccaucacgccgccaugcucgacguggaccugcaccccgcgagugcuuggacccuguacgcgguggccacuaccauaaucacuccgaugaugcgccacaccauagagaacacgaccgcgaacaucagccucaccgccaucgccaaccaagccgccauccugaugggccucgauaagggguggcccaucuccaaaauggacauuggcguaccccuacuggccuuagggugcuacagccaagugaacccccucacccugacggccgcuguguuaaugcucgucgcccacuacgccaucaucggcccggggcugcaggccaaggccacaagagaggcgcagaagcgcaccgccgccggcaucaugaagaaccccacuguggauggcaucguggccaucgaccuggacccagucguguaugacgccaaguucgagaagcagcucgggcagaucaugcugcugauccucugcacgucccagauccuccugaugagaaccaccugggcccucugcgagagcauaacucucgcgacgggcccucugaccacccucugggaggguuccccgggcaaguucuggaauaccacgaucgccgugagcauggccaacauuuuccgcggcaguuaccuggccggggcgggccuggcguucagucucaugaagucccucgggggcgggcgacgcggcacuggcgcccagggggaaacccugggcgagaaguggaagcgacagcuaaaccagcugucgaagagcgaguucaacaccuauaagcgcuccgggaucauggaggucgaucggagcgaggccaaggagggccugaagcgcggggaaacgaccaagcacgcgguguccagaggcacugcaaagcuccgcugguuuguggaacgaaaccugguaaagcccgaaggcaaggucauugaccuggggugcggccgcgggggcuggagcuacuacugcgccgggcugaagaaggugaccgaggucaagggcuacacgaagggcgggcccggccaugaggagcccaucccgauggccaccuauggguggaauuuagugaagcuucauuccggcaaggacguuuucuucaucccgcccgagaagugcgacacccuguugugcgacaucggggaaucuucgcccaacccgacgaucgaggagggccggacacugcgcguccuuaagauggucgagcccuggcuccgggguaaccaguuuuguaucaagauccugaaucccuauaugccuagcguaguggagacucuggagcagaugcagagaaaacacgggggcaugcucgugcggaacccucuuuccaggaacucuacacaugagauguacuggguuuccugcgggaccggcaacaucgucagcgccgugaacaugaccucccgcaugcugcucaaccgguucacuauggcgcaccgcaagcccacuuacgagcgggacguggaucugggagcugguacucgacacgucgccguagagcccgagguagccaaccuagacaucauaggccagagaauugaaaacaucaagcaugagcacaagagcacuuggcauuacgacgaggacaaucccuacaaaacgugggccuaccacggguccuaugaggucaagccgaguggcucggcuagcagcauggugaacggggucgugaaguuacugaccaagcccugggacgugauccccauggucacccagauugccaugaccgacacgacccccuucggccagcagcgcguuuucaaggagaagguggacacccggaccccuaaggccaagcgcggcacggcccagaucauggaggucaccgccaaauggcuguggggguuccucucccggaacaagaagccccgcaucugcacccgagaggaguucacucgcaaggugcggagcaaugcggccaucggggcgguauucgucgaugagaaccaauggaacuccgccaaggaggcgguggaggacgagcgcuucugggacuuaguacaccgggagcgcgagcuacacaaacaggggaagugugccacgugcgucuacaacaugaugggcaagcgggagaagaagcucggggaguucggcaaggccaagggcagccgagccauuugguacauguggcugggagcccgauuccuggaguucgaggcgcucgguuucaugaacgaggaccacugguucucccgcgaaaacagccuguccgggguggaaggcgaggggcugcacaagcucggguacauucugcgagacauaagcaauauccccggcgggaacauguacgccgacgacaccgccgguugggacacccgcaucaccgaggacgaucuucagaacgaggcccguaucacggacaucauggagccggagcacgcccuccuggcgaagaguaucuuuaagcugacuuaccagaacaagguuguaagggugcaaagacccgccaaaaaugguaccgugauggacgucauaagccgacgcgaccagcggggcuccggccagguagggaccuacggucucaacacguucaccaacauggaggcccagcugauacgccagauggagucagaggggaucuucuccccaagcgagcuggagaccccgaaccucgccgagcggguucuggacuggcuggagaaguacgguguggaaagacucaagcggauggccauauccggugacgacugcguggugaagccgauagacgaccguuucgcgacggcccugacggcccugaacgacaugggcaagguucggaaggacaucccgcagugggagccuucgaagggcuggaacgauuggcagcaggugcccuucugcagccaccacuuccaccagcucaucaugaaggacgggcgcgagaucguggucccaugccggaaucaggacgagcuggugggccgcgcccgugugagccagggggcgggcuggucacugcgugagaccgcgugccuggggaaguccuaugcucaaauguggcagcuuauguacuuccacaggcgcgaccuccggcucgccgccaacgcaaucugcagcgccguccccguggacuggauccccaccucacggaccacauggagcauccacgcccaccaccaguggaugaccaccgaggacaugcugucgguguggaaucgcgucuggaucgaggagaaucccuggauggaggacaagacccacaucagcuccuggggcgacgugccguaccugggcaagcgggaggaccaguggugcggaagccucaucggccugacggcccgcgccaccugggcgaccaauauucaaguggcaaucaaccagguccggcgccugauugguaacgagaacuaccucgacuacaugaccuccaugaagcgguucaagaacgagagcgaccccgagggcgcccugugguga

SEQ ID NO: 24590 - RNA, 9879 nt, Artificial Sequence
  derived and/or modified CDS sequence (opt11) from DENV-1__EU482521__SS-prME
agcgugaccaugcugcucaugcugaugcccaccgcccuggccuuccaucucaccacccggggcggggagccgcauaugaucguaagcaagcaggagcgggggaaaagccugcuguucaagaccagcgccggggugaacaugugcacccucaucgccauggaccugggugaacuaugcgaggacacuaugaccuacaagugucccaggauuacagaagccgagcccgacgacguggacugcugguguaacgcgaccgacaccugggucacauacggaaccugcagccaaacuggcgaacaccggcgggacaagcguuccguugcccucgcgccccaugugggccuggggcuggagacgcgcaccgagacuuggaugagcuccgagggcgccuggaagcagauccagcggguggagaccugggcccuccgccauccgggguucacggugaucgcacuguuucuggcgcacgccaucggaaccagcaucacccagaaggggaucaucuucauccuccugaugcuggugacgcccaguauggcaaugcggugugucgguaucggcagccgcgacuucguggaggggcuguccggugccacguggguggacgucgugcuggagcacgggagcugugucaccacuauggccaaggacaagcccacucuggacauugagcuccuaaaaacggaggucaccaacccggcaauccugcggaaguugugcaucgaggccaagaucucaaacaccaccacggacagccgcugccccacccagggagaggcuacccugguggaggagcaggacgccaacuucgugugccggcgcaccuucgucgaccgaggcugggggaacggcuguggucucuucggaaaggggucccucauuacgugcgccaaguucaagugcgugacuaagcuggagggaaagaucgugcaguacgagaaccugaaauacagcgucaucgugacuguccauacgggagaccagcaccagguugggaacgaauccacggagcacggcaccaccgccaccauuacgccgcaagcccccacgaccgaaauccagcuaaccgacuauggggcccugacucuggacuguagccccagaacgggccucgacuuuaacgagaugguacugcugacgaugaaagaaaaauccugguuaguccauaaacagugguuccuggaccuuccgcuccccuggaccagcggcgcgagcacgagccaggagacguggaaccgacaagaucugcugguuaccuucaagaccgcccacgcgaagaagcaggaaguuguggugcugggcagccaggagggggcgaugcacacugcacucacgggggccaccgagauucaaacguccggcaccacgacaauauucgccgggcaucuaaagugccgccucaagauggacaagcugaccuugaagggaaugagcuaugugauguguaccggauccuucaaacucgaaaaggagguugcggagacgcagcaugggaccguacuggugcagaucaaauacgagggcaccgacgccccgugcaagaucccguucucaacacaagacgagaagggggugacgcagaacggccggcugauaacagccaauccaaucgugaccgacaaggagaagcccgugaacaucgaggccgagccgcccuuuggggagagcuacaucguaaucggcgcgggggagaaggcccugaagcucagcugguucaagaaggggagcagcaucggccgcauguucgaggccaccgcccgcggggcccgccgcauggcgauacugggggacacggccugggauuucggguccaucggcggcgucuucaccucaguggguaagcugguccaccagaucuucggcacggcguaugggguccuguucuccggcgugagcuggaccaugaagaucgggaucggcguccuucugacuuggcucggccugaacucccggagcaccaguuucagcaugacaugcaucgcuguaggccucgugaccuuguaccugggcgucauggugcaggccgacuccggcugcgugauuaauuggaagggacgcgagcugaagugcgggagcggcauauuuguuacuaacgaggugcacacguggaccgagcaguacaaguuccaagcugacagcccgaagcgguuguccgccgccaucggcaaggcaugggaggagggggugugcgguaucagaucagcaaccagacuggagaauaucauguggaagcagaucuccaacgagcugaaccauauacuccuagaaaaugacaugaaguuuacugucguggugggcgacguagcgggcauccuggcccaagggaagaagaugauccgcccucagcccauggaguacaaguacagcuggcgguccuggggcaaggcgaagaucaucggggccgacgugcagaacacaacguucaucaucgaugggccuaacacuccggagugccccgacgaccagcgcgcguggaacaucugggagguggaggacuacggauucgggaucuuuacaaccaacaucuggcuaaaacugcgggacucguacacccaggucugugaccaccgccugauguccgccgccaucaaggacuccaaggcagugcacgccgacaugggcuacuggaucgagagcgaaaagaacgagacuuggaagcucgcgcgggccagcuucauugaagugaaaaccugcaucuggcccaagucccacacccuguggagcaaugguguccuggagagcgagaugauuauccccaagauauacgggggcccgaucagucagcacaacuaccgccccgguuacuuuacccaaaccgccggccccuggcacuuggggaagcuggagcuggacuuugaccucugugagggcaccacgguggucguagacgagcacugcgguaaucgcgggccaucccugcgcaccaccacugugacgggcaagaucauccacgaguggugcugucggucaugcacccugccgccccuccgcuucagaggggaggacggcugcugguaugggauggagauccgccccguaaaggaaaaggaggaaaaccugguuaaaaguaugguuagcgcaggcagcggcgagguggacuccuuuucccuagggcuccugugcaucuccaucaugaucgaggaggugaugcggagccgcuggucccggaagaugcugaugacaggcacccucgcagucuuucuucugcucaucauggggcagcugacauggaacgaccugauucggcuaugcaucauggugggugcgaacgccagcgaccgcauggguaugggcacuacauaccuggcccugauggccaccuucaagaugcggccgauguucgcagucgggcuccuguuccggcggcugacgucccgcgaggugcuccuacuuacuaucggccucagccucguggccucggucgaacuuccaaauucgcuugaggaguugggggacgggcucgcuauggguaucaugauccucaagcugcugaccgacuuccagucccaccagcucugggccaccuuguugagccucaccuucaucaagaccaccuucagucugcauuaugccuggaagaccauggccauggugcucagcaucgucucccucuucccccugugucugagcacuaccucccagaagacgacaugguugccaguccugcuggggagccucggcuguaagccccucaccauguuccuuaucgcagagaauaagaucuggggccggcgcuccuggccucucaacgaggggaucauggccgugggcaucgucagcauccuccugagcucccuccugaagaacgacguaccgcuggccgggccgcugaucgcuggcggcaugcugaucgcgugcuaugugaucagcgggucgagcgccgaucugucccucgaaaaagccgccgaggucuccugggaggaggaggccgagcacuccggcgcgucacacaacauccugguggagguucaggacgacgguacaaugaaaaucaaggacgaggagcgugacgacacccugacuauccuauugaaagccacccugcuggcagucucaggcguauacccccugaguauucccgccacgcuauuugucugguacaucuggcagaagaaaaagcagcgcuccgggguccucugggauaccccaagcccgcccgagguggagagggcgguguuggaugaugggauuuaucgcaucaugcagcggggcuuacuggggcgaucccaagucggcgugggggucuuccaggagaacgucuuucauacgauguggcacgugacccggggagcgguucuaauguaccaggggaagcgccuggagcccagcugggccaguguuaagaaggaccuaaucagcuacggcggcggguggcggcuccaggguuccuggaacacaggggaggagguccaggugaucgcugucgagccgggcaagaaccccaagaacgugcagaccgcccccgggacuuucaagacgcccgaaggcgaagugggggccauugcgcuggacuucaagcccgggacgaguggcagucccaucgucaaccgcgagggaaagaucgugggucuguacgguaacgggguggugaccaccagcggaaccuaugugucugccauagcgcaggccaaagcgucucaggaaggaccgcuccccgaaauugaggacgagguguuucggaagcgcaaccugacgaucauggaccugcaucccggcagcgggaagacccggcgcuaccucccggcgaucguucgugaagccauaaagcggaagcugcgcaccuuaaucuuagcccccacccgggucgucgccuccgagauggcggaggcccuuaagggaaugcccaucagauaccagacgacugccgucaagucagagcacaccgggaaggaaaucguggaccuuaugugccacgccaccuucacgaugcggcuccugucccccguacgcguuccgaacuacaacaugauuaucauggacgaggcccacuucaccgauccgagcuccaucgcggcccggggguauaucagcaccagagugggcaugggagaggcagccgccaucuucaugaccgcgacgccgccgggauccguggaagccuucccgcagagcaacgccgucauccaggaugaggagcgggacauccccgagcgcucuuggaauagcggguacgaguggauaaccgacuuccccgguaagacggugugguucgugccuuccaucaagagcggcaacgacaucgccaacugucugcggaagaacgggaagagggucauccagcucucccggaagaccuucgacacggaguaccaaaagacaaagaacaacgacugggacuacguggugacaacugacauuagcgagaugggcgcgaacuuccgcgccgaccgggucaucgacccgcgccggugcuuaaagcccgugauccugaaggacggccccgagcgcgugauccucgcaggcccgaugccggucacgguggccuccgccgcgcaacgccgcgggcgcaucgguaggaaccacaacaaggagggcgaucaauacaucuacaugggucagccccugaacaacgaugaagaccacgcucacuggaccgaggccaaaaugcugcucgacaacaucaauacacccgagggcaucaucccggcccuguucgagccggaacgcgaaaaguccgcugcuaucgacggggaguaccggcugcgcggcgaggcccggaagaccuuugucgaguuaaugcguagaggggaccugcccgucuggcuguccuauaaaguggccucagagggcuuccaguauucugaccggcggugguguuucgacggcgagcgcaauaaccaggugcuggaggaaaacauggacguggagaucuggacgaaggaaggcgagcguaaaaagcucagaccccgguggcuggacgcgcgcaccuacagcgacccucucgccuugcgggaguucaaggaguucgcggccggacgccguucaguguccggugaucugaucuuggagauagggaaacugccgcaacaucugacgcagcgcgcccagaaugcccucgacaaccuggucaugcugcauaacagcgagcaaggcggucgggcguaccgccaugccauggaagaacuuccugacacaauugagacucugaugcugcucgcccugaucgccgugcucaccgguggggugacacucuucuuccucuccggucgggggcuaggcaaaacaagcaucggccuccugugcgucauggcguccagugugcuccucuggauggcguccgucgaaccccacuggaucgccgccagcaucauccuugaguuuuuccugaugguccuccugauccccgagccagaccgccagcgcacgccccaggacaaccagcuggcguacgugguuaucgggcuccuguucaugauucucacgguggccgcgaacgagaugggccuccucgaaaccaccaagaaggaccuggggauaggccacguggcuguugggaaccaccaccacgccgcgaugcucgacgucgacuuacacccggccucagccuggacccuguaugccguagccacgacgauuaucaccccgaugaugcggcauaccaucgagaacacgacggccaauauuagcuuaaccgccaucgcgaaccaagccgccauacuuaugggucuggacaagggcuggccaaucucaaaaauggacaucggugugccccuccuugcgcugggaugcuacagccaggucaacccccucacccucaccgcggccgugcugaugcugguggcucacuacgccaucaucgggccaggcuugcaagccaaagccacgcgcgaggcccaaaagcggaccgccgccgggaucaugaagaaccccacagucgacgguaucguggccaucgacuuggacccggugguauacgacgcgaaguucgagaagcagcuaggccaaauaaugcugcucauacucugcacaagucagaucuugcugaugcgcaccaccugggcccuaugcgagagcaucacccuggccacugggccucucaccacccucugggaaggcagcccggggaaguucuggaacaccacuaucgccgucagcauggcuaacaucuuccggggcucuuaucuggcuggugcgggacuggccuucucccucaugaagucucugggcgguggccgccgggggacuggcgcgcagggagagaccuugggggagaaguggaagcgccagcucaaccagcuguccaaaucagaguuuaacaccuacaaacgguccgguaucauggaaguggauagaagcgaggcaaaagaagggcugaagcggggcgaaauuacgaagcacgcugugucccgcgggacggccaaacuucggugguucguggagcgaaaccuggugaagcccgagggcaaggucaucgaccugggcugcgggcggggcggguggagcuacuauugcgccggcuugaagaaaguuacagaagugaaaggguacacuaagggcggcccugggcacgaggagcccauaccgauggccaccuacggcuggaaccucgucaagcugcacuccggaaaggacguauucuucgugccgccugagaagugcgacacacuauuaugcgacaucggugagagcucccccaacccuaccaucgaggaggggcgcacccuacguguccugaaaaugguggagcccuggcuccgggguaaccaguuuugcaucaagaucuuaaacccguacaugcccagcguggucgagacgcucgagcagaugcagcggaagcauggcgggaugcucguccgcaacccgcuuucccgcaacagcacccaugagauguacuggguguccugcgggacggggaacaucgucagcgccgugaauaugaccucacggauguuguuaaaccgcuucaccauggcccaccguaagccaacguacgagcgugacguggaccuuggcgccggaacccggcacguugccguagagccggagguagccaaccuugacaucaucggccaaagaaucgagaacaucaagcacgagcauaagaguaccuggcacuacgacgaggacaaccccuacaagaccugggcguaccacggguccuacgagguuaagccgagcggcuccgcaagcucaauggugaauggcgucguuaagcuccugacgaaacccugggauguaauccccauggucacccagaucgccaugaccgacacaacccccuucggucagcagcggguguucaaggagaagguggauacucgcaccccgaaggccaagcggggcaccgcccaaaucauggaagucacggcgaaguggcugugggguuuccucagucgcaauaagaagccccgcaucugcacccgcgaagaguucacgcggaaggugcgcucgaacgccgccaucggggccguguucgucgacgagaaccaguggaacuccgcgaaagaagccguggaggacgagcguuucugggacuugguccaccgcgagcgggaguuacacaagcaggguaagugcgcaaccugcgucuacaacaugauggggaagcgagagaagaagcuaggcgaguucgguaaggccaagggcucucgggcgaucugguacauguggcugggcgcgcgcuuccuggaguucgaggcccucggcuucaugaacgaggaucacugguucagcagggagaacagucuguccggcguggagggagagggccugcacaagcucggguacauccugcgcgacaucagcaagauccccggcggcaacauguacgcugaugacacggccgggugggacacccgcaucaccgaggacgaccugcaaaacgaggcccggauaacggacauuauggaaccggagcacgcucuccuggccaaaucaaucuuuaagcugacuuaccagaauaaagugguccgcgugcaacggcccgccaaaaacggaaccgugauggacgucaucagcagacgggaccaacgcggguccggccaagugggcacauacggccugaauaccuucacgaauauggaggcccagcuaauacggcagauggagagugagggcaucuucucgcccucagaacuggagacuccaaaccucgcugagagaguguuagacuggcuggaaaaguacggggucgagcggcucaagcgcauggcgaucuccggcgacgacugcguugugaagccgaucgacgaccgguucgccaccgcccuuacugcacugaacgacauggggaagguccgcaaggacauaccacagugggagcccucaaaaggauggaaugauuggcaacagguccccuucugcucccaccauuuccaccaguugaucaugaaggacgggcgugagaucguggucccgugccgaaaucaggaugagcuggugggccgggcccgcgugagccagggcgcgggguggagcuuacgggagaccgccugucucgguaaguccuacgcucaaauguggcaacugauguacuuccaccgccgugaccugcgccucgcugcuaacgccaucugcagcgccguccccguggacuggauccccaccucccggacuacuuggaguauacacgcccaucaccaguggaugaccaccgaggacaugcuguccguguggaaccgggucuggaucgaagagaaccccuggauggaagacaagacacauaucagcucuuggggugaugugccguaccugggcaagcgcgaggaccaguggugcggcagccucaucgggcuaaccgcgagagcgacgugggccaccaacauacagguggccaucaaccagguccgucguuugauaggcaacgagaacuauuuggauuauaugacuucgaugaagagguuuaagaacgagucggaccccgagggugcccuaugguga

SEQ ID NO: 24591 - RNA, 9879 nt, Artificial Sequence
  derived and/or modified CDS sequence (opt11) from DENV-1__EU482523__SS-prME
agcgugaccauguugcucaugcugaugcccaccgcccuggccuuccaccucaccacccggggcggggaaccccauaugaucgugagcaaacaggagcgcgggaaaagccuguuauucaagacgagcgccggagucaacaugugcacacucaucgccauggaccugggcgagcuuugcgaagacacaaugacauacaagugcccccgcaucaccgagacggagccggacgacguggacugcuggugcaaugccacugauaccugggugaccuacgggaccugcagccaaacuggcgagcaucggcgcgacaagcggucagucgcacucgcgccccacgugggccugggguuagagacacggaccgagaccuggaugagcuccgagggcgcauggaagcaaauacagcgggucgagacgugggccuuacgccacccaggguucaccgugaucgcccuguuccuggcccaugcuaucggcacaagcaucacccaaaaggggaucauuuucauccuccuuaugcuggugacgcccuccauggccaugcggugugucgggauaggcucucgcgacuucguggaggggcucuccggcgcaaccuggguugaugucgugcuugaacacggaagcugugucacuacaauggccaaggacaaacccacgcuggacaucgagcuucucaaaacagaagucacuaaccccgccguucugcggaaacucugcauagaggcaaagaucaguaacaccacgaccgacagccgauguccuacucagggugaggccaccuugguugaggagcaggacgccaacuuugugugccggcgcacguucguggaccggggcuggggcaacgguugcgggcuguucggcaaagggucccucaucacuugcgcgaaguucaagugcgucacaaaacuugagggcaaaauaguccaguacgagaaccugaaguacagugugaucgucacuguccauacgggcgaccaacaccaggucgggaacgagagcaccgagcauggcacaaccgccaccauaacaccccaggcucccaccacggagauucagcucaccgacuacggagcucugacgcuggacuguagcccccgcaccggccucgacuucaacgagaugguccugcugacuaugaaggagaaaucuuggcucgugcacaagcagugguuccucgaccugccgcucccauggaccagcggugcuucaacgucccaagagaccuggaaccggcaggaucugcuggugaccuucaagaccgcacacgccaagaagcaggaggucgugguccugggcagucaagaaggcgcgaugcacacggcccuuacgggugccacggagauccagaccucaggcacgacgacaaucuucgccgggcaucugaagugccgccucaaaauggacaagcugacucuaaaggggaugagcuacguuaugugcacgggcucguucaaacuugagaaggagguggccgagacucagcauggcacaguuuugguccagaucaaauacgagggaacggacgcgcccuguaagauccccuucagcacgcaggacgagaagggggugacccagaacggccggcugauaacagccaacccgauagugacugacaaggagaagcccgucaacaucgaggccgagcccccauucggggaguccuauaucguuauaggcgccggggagaaggcgcugaaauuaagcugguucaagaagggcuccagcaucgggaagauguucgaggccacugcccgaggggcacggcgcauggccauccugggcgauacugcgugggauuucggguccaucggcgguguguuuacaucaguugggaagcuggugcaucaaaucuucgggacugcuuacgggguacucuucucuggcgucagcuggacuaugaagaucggaaucggagugcuccugaccuggcucgggcugaacucccgcaguaccagucugagcaugaccuguaucgccguggggcucgucacguuauaccuuggggugaugguccaggcugacuccgggugcgucaucaacuggaagggccgggaacucaagugcggguccggcaucuuugugaccaacgagguucacaccuggaccgaacaauacaaguuccaggccgacagcccuaagcgccugucggcagccaucggcaaggccugggaggagggggucugcggcauccggagugccacccgcuuagagaacaucauguggaagcagauuuccaacgaacuaaaccacauccugcuggaaaacgacaugaaauucacgguugucguuggggauguggccggcauccucgcgcaggggaagaagaugauccguccccaaccuauggaguacaaguacagcuggaaaagcugggggaaggccaaaaucauaggcgccgacgugcaaaacaccacauucaucaucgaugggcccaacaccccggaauguccugaugaccaacgggccuggaacauaugggaggucgaagauuacggcuuugggaucuucacaaccaauaucuggcugaagcugagggacuccuauacgcagguaugcgaucaccgcuuaaugucggcugccaucaaggacagcaaggcagugcacgccgauaugggcuacuggaucgaguccgagaagaaugagaccuggaagcuggcgagagcuagcuucauugaggucaagacguguauauggcccaagucccacacucuguggagcaauggcguccucgaguccgagaugauuaucccgaaaaucuacggggguccgaucagccagcacaacuaccggcccggguacuucacccaggccgccggccccuggcaccuggggaaguuagagcucgauuucgacuugugugaggguacaacggucguuguagaugagcacugugggaaucgggggccgucccuucgcaccacgaccgugacggguaagaucauccacgagugguguugccggagcugcaccuuaccgccccuccgcuuccgcggggaagaugguugcugguauggaauggagaucaggccggugaaagagaaggaggagaacuuggugaagucaaugguaagugccgguagcggcgagguggacuccuucaguuuaggucuguuaugcauuuccauuaugaucgaggaggugaugcguucacgauggucgcgucgaaugcucaugacgggcacccuagccguguucuuccugcucauaauggggcagcuuacguggaacgacuugauuagguuaugcauaaugguaggcgcgaacgccagcgaccggauggggaugggcaccacguaucuugcccugauggccaccuucaagaugcgcccaauguucgcuguaggacuccuguucagacggcugacgaguagggagguccuacuguuaaccaucggguuaagccuaguugcguccguggagcugccaaacagccuggaagaacucggcgacgggcucgcgaugggaaucaugauccucaaacugcuaaccgacuuccaaucacaucagcuuugggccacccugcugucacuuacguucaucaaaaccacguucuccuuacacuacgccuggaagacuauggcgaugguccuaagcauagugagccucuuuccccugugccugagcacgacaagucagaaaacgacuuggcuccccguucugcugggcucucuggguugcaagccgcugaccauguuccugauugcagagaacaagauaugggggcgccgguccuggccccuaaacgaggggauaauggcaguaggcaucguguccauccuuuuaagcucccuccugaagaacgaugugccgcuggccggaccccucaucgccgguggcaugcuuaucgcgugcuacgucaucaguggcuccucugccgauuugucucucgagaaggcggcugaaguguccugggaggaagaagcugagcacucgggcgcaagucacaacauuuugguugaggugcaggacgacgggaccaugaagaucaaggaugaagaacgggacgacacccugaccauccuccugaaggccacgcugcucgccgugucaggaguguacccgcucaguaucccagccacguuguucguaugguacuuuuggcagaagaagaagcagcggucggggguacucugggacacccccucaccgcccgagguugagcgcgccguguuagaugacgggaucuaccggauaaugcagaggggccugcuggggcguucucagguaggcgugggggucuuccaggagaauguauuccacacgauguggcauguaacacgcggagcgguucuuauguaccaagggaagcgguuagaaccaagcugggccagcgugaagaaggaccugaucagcuacgguggcggcuggcguuugcaggguaguuggaauacgggagaggaaguacaggucaucgccguggaacccgggaagaaccccaagaacgugcagaccgcccccgggaccuucaagacaccggagggugaggucggcgccaucgcacuggacuuuaaaccggggacgagcggcucgcccaucgucaaccgggaggguaaaauugucggacuguacgguaauggggucgugacuacgucaggcacauacgugagcgccauugcccaagccaaagcgagccaggaggggccuuuaccagagauugaagacgaggucuucagaaagcguaaccugacgaucauggaccugcacccaggauccgggaagacccgccgguaccuccccgcuaucgugcgcgaggccaucaaacgcaagcugcggacacugauccucgcgcccacucggguggucgccagcgagauggccgaggcccugaaggguaugccgauccgguaccaaacuaccgccgucaagagcgagcacaccggcaaggaaaucgucgaccugaugugccaugcuaccuucacaaugcgccuccuaucccccguccgggugccgaacuacaacaugaucaucauggacgaagcacacuucaccgacccuagcucaaucgccgcucguggcuacaucucgacccggguagguaugggggaggccgccgcgauauucaugacggcgacgccgcccggcagcguggaagccuucccgcagagcaacgccgugauccaggacgaggagcgggacauuccagaacgaucauggaauagcggguaugaauggaucacagacuuccccggcaagaccgugugguuuguucccagcaucaaaagcggcaaugauaucgccaauugccugcgcaagaacgggaaacgugugauccagcucuccaggaagaccuuugauacggaguaucaaaagaccaagaacaacgacugggacuacguagucaccaccgacaucagcgagaugggggcgaacuuccgagcggaucgaguuauagacccgagacgcugccugaagcccgugaucuugaaggacgggccugagcgggucauccucgccggccccaugccgguuacugucgcuagugccgcgcaacgccgggggcggaucggccgcaaucacaacaaggagggcgaccaguacauuuacauggggcagccccugaauaacgacgaggaucacgcccauuggaccgaggccaagaugcuccucgacaauaucaauaccccggagggcaucauccccgcgcuguucgagccggaacgggagaaaagugcagcgauagauggugaauaucgccugcgaggcgaggcccgcaagaccuucguggagcucaugcggcgcggggaccugcccguguggcugucguacaagguagccucagagggauuccaguacuccgaccggcguuggugcuuugacggcgagcgcaacaaccaaguccucgaggagaauauggacguggaaauauggacgaaggagggggagagaaagaagcuccggcccagauggcuggacgcccggaccuacagugacccucuugcccugcgugaguucaaggaguucgcggcaggacggcggagcgucuccggggaccucauccuugagaucggcaagcugccgcagcaucugacccagagggcccagaaugcccuagacaaucucgugaugcugcacaauuccgagcagggcggucgugcguaccgacacgccauggaggaauuacccgacaccaucgagacguuaauguuacucgcccugauagccgugcucaccggcggcgucacacucuucuuccuauccggccgcggguuagguaagacuagcauagggcuacugugcgugauggccucgagcguguugcucuggauggcuuccgucgagccccacuggauagcggccagcaucauuuuagaguucuuccugauggugcucuuaauccccgagccagaccgucagcggacgccccaggauaaucagcuggccuacguggucaucggucuccucuucaugauccugaccguggccgcgaaugagaugggccucuuggaaacgaccaagaaggaccuugggauaggucacguggccguagaaaaucaucaccacgccgcuaugcucgacguugaucugcaccccgccucagcuuggacgcuauacgccguggccacgaccauaaucacuccgaugaugcgacacaccauugaaaauacgacugcuaacauaagccucaccgccaucgcuaaucaggccgcgauccugaugggucucgacaagggauggcccaucagcaaaauggacaucggcguaccccuccuggccuuaggguguuauagccaggugaauccccucacauugaccgcggccguucugaugcucgucgcccauuacgcaauuauaggcccgggacuucaggccaaggcgacccgggaggcucagaaacguaccgcggccggcaucaugaagaacccaaccguggacgggauaguggcuauugaucuggacccugucguuuacgacgcgaaauucgagaaacaacuaggccagaucaugcuguuaauccucugcacgucgcagauucugcugaugcguacgacgugggccuuaugcgaaagcaucaccuuagccacggguccccucacuacacucugggaggggagccccggcaaguucuggaacacgacgaucgccgugucuauggccaacaucuuucgcggcuccuaccuggcgggugccgggcuugccuucucucucaugaaaucccucggaggagggcgccgagggaccggagcgcagggcgaaacccugggcgagaaguggaagcggcaacucaaccaacuuuccaagagcgaguuuaacacuuacaagagguccggaauuauggagguugaccggagugaggccaaagaggggcuuaagcgcggggagaccacaaagcacgcaguuucacggggcaccgccaaguuacgcugguucguggagcguaaucuggucaaaccggaggggaaggugauagaccugggcugcggccgcggcggcuggagcuacuacugcgccggacucaagaagguuaccgaggucaagggauacacgaaaggcggccccggccaugaggagccuaucccgauggccacguauggguggaacuuagucaaacugcauaguggcaaggauguguucuucauuccacccgagaagugcgauacacugcucugcgauaucggcgagagcagcccaaaccccacaauugaggaggggagaacacugcguguccucaagaugguggagcccuggcuuagggggaaccaguucuguaucaagauccugaaucccuacaugcccagcgucgucgaaacccuugaacagaugcagagaaagcacggcggcaugcucguccggaacccauugucccguaacagcacccacgagauguacugggugucaugcggcaccgggaacaucgucagcgcuguuaauaugaccucacgcaugcugcugaaccguuucacgauggcccaucgcaagcccaccuacgagcgggacguugaucuaggggccgggaccaggcacgucgcaguggagccggagguugccaaccuggacaucauugggcagagaauagagaacaucaaacacgagcauaagagcaccuggcacuacgacgaggacaaccccuacaagacgugggcguaucacggguccuaugaaguaaagccgagcggcucugccagcagcauggugaacgggguagugaagcuacugacaaagcccugggacgugauuccuauggucacacagaucgcaaugaccgacacgacacccuucggccagcagcguguuuucaaggagaagguagauacccguaccccgaaggccaagcgcgggacagcacaaaucauggagguaaccgcgaaauggcuuuggggcuuccugucccggaauaaaaagccccgcaucugcacccgggaagaguucacgcgcaaagugcguagcaacgccgcgaucggcgccguguucguugacgaaaaucaguggaacucugcgaaggaagcaguggaggacgaacgcuucugggaccugguccaccgggagcgagaacugcacaagcaagggaagugcgcaacgugcgucuacaacaugaugggcaaacgggagaagaaacucggggaguucgguaaggccaaggggagccgagccaucugguacauguggcugggagcacgguuucuagaguucgaggcccucggcuucaugaacgaggaccacugguuuagccgggagaacagccuauccgggguagagggcgaggggcugcacaagcucggcuacauuuugcgagacaucagcaagauucccggcgguaacauguaugcagacgacaccgccgggugggacacccguauuaccgaggacgaccuucagaaugaggccaggaucacggacauuauggagccugaacacgcgcuauuggccaagagcaucuucaagcucacauaccagaacaaggucgucagaguccaaagaccugccaaaaacgggaccguaauggacguaauuaguagaagagaccagcggggaucgggccagguuggaaccuacggccucaacacguucacgaacauggaagcccaacucauucgccagauggagucagaagggauauuuucccccuccgagcuagagacccccaaccuugcugaacgggugcuggauuggcuggagaaguacggcgucgagcgucuuaaaagaauggcgaucuccggagacgacugcguugugaaaccuaucgacgaccgauucgcuaccgcccugacggcccuaaaugacaugggcaagguccggaaagacauaccccagugggagccaucaaaaggguggaacgacuggcagcaaguccccuucugcagccaccacuuucaucagcugaucaugaaggacggccgcgagauaguggucccaugccggaaucaggacgagcuugugggccgugccagggugagccagggggccggauggucccugcgcgagaccgccugccucgggaagucuuaugcccagauguggcagcugauguacuuccaccgucgcgacuuacgguuagccgccaacgccauaugcucagcaguccccguugacuggaucccgaccucccgcaccacguggucuauccacgcccaccaccaguggaugacgaccgaagauaugcuuuccgucuggaacagggucuggaucgaggaaaacccauggauggaggacaaaacucacaucagcuccuggggcgacgugccguaucuggggaaacgggaagaccaauggugcgguucucucaucggcuugaccgcucgugcaaccugggccaccaacauccagguugccaucaaccagguccggcgccugauugggaacgagaacuaccucgacuauaugacguccaugaagcgguucaagaacgagagcgacccugagggcgcgcugugguga

SEQ ID NO: 24592 - RNA, 9879 nt, Artificial Sequence
  derived and/or modified CDS sequence (opt11) from DENV-1__EU482525__SS-prME
ucgguaaccaugcugcucaugcugaugcccacggcccuggccuuccaccucacgaccagggguggggagccccacaugauugugaguaaacaggaacggggcaagagccugcuguucaagacaagcgccgggguuaacaugugcacccuaaucgcuauggaccuuggagagcugugcgaggacaccaugacauacaaguguccccgcaucaccgaggccgagcccgacgauguggacugcuggugcaacgcuaccgauacguggguaaccuaugggacuugcagucaaaccggggagcaccggcgcgacaagagguccguggcccucgcgccccaugugggccugggucuggagacgcggaccgagaccuggaugucuuccgagggggccuggaagcagauccagcgggucgagaccugggcccuccgccaccccggguucacggugaucgcccuguuccuggcacacgccauuggcaccagcauaacucagaaggggaucauuuucauccuccugaugcuagugacccccuccauggcgaugcggugugucggcaucgggagccgugacuucguggaggggcucuccggcgccacauggguggacguaguucuagagcacggcucaugcgucaccaccauggccaaggacaagcccacccuggacaucgaauugcugaagaccgaagucacuaauccagcaguguugcguaagcucugcaucgaagccaaaauuuccaauaccaccacggacucacgcuguccgacucagggugaggccacccucguggaagaacaggacgcuaacuuugucugccggcgcaccuucguagaccggggcugggggaacggcugcgggcuguucggcaaggggucccucauaaccugcgccaaguucaagugugugaccaagcuggaaggaaagaucgugcaauacgagaaccugaaauacagcguuaucgugaccguccauaccggcgaccagcaucagguggggaacgaguccacggagcaugguaccaccgcuacaauaacgccgcaggcccccacgaccgagauccagcucacugacuacggugcgcugacccuggacuguucgccccgcacgggccucgauuucaacgagaugguccugcuuaccaugaaggagaaauccuggcucgugcacaagcagugguuccuggaccucccgcugcccuggaccagcggagccuccaccucccaggagaccuggaaccggcaggaccugcuggucacauucaagaccgcccacgcgaagaagcaggaggucgugguguuagggucucaggaaggcgccaugcauaccgcgcugaccggagcaacggagauacagacguccggaaccacgaccaucuucgccgggcauuugaagugccgccugaagauggacaagcugacccugaagggcaugagcuacgucaugugcaccggguccuuuaagcucgagaaggagguggcggagacgcagcacggcacggugcuuguccagaucaaguaugaaggcaccgaugcccccugcaagaucccguucucaacccaggacgagaagggagugacgcagaacggccgguugaucaccgccaacccgauagugaccgacaaagaaaagcccgucaacaucgaggccgagccgcccuucggggagucauacaucgugaucggcgcaggggaaaaggcccucaaauuaagcugguucaaaaaggguuccagcaucggcaagauguuugaggccaccgcccgcggggcacgucguauggcgauccugggcgacacggcaugggauuucgggucgaucggcggcguguucacuagcgucggcaagcuggugcaccagaucuucggcacugccuacggaguacucuucuccggcgucucguggacuaugaagaucgggauaggaguguugcuuaccuggcucggguugaacucccgcagcaccaguuucuccaugaccugcaucgccguugggcuggugacccucuaccuuggcgucauggugcaggccgacucugggugcguuaucaacuggaagggucgugaguugaagugcgggagcggcaucuucgugacgaaugaggugcacaccuggaccgaacaguacaaguuccaggcggauagcccgaagcgccucucggccgccaucggcaaggcaugggaggagggagucuguggcauccguagcgccacccgccucgagaauaucauguggaaacagaucagcaacgagcugaaccacauucucuuagagaaugacaugaagcugacggugguggucggggacguggcgggcauucucgggcagggcaaaaagaugauccggccccagcccauggaguacaaguacaguuggaaguccugggggaaggccaagaucauuggugcugacgcccagaacacgaccuucaucaucgacggccccaacacaccggaaugccccgacgaccagcgggcguggaauaucugggagguggaggacuauggguucggaaucuucaccacgaacauuuggcugaagcuccgggacagcuacacgcaggucugugaucacaggcucauguccgccgccaucaaagacagcaaagcuguucaugcugacauggguuacuggaucgagucggagaagaacgaaacauggaagcuggcacgggccagcuucaucgaagugaagaccugcaucuggcccaagucccacacucuguggagcaacggcguccucgagagcgagaugaucauucccaagauauacggaggcccaaucagccagcacaacuaccgccccggcuauuucacccaaaccgccgggcccuggcaucugggcaaauuagagcucgacuucgaccugugcgaaggcaccacggugguggucgacgagcauugugggaaccggggaccgucccugcgaaccaccacugugaccgggaagaucauccacgaguggugcugccgcucuugcacucucccuccccuacgcuuccggggcgaggacgggugcugguauggcauggaaauacgcccugugaaagagaaggaagagaaccuggucaaaaguauggugagcgccggcagcggagagguagacuccuucagccucggccuacugugcauuuccaucaugaucgaggaggucaugcggagccgcuggagucggaagauguuaaugacuggaacucuggccguguucuuccugcucaucaugggccagcuuacguggaacgaucuaauccgcuuaugcaucauggugggggccaacgccagcgaccgcaugggcaugggcacgaccuaccucgcccugauggccaccuucaagaugcggccgauguucgccgucggguuacuguuccgccgccugacauccagggaggugcuccugcugaccaucggccucagcuuaguggcgaguguagagcugcccaauagccucgaggagcucggggauggccuggcaaugggcaucaugauccucaaauugcugaccgacuuccagucacaccaacucugggccacccuacugagccucacguucaucaagaccaccuucagccugcacuacgccuggaagaccauggcgauggugcugagcauagucucccuguucccguuaugccugagcaccacuucacagaagaccacauggcuuccagugcugcuggggucgcugggcugcaagccgcugacgauguuccugauagccgagaacaaaaucuggggucggaaaagcuggccacuuaacgaggguauaauggccguggggaucguaucgauccugcugucaucccuccugaaaaacgacgugccccuggccggcccccucaucgcuggagggaugcugaucgccugcuacgugaucagcgguuccucugcagaccuaucgcucgagaaagccgcggagguuagcugggaggaggaggccgagcacuccggggcgagccacaacauccugguggagguacaggacgaugguaccaugaaaaucaaggacgaggagcgggacgauacccugacaauacuccuuaaggccacccuguuagccgugagugggguguacccgcugagcauucccgccacucuguucgucugguacuuuuggcagaagaagaagcagcgguccggagugcuuugggacacccccagcccgccagaaguggagcgugcagugcuggacgacggcaucuaccggauaaugcagcgcgggcugcugggcagaucccagguggggguaggcgucuuccaagagaaugucuuccacacuauguggcaugugacccgcggggcggugcuaauguaccagggcaaacgacuggagcccucaugggcuagugugaagaaagaccugauuagcuacggagggggcuggcgccuucggggguccuggaacacgggagaggaaguccaagugauugccgucgaacccgggaaaaacccgaagaacgugcagacggcccccggcaccuucaaaaccccagagggcgaggugggggcgaucgcgcucgacuucaagcccggcacgucggggucgccgaucgucaaccgcgaaggcaaaaucgugggacuguacgggaacggcguggucaccacuagcgggaccuacgugagcgccaucgcccaggcuaaggcuucucaggaaggcccacuccccgagauagaggacgagguauuccggaagcgcaaccuuacgaucauggacuugcacccggggagcggcaagacccggcgauaccucccggccauaguccgagaggccaucaagcgcaagcugcgcacauuaauccuugcgcccacccggguuguggcuagugagauggcggaggccuuaaagggcaugccaauccgcuaccagacuaccgcggucaagagcgaacauacuggcaaggagauaguagaccucaugugccacgcgaccuucacgaugcggcuccuuucgccagugcgcgucccgaauuacaacaugaucaucauggaugaggcgcacuucaccgacccaucuuccaucgcggcccggggcuacauaagcacccgcgugggcaugggcgaggccgcagccauuuucaugaccgcgacuccgcccgggagcguggaggccuuuccgcagucuaacgcagucauccaggacgaggaacgggauauccccgagcgcuccuggaacucgggauacgaguggaucaccgacuuucccgggaagaccguuugguucguuccguccaucaagagcgggaacgacaucgccaacugcuugcggaagaacggcaagcgcgucauucagcucucccggaagacuuucgacacggaguaccagaagaccaagaauaacgauugggacuacguggucaccaccgacaucagcgagaugggggcaaacuuccgggcagaccgggucaucgauccgaggcguugccuaaagcccgugauccuuaaggacgggccggagcgcgugauucucgccggacccaugccggucaccgucgccuccgccgcucagcggcgcggccggaucggcagaaaccacaacaaggagggggaccaauacaucuacaugggccagccccucaacaaugacgaggaccacgcccacuggaccgaggccaagauguuauuagacaacaucaauacccccgaggggauaauccccgcccuguuugagccugagcgcgaaaaguccgcggcggucgacggagaguaccggcugcgcggggaggcccggaagaccuucguggagcucaugcggcgaggcgaccugcccguauggcugucauacaaggucgccagcgaggguuuccaguacagcgaccgccgguggugcuucgacggggaacgcaacaaucaggugcucgaagagaauauggacguggagaucuggacgaaggagggugagcggaagaagcuacgcccacgguggcuggacgcccgcaccuacuccgacccguuagcccugcgggaguuuaaagaguucgcggccggccgccggagcguuuccggggaucugauccucgaaaucgguaaacugccgcagcaccugacgcaacgcgcccagaacgcccuagacaauuuggucaugcugcauaacagcgagcaaggcgggcgugcuuacaggcacgccauggaggagcuccccgacacuaucgagacgcugaugcugcucgcccugaucgccguguuaacagggggcgucacccucuucuuccuaucugggcgggguuugggcaagaccagcaucgggcuccugugcgugauggccuccucggugcugcucuggauggcguccguugagccccacuggaucgccgccaguaucauccuagaguucuuccucauggugcugcugauccccgagccggacaggcagcggacaccacaggauaaucagcuggccuacguggucaucggccuccuguucaugauacugacgguggcugcgaacgagauggggcuauuggagaccaccaagaaggaccugggcaucggucacguagccguggagaaccaucaucacgccgccaugcucgacgucgaccugcacccagccucugcguggacccuguaugccguggcgacgaccaucaucaccccgaugaugcgccacacaaucgagaauacgaccgccaauaucucauuaaccgcuaucgcgaaccaagcggccauccugaugggccuggacaagggauggccaaucaguaaaauggacaucggggucccccuccuggcccugggcugcuacucacaagugaacccccucacccugaccgcggcaguacugaugcuugucgcccacuacgccaucauagguccgggguuacaggccaaggcgacacgcgaggcccagaagcgaacugcugccgggauuaugaagaaccccaccguggauggcauaguggccaucgaccuggaccccgucguguacgaugcgaaguuugagaaacagcucggccagaucaugcugcuaaucuuauguacuucccagauauuauugaugaggaccaccugggcccucugugaaagcauaacgcuggcuacugggccccugaccacacucugggaaggcucccccgguaaguucuggaauaccacuaucgccgucagcauggccaacaucuucaggggcuccuaucuggcgggcgccggacucgccuucagccucaugaaauccuuagggggcggucgccgggguaccggugcccagggcgagacccugggagagaaguggaagaggcagcucaaccagcuguccaagucggaguucaacaccuacaagcgguccggcauaauggaggucgauaggucagaggcgaaagagggauugaagagaggggaaacuaccaagcacgcgguguccagagggaccgccaagcuccggugguucguggagcggaaccuggucaaacccgagggaaagguaaucgaccugggcugcgggagaggcggauggagcuacuauugcgcgggccugaagaaggugaccgagguaaagggauacacgaagggcggaccagggcaugaggagcccaucccgauggccaccuacggcuggaaccucgugaaacugcacucggggaaggacguguucuucauuccaccggagaaaugcgauacccugcuaugcgacaucggcgagagcuccccaaacccuaccaucgaggagggacgcacccugcgcguccugaagaugguggagcccuggcuccgcggcaaccaguucugcaucaagauccugaaccccuacaugcccagcguggucgaaacccuggagcagaugcaacggaaacacggcggaaugcucguacgcaacccguugucccgaaacagcacucaugagauguacugggugaguugcggcaccgggaauauugugagcgcggugaacaugaccagccgcaugcugcucaacagguucacgauggcccaucgaaagcccaccuacgaacgcgacguggaccucggaaccggcacccggcacguggccguugagcccgagguugccaaccuggacaucaucgggcagcgaaucgagaacaucaagcacgagcacaaaucuacguggcauuacgacgaggauaacccguacaagacuugggccuaccauggcucuuacgaggucaagccgagcggguccgcaagcagcauggugaacggcguggugaaacuccugacaaagcccugggaugugaucccgauggucacccaaaucgccaugacagacaccacccccuucgggcagcagcgaguguucaaagaaaagguggacacacguaccccgaaagccaagcggggaaccgcccaaaucauggaggucaccgcccgcuggcuguggggguuccuuucacgcaacaaaaagccccgcaucugcacccgggaggaguucacccgcaaggugcggagcaacgcugcaaucggagcaguguucguagaugagaaccaguggaacuccgcuaaggaggcuguggaagacgagagguucugggaccuuguccaccgggaacgcgagcugcauaagcaggggaagugugcgacgugcguguacaacaugauggggaagcgugaaaagaaacuuggcgaguucgggaaagcgaagggaagccgcgccauuugguauauguggcugggcgcucgguuccuggaguucgaggcgcucggcuucaugaacgaggaccacugguucucccgcgagaacagccuguccggcguggagggagaaggccugcacaaauuaggcuacauccugcgggacaucucuaaaauacccggcggcaacauguacgccgaugacaccgccggcugggauacccgcaucacggaggacgaccugcagaacgaggccaagaucacggauaucauggaaccggaacacgccuuacucgcgaaggcaaucuucaaacugacuuaccaaaacaaggugguacgcgugcagagacccgccaagaacggaaccgugauggacgugaucagucgccgggaccaacgcgggucaggucagguuggcacguaugggcucaacacauuuaccaauauggaggcccagcugauccggcaaauggaauccgagggcaucuuuaguccuuccgaguuggagaccccaaaccucgccgagagagcucuggacuggcuggagaaauacggaaucgagcggcucaagcgaauggcaauuuccggcgacgacugcguggucaagccgauagacgaccguuucgcaacggcccugaccgcgcugaacgacauggggaaaguacgcaaggacaucccgcaaugggaacccaguaagggcuggaacgauuggcagcagguccccuucugcagccaccacuuccaccagcucaucaugaaggacgggcgggagaucgucguaccgugccgaaaccaggacgagcugguagggcgggcacgcgugucccaaggcgccggauggucacugcgagagaccgccugccucggcaagagcuacgcccagauguggcaguugauguacuuccaccgcagagaucuacgccucgcggccaacgcuaucugcucagccgugcccguagacuggguccccaccagcagaacgaccuggaguauccaugcacaucaccaguggaugaccaccgaggacaugcugaguguguggaaccggguguggaucgaggagaaucccuggauggaagacaagacgcauaucuccagcugggaggacgucccguaucuuggcaagcgcgaggaccaauggugcggaucccucaucggccugaccgcccgggccaccugggccacuaacauacaaguugccauuaaccaggugcgccgccugaucgggaaugagaacuaccucgacuacaugaccagcaugaagcgauucaagaacgagacggaccccgagggcgccuugugguga

SEQ ID NO: 24593 - RNA, 9879 nt, Artificial Sequence
  derived and/or modified CDS sequence (opt11) from DENV-1__EU482526__SS-prME
aguguaacgaugcuccuaaugcuaaugccgaccgcgcuggcauuucaucucacaacgcgcggcggcgaaccacauaugauagucaccaaacaagaacgcgggaaaucccugcuauucaaaaccucugcggguguaaacaugugcacacuaaucgcuauggaccucggcgaacugugugaggauacaaugacguacaaaugcccccgaauaaccgaagcagaacccgacgacguggauugcugguguaacgcaacugacaccuggguaaccuacggaaccugcagucagacaggggagcaucgacgagacaaacgaagcguagcacucgccccacacgucgggcuuggcuuagaaacgagaacagaaaccuggaugagcucggagggagccuggaaacaaauacaaagagucgagacgugggcguuaaggcacccagguuucacaguaaucgcgcucuuucuggcccacgcaauaggcacaucgaucacacaaaagggcauaaucuucauccuauugaugcucgucacaccaaguauggcaaugcgcugcgucgggaucgggucgcgagauuuuguggaaggccucucaggagcgacgugggucgacguaguccuugaacaugguagcugcgucacaacgauggccaaggacaaaccaacgcuagacauugagcugcuaaaaaccgaggucacuaacccagccguacuucgaaagcuguguauagaggcuaaaaucagcaacacaacaaccgacagcagaugcccaacccaaggagaagcuaccuugauggaagaacaagacgcuaauuucgugugcagacggacguucguagacaggggaugggggaacggcugcgggcuguuuggaaaaggaagccucaucacaugcgcaaaguucaagugcgucacaaaacuugaaggcaaaaucguccaauacgaaaaucuaaaauacucgguaauagugacggugcacacgggcgaccaacaccaagucggcaacgaaagcaccgagcacggaaccaccgcaaccauaacaccccaagcaccaacaucggaaauccaacucacagacuacggagcacucacacuagacuguagcccccguaccgggcuagacuucaacgagauggucuuacuuacuaugaaagagaaaagcuggcucguccacaagcaaugguuccuugaucuaccacuacccuggacgagcggggcauccaccucccaggagaccuggaacaggcaggaccuccuugugaccuucaaaacggcccacgccaagaaacaagagguggucgugcugggaucccaagagggagcaaugcauacagcgcucacuggcgcaacggaaauacagaccuccggcaccacaacaauauuugcagggcaccucaaaugccgacugaagauggacaagcugacucuaaaagggauguccuacguaaugugcacgggcagcuuuaaacuagaaaaagaagucgcggaaacccagcacgggacgguacugguccaaauaaaauacgaagggacggacgcaccgugcaaaauuccauuuucaacccaggaugagaaaggcguaacacaaaauggacgcuugauaacagccaaccccauuguaaccgacaaagaaaagccagucaacaucgaagcagaaccacccuuuggagagagcuacauagucauaggagccggcgagaaggcgcuaaagcuaucgugguuuaagaaagggucgaguauaggcaagauguucgaggcaaccgcucgcggcgcgagacguauggcaauacugggagauacugcaugggacuuuggcagcauaggaggggucuucacaagcgucggaaagcugguacaccaaaucuucgguacagccuacggcgugcuauucucaggcguaucuuggacgaugaagauuggcauaggaguacuccugaccugguuagggcucaauaguagauccaccagucugaguaugaccuguaucgccgucggucuggucacauuguaucugggggucauggugcaagccgacucuggcugcguuaucaauuggaaagggcgcgagcucaaaugcggaucggggauuuucgugacaaacgaagugcacacuuggacagagcaguacaaauuucaggccgacagccccaaacgacucagcgcggcuaucggcaaggccugggaggaggguguuugcggaauccgauccgccacgaggcucgagaacauaauguggaaacaaaucucaaacgagcucaaucacauccuccuagaaaacgauaugaaauucacgguaguagugggcgacguggucggaauccuugcccaaggcaagaaaaugauccgcccgcaacccauggaacacaaauacuccuggaagaguugggguaaagcuaagaucaucggagccgauguccagaacacgaccuucauuaucgacgggccaaacacgcccgagugucccgaugaucaaagagccuggaacauaugggaaguagaagacuacggguucggaauauucaccaccaauauuuggcugaagcuccgcgauagcuacacacaggugugugaccaccggcucaugucagcggcuauaaaagauagcaaggccguccacgccgauaugggcuacuggauugaaagugaaaagaaugagaccuggaagcuagcaagggcuagcuucaucgaagucaaaaccugcauauggccgaagucgcauacccuauggagcaacgguguguuggaaagcgaaaugauaauaccaaagauauaugggggcccaauuucucaacacaauuaccggcccggauacuucacacaaacugccggaccguggcaucuaggcaagcucgagcucgauuucgaccuaugcgaaggcaccacugugguaguggacgagcauugcggcaaccggggcccgucccugcgcacgacgaccguuaccgggaaaauaauacacgaaugguguugccggagcugcaccuugcccccucuacgauucaaaggugaagacgguugcugguacggaauggagaucagaccagucaaagagaaagaagaaaacuuaguaaagagcauggucagcgcugguagcggcgagguggauucauuuagccucggguugcucugcaucucaauaaugauagaagaagugaugcgaucaagaugguccagaaaaauguuaaugacagggacucucgccguuuuucuacugcucauaaugggccaacucacauggaacgaccugauacgccuaugcauaauggucggagccaaugcaagcgaucgaauggguauggggacgacuuauuuagcgcugauggcaacauucaaaaugcggcccauguucgcggugggccugcuauuuagaagacuaacuucccgggaaguccuccugcuaaccaucggccucagucucguggcaucgguagagcuccccaacucuuuagaggaacuaggggacggacucgccauggguauuaugauccucaaacuacucacggauuuccaaucgcaccaacuaugggcaacccuacucucacuaacauuuauaaaaacaacccugucccuacacuacgccuggaagacaauggcgaugguacucagcauagugagccuauuuccacuaugucuguccacaacaagucagaaaaccaccuggcuaccaguacugcugggcagccucggaugcaagccacugacaauguuuuuaauagcugaaaacaaaaucuggggccggaagucguggccuuugaacgagggcauaauggcgguaggagucgucuccauacugcucagcucccuccucaaaaacgacguaccgcuugcagggccgcugaucgccggcggaaugcucaucgcauguuaugucauaucaggcagcucggccgaccugucacuggagaaggcggcugaggugagcugggaagaagaggcggagcauuccggcgcuagccacaacauccuaguggaaguccaagacgacggcacgaugaaaauuaaagacgaggagcgggaugacacgcucacgauccugcugaaggcaacacuucuagcaguauccggagucuacccgcuaagcauaccagcaacucuuuucgucugguacuucuggcaaaagaagaaacagcgauccgggguccuaugggacacaccgaguccacccgaagucgaaagagcaguucucgacgaugguauauaccguauaaugcaacgcggcuuacuuggcagaagccaagugggcgugggcgucuuucaggagaacguuuuucacacaauguggcacguaacgcgcggggcgguccuuauguaucagggcaaacgucucgaaccguccugggccagcgugaagaaggacuuaauaucuuacggagggggcuggcgcuugcagggcaguuggaacacgggagaagaagugcaagucauagcuguagagccggguaagaacccgaaaaacguacaaacggcucccgggaccuucaagacgccagaaggagagguuggggccaucgccuuggacuucaaaccggguacgagcggcucaccgaucguaaacagggaaggcaagauugugggccucuacggcaacggcgugguaacuacaucaggcacauacgucagcgccaucgcgcaagcgaaagccagucaagaaggcccccucccagaaaucgaagacgagguauuucgcaaacgaaaccuaaccaucauggauuugcacccgggauccgggaaaacgcggcgauaucuccccgcgaucgugcgugaagcaauaaagcggaagcucagaacguuaauacuagcgccgacccgggucguagcaagugaaauggccgaagcacuaaagggcaugccaauuagauaccagacgacugccgugaaaagcgagcacaccggaaaggagauaguggaccucaugugccacgcaacauuuacaaugcgccuccuuaguccggugcgagucccgaauuacaacaugauaauaauggaugaagcacacuucaccgacccgagcagcauagcagccagaggcuacauaaguacccgcgucgggaugggggaagcggcugcaauauucaugaccgcaacaccacccggcucgguagaggcguucccccaaaguaacgccgucauccaagacgaggagcgugacaucccagagagaagcuggaacagcggcuacgaauggaucacugauuuuccaggaaagaccguuugguucguacccuccaucaaguccggcaacgacauagccaacugccucaggaagaacggcaaaagaguaauacagcucaguagaaagaccuucgacacagaauaucagaaaacgaaaaacaacgacugggauuacgugguuacgaccgauauuuccgaaaugggcgcgaauuucagagccgaucggguaauagacccucggagaugccuuaaaccugucauucucaaagacgggcccgaacgggugaucuuagcgggcccaaugccggucacaguggcgucugcagcacaaaggagaggccgaauaggccgaaaccacaauaaagaaggcgaccaauauauauauaugggccagccacucaauaacgacgaggaccacgcacacuggacagaggccaaaaugcugcuagacaacaucaauaccccagaggggaucaucccggcacucuucgaaccggaacgggaaaaaucugcugcgaucgacggugaauaccgacugagaggggaggcacgcaagaccuuuguagaguuaaugcgaaggggagaucuaccaguauggcucagcuacaaagucgcauccgagggcuuccaauauagcgaccggagaugguguuuugacggggagaggaauaaccaaguccuagaggagaacauggacgucgagauauggacaaaggagggcgaaagaaagaaacuuaggccccgauggcuagacgcccggacauacagcgacccccuugcccugagagaauuuaaggaguucgccgcaggacgcaggagcgucucaggugaccugauauuagagaucgggaaacuuccacaacaucuaacacagcgagcccagaaugcacuggauaaccuugugaugcuccacaauuccgagcaaggagggcgagcauauagacacgcaauggaagaguuaccggacacuauagaaacacucaugcuguuggcgcucaucgccguacucacuggagggguuacccucuucuuccuaagcggacggggacuagggaagacaagcauaggccuacucugcgugauggccucuagcgucuuacucuggauggcuucuguggaaccgcauuggaucgcugccagcaucauucuagaguucuuucugauggugcuucucauacccgaaccggacaggcagcgaacuccccaagacaaucaacucgcauaugucguuaucggacugcuauucaugaucuuaaccgucgccgcaaacgaaauggggcuccuagaaaccacuaagaaagaccuaggaaucggacacgucgcgguagaaaaccaccaccacgccacaauguuggacguagaccuccacccagccucagccuggacccucuacgcggucgccacaacuauaauaacucccaugaugcgacacacaauugagaacaccacagccaacauaucgcuaaccgcaauagccaaucaagccgcaaucuugaugggacuagacaagggcuggcccauaagcaaaauggacauuggagucccauugcuugcccuaggaugcuacucccaggugaauccacucacuuuaacugcggccguccucauguugguagcccacuacgcaaucauaggaccaggacuccaagccaaagcaacacgggaagcgcaaaaacgaacggcagcaggcauuaugaaaaacccgacagucgacgggaucgucgccaucgaccuugacccgguagucuacgacgcaaaauucgagaaacaacucgggcaaauaauguuacuuauccucugcacaucacaaauacucuugaugcgcacgaccugggcucugugugaguccaucacccuugcaaccgguccccuuacuacccuuugggaagguucgccgggcaaauucuggaauacaacgauagcugugaguauggcgaacaucuuccguggaagcuaccucgccggcgcuggccuagccuucucccuaaugaagucguuagggggcgguaggagaggcacaggcgcccaaggagagacgcugggagaaaaauggaaacgacagcugaaccaacuaagcaagagcgaguucaacauuuacaagcggagcggaauaauggaaguggacagaagugaggccaaggaaggguugaaacgaggugagacgacaaggcacgcuguuucacgcgguacugcgaagcuaagaugguuuguagaacgcaaccucgucaaacccgaaggcaaagucaucgaucuaggcugcggccgaggaggcuggucguacuauugugcgggccuaaagaaagucacugaaguaaagggauacacgaagggaggcccaggccacgaagaaccuaucccgauggcuaccuauggauggaaccuggugaaacuccacagcggcaaggacguauucuuuacaccacccgagaaaugcgauacacuacuuugcgacauaggagagaguagucccaacccgaccauugaagaaggccgaacacugagggugcucaagauggucgaaccguggcuccgaggaaaccaauucugcaucaagauccuaaacccguacaugccgucaguuguagagacgcuggaacagaugcagcgcaagcacggagggaugcucgucaggaacccccuaucacguaacucuacccacgaaauguacugggucuccugcggaacaggaaauaucguuucugcugucaacaugacaucuagaaugcuacugaaucgguucaccauggcacaccggaaaccuacauacgaaagagacgucgaucucggcgcagggaccagacacguagcaguagagcccgagguugccaaccucgacaucauuggccagcgcauagagaacaucaaacacgagcauaaaucgacuuggcacuacgaugaagauaaucccuacaaaacaugggcguaucacgguucguacgaggucaagcccucuggcagcgcgagcaguaugguaaacggcguggugaaacuacuaacaaagccaugggauguaaucccgauggucacacaaauugcuaugacggacacaacuccguucggccagcaacgaguauucaaagaaaaaguggauacacgaacgccaaaagcaaagcgcgggacggcccagauaauggaagucaccgcacgcuggcuauggggcuuccuaagccgaaauaagaaaccacggauuugcacgcgugaggaguucaccagaaaaguccgcucaaaugccgccauuggcgccguauucgucgacgagaaccaauggaacuccgcaaaagaggcaguagaggacgagcgcuuuugggaccucguccaaaaggaacgggagcuacacaaacaagggaaaugugcgacaugugucuacaacaugaugggcaaaagggagaagaaacucggugaauuuggaaaagcaaagggcagcagagcaauaugguacauguggcucggagcaagauuucuggaguucgaggccuuaggauuuaugaacgaagaccacugguucucaagagaaaauucccuaagcggagucgaaggcgaaggccuacacaagcugggauacauccuaagagauaucuccaaaauuccaggaggcaacauguaugcugacgacaccgcugggugggacacgcgaaucacagaagacgaccuacaaaacgaagcgaagauuaccgacauaauggagccggaacaugcccuucuagccacgucaauauucaaauuaacuuaccaaaauaaggugguccgagugcaacgaccggcuaagaacgggaccgugauggacgucauaucacgacgagaucaacgcggcucaggucaaguagggacauacggucucaacaccuucaccaacauggaagcacaauuaauccgccagauggaauccgaggguaucuuuagcccgagcgagcucgaaauaccaaaccuugcagagaggguucucgacuggcuggagaaauacggggucgaacgcuuaaaacguauggccauaucgggagacgacuguguggucaagcccaucgacgacagguucgcgacggcacucaccgcacucaacgacaugggcaaagucagaaaggacgugccccagugggaaccuucuaaaggguggaaugauuggcaacaaguccccuucuguagccaccauuuucaccaacuaauaaugaaggaugggcgagaaauaguaguaccaugccgaaaccaagacgagcuagucggcagggcaagaguaagccaaggagcaggcuggucgcuacgggaaacggcuugccugggcaaaagcuacgcacaaauguggcaauugauguacuuucaccggagagaccugagacucgccgcaaaugccaucugcuccgcgguuccgguagauugggucccgacaucgagaacgacauggaguauacacgcucaucaccaguggaugacgacggaagacaugcuguccguguggaaccgcgucuggauagaggaaaauccauggauggaagauaaaacccacgucaguagcuggggagacguuccauaccuaggaaaaagggaagaucagugguguggaagccucauagggcugacagcccgagcaacuugggccucuaacauacaaguagccauaaaucaaguacggcgccuaaucgggaaugagaauuaccuggacuacaugaccaguaugaagcgauucaagaacgagggggauccagagggcgcucugugguag

SEQ ID NO: 24594 - RNA, 9879 nt, Artificial Sequence
  derived and/or modified CDS sequence (opt11) from DENV-1__EU482527__SS-prME
agcgugaccaugcugcuuaugcugaugcccaccgcacuggcauuucaccucaccacccgcggcggggagccacacaugaucgugagcaagcaagagcgcggaaagucgcugcuguucaaaaccuccgcaggugucaacaugugcacccucaucgccauggaccugggcgaguucugugaggacacgaugaccuauaagugcccccgcauuacagaagccgaaccggacgacguagacuguuggugcaaugccacggacacgugggugaccuacggcacgugcagccagaccggugagcaccggcgagacaagcgcuccguggcccuggcgccccacgugggccucgggcuggagacgcgcacggagacuuggaugagcucggagggcgccuggaagcaaauucagcgggucgagaccugggcccuucgccacccgggguuuacggugaucgcucucuuccuggcacacgccaucgggacaagcaucacccagaaggggauuaucuucauccugcugaugcuagugacccccuccauggccaugaggugcgucgguaucggcagccgcgacuucguggaggggcugucaggcgcaacguggguggacgucgugcucgagcacggguccugugugaccacuauggccaaggacaagccaacuuuggauaucgagcugcuuaaaacagaggucaccaaccccgcggugcugcggaagcuaugcaucgaagccaagaucucaaacaccaccacggacagccgcugcccuacccaaggcgaagcaacccucguggaggagcaggacgccaacuuugucugccggcgcaccuuuguggaccggggcugggggaacggaugcggccuguucggaaagggcucccugaucacgugcgccaaguucaagugcgugaccaagcucgaggggaagaucguccaguacgagaaccuuaaguauaguguuauagugaccguacacaccggcgaucagcaccaaguggggaacgaaaguacggagcacggcaccaccgcgaccauuacgccccaagccccuagcacggaaauucagcuaaccgacuauggggcguugacacuggacugcucuccccggacaggccuggauuucaacgagaugguccucuuaacgaugaaagagaaaucguggcuggugcacaagcagugguuccucgaccugccacugcccuggacgagcggggcauccaccagccaggagacuuggaaccggaaggaccucuuagugacguucaaaacugcgcacgcgaaaaaacaggaggucguggugcugggcucccaggagggagccaugcacaccgcccucaccggggccacggagauccagaccucgggcaccaccacgaucuucgccggacaccugaaaugucgccugaagauggacaagcugacccugaaaggcaugagcuacgucaugugcaccgggagcuuuaagcuggagaaggagguggcggagacacagcacggcacggugcucguacagaucaaguacgaaggcaccgacgccccaugcaagauccccuucuccacccaagacgggaagggggugacucagaacgggcgauugaucacggccaacccgaucgugaccgacaaggaaaaacccgucaauaucgaggccgagccccccuucggcgagagcuacaucguaauaggcgcgggggaaaaggcccugaagcugucaugguucaaaaagggcagcuccaucgggaaaauguucgaagccacggcccgcggcgccagacgcauggcaauccugggggacacagccugggacuucggaagcauaggugguguauucacuuccguuggcaaguuggugcaccaaaucuuugggaccgccuacggcgugcuguucagcggggucucguggacgaugaagaucggcaucggaguguuguuaaccuggcuggguuuaaauagccgcuccacgagccuguccaugacgugcaucgcuguggggcuggugacccucuaccugggggugauggugcaggcugacagcggcugcgucaucaauuggaaggggcgagagcugaagugcgggagcggcaucuucgugaccaacgagguccauacguggaccgaacaguacaaguuccaggcggauuccccgaagcgccucagugccgcuaucgggaaggcgugggaggaaggcgugugcgggauccgguccgcaacccgccuggagaacauuauguggaaacagaucagcaaugagcugaaccacaucuugcuggaaaacgacaugaaguucaccguggugguaggcgacguggcggggaucuuggcccagggcaaaaagaugauacggccucagcccauggaguacaaguacuccuggaaguccuggggcaaggccaagaucaucggggcggacgugcagaauaccacguucaucaucgacggccccaacaccccggagugucccgacgaccagcgcgcguggaacaucugggaggucgaggacuacggcuuuggcauuuucaccaccaacauuuggcucaaguuacgggacucauacacccaggugugcgaccaccgccugaugagcgccgcgaucaaagauuccaaggccgugcacgcugauaugggauacuggaucgagucggagaagaacgagacauggaagcucgcgcgggccuccuucaucgaggucaagacgugcaucuggcccaagucccacacucuauggucgaacgggguguuagagagcgagaugauuauucccaagaucuacggcggaccgaucucgcagcacaacuacaggccgggcuauuuuacgcagaccgccgggccguggcaucuuggcaagcucgagcuggacuucgaccucugcgaagguacuacaguggucguggacgagcacugcgggaaccggggaccgagccugcgcacgaccacagugaccggaaagauuauucacgaaugguguugccgguccugcacucugccgccccugcgcuucaagggagaggacgggugcugguacggcauggaaauccggcccguaaaggagaaggaggagaaccuggugaaaucgauggugucugccggaucaggggaggucgacagcuucuccuugggccuccugugcaucucgaucaugaucgaagaggucaugcgcagccgauggagccgcaagaugcugaugacagggaccuuggccguguuuuuccugcuaauaauggggcaacucacauggaacgaccugauucggcugugcaucauggucggugcgaaugcauccgaucgaaugggcaugggaaccaccuaccucgcccugauggcgacuuucaaaaugcgcccgauguucgcaguggggcuccuguuucggcgccugaccucaagagaagugcuguuacucacgaucgggcugucccucgucgcuuucguggagcugccaaacagccuagaggagcucggggacggcuuagccaugggcauuaugauucugaagcuccucaccgacuuccagucccaccaauuaugggccacccuccugaguuuaaccuuuaucaagacaaccuucucccugcacuacgccuggaagaccauggcgaugguucugagcaucguguccuuguucccucucugccucagcaccacgucacagaaaaccacguggcugcccguguugcuggguagccuggggugcaagccguuaacaauguuccuuaucgccgagaacaagaucugggggagaaaguccuggccccugaacgagggcaucauggccguaggcaucgugucuauccuccugagcagccugcucaagaacgaugugccccuggccggcccccugauagcgggcggcaugcucaucgcgugcuaugugauaagcggcuccagcgcggaucuaucacuggagaaggcagcugaggugagcugggaggaggaagcugaacacuccggagcgagccauaacauccucguagaaguucaagacgauggcacgaugaaaauaaaagacgaggagagggacgacacgcugaccauucugcucaaggccacacugcuggcgguguccgggguguauccacucuccauucccgccacccuguucgucugguauuuuuggcaaaagaagaagcaacgcuccggugugcuaugggauacucccagcccgcccgagguggagcgggcaguacuggacgacggcaucuaccgcaucaugcagcgggggcuguuaggccgcucccagguggggguuggcgucuuccaggagaacgucuuccacaccauguggcacgugacacgcggggcuguuuugauguaccaaggcaagcgccuagagccuagcugggccuccgugaagaaggaucugaucagcuacggcggggguuggcggcuccaaggguccuggaacacuggcgaagaggugcaaguuaucgccguggagcccgggaagaaccccaagaaugugcagacggcucccggcaccuucaagaccuccgagggcgaggugggggccauagcgcucgauuucaagccaggcacuuccgggagccccaucgugaaccgagagggaaaaaucgugggccuuuacgggaacggcgucguaacgaccagugggaccuauguaagcgccaucgcccaggccaaggccucacaggagggcccccugccggagaucgaggacgaggucuuucguaagcgcaaccucaccaucauggaccugcacccgggguccggcaagacacggcgcuaccugcccgccaucguccgcgaggcuaucaagcgcaagcuccggacccugauccuggcccccacucgcguggucgcgagcgaaauggcggaggcccucaagggcaugcccauccgcuaucagaccacugccgugaagagugagcacaccgggaaggagaucguggaucuuaugugccacgccaccuucacgaugcggcuauuaagccccgugcgagugcccaacuacaacaugaucaucauggacgaggcccauuucacggacccguccagcaucgccgcccguggauacauauccacacgcguggggaugggcgaggccgcagccaucuucaugacggcuacuccucccgggagcgucgaggccuucccccaguccaaugcugugauccaggacgaggagcgggacaucccggagcgcagcuggaacuccggcuacgaauggaucacggacuucccgggcaagaccgugugguucguacccagcaucaaauccgggaacgacaucgccaauugccugcggaaaaacggcaagcgagucauacagcugagccggaagacuuucgacaccgaguaccagaagacgaagaacaaugacugggacuaugugguaacgaccgacaucucggagaugggggcgaacuuucgcgccgaccgagugauugauccccgacgguguuugaagccgguaauccugaaagacggccccgaacgcguuauccuagccgggcccaugcccguaaccgucgcaagcgccgcccagcggcgcggccgcauaggacgcaaccacaacaaggagggggaccaguauaucuacaugggccaaccgcucaacaacgacgaggaccacgcgcacuggacggaggccaagaugcugcuggacaacauaaacacccccgaggggaucauucccgcccucuucgaacccgagcgcgagaaguccgccgcgauagacggcgaguaccgcuuacgcggggaggcacggaagacauucgucgagcugaugcgccggggcgacuugccaguguggcugagcuacaaggucgccucagagggauuccaguacagcgaccgcagauggugcuuugacggcgagagaaauaaccaggugcuggaagaaaacauggauguagagaucuggacgaaggagggugagcggaagaagcuccgcccccgguggcucgacgcucguacguauagcgacccccuggcccuccgggaguuuaaggaguucgcggccgggcgccggagcgucagcggcgaccugauccuggagauagggaaauuaccccagcaccugacccagcgcgcccaaaacgcccuggacaaccucgugaugcuucacaacagcgagcagggagggcgggcguaccgacaugccauggaggagcugcccgacacgaucgagacccucaugcugcuggcccugaucgccgugcugacggggggcgucaccuuauuuuuccugagcgggagggggcucggcaagaccuccaucgggcugcucugcgugauggccagcuccgugcuguuauggauggcgagcgucgagccucauuggaucgccgcuuccaucauacucgaguuuuuccugaugguacugcucaucccugagcccgaccgccaacggaccccgcaagacaaccagcuggccuacgugguuaucggucuccucuucaugauucugaccguggccgccaacgagauggggcugcucgagacgaccaagaaggaccugggcauagggcacguggcggucgagaaccaccaccacgcggcaaugcuggacguagaccuccacccggccagcgcguggacgcuguacgcugucgccaccacgaucauuacccccaugaugcgccacacgaucgagaacaccacggccaacaucucccugacggccauagcgaaccaggccgccauauuaaugggccuggacaaaggguggccgaucagcaaaauggauaucggggucccccugcucgccuuaggaugcuauucucaggugaauccccugacucucaccgcggcaguacugaugcuggucgcccacuacgccauuaucggccccggccuccaggccaaggccacgcgggaggcccagaagcgcaccgccgccgggauuaugaaaaaccccaccgucgauggcauagucgccaucgaccuggacccuguuguguacgacgcgaaguucgagaagcaacugggccagaucaugcucuuaauccugugcaccagccaaaucuugcucaugaggacaaccugggcccugugcgaguccaucacccucgccacugggccccuuacgacccugugggagggcuccccugggaaguucuggaacaccaccauugccguguccauggccaacauuuuuagaggcagcuacuuagccggcgccggacuugccuucagccugaugaagucccucggcgggggccgacgagggacgggagcccagggcgagacccugggggaaaaguggaagcgccaacucaaccaauugagcaaguccgaguuuaacaccuacaaacggucuggcaucauggaggucgaccguuccgaagcgaaggaagggcuuaagcguggcgaaaccacgaagcacgccgugagccgggggacagcgaagcugcggugguucguggagcgcaaccucgucaagccggagggcaaggugaucgacuugggaugcggccguggcggguggucguacuacugcgcuggccuaaagaaggugaccgaggugaagggguauaccaagggcggucccggacacgaggagcccauucccauggcuacguacggcuggaaucucgugaaacuacacucggggaaggacguguucuucaucccgcccgagaagugcgacacccugcugugcgacauuggcgagucuagccccaaccccacuauagaagaaggccgcaccuugcgcguccuaaagaugguggagccauggcugcgaggcaaccaguucuguaucaaaauccucaaccccuauaugcccuccguugucgagacgcuggagcagaugcagcggaaacauggcgggaugcuggugcgcaauccccucagccggaauaguacacacgagauguacugggucagcugugggaccgggaacaucgugucagcggugaacaugaccagccggaugcuguuaaaucgguuuacgauggcccaccgcaagccgacguacgagcgcgacguggaccucggcgcuggcacgcggcacgucgccguggagcccgagguggccaaccucgauaucaucggccagaggauagagaacaucaagcaugagcauaaguccacguggcacuaugaugaggacaaccccuacaagaccugggcguaccacgggagcuaugaaguaaaaccguccgguagcgccagcuccaugguuaacggcgucgugaagcugcucacgaagccgugggacguuaucccgaugguaacccagaucgcaaugaccgacaccacccccuucgggcagcagcggguauucaaggagaagguggauacccgcacacccaaggccaagcgcggcaccgcccagaucauggagguuacggcgaaauggcuguggggcuuccucucgcgcaacaagaagccgcggauaugcacccgcgaggaguucacccggaaaguuaggagcaaugccgccaucggggcaguuuuuguagaugagaaccaguggaacucugcgaaggaggccguggaagacgagcgguucugggaccucgugcaccgcgaaagggaacugcacaagcagggaaagugcgccaccugcguuuacaacaugauggggaagcgcgagaagaaacuuggugaguuugggaaggcuaaggguuccagggccaucugguacaugugguugggcgcgcgcuuccuggaguuugaggcgcugggguucaugaacgaagaccacugguucagccgggagaacucucucagcgggguggagggagaaggccuacacaaacugggguacauccuccgcgacauuucaaaaauccccggcggcaacauguacgccgaugacacggcagggugggacacccggaucaccgaggacgacuuacagaaugaggccaagaucaccgacaucauggaaccggagcacgcguuacucgccaagaguaucuucaagcucacguaucagaacaagguggugcgugugcagcgaccugcuaaaaacggcaccgugauggaugucauuuccaggcgcgaccagcggggaucaggccaggugggcaccuacgggcuaaacacauucacgaauauggaggcccaacugaucagacagauggagucugaggggaucuucagcccuuccgagcuggagacuccgaaccuggccgggcgggucuuggacuggcuggagaagcacggggucgagcgcuugaagcgaauggcgaucucaggggaugauugcguggugaagcccauugacgaucgcuucgccaccgcccugaccgcacugaaugacaugggcaagguccggaaagacaucccucagugggagcccuccaagggcuggaacgacuggcagcagguccccuucugcagccaccauuuccaccaacugaucaugaaagaugggcgcgagaucgugguccccuguagaaaccaggacgagcugguuggacgcgcccgggugagccagggagcgggcuggucccugcgcgaaacggccugccugggcaagagcuacgcucagauguggcagcugauguacuuccaccggagagacuugcgguuggccgcgaacgcgaucuguuccgccguucccguugacugggugcccaccagccggaccaccugguccauccacgcccaccaccaguggaugacgaccgaagacaugcuaucagucuggaaccggguguggaucgaggagaaccccuggauggaagacaagacccauaucucgucguggggugacgugcccuaucugggcaagcgcgaggaccaguggugcggaagccugaucgggcucaccgcgcgggcgaccugggcgaccaacauccaggucgcgaucaaccagguucgacgccugauugggaacgagaacuaccuggauuacaugaccagcaugaagcgguucaagaaugagagugacccggagggugcgcuaugguag

SEQ ID NO: 24595 - RNA, 9879 nt, Artificial Sequence
  derived and/or modified CDS sequence (opt11) from DENV-1__EU482528__SS-prME
ucugugaccaugcugcucaugcugaugcccacggcccuggccuuccaccucacgaccaggggcggggaaccccacaugauagugucaaagcaggagcggggcaagagccugcuguuuaagaccagcgcgggggugaauaugugcacccucaucgccauggaucugggggaguucugcgaggacacgaugaccuacaaauguccacgcauaaccgaggccgaaccagacgacguggauugcugguguaacgccacggacacgugggucaccuacgggaccugcagccagacgggcgagcaccggcgggacaagcgguccguggcgcuggcgccacacgucggccucgggcuggagacccgcaccgagacauggauguccucagagggcgccuggaaacagauccagcgggucgagaccugggcccugcgccacccaggguucacagugaucgcccucuuccuugcgcacgccaucgggaccagcaucacccagaaggggaucaucuucauacuucucaugcuggugacccccuccauggccaugcggugugucggcaucgguagccgcgacuuuguggaggggcuguccggcgccacguggguggacgucgugcucgagcaugggucgugcgugaccacaauggcaaaggacaagcccacccuggacaucgaguugcucaagacggagguaaccaacccagcggugcugcggaagcuaugcaucgaggccaagaucagcaacaccaccacggacagccgcugcccgacccagggcgaggccacccucguggaggagcaggacgccaacuucgucuguagacgcaccuucguggaucggggcugggggaacgguugcgggcuguucggcaaagggaguuuaauaacgugcgccaaauucaagugcgugacuaagcucgagggcaagaccguccaguacgagaacuugaaguacagcgugaucgugaccguccacacgggcgaucagcaccagguggggaacgaaucuaccgagcacggcaccaccgcgacgauaacgccccaggcccccucgacggagauccagcuaacggacuauggggcccucacacuggauugcagucccaggacuggccuggacuucaacgagaugguccuccugaccaugaaggagaaguccuggcuggugcacaagcagugguuuuuggaucuaccgcugcccuggaccucaggugccuccaccagccaggagacguggaaccggaaggaccuacugguuaccuuuaagaccgcacacgcaaagaaacaggaggucgugguguugggcucccaggagggcgccaugcacaccgcucucacaggggcuacggagauccagaccagcggcaccacgaccaucuucgccggucaccugaagugcagacugaagauggacaagcucacccugaaaggcauguccuacgucaugugcacggggagcuucaagcuagagaaggagguggcggagacgcagcacggcaccgugcucguucagauaaaauacgaaggcaccgacgcccccugcaaaaucccuuucuccacacaagacgagaaggggguaacgcagaacggccggcugaucaccgccaacccgaucguaaccgacaaggagaagcccgucaacaucgaggccgagccgcccuucggggagagcuauaucgugaucggcgcuggcgagaaggcacugaagcuguccugguucaagaaagggucguccaucggcaagauguucgaagccaccgcccgcggugcgcggcggauggcgauccucggcgacacggccugggacuucggcagcaucggcggcguguucacguccgucgggaagcuggugcaccagauauucggcaccgccuauggcgugcuguucagcggcguuucuuggaccaugaagaucgggaucggcgugcucuugacguggcugggccucaauagucgcucgaccagccuguccaugaccugcaucgccguggggcuggucacccucuaccugggugccauggugcaggcggauagcggcugcgugaucaacuggaagggccgggagcugaagugcgggagcggcauuuucgucaccaacgaggugcacaccuggaccgagcaguacaaauuccaggcggacaguccgaagcgccucucugccgccaucggcaaggcuugggaggagggugucugcggcauucgguccgcaacccggcuggagaacaucauguggaaacagauuagcaacgagcugaaccacauccuccuggagaaugacaugaaguucaccguaguggugggggaugucgccggcauccuggcccagggcaagaagaugauccgaccgcaacccauggaguacaagcauucauggaagaguuggggcaaagccaagauuauaggcgcggacgugcagaacaccaccuucaucauagacgggcccaacacaccggagugccccgacgaccagcgcgccuggaacaucugggagguggaggacuacggcuucgggaucuucaccacgaacaucuggcucaagcugagggacuccuacacccagguaugcgaccaccgccugaugagcgccgcuauuaaggacuccaaggccgugcacgcggacaugggcuacuggauugagagcgagaagaacgaaaccuggaagcucgcacgggccuccuuuaucgaggugaagacuugcaucuggccaaagagccauacgcuguggaguaacgggguccuggagucugagaugaucauucccaagaucuaugggggaccgaucucccagcacaauuaccgccccggguacuucacccagaccgccggccccuggcaccucggaaagcuggaacuugacuucgacuugugcgagggcaccacgguuguugucgacgagcauuguggcaaucggggcccuagccugcgcacgaccaccgugacgggaaagaucauccacgaguggugcugccgguccugcaccuugccgccccuucgcuucaagggggaggacggcugcugguacgggauggagauacggcccgugaaggagaaggaagagaaccugguaaagagcauggugagcgccggguccggcgagguggacagcuucucucuggggcuauugugcaucagcaucaugaucgaagaggucaugcgcucccgguggagccgcaagaugcucaugacuggcacccucgcgguguucuuucugcugaucauggggcaacugacguggaacgaccugaucagacucuguaucauggugggcgcaaaugccuccgaccgcauggggaugggcaccaccuaccucgcccugauggccaccuucaagaugcggccaauguucgcggucggccuccuguuccgucgccuaacuagccgggaggugcugcuccugaccaucgggcugagucucguagccagcgucgagcugcccaacucucuggaagaacucggcgacgggcuggccauggggaucaugauccugaaauuacugaccgacuuccagucacaccaacugugggcuacgcucuugucccugacguuuaucaagaccaccuucagcuuacacuaugcguggaagacuauggccaugguccugucgauuguuagccuguucccccucugccuguccacuacaagucagaagaccacuuggcugcccgugcuccuaggcucccugggguguaagccgcucacgauguuccugaucgccgaaaacaagauauggggcagaaagagcuggccccugaacgagggaaucauggccgugggcaucgucagcauccuccuguccagccuguuaaagaacgacgugcccuuagccgggcccuuaauagcuggcggcaugcucaucgccugcuacgugaucuccgggucauccgccgaccugagccuggaaaaggcugccgaagucuccugggaggaggaggcggagcacagcggagcaucacacaacauccucguggaggugcaggacgaugguaccaugaagaucaaggacgaggaacgggaugauacccugaccauucugcuaaaggccacccugcuggccgugucaggcguguacccucucuccaucccggccacacuguuugucugguacuucuggcagaagaaaaagcagcgcagcgggguacuaugggacacccccagcccgcccgagguggagcgugcggugcucgacgacgggaucuacaggaucaugcagcggggccuguuagguaggagccaggugggcguggguguguuccaggagaacgucuuucacaccauguggcacgugacccggggcgccgugcugauguaccaagggaaacgacucgagcccuccugggcgagcgucaagaaggaccugauuagcuauggcggcggcuggcggcugcagggcagcuggaacacuggggaagaaguccaggugaucgccgucgagcccggcaagaacccaaagaacgugcagaccgcccccgggaccuucaagaccuccgagggcgaagugggcgcgaucgcccuggacuuuaaacccgggacgagcggcagccccaucguuaacagagaggggaagaucgugggccuguauggaaacgggguggucaccaccagcggcaccuacgugagcgccaucgcccaggcgaaagccagucaagaggggccccuacccgagaucgaggacgagguguuccgcaagcgcaaccugacgauuauggaucugcaccccggcagcgggaagacccggcgcuaccugcccgccaucguccgggaggccaucaagcgcaagcuccggacccuuaucuuagccccgacgcgcgugguugcguccgagauggccgaggcucugaagggcaugcccaucagauaccagacgaccgccgucaagagcgagcacaccggcaaagagauuguggaccugaugugccacgccaccuuuacgaugcggcugcucucucccgugcgcguccccaauuacaauaugauuauuauggaugaggcgcacuucacagacccaagcuccauagccgcacgcggguacaucagcaccagagucggcaugggugaagccgccgccaucuucaugacagccacaccgcccggcuccguggaggccuucccucagagcaacgccgucauccaagaugaggagcgggacaucccggaacgcuccuggaacucuggguacgaguggauaacugacuuccccggcaagaccgugugguucgugccuuccaucaagaguggcaacgacaucgcgaacugccuucggaaaaaugggaaacgagucauccagcugaguagaaagaccuucgacacggaauaccagaagaccaagaacaacgacugggacuacguagugaccaccgacaucagcgagaugggcgccaacuuccgggccgaucgaguaaucgacccccgacggugccucaagccggugaucuuaaaagacggucccgaacgggugauccuggccggccccaugccugucacgguggccuccgcggcucagcggcgggggcggaucggacgcaaccacaacaaggagggcgaucaauacaucuacauggggcagccgcucaacaacgacgaggaccacgcgcauuggaccgaagccaagaugcugcuggauaacaucaacacuccagagggcaucauucccgcgcucuuugaacccgagcgggaaaaauccgcggccaucgacggcgaguaccggcuacgcggcgaagcgcgaaagaccuucgucgagcugaugcgccgcggggaucucccgguaugguugagcuauaagguggccuccgagggauuccaguacagcgaccgcagauggugcuucgacggagagcgcaacaaucagguccuggaggagaacauggacguggagaucuggacgaaagagggggaacgaaagaaacuucgcccucgguggcuggaugcccgcaccuacuccgauccucucgcgcuccgggaguuuaaggaauuugccgcagggcgccggagcguuuccggggaccucauccuggagaucgguaaguuaccgcaacaccugacccagcgcgcgcagaacgcgcuggauaaccucgucaugcugcacaauagcgagcaaggagggcgcgccuaccgccacgcgauggaggaguuaccggacacaaucgagacgcucaugcuguuagcccugaucgccguccugaccggcggcgugaccuuguucuuccuauccggccgggggcugggcaagacuagcaucggcuuacucugcgucauggcguccagcgugcugcuauggauggccucggucgaaccccacuggaucgccgccagcaucauccucgaguucuucuuaauggucuugcucauucccgagccagaccgccagcggaccccgcaggacaaccagcuggccuacguggugaucgggcuccucuucaugauacugacggucgcggccaacgagaugggccugcuagagaccaccaagaaagaccuggggauuggccacguggcaguugagaaccaccaccacgccgccaugcuggacgucgaccuccaccccgcguccgccuggacacuguacgccguggccacgaccaucaucacccccaugaugcgccacaccaucgagaacacgacagccaacaucucacugaccgcgaucgcgaaccaggccgccauccucaugggguuagacaaaggcuggccgaucuccaaaauggacaucggcgugccccugcucgcgcuggggugcuacucgcaagugaacccccugacccucacggccgcggugcugaugcugguagcccacuacgccaucauagggcccgggcuacaggcgaaagcaacccgggaggcgcagaagcgcaccgccgccggcaucaugaagaacccgacggucgacgggauuguggcgauugaucuggaccccguggucuacgacgccaaauucgagaagcagcuggggcagaucaugcuccugauucugugcacgucccagauucucuuaaugcggaccaccugggcccugugcgagaguauuacccucgccacgggaccccugaccacucugugggaagggagucccggcaaguucuggaacacuacgauagccgugagcauggcgaauaucuuucgggggaguuaccucgccggcgccgguuuggccuucucccugaugaagucauuggguggcgggagacggggcaccggggcacaaggugagacccugggagagaaauggaagcgccagcugaaccagcucuccaagagcgaguucaacacauacaaacgguccgggauaauggaggucgacagaagcgaggcuaaggagggccugaaacgcggggagacgaccaagcacgcugucucgcgcggcaccgccaaacugcgaugguucguggagcgcaaccucguuaagccggaggguaaggucaucgaccugggcuguggccgcggcggguggaguuauuacugcgccgggcugaaaaagguuaccgaggugaaaggguacaccaagggcggcccuggccacgaggagcccaucccaauggcaaccuacggguggaaccucguaaagcuccauuccggcaaggacgucuucuucauuccgccggagaagugcgauacccugcugugcgacaucggggaguccucccccaaccccacaaucgaggagggccgcacucuccgcgugcugaagaugguagagcccuggcugcgcgggaaccaguucuguaucaagauccucaaccccuauaugcccagcgugguggagacccuggaacaaaugcagcggaagcauggcggcaugcugguccgcaacccccucucccggaacagcacgcacgagauguauuggguguccugcgggaccggaaacaucgugucggccgucaacaugaccucccgcaugcugcuuaaccgguucacgauggcccaccgcaagccgacauacgagcgcgacguggaccucggggccggcacccgucacguggccgucgagcccgagguggcgaaccuggacaucaucggccagcgcaucgagaacauuaagcaugagcacaagagcaccuggcacuacgacgaggacaacccguauaagaccugggccuaccacgggucauacgaggugaagcccuccgggagcgcaucgagcauggucaacggaguggucaagcuacucaccaagccaugggacgugaucccaauggugacccagauugcgaugacagacacgaccccguucggccagcagcgggucuuuaaggagaagguggacacccgcacccccaaggccaagcgggggacugcgcaaaucauggaagugaccgccaaguggcuguggggcuucuuaucccgaaauaagaagccgagaaucugcacucgcgaggaguucaccagaaaagugcgcagcaacgccgccauuggcgcgguuuucguggacgaaaaucaguggaacuccgcgaaggaggccgucgaggacgagcgguucugggaccucgugcaucgcgagcgggagcugcacaagcaagguaagugcgccacgugcguuuacaacaugaugggcaagcgcgagaaaaagcugggggaguucggcaaggccaaggggagccgugcgaucugguacauguggcucggcgcgcgcuuccuggaguucgaggcccugggcuucaugaacgaggaccacugguucucacgggagaacagccucuccgggguagagggggaggguuugcacaaacugggcuacauccugcgcgacaucagcaagauuccaggggguaacauguacgccgaugacaccgccggcugggacacccggaucaccgaggacgacuuacagaacgaggcgaaaaucacggauaucauggagccggagcacgcccugcucgccaaguccauauucaaauuaaccuaccagaacaaggugguccgcguacagcgucccgccaagaacgggaccgugauggacgucauuagccgccgcgaccagcggggcuccgggcaggucggcaccuacggccugaacacguucaccaacauggaggcucagcucauccgccagauggagucggaggggaucuucucccccucagagcuggagacccccaacuuagcgggccggguguuagauugguuagagaagcacgggguggagcgccugaagagaauggcgaucagcggcgacgauugcguggugaaaccgaucgacgaccgguucgcaaccgcgcugacggcccuaaacgacaugggaaagguuaggaaggacaucccgcaaugggagcccagcaaggguuggaacgauuggcaacaggugcccuuuugcagccaucacuuucaccagcucauuaugaaggacggcagggggaucguggugcccugccggaaucaggacgaguuggucgggcgcgcgcgcgugucccagggggcuggcuggagccugagggagaccgcuugccuggggaaguccuacgcccagauguggcagcucauguacuuccaccggagagaucugcggcuggcggccaacgccaucugcagcgcugugccgguugacugggugcccaccucccgcaccacguggagcauccacgcucaccaccaguggaugaccaccgaagauaugcucuccguauggaaccgggucuggaucgaagaaaaccccuggauggaggauaagacacacauaagcuccuggggcgacguacccuaccugggcaagcgcgaggaucaguggugugggagucugauuggccucacggcgcgggcgacaugggccaccaauauucagguggccauaaaccaggucagacgccugaucgggaacgagaacuaccuggacuauaugaccucgaugaagcgguucaagaacgagagcgacccggagggcgcccucugguga

SEQ ID NO: 24596 - RNA, 9879 nt, Artificial Sequence
  derived and/or modified CDS sequence (opt11) from DENV-1__EU482529__SS-prME
agcgucaccaugcugcugaugcugaugccgaccgccuuagcuuuccaccuaacgacgcgcggcggggaaccacacaugaucguguccaagcaggagcgggguaagagccugcuauucaagacuagcgccgggguaaacaugugcacccucaucgccauggaccugggggagcugugcgaggauacgaugacauauaaaugcccgaggaucacugagacggaaccugaugauguggacugcuggugcaacgccacugacacgugggucaccuacgggaccugcucucagaccggcgagcaccggcgggauaaacgguccguggcccuggcgccccacgugggcuuaggacucgagacccguaccgagaccuggaugucguccgaaggcgcguggaagcagauccagcgggucgaaaccugggcacuccggcacccagguuucaccgugaucgcacuguuccuggcacacgcuaucggcaccucaauaacccaaaaagggauuaucuucauccuccugaugcuagugacccccuccauggccaugcggugcgucgggaucggcagccgggacuucguugagggccucucuggcgccaccuggguggacgucgugcucgagcacgggagcugcgugaccaccauggcaaaggacaaacccacgcuggacaucgagcuccuuaaaacagaagugaccaaucccgcaguuuugcguaagcucugcauugaagcgaagauauccaacacaacaaccgacaguaggugcccgacgcagggcgaggcgacgcugguggaagaacaggacgccaacuucguaugccggcgcaccuucguggaccggggguggggcaauggcugcggucuguucggcaaaggaucccucaucacgugcgccaaauucaagugcgugaccaagcuggaaggaaagaucguccaguacgagaauuugaaguacagcguuaucgugaccguccauacgggcgaccaacaccagguggggaacgaguccaccgaacauggcaccacugccaccaucacgccacaggcgcccaccacagaaauucagcucaccgacuacggggcccugacucuggacugcucaccccgcaccggccuugacuucaaugagaugguucuucucaccaugaaggagaagucaugguuaguucauaaacagugguuucuggacuuaccccuccccuggaccucuggcgccagcacgcugcaagagacauggaaccgucaggaccuccugguaaccuucaaaacagcccaugccaagaaacaagaggucguggugcucggcucccaagagggcgcgaugcacacggccuugaccggugccacagaaauccagaccagcggaacuaccaccaucuucgcuggucaccucaagugccggcugaagauggauaagcugacgcucaagggcaugagcuaugucauguguacggggucguucaagcuggaaaaggagguagcggagacacagcacgggaccguccuaguacagaucaaauacgagggcaccgaugcgccuugcaagauuccguucuccacucaggacgagaagggagugacccaaaacggcaggcugauaaccgcgaacccaaucguuaccgauaaagagaaacccguaaacaucgaggccgagccgccauucggggagaguuacauaaucauuggcgccggcgagaaggcacucaagcuguccugguucaagaagggaagcuccauaggcaaaauguucgaggcuacggcccgcggggccagacguauggccaucuugggcgacaccgcgugggauuucgggagcaucgguggaguauucaccuccguugggaagcucguccaccagaucuucgguaccgccuacggggugcuauucucggguguuucauggacgaugaagaucggaaucggcguccugcucacuuggcuuggccuaaauucucgcuccaccucacucagcaugacaugcaucgccguggggcuggugacgcuuuaccuaggcgucauggugcaggcugauucagguugcgugauaaauuggaaaggccgagagcugaagugcggguccggcaucuucgucacaaacgaggugcauacauggacugagcaguacaaauuccaggccgauagucccaaacgccugagcgcggccaucggaaaggccugggaagaggggguguguggcaucagauccgcgacgcgccucgaaaacaucauguggaagcagaucuccaacgagcugaaucauauccugcuugagaaugauaugaaguucacggucguuguaggggacguggccggcauccuggcgcaaggcaagaagaugauucggccccagcccauggaguacaaguacucguggaaguccuggggcaaggccaagaucauaggagcugacgugcagaacaccacauucaucaucgaugggccaaacaccccggaauguccggacgaccaaagggccuggaacaucugggagguggaggacuacggguucggcaucuucacgaccaacaucuggcugaaacuucgcgauucccauacccaggucugcgaccaucgcuuaaugucggcggccaucaaagacuccaaagcugugcaugcagacauggguuauuggaucgaguccgagaaaaacgaaaccuggaagcuggcucgggcgagcuuuaucgaggugaagacaugcauuuggcccaagagccauacccuguggucgaacggcguccuggagagcgagaugauuauacccaagaucuacggagggccgaucagccaacacaauuaccgcccgggguacuucacccagaccgccggccccuggcaucuggggaagcucgaguuggacuucgaucugugugagggcacgacgguggugguagacgaacauugugguaauagagggcccagccucagaacgacaacggugaccggcaagaucauccacgaguggugcugcaggagcugcacucucccgccucugcgcuuccgcggggaagacgguugcugguacgggauggagauacgccccgugaaagagaaggaggagaaccucgucaagagcaugguauccgcaggcagcggcgaaguagacagcuucucccuggggcuccucugcaucucuaucaugaucgaggaggucaugagguccagguggagucgaaagaugcugaugaccggcacgcuggcagucuucuuucuccugauaaugggccagcugaccuggaacgaucugauccggcugugcaucaugguaggagccaacgcuagcgacagaaugggaaugggaaccaccuaucuagcgcugauggcuacguuuaagaugcggccgauguucgcagugggccuacuguuccgacguuuaaccagccgcgaaguguugcugcucacaaucgguuuaagccugguggccagcguugagcuccccaauucccuggaggagcuuggugacgguuuagcgaugggcauuaugauccuaaagcuguugacugacuuucaaagccaucagcugugggccacgcucuugagccugaccuucaucaagacgacauucucgcuacacuacgccuggaagacuauggcuaugguccucuccauagugagccuguuuccacugugucucagcacuaccucgcagaaaaccacauggcugccgguccugcuagguucccucgguugcaagccucugaccauguuucucaucgcugagaauaagaucuggggccggcggagcuggccccugaacgagggaaucauggccguggguaucgucuccauacuauuauccagccugcugaaaaacgaugugccccuugcagguccccugauugcaggcggcaugcugaucgcgugcuacguaaucuccgggagcuccgcggacuuaagccuagagaaggccgccgaagucagcugggaggaggaagcagagcacagcggcgccagccacaauauccugguggaggugcaggaugauggaacuaugaagaucaaagacgaggagcgcgacgacacccucaccauacuccugaaggcgacgcuguuagccgucagcggaguguauccccuguccaucccugccacccucuucgugugguacuucuggcaaaagaagaagcagcgaucugguguccugugggacacccccucuccgcccgagguugagcgggccgugcuggaugacggcaucuaccguaucaugcagcgaggccuacucgggcgcagucaagucgggguggggguuuuucaggagaacgucuuccacaccauguggcacgugacgcggggcgccgugcugauguaccaggggaaacgccuggagcccuccugggcaucagucaagaaggaccucaucucuuaugguggcggguggcggcugcagggcucauggaauaccggagaggagguccagguaaucgcuguagagcccggcaagaaccccaagaacgugcagaccgccccagggaccuuuaagacgccagagggcgaggugggcgcuaucgcccuggacuuuaaacccgggaccucaggaagcccgauagucaaccgugaggggaagauuguaggccucuacggcaacggaguggucacaaccagcggcacuuaugugucggcgaucgcccaggccaaggccucgcaggaagggccgcugcccgagauugaggacgagguguuccggaagcgaaaccuuaccaucauggaccuccacccugggucagggaagacgagacgcuaccugcccgcgaucguccgggaggccaucaagcguaaacuucgcacccucauccuggcccccacgcguguagucgccucggagauggccgaagcguuaaaggggaugcccauccguuaccagaccaccgccgucaaaucagagcacaccggcaaagaaaucguggaccuuaugugccacgccacauucacuaugcgucugcuaagccccguacgcguuccgaacuacaacaugaucaucauggacgaggcccacuucaccgaccccuccagcaucgccgcucggggauacaucagcacucgcguugguaugggagaggcggcggccauauuuaugacggcgacuccucccggcuccguggaggcguucccucaguccaacgcugucauccaagaugaagaacgggacauccccgagcgcuccuggaacuccggguacgaguggauaaccgacuuccccggaaagaccgugugguucguucccagcaucaaguccggcaacgacaucgccaacugccuccggaagaacggaaagcgcgucauacagcugucgcggaagacguuugauaccgaauaccagaaaaccaagaauaacgacugggacuacguggugacgacggauauuuccgagaugggcgcgaacuucagggcagacagagucaucgauccgcgccggugccugaagccugugauccugaaggacgggcccgagcgaguaauccuagccggacccaugccuguaacugucgcgagcgccgcacagagacgcggucggaucggccgcaaccacaacaaggaaggagaucaauacauuuacaugggccagccccugaacaacgacgaggaccacgcccacuggaccgaggccaagaugcugcuggacaauauaaacacccccgaggguauaaucccggcgcuguucgagccggagcgugagaaauccgccgccaucgacggagaguaccggcuccgaggcgaagcucggaagacguuuguggaacugaugcgucgcggggaccuuccggucuggcucucguacaaggucgccuccgagggcuuccaguacucggaccgccgaugguguuucgacggcgaacgcaacaaccagguccuggaggagaacauggacguggagaucuggaccaaggagggggagcgaaagaagcugcgcccccgguggcuugacgcccgcacguacagcgacccccuugcauuaagggaguucaaggaguucgcugcgggcagacgguccgugagcggcgacuuaauccucgaaauaggcaaguuaccgcagcaucucacccaaagagcacagaacgcucucgacaaccuggucaugcugcacaauucggagcaaggagggcgggccuaccgccacgcgauggaagaacugcccgacacuaucgagacccuaaugcuccuggcacugauugccgugcucaccgggggugugacccuguucuuccugucgggacgggggcucggcaagacuuccaucggucugcugugcgucauggccagcuccguucuccuguggauggcgucuguugagccccacuggauugcggcauccaucaucuuagaguucuuucucauggucuuguugauuccugagccggaccgucaacggacgccgcaagacaaucagcucgccuacguggugauaggguugcuguucaugaucuuaaccgucgccgcgaacgagaugggccugcuggaaacuacgaagaaagaccuagggaucggccacgucgcgguggagaaccaccaccaugcagcuaugcuggacgucgaucugcaccccgccucggccuggacgcucuacgcaguagccaccaccauaauuacaccgaugaugcgccacacgauagagaacaccaccgcuaacauaucccugacagccaucgcuaaucaggcggccauucuaauggggcucgauaaggguuggccgaucuccaagauggacauaggcgugccccuccuugcgcucgguuguuacucccagguuaauccccugacacugacagcggcggugcuaaugcugguggcccacuacgccaucauaggcccugggcugcaggcgaaggcgacccgggaagcgcagaaacguacagcugcuggcaucaugaagaaccccacggucgacgggaucguggccaucgaccucgacccuguaguguacgacgcgaaguucgagaagcaacugggccagauuauguuacucauucugugcacaagccagauccuacucaugcgcaccaccugggcgcugugugaguccaucacguuagcaaccggcccgcucaccacgcugugggaggggucuccggggaaguucuggaacacgaccauagcuguauccauggcaaacaucuuccggggauccuacuuggccggcgcgggucuagccuucuccuugaugaagagucucgggggcgggcgccgggguacaggagcccagggagaaacccucggcgagaaguggaagcgccaacugaaucaacugagcaagucggaguucaauacuuauaagcggucuggcaucauggaagucgaucgcuccgaagcaaaggagggguuaaagcgcggggagaccaccaagcacgcgguuucucgaggcacagcuaagcucaggugguucguggaaaggaaucuggugaagccagaggguaagguaauugaccuggguugcggccgcggaggaugguccuacuacugcgcagggcucaagaaggugaccgaggugaagggcuacaccaaagggggccccggccaugaggaacccaucccgauggccacauacggguggaaccuuguaaagcugcacagcgggaaggacguguucuucaucccgccggagaagugcgacacucuccucugcgacauuggcgaguccagucccaacccgacaaucgaggaaggcagaacccugcgggucuuaaagaugguagagcccugguuacgcgguaaucaguuuugcaucaagauccugaacccuuauaugccuuccguuguggagacacucgagcaaaugcagcggaaacacggaggaaugcugguccgcaacccgcugagucggaacuccacacaugaaauguacugggugagcugugguaccgggaacauagugucagccgucaacaugacgagccgcaugcuccugaaccgcuuuaccauggcgcaccggaagcccaccuaugaacgcgacguggaccugggagccggcacccgccacgucgccgucgaaccugaaguggccaaccucgauaucauaggacagcgcaucgaaaacaucaagcacgaacauaaauccacguggcauuacgacgaggacaaccccuacaagacgugggcuuaccacgguagcuaugaggugaagccguccggcagcgcaucaagcauggucaauggcguggucaagcuacugaccaaaccgugggauguaaucccgauggugacccagauagcuaugacggacaccacuccauucggccagcagcgggucuuuaaggaaaaaguggacacgcgcacgccgaaggccaagcgggggacugcccagaucauggaaguaaccgcgaaauggcuaugggguuucuuaagccgcaacaaaaagcccagaauauguaccagagaggaguuuacucggaagguucgcucaaacgcugccauaggcgcaguauucguugacgagaaccaguggaacagcgccaaggaggcaguugaggaugagcgguuuugggaccugguacaccgcgaacgggagcuccacaagcaggggaagugcgcuacgugcguguauaacaugaugggaaagagagagaagaagcuaggugaguucggaaaggccaaggggucccgcgccaucugguauauguggcucggcgcccgcuuuuuggaguucgaggcgcucggcuuuaugaacgaggaccacugguucagccgcgaaaacucccugucaggcgucgagggcgagggguuacacaagcuaggcuacauccuacgagacauauccaagauccccgguggcaacauguacgccgacgauaccgccggcugggacacccggaucacggaggacgaccuucagaacgaagcccggauaacggacaucauggaaccagagcacgcccugcuggccaagagcauauuuaagcuaaccuaccagaacaagguagugcgcguccagcggccagccaagaaugggaccgugauggacgugaucucccgcagggaccagcgcggcagcggucaggucggcacguacggacugaacaccuucaccaacauggaggcacaauugauccggcagauggaguccgagggaaucuuuagccccuccgaguuggagacccccaaccuggcagagagggugcucgacuggcucgagaaauacggcguugagcggcuaaagcguauggccaucaguggagacgauugcguggugaagccuaucgacgacagguucgcgaccgcuuuaacagcccucaacgauaugggcaaagugcgcaaggacaucccccagugggagcccaguaaggguuggaacgacuggcagcagguccccuuuugcagccaccacuuccaucaacuuaucaugaaggaugguagagagauaguugugccgugccgcaaucaagacgaguugguagggcgggcccgagugucccaaggggccggcuggagccuccgugagacagcgugccuuggcaagagcuacgcccagauguggcaguuaauguauuuccaccgucgggaccuccgacuugccgcgaacgcgaucugcucagccguaccggucgacuggauccccaccagccggacgaccugguccauccaugcucaccaucaauggaugaccaccgaggauauguugucaguguggaaccgcguguggaucgaagagaaccccuggauggaggacaagacacacauauccucauggggcgauguuccguaccucgggaagagggaggaccagugguguggcucgcugaucggccugacggcccgugccacaugggcaacaaauauucagguggcaaucaaccaggugcgccggcucaucgguaacgagaacuaccuagacuacaugaccagcaugaagcgcuucaagaacgaaggagacccggagggggccuuaugguga

SEQ ID NO: 24597 - RNA, 9879 nt, Artificial Sequence
  derived and/or modified CDS sequence (opt11) from DENV-1__EU482531__SS-prME
agcguaaccaugcugcucaugcugaugcccaccgcacuugcauuccaccucaccaccagaggaggggaaccccacaugaucgugaccaaacaagagcggggcaagagccugcuguucaagaccagcgcgggagugaacaugugcacauuaaucgccauggaccugggagagcugugcgaggacaccaugaccuacaagugcccccggauaaccgaggccgaaccagacgacguggacugcugguguaacgccaccgacaccugggugaccuacgggaccugcagucagaccggcgaacaccggcgcgauaagcgcucagucgcccuagcgccccacgugggccuggggcuggagacgcgcaccgagacguggaugaguagcgagggcgccuggaaacagauucaacgggucgagacgugggcccuccgacaccccggguucacgguaaucgcucuguuccuggcccacgccauaggcacuuccaucacccagaaggggaucaucuucauccuccugaugcugguaacgcccucuauggcgaugcggugcgucggcaucggcagccgugacuucguggagggacucagcggcgccaccuggguggacgucgugcuggagcacggguccugugugaccacgauggccaaagacaagccgacgcuggacaucgaacuccugaagaccgaggucaccaaccccgcggugcuacggaaguuguguaucgaggccaagaucagcaacaccacgaccgacucucgcugccccacccagggcgaggccaccuuaauggaggaacaagacgcaaacuucgugugucgccgcacuuucgucgaccggggcugggggaacgguugcgggcuguucggcaagggaagccucaucacgugcgccaaguucaagugcgugacuaaacuggagggcaagaucgugcaguacgagaaccugaaguauuccgucaucgucaccguacacacgggcgaccagcaucagguugggaacgaguccaccgaacacgguaccaccgcuaccaucacgccucaggcccccacuuccgagauccagcucaccgauuacggagcccugacgcuggacuguagccccaggacuggccucgacuucaacgagaugguacugcugaccaugaaggagaaguccuggcucguccacaagcaaugguuccuggacuuaccgcuccccuggaccagcggggccucuaccucccaggagacguggaaucggcaggaccugcugguuaccuucaagaccgcgcacgcgaagaagcaggagguggucgugcucggcagccaggagggugcuaugcacaccgcccugacgggggcgacagagauccagaccagcggaaccacgaccaucuucgcaggccaccuaaagugccgccucaagauggacaagcugacccugaagggcaugagcuauguuaugugcaccgggagcuucaagcucgaaaaggaggucgcggagacgcagcacggcaccguguuaguucagaucaaguacgagggcacagacgccccaugcaaaauccccuucagcacacaggacgagaagggggucauccagaacggucggcugaucacggccaacccgaucgugaccgacaaggagaaacccgucaacauagaggcggagcccccuuucggggagaguuacaucgucaucggcgugggggagaaagcgcuaaaacucagcugguucaagaagggcuccaguaucgguaagauguucgaagcuaccgcccgcggggcccggcgcauggcaauccugggcgauaccgcgugggauuucggguccauuggcggaguguuuaccagcgucggcaagcuggugcaccagaucuucggcaccgcuuacgggguccuguucuccggugucagcuggaccaugaaaauugggaucggggugcuguugaccuggcucgguuugaacagucgcucgacgagccugucgaugaccugcaucgcugucgggcucgucacccuguaccugggugugauggugcaggcugacuccgggugugucaucaacuggaaaggccgggagcucaagugcgggucuggcaucuucgugaccaacgagguucauacguggaccgagcaauauaaguuccaggccgacucgcccaagcgccuguccgcagccauuggcaaggccugggaggaggggguauguggcauccggagugccacccgccuggagaacaucauguggaagcagaucuccaacgaacucaaccacauccugcuagagaacgacaugaaguucaccgugguagucggggacguggugggcauacucgcgcaggggaaaaagaugauccggccgcagccuauggaacauaaguacagcuggaaguccuggggcaaggcgaagaucaucggcgccgacguacaaaacacuacguucaucaucgacgggcccaauaccccggagugucccaacgaccagagagcauggaacaucugggagguggaggacuacggcuucgggaucuucaccaccaacaucuggcugaaacugcgggacagcuacacucaggcgugcgaccaccgccucauguccgcggcaaucaaggacuccaaggccgugcacgccgauauggguuacuggaucgaguccgaaaagaacgagaccuggaaacuggcccgggcgagcuucauugaggucaagaccuguaucuggccgaagucccacaccuuauggucgaacggcguucucgagucggagaugguaauccccaagaucuacgggggcccuaucagccagcacaacuaccgccccggcuacuucacccaaaccgccggcccauggcaucuagggaagcuggagcuggacuucgacuuaugcgaggggaccaccgucgugguggacgagcacugugguaaucgggggccgucccugcgcacgacgaccgucaccggcaaaaucauccacgaguggugcugccggagcugcacgcugccgccccuccgcuucaagggggaggacggcugcugguacgguauggaaauccggcccgugaaggaaaaggaggaaaaccuggugaaguccauggucagcgcaggaagcggcgaaguggacuccuucagccuggggcugcugugcauuuccaucaugaucgaggagguuaugcgcagucguuggucccgcaagaugcucaugaccggcacccuggccgucuuccugcuccugaucaugggacagcugacauggaacgaccucauccggcugugcauaauggucggcgccaacgcgagcgaccgcauggggaugggcacgacuuaccucgcccucauggccaccuucaagaugcgaccgauguucgccguaggguuacuguucaggcgucuuaccucgcgggaggucuugcuguuaacgaucgggcugagccugguggcguccgucgagcuccccaauagccuggaggagcugggcgaugggcuggcgaugggcaucaugauacugaaacugcucaccgacuuccagucccaccaacugugggccacccuccucagccugaccuucaucaaaacgacccucucccuucacuacgccuggaagaccauggccauggugcugagcaucgugucccuguucccgcucugcuuaagcacaacgucucagaagaccacauggcugccgguccugcugggcagccugggguguaagccguuaaccauguuccugaucgcggagaacaagaucuggggcaggaaguccuggccacugaacgaggggaucauggccguggguguggucagcauccuccugagcucucugcucaagaaugacgucccccuugcugggccccugaucgccggcgggaugcuuauugccugcuaugugaucagcggcuccagcgcggaccucucccuggagaaggccgccgaggucagcugggaagaggaggccgagcacuccggcgcgucacacaacauccucguggaggugcaggacgacgggacgaugaagauuaaggaugaggagcgggaugauacccugacaauucuccucaaggcgaccuugcuggccgucuccggcguguacccgcucagcauccccgccacccuguucgucugguacuuuuggcagaagaagaagcagcgguccgggguccuuugggacacgcccucgccgcccgagguggaacgggccgugcuggacgacggcaucuaccgaaucaugcagcggggccuccuggggaggucucagguaggcguagggguuuuucaggagaacgucuuucacacgauguggcacgugacccggggcgccgugcuaauguaccaggggaagcgccuggagcccagcugggcuuccgucaagaaagaccugaucagcuacggugguggguggcgacugcaggguuccuggaacaccggggaggaaguccaggugaucgccgucgaacccggaaagaacccaaagaacgugcagacggcacccgggaccuucaagaccccugagggcgaggugggcgccaucgcccucgacuucaagcccgggaccagcggaucgcccaucgucaaccgcgaggggaagaucgugggcuuguauggcaauggcguagucaccaccagcggcacuuacgugagugcgaucgcccaggccaaggccucccaggaggggccgcugccugagaucgaggaugagguguuucgcaagcgcaacuugaccaucauggaccugcacccaggcagcggaaagacgcggcgauaccugccugcgaucguccgggaggccaucaagcgcaagcuacggacccugauacuggcaccaacccgggugguggcguccgagauggccgaggcguugaagggcaugcccauccgauaucagaccacggcugucaagucugagcauaccgguaaggagaucguggaucugaugugccacgcuaccuucaccaugcgucugcucucccccgugcgcgucccgaacuacaauaugaucaucauggacgaagcccacuucacggaccccagcuccaucgccgcgcggggguauaucagcacccgcgugggcaugggggaagccgccgccaucuucaugacugcuacgccgccgggauccgucgaagcguucccccagagcaacgcagucauccaggacgaggagcgggacauccccgagcguucguggaacagcgguuacgaguggaucacggacuuccccggaaagacagugugguucguccccuccaucaagagugggaaugacaucgccaacugucuccgaaagaacggaaagagggucauccaguugucccggaagaccuucgauaccgaguaccagaaaacgaagaacaacgacugggauuacguggugaccaccgacauuucggagaugggcgcuaacuuccgcgcggaucgggucaucgacccgcgccggugccucaaacccgugauccugaaggacgggcccgagcgaguuauccuggccggccccaugccagugaccguggccuccgccgcccagcggcgcgggaggaucggccgcaaccacaacaaggagggcgaccaguacaucuacaugggacagccccucaacaacgacgaggaucacgcgcacuggacugaggccaagauguuacucgacaacaucaacacucccgaaggcaucauucccgcccucuucgagcccgagagggagaaguccgcagccaucgacggggaguaccgccugcgcggcgaggcccggaagaccuucgucgagcucaugcggcgcggggaccucccaguguggcugaguuacaagguggccagcgagggcuuccaauacuccgaccgacggugguguuucgacggggagcguaacaaccagguccuggaggagaacauggauguggagauuuggaccaaagagggggagcggaaaaagcuccguccccggugguuggaugcccguaccuauagugacccccuggcccuccgcgaguucaaggaguucgccgcgggccgccggagcguguccggggaccugauccucgagaucgggaaacucccgcagcaccuuacccagcgggcccaaaacgcccuggacaaccucgucaugcuccauaacagcgaacagggugggcgggccuaccgccacgcgauggaggagcugccagauaccaucgagacccucaugcuguuagcccucauagccgugcugacgggcggagugacgcuguucuuccucagcggccgggggcugggcaagaccagcaucggccugcuaugcgucauggccuccagcguuuuacuguggauggccuccguggagccccacuggaucgcggccucuaucauccuagaguuuuuccugaugguccuguugaucccugaaccggaccgccagcggacgccccaggacaaccagcuggcguauguggugaucgggcuuuuauuuaugauccugacuguagccgcuaacgagaugggccugcucgagaccaccaagaaggaccuagggaucggccacguagcgguugagaaccaccaccacgccacuauguuggaugucgaccuccaucccgcauccgccuggacccuauacgccguggcgacaaccauaaucaccccaaugaugcggcacacaaucgagaacacgaccgccaacaucagccugaccgccaucgccaaccaagcugcgauauuaauggggcuggacaaaggcuggcccaucuccaagauggacauaggagugccccuucucgcacuggggugcuacagccaggucaaccccuugacucuuacggccgcagucuuaaugcuaguggcccacuacgccaucaucgggccggggcugcaggccaaagccacccgggaggcccagaagcgcaccgcggccggcaucaugaagaaccccaccguagacgggaucguggcuaucgaccuggaccccguggucuacgacgcaaaauucgagaagcaacugggucagauuaugcuccugauucugugcacgucacagauccuacugaugcgcaccaccugggcccugugcgaaagcauuacccucgcgacgggcccccugaccacccugugggaggguaguccgggcaaguucuggaacaccacgaucgccgugagcauggccaacaucuuccggggguccuaccucgccggagccgggcuggcguucagccucaugaagagucucgggggcgggcgccgggggaccggugcucagggcgagacccuuggggagaaguggaagcgccagcugaaccagcuuagcaagagcgaguucaacaucuacaagcgguccgggaucauggaaguggaccgcagcgaggccaaggagggccugaagaggggagagacgacucgccacgccgucucccggggcaccgcuaagcugcgcugguucguagagcggaaccuggugaaacccgaggggaagguaaucgaccucggcugcggccgcgggggcuggagcuacuacugcgcugggcuuaagaaagugacggaagugaagggcuacaccaagggagggccgggccacgaggagcccaucccgauggccacguacggguggaaccuggugaagcuccacuccggcaaagacguguucuucacgccgcccgagaagugcgacacgcugcugugugacaucggggagaguucgcccaacccaaccaucgaggagggcagaacgcucagagugcugaagauggucgagcccuggcuucgggggaaccaguucuguaucaagauccucaaccccuacaugcccagcgugguggagacccuggagcagaugcagcgcaagcacgguggcaugcuugucaggaacccgcucucgcguaacagcacccacgagauguacugggucuccugcgggaccggcaacauagugucugcuguuaauaugaccucuaggaugcuucugaaccgcuucacgauggcccacagaaagccuacuuacgagcgggacguggaccucggggcggguacccgucacguggccguugagcccgagguggccaaccuagacaucaucgggcagcggaucgagaacaucaagcacgagcacaagucuacuuggcacuacgacgaggacaaccccuacaaaacuugggccuaccauggguccuaugaggucaagccgagcggcucagccagcaguauggucaacggggugguuaagcugcucaccaagcccugggacgugauccccauggugacccagaucgcgaugaccgacacuaccccauucggccaacagagggucuucaaggagaagguagacaccaggaccccgaaggccaagcgcgggacggcgcagaucauggaggugaccgcccgguggcuguggggcuuccugucccgcaacaagaaaccccgaaucugcacacgagaggaguuuacgcggaaaguccggagcaacgcugcgaucggcgcuguuuucguggacgagaaccaguggaacuccgccaaagaggcaguggaggacgaaagguucugggacuuggugcagaaagagcgcgagcugcacaagcaggggaaaugcgccacgugcgucuacaacaugaugggaaagcgcgagaagaaacugggggaguucggcaaggcgaaggggagcagggccauaugguacauguggcucggcgcccgguuucuggaguucgaggccuugggcuucaugaacgaggaucauugguucucccgugagaacagccuuuccggggucgagggcgaggggcugcacaaacuggguuacaucuugcgcgacaucagcaagauccccgggggaaacauguacgcggaugacaccgccggcugggacaccaggaucaccgaggaugaccugcagaacgaggccaagaucacggacaucauggagccggagcacgcccuguuggcgaccagcaucuucaaguuaaccuaccagaauaagguggugcgaguccagcguccugccaaaaacggcaccgugauggacgucauuagccgccgggaccagcgcggcuccgggcaggucggcacauacggccuuaauaccuucacuaacauggaggcccaguuaaucaggcagauggagucugaggggaucuuucugcccuccgagcuggagaccccgaaucucgccgagcgcgugcuggacuggcuggagaagcacggcguggagcggcucaagcgcauggccauaagcggggacgacugugugguaaagccgaucgacgacagguucgccacggcccugaccgcccugaacgacaugggcaaggugcgcaaggacauuccccagugggagcccuccaagggguggaaugacuggcagcagguccccuucugcagccaccacuuccaccagcugaucaugaaggacggccgggagaucguagugccgugcaggaaccaggaugaacuugucggccgggcccgcgugagccaaggggccgguuggagccugcgggagaccgccugccucggcaagagcuacgcgcagauguggcaacugauguacuuccaucgccgggaccugcgccucgccgccaacgccaucugcuccgcgguacccgucgauugggucccaaccagcaggacgacgugguccauccacgcccaccaccaguggaugaccaccgaggacauguuaagcguguggaacagggucuggaucgaggaaaaccccuggauggaagacaaaacgcacguguccagcuggggcgacgugccguaccugggcaagcgggaggaccaguggugcgggucccucaucggccuaaccgccagggccaccugggccagcaauauccagguagcuaucaaucaggugcgccggcugaucgggaacgagaacuaccuagacuacaugacauccaugaagagauucaagaacgaaggcgacccagaaggggcccugugguga

SEQ ID NO: 24598 - RNA, 9879 nt, Artificial Sequence
  derived and/or modified CDS sequence (opt11) from DENV-1__EU482532__SS-prME
agcgucaccaugcugcucaugcugaugcccaccgcccuggccuuccaccucaccacccgaggcggcgaaccgcacaugauuguguccaaacaggagcguggcaagucgcuguuguucaagacaagcgcggggguuaacauguguacccugaucgcaauggacuugggcgaguucugcgaggauaccaugaccuacaagugcccccgcaucaccgaggccgagcccgaugacguggacugcuggugcaaugcuaccgauacgugggucaccuaugggacgugcagccagaccggcgaacaccggcgugacaagcgauccguggcccuggcgccccaugugggccugggacuggagacccguaccgagacguggaugagcuccgagggcgccuggaagcagauccagcgggucgagaccugggcccugcgccacccgggguucacgguaaucgcccucuuccuggcccacgccaucgggaccagcaucacccagaaggggaucaucuucauccugcucaugcuggugacccccuccauggccaugagaugcgucggcaucggaagccgcgacuucguggaggggcuguccggcgccacguggguagacguggugcuagagcaugguuccugcgugacaaccauggccaaggauaagcccacccuggacaucgagcuguuaaagacagagguaaccaacccggccgugcuccggaagcugugcaucgaggccaagaucucuaacaccaccaccgacagcagaugcccgacccagggggaggccacccucguggaagaacaggacgccaacuucgugugccggcguaccuucguggacaggggcugggggaacggcugcggucuguucggaaaagggucccugaucacgugcgccaaguucaagugcgugaccaagcucgagggcaagauuguacaguacgagaaccugaaguacucugugaucgugaccguccacacuggcgaccagcaccagguggggaacgaauccacugagcauggcaccaccgcuaccaucacgccacaggcacccagcacggaaauacagcugaccgacuacggggcgcucacucuugacugcuccccccggaccggccucgacuucaaugaaaugguccuccugacgaugaaggagaaguccuggcuggugcacaagcagugguuccucgacuugccgcugccuuggaccagcggggcaucaaccagccaggagacauggaaccggaaggaccuccuggugacguucaagaccgcccacgcgaagaagcaggaggucgugguccugggaucccaagagggugccaugcacaccgcacucacuggggccacggagauccagaccucggguacaacaacaaucuucgccgggcaccugaaguguagacugaagauggacaagcucacccugaagggaaugagcuacgucaugugcaccgggagcuucaagcuggagaaggagguggcggagacacagcacggcaccgugcucguccagaucaaguacgagggcacggacgcuccaugcaagauccccuuuuccacgcaggacgagaagggggugacgcagaacggacgucugaucacagcuaacccgaucgugaccgacaaagaaaaaccggucaacaucgaggccgagccgcccuucggggaaagcuacaucgugaucggcgcgggcgagaaggcccugaagcuguccugguucaaaaaggggagcuccauaggaaagauguucgaggcgaccgcccgaggggcccggcgcauggccauccucggugacaccgcuugggacuucgggagcaucggcggcguguucacguccgucggcaagcuggugcaccaaaucuuuggcacggccuacggugugcuguucucgggcgucuccuggaccaugaagauugggauuggcgugcuccugaccugguuggggcucaacagcagguccacaucgcuguccaugacuugcaucgcgguggggcuggucacccucuaccuuggcgugauggugcaggccgauagcggcugcgucaucaacuggaagggccgggaacugaaguguggaagcggaauuuucgugaccaacgagguucacacguggaccgagcaguacaaguuccaggcggacuccccgaagaggcucucggccgccaucggcaaggcaugggaggagggggucugcggcauacggucaaccacccgucuggagaacaucauguggaagcagaucucgaacgagcuaaaccauauccuccuagagaaugacaugaaguucaccgugguggucggggacguggccggcauacuggcccaggggaagaagaugauccggccccagcccauggaguacaaguacuccuggaagaguuggggcaaggccaagaucauaggggccgacgugcagaacacaaccuucaucaucgacgggcccaacaccccagaaugccccgacgaccagcgcgccuggaauauaugggagguugaggauuacgguuucgggaucuucacgacgaacaucugguuaaagcugcgagacucccacacccagguuugcgaccaccggcugaugagcgcugccaucaaggacuccaaggccguucaugccgacauggguuacuggaucgagagcgagaagaacgaaaccuggaagcucgcgcgggcguccuucaucgaagucaagaccugcaucuggcccaagagccauacguuguggaguaauggcguccuggagagcgagaugaucauacccaaaaucuaugggggcccgaucucucaacacaacuaccguuccggguacuucacacagaccgcggguccauggcaccucgggaagcuggagcuggacuucgacuugugcgaaggcaccacuguaguuguugacgagcacugcggcaaccgggggcccucccugcgcaccaccaccgugacgggcaagaucauccacgaauggugcugccgcagcugcacccugccgccccuccgcuucaagggggaggauggcuguugguaugggauggagauccggccagucaaggagaaggaggagaaccuggucaagagcauggugagcgccggcucgggagagguggacuccuucucguuagggcuccugugcaucuccaucaugaucgaggaggugaugcgaagccgguggucgcgaaagaugcugaugaccgguacucucgccguguuuuuucugcugaucauggggcaacucacguggaacgaucugauccggcugugcaucauggugggcgcaaaugcgucagacagaauggggaugggcacuaccuacuuagcccucauggcuaccuucaagaugcgccccauguucgccgugggcuuacuguuucggaggcugacgucccgugagguucugcuccugaccauugggcuuucacucguagccaguguggagcuaccgaacagccuggaggagcucggcgacggacuggcgaugggcaucaugauccugaaacugcugaccgacuuccagagccaccaacugugggcuacccuccugagccugacguucaucaagaccacuuuuagucuccauuacgccuggaagaccauggccaugguacugagcaucgugagccuguuccccuuaugucuuagcacgaccucccagaagacaaccuggcugcccgugcuccucggcagccuggggugcaagccccucacgauguuccugaucgcggagaauaaaaucuggggccgcaaaagcuggccgcugaacgagggaaucauggccguuggcaucgugaguauccuccugagcucccuucucaagaacgaugugccacuggcggggccccugaucgccggggggaugcucaucgccugcuacgucaucagcggguccucggcggaccugucccuggagaaggccgccgagguaagcugggaggaggaggccgagcauuccggcgccagccacaacauacucguggagguccaggaugacgggaccaugaaaaucaaggacgaggaacgggacgacacccugaccauccugcucaaggcuacccugcuggccgugagcggcguguaucccuuaaguaucccggccacccuguucgugugguacuucuggcagaagaagaagcagcgcuccgggguguuaugggacacccccuccccgcccgagguggaacgggccguccuagaugacggcaucuaccgcaucaugcagcggggucugcuggggcgcucccaggugggcgugggugucuuccaagaaaacguguuccacaccauguggcaugugacccggggcgccguccugauguaccaggggaaacgccucgagccgaguugggcauccgucaagaaggaccugaucagcuacggcggcggguggcggcugcagggcuccuggaauacgggggaggaggugcagguaauugcgguggagcccggcaagaaccccaagaacguacagaccgcccccggcaccuucaagaccucggagggcgagguuggcgccaucgcccuggacuucaagccagggaccaguggcucacccaucgucaauagggaagggaagaucgugggacuguacggcaacggugucgugacuaccucuggcaccuacguguccgcgaucgcccaggccaaggccagccaggaggggccccugcccgaaaucgaggacgagguguuccggaagcgcaauuugacgaucauggaccugcacccgggcagugggaaaacccggcgcuaccugcccgcgaucgugcgggaggccaucaagcgcaaacugcggacccugauacuggccccuacccguguggucgccuccgagauggccgaggcucugaagggaaugccgauccgauaccaaacgaccgcagugaaguccgagcacaccgguaaagagaucguggaccugaugugccacgccaccuucacgaugcggcugcucagccccguccgcgugcccaacuacaacaugaucaucauggacgaagcccacuucaccgaccccuccagcaucgcugcgcggggguauaucuccacccgcgucgguaugggggaggcggccgcuaucuucaugacugccacgccaccuggaagcgucgaggcguucccccaauccaacgccgugauccaggacgaggagcgggacauccccgagcguucguggaacaguggcuacgaauggaucacagauuucccgggcaagaccgugugguucguccccagcauaaaguccggcaacgacaucgccaacugccugcggaaaaacgggaagcgcgugauccagcugagccggaagaccuuugacacggaguaucagaaaaccaagaacaacgacugggacuauguggucaccaccgacaucuccgagaugggcgcuaauuuccgcgccgaccgggugaucgacccccgccggugccuuaagcccguuaucuuaaaggacgggccggaacgcgucauccuggcaggcccaaugcccgugacgguagccagcgccgcccaacggagggggcggauuggccgaaaccauaauaaggaaggagaccaguacaucuauauggggcagccccucaauaacgacgaggaccacgcgcacuggaccgaggccaaaaugcugcuggacaacaucaacacuccggagggcaucauccccgcauuguucgaacccgaacgggagaagucggcugcaaucgacggugaauaccgacugcgcggcgaagcacggaagaccuucguggaguugaugcgccgcggggaccuccccguguggcuguccuacaaggucgcuagcgagggcuuccaguacuccgaucgccgguggugcuucgacggcgaacguaacaaucaggugcuggaggagaacauggacguggaaaucuggacgaaggagggggagcggaagaagcuccgcccgcgguggcuugacgcacgcacuuacuccgauccccuggcccuccgggaguucaaggaguucgccgcggggcgccgguccgucagcggggaccugauccuggagaucggcaagcucccccagcaucugacucagcgggcccagaacgcccuggacaaccuugucaugcugcauaacuccgagcagggcgggcgggcauaccgccacgcgauggaggagcugcccgacaccaucgagacgcucaugcugcuggcccucaucgccgugcugacgggaggggucacccuguucuuccucagcggccgggggcuggggaagaccuccaucggccugcucugcguuauggccagcuccgugcugcuguggauggcaagugucgagccgcacuggaucgcggcauccaucaucuuggaguucuuccucauggugcugcucaucccggagcccgacaggcagcggacgccucaggacaaccagcuggccuacgugguuauuggguuacuguucaugauccugacgguggccgccaacgagaugggccugcucgagaccaccaagaaggaccugggaauaggccauguggcggccgagaaucaccaccacgccgccaugcuggacguugaccuccacccggccagcgccuggacccuguaugccguggcuacgacuauaaucacccccaugaugcgucauaccaucgagaacacgacagccaauaucucccugaccgccaucgcgaaucaggccgccauacucauggggcuugacaagggcuggcccaucagcaagauggacaucggagugccguuacuugcccugggcugcuauucccaggucaauccccugacuuuaacggcggccgugcugauguugguggcccacuacgccaucaucgguccgggacuacaggccaaggcgaccagggaagcacagaagcgcacagcugccggcaucaugaagaaccccaccgucgacgggaucguugccauugaccuggacccgguaguuuacgacgcgaaguucgagaaacagcugggccagaucaugcuccugauccugugcacgagccagaucuugcugaugcgaaccaccugggcccugugcgaguccaucacccuggccacagggccccugaccacccugugggaggggagccccggcaaguucuggaacacuacgaucgcugugagcauggccaauaucuuccggggguccuaccuugcgggcgccggccuggccuuuagccuaaugaaaucccucgggggcgggcgccguggcaccggggcccagggugagaccuuaggcgagaaauggaagcgccagcugaaccagcugagcaaauccgaguucaauaccuacaagcggagugggaucauggagguugaccgcuccgaagcgaaagagggccugaagcgcggggagacgaccaagcacgcggucucgcgcggcaccgccaagcugcggugguucguggagcgcaaccucgugaagcccgaggguaaagucaucgaccugggcugcggacguggcgggugguccuauuacugugccgggcugaagaaggugaccgaggugaagggguacacuaagggcgggccgggccacgaggagcccauucccauggccacguauggauggaaccuggugaagcuccacagcggcaaagacguguucuuuaucccucccgagaagugcgacacccugcugugcgauaucggggagaguagccccaacccaaccaucgaggagggacgcacgcugcggguucugaagaugguugaaccguggcugcgcgggaaccaguucugcaucaagaucuugaacccuuacaugcccuccgugguggagacccuggaacagaugcagcggaagcacggcggcaugcugguccgcaacccccucagccggaauuccacccacgagauguacuggguuagcugugggaccggcaacauuguguccgcggucaacaugaccucgcgcaugcugcugaaucgguucaccauggcccaccguaagcccaccuacgaaagagacguggaccucggggccggcacccgacauguggccgucgagccggaggucgccaaccuggauaucaucgggcagcgcaucgagaauaucaagcacgaacacaaguccaccuggcacuacgacgaggacaaccccuauaagacgugggcuuaccacgggagcuaugaggugaagcccucaggcuccgcaagcuccauggucaacgggguggucaagcugcucaccaagcccugggacgugaucccaauggugacccagaucgcgaugaccgacacgacccccuucgggcagcagcgggucuucaaggagaagguggacacccggacccccaaggccaaacggggcacggcccagaucauggagguuacagcuaaguggcuguggggcuuccugagccgcaacaagaagccccggaucugcacaagagaggaguucacccguaagguccgcuccaacgccgccaucggcgccguguuuguggaugagaaccaguggaauagcgcgaaggaggccgucgaagacgagcgguuuugggaccucgugcaccgcgagcgggagcuccacaagcaaggcaagugcgccacaugcguuuacaacaugaugggcaagcgugagaagaagcugggggaguucggcaaggccaaggggucccgggcaaucugguacauguggcucggcgcgcgcuuccuggaguucgaggcacuggguuucaugaacgaggaccacugguucagccgggaaaacucccucagcggagucgagggcgagggguuacacaagcugggcuauauacuucgcgacauuagcaaaauccccgggggcaacauguacgccgacgacaccgccggcugggacacccggaucaccgaggacgaccuacagaaugaggccaagaucacggauaucauggagccagagcacgcgcuguuagccaaguccaucuucaagcugaccuaccagaacaaggugguacgcguucagcggcccgccaagaacgggaccguuauggacguuaucagucgccgcgaccagcgaggcagcgggcagguaggcaccuacggucucaacacguucaccaacauggaggcccaguugauccgucagauggagucggaggguaucuucagcccguccgagcuggagaccccaaaccuggccggccggguccuagacuggcuugagaaacacggaguggagagguuaaagcggauggcuaucucuggcgacgacugcguaguaaagcccaucgacgaccgcuuugcaaccgcccuuacggccuugaaugauauggggaaggugcggaaagacaucccacagugggagccgucaaagggauggaacgauuggcagcagguccccuucugcucccaccacuuccaccagcugaucaugaaagacggccgggagaucguggugcccugccggaaccaggaugagcucgucgggcgcgccaggguaagccagggugcgggguggucuuuacgggagaccgccugccuaggcaagagcuacgcccagauguggcagcucauguacuuccaccggcgugaucuacggcuagccgcgaacgccaucugcuccgcgguucccgucgacugggucccgaccagccgcacaacuugguccauccacgcccaccaccaauggaugaccaccgaagacaugcucaguguguggaaccggguuuggaucgaagagaaccccuggauggaggacaagacccacaucuccagcuggggugacguacccuaccuggggaagcgcgaagaucagugguguggcagccugaucggacuaacggcccgggcgaccugggcaacuaacauccagguggccaucaaccagguccgaagacugaucggaaacgagaacuaccuggacuacaugaccagcaugaagcgguuuaagaacgaguccgacccagagggggcccucugguaa

SEQ ID NO: 24599 - RNA, 9879 nt, Artificial Sequence
  derived and/or modified CDS sequence (opt11) from DENV-1__EU482533__SS-prME
agcgugaccaugcuguuaaugcugaugccuaccgcccuggccuuucaucuuacgacacggggcggagagccccacaugaucgugagcaagcaggagcgggggaagagccugcuguucaagaccagcgccggggugaauauguguacccucaucgccauggaccuaggcgaauucugcgaggacacuaugaccuacaagugcccucgcauaacggaagccgaacccgacgacguggacugcuggugcaacgccacggauacuugggucaccuacgggaccugcagccagacaggcgagcaccggcgggacaagcgauccguugcgcuggcgccccacgucggccuagggcuggagacgcgcaccgagaccuggaugagcucugaaggggccuggaagcagauccaacggguggagaccugggcccugcgccaccccggguuuacggugaucgcccuguuccucgcgcacgcaauuggcaccagcauaacccagaaggggaucaucuucauccugcucaugcuggugacuccauccauggccaugcguugcgucggcaucggcagccgcgacuuuguagagggguuguccggcgccaccuggguggaugucgugcucgagcacgggucgugcgugaccaccauggccaaggacaagccuacucuggacaucgagcuacucaagacggaggucaccaaccccgcgguccugcggaagcuaugcaucgaggccaagaucagcaacacuaccacggacagccgcugcccuacccagggcgaggcgaccuuaguggaggaacaggacgccaacuucgucugccggcgcaccuucgucgaccggggcugggguaacgggugcggucuguucggcaaggggucccugaucacgugcgcaaaguucaaaugcgugaccaagcucgagggcaagaccguccaguaugagaaucugaaguacagcgugaucgugaccguccacacgggagaccagcaccagguggggaacgaguccaccgagcacggcaccacagcgaccaucacgccucaggccccgagcaccgagauccagcucaccgacuacggggcccucacccuggacugcagcccccggacgggccuugacuuuaacgagaugguccuccugacuaugaaggagaaaaguuggcuggugcacaagcagugguuccucgaccuaccgcugcccuggaccagcggggcauccacgagccaggagacguggaaccggaaggaccuccuggugaccuucaagaccgcccacgcgaagaagcaggaggucaucgugcugggcucucaggagggcgccaugcacaccgcccucacgggggccaccgagauccagaccagcgggaccacgaccaucuucgccgggcaccugaagugccgccucaagauggacaagcucacccugaagggcauguccuacguaaugugcaccggcagcuucaagcuggagaaggaggucgcggagacgcagcacggcaccgugcucgugcagaucaaguacgagggcaccgacgcccccugcaagauucccuucuccacccaggacgagaagggugucacgcagaacggccggcugaucacugccaacccgauugugaccgacaaagaaaagccagugaacauagaggcagagccucccuucggggagagcuacauugucauaggcgcgggugagaaggcccugaaacuguccugguucaagaaggggagcaguaucggcaagauguucgaggccaccgcccgcggggcccgacgcauggcgauacucggcgacacggccugggacuuugggagcaucggcggcguguucacauccguugggaagcugguccaccagaucuucggcaccgccuauggggugcuauucagcggcguguccuggaccaugaagaucgggaucggcguccuccugaccuggcuuggccucaacagcagguccacgagccugucuaugaccugcauagcuguggggcuggugacacucuaccugggcguaauggugcaggccgacagcggauguguuaucaacuggaagggcagagagcuaaagugcgggagcggcauauucgucacgaaugaggugcacaccuggaccgagcaguacaaguuccaggcagacuccccgaaacgccucucagccgccaucgguaaggccugggaggagggggugugcggcauucgguccgcaacccgcuuggagaauauuauguggaagcaaaucuccaacgagcucaaccacauccuccuggagaacgauaugaaguucaccgucguggugggggacguugcgggcauccuggcgcaggggaagaagaugauccguccccagcccauggaguacaaguacuccuggaaguccuggggcaaagccaagaucaucggcgcugacgugcagaacgcgacguucauuaucgacgggcccaauaccccggagugcccggaugaccagagggccuggaacauuugggagguggaggauuacggcuucgggaucuucaccacgaacaucuggcuuaagcugcgggacuccuacacgcaagucugcgaccaccgcuuaaugagcgcagcgaucaaggacuccaaagccgugcacgcggacauggguuacuggaucgagagcgaaaagaacgaaacguggaaacuggcccgggccuccuuuaucgaggugaaaaccugcaucuggcccaagagccacacccugugguccaauggcguccuggagagcgagaugaucauccccaagaucuacgggggcccgauaucccagcacaacuaccgccccggguacuucacccagaccgccggccccuggcaccucgggaagcuggaacuggacuucgaucuuugcgagggcaccaccguggugguggacgagcacugcggcaaccgggggccgagccugcgcacgacaacagugaccggcaagauaauccaugaauggugcugccgguccugcacgcugccgccccuucgcuucaagggggaggacggcugcugguacgggauggagauacggcccgugaaggagaaggaagaaaaccuggucaagagcauggugagcgccggauccggcgagguggacagcuucucccuugggcucuuaugcaucagcaucaugaucgaggaggucaugcguucccgguggagccgcaagaugcugaugaccggcacucucgcgguguucuucuuacugaucaugggccagcucaccuggaacgaccugauccgacugugcaucauggugggcgccaaugccucagaccgcauggggauggguacaaccuaccuggcccugauggcaaccuucaagaugaggccgauguucgcagucggccucuuauucaggcgacugaccagccgggaggugcugcuccugacgaucgggcucucccucguggccagcgucgagcugccuaauucccuugaggagcuuggcgaugggcuugccauggggaucaugauccugaaguuguugaccgauuuccaaucccaccagcugugggccacccuccugucccugaccuuuaucaagacaaccuucagccuccacuacgcguggaagaccauggccaugguccuguccaucguaagccuguucccccugugucuguccaccacgagccagaagaccaccuggcugcccgugcuucugggcucccuggggugcaagccguuaaccauguuccugaucgccgagaauaagaucuggggccgcaagaguuggccccugaacgaggggaucauggccgugggcauagucagcauacuccuguccucgcugcucaagaaugacgucccccuagccgggccccuaaucgcgggcggaaugcucaucgcuuguuacgugaucuccgggagcuccgccgaccuuagccucgagaaggccgccgaggucuccugggaggaggaggcggagcacagcggcgccucccacaacauucucguggaggugcaggacgacgggacgaugaagaucaaggaugaagagcgggacgacaccuuaaccauccugcucaaggcuacccugcuggccgucagcggaguguacccgcucagcaucccggcuaccuuauucgugugguacuucuggcagaaaaagaagcagcgcagcggcguccuuugggacacgcccucuccgcccgaggucgagcgggcggugcucgacgacggcaucuaucguaucaugcagcggggccugcugggccgcagccagguuggugugggggucuuccaggagaauguauuccacaccauguggcacgugacccggggcgccguacugauguaccaggggaagcgccuagagcccagcugggcaucagucaagaaggaccugaucuccuacggcggcggguggcggcugcaaggcagcuggaacaccggggaggagguccaggugaucgccguggagcccggcaagaaccccaagaacguacagacggcacccgggacguucaagaccuccgagggcgaagugggcgcgaucgcccucgacuucaagcccgggaccagcgggucacccaucgucaaccgcgaggggaagauaguuggccuguacggcaacggggugguuacgacguccggaaccuacgugagcgccaucgcccaggcgaaggccucccaggaggggccccugccggagaucgaggacgagguuuuccguaagcgcaaccucaccaucauggaccugcaccccggcagcgggaagacgcggcgcuaccugccugccaucguccgggaggcuaucaagcgcaaacuccggacccugauccuggccccgacccgcgugguggcguccgagauggccgaggccuugaagggcaugcccauccgcuaccagaccacggccgugaagagcgagcacaccggcaaggagaucguggaccugaugugccacgcuaccuucaccaugcggcuccucucccccgugcgaguccccaauuacaacaugaucaucauggacgaggcucacuuuacagacccgagcuccaucgccgcccggggcuacaucagcacccgcgucggcaugggggaggccgccgcgaucuucaugaccgccacgccgcccggcuccguggaggccuucccccagagcaacgccgucauccaggacgaggagcgggacaucccggaacgcuccuggaacagcggguaugaauggaucacggacuuucccggcaagaccgugugguucgugcccuccaucaagagcggcaacgacaucgcaaacugccugcggaagaacgggaagcgcgucauccaguugucccggaagaccuucgauaccgaguaccagaaaacgaagaacaacgacugggacuacguggugacaacagacaucagcgagaugggggcuaacuuccgcgccgaccgggucaucgauccccgccggugcuuaaaaccggugauccugaaggacggacccgagagggugauccuggccggccccaugcccgucaccguagccuccgcggcccagcgacgcggccggaucggccgcaaccacaacaaggagggcgaccaguacaucuacauggggcagccgcucaacaacgacgaggaccacgcccacuggacggaggccaagaugcuguuagacaacaucaacacccccgagggcaucauccccgcgcucuuugagcccgagcgggagaaguccgcggccaucgacggggaguaccgccugcgcggcgaggcccggaagaccuucgucgaacugaugcgccgcggagaccucccgguguggcugagcuacaagguggccuccgaggguuuccaguacagcgaccgccgguggugcuucgacggugagcgcaacaaccagguccuggaggagaacauggauguagagaucuggacgaaggagggggagcggaagaaacuccgcccgcgguggcucgacgccagaacguacuccgaucccuuggcauuacgggaguucaaggaguucgccgccggccgcaggagcguauccggcgaccugauccuggagaucggcaagcucccccagcaucuuacccagcgcgcccagaacgcgcuggacaaccucgucaugcugcacaauagcgaacagggcggccgggccuaccgccacgccauggaagagcugccggauaccaucgaaaccuuaaugcugcuggcccucaucgccguacucacgggcggggugacucucuuuuuuuuaucaggccgaggacuuggcaagaccagcaucggucugcucugcgucauggcguccucagugcugcuguggauggccuccguggagccccacuggaucgccgccuccaucauccucgaguucuuccugaugguccugcugaucccggagcccgacagacagcggaccccgcaggacaaccagcuggccuacguggugaucggucuccucuuuaugauccugaccguggcggccaaugagaugggccugcucgagacgacuaagaaggaccuggggaucggccacguggccguggagaaccaccaccacgcggccaugcuggacgucgaccuccaccccgcguccgccuggacgcuguaugccguagccaccacuaucaucacacccaugaugcgccacaccaucgagaacacgacggccaacaucagucucacggcgaucgccaaucaggccgccaucuuaauggggcuggacaagggcuggccgaucuccaagauggauaucggcgugccccugcucgcgcuggggugcuacagccaggucaacccguugacccucaccgcggcagugcugaugcugguggcccacuacgccaucauuggucccgggcuccaggcgaaagccacgcgggaagcccagaagcgcacggccgccggcaucaugaagaacccgacggucgaugggaucguggcgauagaucuggaccccguugucuacgacgccaaguucgagaagcagcugggccagaucaugcuccugauccucugcacaucgcagauccuccugaugcgcacgaccugggcccugugcgaaagcauaacccucgccaccggcccccugacgacccugugggaggggucccccggcaaguuuuggaacaccaccaucgccgugagcauggcaaacaucuuccggggaagcuaccucgccggcgccgggcuggccuucucccugaugaagucccucgggggcgggcgccggggcacgggggcgcagggcgagacccugggcgagaaguggaagcgccaguuaaaccagcucuccaagagcgaguucaacaccuacaagcgauccgggauuauggagguggaccgcagcgaggcaaaggagggccugaagcgcggggagaccacgaagcacgccgucucccgcggcaccgccaagcuucggugguucguggagcgcaacuuggugaagccggagggcaagguaaucgaccuaggcugcggccgcgguggguggucguacuacugcgccgggcuaaagaaggugacagaggugaagggauacacuaaaggcgggcccggccacgaggagcccauccccauggcgacguacggguggaaccuggucaaacuccacuccggcaaggacguauucuucauccccccggagaagugcgacacgcugcugugcgauaucggggagagcucccccaaccccaccauagaggaggggcgcacccuccgggugcugaagauggucgagccauggcugagggggaaccaguucugcaucaagauccucaacccguacaugcccagcgugguggaaacuuuggagcagaugcagcggaagcacggcggcauguuaguccgcaacccccucuccagaaacagcacccaugagauguacuggguuuccugcgggaccgggaacauugucucggccgucaacaugaccucucgcaugcugcugaaccgcuucaccauggcccaccgaaagcccacauaugaacgcgacguggaccucggggccggaacgcggcacguugccgucgagcccgaggucgcgaaccuggacaucaucggccaacgcaucgagaacauuaagcacgaacacaagaguacguggcacuacgacgaggacaaccccuacaagaccugggcguaccacggguccuacgagguaaagccuagcggcagcgccuccagcauggucaacgguguggucaagcugcucacgaagccgugggacguuaucccaauggugacacagaucgccaugaccgacaccacgcccuucggccagcagcgggucuucaaggagaagguggacacucgcacacccaaggccaagcgggggaccgcgcagaucauggaggugacggcuaaguggcuauggggguuucugucccgcaacaagaagccgcggauuugcacucgcgaggaguucacccggaagguccgcagcaacgccgccaucggcgcgguguucguagacgagaaccaguggaacagugccaaggaggcagucgaggacgagcgguuuugggaccucgugcaccgcgagcgggagcugcacaagcagggaaagugcgcgaccugcguguacaacaugaugggcaagcgcgagaagaagcugggggaguucggcaaggccaaaggaucgcgggcgaucugguacauguggcucggcgcccgcuuucucgaguuugaagcacugggcuucaugaacgaggaccacugguucagccgggagaacagccucuccggggucgagggcgaggggcugcauaagcucggcuacauccugcgcgauaucagcaaaauccccgggggcaacauguacgccgaugacacggccggcugggacacccggaucaccgaggaugacuuacagaacgaggcgaagaucacggacaucauggagcccgagcacgcccugcuggccaaguccaucuucaagcugacguaccagaacaagguggugcgaguccagcggccagccaagaacgggaccgugauggacgugaucagccgccgcgaccagcguggcuccggccaggucggcacguacggccugaacaccuucacgaacauggaggcccagcucauccgccaaauggagagugaagggaucuucucccccagcgagcuggaaacccccaaccuggcgggccgugugcucgacuggcuagagaagcacgggguggagcgccuuaagcggauggccauuuccggcgacgacugcgucgugaagcccaucgacgaccgcuucgccaccgcccucaccgcccuaaacgacauggggaaggugcggaaggauaucccgcaaugggagcccagcaagggcuggaacgacuggcagcagguccccuucugcagccaccacuuccaccagcugaucaugaaggacggccgcgagaucgugguucccugcagaaaccaggaugagcuugucggccgcgcgcgggugucccagggggccggguggagccuccgggagacggccugccuggguaaguccuacgcccagauguggcagcucauguacuuucaccggcgcgaccugcggcuggcggccaacgccaucugcagcgccgugccggucgacugggugcccaccucccgcaccaccuggagcauccacgcccaccaccaguggaugacaacugaggacaugcuauccguguggaaccgggucuggauugaggagaacccuuggauggaggacaaaacccacaucagcuccuggggcgacgugcccuaccugggcaagagagaggaucaguggugcggcagccucaucgggcucaccgcgcgggccacgugggcgacuaacauccagguggccaucaaccagguacgccgccucaucgggaacgagaacuaucuagacuacaugacauccaugaagcgguucaagaacgagagcgacccggagggggcccucugguga

SEQ ID NO: 24600 - RNA, 9879 nt, Artificial Sequence
  derived and/or modified CDS sequence (opt11) from DENV-1__EU482534__SS-prME
agugucacgaugcuacugaugcugaugcccacggcgcucgcauuccaccugacaacccgaggaggagaaccgcauaugaucguguccaagcaagaaagagggaaaagccuauuauucaaaacaagugccggugugaacaugugcacccucaucgccauggaccucggagaguucugcgaagauacuaugacuuacaagugcccccgaaucacagaagcggaaccugacgauguggauuguuggugcaacgcgaccgacaccuggguaaccuacgguaccuguucacaaacuggagagcaucgccgcgacaagagauccguggcccuggcuccccacguuggacugggccuggagacucggacggaaacauggaugaguuccgaaggggcauggaaacaaauucaacgcguagaaacgugggcgcucaggcaccccggcuucacggucaucgcacuuuuccucgcccacgcgauagggaccucgauaacgcaaaaaggaaucaucuuuauucuauugaugcuuguuacuccaaguauggccaugcgcugugucgggauagggucaagggauuuuguggaaggauugagcggugccacguggguggacguggugcuagagcacgguuccugugugaccacuauggccaaggacaaaccaacacuagacauugaacuccuaaaaacggaggucacuaacccggccguacuaaggaaacugugcaucgaagcaaaaaucuccaauaccacaacagauagcagauguccgacccaaggcgaggcaacacugguugaagaacaagacgcaaacuuuguguguagacggaccuuugucgaccgcggcuggggcaacggaugugggcuauucggcaaaggaagccuaaucacaugugccaaguucaagugcguaacgaaacuagaagguaaaauugugcaauaugaaaauuugaaguacagcguaaucguuacugugcauaccggcgaccaacaucaaguggggaacgaaagcacagaacauggcaccacggcgacaauaacaccacaggccccgaguacagagauacaacuaaccgacuauggcgcucuaacgcuagacugcaguccgcgcacgggccucgacuuuaacgaaaugguacuacuaacuaugaaagagaaaucguggcugguacacaaacaaugguucuuagaucucccccugccauggaccucgggggcuagcaccucgcaagaaaccuggaaccgccaagaccuccugguaacauuuaaaacagcgcacgccaagaaacaagagguaguaguacugggaagccaagaaggagcgaugcacacagcccugaccggcgcgacggaaauucaaacuucaggcacaaccacuaucuucgcgggacaccugaaaugccgcuuaaaaauggacaaacuuacacuaaaaggcaugagcuauguaauguguacgggcucguuuaaacuugaaaaagagguagcggaaacacaacaugguacaguccugguucagaucaaguacgagggcacggaugcgccgugcaagaucccguucucgacccaagacgaaaaaggcgucacgcaaaacgggcgcuugaucacagcaaaccccauugucacugacaaggagaagccaguaaauaucgaagcggaacccccguucggcgagucguacauugugauuggagcaggcgaaaaggcucuaaaacuaucaugguucaagaaagggagcagcauagguaagauguucgaggcgacagcgcgaggcgcgagacgaauggcaauacucggugacacggcgugggacuucggaucgaucgggggcguauucaccucggugggaaaacucguccaucaaauauucgggacagcauacgggguacucuucagcggagucuccuggaccaugaaaauaggcauagguguacuccuaacuuggcugggacugaacucccgaaguacaucccucuccaugacaugcauugcagugggacuuguaacguuguaucuaggagucaugguccaggcagacucaggaugcgucaucaauuggaaaggccgagaacuaaaaugcgggucagggaucuucgucacgaaugagguccacacauggacagaacaauacaaguuccaagcagacucccccaaacggcuuucggcagcaaucgguaaagccugggaggaaggcguaugcgggauucgauccgccacgcgccuagagaacauaauguggaaacaaaucagcaacgaacucaaccauauccuccuggaaaacgacaugaaguugaccguggucgugggcgacgucgcuggaauccuugcccaagguaagaaaaugaucaggccgcaaccaauggaauacaaauacucuuggaaauccuggggaaaagcaaagauaauaggcgccgauguacagaacaccacguucaucauagacggucccaacacuccagagugcccugacgaccaaagagcauggaacauuugggagguggaagacuauggcuuugggaucuucacaacaaacaucugguugaaguuacgcgacucauacacccaggugugugaucaccgucugaugucagcagcaaucaaggacagcaaagccguacacgcagacaugggguacuggaucgaaagcgagaaaaaugaaaccuggaaacucgcaagggccucauuuauagaagugaaaaccugcauauggccaaagucucauacccuaugguccaacggaguccucgaaagcgaaaugauaaucccgaagauauacgggggaccaauaucccaacacaacuaccgccccggguacuucacacagacugcaggacccuggcaccucggaaaacucgaauuagacuuugaucuaugugaaggcacuacuguaguagucgacgaacacugcgggaacaggggccccagccuccgcaccaccaccgucaccgggaagauaauccacgaauggugcugccgcagcugcacacuaccuccccuccgauucaagggcgaggaugggugcugguacggaauggaaauaagaccggucaaagaaaaagaagagaaucuaguuaagagcaugguaucggcggggaguggugagguugauuccuucucccucggacuauuaugcauuagcaucaugauagaagaagugaugcgcucaagauggucgaggaaaaugcucaugacagguacauuggcuguauucuuucuacugauaaugggccaguugacguggaacgaccuaauccgucuaugcaucauggucggggccaaugcaagugaucgcaugggaauggguacuacguaucuggccuugauggccacauucaagaugcggccaauguuugcaguaggguuacuauuccgccgauuaacuagcagagaaguccuuuuacuaacaaucggcuuaaguuugguagcuagcgucgaacuaccgaacagccucgaggaacucggcgacgggcuugcaauggggaucaugauacuuaaacuauugacagacuuccaaagccaccagcuaugggcuacacugcuaagccuuacauucguucgaaccaccuucagccuucacuacgcauggaaaaccauggcuauggucuuaagcaucguuucauuauuucccuugugccuaagcacaacaucgcaaaagacaaccugguuaccagucuuacucggcagccuugggugcaagccacuuacaauguuccugaucgcagagaauaagauauggggccgaaaauccuggccccucaaugaggguauaauggcagucgguauaguaucgauccuacugagcaguuugcucaagaacgauguaccucuagcggguccacucauagccgguggcauguuaauugcguguuacguaaucagcggcucaucggccgacuuaucucuagaaaaggccgccgucgugucuugggaagaagaagcagaacacucaggagcgagccacaacauccugguggagguccaggaugaugggaccaugaagaucaaagacgaggaaagagacgauacucuaaccauccuccucaaggccacgcuccuagcgguaucggguguguacccauuaagcauuccugccacucucuucguaugguacuucuggcagaaaaagaaacagcgaagcggcgugcucugggacaccccuagcccaccagaaguagagagggcagugcuagacgacgguauuuaucggaucaugcaacggggccuauuggggcgaagucaagucggcgugggagucuuucaagagaacguauuccacacaauguggcacgucacgcggggcgcggucuugauguaccaggguaagcgccucgaacccucaugggcgagugucaagaaagaccucaucucguaugguggaggauggagacuccaagguucguggaauacaggcgaagagguucaggucauagccguugaaccaggcaaaaauccaaagaacguccaaacagcgccggggacguuuaaaacaagcgaaggcgaagucggagccauagcucuugacuucaaaccaggcaccucaggaagccccauaguaaaccgcgagggaaagaucguagggcucuacggcaauggagucguaacgaccagcggcacauauguaagugccaucgcgcaagcuaaagcaagccaagaaggcccgcuacccgaaauagaagaugaaguauuuagaaagcgaaaucugacaaucauggaccuacacccagggucggguaaaacacgacgguaccucccggcaaucguaagagaagcuaucaaacgcaaguuaaggacucuaauacucgcuccaaccagggugguggccuccgagauggccgaagcccugaaagguaugccgauaagauaccaaaccaccgccguuaaaagcgagcacaccggaaaagagauagucgacuuaaugugccacgcaacuuuuacaaugcgacuacucaguccagucaggguccccaacuauaacaugaucauaauggacgaagcccacuucacagaccccagcagcauagccgcucggggauacaucucgacacgcgucggcaugggagaggccgcagcgauauuuaugacagccaccccgcccggaucgguagaggcuuucccacaauccaacgcagucauacaggaugaagaaagggacaucccggagcggucauggaacucagguuacgaauggauuacugauuuuccuggcaagaccgucugguucgucccuuccauaaaaucaggaaaugacauagccaacugccugcgcaagaacgggaagagagugauccaauugucgcgcaagacauucgacacagaauaucagaaaacuaagaauaaugacugggacuacgucgugacaacagauaucuccgagaugggggcuaacuuuagggccgaccgcguaauugacccaaggagaugccuaaaaccaguaauacuaaaagacggaccggaaaggguaauacuggcagggccaaugcccgucacgguagccuccgccgcgcaaaggcgcggaagaaucggccgcaaccacaacaaagagggugaccaauacauauauaugggccagccacucaacaacgaugaagaccacgcccacuggaccgaggccaaaaugcuucuagacaacauaaauacgccagaagggaucauacccgcacucuuugaaccagaacgagagaagucugcagcgauagacggggaguaccgauuacggggagaggcacggaaaacauucguagaacuaaugcgacgcggcgaccuacccgucuggcuauccuacaagguagccagcgagggauuccaguacucggaccgccgcugguguuuugacggugagcgcaacaaccaggugcucgaggaaaauauggacgucgaaaucuggaccaaagagggagaaaggaagaaacuccguccgcgauggcucgaugcucggacauacagcgacccauuggcgcuuagagaguucaaagaguucgcagccggaaggagaucagucucgggcgaucucauacucgaaaucgggaaacuuccgcagcaccuaacccaaagagcccaaaaugcacucgauaacuuagugaugcugcacaacucagagcagggcgggcgagcauaucgccacgcaauggaagaacuacccgacaccauagaaacacuuaugcuacuugccuuaaucgccguccugacaggcggagugacguuauucuuucugagugggcgggggcuggggaaaacauccaucggcuuacuaugcguuauggcuucgaguguccugcuguggauggccucggucgaaccgcauuggauugcggcaucaaucaucuuagaguucuuccuaaugguccuccucauucccgagcccgaccgccaacggacaccgcaagauaaccagcucgcauacguuguaaucggucuacuauucaugaucuuaacaguagcugccaacgaaaugggccugcuagaaaccacuaaaaaggacuuaggcaucggccacgucgcgguagaaaaucaucaccacgccgcgaugcuggacgucgacuugcaccccgccucagcuuggacccuguacgcgguugccaccacaauaauaacaccgaugaugcggcauacuauagaaaacaccacagcgaauauaucucucacggcgauagcaaaccaagcugcaauccuaaugggccuagacaagggguggcccaucucgaaaauggacauaggcguaccgcugcuggcacuaggaugcuauucccaagugaauccucugacccuaaccgccgccguccucaugcuggucgcucacuacgcaauuauagggccaggccuacaagcaaaagcaacccgagaggcccagaagagaacagccgccgggaucaugaaaaacccaaccgucgauggaauagucgccauagaucucgacccuguuguuuacgacgccaaguuugagaaacaacuaggacaaaucaugcugcuaauacuguguaccucgcaaauacugcucaugagaaccaccugggcccugugcgaauccauaacauuagccacaggcccucugaccacacucugggagggaagucccggaaaguuuuggaacacgaccaucgccgucucuauggccaacauauuccgaggaagcuaccuggcuggcgcgggccuggcuuuuagcuuaaugaaaagccuuggaggagggagacgagggacaggagcccaaggagaaacccuaggggagaaguggaagcggcaacugaaccaauuaagcaaaagcgaauuuaacaccuacaaaagauccggcaucauggagguagauaggucagaagccaaagaggggcugaagagaggcgaaacaacaaaacaugcgguaucgcguggaaccgcgaaacugagaugguucguggaacgcaaucuggucaaacccgaagguaaagucauugaucuaggcugcggacgaggcggcuggagcuacuacugcgcuggacuuaagaaggugacggagguuaagggcuauacaaagggagggcccggacacgaagaaccgauaccgauggccacguacggguggaaccuuguaaagcuacacuccggaaaagaugucuucuucauaccacccgaaaagugcgauacacuccuuugugauauaggagagucauccccuaacccaaccauagaggaggggcgcacacucagaguccucaagauggucgaaccauggcuccgaggaaaccaauuuugcauaaagauacugaauccguauaugccgucaguaguagaaacgcuagagcagaugcaacgaaaacacggaggcaugcuaguccgaaacccucucagcagaaacagcacccaugagauguacugggucuccugcgguaccggaaacauaguaagcgcggugaacaugacgaguaggaugcuccuuaaccgguuuacaauggcacacaggaagccaacauacgaacgcgacguugaccucggugcgggaacgaggcacgucgccguggagccggaggucgcuaacuuggauaucauuggacaacguauagagaauauaaaacacgaacacaagagcacauggcauuacgacgaagauaaccccuacaagacaugggcauaucacggcaguuacgagguaaaacccuccgguuccgccucaaguaugguaaaugggguaguuaagcugcucaccaaaccgugggacgucauacccauggugacgcaaauagccaugacggauaccacgccauucggacaacagcgcgucuucaaggagaagguagacacucguaccccaaaagcaaaaaggggcaccgcacaaauaauggaagucaccgcgaagugguuguggggguuccucagucgaaacaaaaagccgcguauaugcacgcgagaagaguucacgaggaaggugcgaucgaaugcagcgauaggagcagucuuuguagacgaaaaucaauggaacuccgcgaaggaagcgguggaagacgaacgcuuuugggauuuaguccauagggaaagagagcuucacaaacaagggaagugcgcaacaugcguuuauaacaugauggggaagagagagaagaaacucggcgaguucggcaaagcgaaaggaagccgugcgauuugguacauguggcuuggagcgcguuuucucgaguucgaagcccucggguucaugaacgaagaccacugguucucgcgugagaacagcuuaucaggcguagagggcgagggacuucacaagcucggguacauucuacgcgacaucagcaaaauccccggcggaaacauguacgccgacgacacagcggggugggacacuaggauaacggaagacgaccuccagaacgaggccaagauaacagacaucauggaacccgaacacgcccugcuggcaaaaucgaucuucaagcuaaccuaccaaaacaaagucguccgagugcagcgacccgcuaagaauggaacgguaauggaugugaucagccgacgcgaccaaaggggcucggggcaaguaggaacauacggcuuaaacacguucacaaacauggaggcgcagcucauacgacaaauggaaagcgagggcauauucagcccuagcgaauuagaaacgccaaaucuugcaggccgugugcucgacuggcuggagaaacacggaguugagagacucaaacgaauggcaaucagcggggacgacuguguuguaaagccaauagacgauagguucgcaaccgcccuaacagcacuuaacgauauggggaaaguacggaaagacauaccgcagugggaacccuccaaaggguggaacgacuggcaacaggugcccuucuguagccaucacuuucaccaacuaaucaugaaagacgggcgcgaaauagucgugcccugccgaaaccaggacgaacucgucggacgagcacgcgugagucaaggagcaggauggagcuuaagagagacugccugucucgggaaaagcuacgcgcagauguggcaacuaauguacuuccaccgacgcgaccugagacucgcagcgaacgccauauguagcgcgguccccguugacugggucccuaccagccgaaccaccuggagcauccacgcccaccaucaguggaugacuacagaagacauguuaagcguguggaaccgugucuggauugaggaaaacccauggauggaagauaagacacacauuucaagcuggggcgaugugccauaccuaggaaagcgcgaagaccaauggugcggaucucuuaucggacugaccgcccgggccacgugggcuacgaacauacaagucgccaucaaucagguaagaaggcugcucgggaaugaaaacuaccucgauuacaugacgucgaugaagagauucaagaacgagucggacccagaaggggcucugugguag

SEQ ID NO: 24601 - RNA, 9879 nt, Artificial Sequence
  derived and/or modified CDS sequence (opt11) from DENV-1__EU482535__SS-prME
agcguaaccaugcuguugaugcugaugccuacggcucuggccuuccaccucaccaccaggggcggggaaccccacaugaucgugaccaagcaggagcgcggcaagagccugcuguucaagaccagcgcgggugugaacaugugcacccucauagcgauggaccugggcgaacugugcgaggacaccaugaccuacaagugcccccgcaucaccgaggcugagcccgacgacgucgauuguuggugcaacgccacggacaccugggugaccuacgggaccugcucucagacgggcgagcaccgccgcgauaagcgguccguggcccucgcgccccacgugggccuggggcuggagaccaggaccgagacguggaugaguucagagggcgccuggaagcagauacaacgggucgagacgugggcccuccgccaccccgguuucaccgugaucgcccuguuccuggcgcacgccaucggcacuuccauaacccagaaggggaucaucuuuauccuccugaugcuggugacgcccagcauggccaugcggugcgucggcaucggcucgcgcgacuucguggagggacuuaguggcgccaccuggguggacguugugcuggagcacgggagcugugucaccaccauggcaaaggacaagcccacgcuggacaucgagcucuugaagaccgaggucaccaacccagccgugcugcggaagcucuguaucgaggccaagaucucgaacacgacgacagacucgcgcugcccgacccagggggaggcuacccugauggaagaacaggaugccaacuuuguuugccggcgcacguucgucgaccggggcugggggaacgggugcggguuguucggcaaggggagcuuaaucacgugcgcuaaguucaagugcgugaccaaauuggagggcaagaucgugcaguacgagaaccugaaguacucugucaucgugacaguacacacuggcgaccagcaucagguagggaacgaguccaccgagcacggcaccaccgccacaaucacaccccaggcccccaccuccgagauccagcucaccgacuacggcgcgcugacccuggauuguagcccccgcacgggccucgauuucaacgagauggugcugcugaccaugaaggagaaguccuggcucguccauaaacagugguuccuggaccuaccgcuccccuggaccagcggggcaagcaccagccaggagacauggaaccggcaggaccugcuagugaccuuuaagaccgcucacgcgaagaagcaggagguugucgugcuaggaagccaggagggcgcuaugcacaccgcccugacgggugccacagagauccaaaccucgggcaccacgacuaucuucgccgggcacuuaaagugucgccucaagauggacaagcugacacugaagggcaugagcuacgugaugugcacuggaucuuucaaacucgagaaggaggucgccgaaacgcagcacggcacggugcuggugcagaucaaguacgagggcaccgacgccccaugcaagaucccauucucgacccaggacgagaaggggguuacacaaaacggccggcuaauuaccgccaacccgaucgugaccgauaaagagaagcccgugaacauagaggccgaaccgcccuucggggaaagcuacaucgucaucggggcgggcgagaaggcccucaagcuaagcugguuuaagaagggauccagcauuggcaagauguucgaggccaccgcccgcggggccaggcguauggcuaucuuaggcgauaccgccugggacuucggguccaucggcggcguguuuaccagcauagggaagcuggugcaccagaucuucggaaccgccuacgggguucucuucucgggagugagcuggaccaugaagaucgggaucggcgugcugcuuacauggcucggccugaacagccggagcaccucccugucuaugaccugcauagcggugggguuagugacucuauaccugggcgugaugguacaggccgacuccgggugcgugaucaauuggaagggccgggaguugaaaugcggaagcggcauauucgugacgaacgagguccacaccuggacugagcaguacaaauuccaggcggacagcccuaagcgccugucugccgccauagguaaggcuugggaggaggguguaugcggcauccguucagccacccgcuuggagaacauuauguggaaacaaaucuccaaugagcucaaccacauccugcuagagaacgauaugaaguucacgguggucgugggggacguggucggaauccucgcgcaggggaagaagaugauacggccccagcccauggagcacaaguacagcuggaagagcuggggcaaggccaagaucaucggcgccgacguucagaacacgacauuuaucaucgacggacccaacaccccggagugccccgacgaccagcgggccuggaacaucugggagguggaagacuacggguucgggauuuucaccacuaacaucuggcuuaaaaugcgggacagcuauacccaagugugcgaccaccgccugauguccgcggccauuaaggacucuaaggcagugcacgcggacauggguuacuggaucgaguccgaaaagaacgagaccuggaagcuagcccgggcgagcuucauagaggugaagaccugcauuuggcccaagucccauacgcuguggagcaauggcguccuggagucagagaugauaauccccaaaauuuacgguggaccgaucagccagcacaacuaccgccccggguacuucacucagaccgccggacccuggcaccucgggaagcuggagcuggacuuugaucucugcgaaggcaccacggucgugguggaugagcacugcgggaaccgggggccguccuuaagaaccaccacagugacgggcaaaaucauccacgaguggugcugccgcuccugcacccugcccccccuucgauuuaagggggaggacggguguugguaugggauggagaucagacccgugaaggagaaggaggagaaccuggucaaguccaugguguccgccgggucgggggagguggauucguucagcuuagggcuccuguguaucuccaucaugaucgaggaggucaugaggagccgguggagccgcaaaaugcugaugaccggcacccucgccguguuccuguugcugaucaugggucagcuaacguggaacgaucugauacggcucugcaucauggugggcgccaacgcgucagaccgcauggggaugggaaccaccuaucuggcccugauggccaccuucaagaugcgcccgauguuugcggugggccucuuguuccgucgccugacgucccgggaggugcucuugcugaccaucgggcucucauuaguggccuccgucgagcugcccaacagccucgaggagcugggcgaugggcuugcaaugggcaucaugauccugaaguugcugaccgauuuccagucccaucaguugugggccacgcugcugagccucacauuuaucaagaccacucugagccugcacuacgcauggaagaccauggccaugguguuaagcaucgucucgcugaucccguugugucucagcacgaccucccagaagaccaccugguuacccguacugcuggguagccuggggugcaaaccauugacgauguuucucaucgcggagaacaagaucuggggucgcaaguccuggccccugaacgaggggaucauggcaguggggguugugagcauccugcucucaucccugcugaagaacgacgugccccucgcagggccccugaucgccggcgggaugcugaucgccugcuacgucaucaguggguccagcgcggaccugucccuggaaaaggccgcagaagugagcugggaagaagaggccgagcacuccggcgcgagccauaacaucuugguugaggugcaggacgacgggaccaugaagaucaaagacgaggagcgggacgacacccucaccauccugcuaaaggcaacccuccuggccguauccggcguguacccgcugagcauccccgccacccuuuucgucugguauuucuggcagaagaagaagcagcgcagcggggugcugugggacacgcccagcccgcccgagguggagcgggccguccuggacgacggcaucuaccgcaucaugcaaagaggccuacucgggcgcucccaagugggcgugggggucuuccaggaaaacguguuccacaccauguggcaugugacgcgaggcgccguucugauguaccaggggaagcgccuggaacccagcugggcguccgugaagaaggacuuaaucagcuacgggggcggguggcggcugcaaggcagcuggaacacgggggaggaggugcaggucauugccguggagcccaggaagaacccaaagaaugugcagaccgcaccagguaccuucaagacacccgaaggagaaguaggcgccaucgcccuggacuucaagcccggaacguccgggucccccaucguuaaccgggagggcaagaucguggggcucuacggcaacgggguagucaccaccagcggcaccuacgugagcgccaucgcccaggccaaggccucccaagagggcccccugcccgagauugaggacgaggucuuucgaaagaggaaccucacgauuauggaccuucacccggggagcgguaagacccgccgcuaccugccggcaaucgugagagaggcuaucaagcggaagcugcgcaccuuaauccuggccccaacccgcguggucgccuccgagauggccgaggcgcuaaaggggaugcccauucgguaccaaacgaccgccgucaagagcgagcauaccggcaaggagaucgucgaccucaugugccacgcaacguuuacaaugcgucugcuaagucccguucgggugccgaacuacaacaugaucaucauggacgaggcccauuucacggaucccagcuccauugcggcgcgcggcuacaucucuacccgggucgggaugggugaggccgccgcgauauucaugacggccacgccuccaggguccgucgaggcguucccgcagagcaacgccgugauccaggacgaagagcgcgacauucccgagcgcuccuggaacagcgguuacgaauggaucaccgacuucccugggaagacggugugguucguccccucaauaaagagcgggaacgacauagccaacugccuccgcaagaacggcaagcgaguuauccagcuguccagaaagaccuucgacacggaguaccagaaaaccaaaaauaaugacugggacuacguggucaccacagacaucagcgagaugggggccaacuuccgugcggaucgcguuauagauccgcgucgcugucugaagccggugauccucaaggacggccccgagcgggugauccuggcagggcccaugccggugacggucgccuccgccgcccaacggcguggccgcaucggccggaaccauaauaaggagggagaccaguacaucuacaugggacagccgcugaauaaugacgaggaucacgcccacuggaccgaggccaagauguuacuggacaacaucaauaccccugagggcaucaucccagcccuguucgagccggagcgagagaagucagccgccaucgacggugaguaucgccuccgcggggaggcccgcaagaccuucguagagcugaugaggcgaggcgaccugcccguguggcucuccuacaaagucgccagcgagggcuuccaguacagcgaccggaggugguguuucgauggcgagagaaacaaccaggugcuugaggagaacaucgacgucgaaaucuggacaaaagagggcgagcgcaagaaguugcggccccgcuggcuggacgcccggaccuacuccgacccccuggcccugcgcgaauucaaggaguucgccgcggggcggaggagcguuuccggcgaccucauccuagagaucgggaaacuuccgcagcaucucacacagcgggcccagaacgcucuggacaaccuggugaugcuccauaacagcgagcagggaggccgcgccuaccggcacgcgauggaagaguuacccgacacgaucgaaacgcuaaugcuccuugcccugaucgccgugcuaaccgggggcgucacucuguuuuuccuguccgggaggggccucgggaaaaccagcaucgggcugcugugcgugauggccuccucagugcuccuguggauggccucugucgagccccacuggauagcggccuccaucauccuagaguucuucuugaugguucugcucauucccgagccggaccggcagcgaacgccccaggauaaccaacucgcuuacgucgucauaggccugcuguuuaugauccucacagucgccgccaacgagaugggguugcuggagacgacgaagaaggaccucggcaucgggcacgcggccguggaaaaucaccaucaugccaccaugcuggacgucgaccugcaucccgcuagcgccuggacgcucuacgcgguggcaaccaccauuaucacgccgaugaugcggcacacuaucgagaacaccacugccaacaucagcuugaccgccauagccaaccaagccgccauacugaugggccuugacaaaggcuggccgaucuccaagauggacaucggcgugccgcugcuggcucucggcugcuacucccaggucaauccccugacgcugaccgccgcggugcucaugcugguggcccacuacgcuauaaucgggccgggccugcaggccaaggcaacgcgcgaggcgcagaaacgcacagccgccggcauaaugaagaaccccacggucgauggcaucgucgcgaucgacuuagaccccguggucuacgacgccaaauucgagaagcagcucgggcagaucauguuacucauauugugcaccagccagauucugcucaugcggaccacuugggcgcuaugcgagagcaucacguuagccaccgguccccugacaacccugugggaggguucccccgggaaguucuggaacaccaccauagccgugagcauggccaacaucuuccguggcuccuaucuugccggggcgggauuagcguuuagccuaaugaagucacugggugggggccggcgcggaacuggcgcccagggcgagacccucggugagaaguggaagcggcagcuuaaccagcuuagcaagagcgaauucaacauauacaaacgcuccggaaucauggaaguagaccgaagcgaggcuaaggaggggcucaagcggggcgagacgacucggcaugcggugucccgcggcaccgccaagcugcggugguucguggaacgaaaccuggugaagcccgagggcaaggugaucgaccuggggugcggccggggcggguggagcuauuacugcgccggucucaagaaggucaccgaggugaagggcuacacgaagggcgggccuggccacgaggagcccaucccgauggccaccuacgguuggaaucugguuaaguuacacuccggaaaggacguuuucuucacuccgccugagaagugugauacucuccuaugcgauaucggcgagucgagccccaacccgacgauagaggaggggcgcacccugcgggugcucaagauggucgagccguggcuccgcggcaaccaguucugcaucaagaucuugaaccccuacaugcccagcgugguggagacucucgagcagaugcaacggaaacacggcggcaugcucguccgcaacccgcugucccguaauagcacacaugagauguacugggugaguugcgguaccgggaacauaguaagcgccgucaauaugacuagccgcaugcuccucaaccgcuucaccauggcgcaucggaagccaaccuaugagaaggacguggaccugggcgccgggacucgccacguggccgucgagcccgagguggccaaucucgauaucaucggacaacggaucgagaacaucaagcacgaacacaagagcacguggcacuacgacgaagacaaccccuacaaaaccugggcguaccacgggucuuacgaagugaaaccgucagguucggcuagcucuauggucaacggcguagucaagcugcugaccaagccaugggauguaauccccaugguuacccaaaucgccaugacggacaccacccccuuugggcaacagaggguguucaaagagaaaguggacacacggacgccgaaagccaagcgcggcacggugcagauuauggaggucaccgcccgguggcucuggggguuccugucccgcaacaagaagccccggaucuguacccgcgaggaauucacgcggaaggugcgcagcaacgcggcgauaggggcaguguuugucgaugagaaccaauggaauuccgccaaggaggccguggaggacgagcgguucugggaccuggugaagaaggagcgcgagcuccacaagcagggcaaaugcgcaaccugcgucuacaacaugauggggaagagagagaagaaacucggcgaauucgggaaggccaaggggucccgggccauaugguacauguggcugggggccagauuccucgaguucgaagcccugggauucaugaacgaggaucacugguucucccgcgagaacagccuguccggcguggagggggagggccuccauaagcugggguacauucugcgggacaucagcaagauccccggcgguaacauguacgcggacgacaccgccggcugggauacgcgcauuacggaagacgaccuacagaaugaggccaagaucacugacaucauggagccggaacaugcccugcuggcaacauccaucuucaaacuaaccuaccagaacaaggugguccgggugcagcgccccgcgaagaacggcacgguuauggaugucaucagcaggagggaccaacgcgggagcggccaggugggcaccuacggacuaaauaccuucaccaacauggaggcccaacugauccggcagauggagagcgagggcauuuuccuccccuccgagcuggagacgcccaaccuggccgagcgagugcucgacuggcuggagaaauauggcguugagcgacugaagcgcauggccauuagcggcgacgacugcguggucaagccgaucgacgaccgguucgccaccgcgcucacggccuugaacgauauggguaaaguccgcaaggacaucccccagugggagccuuccaagggguggaacgauuggcaacagguccccuucugcucucaccauuuccaucagcugaucaugaaggaugggcgggagaucguggucccaugccgcaaccaggacgagcucguuggccgggcccgcgugucccagggcgcaggguggucucugcgggagaccgccugucugggcaaaagcuacgcgcaaauguggcagcucauguacuuucacagacgcgaccuucgccuggcggcaaacgccauaugcuccgcggucccagugaacugggugccuacuagucggaccacaugguccauccacgcccaccaucaguggaugacuacggaagauaugcucagcgucuggaacagaguguggaucgaggagaaucccuggauggaagauaagacccauguguccagcuggggcgaugucccguaccugggcaagcgggaggaccaguggugugggucccugaucggccucacagcgcgggcgaccugggcgagcaacauccaggucgcgaucaaccaagugcgccggcugaucggcaacgagaacuaccuggacuauaugaccucaaugaagcgcuucaagaacgaaggggacccugagggcgcccucugguga

SEQ ID NO: 24602 - RNA, 9879 nt, Artificial Sequence
  derived and/or modified CDS sequence (opt11) from DENV-1__EU482536__SS-prME
agcgugacaaugcugcucauguugaugcccaccgccuuagccuuccaccuuaccacccgcggcggugaaccccacaugaucgugucaaaacaagaacggggcaagucgcugcuguucaagacuucugccggugugaacaugugcacccuaaucgccauggaccuuggcgaguucugcgaagacacaaugacguacaagugcccgcggaucaccgaagccgaaccugacgacguggacugcuggugcaaugcgaccgacacgugggucaccuacgguaccugcagccagaccggcgagcaccggcgggacaagagauccguggcuuuggccccgcacgugggucucgggcuggaaacgcggaccgagaccuggaugagcuccgagggagccuggaaacaaauccaacgcguggagaccugggcccugcgccaccccggguucacggugaucgcccucuuccuggcgcacgcuauaggcaccucaaucacccagaagggaaucaucuuuauccuacucaugcuggugaccccuuccauggccaugagaugcgucggcaucggcagccgcgauuucgucgaggggcuguccggcgcuacuuggguugacgucguguuggagcacgggagcugcgugaccaccauggcaaaggacaagccgacccuggacaucgagcuccucaagacggaggucaccaacccugcgguccugcggaagcugugcaucgaagccaaaauuagcaacaccacuaccgacagccgcuguccgacacagggcgaggccacacucguggaggagcaggacgccaacuucgucugcagacgcaccuucguggaucgaggcuggggaaacgggugcggccuguuugggaaagggucccugaucacgugcgccaaauucaagugcgugacgaagcucgagggcaagaucguccaguacgaaaaucugaaguacagcguuaucguaacgguccacaccggcgaccagcaucagguggggaacgagucgacggagcacgguaccaccgcgaccaucacgccgcaggcccccagcacggagauucagcugaccgacuacggggcccucacucuggacugcucgccucggaccggccuagacuuuaacgagaugguucuccugacaaugaaggagaaguccuggcugguacauaagcagugguucuuggaccugccgcugccauggacuagcggcgccaguaccagccaggagacuuggaaccggcaggaccuccucgugacguucaagaccgcccacgccaagaagcaggaggucguggugcuggguucccaggagggcgccaugcacaccgcccucacgggggcuacggagauccagaccuccggaaccaccacgaucuuugcugggcaccugaagugccgccugaagauggacaaguuaacucugaagggcauguccuaugucaugugcaccgggagcuuuaagcuggagaaggagguagcugagacccagcacggcacuguguugguccagauuaaguacgaggguaccgacgccccgugcaaaaucccuuucuccacccaggacgaaaagggggugacccagaacggccggcugaucacagccaauccgauagugacggauaaagaaaagcccgucaacaucgaggcagagccuccguucggggagucguauaucgugaucggcgcgggcgagaaggcccugaagcugaguugguucaagaaggggagcuccaucggcaagauguucgaggccaccgcccgcggcgcgagacgcauggcgauacucggcgacaccgcuugggacuucgguagcaucggaggggucuucacgucggugggcaagcuggugcaccaaaucuucggcacagccuacgggguacuguucagcggcguaaguuggaccaugaagauugggaucggagugcucuugaccuggcugggccugaauagccgcuccacgaguuuguccaugaccugcaucgcgguggggcuagucacucucuacuugggcgugauggugcaggcugacagcgggugugucaucaacuggaaaggccgggagcucaagugugggucgggaaucuucguaaccaacgaggugcacacguggaccgagcaguacaaguuccaggcggacuccccgaagcgacucagcgccgcuaucggcaaggcuugggaggagggggucugcgguauacguuccgcuacccgccuggaaaacaucauguggaagcagauaaguaacgaacugaaccacauccuucuggagaacgauaugaaacugaccgugguggucggggacguggccggcauccucgcccaggggaagaaaaugauaaggccccaaccaauggaguacaaauacuccuggaagaguuggggcaaggccaagaucaucggggccgacgugcaaaauacuacauucaucaucgacgggcccaacaccccggagugccccgacgaccagcgcgcguggaacaucugggaggucgaggacuacggguucgggaucuucacgaccaacaucuggcucaagcugcgugauuccuacacccaggucugcgaccacaggcucaugagcgccgcuauuaaggauagcaaggccgugcacgccgacaugggauacuggaucgagucagagaagaacgagaccuggaagcuggcgagagccagcuucaucgaggucaagaccugcaucuggcccaagucucauacccugugguccaacggcgugcucgagagcgagaugaucauacccaagaucuacgggggcccgauaagccaacauaacuaccgccccggguacuucacacagacugccgggcccuggcaccuggggaagcuggaguuggacuuugaccugugcgaagguacgacgguagucguggacgagcacugcggcaaccgggggccuagcuugcgcacuaccaccgugaccggcaagauaauccacgaguggugcugccgguccuguacgcugccgccccugcguuucaagggggaggacggaugcugguauggaauggagauuaggcccgucaaggagaaggaagagaaccuggucaaguccauggucagcgccggcuccggcgaggucgacagcuucucccucgggcugcugugcaucagcaucaugaucgaggaagugaugcgcuccagguggucccgcaagaugcucaugacuggcacccuggccguguucuuccugcuaaucaugggccagcugaccuggaacgaccugauucggcucugcaucauggucggcgcgaacgccuccgaccgcauggggaugggcacuacauaccuggcccuaauggccaccuucaagaugcgcccgauguucgcggugggccuccuguuccggcgccugacaagccgggaggugcuccugcugacaaucggguuaagccuaguagcgagcguggagcugccgaacucccuggaggaacugggcgacgggcuagccaugggcaucaugauacucaaacuucugaccgacuuucagucacaccaguuaugggccacccugcugucguuaaccuucauccggacgaccuucagucugcacuacgccuggaagaccauggcgaugguccuguccaucgugagccucuucccccucugccuguccaccacgucgcagaagaccacguggcugcccgugcugcugggcucccucgggugcaagccgcugaccauguuccugauagcggagaauaagaucuggggccgcaagagcuggcccuugaaugaggggaucauggccgucgggaucgugucaauccuccucuccagccuccugaagaacgacguaccccuggccgggccccucauugcagggggcaugcugaucgcaugcuacguaauuuccgggagcuccgccgaccuaagccucgagaaggccgcggaaguguccugggaggaggaggccgaacacucuggcgcuucccacaacauacuggucgagguccaggacgacgggacuaugaagauaaaggacgaggaacgcgacgacaugcucaccauccugcucaaagccacccuacucgccgugagcggcguguacccacuguccaucccagccacccuuuucgugugguacuucuggcagaagaagaagcagcguaguggggugcugugggacacccccagcccgcccgagguggagcgcgccguccuggaugacggcaucuaccggauuaugcagaggggccugcuggggcguucccagguggguguggggguauuccaagagaauguguuccacacgauguggcaugugacgcguggcgcgguccugauguaccaagggaagagauuggaacccucgugggcaagcgugaagaaggaccugauuucguacggcggcgguuggagacugcagggcucguggaacaccggggaagaggugcaggucaucgccguagagccgggcaaaaaccccaagaauguccagaccgcccccgguacguucaagaccucugagggugaggucggcgccaucgcgcuggacuucaagcccggcaccucuggcagccccaucguuaaccgugaggggaagaucgugggacuguacggaaacggggucgugaccacguccggcaccuacgugagcgccauugcccaggccaaagcgucccaggaggggccccucccggagaucgaggacgaagucuuccgcaagcggaaccugacgaucauggaucugcacccagggucagggaagacgcgccgguacuuaccggccauugugcgagaagccauaaaacggcggcugcgcacgcugauacuugccccgacgcgggugguagccagugagauggcggaagcccugaaagguaugcccauccgcuaccaaaccaccgccgucaagucugagcacacggguaaagagaucguggaccuuaugugccacgccaccuucaccaugcgucuccuguccccuguccgcguucccaacuacaacaugauaaucauggacgaggcccacuucaccgacccguccucaaucgccgcacggggguacauaagcacgcgugugggcaugggugaggcagccgcgauuuucaugacagcgacgccgcccggguccguggaggccuucccacagagcaacgccgugauccaggaugaggagcgggacaucccggagcgguccuggaacagcggguacgaguggauuacagacuucccgggcaagacggugugguucgucccauccaucaagucuggcaaugacaucgccaacugcuugcggaagaacggcaaaagagucauucaacucuccaggaaaaccuucgacaccgaguaccagaagacgaagaacaacgacugggacuacguggucaccaccgauaucagcgagaugggcgccaauuuccgggcggaccgugugaucgauccgcgccggugccugaaaccggugauccugaaggacggacccgaacgcgucauccucgccggccccaugccugugaccgucgcguccgccgcgcaacggcgcgggaggaucggccgcaaccacaacaaggagggcgaccaguacaucuacauggggcaaccucuuaacaacgacgaggaccacgcccacuggaccgaggccaagauguuacucgauaacaucaacacacccgaggggauuauccccgcacuguucgaaccagagcgcgagaaguccgcagcuauugacggggaguaccgguugcgcggcgaagcccggaagaccuucguggagcucaugcgccguggggaucugccggucugguugagcuacaaggucgcauccgagggcuuccaguauagcgacagaaggugguguuucgacggcgaacguaacaaccaggugcucgaggagaacauggacguagagauauggaccaaggagggggagcggaagaagcugcgcccccgguggcuggacgcacguacauauuccgacccccucgcccugcgggaguucaaggaguucgcggccggccgccggagcgucuccggcgaccugaucuuagagaucggcaagcugccccagcaucucacgcaaagggcccagaaugcacucgauaaccuggugaugcugcacaauuccgagcagggcggcagagcguaccgccaugccauggaggagcucccggacacaaucgagacacugauguugcucgcguugaucgccguucuuaccggcgggguaacgcuguucuuccuguccggccgggggcugggcaagacaucuaucggccuucugugcgugauggccuccucuguccugcuguggauggcguccguggagccccacuggaucgccgccagcaucauucuggaguucuuccugauggugcuccuaauccccgagcccgaccgccagcggaccccgcaagacaaccaacuggcuuacgucgugaucgggcuccuguucaugauccugaccguagccgcgaacgagaugggcuuacuggagaccacuaagaaggaccuggguaucggccacguugccgucgagaaccaccaccacgccgccaugcucgacguggaccugcacccggccucggcguggacccuguacgccguggccaccaccaucaucacgcccaugaugcgccacaccaucgagaacaccacugcuaacaucucccuuacggccaucgcgaaccaggccgccauccugaugggguuggacaagggguggccgauauccaagauggacauuggcgucccccuacuggcauuggggugcuacagccaggugaacccccucacccugaccgccgccguccugaugcucguggcccacuacgccauuaucggccccggcuuacaagccaaggcgacccgcgaggcccaaaagaggacggccgccggcaucaugaagaacccgacggucgacggaaucguugcuaucgaccuggaccccguaguguacgacgcgaaguuugagaaacaacugggccagaucauguuauugauccuaugcaccucccaaauccugcugaugaggaccaccugggcccucugcgagucgauuacccuggccaccggcccucugaccacccugugggaggggucccccggcaaguucuggaacaccaccauugccguguccauggcaaacauauuucgugggagcuacuuggcgggcgcagggcuggcauuuucacucaugaagucccucgggggcgggcgucgggguaccggggcacagggcgagacgcugggugagaaguggaagcgccagcucaaccagcuuuccaagucagaguucaauacuuauaaaagaagcggcauuauggaggucgacaggagcgaggcaaaagaaggcuugaagcgcggggagaccaccaagcacgccguguccagaggcaccgccaagcuccguugguucguggagcguaaccuaguaaagccggaagggaaaguaauagaccugggcugcggcagaggcggguggagcuauuacugcgccgggcugaagaagguaaccgaggucaaggguuacaccaagggcgggcccggccacgaggaaccgauccccauggcaaccuauggguggaaccucguaaaacugcacuccggcaaggacguguucuuuauacccccggagaagugcgacacgcugcucugcgacauuggggagagcuccccgaaccccacaauugaggagggccggacccugcgggugcugaaaaugguagaaccguggcuccgcgggaaucaguucugcaucaagauacuuaaccccuauaugcccucggucguagaaaccuuagagcagaugcaacgaaagcacgggggcaugcuugugcgcaacccacuguccaggaacagcacgcaugagauguacuggguguccugcgggaccgguaacaucgucagcgcggugaauaugacuucccgcaugcugcuaaacagauuuaccauggcccaccggaagccuaccuacgagcgcgacguggaccugggcgccggcacuagacacgucgccguggagcccgagguggccaaccuggacaucaucggacaacgcaucgaaaacauuaagcacgagcacaaaagcaccuggcauuacgacgaggauaaccccuacaagaccugggcguaccacggguccuacgaggucaagccaagcggcagugcguccucuaugguaaacggggucgugaagcuccugaccaaaccaugggacgucauccccaugguaacgcagauagccaugaccgacacuacucccuucggccagcaacggguguuuaaggaaaagguggacacacgcacucccaaggccaagcgggggaccgcccagaucauggaggugaccgcgaaguggcucuggggcuuccucucccgcaacaagaagccgcggaucuguacgcgagaggaguucacccggaaagugcgcaguaacgccgccaucggcgccguguucguggaugagaaccaauggaacagcgcgaaggaggccguggaggacgagcgguuuugggaucuggugcaccgcgagcgggagcugcacaagcaggggaagugcgcgaccugcguguacaacaugaugggcaagcgcgagaaaaagcucggggaguucggcaaggcgaaggggagccgcgccauaugguacauguggcugggugccagguuccuggaguucgaggcccucgguuuuaugaaugaggaccacugguucucccgggagaauagcuuguccggggucgagggcgaaggguuacacaagcucgguuacaucuuacgcgauaucucaaagaucccagggggcaacauguacgccgacgacaccgccggaugggacaccaggaucaccgaagacgaccugcagaacgaggccaaaaucacggauaucauggagcccgagcacgcgcucuuggccaaaagcaucuucaagcugacauaccaaaauaagguaguccggguacagaggccggccaagaauggaacagugauggaugucaucagccgucgggaucagaggggauccggccagguuggcaccuacggccucaacaccuuuaccaacauggaggcccagcugauccgacagauggagagcgaagguauauucuccccuuccgagcucgagacgcccaaccuggcaggccgggugcucgacuggcucgaaaaacaugggguugaacgccucaagcggauggcgaucaguggcgacgauugcguugugaaacccauugacgaccgcuucgccacggcacugaccgcccugaaugacauggguaagguacggaaggacaucccgcagugggagcccucaaagggguggaacgacuggcagcagguccccuucugcagccaucacuuucaccagcucaucaugaaggacggccgcgagaucgugguccccugcaggaaccaggacgaacugguagggagggcucgagugucacagggcgcgggguggagccugcgcgaaaccgccugcuuaggaaagucauacgcccagauguggcagcugauguacuuccaccgccgagaccugcggcucgcagcuaacgccaucuguagcgcagucccgguggacugggugcccacgucccgcaccaccuggucgauccacgcucaucaccaguggaugaccacagaagacaugcugucggucuggaaccggguguggaucgaggagaaccccuggauggaggacaagacccacgucagcucauggggcgacguccccuaccugggcaagcgcgaggaucaguggugcggcucuuugaucgggcugaccgcucgcgcgacgugggccacaaacauccagguagcaaucaaccaggugcggagacuacucggcaacgagaacuaccuggacuacaugacauccaugaaacgcuuuaagaacgagagcgacccggagggggcgcugugguga

SEQ ID NO: 24603 - RNA, 9879 nt, Artificial Sequence
  derived and/or modified CDS sequence (opt11) from DENV-1__EU482537__SS-prME
ucggugaccaugcugcucauguuaaugcccaccgccuuggccuuccacuugaccaccagagggggagagccgcacaugaucgugaccaagcaggagcggggcaagagcuugcuguuuaagaccagcgcugggguuaacaugugcacccucaucgccauggaccugggcgagcugugugaggacaccaugaccuacaagugcccgcggaucaccgaggccgagccggacgauguggacugcuggugcaacgccacagacaccugggugaccuacgggaccugcucgcagaccggcgagcaccggcgggacaagcgcagcguggcacucgcuccccacguuggccugggacuggagacccgcaccgagaccuggauguccagcgaaggagccuggaagcagauucagcggguggagacgugggcccuccgccaccccggguucaccgugaucgcccuuuuccuggcgcacgccauuggcaccuccaucacccaaaaggggauuauuuucauccuccuuaugcugguaacgcccagcauggccaugcggugcgucgggaucggcucccgcgacuuuguugaggggcucucgggcgccaccuggguggacgucgugcuggagcacggguccugcgugacaaccauggccaaggacaagcccacacuggauauagagcuccugaagaccgaggucacgaaccccgcgguguugcggaagcucugcaucgaggcgaagaucagcaacaccacgaccgauagccgcugccccacccagggcgaagccacccugauggaggagcaagacgccaacuucgugugccggagaacguucgucgaucggggcuggggaaacggcugcgggcuguuuggcaaggggagccucauaacgugugccaaguucaagugugugacgaagcuggagggcaagauagugcaauacgagaaccugaaguacuccgucauagugaccgugcacacaggcgaccagcaccaggucgggaacgagagcacugagcacggcaccaccgcgaccauaacgccucaggcccccaccuccgagauccagcucaccgacuacggggcccugacgcucgacugcucuccccgcacgggacucgacuucaacgaaauggucuuacugaccaugaaggaaaaguccuggcugguucacaagcagugguucuuagaccuuccgcuccccuggaccagcggggccagcaccagccaggagacauggaaucggcaggaccuucuggugaccuucaagacagcccacgcgaagaagcaggagguggucguacucggcagccaagagggcgccaugcauaccgccuuaacgggggccaccgagauccagaccuccggcaccacgacuauauucgccggucaccugaagugccgccucaagauggacaagcugacccucaagggcaugagcuacgugaugugcaccggguccuuuaagcucgagaaagaggucgccgagacgcagcacggcacagugcuggugcagaucaaguacgagggcacagacgcccccugcaagauccccuucagcacccaggacgagaagggggucauccagaaugguagacugaucacggccaauccgaucgucaccgacaaggagaagcccgugaacaucgaagccgagccgcccuucggggagucauacaucgucauaggcguuggcgagaaggcgcucaaacuuagcugguucaagaaaggguccagcaucggcaagauguucgaggccaccgcgcguggagcccgacgcauggccauccuuggcgacaccgcgugggacuucggguccaucggcggcguauuuacgagugucgggaagcuggugcaccagaucuucggcaccgccuaugggguccuguucuccggcgucagcuggacgaugaaaauagggauuggcguucugcugaccuggcucggucuaaauucucgcucaacgaguuuauccaugaccugcaucgccgugggucucgucacccuguaccugggcgugauggugcaggcagacuccgggugugucaucaacuggaagggucgggagcucaaaugcgggagcggcaucuucgugaccaaugagguucauacguggaccgagcaguacaaguuccaggcagacagcccgaagcgccugucggcggccaucggcaaggccugggaggaagggguaugcggcauccggagcgccacacgccuggaaaacaucauguggaagcagaucuccaacgagcucaaccacauccugcuugagaacgacaugaaguuuaccgucgucgucggggauguaguuggcauacucgcccaggguaaaaagaugauucggccccagcccauggagcacaaguacagcuggaaguccuggggcaaggccaagaucaucggcgccgacguacaaaacaccacguucaucaucgacgggccgaauaccccugagugucccgaugaccagcgugcguggaacaucugggaaguggaggauuacggcuucgguauauucaccaccaacaucuggcugaagcuccgggauaguuauacgcaggccugcgaccaccgccucauguccgccgccauaaaggacagcaaggccguccacgcagacauggguuacuggaucgaguccgagaagaacgagaccuggaagcuggcacgggcgucguucauugaagucaaaaccugcaucuggcccaagucccacacccuguggucgaacggcgugcucgagagcgaaaugguuauccccaagaucuacggagggcccaucucucagcacaacuaccgcccugguuacuucacgcaaaccgccggccccuggcaccuggggaagcucgagcuggacuucgaucugugugagggcaccaccgucgucguggacgagcacuguggcaacagagggccgucccugcgcacgaccaccgucaccggcaagaucauucacgaguggugcugccggucuugcacgcugccacccuugcgcuuuaagggggaggacggcugcugguacgggauggagauacggccagugaaggagaaagaggagaaccuggugaaguccaugguuagcgcaggcagcggcgagguggacuccuucagccucgggcugcugugcaucucuaucaugaucgaagaagugaugcgcaguagguggucccgcaagaugcucaugaccggcacccuagccgucuuccucuuacugaucauggggcaacugaccuggaacgaccucauccggcugugcaucauggugggcgccaaugccagcgaccgcauggggaugggcacgaccuaucuugcccucauggcaacauucaagaugcgcccgauguucgccguggggcugcuguucagacgccucacaucccgggagguccugcugcucacgaucggucuuagccugguggccuccgucgagcucccgaauagccucgaggagcugggcgacgggcucgccaugggaaucaugauccugaagcugcucacugacuuccagucccaucagcugugggccacccugcucagccugaccuucauuaaaaccacccuuuccuuacacuacgccuggaagacaauggcuauggugcugagcaucgugucccuguuuccacucugccugucgaccacuucccagaagacgaccugguuacccguccuccugggcagccuggggugcaagccguugaccauguuccucaucgcggaaaacaagaucuggggcagaaaguccuggccccugaacgaagggaucauggcggugggcgucgugagcauccuccugagcucucugcucaagaacgacgugccccuggccgguccacugaucgcgggcggcaugcucaucgcuugcuacgugauaagcggguccucagccgaccugucccuggagaaggccgccgaggucagcugggaggaggaggcagagcacuccggggccucucacaauauccucguagaggugcaggacgacggaacgaugaagaucaaggacgaggagcgggacgacacccugaccaucuugcucaaggcgacgcugcuggcggugucaggcguauauccacucucuaucccugccacccuguucguaugguacuucuggcagaagaagaagcagcgcuccgguguccugugggacacgcccagcccgcccgagguggaacgagccgugcuagacgacggcaucuacagaaucaugcaacgaggccuccugggacgcucccaggucggcguagggguguuucaggagaauguguuucauaccauguggcacgugacccguggcgccgugcugauguaccaggggaagcgccucgagccaagcugggcguccgucaagaaggaccuaauauccuauggcggcggguggagauugcagggcuccuggaacacgggggaggagguacaggugauagccgucgaaccaggcaagaaccccaagaacgugcagaccgccccugggaccuucaagacacccgaaggugaagugggugcgaucgcccucgacuucaagccugggaccucuggcucccccaucguaaaccgugagggcaagaucguagggcuguacggcaaugggguggucacgaccagcggcaccuacguaagcgcgaucgcccaggccaaggcaucccaggagggaccccugcccgagaucgaagacgagguguuucggaagcgcaaccucaccaucauggaccuacaccccggcagcgggaagacccggcguuaccugccggccaucguccgggaggccaucaagcgcaaguugcggacacugauccuagcccccacccgcgugguggccuccgagauggccgaggcgcucaagggcaugcccauccgguaucagacaacggccgucaagucggagcacaccggcaaggagauaguggaccugaugugucacgcaaccuuuaccaugcgucugcucucccccguucgcgucccgaacuacaacaugaucaucauggacgaggcccacuucacugacccuuccucgaucgcggcgcgaggguauaucucuacccgcgucgggaugggugaggccgccgccauuuucaugaccgcaacgccgccuggcuccguggaggcguucccgcagagcaacgccgucauccaggacgaggagagggacaucccggaacgguccuggaauagcggguacgaguggaucacagacuuccccgguaaaaccgugugguucguacccuccauuaagagcggcaacgauaucgcaaacugccugcggaagaaugggaagcgcgucauccagcuguccagaaagaccuucgacaccgaguaccagaagacgaagaauaacgauugggacuacguggugaccacggacaucagcgagaugggcgccaacuuccgcgcggaccgagucaucgacccgcgccgaugccucaagccgguaauccugaaggacgggcccgagagagucauccuggccggccccaugccggugaccguggcuuccgccgcccagcggcgcggucggaucggccgcaaccacaacaaggagggcgaucaauacaucuacauggggcagccgcucaacaacgacgaggaccaugcgcacuggacggaggcuaagaugcuguuggacaacaucaacacgcccgagggcaucauccccgcccuguucgagccggagcgggagaaguccgccgccaucgauggggaguacaggcugcgcggcgaggcgcggaagacguucgucgaguuaaugcgccgcggggaccuacccguguggcuguccuacaaaguggccagcgagggguuccaguauucagaccgucgguggugcuucgacggcgagcgcaacaaccaagugcuggaggagaacauggacguagaaaucuggaccaaggagggggagcggaagaagcuccgaccccgguggcuggacgcccgcaccuacuccgacccccuggcccuccgggaguucaaggaguucgccgcgggccgccggagcgucuccggggaccugauccuggagaucggcaaacucccgcagcaccugacccagcgcgcccagaacgcccuggacaaccucguaaugcugcacaauucagagcagggcgggcgggccuaccgccacgcgauggaggagcugccugacaccaucgagacccucaugcuguuggcccucaucgccguucugacgggcggugugacccuguuuuuccucagcggccggggguuaggcaagaccagcauuggccuacucugcgucauggccucaagcgucuuacucuggauggcauccguggagccucacuggaucgcggccucaaucauacucgaguucuuucugaugguucugcucauccccgagccggaccgccagcgcacgccccaggacaaccaacuggccuacguggugauagggcuccucuucaugauuuugaccgucgccgccaacgagaugggccugcucgagaccaccaagaaggacuuggggauagggcacguggcgguggagaaccaccaccacgcuaccaugcuggacguugaccugcaccccgccucagccuggacccuguacgccgucgcgacgacuaucaucaccccgaugaugcgccacacaauagagaacacgacugccaacaucagccugaccgcuaucgcuaaccaagcagcuauccucauggggcuggacaaaggcuggcccaucuccaagauggacaucggcguaccccuccucgcccuggggugcuauucacagguaaacccccucacccucacggccgccgugcugaugcugguggcucacuacgccaucauuggcccggggcuccaagccaaagccacccgggaggcccagaagcgcaccgcggccgggaucaugaagaacccgaccgucgacgggauuguggccaucgaccuggaccccgugguguacgacgccaaguucgagaagcaacugggccagaucaugcuccugauccugugcacgucccaaauccuccugaugcgcaccacuugggcucugugugagagcaucacccucgcuacgggcccgcugaccacccugugggagggguccccgggcaaguucuggaauacuacgaucgccgugagcauggcuaacaucuucagagggucuuacuuagccggcgccggcuuagcguuuagccugaugaaaucccucgguggcggaaggcggggcacaggagcccagggcgaaacccugggcgagaaguggaagcgccagcuaaaccaguuguccaagagcgaguucaacauuuauaagcgguccgggauuauggagguggaccgcucggaggccaaggagggccugaagcguggggaaaccacgcgccacgccgucucccguggcacagcgaagcugcgcugguucguggagcggaaccucgugaagcccgaggggaagguuaucgaccucggcugcggccgcgggggcuggucuuacuacugugccgggcugaagaaggugaccgaggugaagggcuauaccaaaggcgggcccggccacgaggagcccaucccaauggccacguacggcuggaaccugguuaaacuccauuccggcaaggacguuuucuucaccccucccgagaagugcgacacccuguuaugcgacaucggggagucuucacccaacccgaccaucgaggagggccggacguuacgcgugcuaaagauggucgagcccuggcuaagagggaaccaguucugcaucaagauccucaacccauacaugcccagcgugguagagacccuggagcagaugcagcgcaagcacggcggaaugcugguacggaacccgcucagccgcaauagcacucacgagauguacugggugagcugcgggaccgguaacaucguaucggcagucaauaugaccucccggaugcugcugaaccgcuucacgauggcccacagaaagcccacauacgagcgggacguggauuuaggggcgggcacccgccacguugccgucgagcccgagguggccaaccuggacaucaucggccagcggaucgagaacaucaagcacgagcauaagagcacauggcacuacgacgaggacaaccccuauaagaccugggccuaccauggaucguacgaaguaaaaccgucgggcuccgccagcagcauggugaacgggguggucaagcuccucaccaaacccugggacgugauccccauggugacccagaucgcgaugaccgacacgacccccuucggccagcagcgcgucuucaaggagaaggucgacacucggaccccgaaggccaagcgcgggacggcccaaaucauggaggugaccgcccgguggcuauggggcuuccugucccgcaauaagaagccucggaucuguacccgcgaagaguucacuagaaagguccgcagcaacgcugcgaucggcgccguguuuguggacgaaaaucaguggaacuccgccaaggaggccgucgaggacgagagguuuugggaccucgugcagaaggagcgcgagcugcacaagcaggggaagugcgcaacguguguguacaacaugaugggcaagcgggaaaagaagcugggggaguucggcaaggccaaggggagccgcgccaucugguacauguggcucggcgcccgauuccuggaguucgaggcgcugggauucaugaacgaggaccacugguucucgcgcgagaacucgcucuccgggguagagggcgaggggcuucacaagcuggguuacauccuccgggacaucuccaagauccccggagguaauauguacgcggacgacaccgcgggcugggauacucgaaucaccgaggacgaccugcagaacgaagccaagaucacggacaucauggagccugagcacgcccugcucgccaccuccaucuucaaguugacauaccagaacaagguugugcggguccaacgccccgcgaagaaugggaccgugauggacguaaucucgcgacgggaccagcgcggcuccggacaagucggcacguacggccugaauaccuucaccaauauggaggcccaacucauccggcagauggagucugaggggaucuuucuccccuccgagcuggagaccccgaaccucgccgagcgcguauuagacuggcuggagaaacacggcguggagcguuuaaagcgcauggccaucagcggggacgacugugucgugaagcccaucgacgaccgguucgccacagcgcugaccgcacugaacgacaugggcaaggugcggaaggacauuccacagugggagcccuccaagggguggaacgacuggcagcagguccccuucugcagccaccacuuccaccaauugaucaugaaggacggccgggagaucguggugccgugccgcaaccaggacgagcuggucggacgcgccagggugucccagggggcuggauggucacugcgggagacugccugccucggcaaauccuacgcgcagauguggcagcugauguacuuccaccggcgggaccuccgccucgccgcuaacgcuaucugcuccgcagugcccguggauugggugcccacgagccgaacgaccugguccauccaugcccaccaccaguggaugaccaccgaggacaugcugagcguauggaaccgggucuggaucgaggagaaccccuggauggaggacaagacgcacguguccagcuggggcgacgugccguaccuggggaagcgggaagaccaguggugcgguucccucaucggccugaccgcccgcgccaccugggccagcaauauccaggucgcgaucaaccaagugcgccggcugaucgggaacgaaaacuauuuagacuacaugacgucuaugaaacgcuucaagaacgagggugacccugaaggggcccugugguga

SEQ ID NO: 24604 - RNA, 9879 nt, Artificial Sequence
  derived and/or modified CDS sequence (opt11) from DENV-1__EU482538__SS-prME
agcgugacgaugcugcugaugcucaugccuacggcccuggccuuccaccucaccacccgcgguggggaaccccauaugauugugagcaaacaggaacgagguaagaguuuacuguucaagacaagugcaggggugaacaugugcacucucaucgcgauggacuuaggcgaguucugcgaagacacgaugaccuauaagugcccccgcaucaccgaagcugagcccgacgacguggacuguuggugcaacgcuaccgacaccugggugacuuaugggacgugcagccagaccggugagcaccgccgcgauaaacgauccguggcccuggcgccccacgugggccucggcuuagaaacgcggaccgagaccuggaugagcucggaaggcgccuggaagcaaauacagcggguggaaacgugggcgcugcgccaucccggauuuacagucaucgcccucuuucuggcccacgccaucggcaccagcaucacgcaaaaggggaucaucuucauccuacuuaugcucgugacccccuccauggccaugcggugcguagggauaggcagccgcgacuucguugaggggcucuccggcgccaccuggguggaugucgugcucgagcacgggaguugcgucaccaccauggcuaaggacaagcccacgcucgauauagaacugcucaagacggaggucaccaaucccgcggugcugcggaagcugugcaucgaagccaagauuuccaauacuaccaccgacagccgcugcccgacccagggggaggccacccucgucgaggagcaggaugccaacuucgucugccggcguaccuucguugacaggggcugggggaacggaugugggcuguucggaaaagguagucugauaacgugcgccaaguucaagugcgugacaaaguuagagggcaagauuguucaauaugagaaccugaaguauagcgugaucgucaccguucacacuggcgaccagcaccaggugggaaacgaaucaacagagcacgguacaaccgcgaccaucacaccgcaggcccccaguacggaaauucaguugacugauuacggcgcccucacucucgacuguucgccccggaccggccuggacuuuaacgagaugguccugcugacgaugaaggaaaaguccugguuagugcacaaacagugguuccucgacuugccgcugcccuggaccagcggggcgucuaccucucaggagaccuggaaccggcaggaccuacugguaacuuuuaagaccgcgcaugccaagaagcaggaggucguaguacuuggcucccaggaaggcgccaugcacaccgcccucaccggcgccacggagauccaaaccagcggaacaaccacgauuuucgccgggcaccugaaaugccgccugaagauggacaagcucacccugaaggguaugagcuaugucaugugcaccgggucguucaaguuggagaaagaaguggcggagacacagcacggcacaguauugguccagauaaaguacgagggcaccgacgcgcccugcaagauccccuuuuccacgcaggacgagaaaggugugacccagaacggucggcuuaucacugcgaauccgaucgugaccgaccgcgaaaaacccguaaauaucgaggccgagccgcccuucggcgagaguuacauugugaucggcgcuggcgagaaggcccugaagcugagcugguuuaagaagggcagcucgaucggcaagauguuugaggccaccgccagaggggcacgccgaauggcgaucuuaggcgauaccgccugggacuucggcucgaucggagggguguucacguccguugggaaacuggugcaccagaucuucggaacggcauacggagugcuguucagcggcguauccuggaccaugaagaucgggaucggcgugcuccuaaccuggcugggccuuaacagccgguccacuagcuuaucaaugacgugcaucgccguagggcuagucacccuguaccugggagugauggugcaggcagacagcggcuguguuauaaauuggaaagggcgcgaguugaagugcggaucaggcaucuuugugaccaacgaagugcacacuuggacagaacaguacaaauuccaggcagacucucccaaacgacucagcgcggccaucgggaaggcaugggaagaagguguguguggcauaaggagcgcuacccggcuggaaaacaucauguggaagcagauaagcaacgagcuaaaccauauccuccuggagaaugauaugaaacugaccgugguagucggugacguagcgggaaucuuggcccaagggaaaaagaugauccgcccccaacccauggaauacaaguacuccuggaagucuuggggcaaagccaagaucauaggggccgacgugcagaacaccacguucauuaucgacgggcccaacacucuggaguguccagacgaucagcgggcguggaauauuugggagguagaggacuacggguucggaauauucaccaccaacaucuggcuaaagcucagggacucuuacacgcaagugugcgaucaccggcugaugagcgccgcuaucaaggacuccaaggcuguacacgccgauaugggcuacuggauagagagugagaagaacgagaccuggaagcuggcgcgcgcgagcuuuaucgaagucaagacaugcaucuggccuaagucucacacccuguggucgaacggcgugcuggagagugagaugaucauacccaagauauacgggggacccauaucccaacauaacuaccggccaggauacuucacgcagaccgccgggcccuggcaccugggaaagcuggagcucgacuuugaccuuugcgagggaacuaccguggucguggacgagcacugcggcaaucgcgggcccucucuccgcaccaccaccgugacgggaaagaucauccacgagugguguugccgcucgugcacgcugccgccccugcgguucaaaggggaggacgguugcugguacgggauggaaauccgccccgucaaggagaaggaggagaaccuaguaaaaucgauggugagcgcgggcucgggcgagguggacagcuucucacugggucugcucugcaucagcauuaugauagaggaggucaugagaucucgguggagccggaagaugcugaugaccggcacccuugccguauuuuuccuccugaucauggggcaacuuaccuggaacgaucucauccgucugugcaucaugguaggcgcaaacgccuccgauaggauggggaugggaacgacauaccuggcccugauggcgaccuucaagaugcggccuauguuugccgucggccugcuguuccgccgucucacgagcagagagguguuacugcucacaaucgggcugucccuggucgccagcgucgagcuccccaacuccuuagaggagcugggugauggguuagccaugggcauaaugauacucaagcugcuuaccgacuuccaaagccaccagcuuugggcuacccuguuaucccuaacuuucauccggacgaccuucagccuucacuaugccuggaagacuauggcgaugguccucuccaucgugagucuguucccacugugccuguccaccacgucgcagaaaaccaccuggcugcccguguugcucggaucacuggggugcaagccccugacaauguuccuuaucgccgagaauaagaucuggggccgcaagagcuggccguugaacgaagggaucauggccgucggcaucgugucgauccugcucuccucgcuccugaagaacgacgugccccucgcagggccccugaucgcaggcgggaugcuuauagcuugcuauguaaucagcgggucauccgccgaccuuagcuuagaaaaggcggcugagguguccugggaggaggaagccgaacacagcggagcgucccacaacauccugguggagguccaggacgacgggaccaugaaaaucaaggacgaggagcgugacgauacccucaccauccugcugaaggccacccuccuggccgugagcggcguguacccgcugucgauaccggcgacucucuucgucugguacuuuuggcagaagaagaagcagcgcucggggguccucugggacacgcccaguccacccgagguggagcgggccguccuggacgacggcauauaccgcaucaugcagcgcggucugcucgggcggagccaagugggcgucggugucuuccaagagaacguguuccacaccauguggcacgugacccgaggagcggugcugauguaccaggggaagcgcuuagagccgagcugggccagcgucaagaaggaccucaucuccuacgggggcggguggcgguuacaggggagcuggaauaccggggaagaggugcaggucaucgccguggagcccggcaaaaacccgaagaacgugcagacagcccccgggaccuuuaaaaccucagagggcgagguuggcgccauagcgcuggacuucaagccagggaccagcgggagcccaaucgugaaccgugaagggaagaucgugggccucuacggaaacgggguggucacgaccuccggcaccuauguaagcgccauugcccaaaccaaagcuagccaggaggggccccugccugagaucgaagaugagguuuuccguaaacggaaucugacaaucauggacuugcauccgggcagcgggaagacacggcgguauuuaccagccauaguccgggaggccaucaagcguaggcugcggaccuugauucuagcaccgacccgcguggucgccuccgagauggcagaagcucugaaggguaugccgauccgguaucagacgacugcugucaagagcgaacacacgggcaaggagaucguagaccucaugugccacgccaccuucaccaugcgucugcucucccccguccgggugcccaacuacaauaugaucauuauggacgaggcccacuucaccgaccccagcuccaucgcugcgcgcgguuacaucagcacccgggugggcaugggugaggccgcggccaucuucaugaccgcuacgccgcccgggaguguagaggcauucccccagucaaaugccgugauccaggacgaggagcgcgacaucccagagcgguccuggaacagcggauacgaguggaucaccgacuuuccggggaaaaccgucugguucguccccucgaucaagagcggcaaugacaucgcaaacuguuugcgcaagaacggcaagagggugauccagcucucccgcaaaacauuugacacggaguaccaaaagaccaagaacaacgacugggauuacgucgucaccacggacaucucugagaugggcgccaacuuccgggcggaccgaguaaucgacccccggcgcugucucaagcccguaauccucaaggaugggccggagcggguuauccuggccggccccaugccuguuacggucgccagcgccgcgcaacggagagggcgaaucggccgcaaccacaacaaggagggugaccaguacauuuacauggggcaaccucugaacaacgacgaggaccacgcgcacuggaccgaagccaagaugcugcuggacaacaucaacacccccgagggcaucauucccgccuuguuugagcccgagcgcgagaaguccgcagcaauagacggggaguaccgccucagaggcgaggcgcgcaagaccuucguggaguuaaugcggcgcggcgaccugccagucuggcuaagcuacaaggucgccuccgagggauuccaguacagugaccggcgcugguguuuugauggcgaacggaacaaccagguacuggaggagaacauggauguggagaucuggacgaaagagggugagcgcaagaaacugcggccgcgcuggcucgaugcccgaacguacucagacccccuagcccugcgcgaguucaaagaguucgccgcuggucggcgcagugucuccggggaccucaucuuggagaucggcaaguugccucagcaccucacccaacgggcccagaacgcccuagacaacuuggugaugcuacacaacagcgaacagggcggaagggcguaccggcacgcgauggaagaacugcccgauaccauugaaacgcugaugcuccuggcccugaucgccguccucacaggcggcgugacacuguucuuucuguccggccgcgggcucggaaagacgaguaucgggcugcugugcgugauggccucaagcguccucuuauggauggcuuccgucgagccccacuggaucgcggccagcauaauccuugaguuuuucuuaaugguucuccugauccccgaacccgaccggcagcgcacuccccaggacaaccagcucgccuacguugucauagggcugcuguucaugauacuuacggucgccgccaaugagaugggccugcuggagaccaccaagaaagaucucggaaucggccacguggccgucgagaaucaccaucaugccgccaugcuggacguggauuuacauccugccuccgcguggacacuuuacgcgguagccacuaccaucaucacccccaugaugcgucacacaauagaaaacacgaccgccaacaucagccugaccgccaucgccaaccaggcagccauccuuaugggccuggacaagggcuggcccaucaguaagauggacaucggcgucccccugcuggcccugggcugcuacagccaggugaacccgcugacacugacggccgcgguguugaugcuaguagcgcacuacgccauaauagggcccggccugcaggcuaaggcuacgcgggaagcgcaaaaacgaaccgccgccgggaucaugaagaaccccaccguggaugggaucguggcuaucgaccucgacccugucguguaugacgcgaaguucgaaaagcaguuaggacagaucaugcuacucauauuauguaccucccaaauccuacuaaugcggaccaccugggcgcugugcgagagcauaacgcuggcuacggguccccucacgacccugugggagggcucgccggggaaguucuggaauaccacgaucgcaguuucgauggcgaacaucuuccgugggagcuaccuugccggugcgggacuagccuuuucccucaugaagucccuagggggcggucggcgcggaaccggagcgcagggcgagacccucggcgagaaauggaagcggcagcugaaccagcuguccaagagcgaguucaacaccuacaaacgcucagggauaauggaggucgaucgguccgaagcaaaggagggccuuaagcgcggggagacaaccaagcacgcagugucccggggcaccgcgaaacugcgcugguucgucgaucggaaccuggucaagcccgaggguaaggugaucgaccugggcugcggccgcggggguuggagcuacuauugcgccggguuaaagaaggugaccgaggugaaaggcuacacuaagggcgggccgggccaugaggagccgauuccuauggccaccuauggguggaaucuggugaagcugcacuccggcaaggauguguucuuuaucccgccagagaagugugacaccuuguuaugcgacaucggggagagcuccccuaacccuacuauagaagagggccggacacugcgcguucucaagaugguggaacccuggcugcgcgggaaccaguucugcauaaagauccugaacccuuauaugcccucuguggucgagacuuuggagcagaugcagcgcaagcauggcggaaugcuugugcggaacccccugucccggaacucuacgcacgagauguacuggguaucuugugggacugguaacaucgucagcgccguuaacaugacaucgaggaugcuccucaaccgguucacaauggcucaccgcaagcccaccuacgaacgggacguagaccugggugcggggacccgacacgucgccgucgagcccgagguggccaaccuggacaucauaggccagcguauugagaacauaaaacacgagcacaagucuaccuggcacuacgacgaggacaaucccuacaaaaccugggcguaccauggguccuaugagguaaagcccucuggcagcgcguccucuauggugaacggcgucgugaagcugcugaccaagcccugggacgugaucccgauggucacccaaauugcaaugacugauacgacccccuuuggccagcaacgcguauuuaaggagaagguggacacccguacccccaaggccaaacgcgggacggcccaaaucauggaggucaccgccaaguggcuuuggggcuuccuuucacggaacaaaaagccccgcaucugcacccgagaggaguuuacacgcaaagugcguagcaacgccgccaucggcgccguguucgucgacgaaaaccaguggaacuccgccaaggaagccguggaggacgagcgcuucugggaccuggugcaccgggagcgcgagcuccacaagcaggggaaaugcgccacaugcgucuacaacaugauggguaagcgggaaaagaaguuaggggaguucggcaaagcgaaggggagccgggccaucugguacauguggcugggcgcccgguuccucgaguucgaggcgcucggguuuaugaacgaggaccacugguucucccgugagaacagccuguccggggucgagggcgagggcuugcacaagcugggcuauauucugcgggauaucagcaaaaucccuggagggaacauguacgccgacgacaccgccgguugggacacccgcaucaccgaggaugaccuccagaacgaggcuaagauaaccgauaucauggagccugaacacgcgcugcuggcgaaguccaucuucaagcucaccuaucagaacaaggugguacgcguccagcggccagccaagaacgggaccgucauggacgucauuagccgccgcgaccagcgcgguuccggccaggugggcaccuacggccugaacacguucaccaacauggaggcccaacugaucagacagauggagagcgaggggaucuucuccccauccgagcuugagacacccaaccuggccggccgcguacuggauuggcuagagaagcaugggguugaacggcugaagcgcauggcgaucuccggugacgacugcguugugaagcccaucgacgaccguuucgcuaccgcccugacggcacucaacgacauggggaagguccgcaaagauaucccccaaugggagccgagcaagggcuggaacgacuggcagcagguaccuuuuugcucacaccacuuccaucagcugaucaugaaagauggcagagagaucguggucccuugccgcaaucaagacgagcugguggggcgggcccguguuucccaaggggccggguggucucuccgggagacggcuugccugggcaaguccuacgcacaaauguggcaauuaauguauuuucaccgccgggaccuccgccucgccgcaaacgcgaucugcagcgccguuccaguggacuggguuccgacgucccgaaccacguggucuauccacgcucaccaccaguggaugaccaccgaggauauguuguccgucuggaaccguguauggauagaggagaaccccuggauggaggacaagacccacguguccuccugggaggacguccccuaccuggggaagcgggaggaccaguggugcgguucccugauuggccugacggcccgggccacgugggcaaccaacauccagguggccauaaaccaagugcgccgcuuacugggaaacgaaaacuacuuagacuauaugacuuccaugaagcgcuucaagaacgaaagcgacccugagggcgcacucugguaa

SEQ ID NO: 24605 - RNA, 9879 nt, Artificial Sequence
  derived and/or modified CDS sequence (opt11) from DENV-1__EU482539__SS-prME
ucggugaccaugcugcucauguuaaugccaaccgcccuugcauuucaccucaccacccggggcggggagccucacaugaucguaucuaagcaggagcggggcaagagcuugcuguucaagacgagcgccggggugaacauguguaccuuaaucgccauggacuugggcgagcugugcgaggacacaaugaccuacaagugcccacggaucaccgagaccgagccugacgacgucgacugcuggugcaaugccacggacaccuggguaaccuacgggaccugcagccagacgggcgagcaccggcgcgacaagcgguccguggcccucgcgccccacgugggcuuagggcuggagacccgaaccgagaccuggaugagcuccgagggagcguggaagcagauccagcggguggaaacgugggccuugcgccaccccggauuuaccgugaucgcccuguuccuggcacacgcgaucgggaccagcaucacccagaaggggaucaucuucauccuccugaugcuggugacgcccucaauggccaugcgaugcgucggcaucgggucccgcgauuucguggaggggcucuccggcgcuacuuggguggacgucgugcuggagcacggaagcugcgugaccacuauggccaaggauaagcccacgcuagacaucgagcuccugaagacggaggucaccaaccccgcaguccugcggaagcucugcaucgaagcgaagaucuccaacaccacgaccgacagccgcugcccgacacagggcgaggcuacucugguggaggagcaggacgccaacuucguaugccggcgcacguucguggaccggggcugggggaacggcugcgggcuguucggcaaggggucccucaucacgugcgccaaauucaagugcgugaccaagcuggagggcaagauaguccaguacgagaaccuaaaauauagcguuaucgugaccguccacacgggcgaccagcaccagguggggaacgagaguaccgagcacggcaccaccgccaccaucacuccccaggcgcccaccaccgagauccagcucacggacuacggggcccuuacccuggacugcagcccccgcaccggccuagacuucaacgaaaugguccugcugacaaugaaagagaaguccuggcuggugcacaaacaaugguuccuggaccugccccuccccuggaccagcggggccagcacgucccaagaaaccuggaaccggcaggaccuacuggugaccuucaagaccgcgcacgccaagaagcaagaggucgugguguuaggcagccaggagggagcgaugcacacagcccugaccggugccacugaaauccagacuucuggcacgacuaccaucuucgccgggcaccugaagugucgccucaagauggacaagcugacccugaagggcaugagcuaugucaugugcacgggguccuucaagcuggagaaggagguggccgagacccagcacggcacagugcugguccagauuaaguacgaggguaccgacgcgccaugcaagauccccuucagcacccaagaugaaaagggggugacccagaaugggcggcugaucaccgccaauccgauagugaccgacaaggagaagccggucaacaucgaggccgagccgccuuucggggaauccuacaucgugaucggcgcaggcgagaaggcgcugaaacucagcugguuuaagaaaggguccagcaucggcaaaauguuugaggccacggcccgcggggcccggcgcauggccauccugggcgacacagccugggacuucggauccaucggcggcguguucaccagcguagggaaacugguacaccagaucuucggcaccgcguacggggucuuguucuccggcgucagcuggacgaugaagaucgggaucggcguacugcugaccuggcuuggccugaacuccaggucuaccuccuugucaaugaccugcaucgccguuggguuagucacgcuguaccugggcgugauggugcaggccgauuccgggugcgucaucaacuggaagggucgggagcucaagugcggaagcggcaucuucgugaccaacgagguacacaccuggaccgaacaguacaaguuucaggccgacagcccgaagcgcuuauccgcggccaucgguaaggccugggaggagggcgucugcgguauccggagugccacccgccuggagaacaucauguggaagcagaucuccaacgagcucaaucauauccuauuagagaaugacaugaaguuuacggugguggucggggacguugccggcauucucgcgcaggggaagaagaugauccggccccagcccauggaguacaaauacagcuggaaguccuggggcaaggcaaaaaucaucggcgccgaugugcagaacaccacuuucaucaucgaugggcccaacaccccggagugccccgacgaccagcgcgccuggaacaucugggaggucgaagacuacggcuucgggaucuucacaaccaacaucuggcugaagcuccgggacagcuacacccaggugugcgaccacagacucauguccgcugcuauuaaggacagcaaggccgugcacgcagacaugggcuacuggaucgaguccgagaaaaacgagaccuggaagcuggcccgggcgagcuucaucgaggucaaaacgugcaucuggcccaagucccauacccuguggagcaacggcguguuagaguccgagaugaucaucccuaagaucuaugggggcccuaucagccagcacaacuaccgccccggguacuucacccagaccgccggccccuggcaucugggaaaacuggaguuggacuucgaccugugcgagggcacgaccguggugguggaugaacacuguggcaaccgugguccgucccugaggaccaccacggugaccggcaagaucauccacgaguggugcugccgcuccugcacccugccuccccuccgcuuccgcggagaggacggcugcugguaugggauggaaauacgccccgucaaggagaaggaagagaaccugguuaaguccauggugucugccggcagcggcgaggucgacuccuucagcuuagggcugcugugcaucuccaucaugaucgaggaggucaugcggagccgcuggucccggaagaugcucaugaccggcacgcuggccguguucuuccugcucaucaugggacagcugacuuggaacgaucugaucaggcucugcaucauggucggcgccaacgcgucugaccgcauggggaugggcaccaccuaccuggcccugauggcaacguucaagaugcggccgauguucgcgguugggcuccuguuccgacggcucaccucccgugagguacuccugcugaccaucggccucagccuggucgccuccguggaacugcccaacucacucgaagaacuaggcgacggguuagcgaugggaauuaugaucuuaaagcugcugacggacuuccagucgcaccaacucugggccacgcugcugagccucaccuucauuaagaccaccuucucccugcacuaugccuggaagacuauggccaugguucugagcaucguguccuuguucccccugugucugagcaccacuucccagaaaaccacguggcuccccgugcugcugggcagccucgggugcaagccgcuaaccauguucuugaucgcggagaacaaaauauggggccggcgcucguggccccucaacgaggguaucauggccgucggcaucgugagcauacugcugagcucccuccugaagaaugacgugccccucgccgggcccuuaauagccggagguaugcugaucgccugcuacguuaucagcgggucgagcgcggaccugucccucgagaaggccgccgaggugagcugggaggaggaggcagagcacuccggcgccucccacaauauccugguggagguccaggacgacgggaccaugaagaucaaggacgaggagcgggacgacacccuaacaauccuccugaaggcgacguugcucgccguguccggaguguacccgcugaguauacccgccacccuauucgucugguacuucuggcagaagaagaagcagcgcuccggggugcucugggacaccccuagcccgcccgagguggggcgggccguacucgacgacggcauauaccggauaaugcagcggggacugcugggccggucccaggugggggugggcgucuuccaggagaacguauuucacaccauguggcacgugacgcgcggggccguacucauguaccagggcaagcgacuggagccuuccugggcguccgugaagaaggaccugauaagcuacggcgggggcuggcggcuccagggguccuggaacaccggcgaggaggugcaggucauugcgguagagcccgggaagaacccuaagaacgugcagacugcgccaggcaccuucaagacgccggagggcgaggucggggccaucgcccuagacuucaaacccggcacaagugggagucccauagugaaucgcgaggggaagaucguaggccuauacgguaacggcguggugacgaccucugggacauacgugagcgcgaucgcccaggccaaggccucccaagagggcccacuccccgagaucgaggacgaagucuuccggaagcgcaaccugaccaucauggaccugcaccccgggagcggcaagacacggcgcuaccucccggcgaucgugcgggaggccaucaagcgcaaguugcgaacccugauccucgcccccacgcggguggucgccuccgagauggccgaggcgcugaagggcaugccaauccgcuaccagaccaccgccgucaagagugagcacaccgggaaggaaaucguugaccugaugugucacgcuacguucaccaugcggcuccuaucccccguccgcgugccgaacuacaacaugaucaucauggacgaggcacauuucaccgaccccagcucaaucgccgcacggggcuacaucagcacccgcgucgggaugggcgaggcugccgccaucuucaugacggccacgccgcccgguuccguugaggccuucccgcagagcaacgccguaauccaggacgaggaacgggacauccccgagcgcuccuggaacagcggcuacgaauggaucaccgacuucccgggcaagaccgugugguuuguccccuccaucaagagcggcaacgacaucgccaacugccugcggaagaauggcaagcgcguaauccagcucucccggaagacguuugacacugaguaucagaagaccaagaacaacgacugggacuauguugucaccacggacaucagcgaaaugggggccaacuuccgcgcggaccgggugaucgacccacgccgaugucugaaacccgugauccugaaggacggccccgagcgcgucauccucgccgggcccaugccggucaccgucgccuccgccgcccagcggcgcggccggaucggccgcaaucacaacaaggagggggaccaguacaucuacaugggccagcccuugaacaacgacgaggaccacgcgcacuggaccgaggccaagaugcugcucgacaacaucaauaccccagaggguaucaucccagcccuguucgagccggaacgcgagaaauccgccgcgaucgacggugaguacagacugcgcggagaggcgcggaagacguuuguggagcucaugcgccggggcgaccugcccguguggcuguccuacaaagucgccagcgaaggcuuccaguacucugaccgccgguggugcuucgacggggagcgcaauaaccaggucuuggaggagaacauggacguggagauuuggaccaaggagggagagaggaaaaagcugagaccacgguggcuggacgcccgcaccuacuccgacccccucgcauuacgggaguuuaaggaguucgccgcggggcggcggagcgucuccggcgaccugauccucgagaucggcaagcugccgcagcaccuaacgcagagggcccagaacgcccuugacaaccuugugaugcugcacaacagcgaacagggcgggcgggccuaucgccacgcgauggaggaacuccccgacacuaucgagacccugauguuacuggcccugauagccgugcugaccgguggcgucacccucuucuuccuguccgggcggggauuaggcaagacaagcaucgggcuccuuugcgugauggcgucgagcgugcugcucuggauggcuucugucgaaccccacuggaucgcggccagcauuauucuggaguucuuccugauggugcuccugauccccgagccggaccgacagcggacuccccaagacaaccagcucgccuacguggucaucggccuccuguucaugauccugaccgucgccgccaaugagaugggauugcuggaaaccaccaaaaaggaccugggcaucgggcacguggcggucgagaaccaccaccacgccgccaugcucgacguggaccugcaccccgccuccgccuggacgcuguacgcgguagccaccacgauaaucaccccgaugaugcgccacacgaucgagaacacaacagcuaacaucagccucacggccaucgccaaccaggcggccauccugaugggccuggacaagggcuggcccaucuccaagauggauaucggggucccccuccuggcccuuggcugcuacagccaggugaacccucucacgcugaccgccgcgguccugaugcucgucgcccacuacgccaucaucgggccgggguugcaggccaaggccacccgcgaggcgcagaagcggaccgccgcugggaucaugaagaacccaacaguggacggcaucguagccaucgaccuggaccccgucguguacgacgccaaguucgagaagcagcucggccaaaucauguugcugauccuuugcacccugcagauccugcucaugcgcaccaccugggcgcugugcgaguccauaacgcuggccaccgguccccucaccacacugugggagggcagccccggcaaguucuggaacacaacaauugcgguuuccauggccaacaucuuccgcgggagcuaucuggccggugcagggcucgccuucucccugaugaagucccugggcgguggccgccgggggacgggcgcccagggcgagacccucggggagaaguggaagcgccagcugaaccagcuauccaaguccgaguucaacacguacaagcggagcggcaucauggaagucgaccgcuccgaggcgaaggagggucucaagcggggcgaaaccaccaagcacgcggugagccgcgggaccgccaagcugcggugguucguggagcgcaacuuggucaaacccgagggcaaggugaucgaccugggaugcgggcggggcgggugguccuacuacugcgccgggcuuaagaaggugacggagguuaagggguacaccaagggcggccccgggcacgaggagccuaucccgauggcaaccuacggcuggaaccuggugaaacugcauucggggaaggauguuuucuucaucccgcccgagaaaugugacacccuccucugcgauauuggcgaguccagcccgaauccgacgaucgaggaggggcgcacuuuaaggguccucaagaugguggagcccuggcugcggggcaaccaguuuugcauaaagauccugaaccccuacaugcccuccguggucgagacccucgagcagaugcagcggaagcacggcgggaugcuggugcgcaacccacugagccggaacuccacccacgagauguacugggugagcugcggcaccgggaacaucgucucagccgugaacaugacgagccgcaugcuccugaaccgcuucacgauggcgcaccggaagcccaccuacgagcgcgacguggaccugggagccggcacccggcacgucgccguggagccagagguggccaaccuagacauuaucgggcagcgcaucgagaauaucaagcacgagcacaaguccacguggcacuacgacgaggacaaccccuacaagaccugggccuaccauggcagcuacgagguuaagccgucagguagcgcguccucaauggugaacggcgucgugaagcugcugaccaagcccugggacguaauccccauggucacccaaaucgccaugacggacaccacccccuucgggcagcagcggguguucaaggagaaaguggauaccaggacgccgaaagcgaagcggggaaccgcgcagaucauggaggucacggccaaguggcucugggguuuccugagccgcaacaagaagccgcggaucugcacccgcgaagaguucacccggaaggugcgcuccaacgcggccaucggggccguauucgucgacgaaaaccaguggaacagcgccaaggaggcgguggaggaugagcgguucugggaccuagugcaucgcgagcgggagcuccacaaacagggcaaaugcgcgaccugcgucuacaacaugaugggaaagcgcgagaagaagcugggggaguucggcaaggccaaaggcucccgggccaucugguacauguggcugggcgcccgcuuccucgaguucgaggcgcugggguucaugaacgaggaccacugguucagccgggagaacucucugagcggcguggagggggagggccuccacaaguuaggguacauccuccgcgacaucuccaacauucccggcggcaacauguacgccgacgacaccgccgguugggacacccggaucacggaggacgaccuccagaacgaggcccgcaucaccgacaucauggagccggaacacgcacugcuggcuaaaagcaucuucaaacucaccuaccaaaacaagguggugcgcgugcagcggcccgccaagaacggcaccguuauggaugucaucagcaggcgggaccagcgcgggagcggccaggugggcacguacggccuaaacaccuucaccaauauggaggcucagcugauucggcagauggaaucggagggcauuuuuagccccuccgagcucgagacccccaaccuggccgagcgggugcuggauuggcucgagaaguacggggucgagcggcugaagcgcauggccaucucuggcgacgacugcguggugaagccgaucgacgaccgguucgcgacggcccugaccgcccuaaacgacauggggaagguccgcaaggacaucccucaaugggagcccucgaagggcuggaacgacuggcagcagguccccuucugcagccaccacuuucaccagcugaucaugaaggacggccgggagaucguggucccgugccgcaaccaggaugagcugguggggcgggcccgcgugucccagggggccggguggagccuccgggagaccgcgugucuggguaagagcuacgcacagauguggcagcuaauguacuuccaccgccgggaccuccgccuggccgccaacgcgaucugcuccgcaguccccguggacuggauccccaccagccggaccaccugguccauccacgcccaucaucaguggaugaccaccgaggacaugcugagcguguggaaccgcgucuggaucgaggagaaccccuggauggaggacaagacgcacauauccagcuggggcgacgugccguaccucggaaaacgagaggaucaguggugcggcucccugaucgggcugaccgcccgggccaccugggcgaccaauauccaggucgccaucaaccaggucaggcggcucauuggcaaugagaacuaccuggacuacaugaccagcaugaagcguuuuaagaacgaguccgaccccgagggggcccuaugguga

SEQ ID NO: 24606 - RNA, 9879 nt, Artificial Sequence
  derived and/or modified CDS sequence (opt11) from DENV-1__KP188539__SS-prME
agcgucaccaugcugcucaugcuucugcccaccgcccucgccuuccaccugaccacgcggggcggagagccccacaugaucgugucgaagcaggaacggggcaagagccuacuguucaagaccagcgucgguguaaacaugugcaccuuaaucgcgauggaccugggugagcucugcgaggacacgaugaccuacaagugcccccggauuaccgaggccgagcccgacgacguggacuguuggugcaaugcaaccgacaccugggugacauacgggaccugcagccagaccggcgagcaccggcgcgacaagcggucuguagcccuggcaccgcacguaggccuggggcucgagacccguacugagaccuggaugagcagcgagggcgccuggaagcaaauccagaagguggagaccugggccuugcggcacccgggguucacggugaucgcccuguuccucgcacacgcgaucgggaccagcaucacccagaaggggaucaucuuuauucugcugaugcucgucacccccuccauggccaugcgcugcgugggcauuggcaaucgggacuucguggagggacugagcggugccacuugggucgacguggugcuggagcacgguuccugcgucaccaccauggccaaaaacaagcccacccucgauaucgagcuacugaaaacugaggugaccaauccggccgugcuccgcaagcugugcaucgaggcaaagauuagcaacacaacaacggauucccggugcccgacacagggcgaggccacccuugucgaagagcaggacgcaaacuucgugugccgacggaccuucguggaccgcgggugggggaauggcugcggccucuucggcaaggguucucugcugacgugcgccaaguucaagugcgucacgaagcucgagggaaagaucgugcaguacgagaaccugaaguacuccgugaucgucaccgugcacaccggugaccagcaccaggucgggaaugagacgaccgagcauggcaccaucgccaucaucaccccgcaggcgcccaccagcgagauccaacugacggacuacggggcccucacacuagacugcagcccccggaccggccuggacuucaacgaaaugguguugcugaccaugaaggagaaguccuggcuagugcacaagcagugguuccucgaccugccgcugcccuggacguccggggcaagcaccagucaggagaccuggaaccgccaggaccuccuggucaccuucaagacggcccaugccaagaagcaggaaguagugguacugggcucccaggaaggcgcgaugcauaccgcccucaccggggccaccgagauccagacaaguggcacuaccaccaucuucgccgggcaccugaaaugccggcugaaaauggauaagcucacgcugaagggcauguccuacgugaugugcaccgggucguucaagcuggagaaggagguggccgagacccagcacggcaccguccugguccagguaaaguacgaaggcacggacgcgcccugcaagauccccuuuuuaacccaagacgagaagggugucacccagaauggucgccugaucaccgccaacccgaucgugacggacaaggagaagcccgugaacaucgaaaccgaaccgccguucggggaguccuauaucgucguaggcgcuggcgagaaggcacugaagcucagcugguucaaaaagggauccagcaucggcaagauguuugaagcgaccgcccgcggggcccgccggauggccauccuuggcgacaccgccugggacuucgggagcaucggcggccuguucacgagcguggggaagcucauccaccagguuuucggaaccgcguacggggugcuguucuccggcgugagcuggaccaugaagauugggaucggcauccuccuuaccuggcuggggcugaacuccaggagcacgucccucagcaugacgugcaucgccgucggcauggucacccuguaccucggcguaaugguucaggccgacuccgggugcgugaucaauuggaagggccgcgaguuaaagugcgggagcggcaucuucgugacgaacgagguacacacguggaccgagcaguacaaguuccaagccgacuccccgaaacggcucagcgccgcgaucggcaaggccugggaagagggggugugcggcaucaggagugcuacccggcuggagaacaucauguggaagcagaucucaaacgagcucaacuauauccugcuggagaacgacaugaaguucaccguggucgugggggacgugaacggcauacucgcccaggggaagaagaugauccgcccccagcccauggagcacaaguacagcuggaaguccuggggcaaagcgaagaucauuggcgcggacauccagaacaccacuuucaucaucgacgggcccgacacccccgaauguccugacgaccagcgggcguggaacaucugggagguggaggacuauggcuucgggaucuucacaaccaacaucuggcugaaacugcgcgacagucacacgcagaugugcgaccaccgguugauguccgccgccaucaaggacagcaaggcggugcacgccgauaugggauacuggauagaauccgagaagaacgagaccuggaaguuggcacgcgccagcuucaucgaggugaagaccugcaucuggcccaaaucccacacccuguggagcaacggaguccucgaguccgagaugguuauccccaagaucuaugggggcccaaucucgcagcacaacuaccggcccgguuacuucacgcagaccgccggccccuggcaucuggggaagcuggagcucgauuucgaccugugcgagggcacaaccgugguuguggacgagcacugcggcuaccgcgggccgagucugcgaacgacuacggugaccggaaagaucauccacgaauggugcugccgcagcugcacgcugccgccccugcgguuucgcggggaggacggaugcugguacgggauggagauccggcccgucaaggagaaggaagaaaaccuggugcgauccauggugagcgcgggcuccggcgagauggacagcuuuagccucgggauucucugcgucuccauccugaucgaggaggugaugcggagccgcuggucccggaaaaugcucaugaccggcacccucgccguguuccuuuuacuaaucauggggcagcuaaccuggaacgaccucauucgacuguguaucauggucggcgccaacgccagcgaccguauggggaugggcacaaccuacuuagcccucauggcgaccuuuaagaugcggccaauguucgccgugggccugcuguuccggaggcucaccucccgcgaggugcugcugcucacagucgggcugagcuugguggccuccgucgagcuccccaacagccuugaggagcugggcgacgggcucgccaugggcaucaugaugcugaagcugcucaccgacuuccagccgcaucagcuguggaccacgcugcucucacugacguucauucggacuucccugucccucgacuacgcauggaagaccauggccauggcacugagcauugugucccuguucccucucugccuaagcaccacgucccagaaaacuaccuggcugccugugcuacugggcagcuuugggugcaagccccugacaauguuucucaucacggagaacaagauuuggggccgcaaguccuggcccaucaacgaggggaucauggccgucggcaucgugucgauccugcugaguagccuauugaaggacgaugugccccuggccgggccgcucaucgcaggaggcaugcugaucgccugcuacguaaucagcggguccagcgcugaccuuucacucgagaaggccgccgaggugagcugggaggaagaggcggaacacuccggcaccagccacaauauccugguggagguccaggacgacgggacaaugaagaucaaggacgaggagcgggacgauacccugaccauccugcugaaggccacgcugcucgcgguuuccggcguguaccccaugagcauccccgccacccuguucgucugguacuucuggcagaagaagaagcagcgcucuggggugcugugggauacccccagcccgcccgagguggagcgggccguccuggacgacggcaucuaccguauccuacagcgggggcugcuggggcgcucccaggugggcguggggguuuuccaggacggaguguuccacacaauguggcacgugacccgcggggcggucuugauguaccagggcaagcggcuggagcccagcugggccagugucaaaaaggaccugauaagcuacggugggggcuggcgguuccagggauccuggaacaccggcgaggaggugcaggucaucgccguggagcccgggaagaacccaaaaaacgugcagaccaccccugggacguucaaaacccccgagggcgagguuggggccaucgcccucgacuucaagcccggcaccagcggguccccgaucgugaaccgcgaagguaaaaucgugggccuguacgggaacggcguggugaccacgagcgggaccuacguguccgcgaucgcccaggccaaggcuacucaggaggggccccugcccgagaucgaggacgaggucuucaagaagcggaaccucacaaucauggaccugcacccggggagcggcaagacgcgccgguaccugcccgccaucgugcgcgaggcgaucaaacggaagcuccgcacacugauccuggccccaacccguguggucgcgucggagauggccgaggcgcucaagggcaugccgauccgguaccagaccacggccgugaagucggagcacaccgggcgugagaucguggaccucaugugccacgcgacguucaccaugcggcugcucucuccgguccgcguucccaacuacaacaugauaaucauggacgaggcccacuucacggaccccgccuccaucgcugcccggggcuacaucagcacccgcgucgggaugggggaggccgccgccauuuucaugaccgcgacgccacccggguccguggaagcauucccccagagcaacgcagugauccaggaugaggagcgggauauccccgagcgcuccuggaacagcggauacgacuggaucacggacuucccgggcaagaccgugugguucguacccucaaucaagucugggaacgacaucgcaaacugccugcggaagaaugggaagcgcgucauccagcugucccggaagacguucgacaccgaguaccagaagaccaagaacaacgacugggacuacguggucaccaccgacauaagcgagaugggggccaacuuccgcgccgaccgagugaucgauccgcgccggugccucaagcccgugauccugaaggagggccccgagcgcgugauccuggcggggccaaugcccgugaccgucgcuuccgccgcacagcggaggggccggaucggccgcaaccaaaacaaagagggggaucaguacauauacaugggccagccacucaacaacgacgaggaccaugcgcacuggacggaggccaagaugcuacuugacaacaucaacacccccgaggguaucaucccggcccucuucgagcccgagcgcgagaaauccgccgcgaucgacggcgaguaccgucuucgcggggaagcccgcaagaccuuuguggagcugaugcgucggggcgaccuccccguguggcuauccuacaaggucgccagcgagggcuuucaguacuccgaccgacggugguguuucgacggggagcgcaacaaccaggugcuggaggagaauauggacguggagaucuggaccaaggagggcgagagaaagaagcuccgcccccgguggcuggacgcccgcacguacagcgacccgcuggcucucagagaguuuaaggaguuugcggccggacgccgguccgucucuagcgacuugauccuggagaucggcaaacuuccccagcaccugacgcugcgcgcccagaacgcucucgacaaccuggugaugcugcacaauuccgagcagggcgggaaagccuaucggcacgcgauggaggagcuccccgacaccaucgaaacccugaugcugcucgcucugaucgcagugcugaccggcggggucacccuuuucuuccugagcggcaaggggcugggcaagaccuccaucggccucuuaugcgugauggccagcuccgcucugcuguggauggccagcguagagccccacuggaucgccgcauccaucauacuggaguucuuccugaugguccuccugauaccggagcccgaccgccagagaacgccgcaggacaaccagcuggccuacguggugauagggcuccuguucaugaucuugacuguugccgccaacgagaugggccuccuggagacgacaaagaaggaucugggcaucggacacguggccguggagaaccaccaccacgcaaccaugcucgacgucgaccugcgcccggcuagcgcguggacccucuacgccguggccacgaccguaaucacccccaugaugcgucacaccaucgagaacacgaccgccaacaucucccucaccgccaucgcgaaucaggccgcuauccugaugggccuugacaagggguggcccaucaguaagauggacaucggcgucccccuccuggcccugggaugcuauucccaggugaaccccuuaacccugacggccgcggugcugaugcuugucgcccauuacgccaucaucggccccgggcugcaggcgaaggcgacccgcgaggcccagaaacgcaccgcggccggcaucaugaagaaccccacgguggacgggaucgugaccaucgaccuggacccgguuguguacgacgccaaguucgagaagcagcucggccagaucaugcugcugauccucuguaccagccagaucuugcugaugagaaccacgugggcgcuaugugaguccaucacgcuggccaccggaccucucacaacacucugggaggggaguccaggcaaguucuggaauacgaccaucgccguguccauggccaacaucuuccgcggcuccuaucuggccggcgcgggccuggccuucucccucaugaagucccucggcggcgggcggcgcgggaccggggcccagggcgagacccugggagagaaguggaaacggcagcucaaccagcucaguaagagcgaguucaacacguacaagaaguccgguaucauggaagucgaccgcagugaggccaaggagggccugaagcgcggggagaccaccaagcacgccgugagccgugggaccgcgaaacugcggugguucguggaacgcaaccucgucaagcccgaggggaagguaaucgaccugggcugcggccgcggugguugguccuacuacugcgcggggcugaagaaagucacggaggucaaaggguacaccaagggcgggcccggccacgaggagccgauccccauggccacauacggauggaaccucgugaaguugcacagcggcaaggacguguucuucacuccgcccgagaagugcgacacccuguugugugacaucggggaguccagcccgaaucccacgaucgaggaaggccgcacccugcggguucuaaagaugguggagcccuggcuccgcggcaaccaguucugcaucaagauccugaaucccuauaugccgucaguggucgagacacuggagcagaugcagaggaagcacggcggcaugcucgugcgaaacccccugagccggaacuccacccacgagauguacugggugagcugcgggacgggcaacaucgucuccgccgugaacaugaccagccgaaugcugcucaacagauucacaauggcgcaccgcaagcccacguacgagcgagacguggaccugggggccgggacucggcacgucgcgguggaacccgaggucgcaaaccuggacauaaucggccagcgcaucgagaacaucaaaaacgagcauaaguccaccuggcacuacgaugaggacaacccguacaaaacaugggccuaccacgggagcuacgaggucaagcccuccggcagcgcguccagcauggugaauggagucguacggcuccugaccaagcccugggacgugauccccauggucacgcagaucgccaugaccgacacgaccccguucggccaacagcggguauucaaggagaaaguggacacgcggaccccccgggccaagcgugggaccgcccagauaauggaggucaccgccaaguggcuauggggcuuccucucgcgcacgaagaaaccccggaucuguacccgggaggaguucacacguaaaguucgcagcaacgcggccaucggcgccguguucgucgacgagaaccaguggaacuccgccaaggaggccguugaggacgagcgguucugggaccuggugcaccgcgagcgggagcugcauaaacaggggaagugcgcgacaugcguauacaacaugaugggcaagagagagaagaagcucggggaguucggcaaggccaaggggucccgggccaucugguacauguggcugggcgcccgcuuccuagaguuugaggccuugggcuucaugaacgaggaccauugguucucacgggagaacucucuaucagggguagagggagaggggcugcacaaacuagguuacauccugcgcgacauuuccaagauccccggcgggaauauguaugccgacgacacggcgggaugggacacgcggaucacggaggacgaccugcagaacgaggccaagaucaccgacaucauggagcccgagcacgcccuccuggcgacgagcaucuucaagcugacuuaccagaacaaggugguccgcguacagcgccccgccaaauccgggaccgucauggacgucaucagccggcgcgaccagcggggcucaggccagguuggcaccuacggcuugaacacguucaccaacauggaggugcagcugauacgccagauggagagcgaggggauuuucucccccagugagcuggagaccccgaaccuugccaagaagguccuggacuggcuggagaagcauggcgccgaacggcucaagagaauggccaucuccggugacgacugcguggugaagcccaucgacgaccgguuugcuaccgcucugacggcccugaacgacaugggaaagguccgcaaggacauaccccagugggaacccagcaagggauggaacgacuggcagcagguuccguucugcucccaccacuuccaccaguuaaucaugaaggacggccgggagaucgugguccccugccgcaaccaggacgagcuggugggcagagcucgggugucacagggggccggcuggagccugcgggagacugcgugccucggcaagagcuacgcccagauguggcagcugauguacuuccaccgccgggaucugcgcuuggcagccaacgccaucugcagcgcggucccaguugacuggguccccacgucccggaccaccuggucaauucacgcccaccaccaguggaugacgaccgaggacaugcuguccguguggaaccgcguguggaucgaggaaaauccguggauggaagacaagacccacgugagcuccugggaggaggugccauacuuaggcaagcgggaggaccaguggugcgggagcuugaucggccugaccgcccgcgccacgugggcgaccaacauccaggucgccaucaaucaggugcgccgguuaauaggcaacgagaacuaccucgacuacaugacguccaugaagcgcuucaagaacgagagcgaccccgagggagcccugugguaa

SEQ ID NO: 24607 - RNA, 9879 nt, Artificial Sequence
  derived and/or modified CDS sequence (opt11) from DENV-1__KP188540__SS-prME
ucugugacuaugcuucucaugcugcugccaaccgcgcucgcuuuccaucugaccacccgcgguggggagccccacaugaucguaucgaagcaagagcggggcaagagccuccuauuuaagaccagcgcgggcguuaauaugugcacgcuaaucgcaauggaccugggcgagcucugcgaagacacgaugacauacaagugcccccgcauuacugaagcagagcccgacgauguagacugcugguguaacgcuaccgauaccugggucacuuacgggacaugcagccaaacaggcgagcaccgucgugagaagagauccguagccuuagcgccccaugugggccuggggcuggagacccgcacugaaacuuggaugagcucggagggcgccuggaaacagauccagcgggucgagacaugggcccucaggcacccuggguucacugugaucgccuucuuccuggcgcacgccauaggcaccagcauaacccaaaaagggaucauuuucauacugcuuaugcuggugacccccuccauggccaugcggugugucggcaucgggaaccgcgacuucguggagggucucuccggugccacguggguggacguaguguuagagcacggguccugcgugacuaccauggcuaagaacaaacccacccuggacaucgagcuucugaaaacggaggucaccaaccccgcagugcucaggaagcucugcaucgaagccaaaauaaguaacaccaccacggacuccaggugccccacccagggcgaggccacccuuguggaggagcaggacgccaacuuuguaugccggcgcaccuucguagaccgagggugggggaacggcugcgggcuuuuugggaaggggagccuccugacuugcgccaaguucaagugugugaccaagcucgagggcaaaaucguccaguacgagaaccucaaguauuccgugaucguuaccguacauacgggugaucaacaccaaguugggaaugaaaccaccgagcacgggaccaucgcgaccaucacgccccaggcgcccacgagcgagauccaguugaccgacuacggggcccugacccuagacugcucaccccggaccggacucgacuucaacgaaaugguccucuugacgaugaaggaaaagagcuggcucgugcacaagcagugguuccuggaccugccgcugcccuggacgagcggggccagcacuagccaggagacauggaaccggcaagaccugcucgugacguucaagaccgcgcacgcgaagaagcaagagguggucguucugggcucacaggagggcgccaugcacaccgcccuuacaggagccaccgagauccagaccagcggcacuaccaccaucuuugcaggccaccucaagugccggcuaaagauggacaaauugacccucaagggcaugucauacgucaugugcaccggguccuucaaacuggagaaagagguggcugagacccagcacggcacgguauuaguccaggucaaguacgaggggacugaugcgcccugcaaaauccccuucucaacccaggaugagaagggggugacgcagaacggccggcugaucacugcaaacccgauugucaccgacaaggagaagcccgugaacaucgagacagagccgccguuuggagagucauauaucguagucggagcgggggagaaggcgcucaagcucagcugguucaaacgcggaagcucuaucggcaaaauguucgaggccaccgcuagaggggcgcgccgcauggccauucugggggacacggcgugggacuucggcagcauuggcgggguguucaccuccguggggaaacuuguccaccagguauucgggacugccuacggcguguuauucucgggugucuccuggaccaugaagaucgguaucggcauccugcucacuuggcugggccugaacagccgguccaccagccucuccaugaccugcaucgccguggggauggugacacucuacuuaggcgugauggugcaggccgacagcgggugcgugaucaacuggaagggcagagaauugaagugcggguccgguauauucgucacgaacgaagugcacaccuggaccgagcaguacaaguuccaggccgacagcccgaagcggcugagugcggccauuggcaaggcuugggaggaaggggugugcgguauccgcucugcgacccggcucgagaacauuauguggaaacagaucagcaacgaacuuaaccacauacugcuggaaaacgacaugaaguucacagucgucgugggcgacgcgaacgguauacucgcacaagggaagaagaugauccgcccccagccaauggagcacaaguacagcuggaagucguggggcaaagcaaaaaucaucggcgccgauauccagaacacaaccuucaucaucgacggucccgacacuccagagugucccgacggccagcgggcguggaacaucugggaggucgaggacuauggguucggcguuuucacuacgaacaucuggcugaaacuucgugauuccuauacccagaugugcgaccaccggcucaugucagcugccaucaaagacuccaaggcagugcacgccgacaugggauacuggauugagagcgagaagaaugaaaccuggaaacuggcgagagcguccuucauagaagucaaaaccugcacauggccaaaaagccacacccuauggagcaacgggguacucgagagcgagaugauuauccccaagaucuucggcgggccgaucucucaacauaacuauagaccuggcuacuucacucagaccgccgggccguggcaucugggcaaguuagagcucgauuucgacuuaugcgagggcacgaccgucgucguugacgagcacugcgggaaccgcggcccaagccugcggaccaccacggugaccgggaagaucauccacgaguggugcugccgcuccuguacccugccaccgcuucgguuccgcggagaggacgggugcugguacgggauggagauucggcccgucaaagagaaggaggagaaccugguucgcagcaugguuuccgccggcaguggcgaggucgacuccuucuccuugggcaugcuguguguuagcaucaugaucgaagaggugaugagaucccgcuggagccgcaagaugcugaugaccgggacgcucgccguauuccuccugcucaucaugggacagcugacauggaacgauuugauccggcuuugcaucaugguuggcgccaaugcgagcgaccgcaugggaaugggcaccacauaucuagcccugauggccacuuucaagaugcggccgauguucgccguggggcuccuguuccgccggcucacuagccgagagguucuccugcugaccauaggccucucacuggucgccagcguugagcugcccaauucgcucgaggagcuuggggacggccucgcgaugggcaucaugaugcucaagcugcugaccgaguuccagccgcaccaacucuggaccacccugcuaagccugacauuugugaagaccacccugucccuggacuacgcauggaaaacuacugccauggugcucagcauaguaucccuguucccacugugccugagcaccacgucgcagaagaccaccuggcugccugugcugcucggaucguucggcuguaaaccccugaccauguuucucauuacugagaauaaaauuugggggcggaaguccuggccacuaaacgagggaaucauggcgaucgggaucguuagcauccugcuguccagccuacuuaaaaacgacgucccccuggccggcccauuaaucgccggagggaugcuaaucgccuguuacgugaucagcggcuccuccgcugacuuaucccuagagaaggccgcggaggugagcugggagcaggaagcugaacacuccggugcaagccacaacauccuggucgaggugcaggaugaugggacgaugaagaucaaggacgaggaacgcgaugacacacucaccaucuugcugaaggccacccugcucgccgugucgggugucuaccccaugucaaucccggcgacacuguucgugugguacuucuggcaaaagaagaagcagcgauccggcgugcuaugggauacgccgagcccgccagagguagagcgcgcaguacucgacgacggcauuuacaggauccugcagaggggguuauugggccggagccaggugggggucggagucuuccaggacgggguguuucacaccauguggcacgugacacgcggcgccgucuuaauguaccagggcaagcgguuggagccuagcugggcaucggucaagaaggaucugauuagcuacggaggggguuggagguuucagggcucguggaacacgggagaggagguucaggugaucgccguggagcccggcaagaacccuaaaaauguccagaccacuccggggaccuuuaagacgccugagggggaggugggugcgaucgcccucgauuuuaagcccgggaccagcggcaguccgauugugaaucgggagggcaagaucguagggcuguacgguaacggcgugguaaccaccucgggcacguauguauccgccaucgcacaggccaaagcgagccaggaggggcccuuacccgagauagagaacgagguguucaagaagcgcaaccucaccaucauggaucugcacccgggcagcggcaagacccggcgcuaccugcccgccaucgugcgggaggccaucaaaaggaagcuccguacccugauccuggcccccacgagggucguggcguccgagauggccgaggccuugaagggaaugcccauccgcuaucagaccacugcggucaagagcgaacacaccggccgggagaucgucgaccugaugugucaugccacguucaccaugcgccugcucagcccggugagaguaccuaacuauaauaugaucaucauggacgaggcgcacuucaccgaucccgcaagcaucgcagcccgugguuacauauccacccgcgucggaaugggggaggcggcggccaucuucaugacggccaccccgcccggcucuguggaggcauucccccaguccaacgccgugauccaggaugaagaacgggacauccccgagcggagcuggaacucaggcuacgacuggaucaccgauuuccccggcaagaccgucugguucguacccucgaucaagagcggcaacgacauagcgaacugccuccguaagaacgggaagcgaguaauccagcuuagccgcaagacauuugacacagaguaccagaagaccaagaauaacgauugggacuacgucgucaccacggauaucucggagaugggcgcuaacuuucgggccgaccgggugaucgacccccggcgcugucuaaagccugucauacugaaggacgggccagagcgggugaucuuagccgggccgaugccggucaccguugcuagcgccgcacagcgccggggccgcaucgggcgcaaucagaacaaggagggcgaccaauacguauauauggggcagccgcucaauaacgaugaggaccaugcgcacuggacagaggccaagaugcugcuggacaauaucaacacgccggagggaaucauuccggcccuguucgagcccgagcgggagaaguccgccgccaucgauggggaauaccgcuugcggggcgaggcucgcaagacguucguugagcugaugcggcgcggcgaccuccccguauggcugagcuacaaaguggccucugaaggguuccaguacuccgaccggagauggugcuuugacggugagcgaaacaaccaggugcuggaggagaacauggacguggagaucuggaccaaagagggggaacgcaagaagcuacggccucgcuggcuggacgcgcggaccuacucugacccguuggccuuacgggaguucaaggaguucgccgcgggucggcgcuccgugucgggggaccucauccuggagaucgggaaacuuccacaacaucugacccugcgcgcccaaaacgcgcuagacaaccuuguaaugcugcacaacuccgagcagggcgggaaagcguacaggcacgcaauggaagaacuccccgacacaaucgagacgcugaugcugcuugccuugauagcgguuuugaccggcggggcaaccuuauucuuucugagcggcaagggccuggggaagaccucgauaggccuccuguguguuacagccucaucagcccugcucuggauggcgucaguugagccacacuggaucgcugccucaaucauucuggaguucuuccugaugguguuguugaucccggagcccgaccggcagcggacuccccaggacaaccagcuggccuacguggucauaggacuccuguucaugauccugacgguggccgccaacgagaugggcuugcuggagacaacgaaaaaggaccuggguaucgguuacguggcggccgaaaaccaccagcacgcuaccaugcucgaugucgaucugcacccggccagcgccuggacccuguaugcgguggcaaccacggugaucacccccaugaugcggcacaccaucgagaacaccacggccaacaucucccucacagcgaucgccaaccaggcugccauccugaugggacuggacaagggauggcccauaagcaagauggacaucggcgucccucuccuggccuuagggugcuauucccaggucaauccccugacauugacugccgcaguccugaugcuagucgcccacuacgccaucaucggacccgggcuucaggccaaggcgacgcgcgaggcccagaagcgcaccgccgccggcaucaugaagaaccccaccguggaugguauuguggcgauugaccuggaccccguaguguacgaugccaaguucgagaagcagcucggacagauaauguugcugauccucuguaccagccagauccugcugaugcggacgacuugggcucucugcgaguccauaacccuugccaccggcccucuaacgacucucugggagggguccccgggaaaguuuuggaauaccacuaucgcaguuuccauggccaacaucuuucgcgguucguaucuggccggugcgggacuggccuuuucccuaaugaaaucacucgggggugggcgucgcgggacgggcgcucagggcgagacccuaggcgagaaguggaaacggcaacucaaucaacuguccaagagcgaguuuaacaccuacaagagaucugggauuauggaggucgacagguccgaggccaaggaaggcuugaagcgcggggaaacgacaaagcacgcagugagcagaggaaccgccaaacuccgcugguucguggagcggaaccuggucaagcccgagggcaagguuaucgaccugggguguggccgcgggggcugguccuacuacugugccgggcugaagaaggucacagaggucaagggcuacacuaagggcgggcccggccacgaggagccgaucccaauggcaacauacgguuggaaccugguuaagcugcacagcggcaaggacgucuucuuuaugccucccgaaaaaugcgacacacugcucugcgacaucggggagagcucaccaaaucccacgaucgaggaaggccggacccuucgaguccugaagaugguggagccauggcugcggggcaaucaauucugcaucaagauccugaacccauacaugccgaguguggucgagacacuggagcagaugcagagaaagcacgggggcaugcucguccggaauccucucaguagaaauucuacgcacgagauguacugggucagcugcgguaccggcaacauuguuagugccguuaacaugaccucacggaugcugcugaaccgcuucaccauggcgcaccguaagcccacguaugagcgugacguugauuuaggcgccgggacccgccacgucgcaguggagccugagguggcgaaccuggauauuaucggccagcggaucgagaacauaaagaaugaacacaaguccacuuggcacuaugacgaagacaacccguauaagaccugggcauaccacgggagcuacgaggucaagccaucgggcagcgcguccagcauggugaacggggucguucgccuccugacgaaacccugggacguaauccccauggucacccaaauugcuaugacugacacuacaccguucgggcagcagcggguguucaaggagaagguggacacccgcacaccacgcgcgaagcgcgggaccacucagaucauggagguuaccgccaaauggcuguggggguuccucagccgcaacaagaagccccgcauuugcacccgggaggaguucaccaggaaaguccggagcaacgcugcuaucggagccgucuuugucgaugagaaccaguggaacagcgccaaggaggccguggaggacgagcguuucugggaccuggugcaccgggagcgcgagcugcauaagcaggggaaaugcgcgacgugcguuuacaacaugauggggaaacgggagaagaaguugggggaguucggcaaggcaaaagggucccgcgccauuugguacauguggcugggggcucgguucuuggaguucgaggcgcucggauucaugaacgaagaccacugguucagccgcgaaaacagccugagcgggguggagggcgagggucugcacaagcucggcuacauccugagagacaucuccaagauuccgggcggcaacauguaugcugacgauaccgcaggcugggacacacguaucacagaggacgaccugcagaacgaggccaagauuacggacaucauggagcccgagcaugcccuccuggccacaucaauuuucaaacuuacauaccagaauaaggugguccgcguccaaaggcccgccaagaacgggacgguaauggacgucaucucccgccgggaucaacgcggcagcggacagguggggacuuacggacucaauaccuucaccaauauggaaguacagcuuauacggcagauggaaucggaggggaucuuccugcccagcgagcuagaaacccccaaucuugccgagagagcccuggacuggcuugagaagcacggcgccgagcgccugaagcgaauggccaucuccggggacgacugcgucgugaagccuaucgacgaccgguuugcgacggcucugaccgcucucaacgauaugggcaaaguccgcaaagacauaccacaaugggagccgagcaaaggcuggaaugacuggcagcaggucccguucugcucccaccacuuccaccagcucaucaugaaggaugggcgggagaucguggugccaugucgcaaccaggacgagcuggucggccgggcccgcgugagucagggagccggguggucccuccgggaaaccgccugucugggcaagagcuacgcacagauguggcagcuuauguacuuucaccgccgggaccuccgccuggccgcaaaugccaucugcucagccgugccggucgauugggugccggcaucucggacuacauggagcauccaugcucaccaucaguggaugacaacagaggacaugcugaguguguggaaccgcguguggauugaggagaacccguggauggaggacaaaacccacguuucgagcugggaggaggugcccuaucucggcaagcgcgaagaccaaugguguggcagccugaucgguuuaaccgcccgugcuacaugggccaccaacauacagguugcuaucaaccaggugcgccggcucauuggcaacgaaaacuaccuugacuacaugaccagcaugaagcgauucaaaaacgagagcgacccagagggggcucugugguga

SEQ ID NO: 24608 - RNA, 9879 nt, Artificial Sequence
  derived and/or modified CDS sequence (opt11) from DENV-1__KP188541__SS-prME
ucagugacuaugcugcucaugcuuuugcccacggcacucgccuuucaccugaccacccgcggcggcgagccacacaugaucgugagcaaacaggagaggggcaagagccuccuguuuaaaacuagcgcuggcguaaacauguguacccugaucgcgauggaucugggcgaguugugugaggacacuaugaccuacaaguguccccgcaucaccgaggccgagcccgaugacguugacuguuggugcaacgcuaccgacaccuggguaacuuacggaaccuguagucagaccggcgagcacaggagggagaaacgcuccguggcccuggcgccccaugugggccucgggcucgagacgcgcaccgaaaccuggaugagcuccgaaggcgcauggaagcaaauccagcgcguagagaccugggccuugcgccaccccggauucacggugauagcauuuuuucuggcccaugccauugggacgagcaucacucaaaaggguauuaucuucauccuccuaaugcuggugacccccucaauggccaugcgcugcgugggcaucgguaaccgcgacuucguggagggccuguccggggcaacgugggucgaugucgugcuugagcauggguccugugugacaacaauggccaaaaacaagccgacacuggacauugagcuccugaagacggagguaaccaacccugcggugcuccgaaaguuguguauugaggccaagaucagcaauaccaccacggacucccgcugcccaacccagggagaggccacccugguggaggagcaggacgccaacuucguuugccgacggacuuuuguggaccgcggcugggggaacggcugcgggcuguuuggcaaggggagccuccucacgugugcaaaguucaagugcguuaccaaguuggaggggaagaucguccaguacgagaaccucaaguacuccgugaucguaaccguccauaccggcgaccaacaccagguggggaaugaaacgaccgagcacggcacaauagcgaccaucaccccgcaggcccccaccuccgaaauucagcucaccgacuacggggcgcugaccuuggauuguagcccccggacgggccuggacuucaacgagaugguccuccuuacgaugaaagagaaaucuuggcuggugcacaagcagugguuccuggaccucccgcuucccuggacuaguggggccagcaccagccaggaaacauggaaccggcaagaucugcucgugacguuuaagaccgcccacgcgaagaagcaggaggucguugugcugggcucacaagaaggcgcaaugcacacugccuugaccggggccacggagauccaaacuagcggcaccaccacgaucuucgccggacaccuaaagugucgccugaagauggauaagcugacccuaaaggggaugaguuacgucaugugcacugggaguuucaagcuggaaaaggagguggcagaaacccaacaugggacgguucugguccagguuaaauacgaggguaccgacgcgcccugcaagauaccguucuccacccaagacgagaagggagugacgcagaacggccggcuuaucacugccaacccaauugucacggacaaggagaagccugugaacaucgagaccgagccucccuucggggagagcuacauagucgucggcgccggcgagaaggcgcucaaguuaagcugguucaagagggggagcuccaucggcaagauguuugaagccacugccagaggggcccgccguauggccauccugggugacacugcgugggauuucgggagcaucggcgguguuuucacuagcgugggaaagcucguacaccagguguuuggcacagcauauggggugcuauucagcggcgucucauggacuaugaagaucggaauuggcauccugcucacguggcuggggcugaacucccgcucgaccucacucagcaugacaugcauugccguggggauggugacucuauaccugggagucaugguacaggcggacagcgggugugugaucaacuggaaggguagagagcucaaaugcggguccggcauuuucgucacgaacgaagugcacacuuggaccgagcaguacaaauuccaggcagacagcccgaaacggcugagcgcggcgauaggcaaagccugggaggagggggucugugggauuagaucagccacuagacuggagaacauaauguggaaacaaaucagcaacgagcucaaccauauccuacuggaaaacgacaugaaguucaccgugguggucggggacgcaaacgggauccuagcgcaggggaagaagaugauccgcccccaacccauggagcacaaguacuccuggaaaucauggggaaaggccaagaucaucggcgccgauauccagaacacgacauucaucaucgauggccccgauacgccggaguguccagacgggcagcgagccuggaacauuugggaaguagaggacuacggcuucggcguguuuaccacgaacauuuggcugaagcugcgcgacagcuacacccagaugugcgaucaccggcucaugucugcggccauaaaggacuccaaggccguucaugccgacaugggcuacuggaucgagagcgaaaaaaacgagaccuggaagcuggcucgcgcguccuucaucgaagucaaaacuugcaccuggcccaagagccauacccugugguccaacgggguacucgagagugagaugauaauccccaagaucuucggugggccuaucucgcaacacaacuaccggcccggcuacuuuacccagaccgccgggccguggcaucuggggaagcucgagcucgacuucgaccugugcgagggcacgaccgugguaguugaugaacauugcgggaaucgagggccgucacugcgcaccacaacggugacagggaaaauuauacaugaguggugcugccguucuuguacccugccgccccugcgguuuaggggcgaagacgggugcugguacggcauggagauucggcccguaaaggagaaggaggagaacuuggugcgcagcauggugucugccgguagcggggaggucgauuccuucagucucggcauccugugcgugaguauaaugaucgaggaggugaugaggucucguuggucuagaaagaugcugaugacugggacguuggccgucuucuugcuccucauuauggggcagcugaccuggaaugacuuaauacggcucugcauaauggugggggccaacgcuucugauagaaugggcaugggcaccaccuaucuggccuuaauggccacguucaaaaugcggccaauguucgccgugggcuuguuauuccgacggcuaaccagccgcgagguccuccugcugaccaucggccuaucccugguggccaguguugagcugcccaacagccuagaagagcugggugacggccuggcgaugggcaucaugaugcugaagcugcuuaccgaguuccagccccaccagcucuggaccacccugcuuagccucaccuucgucaagaccacauuaucccuggacuaugcguggaagacaaccgcaauggugcuaaguauagucucgcuguuccccuuaugccucagcaccacgagucagaagaccaccuggcuaccggugcugcucgggucuuucggcugcaagccacuuaccauguucuucaucacagagaacaagaucugggggcggaagaguuggccccugaacgaggggaucauggcaaucggaauugugagcauccuccuguccagccugcuaaagaacgacgucccucuggcuggcccguugaucgccggcgggaugcuaaucgccuguuacgugaucagcggcuccagcgccgacuugucccuggagaaggccgcugaggucagcugggagcaggaagccgaacauucaggugccagccacaauauccucgucgagguacaagacgacggcacaaugaagaucaaggacgaggagcgcgaugacacacugacaauucuguugaaggcuaccuugcuggccguauccgggguuuauccgauguccauccccgcaacucuuuucguuugguacuuuuggcagaagaagaaacagcgaaguggugugcugugggacaccccaagcccaccggaaguagaacgcgccguccuggacgacgguaucuaccggauacuucaacgcgggcugcugggccggucccagguaggggucgguguauuucaggacggcguuuuucauaccauguggcacgucacccgcggggcagugcugauguaccagggcaagcggcucgagcccagcugggcuagugucaagaaagaccugaucagcuaugguggcggcuggcgauuccagggcuccuggaauacuggggaggagguccaggugauagcuguugagcccggcaagaacccgaagaauguccagaccaccccgggaacuuucaaaacaccugagggagaggugggcgcaaucgcccuggacuucaagccagggaccagcgguaguccgaucgugaaccgagaaggcaagaucgucgggcucuacggcaaugggguggugacgaccucggguacuuaugucuccgccaucgcccaggccaaggcgagccaggaggggccccucccggagauugagaacgagguguucaagaaacgcaaccucacgaucauggaccuccacccgggcagcggcaagaccaggcgcuaucuuccagccauuguccgggaggcuaucaagcguaagcuccgcacacuuauccuggcccccacucgggugguggcauccgagauggccgaggcacugaaagggaugcccauccgcuaccagacuacagccgucaaaagcgagcauacaggccgggagaucgucgaccucaugugccacgcaacguuuaccaugagguuacuguccccggugcgggugccaaacuacaauaugauaaucauggaugaggcucauuuuaccgaccccgccucaaucgccgcccgugguuacaucuccacccggguagguaugggggaagcugcggcuaucuucaugacagccacaccgcccgggucaguugaagccuuuccccaauccaacgcugugauacaggacgaggaacgcgacauccccgagcggagcuggaauuccggguacgacuggaucaccgauuuccccggaaagacugugugguucguuccgucaaucaaaaguggcaacgacaucgcaaauugccuccggaaaaacggcaagcgggugauccagcuuagccgcaagacuuucgacacggaguaccaaaaaaccaagaacaacgacugggacuacgucgugacgacggacaucuccgaaaugggcgcuaauuuucgggccgaccgagucauugacccgcggcgcugccugaagcccguaauacuuaaggaugggcccgagcgugugauccuggcaggcccgaugcccgugacgguggcgagcgccgcccagcgccgcggccgcaucgggaggaaccagaacaaggagggagaccaguacguguacauggggcagcccuugaauaacgacgaagaccacgcccauuggaccgaagcuaagaugcuccuggacaacaucaacacacccgaggguaucaucccggcgcucuucgagccggagcgggagaaguccgccgccaucgacggggaguaccgccuucggggcgaggcucgcaagaccuuugucgaacugaugcggcgcggcgaccuaccaguguggcucagcuacaagguugccuccgagggguuccaguacagcgaucggcguuggugcuucgauggcgagcggaacaaccagguccucgaggagaauauggacguugagaucuggaccaaagagggugagcgcaagaagcugcggccucgcugguuggacgcacggaccuacuccgacccgcuggcacugcgcgaauucaaggaguucgccgccggccggcgcagcguaagcggagacuugauccuggagauugggaaguugccccagcacuuaacucuucgggcccaaaacgcgcucgacaacuuagucaugcugcacaacuccgaacaaggcgggaaggccuaccgccacgccguggaggagcugcccgacacaaucgaaacucuuauguuacuggcccucauagcgguccuuaccggcggggucacucuguucuuccucagcggcaagggccugggcaagaccuccaucggccugcucugcguuacggccagcuccgcccugcuauggauggccagcgucgaaccucacuggaucgcagcguccauaauccuggaguucuuucugaugguacugcucaucccggagccggaccgacagagaaccccccaagacaaucaguuggcguacguggugauaggacuccuuuucaugauccuaacugucgccgccaacgaaaugggccuucucgaaaccacgaagaaggaccugggcaucggcuacguggccgcggagaaccaccaacacgccaccauguuagacgucgacuuacacccggcgagcgccuggacacuguaugcuguugcuaccacggugauuaccccgaugaugagacauaccaucgagaacaccacugcuaacauuucccugaccgcuaucgccaaccaggcggcgauucuuaugggacuggauaaaggguggccuauuaguaaaauggacaucggcguaccccuucucgcccucggguguuacucccagguuaauccgcugacccucacugccgccguucugaugcugguggcgcacuacgccaucauuggaccugggcuccaggccaaggccacgcgugaggcucagaagcgcaccgcggccgguaucaugaagaaucccaccguggauggcaucgucgcgaucgaccuagaccccguggucuacgacgccaaguucgaaaagcagcugggucagauuaugcuccugauccuguguaccagccagauacuccucaugcggacgacuugggcucugugugaguccaucacccucgcgaccgguccgcugacaacccugugggagggcucgccgggcaaguucuggaacacaacaaucgccguguccauggccaauaucuuuagaggcucauaucuagccggggccggccuagcguucucgcugaugaagagcuuggggggugggcggcguggcacgggugcccaaggcgagacgcuaggcgagaaguggaagcggcaacugaaucagcuuuccaaaagcgaguucaacaccuacaagaggagcgggaucauggaaguggaccgguccgaggcaaaagagggcuugaagcgcggggaaaccaccaagcacgccgucucaagggggaccgcgaagcugcgaugguucguggagcgcaaccucgugaagcccgaggguaaggucauagaucuggggugcggacgagggggcuggucauauuauugcgcugggcugaaaaaggugacagaaguaaaagguuacaccaaaggcggccccggccacgaggaaccgaucccaauggcaacguacggguggaaccuggucaagcugcacagcggcaaagacguguucuucaugccgcccgagaagugcgauacgcugcugugcgacaucggggaguccagcccgaacccuaccauagaggaggguaggaccuugcgcguacucaaaaugguugagccauggcugcggggaaaccaauucuguauuaagauccuaaacccuuauaugccgucggugguggagacacuggagcagaugcagcgaaaacacggcggcaugcuugugagaaauccucucagccgcaacuccacgcacgagauguacugggugucuugcgggaccggcaacaucguaucugccgucaauaugaccagccggaugcuucuaaaccgcuucacgauggcccaccgaaagccaacguacgagcgggacguugaccucggggcagggacccgccacguugccguugagccagagguagcaaaucuggauauaaucggccaacggaucgaaaacaucaaaaacgagcacaagaguaccuggcacuacgaugaggacaacccguacaagacgugggccuaccauggguccuacgaggucaagcccuccggcagcgcgucaagcauggugaacggcgugguucgccugcugacgaagcccugggacgugauacccaugguaacccagauagcgaugacugacaccacuccguuuggccagcagcggguguucaaagagaaaguagacacccgcacuccacgggccaagcggggcacaacgcagauaauggagguuaccgccaaguggcuguggggguuccugucacggaacaagaagccaaggauuugcacacgcgaggaauucacucgaaaagugcguagcaaugccgcaaucggcgcaguguuugucgacgaaaaccaauggaacagcgcaaaggaggccgucgaggacgagcgcuucugggaccucgugcacagagaaagagagcuccacaagcaggggaagugcgccacuugcgucuacaacaugaugggaaaaagagagaaaaagcugggagaauucgguaaggcgaagggcagucgcgccaucugguauauguggcucggggcaagauuucucgaguucgaggcccugggcuuuaugaacgaggaucacugguucagcagagagaauuccuugucaggaguugagggugaggggcugcacaagcuaggcuauauucuccgugacauaucgaaaauacccggcggcaauauguacgcggacgacaccgcgggcugggauacucgcauaacagaggacgaccugcagaacgaggccaagaucacggacauaauggagccugagcacgccuugcucgccaccaguaucuucaaacugacguaccagaacaagguaguacgcguucagcgucccgccaaaaacggcaccgucauggauguuauuucgcgacgggaccaacgcggcuccggccagguagguacauauggguugaacaccuuuacaaauauggaggugcagcucauccgucaaauggaguccgaggggaucuuucugcccagcgaacucgagacuccuaaccucgcggagcgagcucuggauuggcuggagaaacauggagccgaacggcucaagcgcauggccaucucuggagacgacugcgucgugaagcccaucgacgaccgguucgcuacggcgcuaacagcccuuaacgacaugggcaaggugcgcaaggauaucccccagugggaacccagcaaaggcuggaacgacuggcagcaggucccguucugcucccaccacuuccaucagcucauuaugaaggacggccgggagauaguggugcccugcagaaaccaagacgagcuggugggccgggcgcgcgucagccagggggcaggcuggucccugcgggagaccgcgugccuaggcaagagcuaugcacaaauguggcaacuuauguacuuucaccgccgggaccugcgucuagccgcuaacgccaucuguucagccgugcccgucgacugggucccugcgagcaggaccaccuggucuauacaugcccaccaccaguggaugaccacagaagacauguugagcguuuggaaccgcguguggaucgaggagaacccguggauggaggacaagacccacgucuccucaugggaggaaguucccuaccugggcaagcgcgaggaccagugguguggcucacuaaucgggcugacagcgcgggcgacgugggcgaccaacauucagguggcuaucaaccagguccgccggcugaucggaaacgagaacuaccucgacuauaugacgucuaugaagcgcuuuaaaaaugagagcgaccccgagggcgcccugugguga

SEQ ID NO: 24609 - RNA, 9879 nt, Artificial Sequence
  derived and/or modified CDS sequence (opt11) from DENV-1__KP188543__SS-prME
agcgugaccaugcugcucaugcugcuacccaccgcccucgccuuccaccugaccacacggggcggggagccucauaugauagugagcaaacaagagcggggcaaaucgcuccuuuucaagaccucggugggggugaacaugugcacguugaucgccauggaccuuggcgagcucugcgaagauacaaugacguauaaaugcccccgaaucaccgaagucgagcccgaugacguggauugcuggugcaacgccaccgacaccugggugacguacggcacgugcagccagacuggcgaacaucggcgggacaagcgguccgucgcccuggcgccccacgugggccuggggcucgagacaagaaccgagaccuggaugagcuccgagggcgccuggaagcagauccaaaagguugagacgugggcccugcgacaucccggauuuacggucaucgccuuguuucuggcccacgccauuggcaccagcaucacucaaaaggguauuauuuucauccugcugaugcucgugacccccucgauggcgaugcgcugcguaggcauaggcaaucgggauuucgucgaggggcugagcggcgccacguggguggacgugguccuggaacacgggucuugcgugaccaccauggccaagaacaagcccacccucgacauugaacugcugaagacggaagugacgaaccccgccguccuccgcaaguugugcaucgaggcgaagaucagcaacaccaccacagacagccgguguccgacccagggcgaggcgacccugguggaggagcaggacgccaacuucguguguaggcggaccuuuguggaccgcggguggggcaacggcugcggcuuauucggcaagggaagccugcugacgugcgcuaaguucaagugcguaaccaaacucgagggcaagaucguucaguacgagaaccugaaguauuccgucaucgugaccguccacaccggggaccagcaccaaguggggaacgaaacgaccgagcacggaaccauagccaccauaacaccgcaagcccccacgagugagauccagcuuacggacuauggggcgcucacccuggacugcaguccccggaccggcuuagacuucaacgagauggugcuccugaccaugaaggagaaguccuggcugguccacaagcagugguuccucgaccugccgcuacccuggaccagcggggcuagcaccucccaggagacuuggaaccggcaggauuuacugguuacuuucaaaacugcccacgccaagaagcaggagguggucgugcugggcucccaagagggcgccaugcacaccgcgcucaccggggccacggagauccagaccagcggcaccacaacgaucuucgccggucaccugaagugccggcugaaaauggacaagcucacccugaagggaauguccuacgugauguguaccgggucauucaagcuggagaaggaggucgccgaaacccagcacggaacagugcuugugcaggucaaguacgagggcaccgacgcgccgugcaagaucccuuuccucacccaggacgagaagggggugacccagaacggcagacuaaucacggcuaaccccaucgucaccgacaaagagaagcccgucaacaucgagaccgagccccccuucggcgaguccuacaucguuguaggagccggagagaaggcccugaagcucagcugguucaagaaaggguccucaaucggcaagauguucgaggccaccgcgcgcggggcccgccggauggccauccugggcgacacggccugggacuuuggguccaucgggggccucuucaccagcguggggaagcucauucaccagguguucggcaccgcauacggggugcuuuucuccggcguuagcuggaccaugaaaauagggaucgggauccuguuaacguggcugggccugaauagucgcagcaccucacuuagcaugaccugcaucgcggucgggauggugacccuguaucuuggcgucaugguccaagccgacuccgggugcgugaucaacuggaagggccgcgaguuaaagugcgggagcggcaucuucgucacgaacgaagugcauacauggaccgagcaguacaaguuucaagcugacaguccgaagcgucugagcgccgcuaucggcaaggcgugggaggagggugugugcggcaucagaagcgcgacccggcuggagaauaucauguggaaacaaaucuccaaugagcucaacuacauacuucuggagaacgacaugaaguucaccgucguggugggcgacgucaacggcauacucgcccaggggaaaaagaugauccgcccccaaccuauggagcacaaauauagcuggaaauccuggggcaaagccaagaucaucggcgccgacauccagaacacuaccuucaucaucgacgggccggacaccccggagugccccgacgaccagcgggcguggaacaucugggaaguggaggacuacggcuucgguaucuucacuacgaacaucuggcugaagcuccgagacucacacacccagaugugugaccacagauuaauguccgccgccaucaaggacuccaaggccgugcacgcggacaugggcuacuggaucgaguccgagaagaacgagaccuggaagcuggccagggccagcuucauagaagucaagaccugcaucuggcccaagucccacacccuguggagcaacggugugcuugaguccgagauggugauccccaagauauacgggggcccgaucagccaacacaacuaccgaccgggguauuucacgcagaccgccggcccguggcaccuaggaaagcuggagcucgacuucgaccugugcgaagguaccacggucguaguugacgagcacugcggcuaucgcgggccgucccugcggaccaccaccgucacgggcaagaucauccacgaguggugcugccgcagcuguacucugccgcccuugcgguucagaggcgaggacgguugcugguacgggauggagauccggcccguuaaggagaaggaggagaaucuggugcgcaguauggucagcgccggcuccggcgagauggacuccuucagccucgggauccugugcgugucuaucuuaaucgaggagguaaugcgcagccgcuggucucggaagaugcucaugaccggcacgcuggcggucuuccugcuccugaucauggggcagcucacguggaacgaccucauccgucuguguaucauggugggcgccaaugcuagcgaccgcaugggaaugggcaccacuuaucuggcccucauggccaccuucaaaaugcggccgauguucgccguggggcugcuguuccgcagacuuaccucccgcgagguccugcugcugaccguggggcugagucucgucgccuccguagaacuacccaacagccuggaggagcugggcgacggccucgccauggguaucaugaugcugaagcugcucaccgacuuccaaccccaccagcuauggaccacauugcugucccugaccuucauccggaccucccugucccucgacuacgccuggaagacaauggccauggcgcugagcaucgugucccuguucccccucugucugucaacgaccucccagaagaccaccuggcuaccggucuuacugggcuccuucgggugcaagccucugacgauguuucuaaucacugagaacaagaucuggggccgcaaauccuggccaauaaacgaggggauuauggccgugggaaucguuagcauccugcuguccagccuccuuaagaacgacgugccccuggccgggccgcucaucgccggcggaaugcugaucgcguguuacguaaucagcggguccagcgccgaccugucccucgagaaggccgccgaggugucaugggaggaggaggccgagcacucgggcacgagccacaacauucuggucgaagugcaggaugacgggaccaugaagaucaaggacgaggagcgggacgauacccugacgauccuccugaaggcgacccugcuugccguguccgggguuuacccaaugagcauccccgcaacccuguucgugugguacuucuggcaaaagaagaagcagcgcuccggggugcugugggacacccccagcccgcccgaagucgagcgggcagugcuggacgacggcaucuaccgcauccuacagcggggccuauugggucgcucccaggugggcguggggguguuccaggacggcgucuuccacaccauguggcacgucacccgcggugcugugcugauguaccagggcaaacgccuggagcccucaugggcguccgugaaaaaggauuugauuuccuacggcgggggcuggcgguuucagggcagcuggaacaccggggaagagguacaggugaucgccguggagcccgggaagaacccgaagaacguccaaaccacgcccggcaccuucaagacccccgagggcgaggugggagccaucgccuuggacuucaagcccggcaccagcggguccccgaucgugaaucgcgagggcaaaaucgucggcuuguacggaaacggcguggugacgaccagcgggaccuacgucagugccauagcgcaggccaaggcgacccaggaggggccccuuccugagaucgaggacgaggucuucaaaaagcggaaccucacgaucauggaccugcacccagggagcggcaagacccgccgguaccugcccgcgauugugcgcgaggccaucaaacggaagcuccgcacccucauacuagcgcccacccgcgucguggccagcgagauggccgaggcgcucaaaggcaugcccauccgguaccagacgaccgcggucaaguccgagcacacagggcgagaaauagucgaucugaugugccacgcgaccuucacgaugcgguuacucagcccagugcgcgugcccaauuacaacaugaucaucauggacgaggcgcacuucaccgaccccgccuccaucgccgccaggggcuauauaagcacccgcgucgggaugggcgaggccgccgccaucuuuaugaccgcuacgccgccuggguccgucgaggcguucccccagagcaaugccguuauccaggacgaggaacgggacaucccugaacgcagcuggaacagcggcuacgacuggaucaccgauuuccccggcaagaccgucugguuugugcccuccaucaagagcgggaacgacaucgccaauugucugcggaaaaauggcaagagggucauacagcuguccagaaagaccuuugacacugaguaccagaaaaccaagaauaacgacugggacuacgucguuaccaccgauaucagcgagaugggggccaacuuccgcgccgaccgaguuaucgacccucgccggugccucaagcccguuauacugaaggaaggcccagaacgcgugauccuugcggguccaaugcccgucacaguggccuccgcugcucagcggcguggcagaauaggccgcaaccagaacaaggaaggggaccaguacaucuacaugggucagccgcucaacaacgacgaggaccacgcacacuggaccgaagccaagaugcugcuugacaacauaaacacccccgaggggaucaucccggcccuguucgagccagaaagagagaaauccgccgccaucgacggcgaauacagacugcgcggggaggcgcggaagacauucguggagcugaugcgccgaggcgaccuccccgucuggcuguccuacaagguagccucagagggcuuccaguacuccgauaggcguuggugcuucgacggggagcgcaauaaucagguccuggaggagaacauggacgucgagaucuggacaaaagaaggagagcggaagaagcuucgcccccgguggcuggacgcgcgcaccuacagcgacccgcuggcccucagggaauucaaggaguucgccgccgggcgcagguccgugagcggcgaccugauccuggagaucggcaagcucccgcagcaccugacgcuaagagcccagaacgcacuggacaaucucgugaugcugcacaacagcgagcagggcgggaaggccuaccgacaugcgauggaggagcuccccgacacgaucgagacccugaugcugcuggcccucauugccguccugaccggaggggucacccucuucuuucuguccggcaaggggcuaggcaagacuagcaucgggcuccugugcgugauggccuccagcgcccuauuguggauggccuccgucgagccccacuggaucgccgcauccaucauccuggaguucuuucugauggugcuccugaucccggagccggaucgccaacguacgccccaggacaaucagcuggccuacguggucaucggccuccuguucaugauacugacgguggccgcgaacgagauggggcuccuggaaaccaccaagaaggaccuggguauagggcacguggccgucgagaaccaccaucacgcaaccaugcuggauguagaccugcgcccggccuccgccuggacguuguaugcgguggccacuaccgucauaacccccaugaugcgacacacaaucgagaacaccaccgccaacaucagccucaccgccaucgccaaccaggcggccauacugaugggccuagauaagggcuggcccauauccaagauggacaucggggugcccuuacuggcccucggcugcuacagccaggugaacccgcucacgcugaccgcagccguccugaugcucguggcccacuacgccaucauagggccaggccugcaggccaaggcaacacgcgaggcgcagaagcgaaccgccgccgggaucaugaagaacccgaccguggacgguaucgucaccauugaccuugauccaguuguguacgaugccaaguucgagaagcagcucggccaaaucaugcugcuuauccucugcaccucucagauccugcuuaugcggacgacgugggcccucugcgagagcaucacccuggccaccgggccgcuaaccacgcuuugggagggcucccccgggaaguucuggaacaccaccaucgcggucuccauggccaacaucuucagaggcuccuaccuggcuggugccgggcuggcuuucagccuaaugaagucccugggcgggggccggcgcgggaccggcgcacagggcgaaacgcugggagagaaguggaagcgccagcucaaccaguuaagcaaguccgaguuuaacaccuacaagaaguccggcaucauggagguggacagguccgaggccaaagaggggcuuaagcggggcgaaaccaccaagcacgccgugucccgggggaccgccaagcugcggugguuugucgaacgcaaccuagugaagccagagggaaagguggucgaucuaggcugcgggcgcggcgguuggagcuacuauugcgcgggacugaagaaggugaccgaggucaagggguauacgaagggcggcccggggcacgaagagccgauccccauggcaacauacggcuggaaccucgucaagcugcacuccgggaaggacguguucuucacgccgcccgagaagugugacacgcugcucugcgacaucggggagagcagcccgaacccaaccauugaggaaggucgcacccugcgggugcugaagauggucgaaccauggcuccgcgggaaccaguucugcauuaagaucuuaaaccccuacaugccgucugugguggagacccuggagcaaaugcaacggaaacauggaggaaugcucguccgaaacccccugucccgaaacucgacgcacgagauguacuggguguccugcggcaccgggaacauagucucugccgucaacaugaccucacgcaugcugcucaacagguucaccauggcccaccgcaagcccacguaugagcgcgacguggacuuaggcgcggguacccggcacguugccguggaacccgagguggccaaccuggacaucaucggacagcgcaucgagaacaucaagaacgagcacaagucgaccuggcacuaugacgaggacaacccauacaagacgugggcuuaccacggcuccuacgaagucaagcccagcggguccgccagcuccauggugaacggcgugguccgauugcugacgaagcccugggacgucaucccuauggugacucagaucgcgaugaccgacaccacgccguucgggcagcagcgcgucuucaaggagaagguggacacccggacgccccgggccaagcgggggaccgcccagaucauggaggugacggccaaguggcuguggggcuucuugagccgcaacaagaaaccccggauuugcacacgcgaggaguuuacccggaagguccgcuccaacgccgcgaucggggcuguguucguugacgagaaccaguggaacagcgccaaggaggccgucgaggacgagagauucugggaccucgugcaccgcgagcgcgagcugcauaaacagggaaagugcgcgacuugcguguacaacaugauggguaagcgugaaaagaaguugggcgaguucgggaaggcaaagggcagcagagccaucugguacauguggcugggcgcccgguuucuggaauucgaggcccuagguuucaugaacgaggaccacugguucucccgggaaaacagccuauccggggucgaaggggagggccugcauaaacucggguacauccugcgcgacaucagcaagaucccuggcggaaacauguacgcggacgacacggccgggugggauacccggaucaccgaggaugaucugcagaacgaggccaagaucaccgacauaauggagcccgagcacgcccuauuggcgacguccaucuucaagcugacauaccaaaacaagguggugcgcgugcagcgccccgccaagucugggacugugauggacgugaucucccggagggaccagcgggggagcggccaggugggcaccuacggacucaacaccuucaccaacauggaggugcagcugauccgccagauggaguccgagggcaucuuuagccccagugagcuggagacaccgaaccucgcgaagaagguucuggacuggcuggagaagcacggggccgagagacucaagcgcauggcgaucaguggcgacgacugcgucgugaaacccaucgacgaucgcuucgccaccgcgcugacggcccugaacgacauggggaagguucgcaaggauaucccccagugggagcccuccaagggcuggaacgacuggcagcaggucccuuucugcagccaccacuuccaccagcugauuaugaaggacggccgggagaucguggugcccugccgcaaccaggacgagcuggucgggagggcgcgcgugagccagggcgccggguggagccugcgggagaccgccugccucggcaaguccuacgcgcagauguggcagcugauguacuuccaccgcagagaccugcgccucgccgcuaacgcaaucugcagcgcggugccgguagacuggguccccacuagccggacgaccugguccauccacgcgcaucaccaguggaugacgaccgaggacaugcuuaguguguggaaccgcgucuggauugaggagaacccauggauggaaaacaagacccacguguccagcugggaggaggugcccuaccugggcaagcgggaggaccaguggugcggcucccucaucggccugaccgcccgcgcgacaugggccacuaacauacaggucgcgaucaaccaggugcgacggcucauugggaacgagaacuaccucgauuacaugaccagcaugaaacgcuucaagaacgagagugaucccgagggggcgcucugguga

SEQ ID NO: 24610 - RNA, 9879 nt, Artificial Sequence
  derived and/or modified CDS sequence (opt11) from DENV-1__KP188544__SS-prME
agcgucacaaugcugcuaaugcuucugcccacggcacucgcauuccaccucacgacccgaggaggagaaccgcauaugaucguaagcaaacaagaacggggaaagucccugcuauuuaaaacgagcguuggagucaauaugugcacgcugaucgcgauggaccuuggcgaguuaugcgaggacaccaugaccuacaaguguccgaggaucacugaagcagaacccgaugacguggacugcuggugcaaugcaaccgauacaugggugacuuauggaacguguucucaaacuggagagcaucgucgcgacaagcggucaguagcacucgcuccgcauguaggccugggccucgaaacgaggacggaaacuuggaugucaucugagggggccuggaaacaaauacaaaagguagaaaccugggcacuacgacacccggguuucacugucaucgcacucuuccuugcgcacgccauagggacgagcauaacacaaaaggguaucauauucauacuccugaugcucgucacuccgucgauggcgaugcgcugcguuggaaucggcaaccgagauuucguggagggacuuucaggugcgacguggguagacgucguccuggaacacgggagcuguguuaccacgauggccaaaaacaagcccacacuagacaucgaacuacugaaaacggaagucacaaaccccgcaguccugcggaaacucugcauugaagcaaagauaaguaauaccaccacugacucgaggugucccacccaaggcgaggcuacccuaguggaagaacaagacgccaacuucguuuguaggcggaccuucguagaccgaggaugggguaacgggugcggacucuucgguaaagggagccucuuaacgugugcaaaauuuaaaugcgucacuaaguuggaggggaagaucguacaauacgaaaacuugaaauauagcgugauagugacaguccacacaggcgaucaacaccaaguugggaaugaaacuaccgaacacggaacgauugcgaccauaacgccccaagcgcccacgagcgaaauucagcucaccgacuacggcgcccucacucuagacugcaguccgcgaacugggcucgacuucaaugaaauggugcuacuuacgaugaaagaaaaauccuggcuuguccacaaacagugguuucuggaccuuccacuccccuggacuagcggagcuuccacuucacaagagaccuggaaccgccaagaucuacugguuaccuucaaaacggcccaugccaagaaacaagagguggucguacuagggagucaagagggggcgaugcacaccgcccucacaggcgcaacagaaauacagacuuccgggacaacaacaauauucgccggacaccugaagugucgccuaaaaauggacaaacugacucucaaaggaauguccuacguaaugugcacaggaucauucaaacuggaaaaggagguagcggaaacgcagcacggaaccguccuuguacaagugaaauacgaggggaccgacgcaccauguaaaaucccuuucuugacccaggacgaaaagggcguaacccaaaacggccgccuaauuacggcaaacccgaucgucacagacaaagagaaaccagucaacauugagaccgagccaccguuuggagaaucauacauaguagucggggcgggcgaaaaagcccugaagcuaucgugguuuaagaaaggguccagcauaggaaaaauguucgaggcaacggcgagaggggcacggaggauggccauccucggggacacugcaugggacuuuggcaguauaggaggacucuucacaucagucggcaagcucauacaccaggucuucgguacagccuacggcguccuuuuuagcggugugagcuggacgaugaaaauagguauuggaaucuugcuaacguggcuagggcucaacucgcgcaguacaucccucaguaugaccuguaucgccguaggaauggugacacuguacuuaggugucaugguacaagccgacuccggcugcguuauuaauuggaaaggcagagaauugaaaugcggaagcggcauuuucguaacaaaugagguccacaccuggacagagcaauauaaauuccaagcggacagccccaaaagacucuccgcagcgauuggaaaggccugggaagaggggguaugcgggaucagauccgcgaccagacucgagaauaucauguggaaacagauaaguaacgaacugaauuauauacuacuggagaacgacaugaaguucacagugguagucggagacgugaacgggauacucgcacagggcaagaaaaugauucgaccccaaccgauggaacauaaguauaguuggaaauccuggggcaaggccaagauaauaggcgccgacauccagaacaccacauucaucaucgaugggcccgacacucccgaaugcccagaugaccaacgagcuuggaacauuugggagguagaagacuacggauucggaaucuucaccaccaacaucuggcuaaagcugcgagacucccacacacaaaugugcgaccaccgcuuaaugagcgccgcaaucaaagauucgaaggcgguccacgcggauaugggauacuggaucgaaagcgaaaagaacgaaaccuggaaacucgcacgagccucguucaucgaaguaaaaaccugcauauggccuaagucucacacacuguggucgaacggcguccucgaaagcgaaauggucauuccgaaaauuuacggaggucccaucagccaacacaacuaccgacccgguuauuucacucaaacugcggggccuuggcaucugggcaaacuggaacuagacuucgaccuaugcgaaggcacaacaguagugguggacgaacauuguggcuaccgaggccccucacuccgcacuaccaccgucacaggaaaaauuauccaugaauggugcugccgcucaugcacccugccaccccuacgcuucaggggugaagacggcugcugguacggaauggagauccgaccaguaaaagagaaagaagaaaaccugguccggaguaugguauccgccgggucgggggaagucgacucauucagccuaggaauacuaugcguaagcauacuaauagaagaggucaugagguccagguggagccgcaagaugcucaugacaggaacucuagcgguguuccuacucuugauuaugggacaauugacauggaacgaccuaauacgccuaugcaucaugguaggagccaacgccagcgacagaaugggaaugggaacgacauaccuagcccucauggccaccuuuaaaaugcgacccauguucgccguuggccugcuauuccgaaggcugacaugccgcgagguccuccuacucacagucggguuaagucuaguugcaucaguagagcuuccuaacucucuggaagaacucggcgacggcuuggccaugggcauuaugauguuaaagcuacucacagacuuucagccccaccaauuguggaccacacuacucucacuaaccuucauccgaacgagcuuaucccucgauuacgccuggaaaacaauggcaauggcgcuguccauagucuccuuauucccccucuguuuguccacgacaagccagaaaaccacguggcucccaguauugcucggauccuuuggaugcaaaccgcugacgauguuucuuauaaccgaaaacaagaucugggggcgaaagaguuggccaauaaacgagggcauaauggccgucgguaucguaucaauucuacuaaguucgcugcucaaaaacgacgucccgcuagccgggccccugaucgccgguggcauguuaauagccuguuaugugauaagcggaaguucagccgaucugagucucgaaaaagcggcugaggucaguugggaggaagaagcggaacacagcggcaccucacacaacauccuggucgaggugcaggaugacgggaccaugaaaaucaaagacgaggaaagagacgacacacuaaccauacuccugaaagccacgcugcucgcgguaagcgguguauaccccaugucaauccccgcgacgcuuuucguaugguacuucuggcagaaaaagaaacaacgcagcggaguacuuugggacacacccagcccacccgaggucgaacgcgcaguccucgacgauggaauuuacagaauacugcaaaggggcuugcucggacguagucaagucggcguaggcguguuccaggacgguguguuccacaccauguggcacgugacacggggagcggucuugaugcaccaaggaaaacgccucgaaccgaguugggccuccgucaagaaagaccuaauaaguuacggcggaggguggcgguuccaaggcuccuggaacaccggagaagagguccaggucaucgcgguagaaccaggcaaaaaccccaaaaauguccagacgacgccuggaacauucaaaacaccggaaggagaagugggagcaauagcacuggacuuuaaaccagggaccagcgggagcccaauagugaaccgagagggaaagauagucggcuuguacggaaacggugucguaacaacaagcgggacauacguaagcgccauagcucaagcuaaagccacucaagaaggaccacuaccugagauagaagacgaggucuucaagaaaaggaaccucacgaucauggaccuacaccccggaucaggaaagacaagaagauacuugcccgccaucgugcgcgaggccaucaagcgcaaacuacgaacccuuauacuggcacccacucgcguaguagcaagcgaaauggcggaggcgcuaaagggaaugccgaucagauaccaaaccaccgccguaaagagcgaacacaccggccgugagauuguggaucugaugugucacgcaaccuucacgaugcgccuccugagccccguccggguuccgaacuacaacaugauuaucauggacgaagcacacuucaccgauccggccuccaucgcugcuagggguuauaucagcacacgaguagggaugggcgaagcggcagcaauauucaugaccgccacuccgccuggauccguggaggcuuucccccaaucgaaugccguaauacaagaugaagaaagggacauacccgaaaggucguggaacucaggauaugauuggauuacagacuucccggggaagacugugugguuuguuccuagcaucaagucggggaaugacauagccaacugccuacgcaaaaacgggaaaagaguaauccaauuaaguaggaagacguucgacaccgaauaccagaagacuaaaaauaacgacugggauuacgucgucaccaccgacauaucugaaaugggggcaaacuucagagcagaucgggugaucgaucccagaaggugccugaagccggucauauuaaaggagggaccagagagaguuauccuagccgggccuaugccagugacgguagccuccgcggcgcagcgacgcggacgcaucggucggaaccagaacaaggagggagaccaguauaucuauaugggacaaccucugaacaaugaugaggaccacgcacacuggacggaggcaaaaaugcuucucgauaacauaaacacaccggaaggaauaauccccgcgcuguucgaacccgagagggaaaagucggccgcaaucgacggggaauauaggcucaggggcgaggcacgaaagacauuuguggaacucaugcggaggggagaucucccagucuggcucaguuacaaaguagcuagcgagggauuucaauacucagaccgaagaugguguuucgacggagagaggaacaaucaaguccuggaagaaaacauggacgucgagauauggacaaaggagggugaacguaagaagcugcgccccagaugguuggacgcacgcaccuacucggauccgcuagcuuugagagaauuuaaagaauuugccgcaggaagaagguccguaucgggagaccugauacuugaaaucgggaagcugccacagcaucuuacgcucagagcacaaaacgcccuugauaaccuagucaugcuucacaacagcgaacagggaggaaaggcuuaucggcaugcuauggaggaauuacccgacacaauagagacgcugaugcugcucgcguuaaucgcagugcuuaccggcggaguuacccuauuuuuccugagcgggaaaggccucgguaagacaaguauagggcugcucugcgucauggcaucgagcgcacuguuguggauggcaucgguugaaccucacuggauagcggcgucgaucauacuagaauuuuucuuaaugguacuacugauuccagaaccggacagacaacgaacuccccaggacaaccaacuggccuaugucguuaucgggcuacuauucaugauccugacagucgcugcgaacgaaaugggauuacuagagaccacgaagaaagaccuaggaauaggccacgucgcaguagaaaaccaccaccacgccacaauguuggacgucgaccugcgaccggcgucagcauggacucuauaugccgucgcuacaacggucauaaccccaaugaugcggcacacaauagaaaacacgacggccaacaucagccucacagcgaucgccaaccaggccgcaauccugaugggacuagacaaaggcuggccaauaucuaaaauggauaucggggucccacuacuagcgcucggcugcuacucccaaguaaacccucuaacgcugacagccgcugugcugaugcucgucgcacacuacgcaauaauaggccccggacugcaggcuaaggcaaccagagaggcacagaaaaggaccgccgccggaauuaugaagaacccaacggucgacgggauaguuacaauugaccucgaccccgucgucuaugacgccaaauucgagaagcaacugggucagauuaugcuccuaauccucugcacuucucagauacuacugaugcgcaccaccugggcccucugcgagagcauuacacuagcaacuggaccccugaccacacugugggaaggaaguccaggcaaauucuggaacacaaccaucgcgguauccauggcuaacaucuuccgggguucguaccuagcaggcgcuggauuggccuucucucucaugaaaagucugggcggaggucgacgaggcacgggagcgcaaggcgagacgcucggcgagaaguggaaaaggcaauugaaucagcuuagcaaauccgaguucaacaccuauaagaaaagcggaauaauggaaguagacaggucugaagcaaaagagggccuaaaacggggagaaacgacaaaacacgccgucucucgugggaccgccaaacucagaugguucguagagaggaaccuggugaaaccugaggggaagguaauagaccucggaugcggucgagguggcuggagcuauuacugcgccggccucaaaaagguaacagaaguaaaaggauacaccaaggguggaccugggcacgaggaaccgauaccgauggcaacauaugguuggaaccuggucaaguuacacuccggaaaagauguuuucuuuacaccacccgaaaaaugcgacacgcuccuaugcgacauaggcgaaagcucccccaaccccacaauagaagaagggaggacccuacgggugcugaaaaugguagagccauggcuacgaggaaaccaauuuugcaucaaaauacuuaauccauacaugccuucgguugucgaaacacuggagcagaugcagcgcaagcacggcgguaugcuggugcguaacccccucagcaggaacaguacacaugagauguauugggucagcugcggcaccgguaacaucguaagcgcagugaacaugaccaguaggaugcuuuugaaccgguucacgauggcccacaggaaaccgacuuaugaaagggacguagaccuaggagccgggaccagacauguagcuguagaaccggaggucgccaaccuugacauaauaggucagcguauagagaacauuaaaaaugaacauaaaucaacauggcaccacgacgaagacaacccauacaagaccugggcauaccacgguuccuaugaagucaaaccauccggcagcgccagcucaauggucaauggagugguacgacuacuaaccaaaccgugggauguaaucccaauggucacucaaauagcgaugaccgacacgacaccauucggccaacaaagaguguucaaggagaagguagauacacguacgccucgggcaaagcgaggaacggcacaaauaauggaagucacggcuaaauggcuauggggguuucugagccgaaacaagaaacccaggauauguaccagagaagaguucacccgaaaaguucgcuccaaugcggcgauaggcgccguauucgucgacgaaaaucaguggaacuccgccaaagaggcagucgaggaugaaagauucugggaucucguacaucgagaacgagaacuacacaaacaagguaaaugcgcgaccuguguauauaacaugaugggcaagcgugagaagaagcucggagaguucggcaaagcaaagggaucccgggcgauaugguacauguggcucggugcacgauucuuagaauuugaggcgcuagguuucaugaacgaggaccacugguucuccagggagaauagccuaucaggaguagaaggagaaggucuccacaaacuaggauauauccuacgcgacauuucaaaaauaccgggagguaacauguacgcagacgacacggccgggugggacacaagaauaacggaagacgauuugcaaaacgaggcuaaaaucacggacaucauggagccugaacaugcccuguuggcaacauccaucuucaaacuaacuuaucaaaacaaaguuguccgcguccaacggcccgccaagucggguacaguuauggaugugaucagccgccgcgaucagcgagguuccggucaaguaggcaccuacgggcucaacacguucacaaacauggaggugcaguuaauaagacaaauggaguccgaaggcaucuuuagccccagugaacuggaaaccccaaaucuagccaaaaaggugcuugacuggcuagaaaaacacggugcggagcgacugaaacguauggcgaucagcggggacgauugcguggucaaaccaaucgacgaucgauucgcaacggcucugaccgcguugaacgacauggggaaaguaagaaaagacauuccacaaugggagccuagcaaaggcuggaacgacuggcaacagguaccauuuugcucgcaccacuuucaccaacuaaucaugaaagauggucgagaaaucgucguaccuugucgaaaccaggacgaacucgucggccgugcgagaguuagccaaggggcaggcuggagccuucgcgagacggccugucucgguaaguccuacgcgcagauguggcaauuaauguauuuccaucgccgcgaucucaggcuggccgcuaacgccaucugcagugcaguucccguagacugggucccaacaagccggaccacguggaguauccaugcccaccaccaauggaugacuacggaagacaugcuaagcgucuggaacagaguauggauagaggagaacccguggauggaagacaaaacccaugucagcuccugggaagaagugccuuaccucggcaaacgcgaagaucaguggugcggcagcuuaauaggacugaccgcgcgagcaacgugggccaccaauauacagguagccauaaaucaggugcgacgacugauaggaaacgaaaacuacuuagacuacaugacgagcaugaaaagguucaaaaacgagucagaucccgaaggggcauugugguaa

SEQ ID NO: 24611 - RNA, 9879 nt, Artificial Sequence
  derived and/or modified CDS sequence (opt11) from DENV-1__KP188547__SS-prME
agcgugaccaugcugcucaugcugcugcccaccgccuuggccuuccaucuuaccacgcggggcggcgagccccacaugaucgugagcaagcaggaacggggcaagucgcuccuguucaagaccucagugggggugaacaugugcaccuuaauugcgauggaccugggcgagcucugugaggacacgaugaccuauaagugcccucggaucaccgaggcggagcccgacgacgucgacugcuggugcaacgcaacggacacuugggugaccuacggaacuugcagccagaccggcgagcaccggcgggacaagcgguccguggcucuggcuccccaugugggccuggggcucgagacgcgcaccgagaccuggaugucauccgagggcgcguggaagcagauccagaaaguagagaccugggcccuucggcaccccggguucaccgucaucgcccuguuccucgcccacgcgauaggcaccagcaucacccagaaggguaucaucuucauacugcugaugcucgucaccccauccauggcuaugaggugcgucggcaucggcaaccgggacuucguggagggacugagcggagccacguggguggacguagugcuggagcacggguccugcguuaccacgauggccaaaaauaagcccacccucgacaucgagcugcuuaagacggagguaaccaaccccgccauccuccgcaagcugugcaucgaggccaaaaucagcaacaccaccacggacucccgcugccccacccagggggaggccacccuaguggaggagcaggacgccaauuuugucugccgccggacguucgucgaccgcggcugggggaauggcuguggccucuucggcaaggggagccugcugacgugcgccaaguucaagugcgugaccaagcuagagggcaagaucguccaguacgagaaccugaaguacuccgugaucgugaccguccacaccggugaccagcaccagguggggaacgaaacuacggagcacggcaccauagccaccaucacgccccaggcgcccacgagcgagauucagcugacagacuacggggcucucaccuuggacuguucaccccggaccggcuuagacuucaacgagaugguucuccugacgaugaaggagaagucauggcuggugcacaagcaaugguuccucgaucucccccugcccuggaccucaggagcaagcaccagccaggagaccuggaaucgccaagacuugcuggugaccuuuaagaccgcccacgcuaaaaagcaggaggucguggugcugggcucccaagaaggagcgaugcauacggcccucaccggggccacggagauccagacaagcggcaccaccacgaucuucgccgggcaucugaagugccggcugaagauggacaaguuaacccugaaaggcaugaguuacgucaugugcaccggaaguuucaagcuggagaaagagguggccgagacccaacaugggacugugcucguccaggucaaguaugagggcaccgacgcgccgugcaagauccccuucuuaacccaagacgaaaagggggugacccagaacggaagauuaauuacggccaauccaaucgucaccgacaaggaaaaacccgugaacaucgagaccgagccgccauucggcgaauccuacaucguggucggcgccggcgaaaaggcccugaagcucuccugguucaagaaaggauccucuauaggcaagauguuugaggcgacggcuagaggagcucgccggauggccauccugggcgacacggccugggacuucgggagcaucggcggcuuauucaccaguguggggaagcucauucaccaaguguucgguacagcguacgggguccuguucuccggcgugagcuggaccaugaagaucgggaucggcaucuuauuaacguggcugggccugaacucacgcaguaccagccugaguaugaccugcaucgccguggggauggucacacuguacuuaggggucauggugcaggccgacaguggaugcgucauaaacuggaagggccgcgaacuaaagugcgggagcggcaucuuuguuacaaaugaggugcacaccuggaccgagcaguacaaguuucaggccgacuccccgaagcggcuuagcgccgcgaucggcaaggccugggaggaaggggucugcgguauccgcagcgccacccggcuggagaacaucauguggaagcagauuagcaacgaguugaacuacaucuugcuggagaacgacaugaaguucacaguggugguuggggacgugaacggcauuuuagcccaggggaagaagaugaucaagccccagcccauggagcacaaguacagcuggaagucauggggcaaggcgaagaucauaggcgcugauauucagaacacgaccuucaucaucgacgggccugauacaccggagugccccgacgaccagcgcgccuggaacauuugggaaguggaggacuaugguuucgggaucuucaccacgaacaucuggcuaaagcuccgggacagccacacccagaugugcgaccaccgacucauguccgccgcgaucaaggacagcaaggcgguacaugccgacauggguuacuggauagaguccgagaaaaaugagaccuggaagcuggcccgugccuccuucaucgaggugaagaccugcauauggcccaagucccauacauuguggagcaacggcguccucgaauccgaaauggucauacccaagaucuauggcggcccgaucagccagcacaacuaucgacccggguacuucacccagaccgcgggacccuggcaccugggaaagcuggagcucgacuucgaccugugcgagggaacaacggugguggucgacgagcacugcggcuaccgggggccgucccuacgcaccaccacagugacgggcaagaucauacacgaguggugcugccggagcugcacgcucccgccguugcgcuuccguggugaggacggcugcugguacgggauggagauccgccccgugaaagagaaggaggagaauuuagugcggucaauggugagcgccggcucaggcgagguggacagcuucagccucggcauacugugcgucuccauccuuaucgaggaggugaugcgcagccgguggucccgcaagauguuaaugaccggcacccuggccguguuccugcucuugauaauggggcaguugacguggaacgaccucauccggcuaugcaucaugguuggcgcuaacgcccuggaccgcauggggaugggcaccaccuaccucgcccugauggccacguucaaaaugaggccuauguucgcaguggggcuacucuuccggaggcugacgagcagagaggugcugcuccugaccguugggcucucacuaguagccagcguggagcugcccuccucacuggaggagcucggcgacgggcuggcaauggggaucaugaugcugaagcuccugaccgacuuccagccacaccagcuguggaccacgcuccugucacugacuuucaucaggacgagccucucacuggacuacgcuuggaagaccauggcuauggcccuguccaucgugucccucuucccacugugucugagcacgaccucccagaagacaacuuggcuacccgugcuccuggguucguucgggugcaagcccuugacaauguuucugaucaccgagaacaagaucuggggccggaaguccuggcccaucaacgaggggaucauggccgugggcaucgugagcauccugcucuccagccugcugaagaacgacgugccccuugccgguccuuugaucgcgggcggcaugcugaucgccugcuacguaauaagcggguccagcgcugaccucucccuggagaaggccgcggaggugagcugggaggaagaggcggagcacuccggcaccagucacaacauccugguggagguacaggaugacggaacgaugaagaucaaggacgaggaacgcgacgacacccucaccauccugcucaaggccaccuuacuggccguauccggcguguaccccaugucaauccccgcaacacuguucgucugguacuucuggcagaaaaagaagcagcgguccgggguacugugggauacccccucaccgccugagguggagcgcgcugugcucgacgacggcaucuaccggauccugcagcgcggccugcucgggaggucccaagucggggucggggucuuccaggacggaguuuuccacacaauguggcacguaacucgcggggcgguccugauguaccagggcaagagacuggagccuagcugggccuccgugaaaaaggaccuuauaagcuacggcggcgguuggcgcuuucagggcagcuggaacaccggcgaagagguacaggucaucgccguggagcccgggaagaacccgaagaacgugcagaccacgcccggcaccuucaagacccccgaaggcgaggugggggccaucgcccuagacuucaaacccggcacuagcggguccccgaucgugaaccgagaggggaagaucguaggccuguacgggaacggcguggugacaaccagcgggaccuacguauccgcgaucgcccaggcgaaggccacucaggagggcacgcuccccgagaucgaagacgaggucuucaagaagcgcaaccugacuaucauggaccugcaccccgggagcggcaagacccggcgcuaucuuccggcuaucgugagggaggcgaucaagcgcaagcugcggacccuuaucuuggcccccacaaggguggucgccagcgagauggccgaagcgcugaagggcaugcccauccgcuaccagacuaccgcagugaagucggagcacaccgggcgggaaaucguggaccugaugugccacgcaacguuuaccaugcgccuacucagccccguccgggucccgaauuauaauaugaucauuauggacgaggcccacuuuaccgaccccgcgagcaucgccgcccgcggcuacaucagcacccgcguggggaugggggaggccgccgccaucuucaugacggcgacaccaccaggguccgucgaggccuuuccgcaaaguaacgccgugauccaggacgaggagagagacauccccgagcggucuuggaacagcggcuacgacuggaucaccgauuucccgggcaagaccgugugguucguccccuccaucaagagcggcaacgacauagccaacugccuucgcaaaaacggcaagcgggucauccaguugucccgcaagacauucgacaccgaguaccagaagaccaagaacaacgacugggacuacguggucacaacggacaucucugaaaugggggccaacuuccgggcggaccgcgugauagacccccgacgaugccugaaaccugugauccugaaggagggccccgagcgggucaucuuggccgggcccaugccgguuaccguggccuccgccgcgcaacgccgaggcaggaucggccggaaccagaacaaggagggggaucaguacaucuacaugggccagccccugaacaacgacgaggaucacgcacacuggaccgaggccaagaugcugcucgacaacaucaauacccccgaagggaucauccccgcccuguucgagccggagagagagaaguccgcggcgaucgacggcgaguaucgccugaggggggaggcgcgcaagacguucguggagcucaugcgacgcggcgaccugcccguguggcuguccuacaaagucgccagcgagggcuuccaguacagugacagacgcuggugcuucgacggggaacguaacaaccaggugcucgaagaaaacauggacguggaaaucuggaccaaggagggugaacggaagaagcugcggccccgcuggcuggacgcgcggaccuacagcgacccccucgcccuaagggaguucaaggaguucgcggccgggagacgguccgucagcggcgaccugauccuagagaucggcaagcucccucagcaucucacccuccgggcccagaacgcuuuggacaaccuggugaugcuccacaacagcgaacaaggcggcaaggccuaccgccacgcgauggaggagcugccugacaccaucgagacgcugaugcuccuggcccugauagccgugcucaccgggggcgucacacuguuuuuccuguccgggaagggccucggcaagacaucuaucgggcugcucugcgugauggccagcagcgcgcuccuguggauggccuccguggagccccacuggaucgccgcaagcauuauccuggaguucuuccucaugguacugcugauccccgagccggaccgacagcgcacgccccaggacaaccaacucgccuacgugguaaucgggcuacuguuuaugauccucaccgucgccgccaacgagauggggcuacuggagaccaccaagaaggaccucggcaucgggcacguggccguggagaaucaucaucacgcuacgaugcuugacgucgacuuacggcccgccuccgcauggacccucuacgcgguggccaccaccguuaucacgcccaugaugcgccacacgaucgagaacaccaccgcgaauaucagccugaccgcgaucgcgaaccaagccgccauccugauggguuuggacaaaggauggcccaucuccaagauggacaucggggucccccugcuggcucugggcugcuacagccaggugaacccccugacccugacggccgccgugcucaugcuggucgcgcacuacgcaaucaucggaccggggcugcaggccaaggcgaccagggaagcccagaaacguacggcagccgguaucaugaagaaccccaccguggacggaaucgugaccaucgaccucgacccggucguuuaugacgccaaguucgagaaacagcucggccagaucaugcugcucauccugugcacaucgcagauccugcucaugcgcaccaccugggcgcugugcgaaagcaucacucuggccacugggccgcucacgaccuugugggagggcaguccagggaaguucuggaacacaaccaucgccguuagcauggccaacauauuccggggcuccuaucuggccggugcgggccucgccuucagccugaugaaguccuuaggcgggggccgccgggggacgggcgcccagggcgagacccucggggagaaguggaagcgacagcugaaccaacugucuaaguccgaguucaacaccuacaagaaauccggcaucauggagguggaccggagcgaggccaaggagggauuaaagcgcggugagaccacuaagcacgccguuucaagagggaccgcgaagcuacgcugguucguggaacgaaaccugguuaagcccgagggcaaggugauagaccugggcugcgggcguggcggguggagcuacuacugcgccggcuuaaagaagguuacggaggucaagggcuacaccaagggaggcccagggcacgaggagcccaucccgauggcaacguauggcuggaaucuugugaaauuacacuccgggaaggacguguucuucaccccccccgaaaagugcgacacccuccugugcgacaucggcgagagcucuccuaaccccaccauugaggaggggcguacccugcgugucuugaagaugguggagcccuggcugagaggcaaccaguucugcaucaagauccugaaccccuacaugcccagcguggucgaaacgcuugagcagaugcagcgcaagcacggcgggaugcugguucggaauccgcugucgaggaacagcacgcacgagauguacuggguguccugcggcaccgguaacaucgucagugccgugaacaugacaucccggaugcuccugaaccgcuucacgauggcgcaccggaagcccaccuacgagcgcgacguggaccugggcgcuggcacccgccacgucgccguggaacccgagguggcaaaccucgacaucaucgggcagcgaauagagaauaucaagaacgagcacaagaguacuuggcacuacgacgaggacaacccuuacaagacgugggccuaccauggcuccuacgaggucaagccgagcggguccgcaagcuccauggugaacggcgucgugcgccugcugaccaagcccugggauguuauucccaugguuacccagaucgcgaugacagacacgacacccuucggccaacagagaguguucaaggagaaaguggacacccgcaccccgcgggccaaaagaggcacggcccagaucauggaggucaccgccaaguggcuauggggcuuucugagcagaaacaagaagccgcgcauuugcacccgcgaggaguucacccggaagguacggucuaacgcggccaucggcgccguguucguggacgagaaccaguggaacagcgccaaggaggccguggaggaugagcgguucugggaccuggugcaccgggagcgcgagcuccauaagcaggguaagugcgccacuugugucuacaacaugaugggaaagcgggagaagaaacugggcgaguucggaaaggcaaagggcagccgcgccaucugguacauguggcugggcgccagauuccucgaauucgaggcgcugggcuucaugaacgaggaccauugguucagucgcgagaauagccugucgggcguggagggggagggccuccacaagcugggguacauccuccgggacauuagcaagauucccggcggcaacauguacgcugaugacacagcagggugggacacccggauuaccgaggaugaucuccagaacgaggccaagaucacugacauaauggagccggagcacgccuugcuggcgaccuccaucuuuaagcucacuuaccagaacaaggugguccgggugcagcgccccgccaagucgggaacggugauggacguuauaagccgccgggaucaacgcgggaguggccaggugggcacguacgggcuuaacaccuucaccaacauggaggugcagcugaucagacagauggaaucugagggcaucuucucccccuccgagcucgagacgcccaaucuggcuaagaagguucuugauuggcuagagaagcacggggcagagcgccugaagcggauggccaucagcggcgacgauugcguggugaagccgauugacgaccgcuucgcgacggcccugaccgcgcucaacgacaugggcaaggugcggaaggacaucccccagugggagcccuccaaaggcuggaacgacuggcagcagguccccuuuugcagccaccacuuccaccagcuuaucaugaaggacggccgcgagauuguggucccuugccggaaccaggacgagcuggucggccgcgccagggugucccaaggcgccggguggagccucagggagaccgcgugccugggcaagucuuacgcacaaauguggcagcugauguauuuccaucggcgcgaccuccggcuggccgcgaacgccaucugcagcgcgguccccguggacugggugcccaccagccgcaccacgugguccauccacgcccaccaccaauggaugacuaccgaagacaugcuaagcguauggaacagaguguggaucgaggagaaccccuggauggaagacaagacacacgucucgagcugggaggaagucccguaccucgggaagcgugaggaccaguggugcggcucccugaucggccugacugcccgggccaccugggcaacgaacauccagguggccauuaaccaggugcgccgccugaucggaaacgagaacuaucucgacuacaugaccagcaugaagcgguucaagaacgaguccgaccccgagggcgcccucugguga

SEQ ID NO: 24612 - RNA, 9879 nt, Artificial Sequence
  derived and/or modified CDS sequence (opt11) from DENV-1__KP723473__SS-prME
agcgugaccaugcugcuaaugcugcuucccacagcccucgcauuccaccucaccacccggggcggggagccccacaugauugugucaaaacaggagcggggcaagagccuccuguuuaagaccagugcgggugugaacaugugcacccugaucgccauggaccugggcgagcucugcgaggacaccaugaccuacaaguguccccggaucaccgaggccgagcccgacgacguggacugcuggugcaacgccaccgacaccugggugaccuacgggaccugcagccagaccggggagcaccggagagacaagagguccguggcccuggcgccucacgugggccuggggcucgagacgcgcaccgagaccuggaugagcuccgagggcgccuggcggcagauacagaagguggaaaccugggcccugcgccaccccggcuucacgguaauagcucuguuccucgcgcacgccaucggcaccagcaucacccagaaggguaucaucuucauucugcugaugcucgugacccccuccauggccaugcggugcgucggcauuggcaaccgcgacuucguggaggggcucagcggcgccacguggguggacgucguucucgagcacggcuccugcgugaccaccauggccaagaacaagcccacacucgacaucgagcuucuaaagacggaggucacaaaccccgcggugcuccggaagcuaugcaucgaagccaagaucagcaauacuacgacagacucccgcuguccgacgcagggagaggccacccugguggaggaacaggacgccaacuucgucugccgacguaccuucguggaccggggcugggggaacggcugcggccucuucggcaaggggagccugcugacgugcgcaaaguucaagugcgugaccaagcucgagggcaagaucguccaguacgagaaccugaaguacuccgugaucgugaccguccacaccggcgaccagcaccagguggggaacgagacgaccgaacauggcaccaucgccacaaucacgccccaggcccccacguccgagauucagcugaccgacuacggggcccucacgcuggacugcagcccccggaccggccuggacuucaacgagaugguccuccuaacgaugaaggaaaaguccuggcugguccacaagcagugguuccucgaucugccgcuaccuuggaccuccggggccagcaccagccaagaaaccuggaaucggcaggaccuccuggugacguucaaaacggcacacgcgaagaagcaggaggucguggugcuggguucccaggagggcgccaugcauaccgcucucacuggggccaccgagauccagaccagcggcaccaccacgaucuucgccgggcaccugaagugccggcugaagauggacaagcucacccuuaaaggcgucuccuacgugaugugcaccgggagcuucaagcuggagaaggagguggcagagacccaacacggcacgguacugguacaggugaaguaugagggcaccgaugccccuugcaagauucccaucaguacccaagacgagaagggggucacccaaaacggccggcucaucacggccaacccgaucgugaccgacaaggagaagcccgugaacaucgagacagaaccgcccuucggugagagcuacaucgucaucggcgccggcgagaaggcgcucaagcuguccugguucaagaaggggagcuccauagggaagauguucgaggccacggccaggggggcccgacgcauggccauccucggcgauacagcgugggacuucgggagcaucgggggcguguucaccuccguggggaagcugguccaccagguguucggcaccgccuacgggguguuguucuccggcgucucguggaccaugaagauagggaucgggauccuccugaccuggcugggccucaacagccgcuccaccucguuauccaugaccugcaucgccguggggauggugacccuguaucucggcgucauggugcaggccgacagcgggugcgugaucaacuggaaggggcgggaacuuaaguguggguccggcaucuucgucacgaaugaagugcacaccuggaccgagcaguacaaguuccaggccgauucgccgaagcgccugucagccgcuaucggcaaggccugggaggagggggugugcggcauccgaucagcaacccgccucgagaacaucauguggaaacaaaucagcaacgagcugaaccacauccugcucgaaaacgacaugaaauuuacagucguggugggggacgcaaacggcauccugacgcaggggaagaagaugauccggccccagcccauggagcacaaguacuccuggaagagcugggguaaggcgaagaucaucggcgccgacacccaaaacaccaccuucaucaucgacggccccgacacgccggagugcccagacgaccagcgggcguggaacaucugggaggucgaggacuacggcuucgggguguucacaaccaacaucuggcugaagcuacgagacucuuacacgcagaugugcgaccaccgccugaugagcgccgcgaucaaagacuccaaggccgugcacgcagacaugggcuacuggauagagagugaaaagaacgaaacguggaagcuggcccgggcguccuucaucgaagucaaaaccugcaucuggccccgcagccacacccucugguccaauggcguacuggagagcgagaugaucauacccaagaucuacgggggcccgaucucccagcacaacuaucggcccggguacuucacccagacggcgggcccguggcaccuggggaagcucgagcuggacuucaaccugugcgagggcaccaccguggucguggacgagcacugcggcaaccgcgggccgagccuccguaccacgaccgugaccggcaagauaauccacgaguggugcugccgcaguuguacccugccgccccugcgguuucgcggggaagacgguugcugguacgggauggagauccggcccgucaaggagaaggaggagaaccuugugcgcagcaugguguccgccgggagcggcgaggucgacagcuucucccuggggcugcuuugcgugagcauuaugauugaggaggugaugaggucccgcuggagccgcaagaugcugaugacgggcacccuggccguauucuuccuccucaucauggggcaguugaccuggaacgaccucauccgccucugcaucauggugggcgccaauguuuccgaucgcauggggauggggaccacguacuuggcgcucauggccaccuucaagaugcggccgauguucgccgucgggcugcuuuuccgccggcucaccagcagggagguccugcugcucacaaucgggcugucccuggucgcaagcguggagcuacccaacucccuggaggagcugggggacgggcucgccaugggcaucaugaugcugaagcugcucacggacuuccagagccaccagcuguggaccacccugcucuccuugaccuucaucaagacgacccugagccucgacuacgccuggaagaccauggcgaugguguuguccaucgucagccuguucccacucugucuuuccacaacgagccagaagaccacauggcuacccgugcuccugggauccuucggguguaaaccgcugaccauguuccucaucaccgagaacaagauauggggccgcaagucguggccccugaacgaggggaucauggccgugggcaucguauccauucuguuaagcagccugcugaagaacgacgugccccuagcugggccccugaucgccggcggaaugcugaucgcgugcuacgucaucucgggaagcuccgcagacuuaagccuggagcgcgccgccgaggucuccugggaggaggaggccgagcacucgggcgcgucccauaacauccugguugagguacaggaugaugggacgaugaagaucaaggaugaggagagggaugacacccugacgaucuugcugaaggcuaccuugcuggccgucagcggcguguacccgaugucgaucccugcgacccuguucgugugguacuucuggcagaagaagaagcagcgcagcgguguccuaugggacacccccagcccaccagagguggagagggcggugcuggacgacggcauauaccgcauccugcagcggggccugcucggucgcagccaggucggcgucggcguguuccaggacggugucuuccacaccauguggcacgugacccgcggggccgugcugauguaccagggcaagcgccuggagccuuccugggccagcgucaagaaggaccucaucuccuauggcgggggauggcgguuccaggggagcuggaacacgggcgaggagguccaagugaucgccguugagcccgggaagaaucccaaaaacgugcagacuacccccggcaccuucaaaacaccagagggcgaggugggcgccaucgcccuggacuucaagcccgguaccucugggagcccuaucgucaaccgcgagggcaagaucguuggccucuacgguaacggcgugguuaccaccuccggaacuuacguaagcgcgauagcccaggccaaggcuagccaggaaggcccgcucccagagaucgaggacgaaguguucaagaagcggaaccugaccaucauggaccuccaccccggguccggcaagacccgccgguaccugccagccaucguccgugaagcgaucaagcgcaagcuacggacccugauccucgccccaacgagaguaguggccagcgagauggcagaagcgcugaagggcaugcccauccgguaccagaccaccgccgucaaguccgagcacacuggaaaagagaucguggaccugaugugccacgccacguucaccaugcgccuccugucccccgugcgggucccgaacuacaauaugaucaucauggacgaggcccacuucaccgaccccgccuccaucgcggcccgcggcuacaucagcacccgaguggggaugggcgaggccgcagcaaucuucaugacugcgacuccgcccgggucaguggaggcauucccgcagagcaacgccgucauccaagacgaagagcgcgacauccccgagcgguccuggaacagcggcuacgacuggaucaccgacuuccccggcaagaccgugugguucgugcccuccaucaagagcgggaacgacaucgccaacugccugcguaagaacggcaagcggguaauccaacucucccgcaagacuuucgacaccgaguaccagaagaccaagaauaacgacugggacuauguggugaccacggacaucagcgagaugggggccaacuuccgggccgacaggguaaucgacccucggcgcugccugaagccggugauccucaaggacggccccgagcgagucauccucgccgggcccaugccggugaccgccgccuccgcggcccagcgccgggggcgcaucggccgcaaccagaacaaggagggcgaccaguacaucuacaugggccagccccugaacaacgacgaggaccacgcccauuggaccgaagccaagauguuguuggauaacaucaacacccccgaggggaucauccccgcccuguucgagccggagcgugagaaguccgcggccaucgacggcgaguaccgccuacgcggggaggcccgcaagaccuucguggagcucaugcggcgcggcgaccugcccgucugguuauccuacaagguggccagcgagggcuuccaguacuccgacaggcgcuggugcuucgacggagagaggaacaaccaagugcucgaggagaacauggacgucgaaauauggaccaaggagggcgagcgcaagaagugcgacagccgguggcuggacgcccguaccuacucagacccccucgcgcuccgggaguuuaaggaguucgccgccgggcgccgguccgugagcggcgaccugaucuuagagaucggcaagcucccccagcaccugacccuucgcgcccagaacgccuuagacaaccuggucaugcuucauaauuccgagcagggcgggaaagcguaccggcacgccauggaggagcucccggacaccaucgaaacgcugaugcugcucgcccugaucgccguccugacagggggugugacccucuucuuccugagcgggaagggccugggcaagaccuccaucgggcuacugugcgugauggcgagcucuguccugcucuggauggccagcguggagccccacuggauugccgcguccauaauccuggaguuuuuccugauggugcuccugaucccugaacccgaccgccagcggaccccgcaagacaaccaguuagccuacgucgugaucgggcuccuauucaugauccugaccguggccgccaacgaaauggggcuccuggagaccaccaagaaggaccuggguaucgggcacgucguugccgagaaccaccaccacgccacgaugcucgacauagaccugcaccccgcuagcgcguggacgcuguacgccguggccaccaccaucaucacccccaugaugcgccacacaaucgagaacaccacugccaacaucucccucacggccaucgcuaaccaggcugccauccucaugggccuggacaagggcuggccuaucagcaagauggacaucggcgucccucuccuggcccugggcugcuacucccaagugaauccccucacacugacagccgcggugcugaugcucgucgcccacuacgccaucaucgggcccggcuuacaggccaaggcgacccgggaggcccagaagcgcacugccgccgggaucaugaagaacccgaccguggacggcaucguggccaucgaccuggacccugucguuuacgacgcgaaguucgagaagcagcucggccagaucaugcugcucauacucugcaccucucagauccugcugaugcgcaccacgugggcccucugugaguccaucacccuggccaccgggccccugacuacucucugggagggcagccccggaaaguucuggaacaccaccaucgccguguccauggccaacaucuuccggggcaguuaccuggcgggcgccggacuggccuucagucuuaugaagucucugggcggcggccgccgggggaccggcgcccagggagagacgcugggcgagaaguggaagcgccagcucaaccaacugagcaaguccgaauucaauacguacaagcguagcggcaucauggaagucgaccgcuccgaggccaaagaggggcugaagcgaggcgagaccaccaaacacgccgugagccguggcacggccaagcuccggugguuuguggagcgcaaccuggucaagccggagggcaaggugaucgaccuaggcugugggcggggcgggugguccuacuacugcgccggccugaagaaggugaccgaagucaagggguacaccaagggcggccccggacacgaggagcccauccccauggccacguacggcuggaacaucgugaagcuucacagcgggcgcgacguguuuuucaccccuccggagaagugcgacacgcugcugugcgacaucggcgaguccucuccaaacccgaccaucgaggaagggcggacccuccgcguccugaagaugguggagccguggcugcggggcauccaguucugcaucaaaauccucaaccccuacaugcccuccgugguugagacucuggagcagaugcagcgcaagcacggcgggauguuagugcggaacccccucagcagaaauuccacgcacgagauguacugggugagcugcggcacgggcaacaucgucagugccgugaacaugaccagccggaugcuguugaaccgcuucaccauggcccaccgcaagccgacguacgagcgcgacguggaccucggagccggcaccagacacgucgccguugagcccgagaucgccaaccuggacauaaucgggcaacggaucgagaacauaaagaacgagcacaaguccaccuggcacuacgacgaggacaaccccuacaagacgugggcguaccaugggucauacgaggugaagcccuccgggacggccagcucaauggucaacggcgugguccgcuuguuaaccaagccgugggacgugauccccauggugacccagaucgccaugaccgacacgaccccuuuugggcagcagcgggucuucaaggagaagguggacacccgcacgccccggccgaagcgcggcacggcccagaucauggaggugacugccaaguggcuguggggcuuccugagcaggaacaagaagccgcgcaucuguacccgggaagaguucacccguaaaguccggagcaacgcggccauaggggccguguucguggacgagaaccaguggaacagcgcuaaggaggcuguagaggacgagagauucugggaccucgugcaucgggaacgcgagcugcacaagcagggcaagugugcgacgugcguguacaauaugauggggaagcgggaaaagaagcugggcgaguucgggaaggcgaagggaucccgcgccaucugguacauguggcucggcgcccgcuuccuggaguucgaggcgcugggguucaugaacgaggaccacugguucucccgcgagaauagccucuccggcgucgagggcgagggccugcacaagcugggguacauccuccgggacauuucgaagauccccgguggcaacauguaugccgacgacaccgccgggugggacacgaggaucaccgaggacgacuuacagaacgaggccaaaaucacggacaucauggagccggaacacgcgcugcucgcgaccuccaucuucaagcuuaccuaucagaacaagguggugcgcguccagcggcccgcaaagagcggcaccguaauggacguuaucucccgccgggaccagcgcgggucaggccaggugggcacuuacggccucaacaccuucaccaacauggaaguacagcucauccggcagauggaguccgagggcaucuucagcccuuccgagcuagagaacagcaaucuggccgagcgcgugcucgacuggcuggagaagcacgggguugagcggcugaagcgcauggcuaucuccggagacgacugcguggugaagcccaccgaugaccgguucgccacggccuuaaccgccuugaacgacauggggaagguccgcaaggacaucccacagugggagccgucaaagggauggaacgacuggcaacaggucccguucuguagucaccacuuccaucaacugaucaugaaggauggccgggagaucgugguccccugucgcaaucaggacgaacucguggggcgggccagggucagccagggcgccgguuggagccugagggagaccgccugccugggcaaguccuaugcgcagauguggcagcucauguacuuccaccgccgggaccugcgccucgccgcaaacgccauauguagcgccgucccggugaacugggugccuaccucccguaccacguggucuauccacgcgcaccaccaguggaugacaaccgaggacaugcucagcgucuggaaccgcguuuggauugaggagaaccccuggauggaggacaagacccaugugagcuccugggaggacguccccuaucuggggaagagggaagaccaguggugcggcagccugaucggccucacggcccgggccaccugggccaccaacauccagguggcgaucaaccaggugcgccggcugaucgggaacgagaacuaccuggacuacaugaccuccaugaagcgauuuaaaaacgagagcgacccugagggcgccuuaugguga

SEQ ID NO: 24613 - RNA, 9879 nt, Artificial Sequence
  derived and/or modified CDS sequence (opt11) from DENV-1__KT187564__SS-prME
agcgugacaaugcugcuuaugcugaugccaaccgcgcuggccuuucaucuuaccacucggggaggagagccccacaugauggucagcaaacaggagcgugggaagucccugcuguucaagacaagcgccggugucaacaugugcaccuugaucgcgauggaccuuggggaacugugcgaggacacuaugaccuauaaguguccgcgcauuaccgaggccgagcccgacgauguagacugcuggugcaacgccacugacacgugggugaccuacgggaccugcagccagacuggagagcaccggagggacaagcggagcguagcucucgcgccccacgugggccuuggucucgagacgcgcacugaaacuuggaugagcuccgagggcgccuggaagcagauccaacgggucgagaccugggccuugaggcaccccggguucacggugaucgcccuauucuuggcccacgccaucggcaccaguaucacccagaaggggauaaucuucauccuccugaugcuagugacccccuccauggccaugcggugcgucggcaucgguucacgcgacuucguggaaggacuuuccggcgcaacgugggucgacgucgugcuggaacacgggagcugcgugaccaccauggcuaaggacaagcccacccuugacauagagcuccucaaaacggaggugacgaaccccgcagugcugcggaaguugugcauagaggccaaaaucuccaauaccacuacggauagccgcugcccgacacagggggaagccacccugguggaggagcaggacgccaacuucgucugccggcggacauucguggaccggggaugggggaacggcugugggcuguucggcaaggggucccucaucacgugugccaaguucaagugcguaacgaagcuggaagguaaaaucguccaguacgagaaucugaaguacagcgugaucguaaccguacacacuggagaucagcaucagguggggaaugaaucgacggagcauggcacaaccgcuacgaucaccccucaggcccccaccaccgagauccaacucacggacuacggggcccugacguuggauugcucgccgcgcaccggccuugauuucaacgagaugguccugcuaacgaugaaggggaaauccuggcuaguacacaaacagugguuccuggaccucccccuucccuggaccagcggcgcuucuaccucccaggaaacguggaaucggcaggacuugcugguuacauucaagacggcccaugcgaagaagcaagagguggugguccucggcucgcaggaaggggcuaugcacaccgcgcugacgggcgccacugagauccaaaccucggguaccacgaccauauuugccggucaccuuaagugucgccucaagauggauaagcuaacgcugaaggggaugagcuaugucauguguacaggcaguuucaagcucgagaaggaggucgccgagacgcagcacggcacaguacucguccagauuaaguacgaaggcaccgacgcccccugcaagauccccuuuagcacccaggacgaaaaggguguaacgcagaacgggcggcugauaaccgccaacccaauuguuaccgacaaggagaagcccguuaacauugaggcagagccucccuucggggagagcuacaucguuauuggggcgggggagaaggcacugaaauugagcugguuuaagaagggcucgucaauuggcaagauguuugaggccaccgcucgcggcgcacgccgcauggcgauccugggugauacagccugggacuuuggauccauaggcgggguuuucaccagcgucgggaagcuggugcaccagauuuucgggaccgcuuaugguguccuauuuuccggagucucguggaccaugaagauaggcaucggaguguugcugacguggcuuggauugaacucucgcucgaccuccuuaucuaugaccugcaucgccgugggccucgucacacuguaccuggggguuauggugcaggccgacuccggcugcgucaucaauuggaaagggcgcgagcucaagugcggcagcggcaucuuugugacgaacgagguccacacuuggaccgaacaguacaaauuccaagcggauuccccgaagcgccuaagugccgcgaucgggaaggcaugggaggaaggcgugugugggauccgcucagccacucgucuagagaacauuauguggaaacaaaucuccaacgaacucaaccauauuuuacuugagaaugacaugaaauucaccgugguggucggcgacgucgcggggauacucgcacagggaaagaagaugauccgaccacagcccauggaguacaaguacagcuggaaguccuggggcaaggcuaagaucaucggggccgacgugcagaauaccaccuuuaucaucgacgggcccaacaccccugaaugcccggacgaucagcgcgcauggaacaucugggaggucgaagacuacggguucgguauuuuuaccacgaauaucuggcugaagcugcgggacagcuacacccaggugugcgaucaccggcugauguccgccgcgaucaaggacucgaaggccgugcacgcugauaugggcuauuggaucgaauccgagaagaaugagacuuggaaacuggcgagggcuagcuucauugaagucaaaaccugcauuuggcccaagucccacacgcucuggagcaacggagugcucgagucagagaugaucauacccaagauauacggcgggccgauaagccaacacaauuacaggcccggcuacuucacgcagaccgccgggccauggcaccugggcaaacucgagcucgacuucgaccugugugagggcaccacggucgucgucgacgagcauugcggaaaucguggccccucccugcgcaccaccaccgugacaggaaagauaauccacgaguggugcugccguuccugcacacugccgccccuccgguuccggggcgaagacgguugcugguacggcauggagauucggcccgugaaggagaaagaggagaaccuggugaaauccauggucagcgccggcagcggggagguugacuccuucagucucggacuucugugcaucuccaucaugauugaggagguaaugagaagccgcuggaguaggaaaaugcucaugaucgggacccuggccguauucuuccuacucaucaugggccagcugacauggaacgaccugauccgacucuguauaauggucggugcgaacgccucugaccgaaugggcaugggcacuaccuaccuggcccuuauggcgacauucaagaugcggccgauguucgcuguggggcuucuauuccgccggcugaccucccgcgaggugcugcugcugaccauaggauuaucgcuugucgcguccgccgaguugccuaacagccucgaggaacugggggacggccuggccaugggcaucaugauucucaagcuguugacugacuuccagucccaucagcucugggcgaccuuacugagccucaccuucauuaagacaaccuucuccuuacacuacgcguggaaaaccauggccauggugcuuucgaucgucucacucuucccccuuugucugucuaccacgucccagaaaacuaccuggcucccaguauuacuggguucucuaggcugcaagccucugacuauguuucugauugccgagaauaagaucugggggcggaaaucguggccccucaacgagggaaucauggccguggggauagucucuauccugcugucaucccuucugaaaaacgaugugccccuggccggccccuuaaucgcaggagggaugcugauagccugcuacgugauaagcgggucaagcgccgaucugagccuagagaaggccgccgaggucagcugggaggaggaggccgaacacuccggggccucccauaacauccugguggaggugcaagacgacggcaccaugaagauaaaggaugaggaacgggaugacacccugacgauccuacugaaagccacacugcuagccgucuccgggguguucccgcugucgauuccagcaacucuguucgugugguauuuuuggcaaaagaagaagcagcggaguggaguccucugggauacgcccagcccacccgagguggagcgcgcggugcucgacgacggcauuuacaggaucaugcagcgagggcugcucggucggucccagguaggggugggcgucuuucaggagaacgucuuucacaccauguggcacguaacgcgcggggccguguuaauguaccaaggaaaacggcuggagcccuccugggcgagcgucaagaaagaucugauuucauacggcggaggcuggcgccugcaggggucuuggaacacuggcgaggaaguucagguaaucgccgucgagcccgggaagaaccccaagaaugugcagacggcccccggcaccuuuaagaccccggagggcgaggugggagcgaucgccuuagacuucaagcccggcaccucgggcucacccauuguuaaccgggagggcaagaucgugggccuuuaugggaauggcguggucacgaccagcgggacguacgugagcgccaucgcucaagcgaaggccagccaggagggcccacuccccgaaauugaggacgagguguuuagaaagcggaaccugacgaucauggacuuacaccccggcuccgggaagacucgucgguaccucccggccauugugcgcgaggccaucaagcggaaguugcgcaccuugauccucgccccuacacgaguaguugccuccgagauggccgaggcccugaagggcaugccuaucagguaccagaccacagccguuaagucugagcacaccgggaaggagauaguggaccuuaugugccacgccaccuucacgaugcgccuccugucgcccgugcgggucccgaacuacaacaugauuaucauggacgaggcgcauuucacggaccccucgagcaucgccgcacgggguuacauaucuacccggguggggaugggcgaagcagccgcuaucuucaugaccgccacgccgccaggcuccguggaggcauucccgcagagcaacgcggugauccaggacgaggagcgcgacaucccagagcggucuuggaacucgggcuaugaguggaucacugacuuuccgggcaagaccgugugguuugugccauccaucaagagcgguaacgacaucgcaaacugccucaggaagaacggaaagagagucauccaacuaucacgcaaaaccuucgacacugaauaccagaaaaccaagaacaaugauugggacuacgugguuacgaccgauaucuccgagaugggcgccaauuuccgcgccgaccgcgucaucgacccgcggcguugucugaaacccguuauccugaaggacggccccgaacgugugauccuagccgguccgaugccggucaccguggccuccgcagcccagagacgugggaggaucggccggaaccacaacaaggaaggcgaccaguacauuuacaugggccaaccccugaacaaugacgaggaccacgcgcauuggacggaggccaaaaugcugcucgacaacaucaacaccccagaggggauuauccccgcccuauucgaaccggagagagagaagucugcggcaaucgacggcgaguaccgccuuagaggugaagcccguaagaccuucguugagcugaugaggcgcggcgaccugcccguuuggcuguccuacaagguagcgagcgagggcuuccaauacucagaccggagauggugcuuugacggggaaagaaacaaucagguccucgaggagaacauggacguagaaaucuggaccaaggagggugagcgcaagaagcuccggccccgcuggcuugacgcgcggacuuacuccgauccgcucgcgcucagagaguuuaaggaguuugccgcugguagacgcagcguuucaggcgaccuuaucuuagaaaucggcaagcugccccagcaccugacccagcgcgcccagaaugcgcucgacaaccuugucauguuacacaacucggaacagggcgggcgcgcguaccggcacgcaauggaagaauuaccugauacuauagagacucugaugcugcucgcccugaucgccguucucacugggggcgugacucucuucuuucuguccgggcgcgggcugggcaaaaccagcaucgggcuacucugcgucauggcgagcagcgugcugcuuuggauggccuccguagagccccacuggaucgccgcaucgaucauucuggaguuuuuccucaugguccugcucauccccgagccggaccgacagaggacgccacaggacaaccaacuggccuacguggugaucggccuccuguucaugauccucaccguugcagcaaacgagauggggcuucuggagacgaccaagaaggaccuaggcauuggacacguugccguagagaaccaccaccacgcugccaugcucgauguugaccugcaccccgcgucagccuggacucuauacgcggucgccacaacgaucauuacaccuaugaugcggcacaccaucgaaaacaccacagccaacaucagccugaccgcgaucgccaaucaggccgccauccugaugggccuagacaagggauggcccaucuccaaaauggacauuggggugccacuucucgcucugggcugcuauagccaggugaaucccuugaccuuaaccgcagccgugcuuaugcugguggcccacuaugccaucaucggcccggguuuacaagcgaaggcaacucgcgaggcccagaagcgcaccgcugccgggauaaugaaaaaucccaccgucgacggaaucguagcgauagaucuggacccgguggucuaugaugccaaguucgagaaacagcucggccagaucaugcuguuaauacucuguaccucccagauacugcugaugaggacgaccugggcccucugugagucaaucacucuggccaccggcccccuaaccacucuuugggagggcuccccgggaaaauucuggaauaccaccaucgcuguaucuauggcgaacaucuucaggggcuccuaccuggccggggccgggcuggccuucagccucaugaagucauugggcgggggacgccgggguacgggagcgcagggcgagacccugggggagaaguggaagcggaggcuuaaccagcuguccaagagugaguucaacacuuauaagcgguccggcaucauggaaguugaccguagcgaggccaaggaagggcugaaacggggcgagacgacgaagcaugcggucucccgcgggacggccaaacuucggugguucgucgagcgcaaccuggucaaaccggaggguaaggucaucgaucuagggugcggacggggagggugguccuauuacugugccggccugaagaagguaaccgaggucaagggguacaccaaaggggguccgggucacgaggaacccaucccaauggcuacauacggauggaaccucguuaagcugcauucggggaaggacguguucuucaucccucccgagaaaugugacacucuucucugcgacaucggugagagcucacccaacccgacuaucgaggaagggcggacucugagagugcucaaaauggucgaaccuuggcuccggggcaaucaguuuugcauuaagauacugaaccccuacaugcccaguguuguggaaacgcuggagcagaugcagcggaaacacggcgguaugcucguucgcaacccacugucucggaacuccacccacgaaauguauuggguguccuguggcaccgggaacaucgugagcgccgucaacaugacaucgcguaugcugcuuaacagauuuaccauggcccacagaaagcccacguacgagagggacguggaccugggugcgggcacccggcacguagccgucgagccagagguggcgaaccuggacaucaucggccagcgcauagagaauauuaaacacgagcacaagagcacauggcauuacgacgaggacaacccguauaagacgugggccuaccacggcuccuaugaagucaagccgaguggguccgccagcagcauggucaacggcgugguuaagcuccugaccaagcccugggauguuauucccauggugacccagaucgccaugacugacaccacgccguucggacagcaacggguauucaaggagaagguggacaccagaaccccgaaggcaaagcggggcaccgcgcagaucauggaggugacggcaagauggcuauggggcuuucucucacggaacaagaaacccagaaucugcacccgcgaggaguucacccguaagguccggagcaaugccgccaucggagcggucuuuauugacgagaaccaguggaacuccgccaaggaagccguugaggacgaacgcuucugggaccugguccaccgggaacgugaguugcacaagcagggaaagugugcaaccugcguuuauaauaugauggguaagcgggaaaagaaguuaggcgaguucgggaaggcgaaggggagccgcgcgauaugguauauguggcuaggagcgagguucuuggaguuugaggccuugggcuucaugaaugaggaucacugguuuucacgcgaaaacucgcuguccggcguugagggugaaggccugcacaagcuaggguacauauuacgagauaucuccaaaaucccgggcgggaacauguacgccgaugacacggccgggugggauacccgcaucaccgaggacgaccugcagaacgaggcuaagaucaccgacaucauggagccggagcaugcccuguuagcuaaagccauauucaaacugaccuaccagaauaaagucguccgcguucagcggcccgcgaagaacgggaccguuauggaugugauaucccgcagggaccagcgcgguucgggccaaguaggcaccuacggccucaacaccuucacaaacauggaggcgcagcugauccggcagauggagucggagggcaucuuuagccccagugagcuggaaaccccuaaucuggccgagcgcguccuggacuggcuggggaaguacggcguagagcgguugaagcgcauggccauaucgggugacgacugcgugguuaaacccaucgacgacagguucgccaccgcccugaccgcacugaacgauaugggaaaggugcguaaggacaucccccagugggagcccuccaagggcuggaacgacuggcaacaaguucccuucuguucccaucacuuccaccaguuaaucaugaaggacgggcgggagaucgucgugccgugccguaaccaagaugaacuugugggcagggccagggucucccagggggcgggcuggagccugcgggaaacggccugccucggcaagagcuacgcucagauguggcaauugauguacuuucaccgucgggacuugaggcuggccgcgaacgccaucugcuccgccgucccaguggacuggguccccacaucgcggacaacguggucaauccacgcgcaucaccaguggaugacuaccgaggacaugcuuucgguguggaaucggguguggauagaggagaaccccuggauggaggacaaaacacacaucuccaacugggaagacgucccguaucucggcaagcgugaggaccaguggugcggcagccuuaucgggcuaaccgcccgggccacgugggcuaccaacauccagguggccaucaaccaggugcgacggcugauugguaacgaaaacuaccucgacuauaugacauccaugaagcgcuucaaaaacgagucugaccccgaaggugcauuaugguag

SEQ ID NO: 24614 - RNA, 9879 nt, Artificial Sequence
  derived and/or modified CDS sequence (opt11) from DENV-1__KT187560__SS-prME
agcgucaccaugcugcucaugcuguugccgaccgcccucgccuuccaccuuacgacucguggaggagagccgcauaugaucgucagcaaacaggagcggggcaagagccuccuuuucaagacaucugcaggggugaacauguguacacugauagccauggacuuaggcgagcuaugcgaagacaccaugaccuauaagugcccgcguaucacagaggcugagccugacgacguggacugcuggugcaacgcuaccgacacgugggugaccuacgggaccugcagccagaccggagagcaccggcgcgacaagcgguccguugcucucgcuccgcacgugggccugggccucgagacgcgcacagagaccuggaugagcuccgagggcgccuggcggcagauccaaaaggucgagaccugggcguuacgccacccaggguucacugugauagcacuguuucucgcgcacgccaucggcaccagcaucacccaaaaagggaucaucuucauccugcugauguuggugaccccgagcauggccaugcguugcgucgguauugggaauagggacuucgucgaggguuuaagcggcgcgacguggguggacguaguguuggagcacgguuccugcgucacaaccauggccaagaacaagcccacccucgacauugaacugcugaagacggaggucaccaaccccgcggugcuccgcaaguuauguaucgaggccaaaaucagcaacacaaccacggacucccgcugucccacucagggcgaggccacccugguggaggaacaggacgcuaauuuugucugccggcguaccuucguggaccggggauggggaaacggcugcggucuguucggcaaagggagccuguuaacgugcgccaaauucaagugcgugacgaaacucgagggaaaaaucguccaguacgagaaccugaaguacuccgugaucgugaccguacacaccggcgaccaacaccaggugggaaacgagacaaccgagcacggcaccaucgcgaccaucacgccccaagccccgacgagugaaauccagcucacggacuacggggcccucacccuggacugcucgccccggaccgguuuagacuucaacgagaugguucuuuuaacgaugaaagagaaguccuggcuagugcacaagcaaugguuccuugauuuaccgcugcccuggacuuccggagcaucgacgucgcaggagacuuggaaccggcaggaucucuuagugacguucaagaccgcucacgcgaagaagcaggagguuguggugcugggcucccaggagggcgcgaugcacacagcgcucacaggggcaacggagauccagaccaguggaaccaccacgaucuucgccgggcaccugaagugccgccugaagauggacaaacucacccugaagggcgucuccuacgugaugugcaccgggagcuuuaagcuggagaaggaggucgcggagacacagcacggcacuguccugguacaggucaaguaugagggcaccgacgcccccugcaagauccccaucuccacccaggacgagaaaggugucacccagaacggccggcucaucacggccaaccccaucgugaccgacaaggagaagcccguuaacaucgagaccgagccgccuuucggggaguccuacaucguaauaggcgccggcgaaaaggcgcugaaauuguccugguucaagaaggggagcuccauugggaagauguucgaggccaccgcccgcggggcccggcgaauggccauccucggggacacugcuugggacuucggcagcauuggcgguguguucaccuccguggggaagcugguacaccaaguguuuggcacggcuuacggggugcuuuuuaguggagucuccuggacgaugaagauagggaucggcauacuccugacguggcugggccucaacucgcgcuccacaagccuguccaugaccuguauugcgguggggauggugacacuguaccucggcgucauggugcaagccgacagcgggugcgugauaaacuggaagggccgggagcugaaaugcgggucaggcaucuucgucacgaacgaggugcauacauggaccgagcaguacaaguuccaagcagauaguccgaagcgccugucagcugcuaucggcaaggccugggaagagggggugugcggcauccguucggccacccggcuggagaacaucauguggaagcagaucagcaacgaacugaaucacauccugcucgagaacgacaugaaguucaccgucguggugggggacgcaaacggcauccugacucagggaaagaagaugauccgcccccaacccauggagcacaaauauucuuggaaguccuggggcaaggcuaagaucaucggcgccgacacucagaacacgaccuucaucaucgaugggcccgacacgccggagugccccgacgaccagcgcgccuggaacauuugggaagucgaggacuacggcuucggcguuuucacaacuaauaucuggcugaaacuccgggacuccuauacccagaugugugaccaccgccugaugagcgccgcgaucaaggacucuaaggccgugcacgcagacaugggcuacuggauugagagcgagaaaaacgagacguggaagcuggcccgggccuccuucaucgaggucaagacaugcauauggccacgcagccacacccucugguccaacgggguguuagagagcgaaaugauaauccccaagaucuacgggggcccgaucucccagcacaacuaccggcccggguacuuuacccagacggcugguccuuggcaucuagggaagcuagagcuggacuucaaccugugcgagggcaccaccguagucguagacgagcacuguggcaaucgcgggccgagccuccggaccacgaccgugaccggcaaaauuauccacgaauggugcugcagguccuguaccuuaccgccccuacgguuccgcggggaggaugguugcugguacgggauggagauucggcccgucaaggaaaaggaggagaaccucgugaggagcaugguguccgccggcagcggcgaagucgauagcuucaguuuggggcuccucugugucucuaucaugauugaggaagugaugcggucccgcuggagccgcaagauguugaugacgggcacccuggcuguguuuuucuugcuuauaauggggcagcugaccuggaacgaccucauccggcugugcaucaugguaggcgccaacguguccgaucgcaugggaaugggcaccacauaccuggcccucauggcaaccuuuaagaugcggccgauguucgccgucgggcugcuguuccgccggcucacaagccgcgaagugcugcugcucaccauaggguuguccuugguagcaucuguggagcuucccaacucccuggaggagcugggggauggauuggccaugggcaucaugaugcugaagcugcucacggacuuccagagccaucagcucuggaccacacugcucuccuugaccuucauaaaaacgacccugagccucgacuacgccuggaagacaauggcgauggugcuguccauugucagcuuauuuccccugugucuguccaccacgagccaaaagaccaccuggcugcccgugcuccugggaucccucgggugcaagccgcucaccauguuccugaucaccgagaacaagaucuggggccgcaagagcuggccccugaaugaggggaucauggcgguuggcauuguguccauccuccugagcagccugcucaagaacgauguuccccuggcuggaccccugaucgcgggcggcaugcucaucgcguguuacgugaucuccgggagcuccgccgacuuaucacuggaacgcgcagcugaggucaguugggaggaggaagccgagcacagcggugcgucccacaacaucuugguggaaguacaagacgacgggacgaugaagauaaaagaugaagagcgggacgacacgcugaccauccugcucaaagccaccuuacuggccgucagcggcguguacccgauguccauaccggccacccucuucgugugguauuucuggcagaaaaagaagcagagaagcggagucuugugggauacccccagcccgccugaggucgagcgcgccgugcuggacgacggcaucuauagaaucuugcagcggggccuccuggggcgcagccaggugggggucggggucuuucaagacgguguguuccacaccauguggcacgucacccgcggggcggugcugauguaccagggaaagcgccucgagccuuccugggcaagcgucaagaaggaccugaucuccuauggagggggcuggcgauuccaggggucguggaacacgggggaagagguccaggugaucgcggucgagccugggaagaacccuaagaacguacagaccacgcccgguaccuuuaagaccccggaaggggaggucggggcaauagcccucgacuucaagcccgguacauccgggagcccgaucgucaaucgcgagggaaaaauugugggccucuacgggaacgggguggucacaacauccgggacguacgugagcgccaucgcacaggccaaagcuagccaggagggcccgcugcccgagaucgaggacgagguguucaagaagcggaaccuaaccaucauggaucuccaucccgggucgggcaaaacccgccgguaucuuccggccaucguuagggaagcuaucaaacgcaagcugcggacccucauccuggcucccacgagagugguggccagugagauggccgaggcgcugaagggcaugccgauccgguaccagacaacugccguuaaguccgagcacaccgggaaagagaucguggaccucaugugccaugccacguucaccaugcgucugcugagcccgguacggguaccgaauuacaacaugaucauaauggaugaggcccacuucaccgacccggccuccauugcggccaggggcuacauuagcacccggguagggaugggggaagcugccgccaucuucaugacggccacgccgcccggguccguugaggccuucccgcagucgaacgcugucauccaggacgaggagcgcgacauccccgagcgguccuggaacagcggcuaugacuggauaacugauuuccccggaaagaccgugugguucgugcccagcaucaagucggggaacgacaucgccaacugccuccgcaagaauggaaagcgcgucauccaguugucccgcaagacuuucgauaccgaguaccagaagaccaagaacaacgacugggacuacguggugaccacagauaucagcgagaugggggccaauuuccgggccgaccgcguuaucgacccgcggcgcugccugaagccggugauccucaaggacggccccgagcgggucaucuuggccggccccaugccggugacggccgccagcgccgcccagcgccggggacgcaucggccgcaaccagaacaaggagggggaucaguacaucuacaugggacagccucuaaacaacgacgaggaccacgcccacuggaccgaggcuaaaaugcuccuggacaacaucaacacccccgaggguaucauccccgcccuguucgaaccggagcgugaaaaauccgcggccaucgacggugaguaccgcuuacgaggagaggcccgcaagacauucguggagcucaugcggaggggggacuuacccgucuggcucuccuacaaaguagcgagcgagggcuuccaguacuccgaucggcgcuggugcuucgacggggagcguaacaaucaggugcuggaggagaacauggauguugagauuuggaccaaggagggcgagcgcaagaagcugcggccgcgcuggcucgaugcccggaccuacuccgacccccuagcguuacgggaauucaaggaguucgccgccgggcggcgcagcguauccggcgaccucauccucgagauaggcaagcugccgcagcaccucacccugcgcgcccagaacgcauuagacaaccucgugauguuacacaacagcgagcagggcgggaaggcguaccgccacgcaauggaggaacugccggacaccauugaaacucucaugcugcuugcacucauagccguacugaccgggggcgugacccuguucuuccuauccgguaagggccugggcaagaccagcaucgggcugcuuugcgugauggcguccagcguccugcuguggauggccuccguggagccacacuggaucgccgccagcaucauucucgaguucuuccuaaugguucugcucauccccgagccggaccggcagcgcacgccccaggacaaccagcuggcuuauguugucaucggccuacuauuuaugauccugacaguggcggccaacgagauggggcugcucgagaccacuaagaaggacuuaggcaucgggcacgucguggcagagaaccaccaccacgccacgaugcuggacaucgaccuccaccccgcuuccgcauggacccuguacgcaguggcgacgaccauuaucacuccgaugaugcggcauaccaucgaaaacaccacagcgaacauaagccucacggccaucgcaaaccaagccgccauccuuaugggccuggacaagggcuggcccaucuccaagauggauauuggagugccacugcuggcucugggaugcuacucacagguaaauccccugacccuuaccgcggcggugcucaugcuggucgcgcacuaugccaucauuggaccggggcuccaggcgaaagcaacccgagaggcccagaagagaacagcggcugggaucaugaaaaaccccaccguggauggcauaguggcuaucgaccuggaccccgucgucuacgacgcgaaauucgagaaacagcugggccagaucaugcuccuaauccuuugcacuucccagauccuccugaugcggaccacgugggccuuaugcgagagcaucacccucgcuaccgggcccuuaaccacguugugggaagguuccccggggaaguucuggaacaccacuaucgcagugaguauggcgaacauauuucgcggcagcuaccucgccggcgccgggcuggccuuuagccugaugaaaucccucggcggggggcggcgcgggacaggcgcccagggcgagacgcugggggagaaguggaagcggcagcugaaccaauuaagcaagagcgaguuuaacacauacaaacgcucggguauaauggaaguugaccggagcgaggccaaggaggggcugaagcgcggcgaaaccaccaagcacgccguguccagggggacggccaagcugcgcugguuuguagagcggaaccuggucaaacccgagggaaaagugaucgaccugggcugcggcagaggcggguggagcuauuacugcgcuggucuaaaaaaagucaccgagguuaaggguuacacgaagggcggaccugggcaugaagagcccaucccuauggcuacauacgguuggaacaucguaaagcugcacagcgggcgggacguguuuuucacgccgccagagaagugcgacacgcuguugugcgacaucggcgagucaagcccuaauccgaccaucgaggaaggacgcacccugcggguccuaaagaugguggaacccuggcugcggggcaaccaguucuguaucaagauccugaaucccuacaugcccagcguggucgagacccuggagcagaugcagcgcaaacacgguggaauguuaguacgcaacccgcugucccggaacagcacucacgagauguacuggguguccugcggcaccggaaacaucgucagcgcggugaacaugaccucacgcaugcuccuuaaccgcuucacaauggcccaccggaagcccacguacgagcgcgacguggaucugggagccggaacccggcacgucgccguggagcccgagauugccaaccucgauaucaucggccaacgcauagagaacaucaagaaugaacacaagaguaccuggcacuacgaugaagacaaccccuacaaaacaugggccuaccauggcuccuacgaggugaagccgagcggguccgcuuccuccauggucaauggcguggugcggcugcucacaaagcccugggacgugaucccgauggugacccagauagccaugaccgacaccacgcccuuugggcagcagcgcgucuucaaggagaaaguggauacgaggaccccgcgcccuaagcggggcaccgcgcagauuauggaggugacggccaaguggcuauggggcuuccugagccgcaauaagaagccccggaucugcacucgcgaggaauucacccggaagguccgcagcaaugcggcgauuggggcuguuuuuguggacgagaaccaguggaacuccgccaaggaggccgucgaagacgagagguucugggaccuuguucaccgcgagcgggagcuccacaaacaaggcaagugcgccaccugcgucuauaacaugauggggaagcgggagaaaaagcugggcgaguuugggaaggccaagggaagucgggccauaugguacauguggcugggagccagguuucuugaguucgaggcucuaggguucaugaacgaggaccauugguucucccgggagaacagccuuuccggcgucgagggggagggccuccacaagcugggguacaucuugcgcgauaucaguaagauacccggcgggaacauguacgcugacgacacggccggaugggacacccgcaucacagaagacgauuugcagaacgaggccaagauaaccgacaucauggaacccgagcacgcccugcuggcgacgagcaucuucaaguugacuuaccagaacaagguggugcggguacagcgccccgccaagagcggcaccgucauggacgugaucucuaggagggaccagcgggggagcggucagguuggaaccuacggucugaacacuuucacaaacauggaggugcagcugauacgacaaauggagagcgagggcaucuucagccccuccgagcucgaaaauagcaaccuggccgagcggguccuggauuggcucgagaagcacggagucgagagacugaagaggauggccaucuccggcgacgacugcguagucaaaccaaccgacgaccgcuucgccaccgcccugacggcccucaacgauauggggaagguccgaaaggacauaccccagugggagcccucgaagggcuggaacgacuggcagcagguccccuucugcucccaucacuuccaccagcuuaucaugaaagaugggcgcgaaauagugguaccgugccggaaccaggacgagcugguggggcgcgcccgggugagccagggcgccggguggagccuacgcgagaccgccugccugggcaaguccuacgcccagauguggcagcugauguacuuccaucggcgcgaccuccgguuggccgccaacgccauuugcucugccguccccgugaacugggugcccaccucccgcacaaccuggagcauucacgcgcaccaccaguggaugacgacggaagacaugcugucggucuggaaccgcguguggaucgaggagaaccccuggauggaggacaagacccaugugagcaguugggaggacgucccauaucucgguaagcgggaggaccaguggugcgggagcuugaucggccucaccgcucgcgccacaugggcaacgaacauacagguggcgaucaaccaggugcggagguugaucgggaacgagaacuacuuggacuacaugacuaguaugaagcgguucaagaaugagagcgaccccgagggcgccuugugguaa

SEQ ID NO: 24615 - RNA, 9879 nt, Artificial Sequence
  derived and/or modified CDS sequence (opt11) from DENV-1__KT187561__SS-prME
agugucaccaugcugcuuaugcugcugccgaccgcccucgcauuccaccugaccacucgcggcggggaaccccacaugauugugucuaaacaggaacgcggcaagagccuccuauuuaaaaccagugcgggggugaacauguguacgcuaauagcaauggacuugggcgagcugugcgaggacaccaugaccuacaaguguccucguauuaccgaggccgaaccugacgacguagacugcuggugcaacgccaccgauacuuggguuacguacgggaccuguagccaaacuggggagcaccgacgcgacaagcggucaguggcgcuggcgccccacguuggccuggggcucgagacgcguacugagaccuggaugucauccgagggagccuggcgccagauucagaaaguggaaaccugggcccugcgccaucccggguuuacggugaucgcguucuuucuggcacaugccauuggaacaagcaucacacagaagggcaucaucuucauacuccucaugcuugugacccccuccauggccaugaggugcgucggcaucggcaaucgugauuucguagaggggcugucgggcgccacgugggucgacguugugcuggagcacgguuccugcgugacaaccauggcgaagaacaagcccacacuggacauagagcugcucaagacggaggucaccaaucccgcgguucugcggaaacucugcaucgaggcgaaaaucucuaacacuaccacggacucccgcugucccacgcaaggcgaagccacgcugguggaggaacaggacgcgaacuucgucugccggcguacuuucguggaccgaggcugggggaauggcugugggcuguuuggcaaggguucucugcugacgugugcgaaguucaagugcgugaccaagcuggaggggaagauuguccaauacgagaaccucaaguacuccguaaucgugaccguccacacuggggaccagcaccagguggguaacgagacgaccgagcacggcacaaucgcgacuaucacaccgcaggccccgacaagcgagauccagcuaaccgacuacggagcccugacccucgacugcagcccccggaccggacuugacuucaacgaaaugguacuguuaacgaugaaggagaaguccuggcuggugcacaagcagugguuccuugaccucccgcuaccguggacauccggugccagcaccucucaagaaaccuggaaucgacaggaccugcucguaacguucaaaaccgcccacgcgaagaagcaggaggucguggugcuaggcucccaggaaggugccaugcacacggcccugacaggggccacagaaauccaaacgucggguacuaccacgauuuuugcugggcaucucaagugccgguuaaaaauggauaagcugacucucaagggugucuccuacgugaugugcaccgggucauucaagcuggagaaagaggucgccgaaacccagcauggcacgguccuaguccaggugaaguacgagggcaccgacgccccgugcaagauccccaucuccacccaggacgagaagggggucacccagaauggcagacuuaucaccgccaacccgauugugaccgacaaagagaagcccgugaauauagagacugaaccucccuucggggaaagcuacaucgucaucggcgcuggggagaaggcccucaaguuauccugguucaagaaggggucuuccaucggcaagauguucgaggccacggcccgcggggcccggcgaauggccauccuuggcgacacagcgugggacuucggcucaauuggcggcguguucacgaguguggggaagcucguccaccagguuuucggcaccgcauacggcgugcuuuucucuggugugucguggaccaugaagaucggaauuggcauccugcucacauggcuggggcugaacagccggagcacuagcuuguccaugaccugcauagccgucggcauggugacccuauaccugggcguaaugguacaggccgacagcgggugcguaauaaacuggaaaggccgcgaguuaaagugcggauccggcaucuucgucaccaaugagguacacaccuggaccgagcaguacaaguuccaggccgauucaccgaagcgccucagugcggccaucggcaaggccugggaggagggggucugcggcauacgaucagccacucguuuggagaacaucauguggaagcagaucagcaaugaacucaaucacauccugcuggagaacgacaugaaguucacggugguggugggugacgcaaacggaaucuuaacccagggaaagaagaugauacgaccacagcccauggagcacaaauacucguggaaguccuggggaaaggcgaagaucauaggcgccgacacacagaauacuaccuuuaucauagacgggcccgacacgccggagugucccgacgaccagcgggccuggaacaucugggagguggaggauuacggcuuugggguguucacuaccaacauauggcugaaguuacgggacuccuacacccaaaugugcgaccaucgguugaugucagccgcgaucaaagacuccaaggcugugcaugcugacaugggcuacuggauagagagcgagaagaacgaaacuuggaagcuggcccgcgccuccuucaucgaggucaagaccuguauuuggccucgcagccacacucugugguccaacgguguccucgaguccgagaugauuauccccaagaucuaugggggcccaaucucccagcacaacuaccgccccggguacuuuacccagacggccggccccuggcacuuggggaagcuggagcucgacuuuaaccucugcgagggcacgaccguugucguugacgaacacugcgggaaccgugggccgagccugcggacuaccaccguuaccggcaagaucauccacgaauggugcugccgauccuguaccuuacccccacuacgguuccguggagaggacggaugcugguacgggauggagauccggccgguaaaagaaaaggaggagaaccuagucaggagcauggugagugccggcucgggggaggucgacucauucucccuugggcugcugugcgucuccauaaugauagaagaaguuaugcggucgcgcuggucucguaagaugcuaaugacuggaaccuuagcgguauucuuccugcucaucaugggacagcuaacauggaacgacuuaauccgguuauguaucauggugggcgcgaacguguccgaccgcaugggaaugggcacgacguaccuggcccugauggcgaccuucaaaaugcgccccauguucgccgucgggcuccucuuccgccggcugacuagccgggaggugcuccuacugaccaucgggcucucccucguagccagcguggagcugccaaacucacucgaggagcugggggacggguuggcaaugggcaucaugauguuaaaguugcugacggacuuccaaagccaccaacucuggacgacuuuacugucccugacguucaucaaaaccacuuugucgcuggacuacgccuggaagacuauggcgaugguguuaaguaucgucagccuguuccccuugugucucuccaccacgagccagaagaccaccuggcuccccgugcuccugggcuccuuuggaugcaagccucugaccauguuccugaucaccgagaacaagaucugggggcgcaaaucuuggccacugaacgaggggaucauggcgguuggcauugucuccaucuugcugucuucucuccugaaaaacgaugugccacuggccgguccccucaucgcaggcggcaugcucaucgcgugcuacgugaucucggggucgucggccgaccugagccucgagcgcgccgccgaagucuccugggaggaggaggccgagcacagcggugcuucucacaauauacugguggaggugcaagacgaugggacgaugaagaucaaggaugaggagcgagacgacacgcugaccauucucuugaaggccacacuacucgccguuucgggcguguacccgaugaguaucccggccacgcuguucguaugguacuucuggcagaagaagaagcaacgcagcgggguacugugggauaccccuagcccuccagagguggagcgggccguucucgacgauggaaucuaucguaucuugcagcggggccugcugggacgcagccaaguaggaguagggguuuuccaagacggcguauuccacaccauguggcacgucacgcggggugcgguguuaauguaccaaggcaaacggcuugaacccuccugggcuagcgucaagaaggacuuaaucagcuacggcgggggcuggcgguuucaggggagcuggaacaccggagaggagguccaggucaucgcugucgaacccgggaaaaaccccaagaacguucagaccacccccggcaccuucaagacgccugagggugaggugggggccauugcccucgacuucaagccggggaccuccggcagccccaucgucaaccgcgaaggaaagaucguagguuuguacggcaacggcguugucacuacgucggggacguacguuagcgcgauagcccaggccaaggcuagccaagagggaccgcuccccgagaucgaagacgaaguguucaaaaagcggaaccucacaaucauggaccuacaccccggauccggaaaaacccgccgguaccugccggcgauuguccgcgaggcuauuaagaggaaguugcggacucucauccuggcgccaacgcgcgugguugcaagcgagauggccgaggcgcucaaggggaugcccauccgguaccaaaccaccgcggucaaguccgaacacacggggaaggagauuguggaccuaaugugucacgccacguuuacaaugagacugcucagccccgugcggguccccaacuacaacaugaucaucauggacgaagcgcacuuuaccgacccugcuagcaucgcugccaggggcuacaucagcacccggguagggaugggcgaagccgccgcgaucuucaugacggcaacaccacccggguccguggaagccuuuccgcagagcaacgcggugauacaggacgaggagcgcgacauccccgaacggucuuggaacucgggguaugacuggaucaccgacuucccaggcaagacggugugguucgugccaucaauuaagucugguaacgacauugccaacugcuuaagaaagaauggaaaacgagugauucaacugucccggaagaccuucgacacugaauaucagaagacgaaaaacaacgacugggacuacguagugaccacggacaucagcgagaugggggccaacuuucgggcggaccgcgucauagauccccggcgcugccugaaaccggugauccuaaaggacggcccugagcgggugauccuugcagggcccaugccgguaaccgccgccuccgcagcgcagcgccgggggcgcauaggacguaaccaaaacaaggaaggugaucaauacauuuacaugggccagccccucaacaacgacgaggaccacgcgcacuggaccgaggccaagaugcugcucgauaacauuaacacacccgaggggaucauucccgcccucuuugaaccggaacgggaaaaaucggcggcaaucgacggagaguaccggcugcgcggggaagcccgcaagacguucguggaguugaugcgacgcggcgaucuccccgucuggcuguccuacaagguggccagcgagggcuuccaauacuccgaccgccgcuggugcuucgacggagaacggaacaaccaagugcuggaggagaacauggaugucgagauauggacuaaggagggcgagcgcaagaagcuccggccccgcuggcuggaugcgagaaccuacucugacccccucgcacuacgagaguucaaggaguucgccgcugggcguagaucugugagcggcgacuugaucuuggagauuggcaagcucccccagcaccugacccugcgcgcccagaacgcacucgacaaccuggucaugcuucacaacagcgagcagggcggaaaggcuuaccgccacgccauggaggagcuacccgacacaaucgaaacgcugaugcuacucgcacuaaucgccguucugaccggcgggguaacccucuucuuucugucggggaagggccuuggcaagacuagcaucgggcuccugugcguaauggcguccucgguccugcucuggauggcguccguggagccucacuggauagcggccagcaucauccuggaguucuuucugauggugcuccugauccccgagccggaccggcagcggacuccccaggauaaccagcuggcguacguugugaucggccuccuuuuccucauucucacgguggccgccaacgagauggggcugcuggagacaaccaaaaaggaucucggcauagggcacguuguggccgaaaaucaccaccacgccacaaugcuugacaucgacuugcauccggccucugcguggacacuauaugccguagccaccaccaucauaaccccgaugaugcgacacaccaucgaaaacaccaccgccaacaucucacugacugccauagccaaccaggcagccauacucaugggccuagacaaaggcuggccuaucuccaaaauggauauuggggucccccuucuggcuuugggcugcuacagccaggucaauccacugacccuaaccgccgcuguacucaugcuggucgcccauuacgcgauaaucgggccgggucugcaggccaaggcgacgcgcgaagcccagaagaggacggcggccgguauuaugaagaaccccaccguggaugguaucguggccaucgaccucgauccagucguguacgacgcgaaguucgagaagcagcucgggcaaauuaugcugcucauacugugcaccucccaaauacugcuaaugcggaccacgugggcauuaugcgagagcaucacccuagcuaccgggccgcucaccacguuaugggagggcuccccggggaaauucuggaauacuaccaucgcugugucuauggccaacaucuuccgcgguuccuaccuggcgggcgccgggcuugccuucucgcugaugaagucacugggcggugggcgccgcgggaccggcgcccagggagaaacgcucggcgaaaaguggaagcggcaacuaaaccaguugagcaagucagaguucaacaccuacaagcgaucugguaucauggaggucgacagaagcgaggcuaaggaggggcucaagcgaggcgagaccacuaaacaugcgguaucccgcgggacggccaaacuacgcugguucguggagcggaaccuggucaaaccggagggcaaagucauagaccugggaugugggcgcggcgguuggagcuauuacugcgccggacucaaaaaggugacagaggucaagggguacaccaaagggggaccugggcacgaggagccuauaccgauggccaccuacggcuggaacaucgugaagcuccauuccggacgggacgucuucuuuacgccgcccgagaagugcgacacucugcucugcgacaucggugagagcucccccaauccgaccaucgaggaggggcgaacacugcgggugcugaaaaugguggagccuuggcuccgcggcaaucaauucugcaucaagauccuaaacccauacaugcccucgguaguagaaacccuggagcagaugcagcggaagcacggcgggaugcucguuaggaacccgcugucacggaacuccacacacgagauguacugggucuccugcgggaccgggaacaucguaagcgcgguaaacaugacuucucgcaugcugcucaacagguuuaccauggcucaccggaagcccaccuaugagcgcgacguagaccugggcgccggcacccggcacgucgccguagagcccgagaucgccaaccucgacaucaucggccagcguauugaaaacaucaagaacgagcacaagagcaccuggcacuacgaugaggacaaccccuacaagaccugggccuaucacggcucguaugaagugaagccgucaggauccgccuccuccauggucaacggaguggucagacugcugacgaagccgugggacguuauccccauggugacccaaaucgcuaugaccgacaccacgcccuucgggcagcaacgaguuuuuaaagagaaaguggacacuaggacaccccgcccaaagcggggcacugcccaaaucauggagguuacggccaagugguuauggggcuuccugucgcgcaacaagaaaccgcguaucugcacucgagaggaguucacacggaaggucaggucaaacgcggccaucggugcgguauuugucgacgaaaaucaguggaacuccgccaaggaggccgucgaagacgagcgguucugggaucucgugcaccgcgaacgcgagcugcauaagcagggcaaaugugcgaccugcguguacaacaugaugggaaaacgcgagaagaagcucggcgaguucggaaaggccaagggcucgcgggcuaucugguacauguggcugggugcgagguucuuagaauuugaagcgcucggguucaugaacgaggaucauugguucucccgggagaauagccuguccggcguggagggggaaggccugcacaagcucggguacauauugcgcgacauuagcaagauuccgggcggcaacauguacgcugacgacacggccgggugggauacccgcauaaccgaggacgaccugcagaacgaggcaaagauaacugacaucauggaaccagaacaugcccuccuugcgacuuccauauucaaacugacauaccagaacaagguggugcguguccagcgccccgcaaaaagcggcacggugauggacgucaucucucgccgugaccagcgagguagcggccaaguuggcacauacgggcugaacacuuucaccaacauggagguccagcucauccgccagauggagagcgagggcauauucuccccuuccgagcuggagaacaguaaccuugcggagcggguguuagacuggcuggaaaagcauggggucgagcgccucaagcgcauggcgauaucaggugacgacugcguggugaaaccaaccgacgaucgcuucgccaccgcucugaccgcccucaacgacauggguaaggugcguaaggacauuccccagugggagcccuccaaaggguggaaugacuggcagcaaguucccuuuuguucacaccacuuccaucaacucaucaugaaggacggacgcgagaucgugguaccgugccggaaccaggaugaacucguggggagagccagggugagccagggagccggguggagucugcgcgagacagccugccucgggaaguccuacgcacagauguggcaguugauguauuuucacagaagagaucugcggcuggcugccaacgccauaugcagcgccguccccgugaauugggugccgacgucacgcaccacauggagcauccacgcgcaccaccaguggaugacuaccgaagacaugcugaguguauggaacagagucuggaucgaggagaaccccuggauggaggacaaaacacacguaagcuccugggaggacgucccguaccugggaaagcgggaggaucagugguguggcucgcucaucggcuugacugcccgugccacgugggcaaccaacauccaggucgcgaucaaucagguucggcgccugauagggaacgagaauuaccucgauuacaugaccucuaugaagcgauucaagaacgaaagcgaccccgagggcgcgcugugguga

SEQ ID NO: 24616 - RNA, 9879 nt, Artificial Sequence
  derived and/or modified CDS sequence (opt11) from DENV-1__KT187562__SS-prME
agcguuaccaugcugcucaugcugcugcccaccgcccuugccuuccaccuaacaaccaggggcggggagccccacaugaucgugagcaagcaggagcggggaaagagccuccuguucaaaaccuccgcaggggugaacaugugcacucugaucgccauggaucugggcgagcucugcgaggacaccaugaccuacaagugcccgcggaucacugaagccgagcccgacgacguggacugcuggugcaacgccaccgacaccugggugaccuacgggaccugcucacagaccggggagcaccgccgcgacaagcgguccguggcccuggcgccucacgugggauuaggucucgagacgcgcaccgagaccuggaugagcagugagggcgcguggcggcagauccagaaaguggagaccugggcccugcgccaccccggguucacagugaucgcucucuuccucgcgcaugcuaucggcacgagcaucacccagaaggggaucaucuucauccugcugaugcucgugacccccuccauggccaugcggugcgucggaaucggcaaccgcgacuucguggaggggcugucuggcgcgacuuggguggacgucgugcuagagcacggguccugcgugaccaccauggccaagaacaagccgacccucgacaucgagcugcugaagacagaggucaccaacccugcggugcuccggaaacugugcauagaagcuaagaucagcaacaccaccacggacucacgcugccccacgcagggcgaggccacccugguggaggagcaagacgccaacuucgucugccgacgcaccuucguggacagaggcugggggaacgggugcggccucuucgggaaggggucccugcugacgugcgccaaguucaagugcgucaccaagcucgagggcaaaaucguccaguacgagaaccugaaguacuccgugaucgucaccguccauaccggugaccagcaccagguggggaacgagacgaccgaacacggcaccaucgcgaccaucacgccgcaagcccccacgagcgagauccagcugaccgacuacggggcccucacccuggacugcagcccucggaccggccuggacuuuaacgaaaugguccuccugacgaugaaggagaaguccuggcuggugcacaagcagugguuccucgaccugccgcugcccuggaccaguggggcuagcaccagccaggaaacuuggaaccggcaggaccuccuggugacguucaagacggcccacgcgaagaaacaggaagucguggugcugggcucccaggagggcgccaugcacaccgcccucaccggggccacggagauccagacgagcgguaccaccacgaucuucgccgggcaccugaagugccgccugaaaauggauaagcucacccugaagggcgucuccuacgugaugugcaccgguagcuucaaguuagaaaaggagguggcggagacacagcacggcacgguccugguccaagugaaguacgagggcaccgaugcccccuguaagauccccauuuccacccaggaugagaagggggucacccagaacgggcggcucauuacggccaacccgaucgugacagacaaggaaaaacccgugaacauugaaaccgagccgcccuucggggagagcuacaucgucaucggggccggcgagaaaacccuuaagcuuuccugguucaagaaggggucaucaaucggcaaaauguucgaggcgacggcccgcggggcccggagaauggccauccucggcgacaccgccugggacuucgguagcaucggcgggguguucaccucaguggguaagcugguccaccagguguuuggcacugcguacgggguguuguucagcggcgucuccuggacgaugaagaucgggaucgggaucuugcugaccuggcugggccucaacucccgcuccaccagccuguccaugaccugcaucgccguggguauggugacacuguaccucggcgucauggugcaggccgacagcgggugcgugauaaauuggaaggggcgggagcuaaagugcggguccggcaucuuugucaccaacgaggugcacaccuggaccgagcaauacaaguuccaagccgacagccccaagcgccugagugccgcgaucggcaaggccugggaggaaggggugugcggcauccgguccgccacccgccucgagaauauuauguggaagcagaucagcaacgaacuaaaccacauccugcucgagaacgacaugaaguucacggucguagugggggacgccaacgggauccugacccaggggaagaagaugaucaggccccagcccauggaacacaaguacuccuggaagaguuggggcaaggcaaaaauuaucggugccgacacccagaacaccacguucauaaucgacgggccggauaccccagagugccccgacgaccagcgcgccuggaacaucugggagguggaggacuacggcuuugggguguucaccacaaacaucuggcugaagcuccgggacuccuacacgcagaugugcgaccaccgccugaugucggccgccaucaaggacaguaaggcggugcacgccgauaugggcuacuggauugagagcgaaaaaaacgagacuuggaagcuggcucgagccuccuuuaucgaggucaaaaccugcaucuggccacgcagccacacgcucugguccaacggcgugcuggagagcgagaugaucauccccaagaucuacgggggccccaucucgcagcacaacuaccggcccggguacuucacucagaccgccgggcccuggcaccuggggaagcuggagcuggacuucaaccucugcgagggcaccaccguggucguggacgagcacugcggcaaucgcgggccgagccuccggacgaccaccgugaccggcaaaaucauccaugaaugguguugccgcuccuguacgcugccgccccugcgguuucgcggggaggacggcugcugguacgggauggagauccggccggucaaggagaaggaggagaaucucgugagaagcaugguguccgcuggaagcggcgagguugacagcuucucacuggggcugcucugcgugagcaucaugaucgaggagguuaugcguucccgcuggucgcgcaagaugcucaugaccggcacccuggccgucuucuuccuccugaucauggggcaguuaaccuggaacgaccucauccggcuaugcauuauggugggcgccaacguguccgaccgcauggggaugggcacgaccuacuuagcccucauggcgaccuucaagaugcggccuauguucgcggucgguuuacuguuccggcggcucaccagccgagaagugcugcuguuaacgaucgggcugucacuggucgccagcguggagcuccccaacucccuggaggaguuaggugacgggcucgccaugggcaucaugaugcugaagcugcucaccgacuuccagagccaccagcuguggaccacccugcucucccugacguuuaucaagacaacgcugagccucgacuacgccuggaagaccauggccauggugcuguccaucgucagccuguuuccccucugucuguccacgacuagccagaagaccaccuggcugcccgugcuccuggguuccuucgggugcaaaccgcuuaccauguuucucaucacggagaacaagauauggggcagaaagagcuggccccugaaugagggaaucauggcggugggcaucgucucgauacugcucagcagccuguuaaagaacgacgugcccuuggccgggcccuugaucgccggcggcaugcugaucgccugcuacgugaucuccgggagcagcgcggaccucagccuggagcgcgccgccgaggucuccugggaggaggaggccgagcacagcggcgcaucccacaacauccugguggaagugcaggaugacggaaccaugaagaucaaggacgaggagcgggaugacacccugaccauccugcugaaagcgacucuccuggccgucagcggcguauauccgauguccauccccgccacccuguucguuugguacuucuggcagaaaaagaagcagcgcagcggcgugcucugggacacccccagcccgcccgaaguagagagggccgugcuggacgacggcaucuaccgcauccugcagcggggccuguuaggucgcagccaggucggcguugggguguuccaggacggcgucuuccacacgauguggcacgugacgcgcggggccgugcugauguaccagggcaaacgccuggagcccuccugggcgagcgucaagaaagaccucaucuccuacggcgggggcuggcgguuccagggcagcuggaauaccggcgaggagguccaggugaucgcuguggagcccgggaagaaccccaagaacgugcagacgacccccggcaccuuuaaaacccccgagggcgaggugggggccaucgcacuggacuucaagcccggcacuuccgggucucccaucgucaaccgcgagggcaagaucgugggccuguacgggaacggcguggucaccacguccgggaccuacgugagcgccaucgcucaggccaaggccagccaggagggcccauugcccgagaucgaggacgagguguuuaagaagcggaaccugaccaucauggaccugcacccuggcagcggcaagacccgccgauaccucccggccaucguccgcgaggccauuaagcgcaagcugcgaacgcugauccucgcgcccacccgcgugguggccagcgagauggccgaggcccuaaagggcaugccaauccgguaucaaaccaccgcggucaaguccgaacauacuggaaaggagaucguggaccugaugugccacgcaaccuucaccaugcggcuccugagccccgugcgggucccgaacuacaacaugaucaucauggaugaggcccauuucaccgacccggccucgaucgcugcgcgcggcuacaucagcacgcgggugggaaugggagaggccgcugccauauucaugaccgcuacuccucccggguccguggaggcguucccgcagagcaacgccgucauccaagacgaggaacgcgacaucccugagcgguccuggaacagcggcuacgacuggaucaccgacuuccccggcaagacggugugguuugugcccuccaucaaaagcgggaacgacaucgccaacugccugcgcaaaaacggcaagcgcgugauccagcucucucgcaagaccuucgacaccgaguaccagaagaccaaaaacaacgacugggauuaugugguaacgaccgacaucagcgagaugggcgccaacuuccgggccgaccgcgucaucgacccgcgacgcugccucaaacccguaauccugaaggacggccccgaaagagucauccucgcggggccuaugccugugaccgccgccuccgccgcgcagcgccgcggccgcaucggccgcaaucagaacaaggagggggaccaguacaucuacaugggucagccccugaacaacgacgaggaccacgcccacuggacugaggccaagaugcuacuggacaauaucaacacgcccgaggguaucaucccugcccuauucgagccggagcgggagaaguccgccgcgaucgacggcgaguaccgcuugcgcggggaggcccgcaagaccuuuguggagcuaaugcgacgcggcgaucugcccgucuggcucuccuauaaggucgcgagcgagggcuuccaauacuccgaccggcgcuggugcuucgacggcgagcgaaacaaccaggugcucgaggagaacauggacgucgaaaucuggaccaaggagggcgaacgcaagaagcugcggccccguuggcuggacgcccgcaccuacuccgacccccucgcgcugcgcgaguuuaaggaguucgcagccgggaggcguagcguguccggcgaccugauccucgagaucgggaaguugccgcagcaccugacccucagagcccagaacgcccuagacaaccugguuaugcuucacaacucggagcagggcgggaaggccuaccgccacgcgauggaggagcuacccgacacgauugagacccugaugcuccuggcccuuauugccguacucacugggggcgugacccuguucuuccuuuccgggaaaggccucggcaagacgagcaucgggcugcuuugugugauggccucaagcguccuccuguggauggcauccguggagccccauuggaucgcagccagcaucauccuggaguucuuccugauggugcugcugauccccgaaccugaccggcaacgcacgccccaggacaaccaacucgcuuacgucgugaucggccugcuguucaugauucucaccguggccgcgaacgagaugggccugcuggagaccacuaaaaaggaccugggcaucgggcacgucguggccgagaaccaucaccacgccaccaugcuggacaucgaccugcaccccgccuccgccuggacccucuacgcgguugccaccacgaucauaaccccgaugaugcggcacaccaucgagaacaccacggcaaacaucagcuuaacagccaucgccaaccaggcggccauccugaugggccucgacaagggcuggcccaucuccaagauggacauaggggucccccuacuggcccucggcugcuacagccaggugaacccccugacccugaccgccgccguucucaugcuggucgcgcacuaugccaucauugggccggggcugcaggccaaggccacgcgcgaggcccaaaagcgcacagccgccggcaucaugaaaaaccccaccguggacggcaucguggccaucgaccucgaccccgucguguacgacgcuaaguuugagaagcagcugggccagaucaugcugcucauucugugcaccucccagauucugcucaugcggacgaccugggcgcugugcgagagcaucacccuggccaccgggccccugacgacccugugggagggcuccccagggaaauuuuggaacaccacgaucgccgugagcauggccaacaucuuucgaggcucuuaccuagccggcgcggggcucgccuucagccugaugaaauccuugggugggggcagacgcgggacgggcgcccagggagagacccucggcgaaaaguggaagcggcagcugaaccagcugagcaagagcgaguucaacacauacaagcgcagcggcaucauggaggucgaccggagcgaggccaaagagggguugaagagaggcgagacgacgaaacacgccgugucucgggggacugcgaagcuccguugguucguugagcggaaccuggucaagcccgagggaaagguuauagaccugggcugugggcgcggcggguggagcuacuacugcgccggccucaagaaggugaccgaggucaagggguacaccaagggcggccccgggcacgaggaacccaucccuauggccaccuacggcuggaacaucgugaagcugcauucagggcgggacguguucuucacgccgcccgagaagugcgacacccugcucugcgacaucggcgagagcucccccaacccgaccaucgaggaggggcguacccugcguguccugaagaugguggagcccuggcuccgcggcaaccaguucugcaucaagauccuuaaucccuauaugcccaguguggucgagacgcuggagcaaaugcagcggaaacacggcgguaugcucgugcgcaacccucugucacggaauagcacccacgagauguacugggucuccugcggcaccgggaacaucguuagugccgugaacaugaccucccgcaugcugcucaaccgcuucacuauggcgcaccggaagcccaccuacgagcgcgacgucgacuugggcgccgguacccggcacgucgccguagagcccgagaucgccaaccuggacauuaucgggcagaggaucgagaacaucaagaacgagcacaagaguacauggcacuacgacgaggacaaccccuauaaaacgugggccuaccacgguuccuacgagguuaagcccagcggguccgcgagcuccauggucaacggcgucguccgucuccugaccaagcccugggacgugauccccauggugacccagaucgcuaugaccgacacgacccccuucgggcagcagcgugucuucaaggagaagguggacacccggaccccucgaccaaagcgugggaccgcccagaucauggaggugacugccaaauggcuguggggauuccuaagccgcaacaagaagccccggaucugcacucgcgaggaguucacgcggaagguccgaagcaacgccgcgauuggagccguguucguggacgagaaucaguggaacuccgccaaggaggcggucgaggacgagcgguuuugggaccuggugcaccgcgagcgcgagcugcacaagcagggcaagugcgcaacuugcguguacaacaugauggggaagcgcgagaagaaacucggcgaguucgggaaggcgaagggcagcagggccaucugguauauguggcugggcgcccgcuuccuggaguucgaggcccucggguucaugaacgaagaccacugguuuucccgggaaaacagccugucuggaguugaaggggagggucugcacaaguuagguuacauccugcgggacauaagcaagaucccgggcggcaacauguacgcggacgacaccgccgggugggauacccgcaucaccgaggacgaccugcagaacgaggccaaaaucacggacauuauggagccagagcacgcccuccuggccaccaguauuuucaagcuaaccuaccagaacaaggugguucggguccagcgccccgcaaagagcggcaccgugauggacgucaucucccggcgcgaccagagggggagcggucaggucggaacguacggauuaaacacguucaccaacauggaggugcagcuaauccgccagauggagucggaggggaucuuuagccccagcgaacuggagaacagcaaccucgcggagcgggugcuggacuggcuggagaagcaugggguggaacgccucaagcggauggccaucuccggggacgacugcguggugaagccgaccgacgaccgcuucgccacggcucuaacagcgcugaacgacauggggaagguccggaaggacaucccccaaugggagcccucgaagggcuggaaugacuggcagcagguccccuucugcucccaucauuuccaccagcucaucaugaaggacggccgcgagaucguggugccgugucggaaccaggacgagcugguugggcgcgcccgggugucgcagggugcggguuggagcuugcgcgagaccgccugccucggcaaauccuaugcccagauguggcagcugauguacuuccaucggcgcgaucugcggcucgcggccaacgccauuuguagugccguccccgugaacugggugcccacaucccgcaccacguggagcauacacgcccaccaccaguggaugaccaccgaagacaugcuguccgucuggaaccgcguauggauagaggagaaccccuggauggaggauaaaacccacgugucguccugggaggacguuccguaccuggggaagcgggaagaccaguggugcggaagccucaucggacugacggcgcgcgcgaccugggccacaaauauucagguugcaaucaaccagguucgccgcuugaucgggaacgagaacuaccucgacuacaugaccuccaugaagcgcuucaaaaacgagagcgauccagagggcgcgcugugguga

SEQ ID NO: 24617 - RNA, 9879 nt, Artificial Sequence
  derived and/or modified CDS sequence (opt11) from DENV-1__JQ045628__SS-prME
ucagucaccaugcuacugauguuaaugcccacugcgcuagcuuuccacuugacgacucggggaggggaaccgcacaugauaguauccaaacaagaaagggggaagucucuccuauuuaaaacauccgcaggagugaacaugugcacacugauagcaauggaccuaggagaacuuugcgaagauacgaugacguacaaaugcccacggauaacagagaccgaacccgacgacguagauugcugguguaacgccaccgacacaugggugaccuacggaaccugcagccaaacgggagaacaccgacgagacaagcgcuccguggcucuagccccacacguaggacucggccucgagacuagaaccgagaccuggaugaguagcgaaggggccuggaaacaaauccagagaguggagaccugggcccuccgccauccgggcuucacaguaauagcuuucuucuuggcacacgccaucggaaccagcauuacccagaagggcauaaucuuuauacuucugauguuagucacaccaagcauggcaaugaggugugucggaauaggaucccgggacuuuguagaggggcuguccggggccaccuggguggauguagucuuggaacauggaucuugugucaccacaauggcaaaagauaaaccaacacuagacaucgagcuucucaaaacagaggugaccaacccggccauacuccgcaaacuuugcauagaggcaaaaaucagcaacacgaccacagacucccgauguccaacacaaggagaggcaacucuaguggaagaacaagacgccaacuuuguaugcagaaggacauucguugaccguggguggggcaaugggugcgguuuauucggaaagggaagccuaauaacgugcgcaaaauuuaagugcgugacaaaacuggagggaaaaaucguucaguaugagaaccucaaauauaguguaauuguuaccguacacaccggagaccaacaccaaguaggcaacgaaucaacagagcacgggacgacggccacaaucaccccacaggcaccaaccacggaaauccaauuaacggacuacggggccuugacacucgacugcaguccacgcacaggacuagacuucaacgagauggugcuccugaccaugaaggaaaagucuugguuagugcacaaacagugguuucucgaucuaccgcucccguggacuagcggugcaaguacgucacaagagaccuggaaucggcaagaccugcucgucaccuucaaaacagcgcacgcgaaaaagcaggaaguaguaguacugggcagucaggaaggcgcuaugcacaccgcccuaacaggugcgaccgagauccagacgagugguaccacgacuauauucgcaggccaccucaagugucgcuugaaaauggacaaacuaacacuaaaagggaugagcuacgucaugugcacaggguccuucaaacuagagaaagagguggcagaaacacaacauggcacgguguuagugcaaauaaaauacgagggaacggacgcccccugcaaaauaccuuucucaacccaagacgagaaaggcguaacacaaaacgggcggcuaaucacagcuaacccgauagucaccgacaaagagaagccgguaaacauagaagccgaacccccuuuuggggaauccuacaucguaauaggggccggcgaaaaagcucugaaguuaaguugguucaagaagggaagcaguauuggaaagauguucgaagcaacagcacguggcgcccggcgaauggcgaucuuaggcgacacagcaugggacuucggaucgauuggagggguauucacaagugugggaaaacucguccaccaaauuuuuggaaccgcguauggcguauuauucagcggcguuaguuggaccaugaaaaucgggaucggggugcuauugacguggcucggucucaacagucgcagcacaagccuaaguaugaccugcaucgcggugggcuuaguuacucucuaccugggagugauggugcaagcggacucuggaugcgucaucaacuggaagggacgagagcugaaguguggaagugggauauucgugaccaaugaggugcacacuuggaccgagcaguacaaauuucaagcggacaguccaaaaaggcugagcgcagcgauagggaaagcaugggaagaaggcguaugcggcauaaggucagcgacccgguuggagaacauaauguggaagcagaucuccaacgaacugaaucauauacuccuagaaaacgacaugaaauuuacaguugucguuggcgacguagccgguauucuagcacaaggcaagaaaaugauccgcccacagccaauggaguacaaauauuccuggaaaaguuggggaaaagcaaaaaucauaggggcagacguccaaaacacaaccuuuauaaucgaugggccaaacacaccggagugucccgacgaccaaagagcauggaacaucugggagguugaggacuauggguucggaauauucacgacaaacauauggcugaaacuacgagacaguuacacgcaagucugcgaucaucgccuaaugagugcagccauaaaggauucgaaggcgguccacgccgacaugggauauuggauagagucagagaaaaacgagacauggaaauuggcacgcgcguccuucauagagguaaaaacauguauuuggccgaaaagccauacgcuguggucaaacggagugcucgaaagcgaaaugaucaucccaaaaauauacgguggaccuaucagucaacacaacuacagaccaggcuacuucacacaaaccgcaggcccguggcaccuggguaaacuagaacucgacuucgaccugugcgaaggaacuacgguaguagucgacgaacacugcggcaauaggggcccaucacuucgaacgacaacggucaccgggaaaauuauacacgaauggugcugccgcucguguacacuaccaccacuacgauucaggggagaagaugggugcugguauggcauggaaauaagacccgugaaagagaaggaagaaaaccuagugaaaucgaugguaagugcgggguccggcgagguggacagcuucucguuaggccuauuaugcauuucgauaaugaucgaggaaguaaugcgcucacgauggucgcgaaaaaugcuuaugacaggaacccuagccguguuccugcuccucaucaugggacagcucaccuggaaugaccuaaucagguuaugcauaaugguaggcgccaaugccagcgaucggauggguaugggaaccacguauuuggcucucauggcuacguucaaaaugagaccaauguuugcaguggggcuccuguuccgccgccuuacaagucgagaaguacuccuccuaacgauuggguuaagucugguagcaaguguagagcuacccaacagccuagaagaguuaggcgacggacuagcaaugggaauaaugauacucaaacuauuaacggacuuccagagccaccaacuuugggccacucucuuauccuugacauucauuaaaacaacauucagccuucacuaugcuuggaagacaauggcuaugguccuaaguauaguaucgcucuuuccauuaugccuaaguacgaccagccaaaagaccacgugguugccaguguuguuaggaucacuaggauguaagccccuaaccauguuccucauagccgagaauaaaauauggggccgucgaucauggccacuaaaugaggggaucauggccgugggaaucgugagcauucugcucagcucgcuacuaaagaacgacguaccauuggcaggaccuuuaauagcaggagggaugcuaauagcaugcuacgucaucagcggcagcucagccgaccuaucacuagaaaaagcagcagaagucucuugggaagaagaggcggaacauagcggggcaagucauaacauacuggucgagguacaagacgaugggaccaugaagauaaaagacgaagaacgcgacgacacgcuuacgauacuacucaaggcaacgcuccuagcagucuccggcgucuacccauuaucaauacccgcgacgcuauucgugugguacuucuggcagaagaaaaagcaacgaucgggagucuugugggacacccccucgccaccagaaguagaaagggccguacuagaugacggcauauaccgcauaaugcaacgcggcuuguuaggccgaucacaagucggggugggcgucuuucaagaaaauguguuccauacaauguggcacgucacucgaggggccguccuaauguaccaagggaagcggcuugaacccagcugggcaaguguuaagaaagaucuaauuucuuacggaggcggguggcgguugcaaggguccuggaacacuggggaagaggugcagguaauugcaguagagccggguaaaaacccaaagaacguccagacgacgcccggcacguucaagacgcuagagggcgagguaggugcgauagcguuggacuucaaacccgggaccagugggucccccaucgugaauagagaaggaaaaauagugggauuguacggcaacggcguggugacuacaucagggacguacgucagcgccauagcacaggccaaagccagccaagaaggcccucucccggaaauagaagacgaggucuucaggaagaggaaccucacuauaauggaccuacacccaggcucaggcaagacacgccgauaccuuccagccauugugcgcgaagcuauaaaaagaaaacugcgaacauugaucuuggccccaacccgcgucguggcuagcgagauggcggaagcccuaaaaggcaugccaaucagauaccaaacaaccgcugucaaaucggaacacaccggcaaagaaauuguggaccucaugugccacgccacauuuacgaugcgccuacucagccccgugcgcguaccuaauuacaacaugauaaucauggaugaagcccacuucacggaucccagcaguaucgccgcaaggggcuauaucucaacuagagucgguaugggggaagccgcagcaaucuucaugacagccacaccacccggcaguguagaagcauucccgcaaucgaacgcggucauacaagaugaggaaagggauauaccggagcgaucauggaacaguggcuacgaauggauuacugacuucccuggcaagaccgucugguuuguaccauccaucaaaucggguaaugacaucgcgaacugccuacggaaaaacgggaaacgaguuauacaacucagccgaaaaacauucgacacagaguaccagaaaaccaagaacaacgacugggauuacguagucacaacugauauaagcgaaaugggcgcgaauuuuagggccgacagaguaauagaucccaggcgaugccucaaaccagucaucuuaaaagacggcccagaaagagucauacuugcaggccccaugcccguaacgguagcaucagccgcgcaacgacgcggucgcauagggaggaaccacaacaaagaaggggaccaauacaucuacauggggcaaccacuaaauaacgacgaggaccacgcccacuggacagaagccaaaaugcuccucgacaacaucaauacgccggaaggcauaauucccgcccuuuucgagcccgagagagaaaaaucagccgcaaucgacggagaauauaggcuccgaggggaagcccgaaagacauucguggaacuaaugcgccguggggacuugccaguguggcuaucuuauaaggucgccagugagggauuccaauauagcgacagaagguggugcuucgacggugagcgcaauaaccaaguccucgaggaaaauauggacguagaaaucuggacuaaagagggcgaacguaagaaacuucgucccagaugguuagacgcuagaacguauagcgacccccucgcccuccgcgaguucaaagaauuugcugcaggccgacgaucagugucaggcgaccucauacuggagauaggcaaacuuccccaacaccuaacacaacgggcgcaaaaugcgcuggacaaccucgucaugcuccauaauuccgaacaaggagggagagccuacagacacgcaauggaagaacuaccagacaccauugaaacucuaaugcugcuagcgcucauagccguacucaccgggggcguuacucuauucuuccucagcggccgggggcuugggaagacuagcaucggccuacuaugcguuaucgcguccucaguuuugcuauggauggccaguguagagccccacuggaucgccgcaucaaucauccuugaguucuuccucaugguccuucucauucccgaaccagaccgacaacgaacgccucaggacaaccagcucgcguacgucguuaucggccucuuguuuaugauccucacaguggcugccaacgaaaugggcuuacuagagaccacgaagaaggaucuaggaauuggacauguggcaguuggaaaccaccaccacgccgcaaugcuagaugucgauuuacauccagcaagcgcauggacucuuuaugcagucgccacaacaauaauaacacccaugaugcgacacacgaucgaaaacaccaccgcaaacauaagccucacagcuaucgcgaaccaagcagcaauccugaugggacucgacaaaggguggccgauaucgaagauggacauaggagucccguuacuggcccuggggugcuacagccagguuaacccauugacccuaacagcagcagugcucauguuggucgcucacuacgccaucauagguccaggcuuacaagcaaaggcgaccagggaagcucaaaagcggacugcggccggcaucaugaagaacccaacgguggauggaauaguagcgaucgaccucgacccaguugucuacgacgcaaaguucgagaagcagcucggacaaauuaugcuccugauacuaugcaccagccagaucuuacucaugcgcacgaccugggcacuuugcgaaagcauuacacuagcaacaggaccgcugacuacauuaugggaaggcuccccuggcaaauucuggaacacaacgaucgccgugucaauggcaaacaucuuccgaggcucuuaccuagccggugcgggguuggcauucuccuugaugaaaagucugggaggagggcgccgcgggacgggcgcgcaaggugaaacccugggagagaaauggaaacggcagcugaaccagcucagcaaaagcgaguucaacacuuacaagaggagugggauaauggaaguagacagauccgaggccaaagagggauuaaagcguggggagacgacaaaacaugccgugucccgcgggaccgccaaacuaagaugguucguugaaaggaacuuagugaagccugaagggaaagucaucgaucucggcugcgggcgcggcggguggucguacuauugcgcagggcucaaaaaggucaccgaggucaaaggcuauacuaagggaggucccggacacgaagaaccuaucccgauggcaacauacggguggaaucucguaaagcuacauucagguaaggacguguucuucauaccgcccgaaaagugcgacacgcugcugugcgauauaggugaaucuagccccaacccaacgauagaggaaggccgaacauuacgcguccuaaaaaugguggaacccuggcuucggggaaaccaguucuguauaaagauauugaacccauacaugcccagugucguugaaacccucgagcaaaugcaacggaaacauggcggaaugcuaguuaggaacccccucagucgcaacucaacacacgaaauguacuggguguccuguggcacuggaaacaucgugucagcagucaacaugacaagccgaaugcuucuuaaccgguuuacgauggcacauaggaagccgacauacgaacgagacguggacuuaggugcagguaccaggcacgucgcagucgaaccagaagucgcaaaccuggacaucaucgggcagaggauagagaacauuaagcaugagcacaaaaguacguggcacuacgacgaggacaacccauacaaaacaugggccuaccacgggucauacgaaguaaaacccagcggcagcgcuucgagcauggugaacggaguggugaaguuacuaacgaaaccuugggacguaauuccaauggugacacaaauagcgaugacugauacaacaccauucggacaacaaaggguguucaaggaaaagguagacacaagaacgccgaaagcaaaacgaggaacggcccaaaucauggaaguuaccgcgaaguggcuuuggggauuccugucccgaaacaagaagcccagaaucugcacgcgagaagaauuuacucgcaaagugcgaucaaacgccgcaauaggggcaguauuuguggaugaaaaucaauggaacucggccaaagaagcaguagaggacgagcgcuucugggaccuaguccaccgggaacgugagcugcacaagcaagguaaaugcgccacaugcguguacaacaugauggggaaacgggagaaaaagcugggggaauuuggcaaggcaaaagggucaagggcuauaugguacauguggcuaggagcaagauuucuagaguucgaggcgcucggauucaugaaugaggaccacugguucucaagagagaauagccuuagcggcguagaaggagaaggacuucacaaacuaggauacauccugcgagacauuaguaaaaucccggguggaaacauguacgccgacgauacggcuggaugggacacacguaucacagaggacgauuuacaaaacgaagcacgaauaaccgacauuauggaaccagagcacgcacuauuagccaaguccaucuucaaacucacauaccaaaacaaaguggugcggguccagcguccugcaaagaacggcacggugauggacguuauuucgcgacgcgaccagcgcggcagcgggcaagucgguacuuacggucucaauacguucacgaauauggaggcacagcuuauacgccagauggaaucggagggcauuuucaguccaagcgagcuagagacgccaaaccuugccgagcgcguguuagacugguuggaaaaauacgggguggaacggcuaaagagaauggcuaucagcggagacgauugcguggucaaaccgauagacgaccgguucgccaccgcacucacagcccugaacgacaugggaaagguccgcaaggacauuccccagugggaaccgagcaaaggauggaacgacuggcaacagguaccuuucugcucgcaccacuuccaccaguuaauaaugaaagacgggcgggagauagucguacccugcaggaaucaggacgaauuagugggcagagccagggucagccaaggagcgggcuggagccugcgggaaacggccugccuaggcaagucuuacgcccaaauguggcaacucauguacuuccaucgaagggaucuuaggcuagccgccaacgccauaugcagcgcaguuccaguggacuggauucccacgagcagaaccacuuggaguauccacgcccaccaccaauggaugaccacggaagacauguuguccguguggaaccgcgucuggaucgaagaaaaccccuggauggaggacaagacacacaucaguaguuggggcgauguaccauacuuaggcaaacgagaagaccaauggugcggcagccuaaucggacugaccgcgcgcgcgacgugggccacaaacauccaaguugcgaucaaucagguaagacgacucaucggaaaugaaaacuaccucgacuacaugacaagcaugaagagguucaaaaacgaaucugaccccgaaggagcacucugguga

SEQ ID NO: 24618 - RNA, 9879 nt, Artificial Sequence
  derived and/or modified CDS sequence (opt11) from DENV-1__JQ045629__SS-prME
agcgugaccauguugcucaugcugaugcccaccgcacuggcuuuccaucucacgaccagaggcggggaaccccauaugaugguuagcaagcaggagcggggcaagucgcuucuguucaagaccucugccggggugaauaugugcacccucaucgccauggaccugggggagcugugugaggauacgaugaccuacaagugcccacggaucacggagaccgagcccgacgacguggacugcuggugcaacgccacggacacaugggucacauacgggaccugcagccagacuggcgagcaccggcgggacaagagauccguggccuuagcgccccacgugggccugggucuggaaacacgaaccgagaccuggaugagcagugagggcgccuggaagcagauccagcgggucgaaacgugggcccuccggcaccccggguucaccgugaucgccuuauuccuggcccacgcaaucgguaccucgauuacccagaaggguauuaucuucauauugcugaugcuggucacgcccuccauggccaugcgaugcgucggcaucggcucucgcgacuucguggaagggcucucaggugcgaccuggguagaugucguccuugagcacgguagcugcgugaccacgauggccaaggacaagcccacccuggauaucgagcuucugaaaacugaggucaccaacccugcagugcugcggaagcugugcaucgaagcgaagaucagcaacaccacgaccgacagccgcugcccgacgcagggggaggccacccugguugaggagcaggacgccaauuucguuugccggaggacguucguggaccggggcugggguaacggaugcgggcuguuuggcaaggguucccuuaucacgugcgcuaaguuuaagugcgugacuaagcuggaggggaagaucguacaguacgaaaaccuuaaguacagcgugaucgugaccguacacacgggcgaccagcaucagguggggaaugaguccaccgaacacggcacuaccgccaccaucacaccccaggcgcccaccaccgaaauccaguugaccgacuacggcgcccucacgcuggacugcucacccagaacaggcuuggacuucaacgagauggucuuacugacgaugaaagagaaguccuggcucgugcacaagcagugguucuuagaccugccguugccauggacgagcggugccucaacgagccaggagaccuggaaucggcaggaccugcuugugaccuucaagaccgcucacgccaagaaacaggaggucguggugcucggcagccaggagggcgcgaugcacacggcgcugacgggggcuacagaaauccagaccucugguacaacaaccauuuuugccgggcaccugaagugccggcucaagauggacaagcugacacugaagggcaugagcuacgucaugugcacggggagcuucaaacucgagaaggaguuggcggagacacagcacgguaccguacuggugcagaucaaguaugaggggaccgacgcgcccugcaaaauccccuucagcacgcaagacgagaaggggguaacgcaaaacggccggcugaucaccgcaaacccgauugucacggacaaagagaagccagucaacaucgaggccgagccgcccuucggggaguccuacaucguaaucggagcgggagaaaaagcucuuaaacuuagcugguucaaaaagggguccucuauuggcaagauguucgaggcgacugcccgcggggcccggcgcauggccauacucggggacaccgcgugggacuucggguccaucggcggcgucuucaccagcguuggcaaguuggugcaccagaucuucggcaccgccuauggggugcuguucuccggcguaagcuggaccaugaagaucgggaucggcgucuugcugaccuggcugggccuaaacucccgcaguaccucccucucgaugaccugcaucgcggugggccuggugacacuguaccucggcgugaugguucaggcugauagugggugcgugaucaauuggaagggccgggaacugaaaugcggcagcgggaucuucgucacuaaugaaguccacaccuggaccgagcaguauaaguuccaggccgacucaccgaagcgguuauccgcagccaucggcaaggccugggaggaaggcgugugcggcauccggagcgcaacccgccucgagaacaucauguggaaacaaaucuccaacgagcugaaccauaucuuacucgagaaugauaugaaauucacuguggucgugggagacguagcgggcauacuggcgcaagggaagaaaaugauucggccacagcccauggaguacaaauacagcuggaaauccuggggcaaagcgaagaucauuggcgcggauguucagaacaccaccuucaucaucgacgggcccaauacuccggagugccccgacgaccagcgggcguggaacauuugggaaguggaggacuacggcuucgggaucuuuaccaccaacaucuggcugaaacugcgggacagccacacgcaagucugcgaccacagacucauguccgccgccaucaaggacagcaaggccgugcacgccgauaugggguacuggaucgaguccgagaagaacgaaaccuggaagcuggcccgggcaucguucauagaggugaagacaugcaucuggcccaagucccacacccucuggucaaacggcgucuuggagucggagaugauuauccccaagauuuacggggguccuaucagccagcacaacuaccgccccggguacuucacgcagaccgccggcccauggcaccugggcaagcucgaguuagacuuugaccugugcgagggcaccacaguagugguugacgagcauuguggcaaccgggggccgucacuccgcaccaccacggugaccggaaagaucauucacgaauggugcugccgaagcuguacccugccgccucugcgcuuccgcggggaggacggcugcugguacgggauggagauccgccccguaaaggagaaggaggagaaccuagucaaguccauggugucugccggcuccggcgagguggauagcuuuuccuuggggcugcucuguauaucgaucaugaucgaggaagucaugcggagccgaugguccagaaaaauguugaugaccgguacguuagccgucuucuuucucuugaucauggggcagcugaccuggaaugacuuaauucgccuguguaucauggugggcgcgaacgcgagcgacagaaugggaauggguaccaccuaccuagcccucauggccacguucaagaugcggccgauguucgccgucggccuucuguucagacgacuuaccucccgcgaggugcuucuucugaccaucggacucagccugguggccuccguugagcuuccgaacagccuggaggaguugggcgacgguuuggcgaugggcaucaugauccugaagcugcucaccgacuuccagucccaccaauuaugggccacgcuacucagcuuaacauucaucaagacuaccuucagcuugcacuacgcauggaagacgauggccauggugcucagcaucgucucccuguucccacugugccuguccacuaccucccagaagacaacguggcugcccgugcugcugggcucccuggggugcaagccccugacaauguuucucaucgccgagaacaagaucuggggacggcgcuccuggccccugaaugaagggauuauggccgugggcaucguuucaauccuacucucgucccuguuaaagaacgaugugccacuugcagguccccugaucgccggcggaaugcugaucgccuguuacgugauuagcggcuccagcgcugaccucucacuggagaaggcugccgaggucagcugggaggaagaagccgaacacucgggcgccucucacaacauccuuguggaagugcaggacgaugggacgaugaaaauuaaagacgaggaacgggacgacacucucaccauccugcugaaggcgacgcuacuggccgucagcggcguguacccguuaaguauccccgcgacacucuucgugugguacuucuggcagaagaagaagcagcgcuccgguguccugugggauacccccagcccgcccgagguugagagggcuguucuggacgauggaaucuaccgcaucaugcagcggggccugcucgggcgcagccaagucgggguggggguguuccaggagaacgucuuccauaccauguggcacgucacgcggggcgccgugcugauguaccaggggaagcgccuagaacccucgugggcuucugucaagaaggaccucauauccuauggcggaggguggcggcuccagggcuccuggaacacaggggaagagguccagguaaucgccgucgaaccgggcaagaauccgaagaacgugcagaccgcucccgggacuuucaagacucccgagggcgagguaggagcaauagcgcuggacuuuaagccagguaccagcggcucccccauagucaauagagaagggaagaucguaggccuguacggaaacgggguggucacaaccucagguacuuauguguccgccaucgcccaggccaaggccucgcaggaggguccgcugcccgagauugaggacgaaguguucagaaagcgaaaucuaacaaucauggaccuccaccccggaagcgggaagacgcggcgcuaccugccggcgaucguccgggaggcuauaaagcgcaaauugagaacccucauccuagccccaacucggguaguugcuucugaaauggcugaagcgcugaagggcaugcccaucagguaccagaccaccgccguaaagagugagcacaccgguaaggagaucguggaccucaugugccacgccacuuucaccaugcggcuguugucccccguucgggucccgaacuacaauaugaucaucauggacgaagcccacuucaccgacccaagcuccaucgccgcucggggauacaucucaaccagggugggcaugggggaggccgccgccauuuucaugacggcgacgccgcccggcuccguggaggcguucccgcagagcaacgccgucauccaggacgaggaacgggacauucccgaacgcuccuggaacuccggguacgaguggaucaccgacuuccccggcaaaacgguaugguuugugccuucgauaaaaagcgguaacgauaucgccaauugccuccgcaagaacgggaagcgcgucauccagcugucccggaagacguucgauaccgaguaccagaaaaccaagaacaacgacugggacuacguagugacgacagacauaucggagaugggcgccaauuuccgugcugauagggucaucgacccgcgccggugucugaagccagugauacucaaggacggaccggagcgggugauacuggcaggcccaaugccagucaccguggcguccgcugcccagcggcgcgguaggauuggacggaaccacaacaaggagggggaccaguauaucuacaugggccagcccuuaaacaacgaugaggaucacgcgcacuggaccgaggcgaaaauguugcuugauaauaucaauaccccagaaggcaucauccccgcgcuguucgagccggaacgcgagaaguccgccgccaucgacggggaguaccggcuccggggcgaggcgcggaagaccuucguagagcuuaugcgccgcggugaccugcccguguggcucagcuacaagguggccucugagggcuuccaauacagcgaucgccgaugguguuuugauggggagcgcaauaaccagguccuggaagagaacauggacguugagaucuggacgaaagagggcgagaggaagaaacugcgcccccgguggcucgacgcuagaaccuacucagacccccuggcccugcgggaguucaaggaguucgcagcgggcagacguagcgugaguggagaucucauacuggaaauuggcaagcucccgcaacaccucacccagcgagcccagaaugcauuagauaaccuagucaugcuccacaauuccgagcagggcgggcgggcauaucgccacgcgauggaggagcugcccgacacaaucgagacccugaugcuccuggcccugaucgccguccucaccggcggggugacccuguucuuucuguccgggcggggccucgggaagacgagcaucggucuacuaugugucauggcuuccagcguccuauuauggauggcguccguagagccucacuggauagcggcuagcaucauccuggaguucuuccucaugguccugcugauccccgagccggaccgccagcggacaccccaggacaaucagcucgccuacguagucauuggccugcuuuucaugauccucaccguugccgcuaaugaaaugggacugcuggagaccaccaagaaggaccugggaaucggccacguugcgguggaaaaccaccaccacgcagccaugcuugacgucgaccugcaccccgccuccgccuggacccucuacgcgguggccaccaccaucaucaccccgaugaugcgucacacaaucgagaauaccaccgcgaacaucucauugaccgcuaucgccaaucaggcagcuauccuaauggggcucgacaaaggcuggcccaucucaaagauggacauuggcgugccccugcuggcucucgggugcuauagccaggucaacccucucacguuaacggcugcagugcucaugcuuguggcgcacuacgccaucaucggcccggggcugcaggccaaggccacccgcgaggcccagaaacggaccgcggccggcaucaugaagaaccccacggucgaugggaucguggccauagaccucgacccagugguuuacgacgccaaguucgagaagcagcugggacagauaaugcugcuaauccuuuguacaucccagauccugcuuaugcgcaccaccugggcccuaugcgaaucgaucacgcuggccaccggcccacucacaacgcugugggaggggucgccgggcaaauucuggaauacaaccaucgccguaagcauggcgaauauuuuuagggggaguuaccuggccggugcgggguuagccuuuucucucaugaagucccucgggggaggucgccgggggaccggagcccaaggcgagacccucggcgagaaguggaagcgccagcugaaucagcugucgaaaagcgaguucaacacguacaaaagaucugggauuauggagguggacagguccgaggccaaagagggccucaagcgcggggagacuaccaagcacgccguaucgagaggcaccgccaaacugcggugguucguggagcgcaaccuggugaaacccgaggggaaggucaucgaccucggcugcggccgcgggggcuggagcuacuauugcgcagggcucaagaaggugacagaggugaaggguuacaccaagggaggccccggucacgaggagccgauccccauggccaccuacggguggaacuuagugaaacuucacuccggcaaagauguguucuucaucccgcccgagaagugcgacacacuccugugcgacauuggggagucauccccuaauccgacuaucgaggaaggccgcacccuacggguuuuaaaaauggucgagccaugguugcggggcaaccaauuuugcaucaaaaucuuaaacccguacaugccaucgguuguggagacccucgaacagaugcagcguaagcacggcggcaugcugguacgcaacccgcugucaagaaacuccacacaugagauguacugggucuccugugggaccggcaacauuguaucugccguaaacaugacgucccguaugcuccuuaaccgcuuuaccauggcgcaccguaaacccacauacgagcgcgacguggaccugggggccggaacacggcacguggccguagaacccgaaguugcgaaccucgacaucauaggacagcguaucgagaauauaaagcacgagcacaaaagcacguggcacuacgacgaggacaaccccuauaagaccugggccuaccauggguccuacgaaguaaagccgucgggcagugcguccucuauggucaacgggguggucaaguuacugaccaaaccgugggacgugauacccauggugacccagaucgccaugacggacaccacucccuuuggccagcagcgggucuucaaggagaagguggacacacgcaccccgaaggcuaagcgcgggaccgcucagaucauggaggugacggccaaguggcuuugggguuuucugucccggaacaagaagccccggaucuguacccgcgaagaguucacgcggaagguuagaagcaaugcggcaaucggcgccgucuucguggaugagaaucaguggaacuccgcaaaagaggcgguugaggacgagcgauucugggauuuggugcaccgcgagcgggagcuccacaaacaggggaagugcgcgacaugcguauacaauaugauggggaagcgcgagaaaaaguugggggaguucggcaaagccaaggggagccgggccauuugguacauguggcugggcgcaagauuucucgaguuugaagcgcuggguuuuaugaacgaggaccauugguucucccgggagaacucgcuguccggggucgagggcgagggacuucauaaacugggcuacauccuccgugauaucagcaagauccccggaggcaacauguacgccgacgacacugccgguugggacacacggaucacggaagacgaccuccagaacgaagcccggaucacagacaucauggagccugagcacgcccuacuggcgaaguccaucuucaaguuaaccuaccagaacaagguggugcgcguacagagacccgcaaagaacgggaccgugauggaugugauuucgcgacgggaccagagaggcuccgggcaggucggcacguacgguuuaaauaccuucaccaacauggaggcccagcugauccggcaaauggaguccgaggggaucuucucccccagcgaauuagaaacccccaacuuggcagagcgcgugcuggauuggcucgaaaaguauggcguggaacgccugaagcgcauggccaucuccggggaugacugcguagugaaaccgaucgacgaccguuucgcuacggcccugaccgcgcucaacgacaugggcaaggugcgcaaggacaucccccaaugggagcccagcaaaggauggaacgacuggcagcaggucccauucugcucccaucacuuccaccaacuuaucaugaaagacggccgggagaucguggugcccuguaggaaucaagacgagcuggucgguagggcuagagugucgcagggggcuggcuggucgcuccgggagacggcaugccuggggaaguccuacgcccagauguggcagcugauguauuuccaccgacgggaucuccgauuggcggcgaacgcgaucugcagcgccgugcccguggacuggauaccgacaucccggaccaccuggagcauccacgcccaccaccaguggaugacaaccgaggauaugcuguccguguggaaccgcguguggaucgaggagaacccuuggauggaggauaagacacauaucagcuccuggggagacgucccguacuuagggaagcgugaggaccagugguguggcagcuugaucggccugaccgcuagagcaacuugggccaccaacauccagguggcgaucaaucaaguccgccggcucaucgggaaugagaacuaccuggacuacaugaccuccaugaagcgcuucaaaaaugagucugauccagaaggcgcccucugguga

SEQ ID NO: 24619 - RNA, 9879 nt, Artificial Sequence
  derived and/or modified CDS sequence (opt11) from DENV-1__JQ045630__SS-prME
agcguaaccaugcuccuaaugcugaugcccaccgcccucgccuuccaucucacuacccggggcggggagccccacaugaucguuucaaagcaggagcggggcaagagccuuuuguucaagacaagugccggggugaacauguguaccuuaaucgcuauggaccugggcgagcugugugaagacaccaugaccuacaagugucccaggaucacggagaccgagcccgacgauguugacugcuggugcaacgccacugacacgugggugaccuacgguaccugcagucaaacgggcgagcaccggcgggacaagcggagcguggcacucgcgccccaugucggccugggguuagagacccgcacggagaccuggaugaguagugagggugcguggaagcaaauccaacgagucgagacuugggcccuccgccaccccggguucaccguuaucgcuuuguuucuggcccacgcgaucggcaccagcaucacccagaaagggaucaucuucauucuccugaugcuggugacgcccuccauggccaugcggugcgucggcaucggcagccgagacuucguggaggggcucuccggcgccaccuggguggauguagugcuggagcacgggagcugcgugacuacgauggcuaaggacaagccaacguuagacaucgagcuccugaagaccgaggucaccaaccccgccauucugagaaagcuaugcauagaggcgaagaucuccaacacgacgaccgauagccgcuguccaacccagggugaggccacccugguggaggagcaggacgccaacuuugugugccggcggacguucguggaccggggcugggguaacggcugcgggcuauucggcaaggggucccuaauaacgugugccaaauucaagugcgugaccaaacuggagggcaagaucguucaguacgagaaccugaaguacagcgugaucgugaccguacacaccggcgaccaacaccaggucgggaacgaguccacugagcacggcaccaccgccaccauuacaccccaagcgcccacgacugagauccagcucaccgacuacggggcccucacgcuggacugcagcccccguaccggccucgacuucaacgagauggugcugcugaccaugaaggagaaauccuggcugguccacaagcagugguuccuggacuugccccuccccuggacuagcggagccagcacgucccaggagaccuggaaccgacaggacuuacuggucaccuucaagaccgcccacgccaaaaagcaggagguaguaguccucggcagucaggagggcgcgaugcacacugcacuaacaggggcgaccgagauccagaccagcggcacgaccaccaucuuugccggccaccucaagugccgccucaaaauggacaagcugaccuugaagggcaugagcuacguaaugugcacgggguccuucaaacucgagaaggaggucgcagagacacaacacggcaccguucuggugcagaucaaguacgaggggaccgacgcucccuguaagauucccuuuagcacgcaggaugaaaagggcgucacccagaacggccggcugaucaccgccaacccuaucguaaccgacaaagaaaagcccgugaauauagaggccgagccgcccuucggugaaagcuacaucguaaucggcgccggcgagaaggcuuugaagcucagcugguucaagaagggguccagcauuggcaaaauguucgaggccacggcccgcggggcccggagaauggccauacugggcgacaccgcgugggacuucgggagcaucggcggcguguucaccucggucgggaagcugguccaccagaucuucgggacggccuacggcguccuguucuccggcgugagcuggacgaugaagaucgggaucgguguccugcuaaccuggcucggauuaaacucgcggagcacaucacugagcaugaccugcaucgcggucggucuugugacguuguaccugggcgucauggugcaggccgacagugggugcgugaucaacuggaaaggucgugagcucaaaugcgggagcggcauuuucgucacgaacgaggugcacacauggaccgagcaguacaaauuccaggccgacagcccgaagcgccuuuccgcggccaucggcaaggccugggaggagggggugugcggcauccggagcgcuacccggcuggagaacauaauguggaagcagauuagcaaugaacucaaccacauccugcuggagaacgacaugaaguucacggucguggugggggacgucgccggcauccucgcgcaaggcaaaaagaugauccgaccccaacccauggaguacaaguacagcuggaaauccugggggaaggccaagaucaucggcgccgacgugcagaacaccacauucaucauugacgggccaaauacacccgagugcccugacgaccaacgagccuggaauauaugggagguggaagacuacggauucgggauuuucacgacuaacaucuggcugaaacugcgcgacagcuacacccaggucugugaucaucgccucauguccgcggccaucaaggacagcaaagccgugcacgcugacaugggcuacuggaucgaauccgaaaagaacgagacuuggaaacucgcccgggccagcuuuaucgaagucaagacgugcaucuggcccaagucccacacucuguggaguaacggcguccuggaguccgagaugaucauccccaagauauacggcgggccgauaagccaacacaacuaccgccccggguacuucacccaaacugcaggccccuggcaccuggggaagcuggaacucgacuuugaccugugcgagggaacgaccguggugguggaugagcacugugggaaccgggguccuucccugcggacaaccacugugaccggcaagauaauccaugaguggugcugccggagcugcacgcugccgccccuacgcuuuagaggggaggacggcugcugguacgggauggaaauccgcccuguaaaggagaaggaggagaaccuggucaaaagcaugguaagcgcaggcagcggcgagguggacagcuucuccuugggguuacugugcauuuccaucaugaucgaggaggucaugaggagccgcuggucccggaagaugcucaugaccggcacgcuggccguguuucugcuccugauuauggggcagcugaccuggaacgaccuaaucaggcugugcaucauggugggcgccaacgcgagcgaccgaauggggauggggacgaccuaccuugcauugauggccacguucaagaugcggccuauguucgcuguuggccugcuauucagacggcucacaucccgugaggugcugcuacucaccaucgggcugagccugguagccuccguugagcucccgaacaguuuggaggagcugggcgacgggcucgcgaugggcaucaugauccucaaacugcugaccgacuuccagucccaccagcugugggccacucugcuaucacuaacauucaucaagaccacauucucgcuacauuacgcuuggaagacgauggccauggugcucaguauagucucccuguucccgcugugccucagcacgaccucccaaaagacaaccuggcuacccgugcugcucggcagccuuggaugcaagccccugaccauguuucucauugcggaaaacaagaucuggggcagacgcuccuggccccuaaacgaggguaucauggccgugggcaucgugagcauccugcucagcagucuccugaaaaaugacguaccgcucgccgguccccugauugccggaggaaugcugaucgccugcuacgugaucagcgguucgucugcagaccugagccuggagaaagccgccgaggucagcugggaggaggaggccgagcacuccggcgccucccacaacaucuugguagaggugcaagaugacgggacgaugaagaucaaagacgaggagcgggaugacacgcucaccaucuugcugaaggcgacgcuucuggccgucuccggcguauauccgcuaagcauccccgccacccucuucgugugguacuucuggcagaagaagaagcagcgcagcgguguccucugggacacgccaagcccgcccgagguugagcgggccguucuggacgacggcaucuacaggaucaugcagcgaggccugcucgggcgcucccaggucggcguggggguguuccaggagaacgucuuccacacgauguggcacgugacgcggggcgccgugcuuauguaucaagggaagcgcuuggagcccucaugggcguccgucaaaaaggaccucaucuccuauggcggcggguggcggcugcagggcucauggaauacaggggaagagguccaggugaucgcuguugagcccgggaaaaaucccaaaaauguacagaccacccccgggacguucaaaacuccugaaggcgaggucggcgccaucgcccuggacuucaagcccgggaccucuggcucacccaucgugaacagagaagggaagaucgugggccucuaugguaacgggguagucaccacgagcggcaccuacgugagcgccaucgcccaagccaaggccucacaggaggggccgcugccagaaaucgaggacgagguuuuccggaaaagaaaccugaccauaauggaccuccaucccggcuccgggaagacacggagauaccugccggccauaguccgggaggcuaucaagcgcaagcugcgcacgcugauacuggcccccacgcgggugguggccuccgagauggccgaggcccugaagggaaugcccauccgcuaccagaccacggcagucaagagcgagcacacgggcaaggagaucguagaccucaugugccacgccaccuucaccaugcgucuccugagucccgugcgcgucccaaacuacaacaugaucauaauggaugaagcccacuucaccgaccccagcuccauagcugcccggggguacaucucuacgcgcguuggcaugggugaggcggcggccauauucaugaccgccaccccacccggcucgguagaggccuucccgcagagcaacgcagucauccaggaugaggagcgggacauccccgagcgcuccuggaacagcggguaugaguggaucaccgacuucccaggcaagacggugugguucgugcccuccauuaagucagguaacgauaucgccaacugccuccggaagaacgggaagcgcguaauccaacugucccggaagaccuucgacaccgaguaccagaagaccaagaauaaugacugggacuacguggugacgaccgacaucucggagaugggcgccaacuuccgcgcggaccggguuaucgacccccgccgcugccugaagcccgucaucuugaaagacgggccggagcgcgugauccuggcgggacccaugccggucaccgucgccucggccgcccaaaggcgcgggagaauaggccggaaccauaacaaggagggcgaccaguacaucuacauggggcagccccugaacaaugacgaggaccacgcccacuggaccgaggcgaaaaugcuccuggacaauaucaacacgcccgagggcaucauccccgcccuguucgagccggagagagaaaaguccgccgccaucgacggggaauaccgucuccgcggugaggcccggaagacguucgucgagcugaugcgcagaggggaccugcccgugugguugagcuauaagguggcgagcgagggcuuucaguacucagaccgccgguggugcuucgacggagagcgcaacaaccagguacuggaggagaacauggacguggagauuuggaccaaggagggggaacggaagaaacuucgcccccgguggcucgacgcccgcaccuacuccgacccccuggcucugcgcgaguucaaggaguucgccgccggccgccguucaguguccggagaccucauucucgagaucgguaagcugccgcagcaccucacgcagcgugcccagaacgcccuggacaaucucgucaugcuccacaauagcgagcaaggcgggcgggccuacaggcacgccauggaggagcugcccgacaccaucgagacccucaugcuccuggcucugauagccguguugaccggcggggugacccuguucuuccucuccggccgggggcucggcaaaacgagcaucggacugcuaugugucaucgcaagcagcgugcucuuauggauggcgaguguggagccgcacuggaucgcggcgucaaucauccuggaguucuuuuugauggugcuccugauacccgagccggaccgccagcggacgccccaggacaaucaguuagccuacgucguuaucggucugcuguucaugauccucaccgucgccgcgaacgagaugggucugcuggagaccacgaagaaggaccucgggauaggccacguggcaguggguaaccaucaccacgcggcaaugcuggacguugaccuucaccccgccagugccuggacccucuacgccguagcgacuacaaucaucaccccgaugaugcgccacacgaucgagaacacaaccgcuaacaucucccugaccgccaucgccaaccaggccgcgauccugaugggccucgacaaggguuggcccaucuccaagauggacauuggggugccccuucuggcccucgguugcuacucccagguuaacccccuaacccugaccgcggccguccucaugcugguggcucauuacgccauaaucgggccgggucugcaggcaaaagccacacgcgaggcccagaagaggacggcggccgggauuaugaaaaauccuaccgucgacggcaucgucgccauugaccucgaucccgugguuuaugacgcuaaauuugagaagcagcugggccagaucaugcuccuaauccugugcaccucccagauccugcucaugcgcaccacaugggcccugugcgagagcauaacgcuggccaccgggccccucaccacgcugugggaaggcuccccggggaaguucuggaacacaaccauagcagugucaauggcaaacauauuccggggauccuaccuggccggugcaggguuggcguucagccugaugaaaagccugggcgguggccgccgggggaccggcgcccagggcgagacacuaggggagaaguggaagagacagcugaaccaacuguccaagagcgaguucaacaccuacaagcggucuggcaucauggaaguggaccgcucggaggccaaggagggacuuaagcgcggcgaaacgaccaaacacgccgucucccgcgguacggcaaagcugcgaugguucguggaaagaaaccuggugaagcccgagggcaaggucaucgaccugggcugcgguaggggcggcugguccuacuacugcgccggucucaagaaagucacggaggugaagggguacaccaagggugggcccgggcacgaggaacccauccccauggcgaccuacggcuggaaccuggucaaacuccacuccggcaaggacguguucuuuauaccacccgagaagugcgacaccuugcugugugacaucggagaguccucccccaacccgacuaucgaggaggggcgcacucuucgggugcucaagauggucgagccguggcuucgcggaaaccaguucugcaucaaaauacugaacccguacaugcccagugugguggagacacucgagcagaugcagcggaagcacggcggcaugcugguccgcaacccccugucaaggaacucaacucaugagauguacugggugucuugcggcacagggaacaucgugagcgccgucaacaugaccagucgcaugcuccugaaccgcuucacgauggcccaccggaaaccaaccuaugagcgcgacgucgaccugggcgcgggcacuagacacguggccgucgaacccgagguggccaaccucgacaucaucgggcagcgcaucgagaauaucaaacaugagcacaagaguaccuggcauuaugaugaggacaacccauauaagaccugggcuuaccacggcuccuacgaagugaagccgagcggguccgcuagcagcauggucaacggcgucgucaaacuucucaccaagccuugggacgugauacccauggugacacaaaucgcgaugacagauacaacacccuucgggcagcagcgggucuucaaggaaaagguggacacucgcacgcccaaggccaagcggggcaccgcccagaucauggagguuacagccaaguggcucuggggcuuccugucccgcaacaagaagccccggaucugcacgcgcgaggaguucacacggaaaguccgcagcaacgcggcgaucggggccgucuuuguggacgagaaccaguggaacuccgccaaggaggccgucgaggacgagcgguucugggaucuggugcaucgcgagcgggagcuccacaagcagggcaagugcgcgacuugcguguacaacaugauggggaagcgcgagaagaagcugggcgaguucgguaaggccaaaggcagucgagccaucugguacauguggcuuggcgcucgcuuucucgaguucgaggcccugggguucaugaacgaggaucacugguuuucccgugagaacagccuuagcggcgucgagggggagggccuccacaagcuggguuacauuuugcgcgacaucagcaagauccccggcggcaacauguaugcagacgauaccgccggaugggacacgcggauaaccgaggacgaccuucagaacgaagcccgaaucaccgauauaauggagccggagcacgcccuacuggccaaauccaucuucaaacuuacauaucagaacaaggugguccgcguccagcggccagcgaagaauggaacggugauggacgugaucagccgccgggaccagagagggucuggacaggucggaaccuacgggcuuaauaccuuuacaaacauggaggcccagcugauccggcagauggagagcgagggcaucuucucccccuccgagcuugagacgccuaaccuggcggagagagugcuggacuggcucgagaaguacgggguggagcggcugaagcgcauggcaaucuccggcgacgacugcgucgugaagcccaucgacgaccgguucgccacugcgcugacugcacugaaugauauggggaaagugcggaaagacaucccccagugggagccuucaaagggcuggaacgacuggcagcagguccccuucugcucucaccauuuccaccagcugaucaugaaagacggccgggagauaguggugccuugccgcaaccaggaugagcuggucgggcgcgcaagggugagucagggcgccgguuggagccugcgggagaccgccugccugggcaaguccuacgcgcagauguggcagcugauguacuuccaccgccgggaccuccgccuggccgccaacgccauuuguagcgcgguucccguagacuggauucccacgucccggacgacguggagcauucacgcccaccaccaguggaugaccacggaagacaugcuguccguuuggaaccguguguggaucgaggagaaccccuggauggaggauaagacccacaucagcuccuggggcgacgucccguaucucggcaagcgcgaggaucaguggugcggcagccugauagggcugaccgcccgcgcgaccugggcaaccaacauccagguugcgaucaaucaagugcggcggcucaucggaaacgaaaacuaucuggauuacaugaccucgaugaaacgguucaagaacgagagcgaccccgagggagcccugugguaa

SEQ ID NO: 24620 - RNA, 9879 nt, Artificial Sequence
  derived and/or modified CDS sequence (opt11) from DENV-1__JQ045632__SS-prME
ucggucaccaugcugcuuaugcugaugcccaccgccuuggccuuucacuuaaccacccgcgggggggaaccccacaugaucgugucaaagcaggagcgaggcaagagccugcuguucaaaacguccgccgggguuaacaugugcaccuuaaucgccauggaucugggcgaguuaugcgaggacaccaugaccuacaagugcccgcggauuacugagacagaacccgacgacguugacugcuggugcaaugcuacggauaccugggucacguacgggaccugcagccaaacuggagaacaccggcgagacaagagguccguggcccucgcaccccacgugggcuuaggucuggaaaccaggacagagaccuggaugagcucugagggcgcauggaaacaaauacagcgagucgagacgugggcccuccgccaccccggguucacggugaucgcucuguuccuggcacacgcgaucggcacgagcaucacccagaagggaauuaucuucauccuccugauguuaguuacgccuuccauggccaugcgcugcgucggcauaggcagccgcgauuucguugagggucuauccggcgccaccuggguugacgucgugcuggagcacgggaguugcgugacgaccauggccaaggacaagccgacgcuagacaucgagcuucugaagaccgaggucacgaacccagccguucugcggaagcucugcaucgaggcuaagaucuccaacaccacgaccgacucucgcugcccaacccaaggcgaggcgacacucguagaggaacaggacgccaauuucgucugccggagaacuuucguggacagaggcugggguaacggaugcgggcuguuuggcaaggggucccucauaacgugcgccaaguuuaagugcgugaccaaguuagagggcaagauugugcaguacgaaaaccugaaguauucgguaauugucaccguccacacgggcgaccagcaucaagugggaaacgaaucgacagagcacggcacgaccgccaccaucacgccccaggcgcccacgaccgaaauacaguuaaccgacuauggggcccugacgcuggacugcucuccccgcaccggccucgauuucaacgagaugguccuacugaccaugaaggagaagucguggcuagugcauaagcagugguuucuggaccugccacuccccuggacuagcggagcaucaacgucccaggaaacuuggaacagacaggaccugcuugugaccuucaagaccgcucaugccaaaaagcaggaggucguggugcucggcagccaggagggcgcgaugcauacggccuugacuggggcuacugagauacagacuuccggcacgaccaccaucuucgccgggcaccugaagugccgccugaagauggauaaauuaacccuaaagggcaugagcuacgucaugugcaccgggaguuucaagcucgagaaggagcuggccgagacccagcacggcaccgugcucguacagaucaaguacgagggcacugacgcgcccugcaagauccccuucuugacgcaggacgagaagggggucacccagaacgguagacuaauaaccgccaacccaaucguuaccgacaaggaaaagcccgugaacaucgaggcagagccgcccuucggggagagcuacaucgucauuggcgccggagagaaggcccucaagcucuccugguucaaaaaggggagcaguaucggcaagauguucgaggccacggcacgcggcgcccggcgcauggccauccuuggagacacugcgugggauuucgggagcaucggcggcguauucaccagcaucgggaagcuggugcaucagaucuucgggaccgccuacgggguccuguucagcggcgugucuuggacgaugaaaaucgggauaggcgugcuccugacuuggcugggccucaacagccgcuccacgagcuuaagcaugacguguauugcagucggguuggugacucucuaccugggcgugaugguccaagccgacucugggugcguuaucaauuggaagggccgagagcugaaauguggguccggcauuuuugugacaaacgaaguccauaccuggacagagcaguacaaguuucaggcggacagcccaaagcgccucagcgcagccaucgguaaggccugggaggagggggugugcggcauucggagcgccacccgccuagagaacaucauguggaagcagauaagcaacgagcugaaccacaucuuacuagaaaacgauaugaaguucacggugguugugggggauguggccggcauucuggcccaggggaaaaagaugauccggccccaaccaauggagcacaaguacuccuggaaauccuggggcaaggcuaagauuaucggcgcugauguccaaaacaccacguuuaucaucgaugggccuaacaccccggaaugccccgacgaccagcgcgcauggaacaucugggaggucgaggauuacggcuucgggaucuuuacgaccaacaucuggcucaagcugcgagauucauacacccaggugugcgaccaccgccugaugucagcggccaucaaggacuccaaggcuguccacgccgacaugggcuauuggaucgagagcgagaagaaugagaccuggaagcucgcucgugcgaguuuuaucgaggugaagacuugcauuuggccaaagagccacacucugugguccaacgggguccuagagagcgagaugaucauccccaagaucuacggaggcccgaucucccagcacaacuaccgccccggguacuucacccaaaccgcaggccccuggcacuuagguaagcuggagcuggacuuugaccuaugugaaggcacgacagucgugguggacgagcacugcggcaauagagguccgucuuugaggaccacgacggucacuggaaagauaauacacgaguggugcugccgguccugcacccuaccgccucuacgcuuccgcggggaggacggcugcugguacgggauggaaauccggcccgugaaggagaaggaggaaaaccuggucaagagcaugguaucugccggcagcggugagguggacuccuucucccuggggcuacugugcauaagcauuaugauagaggaagugaugcggucccgcuggagccggaagaugcuuaugaccggcacucucgccgucuuuuuccugcucauuaugggucagcucaccuggaacgaucugauccgucugugcaucauggugggcgccaacgcauccgaccggauggggaugggcacuaccuaccucgcgcugauggccacguucaaaaugcggccuauguucgccguuggucuccuguuccgccggcuaacuucacgcgagguccugcuccugacaauaggacugucacucgucgccagcguggagcugcccaacucccuggaagagcucggcgacgguuuagcgaugggcaucaugauccugaaacuccugaccgauuuccaaagccaccaacugugggccacccucuuaagccucaccuucaucaagaccaccuucagccugcacuacgcauggaagacgauggccaugguccuuaguauugugagccuguucccccucugucugagcaccaccucgcagaagaccacuuggcuccccguccuccucggcucccuaggguguaagccgcucaccauguuccucaucgcugagaauaagaucuggggccggcgcagcuggccacugaacgaagguauaauggcaguaggcaucgugaguauccucuuaagcucccuucucaagaacgacguccccuuggccggcccccugaucgccggagggaugcucaucgcauguuacgugauauccgggucuagugcggaccugagccuggaaaaagccgccgagguguccugggaggaggaggcagagcauagcggugcgucccacaacauccuggucgagguacaggacgacgggaccaugaagauaaaggacgaggagagggacgacacacugaccaucuuacucaaagcuacccugcuugcagugagcggcgucuauccgcuguccauccccgcgacccuguuugugugguacuucuggcagaagaagaagcagcgaagcggggugcugugggauaccccuucuccgccggaagucgagcgggccguccuggaugacgggaucuaccggaucaugcagcggggccuccuggggcgcucccaagugggcgucgggguguuccaggagaauguguuccacaccauguggcacguaacacggggagccgugcugauguaccaagggaaacgccucgagcccuccugggcgucaguuaagaaagaccugauuucauacggcggcggguggcggcugcagggcucguggaacacuggagaagaggugcaaguuauagccguugaaccgggcaagaacccgaaaaacguccaaaccgcccccgguaccuucaagacgcccgagggggaggugggcgccaucgcccuugacuucaagcccgggaccagcggaucacccauagugaaccgcgaggggaaaaucgucggccuguacggcaaugggguggugaccaccuccggaacguacgucucagccaucgcccaggcaaaggcaucacaagaggggccgcuucccgagauagaggacgaaguguucaggaagaggaaccucaccaucauggaccuccaccccggauccgggaaaaccagacguuaccuaccggcgaucgugcgggaggcgaucaagcggaagcuccgaacgcugauccuggccccgacucgaguuguggccucggagauggccgaggcgcucaaaggaaugccaauccguuaccagacaacagccguuaaauccgagcacaccgguaaagagauugucgacuuaaugugccacgccacuuucaccaugcggcuguugagucccgugcgcgugccgaacuacaauaugauuaucauggacgaggcucacuucaccgaucccucaucgauugcugcgcggggguacaucucuacccgcgucggaaugggggaagccgccgccauauucaugacggccacgccgccugguuccguggaggcguucccgcaguccaacgccgugauccaagaugaggaacgggacauuccggagcgcuccuggaacuccggguacgaauggaucacggacuuccccggcaaaacugucugguucgugcccagcauaaagagugguaacgauaucgcuaacugccugaagaaaaacgggaaaagagugauccagcugagccgcaagacuuuugacaccgaguaccagaagacuaaaaacaacgacugggacuaugucgugaccacggacauuuccgaaaugggcgcaaauuucagagcggaccgcgugaucgacccgcggcgcugccucaagcccguaauucugaaggacgggcccgagcgggugauccuugccggccccaugccggucaccguggcuagcgccgcucagcgccgggggcgaaucggccggaaccauaacaaagagggcgaccaguacaucuacauggggcaaccccuaaacaacgaugaggaccacgcgcauuggaccgaggcuaagaugcuccucgauaauaucaauacucccgaaggcauaauacccgcacucuuugagccugagcgcgagaaguccgccgccaucgacggugaguaccgucuccguggcgaggcgcguaagacguucguugagcugaugcggcgcggggaucuccccguauggcuguccuacaaggucgccagugagggcuuccaguacucugaucggcgcuggugcuucgacggcgagcggaacaaccaggugcucgaggaaaauauggacguugaaaucuggacgaaagagggagaacgcaaaaagcugcggccucgcuggcuggaugcccgcaccuacagcgaccccuuagccuuacgggaguucaaagaguuugcggcugggcggcgcuccgugagcggggaccuaauucuggagaucggcaagcucccgcagcacuuaacccaacgggcccagaacgcccuggacaaucucgugaugcugcauaacuccgagcagggugggcgugccuaucggcacgcuauggaggaacuucccgacacgaucgaaacccucauccugcuggcccucaucgccguacugaccggggggguaaccuuauuuuucuuaucagggcgcggucuggggaagaccuccaucggcuuauugugugugauggccagcuccguccuccuguggauggccagcguggagccgcauuggaucgcagccucaaucauccucgaauucuucuuaauggugcuguuaauuccggagccggaucggcagcgaacgccccaggacaaccagcuggccuacgucguuaucggucuccuauucaugauccugaccguggccgccaacgagaugggacugcucgagaccaccaagaaggaucuugggaucggccacguagcgguagagaaccaccaccacgccgcaaugcuggacguugaccuccaccccgccagugccuggacucuguacgcgguagccaccacuaucaucacgccaaugaugcgucacacgaucgagaauacgaccgccaacaucucccugacagccauagccaaccaggcggccaucuugauggggcuugacaagggcuggcccaucagcaagauggacaucggcgugccuuuauuggcccuggggugcuacucacaggugaacccccucacgcucaccgccgcgguccugauguugguggcccacuaugcaauuaucggcccggggcuccaggccaaggccacccgcgaggcgcaaaagcgcaccgccgccggcaucaugaagaaccccacaguggacgggauugucgccaucgaccuggacccgguaguguacgacgcgaaguucgagaagcagcucggccaaaucaugcuauugauacugugcaccagccaaauccuucuaaugcggaccacaugggcgcugugugagucaaucacgcucgccacagggccccucaccacacugugggagggcagcccggggaaauucuggaauacgacgaucgcagucuccauggccaacaucuuccgcgggucguaucucgcaggugccgggcuggccuucagccugaugaagucccuugggggggggcggaggggcaccggggcgcagggcgagacccuaggggagaaauggaagagacagcugaaccaguuauccaaauccgaguucaacacguacaagcgcagcgggaucauggagguagaucgguccgaagcuaaggaaggccugaagaggggggagaccacgaagcacgcggugagccggggcaccgccaagcugaggugguucgucgagcggaaucuaguaaagccugaggggaaagugaucgaccuaggcugcggucguggggguugguccuacuacugcgccggguuaaagaagguuacggaggugaagggcuacacgaaaggcgggccugggcacgaagagccaaucccgauggccaccuauggauggaaucuggugaagcuccacagcggcaaggacgucuucuuuauaccgccugagaagugcgacacccuguuaugcgacaucggggagucaagccccaauccaacgaucgaggaagggcggacccugcgcgugcugaagaugguggagcccuggcugcgggggaaccaguucuguauaaagguccuuaacccuuauaugcccucugugguggagacccuggagcagaugcagcgcaaacauggcgguaugcugguccggaacccgcucagccgcaacuccacccacgagauguauugggugucuugcgggaccgguaacaucgugucugcaguuaacaugacgagcagaaugcugcucaaccgcuucaccauggcgcaucgcaaacccacguacgagcgggauguggaccucggggccggcacccgccacguggccgucgagcccgagguggccaaccucgacaucaucggccagcggaucgagaacauaaagcacgagcacaagagcaccuggcauuacgacgaggacaaucccuacaagacgugggccuaccacggcagcuaugagguaaagccguccggcagcgccuccucaauggucaacgggguggucaagcuguuaacaaagccaugggaugugauacccauggugacccaaauugccaugacggacacaacccccuucggacaacaacgaguguucaaggagaagguggacacccggacaccgaaagcuaagagggggacagcccagaucauggaggugaccgccaaauggcuguggggcuuccugagccggaacaagaaaccccggauuugcacccgggaagaguucacgaggaaaguucgcuccaacgcggccaucggcgccguguuugucgacgagaaccaauggaacagcgccaaggaggccgucgaggaugagcgcuucugggaucucgugcaccgggaacgagagcugcacaagcaaggaaagugcgcgaccugcguguacaacaugaugggaaagcgggagaaaaaguuaggcgaguucggcaaagccaagggguccagggccaucugguacauguggcucggcgcccgguuccuggaguuugaggcgcugggauucaugaacgaagaucauugguucagccgcgagaacucgcucucggggguggagggugaaggccuacacaagcugggcuauauccuucgcgacaucuccaagaucccaggcggcaacauguaugccgacgacaccgcagguugggauacccgcaucacagaggaugaccugcagaaugaagcccggaucaccgauaucauggaaccggagcacgcgcuucucgcuaagagcaucuucaaacugaccuaccagaacaagguggugcgcguacagcgccccgcaaagaauggcaccguuauggacgugauaucccggcgcgaccaacggggaagcggacaggucgggacguacggacugaacaccuuuaccaauauggaggcccaguugauccgucaaauggaaucagaagguaucuuuagcccuuccgagcuggagacccccaaccuggccgagcgggugcuggacuggcuggagaaguacggcguggagcgccuaaagcggauggccauuucgggggaugacugcgucgugaagcccaucgaugauagauucgcuaccgcccucaccgcccuuaacgacauggggaaggugcguaaggacaucccccagugggagcccagcaaaggauggaacgacuggcagcaggucccguuuugcagccaccauuuucaucagcugauaaugaaggacggccgcgagaucguuguuccgugccggaaccaggaugaauuggucggccgcgcacgggugucacagggcgccgguuggucucugcgcgagaccgcuugcuuggguaagaguuacgcccagauguggcaauugauguacuuccaccggcgcgaccugagguuagcagccaacgcgauauguucagccgugcccgucgacuggaucccuacgagccgcacuaccugguccauccacgcccaccaccaguggaugaccaccgaggacaugcucucgguguggaaccgaguuuggauugaggagaaccccuggauggaagacaagacgcacaucuccagcuggggcgacgucccuuaccugggcaagcgcgaggaccaguggugcgggucccugaucggccucacagcucgcgccaccugggcgaccaacauccagguugccaucaaucagguccggcgccugaucgggaacgaaaacuauuuagacuacaugaccaguaugaagcgguucaaaaacgaauccgaucccgagggcgcucucugguga

SEQ ID NO: 24621 - RNA, 9879 nt, Artificial Sequence
  derived and/or modified CDS sequence (opt11) from DENV-1__JQ045633__SS-prME
ucugugaccaugcugcucaugcugaugcccaccgcccuggccuuccaccugaccacgcggggcggggagccacacaugaucguaagcaaacaggagcgggguaagagccuguuguuuaagaccuccgccggggugaacaugugcacccugauagccauggaccugggcgagcugugcgaagauacgaugacauauaagugcccucguaucacggagaccgagccggacgacguggacugcuggugcaacgcuacggacaccugggugacuuacggaaccuguagccaaacgggcgagcaucggcgggacaagcggagcguggcccucgcaccccaugugggguuggggcucgaaaccagaaccgaaaccuggaugagcuccgagggcgccuggaagcagauccagcggguagagacgugggcccuacggcauccgggguucaccgugaucgcccuauuccuagcccacgcgauaggaaccagcaucacgcagaaggggaucaucuucauucucuugaugcuggugacacccucaauggccaugcggugugucgguauaggcagccgcgacuucguggaggggcucucaggcgccaccuggguggacgucgugcuggagcaugggagcugcguaaccacgauggccaaagauaagccaacgcuggacauagagcucuugaagaccgagguaacaaaccccgccgucuuacggaaguuaugcaucgaggcgaagaucuccaauaccacgaccgacagccgcugccccacccaaggcgaggccacccuaguggaggaacaggacgcgaacuucgucugccggcgcacguucguggaucgggggugggggaacggcugcgggcuguucggcaaaggaagccugaucacgugcgccaaguucaagugcgugaccaagcuggagggcaaaaucgugcaguacgaaaaccugaaguacuccgugaucgugaccguccauacgggcgaucagcaccaaguagggaacgagagcaccgagcauggcaccaccgccacaaucacgccccaggcgcccacuaccgagauucagcuagccgauuauggggcccugacccuggacugcagcccccgcacggggcuagacuuuaacgagaugguccugcucacgaugaaggaaaagucuuggcucguccauaagcagugguucuuagaccugccgcuacccuggaccucaggugccaguaccucucaggagacguggaaccggcaagaccuguuagucacauucaagacugcccaugcgaagaaacaggaggucgugguccucgguagucaggagggagccaugcacacugcccugacgggagcaaccgagauucagacaaguggcaccacgaccaucuucgcaggccaccugaagugucgccucaaaauggacaagcugaccuugaaaggcaugagcuaugucaugugcaccggguccuucaagcucgagaaggagcuggcggagacgcaacacggcaccgugcuggugcagaucaaguaugaagggaccgaugcccccugcaagauaccuuucucgacccaggacgagaagggggucacgcagaauggccggcugauaacugcaaacccgauagugaccgacaaggagaagcccgugaacaucgaggcugagccgccguucggggaguccuacauugucauaggggcaggcgagaaggcgcuaaaacugagcugguuuaagaaggggaguagcaucggcaagauguucgaggccaccgcccgcggcgcucggcgcauggcgauccugggugauacggccugggacuucgggaguaucggcggaguguucaccagcgugggaaagcucguccaccagaucuuuggcgccgccuacggggugcuguucuccggugugucuuggaccaugaagauagggaucggcgugcugcugacuuggcugggccuuaacucccgcagcacgucucucaguaugaccugcauagccguggggcuggugacucuauaccucggcguuauggugcaggcggacuccgggugcgugaucaacuggaagggccgggagcugaagugcggaagcggcaucuucgucaccaacgaaguacacacguggaccgagcaguacaaauuucaggccgacaguccuaaacggcugucggccgccauagguaaagccugggaggaaggggucuguggcauccgaagcgcgacacgccucgagaacaucauguggaagcagaucagcaaugagcugaaccacauccuuuuggagaaugacaugaaguucaccgucguggucggcgacgucgccgguauccucgcccaggggaaaaagaugauccggccucagcccauggaguacaaguacagcuggaagagcuggggcaaggcgaagaucauaggggcggaugugcaaaacaccacuuucauaaucgacgggcaaaacacccccgagugcccggacgaccagcgggccuggaacauuugggagguggaggacuauggcuucggcaucuucaccaccaacauauggcugaaguuacgggacagcuacacccaggucugcgaucaccgccugauguccgccgccaucaaagacagcaaggccgugcacgcggacaugggcuauuggaucgaguccgagaagaacgaaacauggaagcuggcccgggccagcuucaucgagguuaagaccugcaucuggccgaagucccauacccucuggagcaacggcguccuggaguccgagaugaucauccccaagaucuacgggggccccauaagccagcacaacuaccgcccuggguacuucacgcagaccgccggacccuggcaccuggggaagcucgaacuggacuucgaccuaugugagggcacuaccgugguaguagacgagcacugcggcaaucgggggcccuccuugcgcacgaccaccgugacgggcaagaucauccacgaguggugcugccggagcuguacgcugccgccccugcgcuuccgcggugaggacggcugcugguaugggauggagauacgccccgugaaggaaaaggaggagaaccucgucaaguccauggugagcgccggcucuggagagguagauucuuuuagccucggguugcucugcaucuccaucaugaucgaggaggucaugcggagccgaugguccaggaagaugcugaugaccggcaccuuggcuguguuccuccuguugaucaugggucaguugaccuggaacgaccucaucagacuuuguaucaugguaggcgcgaacgccuccgacaggaugggcaugggcacgacguaccuggcgcugauggcuaccuuuaagaugcgucccauguuugcugucggccugcuguuucgccggcugaccucccgcgaggugcuccuccuuacgauagggcugagccucguggccuccgucgagcugccgaauagccuggaggaguuaggcgacgggcuggccaugggcaucaugauccugaagcuccuaaccgacuuucagucccaccagcugugggccacacugcugagccugaccuucauaaagaccacauucucacuccacuacgcguggaagaccauggccaugguacugagcaucgucucccuauucccucucugucugagcaccacgucccagaagaccaccuggcugcccgugcuccugggcagcuuagguuguaagccucucacuauguuccugaucgccgagaacaagaucuggggccgccgcagcuggccgcugaacgaggggauaauggccguggggauugucagcauccuccucagcucccuacucaagaacgaugugccgcuggccgguccccucaucgcgggcggcaugcuuaucgccugcuacgugaucucuggguccagcgccgaucuuucccuggagaaggccgccgaagucagcugggaggaggaggcugagcauuccggcgccagccacaacauccugguggaaguccaggacgacgggacgaugaagaucaaagaugaggagcgugaugauacccugaccauuuuauugaaggcuacgcugcuggccgucaguggcgucuaccccuuaagcauacccgcgacccuguucgugugguacuucuggcaaaagaagaagcagcgcagcgggguucugugggacacgcccuccccgcccgaaguggagcgggcggugcuggacgauggcauauaucgcaucaugcagcggggccuccugggacguucgcaaguuggcgucgguguguuucaggaaaauguguuccacacaauguggcacgugacccggggcgccguacuuauguaccaagggaagcgcuuggaaccgagcugggccuccguaaagaaggaucugaucagcuacggcggcggguggagacugcagggcaguuggaacaccggggaggagguccaggucaucgcggucgagcccggcaaaaaccccaaaaacgugcaaacggcgcccggcaccuucaagacccccgagggagaagugggcgcgaucgcccucgacuucaagccagggaccagcggcucuccaaucguaaaccgcgaagggaagaucgucggccuguacggcaaugggguggucacgaccagcgguacguacguauccgccaucgcccaggcgaaggugucccaggaagggccccugccggagaucgaggacgaagucuuccggaaacgcaaccucacaauuauggaccugcaccccggcagcgggaagacccggcgauaccugcccgccaucgugagggaggccaucaagcgcaagcucagaacccugauccuggcucccacccgagugguagccuccgaaauggcagaggcccucaaaggcaugcccauccgcuaccagaccaccgccgucaagagcgagcacaccggcaaggagaucguugaucugaugugccacgccaccuucacuaugcgguugcuuucccccguucgcgugcccaauuauaacaugaucauaauggaugaggcgcacuucacggacccgagcucaauagcggccagggguuacaucagcacccgggugggcaugggggaggccgccgccaucuucaugacugcgacaccgccuggcuccgucgaggccuucccccagagcaaugccgugauccaggacgaggaacgggacaucccugagagguccuggaacucgggguacgaauggauaacggacuucccgggcaagaccgugugguucgucccgucuaucaagagcggcaacgacaucgcuaacugccugagaaaaaaugggaaacgcguuauacagcugucgcggaagacguucgacaccgaauaccaaaagacuaagaacaaugauugggacuauguggucacaacggacaucagcgagaugggcgcgaacuuccgcgcugaccggguuaucgacccccggcgguguuugaagccgguuauccugaaagacgguccugagcgagucauccuggccggccccaugcccguaacggucgccuccgccgcacaacggcguggucggaucggccgcaaucacaacaaggaaggcgaccaguacaucuacaugggacagccgcucaacaacgacgaggaccacgcccacuggacugaggcaaagauguugcuagacaauaucaacacccccgaggguauuauccccgcccuuuuugagcccgagcgcgagaaguccgccgcuaucgacggggaguaccggcugcgcggcgaggcuagaaagacguucguggagcugaugcgccggggugaccucccggugugguuauccuacaaggucgccagcgagggauuccaguacagcgaucgccgguggugcuucgacggcgagcgcaacaaccaggugcuagaggagaacauggauguggagaucuggacgaaggagggggagcggaagaagcuccgcccccgguggcucgaugcccgcacguacuccgaccccuuagcacuccgugaguuuaaggaauucgcggccggcaggcggagcguauccggggaccugaucuuggagaucggcaagcuaccacagcacuugacccagagagcccagaacgcccuggacaaccucgucauguuacacaacagcgagcagggaggucgggcauacaggcaugccauggaggaacuuccagacaccaucgagacucuaaugcugcuggcccucaucgccgugcugacaggcgggguuacgcuguucuuucucuccggccgcgggcugggcaaaacuucgaucggacuucuaugcgugauggccuccagcgugcugcuguggauggcguccguggagccccacuggaucgccgcgaguaucauucucgaguucuuucugauggugcugcugauccccgaaccugaccgccagagaaccccgcaggauaaucagcuggcguacgugguuaucgggcuccuguucaugauccugacgguggccgcaaacgagaugggccuguuggagacgacuaagaaggacuuagggauuggccacguggccgucgagaaucaccaccacgccgcgaugcuggacguugaccuccaccccgcuuccgcguggacucuguacgcgguagccaccacgauaauaacuccgaugaugagacacaccauugagaacacuacggccaauaucagccugaccgccauugcgaaccaggccgccaucuugauggggcuggacaagggcuggccuaucuccaagauggacaucggcgugccccugcucgcccuggggugcuauucucaggugaaccccuuaacccucaccgcggcagugcugaugcuggucgcccacuacgccaucaucggccccggucuccaggcaaaggcgacgcgcgaagcccagaagcguaccgcugccggcaucaugaagaaucccaccguugacgguaucguugccaucgaccucgacccggucguguacgacgcgaaguucgagaagcaauuaggccagaucaugcuucuaauacuguguaccucccagauccuccugaugaggacgacuugggcccugugcgagucgauaacacucgccaccgggccccugacgacccugugggaagggucccccggcaaguucuggaacaccaccauagcugugagcauggcuaauaucuuccgggguuccuaccuugcgggagccggccuggccuucagccugaugaaaucccucggaggcgggcgccggggcacgggagcccagggcgagacucugggcgaaaaguggaaacgacagcugaaccagcucuccaagagcgaguucaacacguauaagcgguccggaaucauggaggucgaucgcagcgaggcgaaggagggccugaagcguggugagaccacgaaguacgccguaucccgcggcacggccaaacuacggugguucguggagcgcaaccuggucaagccugaggggaaggugauagaccucgguugcggccgggggggcugguccuacuacugcgcuggucugaagaaggugacagagguuaaggguuacaccaagggcggcccgggccacgaggagccgauucccauggccacguacggguggaaccucgugaagcuccacuccggaaaagacguguucuucgugccgcccgagaagugcgacacccuccuuugcgacauuggggagagcucccccaaccccacuaucgaggaaggcaggacccuccgggugcugaaaaugguugagccguggcugcgcgggaaccaguucugcaucaagauccucaaccccuacaugcccucgguaguggaaacgcuggagcagaugcaacggaagcacgguggcaugcuggugcgcaacccccucucaaggaacagcacccacgagauguacugggucuccugcgggaccggcaacaucgugagugcgguuaacaugaccucccgcaugcugcugaaccgcuucacaauggcccaccggaagccgacguacgagcgcgacgucgaccucggggcgggcacccggcacgucgcgguggagccggaggucgccaaccuggacauaaucggccagcgcauugaaaacaucaaacacgaacauaagagcacauggcauuacgacgaagacaaucccuacaagaccugggcauaccacggguccuacgaggugaagcccagcggcuccgccucuagcauggucaacgggguagugaagcugcucaccaagccgugggacgucauucccaugguaacucagaucgccaugaccgacaccacgccuuucggccaacagcggguguucaaggagaaggucgacacaagaacgcccaaggccaagagggguaccgcccagauuauggaggugacggcgaaguggcuguggggauuccugucgcgcaacaagaaaccgcggaucuguacgcgcgaggaguuuacccggaaggugcgcagcaaugccgccaucggcgccguauucguggacgagaaccaguggaacuccgcgaaggaggccguagaggacgaacgcuuuugggaccucguccaccgcgagagagagcugcacaagcaggggaagugcgcuaccugcguguacaacaugaugggcaaacgggagaagaagcugggggaauucggcaaggcuaaggggagccgggccaucugguacaugugguuaggcgcgcgcuuccuggaguucgaggcccucggcuucaugaaugaggaccauugguucagccgggaaaacucccucagugguguggagggcgagggucugcacaaacugggcuacauccuccgcgauaucucaaagauccccgggggcaauauguaugcggaugauacugccggcugggacacacggaucacggaagacgacuugcagaaugaggcccgcauaaccgauaucauggagcccgagcacgcgcuuuuagccaaguccaucuuuaagcugacguaccagaacaaggucgugcgcgugcagcguccggccaagaacggcaccgucauggacgugauaagccgccgggaccagcgcggcagcggccaaguggguacauacggacugaacaccuuuacgaacauggaggcccagcucauccggcaaauggagucggaggggaucuuuucccccuccgaauuagagacucccaaccuggccgagaggguccucgacugguuggagaaauacggcguggagcggcugaagcgcauggcuaucuccggagaugacugcgugguuaaacccaucgaugaucgguucgccaccgccuugaccgcccugaacgacaugggcaaggugcgcaaagacaucccgcagugggagcccagcaagggguggaacgauuggcagcagguccccuucugcucccaccacuuccaccaacugaucaugaaggacggacgcgagaucgucgugccaugccgcaaccaagaugagcucgugggacgggcccgaguaagucaaggggcgggguggagcuugcgggagacagcaugccuggggaaguccuaugcccagauguggcagcucauguacuuucaccgccgcgaccugcgacuggccgcaaacgcgaucuguagcgccguuccgguggacuggauucccaccagccggacuacuuggagcauccacgcccaccaccaguggaugacgaccgaggauaugcuguccguauggaacagaguguggaucgaggagaaccccuggauggaagacaagacccacaucagcuccuggggcgacgugcccuacuuggggaagcgagaggaccaguggugcggcagcuugaucggucuuaccgcccgggcgacaugggccacgaacauccaggucgcgaucaaccaggugaggcggcuuaucgguaacgagaacuaccuggauuacaugacauccaugaagcgcuucaagaacgagagcgauccggagggcgcacucugguga

SEQ ID NO: 24622 - RNA, 9879 nt, Artificial Sequence
  derived and/or modified CDS sequence (opt11) from DENV-1__JQ045634__SS-prME
agcgugacuaugcugcugauguuaaugcccaccgcacuggcuuuccaucucacgacgcggggcggggaaccacacaugaucgugagcaagcaggagcggggcaaaagccugcuuuucaagacgagcgccggggugaauaugugcacccucaucgccauggaucugggcgaguugugcgaggauaccaugaccuacaaaugcccccggauaacugagaccgagcccgaugauguagacugcuggugcaaugccaccgacaccugggugaccuacggaacgugcagccagacgggcgagcaccggcgugacaaacggagcgucgcccucgcgccccaugugggccugggacuggagacccgcaccgagaccuggaugagcuccgagggcgccuggaagcagauccagcggguggagacgugggcucuccggcaucccggguuuaccgugaucgcccuguuucuggcccaugcgauaggcaccagcaucacgcagaaggggauaauauucauccuccugaugcuggucacccccuccauggcgaugcggugcguuggcaucggcagccgcgacuuuguugagggcuuaucgggcgcgaccuggguagacgucgugcuggagcacggaagcugcgugaccaccauggccaaggacaagcccacguuagauaucgagcuccugaaaacggaagucaccaacccagccgugcugcggaagcucugcaucgaggcgaagaucuccaacaccacuaccgacagccgcugccccacccagggcgaagccacucuggucgaggagcaggacgcgaacuucgucugcaggcgcacguucguggaccgggguugggggaauggcugcgggcuguucggcaaggggucccucaucacgugcgcgaaguuuaagugcgugaccaaacuugaagguaagaucgugcaguacgagaaucugaaguacagcgugaucgugacgguccacacgggggaccaacaccagguggggaacgaguccacagagcacggcacgaccgccaccaucacgccccaggcgcccacuacggagauccagcucgccgacuacggggcccugacccuggacuguagcccccguacgggccucgacuuuaaugagaugguccuguugaccaugaaggaaaagucaugguuggugcacaagcagugguucuuagaccuaccgcuccccuggaccagcggggcaucaaccucgcaggagacguggaaccggcaggaccugcuggugaccuucaagaccgcccacgcgaagaagcaggaggucguggugcucggcagccaggagggcgccaugcauacggcccucacgggggccacggagauccaaaccagcggcaccacgaccauauucgcggggcaccugaagugcaggcucaagauggacaagcucacccugaaggggaugagcuacgucauguguaccggauccuucaaacucgagaaggaacuagcggaaacgcagcacggcaccgugcugguucagaucaaguaugagggcaccgaugcccccuguaaaauccccuucagcacacaggacgaaaagggcgucacgcagaacggccggcugaucacagccaacccaaucgugaccgacaaggagaagcccgugaacauagaggccgagccgcccuucggggaguccuacaucgucaucggcgcaggcgagaaggcccucaaacuuagcugguucaagaagggguccagcaucggcaagauguucgaggccaccgcccgcggggccaggcgcauggcgauucugggcgacacggccugggacuuuggguccaucggcggcguuuucacuagcguggggaagcucguccaccagaucuucggcgccgccuacggcguguuguucucgggcgucagcuggaccaugaaaaucgggauaggcguacugcuaaccuggcugggccugaacucucgcagcacgucccucucgaugaccugcaucgccguggggcuggugacccuguaccucggcgucaugguucaggcggacuccggcugcguaaucaacuggaagggcagggaacugaagugcggguccggcauauucgucaccaacgaaguucacacuuggacagagcaguacaaguuccaggccgauagcccgaagcgccuguccgccgcaaucggaaaggccugggaggagggaguuugugggaucagaagcgcgacccgccucgagaacaucauguggaagcaaaucuccaacgagcugaaccacauccugcucgagaacgacaugaaguucaccgugguggugggcgacgucgccggcauccuggcccaaggcaagaagaugauccggccccagcccauggaguacaaguacucguggaaguccuggggcaaggccaagaucaucggcgcggacgugcaaaacaccacguucaucaucgacgggcagaacacccccgaguguccggacgaccagcgcgccuggaacaucugggaggucgaggacuacggcuucgggaucuucaccaccaacaucuggcugaaacuccgggacagcuacacgcaggucugcgaccaccgccugauguccgccgcaauaaaagacagcaaggccgugcacgcggacaugggcuacuggaucgagagugaaaagaacgagacuuggaagcuggcacgggccagcuuuauugaggugaagacguguaucuggcccaagucccacacgcucuggagcaaugggguccuagaauccgagaugaucauccccaagaucuaugggggccccaucagccaacacaacuaccgcccgggguacuucacgcaaaccgccggccccuggcaccuggggaagcucgagcucgacuucgaccugugugagggcacuaccguuguugucgacgagcacugcgguaaccgggggcccucccuccgcacgacuaccgugacggggaagaucauccaugaaugguguugccggagcugcacgcugccaccccugcgcuuccgcggugaggacggcugcugguacgggauggaaauccgccccgugaaggagaaggaggagaaccucgucaaguccaugguaagcgccggcucuggcgaggucgauucuuucagccuggggcuucucugcaucuccaucaugaucgaggaggugaugcguagccgcuggucccggaagaugcugaugaccggcacccuggcgguuuuccuccuucuuaucauggggcagcucaccuggaacgaccugauccgcuuauguauaauggugggggccaaugccagcgaccgcauggggaugggcacgaccuaccucgcccuaauggccaccuucaaaaugcggcccauguuugcgguggggcuccuguuccgccggcugacgucccgcgagguacugcuccugacgaucgggcugagccucguggcguccgucgagcucccuaauagucuggaggaacucggcgacgggcuggccaugggcaucaugauccugaagcuccugaccgacuuccagucccaccagcugugggccacgcuacugagccugacuuucaucaagacgaccuucucccuacacuacgcguggaagacaauggccauggugcucucaaucgucucccuguuuccccucugccugagcacuaccucccagaagaccaccugguugcccguucuccugggcagucuggggugcaagccucucaccauguucuuaaucgccgagaacaaaaucuggggccguagauccuggccguugaacgaggggauaauggccguuggcaucgucagcauccuccugagcucccuucucaagaacgacgugccccuggcaggaccccuuaucgcgggcggcaugcucauugccugcuacgugaucagcggguccagcgccgaucugucucuggagaaggccgcggagguuagcugggaggaggaggcggagcacuccggcgcgagccacaacauccuuguagagguacaggacgacgggacgaugaaaaucaaggacgaggagcgggacgacacccugaccauacugcucaaggccacacuguuagccguuuccggcguguacccccuuagcauaccagcaacccuguucgugugguauuuuuggcagaagaagaagcagcgcucagggguccugugggacacgcccuccccgcccgaggucgagcgggcgguacuugacgacggcauauaccgcaucaugcagcggggccuacuggggcguucccaggucggagugggcguguuccaggaaaacgucuuccacaccauguggcacgugacccggggagccguacugauguaucaagggaaacggcucgagccgaguugggccucagugaaaaaggaccugaucagcuauggcggugguuggcggcugcagggcuccuggaacaccggugaggagguccaggugaucgcagucgagcccgggaagaaccccaagaacgugcaaacggcccccgggaccuucaagacuccggaaggugaggugggcgcuaucgcccuugacuucaaaccggggacaagcggcucccccaucguuaaccgagaggggaagaucgucggccuguacggcaacggggugguuacuacaaguggaacguacgugagcgccaucgcacaggcgaaaguaucccaggaggggccccuaccggagaucgaagacgaggucuucagaaagagaaaccucaccaucauggaccugcaccccggcagcgggaagacgcggcgcuaccugccagcuaucgugcgggaagccaucaagcgaaagcucagaacucugauccuggcuccuacccgaguggucgccucugagauggcagaggcucuaaagggaaugcccauccgcuaccagaccacggccgucaagagcgagcacaccggcaaggagaucguggaccugaugugccacgccaccuuuaccaugcggcugcucucacccguccgcgugcccaacuacaacaugaucauuauggacgaggcucacuucacggauccgagcagcaucgcggcacggggguacauaucgacccgcgugggcaugggggaggccgccgcaaucuucaugaccgccacgccgcccggcucaguugaggccuucccucagucgaacgccgugauccaggacgaggagcgggacaucccggagcguuccuggaacucuggguacgaguggaucacggacuucccugggaaaaccgugugguucguccccuccaucaagagcggcaacgacaucgccaacugccugcggaagaacgggaaacgagugauccagcugucccguaagaccuucgacaccgaauaccagaagacgaagaacaacgacugggauuacguggucaccacagacauaagcgaaaugggcgcgaacuuccgcgccgaccgggugaucgacccccgucggugccucaagccggugauccugaaggacgggccagagcgcgucauccuggcgggacccaugcccguuacagucgcguccgccgcgcagaggagggggcggaucggccgcaaccacaacaaggaaggcgaccaauacauuuacauggggcagccgcucaacaacgacgaggaccacgcccacuggacggaggccaagaugcuguuggacaacauuaacacccccgagggcauaaucccagcccucuucgagcccgagagggagaaguccgccgcaaucgacggggaguaccggcugcgcggcgaggcgcggaagaccuucguggagcugaugcgccgcggggaccucccuguguggcuguccuacaagguugcaucugagggcuuccaguauucagaccgccgguggugcuucgacggcgagcgcaacaaccaggugcuggaggagaacauggauguggagauuuggaccaaggagggggagcguaagaaacuccguccacgauggcuggacgcgcguacguacuccgaucccuuagcccuccgggaguucaaggaauuugcggccggccgccggagcgucucgggcgaccugauucuggagaucggcaaacucccccagcacuuaacccagcgcgcccagaacgcccuggacaaccucgugaugcugcauaacuccgagcagggcgggagagcguaccgacacgccauggaggagcugccggauaccauugagacccuaaugcuccuggcacucaucgccgugcugacaggcggggucacacuuuucuuccucuccgggcgggggcucggcaaaaccagcaucggccugcuuugcguaauggccucgagcgugcugcuguggauggcuuccgucgagccccauuggaucgccgcaagcaucauucuggaguucuuccugaugguacugcugauccccgagcccgaccgccagcggaccccgcaggacaaccagcuggccuacguggucaucggucuccuguucaugauacugaccguggccgcgaacgagaugggccugcucgagacgaccaagaaggaccuggggaucggccacguggccgucgagaaucaccaccacgcggccauguuggacguggaccuccacccagccucugcguggacccuguacgccguggcaaccacgaucauaacucccaugaugcgccacacaaucgagaacaccaccgccaacaucagccugaccgccaucgcgaaccaggccgcuauccucauggggcuugacaaagguuggccgaucuccaagauggacaucggggucccucugcucgcccugggguguuacagccaggugaacccccucacccuaacggcugcugugcugaugcuagucgcccacuacgccaucauaggacccgggcuccaggccaaggccacucgcgaggcacagaagcggaccgcagccgggauuaugaagaacccgacuguggacgggaucguggccaucgacuuggaccccgucguguaugacgcgaaguucgagaagcagcuggggcagaucauguuacugauccugugcaccucgcaaauccucuuaaugcgcacgacuugggcccugugcgagucaaucacccucgcaaccggcccguugacgacccugugggagggguccccggggaaguuuuggaacaccaccaucgccgugucuauggcaaacauauuccgggggucuuaccucgcgggcgccggccuagccuucagccugaugaagucccucggaggcgggaggcgggggaccggggcucagggcgagacccuaggcgagaaguggaaacgccaacugaaccaguuguccaagagcgaguucaacaccuauaagcgguccgggaucauggagguugaccgcagcgaggccaaagagggccugaagcgcggugaaaccacgaaguacgcggugucacguggcacggccaagcugcggugguucguagagcgcaaucuggucaagccggaggguaaggugaucgaccucggcugcggucggggagggugggcguacuacugcgccggccuaaagaaagugaccgaggucaaaggguacacuaaaggcgggcccggccaugaggagcccaucccuauggcuacguacggguggaacuugguaaagcuccacagcggcaaagacguguucuucgucccgcccgagaagugcgacaccuugcugugugacaucggggaguccagcccgaaccccaccaucgaggagggccgaacccuccgggugcugaagaugguggaaccguggcugcgcgggaaccaguuuugcaucaagauucucaacccauacaugcccagcgucgucgagacgcuggaacagaugcaacggaaacauggugguaugcuggugcgcaacccccuaagccgcaacuccacgcacgaaauguacugggugagcugcgguaccggcaacauuguauccgccguaaacaugaccagccgaauguugcugaaccgcuucacuauggcccaccggaagccaacauacgaaagagacgucgacuugggggcgggcacccggcacguggccguagagccggaggucgcgaaccuggauaucaucggccagagaaucgaaaacaucaagcacgagcacaaguccacguggcacuaugacgaggacaaccccuacaagaccugggccuaccacggguccuacgaggugaagcccuccggcagugcguccagcauggucaacgggguggugaagcugcucacuaagccgugggacgucauccccauggugacccagauagccaugacugacaccacgcccuucggccagcagagaguguucaaggaaaaggucgacacacgcacccccaaggccaagcgggggaccgcgcagaucauggaggucacggccaaguggcuguggggcuuucugagccgcaacaagaagccgcggaucugcacccgcgaggaguucacccgcaaggugagguccaacgccgccaucggugcggucuucguggacgagaaccaguggaacucugccaaggaggccguagaggacgagcgguuuugggaucucguccaccgcgagcgggagcugcacaagcaggggaagugcgcgaccuguguguacaacaugaugggcaagcgcgagaagaagcugggugaguucggcaaggccaaaggguccagagcaaucugguacauguggcucggcgcccgcuuccuggaguucgaagcccugggguuuaugaacgaggaccacugguucucacgggagaacucccucagcggaguugagggagagggguugcacaaguuaggcuacauccucagagacaucuccaaaauaccugggggcaacauguaugccgaugauaccgcaggaugggacacccgcauaaccgaggacgaccugcagaacgaggcgcggaucaccgacaucauggagccagagcacgcccuccucgcgaagucuaucuucaagcugacguaccaaaacaaggucgugcgcgugcaacggccggcuaagaacgggaccguuauggacgugaucucccgccgggaucagcgcggcagcggacaggugggcaccuacggccucaacacauucacgaacauggaggcucagcugauccggcagauggaguccgaggggaucuuuuccccauccgaacuggagacccccaaccuugcagagcgcguucucgauugguuggagaaguacgguguggagcggcugaaaagaauggccaucagcggggaugacugcguggucaagcccaucgacgaccgguucgccacagcccucaccgcccuaaacgacauggggaagguucgcaaggauauuccgcagugggagccguccaagggguggaacgacuggcagcaggucccuuucuguagccaccacuuccaccagcugaucaugaaggacggccgggaaaucguagugcccugcaggaaucaggaugaauuagugggccgggcacgcguaucccaaggggccggcuggagccugcgggagacagccugucuggggaaaagcuacgcccagauguggcagcucauguacuuccaccgccgugaccugagacuggcggccaacgccaucugcagcgcaguaccgguggacuggaucccgaccucgagaaccaccugguccauccacgcccaccaccaguggaugacaaccgaggacauguuaucggucuggaaccgaguguggauugaggagaacccauggauggaggacaagacccacaucuccucuuggggugacgugcccuaccugggcaagagagaggaucaguggugcggcucucugaucggccucaccgcgcgggccacgugggccacgaacauccaagucgccaucaaccaggugcgccggcugaucggcaacgagaacuaccuggacuauaugaccuccaugaagcgcuucaagaacgaguccgauccggagggcgcccucugguga

SEQ ID NO: 24623 - RNA, 9879 nt, Artificial Sequence
  derived and/or modified CDS sequence (opt11) from DENV-1__JQ045636__SS-prME
ucagugaccaugcugcucaugcugaugcccaccgcccuugccuuccaccucacgacccgcggcggggagccccauaugaucgugagcaagcaggagcggggcaagagcuuauuguucaagaccucugccggggugaacauguguacacucaucgccauggaccugggugaauucugcgaggauaccaugaccuacaagugcccccgcaucaccgaggcugagcccgaugacguggauugcuggugcaacgccaccgauacuugggucacuuacgggaccugcucccagaccggcgagcaccggagagacaagcgguccguggcccuggcgccccacguggggcucgggcuggagacgcgaaccgaaaccuggaugagcuccgagggcgccuggaagcagauccagcgggucgagaccugggcccugcgccaccccggguucacggugaucgcucucuuucuggcgcacgccaucggcaccagcaucacccaaaaggggaucaucuucauccugcucauguuagucacccccuccauggccaugcggugcgucggcaucggcucuagggacuucgucgaagggcuguccggugccacguggguggacgucgugcucgagcacgggagcugcgucaccacaauggccaaggacaagcccacccuggacaucgagcucuuaaagacggaggucaccaaccccgcggugcugcggaagcuguguauugaggccaaaaucaguaacaccaccacggacagccgcugcccgacccagggcgaggccacgcucguggaggaacaggacgccaacuucgucugucggcgcacuuucguggaccggggcugggggaacggcugcgggcuguucggcaaggggucccugaucacgugcgccaaguucaagugcgugaccaagcucgagggcaagauaguccaguacgagaaucugaaguacagcgugauaguaaccguccauaccggggaccaacaccaggucgggaacgaauccacggagcacggcaccaucgcgaccaucacaccccaggcccccucaacugaaauccagcugacggacuauggggcccucacgcuggacugcagcccgcggacuggccuggacuucaacgaaaugguccuccugaccaugaaggagaagaguuggcucguucacaagcaaugguuccuggacuugccgcugcccuggacgagcggggccuccaccagccaggagaccuggaaccgccaggaccuccuggugaccuuuaagacggcccacgcgaagaagcaggaaguggugguguuaggcagccaagagggcgccaugcacaccgcccucacuggggccaccgagauccagacgagcggcaccaccacgauauucgccgggcaccugaagugucgccugaagauggacaagcucacgcuuaaaggcauguccuacgucauguguacugggagcuucaagcuggaaaaggagguggcggagacccagcauggcaccgugcugguccagaucaaguacgaaggcacggacgcgcccugcaagaucccuuucuccacccaagacgagaagggagcuacccaaaacggccggcugaucaccgccaaccccaucgugacggacaaagagaagcccgugaauaucgaagcggagccccccuucggggaaagcuacaucgucaucggugccggcgagaaggccuugaagcuguccugguucaagaaggggagcuccaucggcaagauguucgaggcaacagcccgaggagcgcggcgcauggcgauccucggcgacaccgccugggacuucggguccaucggcggcguauucaccuccguggggaaguuaguccaccagauauucggaacggccuacggggugcuguucuccgguguguccuggaccaugaagaucgggaucgguguccucuuaacauggcugggccugaacagucgcuccacaagccuguccaugacgugcaucgccguggggcugguaacacucuaccugggugucauggugcaggcggauagcgggugcgucaucaacuggaagggccgggagcugaagugcgggagcggcaucuucgucaccaacgagguccacaccuggacggagcaguacaaguuccaggcagacagcccuaagagauugagcgccgccaucggaaaggccugggaagaaggggugugcggcauccgguccgcgacccggcuggagaacauaauguggaagcaaaucuccaaugagcugaaccauauccuccuggagaacgacaugaagcugaccgucguggugggggacgucgcagguaucuuagcccaggggaagaagaugauccggccccaacccauggaguauaaguacuccuggaaguccuggggcaaggccaagaucaucggcgcggacgugcagaacacuaccuucauaaucgacgggcccaacacgccugagugcccugacgaccagcgggccuggaacaucugggagguggaggacuacggguucgggaucuucacuaccaacaucuggcugaagcuccgggacuccuacacccaggucugcgaccaucgccucaugagcgcagccaucaaggacaguaaggccgugcacgcugauaugggcuacuggaucgagucugagaagaaugagacguggaagcuagcucgggccuccuucaucgagguaaagaccugcauauggcccaagagccacacgcuguggucgaacggcguccucgagucagagaugaucauacccaaaaucuaugggggccccaucucccagcacaacuaucgccccggguauuucacccagacggccggcccauggcaccuggggaagcuggagcucgacuucgaucugugcgaaggcaccacggugguggucgacgagcacuguggcaaccgggggccgucgcuacgcaccacgaccgugaccggcaagaucauccacgaguggugcugccgguccugcacguugccgccccuccgcuucaagggggaggacggcugcugguacgggauggaaauccggccggugaaggagaaggaggagaaccuagucaagagcauggugagcgccgguuccggcgagguggacagcuucucccucgggcugcugugcauaagcaucaugaucgaggaggucaugcgcucccgguggagccgcaagaugcucaugacgggcacccuggcgguguucuuuuuacugaucauggggcaguuaacuuggaacgaccugauccggcucugcaucauggugggggccgacgccuccgaccgcauggggaugggcaccaccuacuuagcccugauggccacauucaagaugcgcccgauguuugcggucggucugcuguuccgaaggcugaccagccgggaggugcuccugcugaccaucgggcucuccuuaguggcuuccgucgagcugcccaacuccuuggaggagcugggcgaugggcuggccaugggcaucaugauccucaaacugcugacggacuuccaaagccaccaacucugggccacccuguugagucucaccuucauccgcacuacguucagccugcacuacgcauggaaaacaauggccauggugcugucuauagucagccucuucccgcugugucuguccaccacuucgcagaagacgaccuggcucccggugcugcugggcucucuagggugcaagccacugaccauguuccuaaucgccgagaacaagaucuggggccgcaagucguggccccucaacgaggggaucauggccguaggcaucgucucgauccuucuguccagccuccugaagaacgacgugccccuggcggggccccuuauugcgggcggcaugcucaucgccugcuacgucauuucggggagcagcgccgacuugucucuagagaaggccgccguuguguccugggaggaggaagccgagcacaguggagccucccacaacauccuaguggagguccaggacgacgggaccaugaaaaucaaggacgaggaacgcgacgacacacugaccauucuccugaaagcgacccugcucgccguaagcggcguuuacccacugagcauccccgccacgcucuucgucugguauuucuggcagaagaaaaagcagcggagcggggugcucugggauacccccaguccgccggagguggagcgcgcgguacuggacgacggcaucuaccggauaaugcagcgcggccugcuggggcggucccagguaggcgugggggucuuccaggagaacguuuuccacacaauguggcacgugacccgcggagccguccucauguaccagggcaaaaggcuggagccuucgugggccagcgugaagaaggaccugaucuccuacgggggcggguggcgucuccagggcucauggaauaccggugaggaaguucaggucaucgcgguggagccagggaagaaucccaagaauguucagaccgccccugggacguuuaagacguccgagggcgaggugggcgcaaucgcgcuggacuucaagcccggcaccagcggcagccccaucgugaacagggaggggaagaucgugggccuguacgggaacggggucgugaccacauccggcaccuacgugagcgcgauagcucaggcgaaggcuucccaggaggggcccuuaccagagauagaggacgaggucuucagaaaacggaaccugacaaucauggaccugcaccccggcagcgggaagacccgccgguaccuccccgccaucgugcgcgaagccaucaagcggaagcugcgcacgcuuauucuugcaccgacccggguagucgcguccgagauggccgaagcccugaaaggcaugcccauacgguaccagaccacagccguuaagagcgagcacacgggcaaggagaucguggauuugaugugccaugccaccuuuaccaugcgacuccugucccccguccgggugccuaacuacaacaugauuauuauggacgaggcgcacuucaccgacccgagcuccauugcugcccgcgguuacaucagcacgcgggugggcaugggggaggcugccgcuaucuucaugaccgcaacgccucccgguuccgucgaagcauuuccccagagcaacgccgugauccaagaugaggagcgcgauauaccggagcgguccuggaauagcggguacgaguggaucaccgauuuuccagguaagacggugugguucguacccuccaucaagagcggcaacgacaucgcgaacugccugcgaaagaacgggaagcgggugauucagcucucccgcaagacuuucgacaccgaguaucagaaaacgaagaacaaugacugggacuacguggucacaacagacaucagcgagaugggcgcaaacuuccgggcagaccgcgugauugacccucggcgcugcuugaagccgguaauccuaaaggacgggcccgagcgggucauccucgccggcccuaugcccgugaccgucgcgucggcggcacagcgccgggggcguaucggcaggaaccacaacaaggagggcgaccaguacauuuacaugggucagccgcugaacaacgaugaggaucacgcucacuggaccgaagccaaaaugcugcucgacaacaucaacacgcccgaaggcauuauccccgcucuguucgacccagagcgcgaaaaguccgcggccaucgacggggaguaucgccugcggggcgaggcccgcaagaccuuuguggaacucaugcggcgcggggaccugccgguguggcugagcuacaagguugcguccgagggcuuccaauacagcgacagacgcuggugcuucgacggcgagcggaacaaccagguucucgaagagaacauggauguggagaucuggaccaaagagggcgagcgcaagaagcugagaccccgcuggcuggacgcccggaccuacuccgacccacuagcgcugcgcgaauucaaggaguucgccgccggccgccguagcgucuccggggaccuaaucuuagagaucggcaaauugccccaacaccugacgcagcgggcccagaacgcucucgacaaccucgugaugcugcacaauagcgagcagggcgggcgcgccuaucgacacgccauggaggaacuuccggacaccauugaaacccugaugcugcucgccuugaucgccgugcugaccggcggagucacucuuuucuuccugucaggccgcgggcugggcaaaacuagcaucggccucuuaugcgucauggcguccagcgugcuccucuggauggccuccguggaaccccacuggaucgccgccagcaucauacuggaguuuuuccuuauggugcuacugauccccgagccggacagacagcgcacuccgcaagacaaucaacuggccuacgugguuaucgggcuccuguucaugauccuaaccguggcggccaacgagaugggccucuuagaaaccaccaagaaggaccugggaauaggccacguggccgucgagaaucaccaccaugccgcuaugcucgacguagaucugcaccccgcuagugcguggacccucuacgcgguagccaccaccaucaucacgcccaugaugcgucacaccauagaaaacaccaccgccaacauuagccucacggcgauugccaaccaggccgcaauccugauggggcuggacaaaggcuggccuaucuccaagauggacaucggcguccccuuauuagcguuaggguguuacagccaggugaacccacucacccugacugcugccguguuaaugcucguggcccacuacgccaucauaggccccggacugcaagccaaggccacccgcgaggcucagaagcgcacggccgcgggcaucaugaagaacccgaccguggacgggaucguggcgaucgaccuggaccccgucguguacgacgccaaguucgagaagcagcuuggccaaaucaugcugcugauccugugcaccucccagauauuacugaugcggaccacgugggcccuuugugagagcaucacacuggccaccggcccccugaccacgcucugggagggguccccgggcaaguucuggaauaccacaaucgccgugucgauggcgaacauauuucgcgggagcuaccuggccggcgcgggccuggccuucucccuuaugaagucccucggcggugggcggagagggaccggugcgcagggcgagacgcuaggcgagaaguggaagcggcagcucaaccagcucuccaaaucugaguucaacaccuacaagcgcuccggaaucauggaggucgaccggagcgaagccaaggagggccugaagcgcggagagaccaccaagcacgccgugucccggggcacggcuaagcucagaugguuuguggagcgaaacuuaguaaagcccgaagggaaggugaucgaccugggcugcggccgcgggggcuggagcuauuauugcgccggguugaagaagguuaccgaggucaagggcuacaccaaggguggcccgggacacgaggagcccaucccaauggcgaccuacggguggaaccucgugaagcuccacucgggcaaagauguguucuucaucccgcccgaaaagugcgacacucugcucugcgacauuggggagagcucccccaaucccaccaucgaggaaggccggacccugagaguccugaagaugguggagccgugguugcgugggaaccaguucugcauaaagauucugaaucccuacaugcccucggugguugagaccuuggagcagaugcaacgcaaacauggcggcaugcucguccggaacccccugucgcgcaacaguacgcacgagauguacuggguguccugcggaaccgggaacaucgucagcgccgugaacaugaccucccggaugcuguuaaacagauuuaccauggcccaccgcaaaccgaccuacgagcgggacguggaccugggagccgggacgcgacacgucgcaguggaacccgagguggcgaacuuggacauaaucggccagcggaucgagaacauaaagcacgaacacaagagcaccuggcacuacgacgaagacaauccguacaagaccugggccuaccacgggagcuacgaggucaagcccagcggcagcgcguccagcauggugaacgggguggucaagcuccugaccaagccgugggacguaaucccuauggucacgcaaaucgcgaugacagacacaaccccguucggccagcagcgggucuucaaagagaagguagacacgcggacccccaaggccaagcgcggcaccgcgcagauaauggaggucaccgcuaaguggcuguggggcuuccucagccggaacaaaaagccgcgcauaugcacgcgggaggaguucacccgaaaagugcggagcaacgccgcaauaggggcgguguucgucgacgagaaccaguggaacuccgccaaggaggcuguggaggaugagcgcuucugggaccuggugcaccgagaacgcgaguuacacaagcaggguaagugcgcgacaugcgucuacaacaugaugggaaaacgggaaaagaagcucggggaauucggcaaggccaagggcagccgagcgaucugguacauguggcugggugcccgguuccuggaguucgaggcccucggcuucaugaaugaggaccacugguucucucgcgaaaacagccuguccgggguggagggggagggguugcacaagcucggcuacauccugagagacauuagcaagauccccggggguaacauguacgccgaugacaccgccgggugggacacucgcaucaccgaggacgaccugcaaaacgaggcgaagaucacugacaucauggagcccgagcacgcccuccuggccaaguccaucuucaagcugacauaucagaacaaggugguccguguccaacgcccggccaagaaugggacggugauggacgugaucagccgccgggaccagcgcggcuccggccaaguggguaccuacggccucaacacuuucaccaacauggaggcccagcugauacggcagauggagagcgaggggaucuucucccccagcgagcuugaaacucccaaucucgcggguagaguucuggacuggcuggagaaacacggggucgagaggcucaagcgcauggcaaucucuggcgaugacugcguggugaagcccaucgacgaccgguucgccaccgcgcugaccgcccugaacgacauggguaagguacgcaaagacaucccgcaaugggagcccagcaagggguggaacgacuggcagcagguccccuucugcagccaccacuuccaccaguugaucaugaaagacggccgggagaucgugguacccugucgcaaucaggacgagcugguggggcgggcgcgcguaucccagggcgccggguggagucugcgugagaccgccugccucgguaaguccuacgcucagauguggcagcugauguacuuccaccgccgggaccugcgccucgcggccaacgccaucuguagcgccgugccggucgacuggguacccacgucccggacuacauggagcauccacgcucaccaccaauggaugacaacugaggacaugcuguccgucuggaaccgcguguggaucgaggagaaccccuggauggaggacaagacccacaucucguccuggggcgacgugccauaccugggcaagcgggaagaccaguggugcggcagccucaucggccuaaccgcgcgcgccaccugggccacgaacauccaggucgcuaucaaccaggugagacggcugcuaggcaacgagaacuaucuagacuacaugacauccaugaagcgauucaaaaaugaaagcgauccggagggggcucugugguga

SEQ ID NO: 24624 - RNA, 9879 nt, Artificial Sequence
  derived and/or modified CDS sequence (opt11) from DENV-1__JQ045635__SS-prME
uccgucacaaugcuguuaaugcugaugccgacagccuuagccuuccaccucaccacacggggaggugaaccucauaugauagucagcaaacaggagagggguaagucccugcuguuuaagaccucagccggggugaacauguguacccucaucgccauggaccuuggggaguucugcgaggacacuaugaccuacaaauguccccgcaucacagaggccgagccugacgauguggauugcuggugcaacgcuaccgacacuugggugaccuacggcaccuguagccagaccggcgagcaccggcgagacaaacgguccguggcucuggcgccccacguuggccuaggccucgaaacccgcaccgaaacuuggaugagcucugaaggugcguggaaacagauccagagagucgagaccugggcgcucagacaccccggguucacgguaauugcccuuuuccuggcccacgcuaucggcacaucuaucacccaaaaggggaucauauucauucuauugauguugguuacccccuccauggccaugcggugugucgguauaggaagcagagacuuuguagagggguugucaggcgccacauggguggacgucgugcucgaacacggaagcugcgugacuaccauggccaaagacaagcccacucuagacaucgagcugcucaagacggaaguaaccaacccggcuguuuugcguaagcugugcaucgaagccaagauuuccaacacaaccacggauagccggugucccacacaaggcgaggccacacucguggaagaacaagaugccaauuucgugugcagacgcaccuucguggaccgcggcugggggaacgggugcgggcuguucggcaagggcucccugaucacaugugcgaaguuuaagugcgugaccaagcucgagggaaaaauuguccaguacgagaaccuuaaauacagcgugaucgucacugugcacaccggcgaccaacaucagguggggaacgaguccacugagcacgggacgaucgcaaccauaacgccucaggcgccuucaaccgaaauccaguuaacggauuacggcgccuuaacauuggauugcagcccgaggacuggcuuagauuuuaacgagaugguccuccugaccaugaaggagaaguccuggcuggugcacaaacagugguuccucgaccugccccuucccuggacgucgggggcgagcaccagccaggaaacguggaaccggcaggaucuacucgugacauucaagacagcacacgcuaagaaacaggaggucguggugcugggcucccaggaaggcgccaugcacaccgcuuugaccggggccaccgaaauccagacaagcggcaccaccaccaucuucgccgggcaccugaaaugccgccugaaaauggacaagcucacucugaagggcauguccuaugucauguguaccgggagcuucaagcuggagaaggagguggcggagacgcagcauggaaccguccucguccagaucaaauaugaggggacugacgcgcccugcaagauccccuucucaacgcaggacgagaagggggccacgcagaauggucggcugaucacugccaauccuaucguaaccgacaaggaaaagcccgucaacaucgaggccgaaccgcccuuuggagagucguauaucgucaucggcgccggcgagaaggcuuuaaagcuguccugguucaagaaggggaguaguaucggcaagauguucgaggccacugcccgcggugcucggcgcauggccauucucggcgacacagccugggacuucgggucaauaggcgggguguucacguccguagggaaacucguccaccaaaucuucggcacggccuacggcgugcucuuuucgggggugagcuggacaaugaagaucgggaucggcguccugcugacuuggcuagggcucaauucacgcuccaccagccugucaaugacgugcauagccguggggcuggugacccucuaucuuggcgucauggugcaagcugacagugggugcgugauuaacuggaagggacgugagcuuaaaugcgggucgggcaucuucguaacaaaugaaguccacaccuggacggagcaguacaaguuccaggcagacucccccaagcgccucucggcggccaucggcaaggccugggaggagggagugugugguauacgguccgcgacccgucuggaaaacaucauguggaagcagauuagcaacgagcuaaaccacauccuccuggaaaacgacaugaagcugaccguggugguaggagacgucgcugggauccucgcccaaggaaagaaaaugauccggccccaaccuauggaguacaaguacuccuggaagucuuggggcaaggcuaagauaauaggcgcugacguccagaacaccacguucaucaucgaugggccuaacacgccugaaugccccgacgaccagcgcgccuggaacaucugggaagucgaggacuauggcuuugggauuuucacuaccaacaucuggcugaaacugcgagacaguuacacccaggucugcgaccaucgccucaugucugccgccauuaaggauucaaaagccgugcacgcggacauggguuacuggaucgagagcgagaagaaugagacguggaagcucgcgcgggccuccuuuaucgaggugaagaccuguauuuggcccaaaucccacacccucugguccaauggggucuuggagagcgagaugauuauccccaagauuuaugggggcccaaucucccaacacaacuaccgcccggguuacuuuacccagacggcggggcccuggcacuugggcaagcuggaacucgacuuugaucucugcgagggcaccaccgugguagucgaugagcacuguggcaaccgggggccgagccugcgaaccacaaccgugaccggcaaaauaauacacgagugguguugcagauccugcaccuugccuccgcuccgcuucaagggcgaggacggaugcugguacgggauggaaauaaggccaguuaaagaaaaggaggaaaaccugguaaaaagcauggucucugccggcuccggcgagguggacaguuucucccucggccugcugugcaucuccaucaugaucgaagaggucaugcgcucgagguggagucgcaagaugcucaugacgggcaccuuagcuguguucuuuuuacucauaaugggacaacugaccuggaacgaccugauacggcucugcauuauggugggggcugaugcaucugaccgcaugggaaugggcacuacguaccucgcgcugauggccaccuuuaagaugcgcccgauguucgcugucgggcuacuguuucggcgccugacgucgcgggaggugcuccugcugacaaucgggcucucccucguugccucugucgaacuacccaacucccucgaggaacugggugacgggcuggcaaugggcaucaugauucugaaguuacugacggacuuccagagccaccagcucugggccacccugcuaagccucaccuucauucguacaacguucagccugcacuacgcuuggaaaaccauggccaugguacucuccaucguaucccucuuucccuugugccuguccacgaccucccaaaagacaaccuggcuccccguucugcucggcaguuuggggugcaagccgcugacuauguuccucaucgccgaaaauaagaucugggggcgcaaaagcuggcccuugaacgaggggaucauggcgguagggauagucucaauccugcuguccucccugcucaaaaacgacgucccccuagccgggccccucaucgccggcggcaugcugauagcguguuacgugauuagcgguagcagugcagaccuaucucucgaaaaggccgcggugguauccugggaagaggaggccgagcacagcggcgccucgcacaauauccuuguggaaguccaggacgacgggacgaugaagauuaaggaugaggaaagggacgauacgcuuacuauccuccuaaaagccacccugcucgccgugagcggaguuuacccgcugucgauccccgccacccuguucgucugguacuuuuggcagaagaagaagcagcgaucggggguacugugggacacacccuccccucccgaaguggagagggcggucuuggacgacggcaucuacaggaucaugcagcggggccugcuggggagaucccaggugggcgugggcguuuuccaggagaacguguuccacacgauguggcacgugacccgaggagccguccucauguaucagggcaagcgguuagagcccuccugggcgucaguaaagaaggaccucaucuccuacggcggcggguggcggcuccagggcagcuggaauacaggggaggaggugcaaguuaucgccguugagccuggcaagaaucccaagaacgugcagacggcacccgguacauucaagacauccgagggugaggucggagcuaucgcccuggauuuuaagcccgguacaagcggcagccccauuguaaauagagaagggaagauaguuggucuguacggcaacggggugguuaccacuuccggcaccuacguaagcgccaucgcgcaggcaaaggccucacaggaagggccccuacccgaaaucgaggacgaggucuuucgaaaacgcaaccugaccaucauggaccugcacccagguuccggcaaaacccgccguuaccucccugcgaucgugcgcgaggccaucaagagaaaacugcgcacguuaauccucgccccuacucgcgugguggcguccgagauggcugaggcucugaagggcaugcccauuagguaccagaccacggccgucaaaucggagcacacgggcaaggagaucguggaccucaugugccaugccaccuucacuaugcgccuccugucacccguucgggugcccaacuauaacaugaucaucauggacgaggcgcauuucaccgaccccagcucgaucgccgcccgcggguacauuuccacgcgcgugggcaugggggaggccgccgcgauauucaugaccgccacaccgcccgguuccgucgaggccuucccucagagcaacgccgugauacaggacgaggagcgcgacaucccagagaggucguggaauagcggauacgaguggaucacggauuucccaggcaagaccgugugguucguccccuccaucaaaagcggcaacgacaucgcgaacugcuuaaggaagaacgggaaacggguaauucagcucucccgcaaaaccuucgacaccgaauaccaaaagaccaagaauaaugacugggacuacguagugacgacggacauaagcgagaugggcgccaacuuccgggcugaccgcgucauugacccccgccgcugccugaaaccugugauacugaaggacgggcccgagcggguaauccucgccggccccaugccugucaccgucgccucugcggcccagcgucggggacguaucggccggaaccacaacaaagaaggcgaccaguacaucuauauggggcagccguuaaacaacgaugaagaucacgcccacuggaccgaggcuaagaugcugcucgacaauauuaacacgccggaggguaucaucccugcucuauucgaccccgaacgcgagaaguccgcagcgaucgacggggaguauaggcugagaggcgaggcccgcaagaccuuuguggagcucaugcggcguggggauuugcccguguggcugagcuacaaggucgcauccgagggcuuucaguauucagaccgccgcugguguuucgacggcgagaggaacaaccaggugcucgaggagaacauggacguagagaucuggaccaaggagggggagcggaagaaguuacgccccagauggcuggacgcccggacuuauucagauccacuugcguugcgcgaguucaaagaguucgccgccgggcggcggagcgucagcggggaccuaaucuuggagauuggcaagcugccccagcaccuaacgcaacgagcacagaacgcgcucgacaaccugguaaugcuacacaacagcgagcagggcggucgggccuaccggcacgccauggaggaguuacccgacacaauagagacgcugaugcuccucgccuugauagccguucugaccggcggugucacccuuuucuuccuguccggacgcggccugggcaagaccucaauagguuuacugugcgugauggcaucuucggugcugcucuggauggcaucagucgagccccacuggauugcugccucuaucauucuggaguucuuccuaaugguacuccugaucccagagcccgaucggcagcgcacuccgcaggacaaccagcuggcguacgucguuaucggucuccuguucaugauccugaccguagcggccaacgaaaugggucuccuugagaccacgaaaaaggaucuugggauuggucauguggccgucgaaaaccaccaucacgcggccaugcuggacguggaccugcacccugcgagcgccuggacccuguacgcuguugccacaacuauuauaacgcccaugaugagacacaccauagaaaacacaaccgccaacaucagccucacggcuaucgcuaaucaggccgcaauccugauggggcuggauaaggguuggccgaucucuaagauggacaucggcgucccgcuucucgcccuggggugcuacagccagguuaacccccucaccuugacagccgccgugcuaaugcucgucgcccacuaugccaucauugggcccggccugcaggcuaaggccacuagggaggcccaaaaacgcacagcagccggaaucaugaagaacccgaccguggauggaaucguugcgauagaccuggaccccguaguuuacgacgccaaguuugagaaacagcucggucagaucauguuacucauccucugcaccucacagauccugcuaaugcggacgacgugggcccucugcgagaguauuacgcucgcuacugggccucugacuacacuaugggaaggaucucccgguaaguucuggaacaccacaauagcggugaguauggccaacaucuuucggggaucuuaccuggcaggcgcgggccuggccuucucgcuaaugaaaucccucggcggcggucggagagguaccggagcacagggugagacgcucggcgagaaguggaagaggcagcuaaaccagcuguccaagagcgaguucaacaccuacaagcgcucagggaucauggaagucgaccggucagaagcgaaggagggccuuaagagaggggagacuacaaagcacgccgugagccggggaacagccaagcuacgcugguucguagagcggaaccuugucaagccggaggggaagguaaucgaccugggcugcggccgcggugguugggcguacuauugcgcgggacugaagaaggugaccgaggucaaagguuacaccaaggguggccccggccacgaggagcccaucccuauggcaaccuacggauggaaucuggugaagcugcacagcggcaaggacguguucuuuauaccacccgagaagugugauacgcuucugugcgacaucggggagaguucgcccaaucccacgaucgaagagggucggacccuacgcguacugaagaugguggagcccuggcuccgggggaaccaguucuguaucaagauccuaaaucccuauaugccauccgugguggaaacccucgaacagaugcaacguaagcacggggguauguuggugcguaacccccugagccgcaauucaacgcaugagauguauugggugagcugcgggaccgggaacaucguauccgcggugaacaugacaagccggauguuacucaaucgguuuacgauggcccaccgcaagccgaccuacgagcgggauguugaccucggggccggaacgcgacacgucgcgguggagccagagguggcaaaccucgacaucaucggccagcgcaucgagaacaucaagcacgagcauaagucaaccuggcauuaugacgaggauaacccuuacaagaccugggccuaccacgggaguuacgaagucaaaccaucaggcucggccucuucaauggugaauggggugguuaagcuccugaccaagccuugggacgugaucccaaugguaacgcagaucgccaugaccgacacaacccccuuuggccagcaacgggucuuuaaagagaaaguggacacgcgaacccccaaggcaaagcguggaaccgcccagaucauggaggucaccgccaaauggcuguggggauuccucagcaggaacaagaaaccgagaaucugcacgcgggaggaguucacucguaaggugcggagcaacgccgcuauaggugcgguauucgucgacgaaaaccaauggaauagugcuaaggaggccguagaagacgagcgauucugggaucugguacaccgggagagagaguuacauaaacaggguaagugcgcaaccuguguguacaacaugauggguaagcgggagaagaaguugggugaguucggcaaggccaaggggucccgcgcuauuugguacauguggcugggugcacgguuccuagaguucgaggcauugggcuucaugaacgaagaccacugguucagccgcgagaacagucuguccggagucgaaggcgaagggcugcacaaauuaggcuauauccugcgcgacaucuccaagauccccggggguaacauguacgccgacgacaccgcgggcugggacaccaggaucaccgaggacgauuuacaaaacgaagccaagaucaccgacaucauggagccggagcacgcccucuuagcgaaauccaucuuuaaacugacauaccagaacaaagucguccgggugcagcguccggccaaaaauggaaccgucauggacgucaucagucgccgcgaccagcgcggcagcggccaggugggcaccuacggccucaacaccuucacgaacauggaggcacaguuaauccggcagauggaguccgaagguaucuucuccccuagcgaacuggagacccccaaccucgccgggcgaguccuagauuggcuggagaagcacggggucgagcgccuaaagcggauggcuaucaguggcgaugacuguguggugaaacccaucgaugaccgcuuugccaccgcccugacggcgcugaaugauauggggaaaguuagaaaagacauuccucaaugggaaccauccaagggcuggaacgacuggcaacaggugcccuuuugcagccaccacuuccaccagcucaucaugaaagaugggcgugaaaucgugguuccuugccgaaaccaggacgagcugguggggcgggcccgcgugagccaaggggccggcuggucucugagagagaccgccugucuuggcaaaagcuacgcgcaaauguggcagcugauguacuuucaucgccgggaccuaaggcucgcggccaaugcaaucugcagugcugucccaguggacugggugccuacaaguagaaccacguggucaauucacgcgcaccaccaguggaugacuacagaagacaugcuuucgguguggaaucgcguguggaucgaagaaaaccccuggauggaggacaagacccacaucuccagcuggggcgacgugcccuaucugggcaaacgggaggaccaguggugugguucccucaucggguuaaccgcucgcgcgaccugggccacgaauauacaggucgccaucaaccagguacgccgacugcucgguaacgagaauuaccuggacuacaugaccagcaugaagagauucaagaaugaaagugacccugaaggggcacucugguga

SEQ ID NO: 24625 - RNA, 9879 nt, Artificial Sequence
  derived and/or modified CDS sequence (opt11) from DENV-1__JQ045637__SS-prME
agcgugaccauguugcucaugcugaugccgaccgcucuggcguuccaccucaccacccggggcggggagccccacaugaucguguccaagcaggagcggggcaagucacugcuguucaagaccuccgccggggugaacaugugcacccucaucgccauggaccugggcgagcugugcgaggacaccaugaccuauaagugcccucggaucaccgagaccgagcccgacgauguggacugcugguguaacgccaccgacaccugggucacguacgggaccugcagccagaccggcgagcaccggcgggacaagcgguccguggcucucgcgccgcaugugggccuggggcuggagacccgcacggagaccuggaugagcuccgagggugccuggaagcagauccagcggguugagacaugggcccuccggcacccaggguucacagugaucgcccuguuccuggcccacgcgaucggcaccagcauuacccaaaagggcaucaucuuuauccuccucauguuagugacgccauccauggcaaugaggugugucggcaucggcagccgugacuucgucgaggggcucucuggcgccaccuggguagacgucguuuuggagcacggaagcugcgugaccaccauggcuaaggacaagcccacgcuggacaucgaauuacugaagaccgaggucaccaaucccgccgugcugcggaagcucugcaucgaagcaaagaucuccaacacgacgaccgacagccgcugcccgacccagggcgaggccacccuaguggaagaacaggacgccaacuuugucugucgucgcacuuucguggaucggggcugggggaacggcugcggguuguuuggcaaggggucccucauaaccugcgcuaaguucaagugugugaccaagcuggagggcaagaucguucaguacgagaaccugaaguacucggugauugugaccguacacaccggcgaccagcaucagguggggaacgaguccaccgagcacggcacgacggccaccaucaccccacaggcgccgaccaccgagauccagcuuaccgacuacggggcccugacacuugacugcagcccccgcaccggccuagacuucaacgagaugguccugcugacuaugaaggagaaguccuggcucguacacaagcagugguuccuagaccugccccuacccuggaccagcggggccucgacgucccaggaaacuuggaaccgacaggaccugcucguaaccuucaagaccgcccaugccaagaagcaagagguagugguguuagguagccaggagggcgcgaugcacacugcgcugaccggggccacagagauccagauguccggcacuacgaccaucuucgccggccaccugaagugccggcugaagauggacaaacugacccugaagggcaugaguuacgucaugugcaccggguccuuuaagcucgagaaggagguggccgaaacccaacacggcaccguucugguccagauuaaauaugagggcacggaugcgccgugcaagaucccuuuuucaacccaggacgaaaaggggguuacucagaacggccggcugaucaccgcuaacccgaucgugaccgacaaagagaagcccgucaauauagaggcggagccuccuuuuggggaguccuacauagugaucggcgcgggcgagaaagcguugaagcucucuugguucaagaagggaucuuccaucgggaagauguuugaggccacggcccguggggcccggcguauggccauauugggugacacugcaugggauuucggguccaucggcggcguguuuaccagcguagggaagcugguccaccagaucuuuggcaccgccuacggagugcuguucuccggcgugucguggacuaugaagaucgggaucggcgugcuacucaccuggcucggacugaacagucgcagcaccucccugagcaugacguguaucgccguagggcucgucacucuguaccugggcgugauggugcaggcugacuccgggugcgucaucaacuggaagggucgggagcucaagugcgggagcgggaucuuugugacgaacgaaguccacaccuggaccgagcaguacaaauuucaagccgacaguccgaagagacucuccgcagcaauuggcaaggccugggaggagggugucuguggcauacggagcgccacccgcuuggagaacaucauguggaaacagauauccaaugagcugaaccacauucuucuggagaacgacaugaaguucaccgugguagucggggacguggcaggaauccuagcacaaggaaagaagaugauccggccccagcccauggaguacaaguauagcuggaaguccugggggaaggccaagaucaucggcgccgacgugcaaaacacgacauuuaucaucgacgggccaaacacuccggagugccccgacgaccaaagagcguggaacaucugggagguagaggacuacggguucgguaucuucaccacgaacauuuggcuuaagcugcgugacucauacacacaggugugcgaccacagacucauguccgcggccaucaaagauagcaaggccgugcacgcagauaugggcuacuggaucgaguccgagaagaacgaaaccuggaaacuugcccgggcgagcuucaucgaggucaagaccugcaucuggccaaagucccauacccucuggagcaacggaguucucgaguccgagaugaucauccccaagaucuacgggggcccgaucucgcagcacaauuacagacccggauacuucacgcagacggcgggccccuggcaccuggggaagcuggagcucgacuucgaccugugcgaaggcacuacgguggucguggacgagcacugcgguucacgggggccgagccugcgcaccaccaccgugacggguaagaucauccaugagugguguugccgcuccugcacucugccgccccuccgcuuccguggggaggauggcugcugguacgguauggaaauccgccccgucaaggagaaggaggagaaccuggugaagucgauggugagcgcgggcagcggcgaagucgacucguuaucccuggggcugcucugcaucagcaucaugaucgaggaggugaugcguucccguuggagucggaaaaugcugaugaccggcacccuggccguuuucuuccuccuaaucauggggcagcuuacguggaacgaccucaucaggcugugcaucauggucggcgcuaacgcguccgaccgcauggggaugggcacaaccuaccuagcgcucauggccgccuucaagaugcggccgauguuugcaguuggccuguuguuucgccgguuaaccucccgugaggugcugcugcuuacuaucgggcugucccugguagcgucgguggagcuccccaacucucucgaggaacugggcgauggccuggccaugggcaucaugauccugaaguuacugaccgacuuccaaagccaccagcuaugggcgacccugcugucccugaccuuuaucaagacgaccuuuagccuccauuacgccuggaagaccauggcgauggugcucuccauugugucuuuauucccccugugccucuccaccacuagccaaaagacuaccugguugcccguccugcucggcucccugggcuguaaaccacugaccauguuuuuaaucgccgagaacaaaauauggggcagacguagcuggccacugaacgaaggcaucauggcagucggcaucguaagcauccuucucagcagucugcugaagaaugacgugccccucgcagggccccugauugccggcggcaugcuuaucgcguguuacgucauuuccggaagcuccgccgaucucagccuggagaaggccgccgagguguccugggaggaggaggccgagcacagcggcgcgucccacaacauccugguagagguccaggaugacggaacgaugaagaucaaggaugaggagcgggacgacacccuaaccaucuugcugaaggcaacucuucuggccgugagcgggguguacccguuauccaucccugccacccuguucgucugguauuucuggcagaagaagaagcaacgcagcggggugcugugggacaccccgucgccacccgaggucgagcgggccgugcuggacgacggcaucuaucgcaucaugcaacggggucugcucgggcgcagccaggugggcguuggggucuuccaggagaacguguuccacaccauguggcacgucacgaggggcgcgguccugauguaccaagguaagcgcuuggaacccuccugggccucugugaagaaagacuuaaucucauacgguggcggguggcggcugcagggcagcuggaauaccggggaggaggugcaggucaucgcugucgaacccggcaaaaaccccaagaacgugcagacugccccugguaccuucaaaaccccagaaggcgaagucggggcaauugcgcuugacuucaagcccgguaccuccggcucccccauuguaaaccgcgaagggaagaucgugggcuuauacgggaacggggucguuacgaccagcggaaccuacguauccgcuaucgcccaggccaaggcaucgcaggaggggccgcugccugagaucgaggacgaggucuuucggaagcgcaaccugacaaucauggaccuccaccccggaucggggaagacucggcgcuaucugccggcgauaguacgcgaggccaucaagcgcaagcuacgcacccucaucuuagcccccaccagagugguggcuucagagauggcggaagcacugaagggcaugccgauccgauaccagaccacggccgugaagucagagcacaccgguaaggagaucguggaccucaugugccacgccacuuucaccaugcggcugcuuagccccgucagggugccgaacuacaauaugaucaucauggacgaggcgcacuucacagaccccuccagcaucgcggcccggggguauaucagcaccagagucggcaugggggaggccgccgccaucuuuaugaccgcgacuccgcccggcagcgucgaggccuucccgcaguccaaugcugugauccaggacgaggagcgggauauccccgagcgcagcuggaacagcggauacgaguggaucacggacuuccccggcaagaccgucugguucguccccagcaucaaguccgggaacgauaucgccaacugccuucggaagaacgggaagcgcgucauccaguuaagccggaaaaccuucgacaccgaguaccagaagacgaagaacaacgacugggauuacguggucaccacugacauauccgagaugggcgcgaacuuccgcgccgaucgcguaaucgacccgcgccgcugccugaagcccgugauccugaaggacgggcccgagcgugucauccuggccggucccaugcccgugacagucgcgagcgccgcucagcggcgcgggcggaucggccgcaaucacaacaaggaaggcgaucaguacauauacauggggcagccucugaacaacgaugaggaccacgcccacuggacggaggccaagaugcuccuggacaacaucaacaccccggagggcaucauacccgcccuguucgaaccggagcgugagaaauccgccgcuauugauggugaguaccggcuucgcggagaagcgcggaagaccuucguggagcugaugcgcagaggugacuuaccgguguggcucagcuacaaggucgcaagcgaaggguuccaguacagcgacagacgguggugcuucgacggcgagcgcaacaaccagguacuggaagagaacauggacguggaaauauggacaaaggagggagagcggaagaagcuacgcccgcgguggcucgacgcccgcacauacucggacccucuggcccugcgggaguucaaggaguucgcagccggccgucgguccgucagcggggaccucauccuggaaaucggcaaacuuccccagcaccucacucagcgcgcccagaacgccuuagacaaccuggugaugcuucacaacuccgagcagggcgggcgggcguaccgccacgccaucgaggagcuacccgacacgauagagacccugaugcuccuggcccugaucgccgugcucacgggcggggugacucuguucuuccugagcggccgggggcucggaaaaaccuccaucggccugcugugugugauggcgagcagugugcuccuguggauggcgucggucgagccccacuggauugccgccuccaucaucuuggaguucuuccucaugguacugcugauacccgaaccggaccgccagcggacgccccaggacaaccagcuagcuuacguugucauugggcugcuguucaugauucucaccguggccgcgaacgagaugggccugcuggagacgaccaagaaagaccucggcauuggccacguggcagucgaaaaucaccaccacgcagccauguuagacguggaucugcaccccgcaagcgcguggacccucuacgccguggccacaacgaucauuaccccgaugaugcgacacaccauugaaaauacaacggccaauaucucccucaccgccaucgcgaaccaggccgccauccugauggggcucgacaaaggauggcccaucagcaagauggacaucggugucccccugcuggcuuugggguguuacucccaagugaacccccuuacccucacggcugccguguuaaugcucgucgcacacuaugccauuaucgguccggggcugcaggccaaagcgacgcgcgaggcccagaagcggaccgccgccggcaucaugaagaaucccacaguagacgggaucguggcaaucgaccuugaucccgucguguacgacgcgaaguucgagaagcaguuaggccaaaucaugcuucucauauuaugcaccagccagauccugcucaugcgcacgacaugggcccugugugaguccauuacccuggcgacaggcccccugacuacccugugggagggaagcccgggcaaauucuggaacacaaccaucgccgucucgauggcaaacaucuuccguggaagcuaccuagccggcgcaggccucgccuucagcuuaaugaaauccuuagggggcgggcgacgugggacuggggcacaaggcgaaacccucggcgagaaguggaagcgccagcugaaccagcucuccaagucugaguucaacaccuacaagcggucggggaucauggaggucgaccgcagugaagcgaaggagggcuuaaagcgcggggagaccacgaagcacgcggugagccgcgggaccgccaagcugagaugguucguggagcgcaaccuggucaagccggaggggaaagugaucgaucuuggaugcggccgcggcggcugguccuauuacugcgcagggcucaagaaggugacagaggucaagggauacacgaagggcggcccgggccacgaggagcccaucccgauggccacguacggguggaacuuggugaagcugcacucaggcaaggacguguucuucaucccgcccgagaagugcgacacacuccugugcgacaucggagagucaagccccaauccgaccaucgaggagggccgaacccugcggguccucaagaugguggagcccuggcugagagggaaccaauuuugcaucaaaauccugaauccauauaugccauccguugucgagacgcucgagcagaugcaacgcaagcacggcggcaugcucgugcgcaacccgcugagccgaaauucaacccacgagauguacuggguuagcugcgggaccgguaauauagucuccgcugugaacaugaccucgcgcaugcugcugaaucgcuucaccauggcucaccggaaacccacguacgaacgcgacguggauuuaggggcgggcacucggcacguagccguggaacccgaagucgccaaucucgauaucaucggccagcgcaucgagaauaucaagcaugagcacaaguccaccuggcacuacgacgaagacaaccccuacaagacuugggcuuaccaugggagcuacgaagucaagccguccggcagcgccucuuccauggucaacggggucgugaaacuucugacgaaacccugggaugugaucccaaugguaacccagaucgccaugacagacaccacgcccuuuggccagcagaggguguucaaggagaagguggacaccaggaccccgaaggccaagcggggaacugcacagaucauggaggucacggcgaaguggcucuggggguuccugagccgcaacaagaagccacggaucugcacccgcgaggaguuuaccagaaaagugcgcuccaacgccgcgaucggcgcaguuuucgucgacgagaaucaauggaauagcgcgaaagaggccguagaggacgaaagguucugggacuuaguccaccgcgaacgcgagcuccacaagcaagggaaaugcgcaacaugcguuuacaacaugaugggcaagcgcgagaagaaacuuggggaguuuggcaaggccaagggaucgcgggccaucugguacauguggcuaggagcgcgcuuccucgaguuugaagcccugggcuuuaugaacgaggaucauugguucucacgggagaacucucugagcgggguggagggagaagggcugcacaagcuggguuacauccugcgagauaucuccaaaaucccagggggcaacauguacgcagacgacacggcaggcugggacacccggaucaccgaggacgaccuccagaacgaggcccggaucacugacauaauggagcccgagcacgcgcuguuggcccggagcaucuucaaacuuacguaccagaacaaggugguccggguacagcgacccgccaagaacgggaccgugauggacgucaucucgcggcgugaccagcggggcagcggccaggugggaaccuacggucugaauaccuucacaaacauggaggcccagcugauacgccagauggaguccgaggguaucuucagccccagugagcucgagacccccaaccuggccgagcgagugcuggacuggcucgagaaguacggcguugagcgccugaagcgaauggccaucaguggggacgacugcguagugaagccuaucgacgaccguuuugccaccgcucugaccgcccucaacgacauggggaaggugcgcaaagacaucccccaaugggagcccucuaagggguggaacgacuggcaacaagucccguuuugcagccaucacuuccaccagcugaucaugaaggacggccgcgagaucguggucccgugccggaaucaagacgagcuggugggccgugccagggugagccagggggcuggcuggucccugcgcgagacggccuguuugggcaagucguacgcacagauguggcagcugauguauuuucaccggcgcgaccuccggcuggccgcaaacgccaucugcuccgcaguccccguagacuggauucccaccagcaggaccaccugguccauccacgcccaccaccaguggaugacaaccgaggacaugcuuagcgucuggaaccgcgucuggauugaagagaaccccuggauggaggacaagacccacaucagcagcuggggcgacguaccguaccucgggaagcgggaggaccaauggugcgguucccugaucggccugaccgcgcgagcaacgugggcgacuaacauucagguggccaucaaccagguccggcgccucaucgggaacgagaacuaccuggacuacaugaccagcaugaagcgguucaagaaugagucagaccccgagggggcccuaugguag

SEQ ID NO: 24626 - RNA, 9879 nt, Artificial Sequence
  derived and/or modified CDS sequence (opt11) from DENV-1__JQ045638__SS-prME
ucagugaccaugcugcucaugcugaugcccaccgcccuggccuuccaccugaccacccgcgggggugagccacacaugauaguguccaagcaggagaggggcaagagccuccuguucaagaccucagccggugucaauaugugcacccucaucgccauggaccugggcgagcugugcgaggacaccaugacguacaagugcccgcggauaaccgagaccgagcccgacgacguagacugcuggugcaacgccaccgacacgugggucaccuacgggaccugcucucagacuggcgagcacaggcgagacaagcgguccguggcccuagcgccccacgugggccugggccuggaaacacgcaccgagaccuggaugucuuccgagggcgccuggaagcagauccagcggguugagacgugggcgcucagacacccgggguucaccgucaucgcccuguuccuggcccacgcgaucggcacgagcaucacccagaaggggaucaucuucauccucuuaaugcuggugacgccauccauggccaugcggugugucggcaucggcagccgcgacuucguggaggggcucuccggcgcuaccugggucgaugucguauuggagcacgguagcugcgugaccacuauggcuaaggauaagcccacgcuggacaucgaacuccugaagaccgaggucaccaaccccgccgugcugcggaagcucugcaucgaagcuaagaucuccaacaccacuaccgacagccgcugucccacccagggcgaggccacccuaguggaggagcaagaugccaacuucgucugccggcgcacguuuguugacaggggcugggggaacggcugcgggcuguuuggcaaggggucccucaucacgugcgccaaguucaagugcgugaccaagcuggaggggaaaaucguccaauacgaaaaccugaaguacucggucaucgugaccguacacacgggcgaccagcaccagguggggaaugagucaaccgaacauggcaccacggccaccauaacgccccaggcccccaccaccgagauccagcucacagacuacggcgccuugacgcuggauugcucuccccgcacuggccucgacuucaaugagaugguccugcugaccaugaaggagaaauccuggcuggugcacaagcaaugguucuuggaccugccccucccuuggaccagcggggccagcacgucgcaggagaccuggaaccgacaggaccugcuggugaccuucaagacagcccacgccaagaagcaagaggucguggugcucggcucccaggaaggggcgaugcacacggcccugacgggggccaccgagauccagaugucgggcaccacgaccaucuuugccgggcaccugaaaugcaggcugaagauggacaagcucacacuaaaaggcaugagcuacgucaugugcaccggguccuucaagcucgagaaggaaguggccgagacccagcacggcaccgugcugguacagaucaaguacgaagguacggacgcgccuugcaagauccccuucucgacccaggacgagaaggguguaacgcagaauggccggcuaaucaccgccaaccccauagugaccgacaaggagaagccagucaacaucgaggccgagccgcccuucggugaguccuacaucguaaucggcgccggcgagaaggcccugaaacucagcugguucaagaaggggucgagcauaggcaagauguucgaggccaccgcccgcggggcgagacgaauggccauccugggcgacacggcgugggacuucgggucgauaggcggcguguucaccucggucgggaagcuggugcaucaaauuuucgguaccgccuaugggguguuguucuccggcguuagcuggaccaugaagaucggcaucggcgugcugcugacguggcucggccugaacucgcgaagcaccucgcuuagcaugaccuguaucgcagugggauuggucacccuauauuugggcgugauggugcaggccgacuccgguugugucauuaacuggaaggggcgggaacucaagugcggguccggcaucuucgugacgaacgaggugcacacauggacagaacaguauaaauuccaggccgacagcccgaagcgcuuguccgcggccaucggcaaggccugggaggagggugucugcggcauccggucagccacccgccuggagaacaucauguggaagcagaucuccaacgaacucaaccacauccuacuggagaaugacaugaaguuuaccgugguugucggggacguggccgguauccucgcacaagggaagaagaugauccgcccucagcccauggaguacaaguacagcuggaaauccuggggcaaagcaaagaucauaggcgcagacgugcaaaacacgacauucaucaucgacgggcccaacaccccggagugccccgacgaccagagagccuggaacauaugggaggucgaggauuacggcuucgggaucuucaccaccaacauauggcugaaacuucgggacucguacacucaaguuugcgaccaucgccucauguccgccgccaucaaggacagcaaagccguccaugcagauaugggcuacuggaucgaguccgagaagaacgagaccuggaagcuggcccgggcgagcuuuauagaggucaagaccugcaucuggcccaaaucccacacguuguggagcaacggugugcucgagucggagaugaucaucccuaagaucuaugguggcccaaucagccagcacaacuaccgcccgggguacuucacccagaccgccggccccuggcaccuggggaagcuggaguuggacuuugaucugugcgagggcacaacgguggucguagaugagcacugcggcucccgggggccgucauuacggaccaccaccgugacggggaagaucauccacgaguggugcugcagauccuguacucugccgccccugcgauuccgcggggaggauggcuguugguacgguauggagauccgucccgucaaggagaaggaggagaaucuggugaagucgaugguuagcgccggcuccggcgaggucgacagccucucccuagggcugcucugcaucagcaucaugaucgaggaagugaugcggucccgcuggagccggaaaauguugaugacuggcacccuggcaguguucuuccuccugaucauggggcagcuaacguggaacgaccucauccgcuuaugcaucauggugggggccaacgcauccgaccgcauggggaugggcacgaccuaccuggcccucauggccgcuuucaagaugcggccgauguucgcggugggccugcuguuccgucggcucaccucucgugagguguuacugcucacgaucggguuaucccuggucgcgagcguggagcucccaaauucccuggaggagcuaggcgauggauuggccaugggcaucaugauccugaagcuguuaaccgauuuccagagccaccagcuuugggccacccugcuuucccugaccuucaucaaaacaaccuucagccugcacuaugccuggaaaaccauggcgaugguccucuccauuguaagccuguucccccugugucucuccaccacaagucagaaaaccacguggcugcccgugcugcucggcucccuggggugcaaaccacugacaauguuuuugaucgccgagaauaagaucugggggcggcguagcuggccgcugaacgaggggauuauggccguuggcaucgugagcauccugcucuccagccuacucaagaacgacgugccccucgccgggcccuugaucgccggcggcaugcuuaucgcuugcuacguuaucuccgggagcagcgcggaccucagccuugaaaaggccgccgagguguccugggaggaggaggccgaacacagcggcgcgucccacaacauccugguggaggugcaggacgacgggacuaugaagauaaaggacgaggagcgagacgacacccuuaccauccugcuaaaggccacccuccuggcgguaucgggcgucuacccgcuuuccauccccgccacucuuuucgucugguacuuuuggcagaagaaaaagcaacguagugggguacugugggacacgccgagcccgcccgagguggaacgggccgugcuggacgacggcaucuaccgcaucaugcagcggggcuuacucgggcgcucgcagguuggcgugggagucuuccaggagaauguguuccacacgauguggcacguuacccggggcgcgguccugauguaccagggaaaacgccuggaacccuccugggccucugugaagaaagaccucaucucguacggcggcggguggcggcugcagggcagcuggaacaccggggaggaggugcaggucaucgccguggagcccgguaagaaccccaaaaaugugcagacggcccccgggaccuucaagaccccugagggcgaagucggcgccaucgcgcuggacuucaagccggggaccuccggcucucccaucguuaaccgggagggcaagaucguuggcuuauauggcaacgggguagugacgaccagcggcaccuacguguccgccaucgcccaggccaaggccagccaggaggggccgcugcccgagaucgaggacgagguauuccggaagcgaaaucugaccaucauggaccuacaccccggcuccgggaagacacggcgauaccuuccggccaucgugcgggaggccauuaagcgaaagcugcgcaccuugauuuuagcucccacccggguggucgccagcgagauggcagaggccuuaaagggcaugccaauccgcuaccaaaccacggccgugaaauccgaacacaccggcaaggagaucguggaccucaugugccaugcuaccuucacaaugcggcugcugagccccgugagaguaccaaacuacaacaugauuaucauggaugaggcccacuucacggaccccuccagcaucgcugcccggggguacaucucuacccgcgugggcaugggggaggccgccgcgaucuucaugaccgcgacgccgcccggcagcguggaggcuuucccccaguccaacgccgugauccaggaugaggagcgagacauucccgagcgcagcuggaacuccggguacgaguggaucacggacuuucccggaaaaacgguuugguucguucccucgaucaaauccggcaaugacaucgcuaacugccuccggaaaaacgggaagagggugauucagcucagccggaagaccuucgacacagaauaucagaagaccaagaacaacgacugggacuacguggucacaaccgacaucagcgagaugggagcuaacuuccgggccgaccgggugaucgacccgcgccggugccugaagcccgucaucuuaaaggacgggccggagcgcgucauccuggccggucccaugccggugacagucgcgagcgccgcgcagcggcgcgggcggauaggccgcaaccacaacaaggaaggcgaccaguacaucuacauggggcaacccuuaaacaacgacgaggaucacgcccacuggacggaggccaagaugcuccuggacaacaucaacacacccgagggaaucaucccugcccuguucgagccggagcgcgagaaaucggccgcgaucgacggggaguaucgccuccggggcgaggcccguaagacguucguggagcuuaugcgaagaggugaccugcccguguggcugucuuacaaaguggccagcgaaggcuuccaguacuccgaucgucgguggugcuucgacggcgagcgcaacaaccaggugcuugaggagaauauggacguggagaucuggaccaaggaaggggagagaaagaaacuucgcccucgcuggcucgacgcccgcacguacagcgacccccuggcccugcgggaguucaaggaguucgcggccgguagacguuccgugucaggggaccucauccuggagaucggcaagcuaccgcagcaccucacccagcgcgcccagaaugcccuggauaaucuggugaugcuccacaacuccgagcagggcggacgggccuaccgccacgccaucgaggagcugccggacaccaucgagacccugaugcuccuagccuuaauugccgugcucacuggcggggucacccuuuucuuccugagcggccgggggcucggcaagaccuccaucggccugcugugcgugauggccagcuccgugcuccucuggauggcgagcguagagccccacuggaucgccgccagcaucauacuggaguucuuccucauggugcugcuuauccccgagccagaccgacagcggacgccacaagacaaccaguuagccuacguggucaucggacugcuguucaugauccucacuguggccgcgaacgaaaugggccugcuggagacgacgaagaaggaccucggaaucggccacguggccgucgaaaaccaccaccacgccgccaugcuugauguagaccuccaccccgccagcgcguggacccucuacgccguggccacgaccaucaucaccccaaugaugcgccauaccaucgagaauaccacggccaacaucucccugaccgccaucgccaaccaggcugcaaucuuaauggggcucgacaagggcuggcccaucagcaagauggauaucggcgucccucugcuggcccucggguguuacucccaggugaacccccugacccugaccgcggccgugcucauguuaguagcccacuaugccaucaucggcccagggcugcaggcuaaggcgacgcgggaggcccagaagcggacagccgccgguauaaugaaaaaccccaccguagacgggaucguggcgaucgaccuugaccccgugguguacgacgccaaguucgagaagcaguugggccagauaauguugcucauccugugcaccagucagauccuguugaugaggacgaccugggcccugugcgaauccaucacucuggccaccggcccccucaccacccugugggagggguccccgggcaaguucuggaacacuaccaucgccguguccauggccaacauauuccggggcagcuaccuggcgggugccggccuggccuucagccugaugaagucccuaggcggugggcggcggggaacgggggcccaaggcgagacccucggugagaaguggaagagacaacugaaccaacugagcaaguccgaguucaacaccuacaagcgguccgggaucauggaggucgaccgauccgaggcgaaggagggcuuaaaaagaggggagaccacgaagcacgccgugagccgaggcaccgccaagcugcggugguucguagagcguaaccugguaaagcccgaggguaaagugaucgaccugggcugcggcaggggcggcugggccuacuacugcgccggccugaagaaggugaccgaaguaaagggguacaccaagggcggucccggacacgaggaacccauuccgauggcgacguacggguggaaucuggucaaguugcacaguggcaaggacguguuuuucaucccgccagagaaaugcgacacccuccugugcgacauuggugagucgucccccaacccgaccauagaggagggccgcacccugagaguccucaaaaugguggagccguggcugcgcgggaaccaguucugcaucaagauccugaauccuuacaugccaagcgugguugagacgcucgagcagaugcagcguaagcacggaggcauguuggugcgcaacccgcugagccggaacagcacccacgagauguauuggguguccugcgggaccggcaacaucgucagcgcaguuaacaugacuucgcgcaugcuccugaaucgcuucaccauggcccaccggaaacccacguacgagcgcgacguggaccuaggggccggcacccggcacgucgcugucgagcccgagguggcgaaccucgacaucaucggccagcgcaucgagaacaucaagcacgagcacaagagcaccuggcacuaugaugaagacaacccuuacaagaccugggccuaccacgggucguacgaggucaagccgagcggcucugccagcagcauggugaacgggguugugaagcugcuaacgaagccgugggacgugauccccauggucacccaaaucgccaugacugauacuacccccuuuggccaacaacggguguucaaggaaaagguagacacccgcaccccgaaagccaagcgcgggaccgcgcagaucauggagguuacggccaaguggcucuggggcuuccugucccgcaacaagaagccccggaucugcacccgggaggaguucacccggaagguacgcagcaacgccgcuaucggcgcgguguuugucgacgagaaucaguggaacuccgcuaaggaggcgguugaggacgagcgguucugggaccuugugcaccgcgagcgggagcuccacaagcaggggaagugcgcaaccugcgucuacaacaugaugggaaagcgcgagaagaagcugggagaguucgguaaggccaaggggagccgggcuauuugguacauguggcugggcgcccgcuuccucgaguucgaggcacugggauuuaugaacgaggaucacugguucucccgggagaacagccugucaggcguggagggcgaggggcuucacaaacugggcuacauucuucgcgacaucagcaagauccccgggggcaacauguaugcggacgacaccgcgggcugggacacccggauaaccgaggacgaccuccagaacgaggcgcguaucaccgacaucauggagccggagcaugcccugcuggcccgcuccaucuucaagcucacguaccaaaacaagguuguacggguacagcgucccgccaagaaugggacaguaauggacgucauaagccggcgcgaccagcggggauccggacagguggggaccuacggccucaacaccuucaccaacauggaagcgcagcugaucaggcagauggagagcgaggggaucuucagccccagcgagcucgagaccccuaaccuggcggagcggguguuagacuggcucgagaaguacggcgucgagcgccugaaacggauggccaucuccggcgacgacugcguugugaagccgaucgacgaccgcuucgccaccgcucugaccgcccucaacgacaugggcaagguccggaaggauaucccccaaugggagcccuccaagggguggaacgauuggcagcagguccccuucuguucccaccacuuccaccagcugauuaugaaggauggccgcgagaucguggucccgugcaggaaccaggaugagcuggucggccgcgcgcgggugagccagggggccggcuggagccucagagaaacggccugccuggguaaguccuacgcccagauguggcagcugauguacuuucaccggcgggaccuccggcuggcggcaaacgccaucugcagcgccgucccgguggacuggauuccgaccucacgcaccacguggagcauccacgcccaccaccaguggaugacgaccgaagacaugcuguccguguggaaccgcgucuggaucgaggaaaaucccuggauggaagacaagacccacaucagcuccuggggcgacgugccguauuuggguaagcgggaggaucaguggugcggcagucugaucggccugaccgcacgcgcaacgugggccaccaacauccagguugccauaaaccaaguacggcgccucauagggaacgagaacuaccuggacuacaugaccuccaugaagcgguucaagaacgagagcgaccccgagggcgccuugugguga

SEQ ID NO: 24627 - RNA, 9879 nt, Artificial Sequence
  derived and/or modified CDS sequence (opt11) from DENV-1__JQ045639__SS-prME
ucggugaccauguuccugaugcucaugccgaccgcccuggcguuccaccugaccacgagaggaggggagccacacaugaucgugagcaagcaggagcggggcaagagccuccucuucaagaccucggccggggugaauauguguacccugaucgccauggaccucggcgagcugugcgaggacaccaugaccuauaagugcccccgcaucacugagacagaaccggaugacguggauugcuggugcaacgccacggacaccugggugaccuacgggaccugcucacagacaggcgagcaccgccgcgacaagcguuccguggcacuggcgccucacgucggcuuagggcuggagacccgcaccgagacguggaugagcagcgagggcgcuuggaagcagauccagcgggucgaaacgugggcccugcgacaucccggauucaccgugaucgcacucuuccuggcucacgcaauagguaccaguaucacccagaaggggaucaucuucauccugcuuaugcuggugacgcccucgauggccaugcguugcgucggcauuggcagccgcgauuuuguagaagggcugucuggcgcaaccuggguggacguggugcucgagcacggcucaugcguaacgaccauggccaaggauaagcccacgcuggacaucgaauugcugaagaccgagguuaccaauccugccgugcugcggaagcugugcaucgaggcgaagaucuccaacaccacgacugauucucgauguccgacgcagggggaagccacgcucguggaggagcaggaugccaacuuuguuugccgucgcacuuucgucgaccgcgggugggggaacggaugcggacuguucggcaaggggagucugaucacaugcgccaaguucaagugcgugaccaaguuagaggguaagaucguucaguaugagaaccugaaguacagcgugaucgugaccguccacacgggugaccagcaucagguuggaaacgagucaaccgagcacggcaccacugccacaaucacgccccaggcgccgacaaccgagauccaguugaccgacuacggggcgcucacgcuagacugcagcccccgcaccggccuggacuucaaugagauggugcuccugacaaugaaggagaagaguuggcuugugcacaagcagugguuccuagaucugccccugcccuggaccagcggcgcuucaacgucccaggagacuuggaaucggcaggaccuccuggucaccuucaagacugcacacgccaagaagcaggaggucguugugcuggguucucaagagggggcgaugcauacggcccugacaggggcuaccgaaauccagaccuccggcacgaccaccaucuuugccggccacuuaaaaugccgucugaaaauggacaagcucacgcugaaaggcaugucauacgucaugugcacgggguccuucaagcucgagaaggaacucgcugaaacacagcauggaacgguccuggugcagaucaaauacgagggcaccgacgcgcccugcaagauccccuucucuacacaggacgagaagggcgugacacagaacgggcggcugaucaccgcgaaucccaucguaacagacaaggagaagcccgugaauaucgaggcagagccgccauucggugagagcuacauagucaucggcgccggggagaaggcgcuuaaacuuagcugguucaagaagggguccagcaucggcaagauguucgaggcaaccgcccgcggggcccggaggauggcaauccugggcgauaccgcgugggacuucggauccauaggcggcguguuuacaucuguagggaagcucguacaccagaucuuuggcaccgccuacggcgugcuguuuucgggcgugagcuggacgaugaagaucgggaucggcguucuccugacuuggcucggccuaaauucgcgcuccaccucccugagcaugaccugcaucgcuguagggcucguuacgcucuaccugggugucauggugcaggccgacucugggugcguaaucaacuggaagggccgcgaacugaagugcgggagcggcauuuucgucacaaacgagguucauacuuggaccgaacaauacaaauuucaagccgacagcccgaagcgauuguccgcggccaucggcaaggcaugggaggagggggugugcggaaucagaucagcaacccggcuggaaaacaucauguggaaacagaucuccaaugaacucaaccacauccugcuggagaacgacaugaaguucacugucguggugggggacgucgcuggcaucuuagcucaggggaagaagaugauccggccccaacccauggaauacaaguacagcuggaaauccuggggcaaggcgaagaucauaggcgccgacgugcagaacacuaccuucaucauagacgggcccaacacaccagagugccccgacgaccagagagcauggaacaucugggagguggaggacuacgguuuuggaaucuucacaacaaacaucugguugaagcugcgcgacagcuacacccagguuugcgaccaccgccugaugagugcggcgaucaaggauagcaaagccgugcacgcugauaugggcuacuggaucgaguccgagaagaacgagacauggaaguuggcgagggcaucguuuaucgaggugaaaacuugcauuuggccuaagucccacacccuguggagcaacggcgugcucgagagcgagaugaucaucccgaagauauaugggggcccgaucagucagcacaacuaucgaccgggguacuucacccagaccgccggccccuggcaccuggggaaguuagaguuggacuucgaucugugcgagggaacgaccgucguggucgacgagcacuguggcaaucgggggccgucacugcgcaccaccacggugaccggcaagauaauccaugaguggugcugccggagcugcacccugccaccccuccgcuuccgcggggaggacggcugcugguacgggauggagauucgccccgugaaagaaaaggaggagaacuugguaaaguccaugguuagcgccggcagcggggaaguggacaguuucagccucggguugcugugcaucuccaucaugauagaggaggucaugcggagccguuggucccggaagaugcuuaugaccggcacgcuggcuguguucuuucuccucaucaugggacagcugacguggaacgaucuaauccgcuugugcauuauggugggugccaacgcgagcgaccgcauggggaugggcaccaccuaccuggcccugauggccacguucaaaaugcggccgauguucgccguaggacuccuguuucgccggcuaaccucaagggaggugcuccugcuaacgaucggucucagcuuaguugccuccgucgagcugcccaacagccuggaggaacugggcgacggacuggcaauggguaucaugauacucaaguugcugaccgacuuccagucccaccaguuaugggccacgcugcugagcuugaccuucauuaagacgaccuucagcuuacacuacgccuggaagacaauggccaugguguugagcaucgucucccuguuuccacugugccugagcaccaccucccagaagaccacguggcuccccgugcuucuggguucauugggaugcaagccguuaaccauguuuuugauugccgagaacaagaucuggggccggcgauccuggccccucaacgaggguaucauggccguuggcaucgucagcauccuucuaagcucgcuucuuaagaacgacgugccgcuggcugggccccuaaucgcuggcggcauguuaaucgccuguuacgugauuagcggguccagcgccgaccuaucccucgagaaggcggccgaggucucuugggaggaggaggccgagcacuccggcgccagccauaacauccugguggagguacaggacgacggcacgaugaaaaucaaggaugaggagcgggaugacacccugaccauacucuugaaagcgacgcugcucgccgucucuggcguguacccguuaagcaucccugcuacccuguucgucuggcacuucuggcagaagaagaaacagcgcagcgggguccucugggauacgccaucgcccccagagguggagcgggcaguacuggacgacggaaucuaucgcauuaugcagcgcggacuccuggggcgcucccaggucggcgucggcguauuccaggagaacgucuuccacaccauguggcacgugacgcggggcgcggugcucauguaccaagggaagcgccuggagcccagcugggcgucugucaagaaggaucugaucagcuacgggggcggguggcggcuccaaggcuccuggaacacaggggaggagguccagguaaucgccgucgagcccggcaagaaccccaagaacgugcagaccgccccgggcaccuucaaaacgccugagggcgaggugggcgccaucgcgcuggacuucaagcccgggacaagugguuccccgaucgucaacagagaggggaagauagugggccuguacggcaaugggguggugacuacaagcggaacguacgucagcgcgauagcucaggcccgggccucccaggaggggccgcuccccgagauugaggacgagguguuccgcaagcgaaaccugacuauuauggaccugcacccaggguccggcaagacccgccgguaccucccggccauuguccgcgaggccaucaagaggaagcugcggacccugauacucgcccccacucggguggucgccuccgagauggccgaagcguuaaaggggaugccaauccgauaccaaacuaccgccgucaaguccgagcacaccggcaaggagauuguggaccugaugugccacgccacguucaccaugcgccuccugucaccggugcggguccccaauuacaauaugauuauuauggacgaggcccacuucaccgauccaaguuccaucgccgcucgcggguauauaagcacccggguuggcaugggcgaggccgcggccaucuucaugacggccaccccgcccggcuccguggaggcguuuccgcaaagcaacgcggucauccaggacgaggagcgcgacauccccgagcgguccuggaacagcggguacgaguggauuaccgacuuccccgguaagacagugugguuugugcccuccaucaagagcggcaaugacaucgcuaacugucugcgcaaaaacggaaagcgagucauacaguugucccgcaagaccuuugacaccgaauaucagaagaccaagaacaacgauugggacuacguggugacuacggacaucucagagaugggggccaacuucagggcggaccgcgugaucgacccgcgucgcugccugaagccaguaauccugaaagacgggcccgaacgggugauccucgccggacccaugccggucacuguggcuucugcagcucagcgucgagggcggauuggcaggaaccacaauaaggagggcgaccaguauaucuacaugggacagccccugaacaacgacgaggaccaugcgcacuggacagaggccaagaugcugcuagacaacaucaacaccccagaaggcauaauccccgcccuguucgagccggaacgggagaagucugccgccauagacggggaauaccgccuacggggagaggcgcgcaagacauucgucgaacucaugcggcgcggggaccuucccguguggcuguccuauaagguggcauccgaaggcuuucaguacagcgaucgccgcuggugcuuugacggcgagcggaacaaccagguccuggaggaaaacauggacguggagauuuggaccaaggagggagaacgcaagaaacugcguccccgcuggcuggacgcgcggaccuacagcgacccucucgcccugcgcgaguucaaggaguucgcggcgggccggcgcucgguguccggggaccugauccucgagauaggaaagcugccccagcaccuaacacaacgggcccaaaacgcgcucgauaaccuagucaugcugcacaacagcgagcagggcgggcgcgccuauaggcacgcgauggaggagcuucccgauacuaucgaaacccugaugcugcucgcccugauagcggugcugaccgguggagugacccucuucuuccuguccggccgcgggcuggggaaaaccagcaucggccuccugugugugauggccuccagcgcauuacucuggauggcuuccguggagccccacuggaucgcagcgagcaucauccuggaguucuuuuugauggugcucuugauaccugaaccggacaggcagcgcacgccgcaagauaaccaacuugcguacguugugaucggguugcucuuuaugauacuuacgguggcggcuaaugaaauggggcucuuagaaacgaccaaaaaggaucuggggauuggccacgccgcagucgagaaccaccaucacgcggccaugcucgacguggaucugcaccccgcgagcgccuggacgcuguacgcaguggccaccacgaucaucaccccgaugaugcgccacacuaucgagaauacaacggcaaacaucagccucaccgcuaucgccaaccaggccgccauacugauggguuuagacaaggguuggccuaucucaaagauggacaucggggucccccugcuggcacuggggugcuacagccaggugaacccacugacccucacggccgcggugcuaaugcucgucgcacacuacgccaucaucggcccagguuuacaagcgaaggccacccgggaggcccagaagcgcaccgcggccggcaucaugaagaaccccacgguggaugggauuguugcgaucgaucuggauccggucguguacgacgccaaguucgagaagcaacucggccagaucauguuacuaauccucugcaccucccagauccuucugaugcgaaccaccugggcccucugcgagagcauuacacuggccacgggcccccugacuacccucugggaagggaguccggggaaauuuuggaacaccaccaucgccguguccauggcaaauaucuuccgcggcuccuaccuggccggcgccggcuuagcauuuagccucaugaagucccuagggggcgggagacgcgggaccggcgcgcagggcgagacccugggcgagaaguggaagaggcaguugaaccaacugagcaagagcgaguucaacacguacaagaggagugggaucauggaagucgaccggagcgaagcuaaagaaggccugaagcgaggagagacaaccaaacaugccgugucaaggggcaccgcgaagcuccgcugguucguugagcggaaccugguuaaacccgaggggaaggugauugaccugggcugcggccgcgggggcuggagcuacuauugugccgggcugaagaaggugacggaggugaagggcuacaccaaaggcggcccgggccacgaggaacccaucccgauggcgaccuaugguuggaacuuagugaagcugcacuccggcaaggacguguuuuucauuccacccgagaagugcgacacgcugcucugugacauaggugagagcucccccaacccgacgaucgaggagggccggacccuucgugucuuaaagaugguggaacccuggcuccgggguaaccaguucuguaucaagauacucaaccccuauaugccuagcguggucgaaacccuggagcagaugcagcggaagcauggcggcaugcucgugcggaacccgcugucccgcaauuccacccacgaaauguacugggugagcugcgguacgggcaacaucguuagcgcugucaacaugacgagucgcauguuacucaaccgguucacgauggcccaccgcaaacccaccuacgagcgggauguggaccugggggccggcacccgccacgucgccguggagcccgagguggcaaaccuugauaucaucggccaacguaucgagaauaucaagcacgaacacaagagcacguggcacuacgacgaggauaauccauacaaaacuugggccuaccauggguccuacgaagucaagccgagcggauccgccaguagcauggucaacgggguagucaagcuccugacaaagccgugggacgugauccccauggucacucagauugcaaugacggacaccacccccuucggccagcagcgcguguucaaagagaaggucgacaccagaacgccgaaagccaagcguggaaccgcgcagaucauggaagucaccgcgaaguggcucuggggcuucuugucccggaacaagaagccaagaaucugcacacgggaggaguucacgcgcaaggugagguccaacgccgccauaggcgcuguuuuugucgaugagaaucaauggaacuccgccaaggaagcugucgaggacgagcgauucugggaccuggugcaccgagaacgcgagcuucacaagcaggggcggugcgcgaccugcgucuacaacaugaugggcaagcgugagaagaagcucggagaguuuggcaaggcuaagggcagccgagcuaucugguacauguggcugggcgcccgcuuccuggaguucgaagcccucggguuuaugaaugaagaccacugguucucccgagagaacagcuuauccgggguggagggcgaaggguugcacaaguuaggcuauauccugcgcgacaucucgaagauccccggggguaacauguacgccgacgauaccgcaggcugggacaccaggauuacagaagacgaccugcagaacgaggcgagaaucacugacaucauggaaccggagcacgcccuccuggccaagucuaucuucaaacugaccuaucagaacaaggugguucgcgugcagcggcccgccaaaaacgggacaguaauggauguuaucagccgucgggaccagagaggguccggccaggugggaacguacggacucaacaccuucaccaacauggaagcccagcugauccggcaaauggagagcgagggcaucuucuccccuucagagcuggagacccccaaccucgcggaacgagugcucgauuggcuggaaaaguacggcgucgagcgacucaaacggauggccauuuccggggacgacuguguagugaagccgauagaugaucgcuucgccacugcccugacggcguuaaacgauaugggaaagguccgcaaggacauaccacagugggaacccagcaagggguggaaugacuggcaacaggugcccuucugcucacaccacuuccaccaauugauaaugaaggacggccgggagaucguuguaccgugccgcaaccaagacgagcuggucggcagagcgcgcgucagccagggggcaggauggagccugcgugagaccgcgugccucgggaaaaguuacgcccaaauguggcagcugauguacuuccaccgucgggaccugcgccuugcggccaacgcuaucugcagcgccguccccguggauuggauuccuaccucccgcacaaccuggagcauucaugcccaccaccaguggaugaccaccgaagacaugcuguccguguggaaucgcgucuggauagaggagaaccccuggauggaggacaagacgcacaucagcuccugggaggacguaccguaccugggcaagcgcgaagaccaguggugcgggagcuugauaggccugacggcacgggccaccugggcgacuaauauucagguggccaucaaucagguucggcggcuuauagguaacgaaaacuaccucgauuacaugacauccaugaaacguuucaaaaacgaaagugacccugagggggcccugugguga

SEQ ID NO: 24628 - RNA, 9879 nt, Artificial Sequence
  derived and/or modified CDS sequence (opt11) from DENV-1__JQ045641__SS-prME
agcgugaccaugcugcucaugcugaugccuaccgcccuggcauuccaccuaaccacccggggcggggagccgcauaugaucgugagcaagcaggagcggggcaagagucugcuguuuaaaaccagcgccggggugaacaugugcacccucaucgccauggaccugggcgaguugugugaggacaccaugaccuacaagugcccacggaucacggagacggagcccgacgauguggacugcuggugcaacgccacggacaccuggguaaccuaugguaccugcucucagacuggcgagcaucggcgugacaagcgguccguggcgcucgcuccgcacgugggucuggggcuggagacucgcaccgagaccuggaugagcucggagggugccuggaagcagauccagcgggucgagacgugggcccuccggcaucccggguucaccgugaucgcccuguuccuggcccacgcgaucgggaccagcaucacccagaaggggaucaucuucauccuguugauguuggugacgcccucgauggccaugcggugcgucgguaucggcagcagagauuucguggaagggcucuccggcgccaccuggguggacgucgugcuggagcacgggagcugcgugaccaccauggccaaagacaagcccacgcuggacaucgagcuccucaagacggaggucaccaauccggccgugcugcggaagcucugcaucgaggcgaagaucucaaacacgacgaccgacucucgcugcccgacacagggcgaagcgaccuugguggaggagcaggacgccaacuuugucugccguagaacguucguggaccggggcugggggaacggcugcgggcuguucggcaaggggagucucaucacaugcgccaaauuuaagugugugaccaagcuggagggaaagaucguccaguacgagaaccuuaaguacucuguuaucgugaccguccacacgggcgaccagcaccagguggggaacgagaguaccgagcacgguaccaccgccaccaucacgccucaagccccaaccaccgagauccaacucaccgauuacggggcccugacgcuggacugcagcccccgcaccggacucgacuucaacgagaugguacuacugaccaugaaggagaaauccuggcuagugcacaagcagugguuccuggaccugccccuccccuggaccucaggggccagcacuucccaggagaccuggaaccggcaggaccugcuggugaccuucaaaaccgcccacgccaagaagcaggaggucgugguguugggcagccaggaaggcgcgaugcauacggcccugaccggggccaccgagauccagaccuccggcacgaccacaaucuucgccgggcaccugaagugcagacucaagauggauaagcugacccugaagggcaugagcuacgucaugugcacggggagcuucaagcuugagaaggagcuggccgagacccagcacggcaccgugcuggugcagauaaaguacgagggcaccgacgcgcccugcaagauccccuucagcacgcaggacgagaagggcguugcccagaacgggcggcugauuaccgccaaccccaucgugacagacaaggagaagcccgugaacaucgaggccgagccgcccuucggggagagcuacaucgucauuggcgcgggagagaaggcgcucaagcuguccugguucaagaagggguccagcaucgggaagauguucgaggccaccgcccgcggggccagacgcauggcgauccugggcgacacagccugggauuucggauccaucggcggcguguucaccagcguggggaagcucguccaccagaucuuugggaccgccuacggggugcuguucucaggcgugagcuggaccaugaagaucggaaucggcguccuccucacguggcugggccugaacucccgcagcaccucccucagcaugaccugcaucgccgucggccuggugacccuguaccucggagucauggugcaggccgacuccgggugcgugaucaacuggaaagggcgggaacugaaaugcgggagcgguaucuucgucacgaacgaggugcacaccuggacugagcaauacaaguuccaggcggacucaccgaagcgccugagugccgccaucggcaaggccugggaggaaggugugugcggcaucaggagcgccacccgccucgagaacaucauguggaagcagaucuccaacgagcugaaccacauccugcuggagaacgacaugaaguucaccgucgugguuggggacguagcagguauccuggcccaggggaagaagaugauccggccccagccuauggaguacaaauacagcuggaaguccuggggcaaggcuaagaucaucggcgcggacgugcagaauacgaccuucaucauugacggccccaacacuccggagugccccgacgaucagcgcgcguggaacaucugggagguggaggacuacggcuucgggaucuucaccacuaacauuuggcugaaguugcgggauagcuacacccaggucugcgaccaccgccugauguccgccgcaaucaaggauagcaaagccgugcacgccgacaugggguacuggaucgagucggagaagaacgagaccuggaaacuggcgcgggccucuuucaucgaggugaagaccugcaucuggccuaagucccacacgcuauggagcaacggcguccuugagucagagaugaucauccccaaaaucuacgggggcccgaucagccagcacaacuaccgcccaggguacuucacccagaccgccggccccuggcaccuggggaagcuagaguuagacuucgaccuuugcgaagguaccacgguggugguagacgagcacuguggcaaccgggggcccucccuccgcaccaccaccguaacgggcaagaucauccacgagugguguugccggagcugcacccugccgccccugcgcuuccgcggggaggacggcugcugguacgggauggagauccggcccgugaaggagaaggaggagaaccuugucaaauccauggugagcgccggcagcggcgagguggacuccuucagccuggggcugcugugcaucuccaucaugaucgaggaggucaugcgaagccgcuggucccggaagaugcugaugaccggcacacuggcuguguuuuuccuccugaucauggggcagcugaccuggaacgaccucauccgccugugcauaauggucggcgcgaacgccagcgaccgcauggggaugggcacgaccuaccuggcccucauggccacuuucaaaaugcggccgauguucgcagucggccuguuguucaggcggcucacuucccgcgaggugcugcugcugaccaucgggcugagccugguggcguccguugagcuccccaauagccuggaggagcugggcgacgggcucgccauggguaucaugauccugaaacuguugaccgacuuccagucccaucagcugugggccacccugcucucccuuacguuuaucaagaccacccugucccuccacuacgccuggaagaccauggcgaugguguugagcaucgucucccucuucccccuuugccugagcacaaccucgcagaagaccaccuggcugcccgugcuccugggcucucuagggugcaagccgcucacgauguuucucaucgccgagaauaagauauggggcagacgcuccuggccccugaacgagggcaucauggccgucggcaucgucagcauccugcugagcucccugcuaaagaacgacgugccccuggccgggcccuugauagccggcggcaugcucaucgcgugcuacgugaucagcgggucgagcgccgaccugucccuggagaaagccgccgagguaagcugggaggaggaggcagagcacuccggcgcgucccacaacauccucguggaggugcaggacgacggaacuaugaaaaucaaagacgaggagagggacgacacucugaccauccugcucaaggccacccuucuggcagucuccggaguguacccgcucagcauccccgccacgcuguucgugugguacuucuggcaaaagaagaaacagcgcucagggguccugugggacacccccagcccgcccgagguggagcgggccgugcuggacgacggcaucuaccgcaucaugcagcggggccuccuggggcgcucccaggucggcgugggggucuuccaggagaacgucuuccacacgauguggcacgucacgcggggcgccgugcugauguaccaggggaagcgccucgagcccagcugggccuccgucaaaaaggaucugaucagcuacgggggcggguggagacugcaggguuccuggaacacgggcgaggaaguccagguaaucgccgucgagcccggcaagaaucccaagaacgugcagacugcccccgggacuuucaagacccccgagggcgaggugggcgccaucgcguuagacuuuaagccggggacgucgggcucccccaucgucaaccgcgaggggaagaucgugggccuguacgggaacgggguggucacgaccagcggcaccuacgugagcgccaucgcccaagccaaagcgucccaggaggggccgcugccggagaucgaagaugaaguguuccgaaagcgcaaccucacgaucauggaccugcacccaggcagcgguaaaacccggcgcuaccugccggccaucguccgggaggccaucaagaggaagcuccgcacccugauccuggccccaacccgugugguggccuccgagauggcggaggccuuaaaaggcaugcccauccgcuaccagacgaccgcagucaagagcgagcauaccggcaaggagaucgucgaccugaugugucacaccacguuuaccaugcggcugcucucccccguccgcgucccgaacuacaauaugaucaucauggaugaggcccacuucacugaccccagcuccauugccgcgcggggguacaucagcacccgcguggguaugggagaggccgccgccaucuucaugacggccacgccgcccggcucuguggaggcguucccacagagcaacgcggucauucaggaugaggagcgcgacauccccgagcgcucauggaacagcggguacgaguggaucaccgauuuccccggcaagaccgugugguuugugccauccaucaagagcggcaacgacaucgccaacugccugcggaagaacgggaagcgcgucauucagcugucucggaagacguucgacacggaguaccagaagaccaagaacaacgacugggacuacguagugaccacggacaucagcgagaugggcgccaacuuccgcgcggaucgggucaucgacccgcgcaggugccucaagcccgugauccugaaggacggacccgagcgcgucauccuggcuggcccuaugccggucaccguggcgagcgccgcccagcggcgcggacggaucggccgcaaccacaacaaagagggcgaccaguacauuuauauggggcagccccucaacaacgaugaggaucacgcgcacuggaccgaggccaaaaugcugcuggacaacauaaacacuccagaggggaucauccccgccuuguucgagccggagcgcgagaaguccgccgcaaucgacggggaguaccggcugcggggcgaggcgcggaagacguucgucgagcugaugcgccguggggaucuccccguguggcugagcuacaaaguugccagcgagggcuuccaguacucugaccgccgguggugcuucgacggcgagcgcaauaaucaagucuuagaggagaacauggacguggagaucuggacgaaggagggugagcggaagaagcuccgcccccgguggcuggacgcccgcaccuacuccgacccccuggcccuccgggaguucaaggaguucgccgcuggccgccguagcguguccggugaccugauacuggagauuggcaagcucccgcagcaccugacccaacgcgcccagaacgcccuggacaaccucgucaugcugcacaacagcgagcagggcgggcgggccuaccgacaugcgauggaggagcugcccgacacgauagagacccucaugcugcuggcccucauugccgugcugacgggcggggugacguuauucuuccucuccggcagagggcugggaaagaccagcaucggccuccucugcgucauggccagcagcgugcugcuguggauggccuccguggagccacacuggaucgcggcgagcaucauccucgaguucuuccugauggucuugcucauacccgagccagaccgacaacggacgccccaggacaaccaacuggcguacguggugauugggcuucucuucaugauccugaccguagccgccaacgagaugggccugcuugagaccaccaagaaggaccuggguaucggccauguggcggucgaaaaccaccaccacgccgccaugcuagacgucgaccuccacccagccuccgccuggacgcuguacgcgguggcaaccaccaucaucaccccgaugaugcgccacacgauugagaacaccaccgccaauaucagccugaccgccaucgccaaucaagcggcuauccucauggggcuggacaaaggcuggcccaucucgaagauggacauuggcgugccucugcucgcccuggggugcuacagccaggucaacccacugacgcucaccgccgcggugcuuaugcuuguggcccacuaugccaucaucggcccagggcuccaagccaaggccacccgcgaggcccagaagcggaccgccgccggcauuaugaagaaccccacggucgacgggauugucgccaucgaccuggaucccguggucuacgacgccaaguucgagaagcagcuaggccagaucaugcucuuaauccuaugcaccucccagauacuucugaugcgcaccaccugggcguugugcgagucgaucacgcuagccaccggcccgcugaccacccugugggaggguuccccgggcaaguucuggaacacgaccaucgccgugagcauggccaacaucuuccggggguccuaucuagcuggcgcgggccuggccuucagccugaugaaguccuuggggggcgggaggcggggcacgggggcccagggcgaaacccugggcgagaaauggaagagacaacuaaaccagcucuccaagagcgaguucaacacguacaagcgguccgguaucauggagguggaucgcagcgaggccaaggagggccugaagcgcggggaaacaacuaagcacgccguaucgcgaggcacggccaaguuacggugguucguggagcgcaaccugguaaagcccgaagggaaggucaucgaccucggcugcggccgcggcggguggagcuacuauugcgccgggcugaagaaggugaccgaggugaagggguacaccaagggcggccccgggcaugaggagccuauucccauggcuaccuacggguggaaccuggucaagcuccacuccggcaaggacguguucuucauaccgcccgagaagugcgacacccugcugugcgacaucggggagagcucccccaacccgacgaucgaggagggccgcacccuccgggugcugaagauggucgagcccuggcugcgugggaaccaguucugcaucaagauccucaaccccuauaugcccagcgugguggagaccuuggagcagaugcagcggaaacacggcgguaugcugguccggaacccguugucccggaacagcacccacgagauguacuggguuuccugugggaccgguaacaucgugagcgccgugaauaugacuucucggaugcuucugaaccgcuucaccauggcacaucggaagcccaccuacgagcgcgacguggaccucggcgccggcacccggcacguggccguugagcccgagguggccaaucuggacauaaucggccagcgcauagagaacaucaagcacgagcacaagucgacuuggcacuacgacgaggauaacccauacaagaccugggccuaccacggguccuacgaagugaagccgagcggcuccgcgucuagcauggucaaugguguggucaaacuccucaccaagcccugggacgugauccccaugguuacccagauagcaaugacggacaccacccccuuuggccagcagcggguuuucaaggagaaggucgacacccgcacgccaaaggcuaagcggggcaccgcacagaucauggagguaaccgccaaguggcuguggggauuccugucccgcaacaagaagccaagaaucugcacccgcgaggaguucacaaggaaggugcgcagcaacgcggccaucggcgccguguuuguggacgagaaccaguggaacuccgccaaggaggcagucgaggacgagcgguucugggaccucguucaccgcgaacgggaacugcacaagcagggcaagugcgcgaccugcguuuacaacaugauggggaagcgcgagaaaaagcugggggaauucggcaaggccaaggggagccgggccaucugguacauguggcucggcgcccgcuuucuggaguucgaggcgcuggguuucaugaacgaagaccacugguucucccgggagaacagcuuguccgggguugagggggaggggcugcacaagcugggcuacauucuccgcgacaucaguaagauccccgggggaaacauguacgcggacgacaccgccgggugggacacccggauuacggaggacgaccugcagaacgaggcccgcaucaccgauaucauggagccagagcacgcccugcucgcgaaguccaucuucaagcugaccuaccaaaacaagguggugcgcguccagcggcccgccaagaacgggacagugauggacgugaucagccgccgggaccagcgcgguuccgggcaggucggcacauacggccugaacaccuucacuaacauggaagcccaacuaauccgccagauggagagcgaggggaucuuuucccccagcgagcuggagaccccaaaccuggccgagcgcgugcucgauuggcuggaaaaguacggcgucgaaagacugaagcgcauggccaucuccggggacgacugcgucgugaaaccaaucgacgauagauucgcgacggcucuuaccgcacugaacgacaugggcaagguccgcaaggauauuccccagugggagcccagcaagggguggaacgacuggcagcagguccccuuuugcucccaccauuuccaccagcuaaucaugaaggacggcagggaaaucguggugccaugccgcaaccaggacgagcucgucggccgcgcccgcgugucacaaggagccggcuggucccugcgggagaccgcgugcuuagggaaguccuacgcccagauguggcaguuaauguacuuccaccgccgggaccugcgacuagccgccaacgcgaucugcagcgcugugccagucgauuggauccccaccucccggacgaccuggucaauccacgcccaccaccaguggaugaccacagaggacaugcucuccguguggaaccgcguguggaucgaggagaaccccuggauggaggacaagacgcacaucagcuccuggggcgacgucccguaccuggggaagcgcgaagaccagugguguggcagccugauuggccucaccgcccgggccaccugggcgaccaacauccagguggccaucaaucaggugcgccggcugaucgggaaugagaauuaccuugacuacaugaccuccaugaagcgcuucaagaacgaaagcgaucccgagggcgcgcucugguga

SEQ ID NO: 24629 - RNA, 9879 nt, Artificial Sequence
  derived and/or modified CDS sequence (opt11) from DENV-1__JQ045642__SS-prME
agcgugaccaugcuacucaugcugaugcccacggcccuggccuuccaccucaccacccggggcggagagccccacaugauagugagcaagcaggagagaggcaagagccuguuguucaagaccagugccggggugaacauguguacacucaucgccauggaccugggcgagcugugcgaggacaccaugaccuacaagugcccacgaaucaccgagacggagcccgacgacguggacugcuggugcaacgccacggacacaugggugaccuacggaaccugcagccagacgggcgagcacagacgcgacaaaagauccguggcccuugcgccccacgugggccuggggcucgagacccguaccgagaccuggaugagcuccgagggcgccuggaaacaaauccagcggguggagacaugggcccuccgccacccuggguucaccguuaucgcucuuuuccuggcgcaugcgaucggcaccaguaucacgcagaaagggauaaucuuuauccuccugaugcugguaacacccuccauggccaugcggugcgucgggaucgguagccgcgacuucguggaagggcucuccggggccaccuggguggacgucguucuggaacacgggagcugcgugaccaccauggcuaaggacaagcccacgcuggacaucgaacuccugaagacggaggucaccaaccccgccgugcugcggaaacucugcauugaggcgaagaucuccaacaccacgaccgacagccgcugcccgacccagggcgaggccacccuggucgaagagcaggacgccaacuucguuugccggcgcaccuucguggaccggggcugggggaacggcugcgggcuguucggcaaagggucgcucaucacgugcgccaaguucaagugcgugacuaaacuggagggcaaaaucguccagugcgagaacuugaaguacagcgugaucgucacgguccacacuggagaccagcaccaggucgggaacgaguccaccgagcacggcacgaccgccaccaucaccccacaggcucccaccaccgagauccaguugaccgacuacggcgcccugacgcuggacugcagcccccgcaccggccucgacuucaacgagaugguccugcugaccaugaaggagaaguccuggcucgugcacaagcagugguuccuugaccugccauuacccuggacgagcggggccagcacuucccaggagaccuggaaccggcaggacuugcuaguaaccuuuaagaccgcccacgccaagaagcaggaggucguugugcucggcagccaagagggcgcgaugcacaccgcccugaccggggccacggagauccagacgucuggcacuacgaccaucuucgccgggcaccugaagugccgccucaagauggacaaguugacccugaagggcaugaguuacgucaugugcacgggauccuucaaguuagagaaggagguggcugaaacucagcacggcacugugcugguccagaucaaguacgaggguacggacgcgcccugcaagauccccuucagcacacaggacgagaaggggguaacccagaacgggcgccugaucaccgccaacccgaucgugaccgauaaggaaaagcccguuaacaucgaagccgaaccgcccuucggggaguccuacaucgugaucggcgcaggcgagaaggcguugaagcucagcugguucaagaaagggucgagcaucggcaagauguucgaggccacggcccgaggugcccggcgcauggccauccuaggcgacacugcgugggacuucggguccaucggcggaguuuuuaccucagucgggaaacugguucaccagaucuucggcaccgccuacgggguacuuuucuccggcgucagcuggacgaugaagaucggcaucggcguccugcugacguggcucggccugaacucucguuccacuucccuuucgaugaccugcaucgccgugggacucgucacgcuguaccugggcgugaugguccaagccgacuccgggugcguuaucaacuggaagggccgggagcuaaagugcggcagcggcaucuucgugaccaacgaggugcacacauggacugagcaguacaaguuccaggcugacucgccuaagcgccuguccgcggccaucggcaaggcuugggaagaggggguuugcggcauuagaucugccaccagacuggagaacaucauguggaagcagauuuccaaugagcucaaccacauccugcuggagaacgacaugaaguucacggugguggucggugacguagccggcauucucgcgcaggggaagaaaaugauccggccccaacccauggaguacaaguacagcuggaagucauggggcaaggccaagauaaucggagccgacguucagaacaccaccuucaucaucgacggacccaauaccccggaaugcccggacgaccagcgcgccuggaacaucugggaggucgaggacuacggcuucgggaucuucacgaccaacaucuggcugaaacugcgggacucguacacccagguaugcgaccauaggcucauguccgcggccauuaaggacagcaaggccgugcacgcagacaugggcuacuggaucgagagcgagaagaacgagaccuggaaacuagcccgggcgagcuucaucgaagucaagacgugcaucuggcccaagucccacacgcuguggagcaacggugugcucgaaagugagaugaucauccccaagauauacgggggcccgauaagucagcacaacuaccgccccggguauuucacccagacggccggccccuggcacuuggggaagcuggagcucgacuucgaccugugcgagggcacgaccguggucgucgacgagcacugcggcaaucguggaccgucccugcgcaccaccacggugaccggcaagaucauccacgaauggugcuguaggagcugcacccugccaccacuccgguuuagaggcgaggacggcugcugguacgggauggagauucgccccgugaaggagaaggaagagaaccuggucaaguccauggucucggccggaagcggggaggucgacuccuucagccuugggcugcugugcaucuccaucaugaucgaggaagugaugcggagccguuggucccggaagaugcucaugaccgggacgcuugccguguucuuccuacucaucaugggucagcugaccuggaaugaccugauccgccucugcaucaugguaggugccaacgcgagcgaccgcauggggaugggcacaaccuaccuggcccugauggcuacguuuaagaugcggccgauguuugcgguggggcuccuguuccgccggcugaccucccgcgaggugcuccuucugaccaucgggcucagccuugucgccagugucgagcugcccaacagccucgaggagcugggcgacgggcuggcaaugggcaucaugaucuuaaagcugcuuaccgauuuucagucccaccagcucugggccacgcugcugagccucaccuucauaaagaccaccuucuccuugcacuacgcuuggaagacgauggcuaugguccugucuaucgugucccucuucccucugugucugagcacaaccucccagaagacgacguggcuucccgugcugcugggcagcuuagggugcaagccgcugaccauguuccugaucgcggagaauaagaucugggggagacgguccuggccccucaacgaggggaucauggccgucggaauugugagcauccugcugagcucccuauuaaaaaacgaugugccccuugcuggcccccuaaucgccggcggaaugcugaucgccugcuacgucaucagcggguccagcgccgaccugucccucgagaaggcagccgaggugucgugggaggaggaggcugagcacucaggcgccagccacaacauccugguggagguacaggacgacgggaccaugaagaucaaggacgaggagcgggaugacacccugaccauccuucuuaaggcgacgcuccucgccguguccgguguuuauccacugucaauccccgcgacgcucuucgucugguacuuuuggcagaagaagaagcagcgcuccgguguccucugggacacccccagcccgcccgaggugggcagagcuguccuggacgacggaaucuaucgcaucaugcagcgggggcugcuaggccgcucccaggugggggugggagucuuucaggagaauguauuccacacaauguggcacgugacgcgcggggccguccucauguaucagggcaagcgccuggagcccagcugggcgucugugaagaaggaucugaucagcuauggagggggcuggcggcuacaaggguccuggaauaccggcgaggaggugcaggucaucgccguggagcccgggaagaaccccaagaaugugcaaaccgcccccggcaccuucaagacgcccgagggcgaggucggggccaucgcccuggacuuuaagcccggaaccagcgggagucccaucgugaacagggaggguaagauugucggccuauacgggaacggcguagugacgaccagcgggacguauguguccgcaaucgcgcaggccaaggcuucccaggagggcccguuacccgagaucgaggacgaggucuuccggaagcgcaaccugaccaucauggaccuucaccccgggaguggcaagacccggcgcuaccucccggcgaucguucgggaggccauuaagcgcaagcugcgcacccugauccucgcccccacgcggguggucgccuccgagauggccgaagcgcugaagggaaugccgauccgcuaccagaccacggccgucaagagcgaacacaccgguaaggagaucguggaucuuaugugucaugccacguucacaaugcggcuccugucccccguccgcgugccgaacuacaacaugaucaucauggacgaggcgcacuucaccgaccccagcagcauagccgcgcggggguacaucagcacccgaguggggaugggcgaggccgcggccaucuucaugacggccacgccacccgggucagucgaggcguucccgcagagcaacgccgugauccaagacgaggagagggacauccccgagcgcuccuggaacagcggauacgaguggauuaccgacuuccccggcaaaaccgugugguucguccccagcauuaagagcgggaacgacaucgcuaacugccugcggaagaacggcaagagggugauccagcuuucgcggaagacguucgacaccgaguaucagaagacgaagaacaacgacugggacuacguggugaccacggacaucagcgagaugggcgcuaacuuccgcgcggaccgggugaucgacccgcgccguugccugaagcccgugauucuaaaggacggacccgaacgcgucauccucgccggucccaugccggugaccgucgccuccgccgcccagcgccgcggccguaucggacgcaaccauaacaaggagggugaccaguacaucuacaugggccaaccccuuaacaacgacgaggaccacgcccacuggaccgaggccaaaauguuacucgacaacauaaacacccccgagggaaucauccccgcccuguucgagccggagcgcgagaaguccgccgcgaucgacggcgaguaccgguuacggggggaggcgcggaagacguucguggaacucaugcgccggggcgaccugcccgucuggcuguccuauaaggucgccagcgagggcuuccaguacagcgaccgccgguggugcuuugacggcgaacgcaacaaccaggugcucgaggagaacauggacguggagaucuggaccaaagagggcgagcggaagaagcuucgcccuagguggcuggacgcccgcaccuacuccgacccccucgcucugcgggaguuuaaagaauucgccgccggacgccgguccgucucaggggaccugauccucgagauaggcaagcugccgcagcaccugacccaacgcgcccagaaugcccucgacaaucugguaaugcugcacaacucugaacaaggcggacgggccuaccgccacgcgauggaggagcuucccgacacgaucgagacucugaugcugcucgcacugaucgccguucugacggggggcgucacccucuucuuccuuuccgggcguggccuagguaagaccucgaucggguuacugugcguaauggccucuagcgugcugcucuggauggcauccgucgaaccccauuggaucgcggccagcaucauucuggaauucuuccugauggugcucuuaauacccgagccagaccgccagcggacaccgcaggacaaccagcuggcguacguggucaucggccuccuguucaugauccugaccguggccgcaaacgagauggggcuccuggagaccaccaagaaggaccugggcaucgggcacguggcggucgagaaccaccaccacgccgccaugcucgacguggaccugcaccccgccuccgccuggacgcuauaugcgguggcaaccaccaucaucaccccuaugaugcgccacacgaucgagaacaccaccgccaauauuucacucaccgccaucgccaaccaggcggccauccugaugggccuagacaagggcuggcccaucucgaagauggacaucgguguaccccuccuggcccugggcugcuauucccaggugaacccccucacacugaccgccgcggugcugaugcucgucgcccauuacgcuauaaucgguccgggccugcaggccaaggccacacgcgaggcgcagaaaaggacagcugccggaaucaugaaaaaccccacgguggacgguaucguggccaucgaccuggacccggucguguaugaugcaaaauucgaaaagcagcucggucagaucaugcuccuaauucuaugcacuagucaaauccugcuuaugcgaacgaccugggcccuaugcgagagcaucacguuggccaccgggccccugaccacgcucugggagggcagcccgggcaaguucuggaauacgacaaucgccgugagcauggccaacauauuccgugguucauaccuagccggcgcggggcuggccuucagccucaugaagucccugggcggcggccgccgggggaccggcgcccagggagagacccuuggggagaaguggaagcgccagcucaaccagcuguccaagagcgaguucaacacguauaagcgguccgguaucauggaaguugaccgcagcgaagccaaagaagggcugaagcggggggagaccacgaagcacgccgugucucgcgggaccgccaagcuccggugguuuguggagaggaaccuggucaagccugagggcaaggugaucgaccugggcuguggucggggaggguggagcuauuacugcgccggucugaagaaggugacggaagucaagggguacacgaagggcggcccugggcacgaggagcccauaccgauggccaccuacggcuggaaccucgugaaguuacacucggggaaggacguuuucuucaucccgcccgagaagugcgacacccuguugugcgauaucggcgagagcucccccaacccgacgaucgaagaaggucgcacccugcguguccugaagaugguggagcccuggcuccgcggcaaccaauuuugcaucaagauccugaacccauacaugcccagcguggucgagacacuagagcagaugcagcggaagcacggcgggaugcuugugcgcaacccacuauccaggaacagcacccacgagauguacugggucaguugcggcacagggaauauagucagcgccgugaacaugacgagccgcaugcugcucaaccgcuucaccauggcucaccggaaaccgaccuacgagcgagacguggaccugggcgcggguaccaggcacgucgccguagagcccgaaguagccaaccuggacaucaucgggcagcgcaucgagaauaucaagcaugaacacaagagcacguggcacuaugacgaggacaaccccuacaagaccugggccuaccacggcuccuacgaggucaagccgucgggguccgcgagcuccauggugaauggcguugugaagcuccugacgaagcccugggacgugauccccaugguaacccagaucgcuaugacugacaccaccccauucgggcagcagcggguguucaaggagaagguggacacgcgcacgccgaaagccaagcggggcaccgcccagaucauggaagucacugccaagugguuguggggcuuucucucccgcaacaagaagccccggaucugcacccgcgaggaguucacgcgcaaggugcgcagcaacgcggccauaggggccguguucgucgacgagaaucaguggaacuccgccaaggaggcgguggaggacgagcgguucugggaucucgugcaccgcgagcgggagcugcacaagcagggcaaaugugcgaccugcgucuacaacaugauggguaagcgcgagaagaagcucggcgaguucgguaaagccaaaggaagucgggccaucugguacauguggcugggcgcccgcuuccuggaauucgaggcguuaggguucaugaacgaggaucacugguucucccgggagaacagccuguccggcgucgagggagaaggccugcacaagcuugguuacauucugcgcgacaucagcaaaaucccaggcggaaacauguacgccgacgacacugccgggugggacacccggaucacggaagacgaccugcagaacgaggcccgaauuaccgacauaauggagccggagcaugcccuccuggcgaagucaaucuucaagcugaccuaccagaauaaggugguccgcgugcagcggcccgccaagaacggcaccgugauggacgucauuucacgccgggaucagaggggcuccggccaaguggguaccuacgggcucaacaccuucaccaacauggaggcccagcugauccggcagauggagucugaggguaucuucucccccagcgagcuggagacgccgaaccuagcagagcgcgugcuggacuggcuggagaaauaugggguugagcggcucaagcgcauggcgauuucgggcgacgacugcguggugaagccgaucgacgaccgguucgcuacggcccugaccgcccugaacgauauggggaagguccggaaagauaucccucagugggagccuagcaagggguggaacgacuggcagcaggucccguucuguucacaccacuuccaccaacucaucaugaaagauggccgggaaaucguagucccaugucguaaccaagacgagcugguggggcgggcgcgcgugucacagggcgcuggguggagccuccgggagaccgcgugccuuggcaaguccuacgcccagauguggcagcugauguauuuccaccgaagagacuugaggcucgccgccaacgcgaucugcucagcuguaccuguggacuggauuccaaccucccggaccacauggagcauccacgcccaucaccaguggaugacaaccgaggacaugcuguccguuuggaaccgcgucuggaucgaggagaaccccuggauggaggacaagacgcacaucaguaguuggggcgaugugccguaccugggcaaacgugaggaccaguggugcggcucgcucaucggccugaccgccagagcgaccugggcgaccaacauccaaguggccauuaaccagguacgacggcugaucggcaaugagaacuaccuagauuacaugaccuccaugaagcguuucaagaacgagagcgaucccgaaggggcccuuugguag

SEQ ID NO: 24630 - RNA, 9879 nt, Artificial Sequence
  derived and/or modified CDS sequence (opt11) from DENV-1__JQ045644__SS-prME
ucugugaccauguuacucaugcugaugcccacugcucuagcuuuccaccucaccaccagaggaggggagccccacaugaucguuagcaagcaggagcggggcaagucacugcuguuuaagacgagcgccggcgugaauaugugcacccuuaucgccauggaccugggagagcuaugcgaggacaccaugaccuauaaaugcccccggaucaccgagaccgagccggaugacguggacugcuggugcaacgccacggauaccugggugaccuacgggacgugcagccagacaggcgagcaccggcgggacaaacgauccguagcccucgcaccccaugugggacuggggcuggagacucgcacugaaacuuggaugagcuccgaaggagcauggaagcagauccaacggguagagacuugggccuugagacaccccggguucaccgugaucgcccuguuccuggcucacgcgaucggcaccaguaucacacagaaggggaucaucuucaucuuacugaugcuggucacgcccucuauggcgaugcgauguguaggcaucggcagccgcgacuucguggaggggcucaguggggccaccuggguggacgucgugcuggagcacgggagcuguguaaccaccauggccaaggauaaacccacuuuggacaucgagcuucugaagaccgaagucaccaaccccgcggugcugcggaagcucugcaucgaggcgaagaucuccaacaccacgaccgacagccgcugcccgacacagggagaggccacccuggucgaggagcaggaugccaauuucgucugccgccgaacguucguggaccgaggcugggggaacggcugcggacuguucggcaagggaucucucauaacgugcgcaaaauucaagugcgugaccaaguuagaaggcaaaauaguccaguacgagaaucucaaguauucaguaaucguuaccguccauacgggcgaccagcaucagguggggaacgaguccacggaacacgguaccacagcgaccaucacgccccaagcgccgacgaccgaaauacagcucaccgacuacggggcccuaacgcucgacugcuccccuagaacgggccucgauuucaacgagauggucuuauuaaccaugaaggaaaaauccuggcucguccacaagcagugguucuuggaccugccgcuccccuggaccagcggggcaagcacgucccaggagaccuggaaccggcaggacuuguuagugaccuucaaaaccgcccacgccaagaagcaggaggucguggugcucgggagccaagagggcgcgaugcacacggcccugacuggggcaaccgagauccagaccuccggaacgacaaccauauucgccgggcaccuaaagugccgccuaaagauggacaagcuuaccuuaaagggcaugagcuauguaaugugcacgggguccuucaagcucgagaaagagguggccgagacccaacacggcaccgugcugguccagaucaaguacgagggcaccgaugcgcccugcaagauccccuuuagcacucaagacgagaagggggugacacagaacggccggcuuauuaccgccaaucccaucgugacagacaaggagaagccggucaacaucgaggccgagccgcccuucggggagucguacaucgugauaggcgccggcgagaaggcgcuaaaguuguccugguucaagaagggguccagcaucggcaagauguucgaggccacagcgcgcggggcgcggcgcauggccauccuuggcgacaccgcgugggacuucggguccaucggcggcguauucaccucagucgggaagcugguucaccaaaucuuuggcaccgccuacggagugcuguucuccggcgucucauggacuaugaagaucgggaucggcgugcugcugaccuggcucggcuuaaacagucguagcaccucccuaagcaugacaugcaucgccguggggcucgugacccuguaccuuggugugauggugcaggcugacuccgggugcguuaucaacuggaagggcagggagcucaagugcgggagcggcaucuucgugacgaacgaggugcacaccuggacugagcaguacaaauuccaagccgacaguccgaagcgacugagugcggccaucgggaaagccugggaagagggggucugcggcauucggagcgcuacgcgccuggagaacaucauguggaagcagaucuccaaugagcucaaccacauccuucuggagaacgacaugaaguucacaguggugguaggggauguggccgggauccucgcgcaggguaagaagaugauccggccccagccaauggaauacaaguacagcuggaaguccuggggcaaggccaagaucaucggagccgacgugcagaacacgacguucaucauugacgggcccaacacgccagagugccccgacgaucagcgagccuggaacaucugggagguagaggacuacggcuucggaaucuucacgaccaacauauggcugaagcugcgggauagcuacacccaggucugcgaccaucgccugaugucugcggcaauaaaggacagcaaggccguccaugccgacaugggauauuggaucgaguccgagaaaaacgaaaccuggaagcuggcccgggcuucuuucauugaggucaagacgugcaucuggcccaagucccacacccuauggucuaacggcgugcucgaauccgaaaugaucaucccuaagauuuacggcgguccgaucagccagcauaacuaccgccccggguacuucacccagaccgccggccccuggcaccuggggaaacuggaguuagacuucgaucugugcgaggguacgacgguggucguggacgagcacugcggcaacagagggccgagcuugcgaaccaccacggugacgggcaaaauuauccacgaguggugcugccggucuuguacucuaccgccccugcgcuuccgcggggaggaugguugcugguacgggauggagauccgccccgucaaagaaaaggaggagaaucuggugaaguccauggugucugccgguucaggcgagguggacagcuuuagcuuaggguuacugugcaucagcauaaugaucgaggaggucaugcguagccgcugguccagaaagaugcuuaugaccggcacgcuggccgucuucuuccugcuaauuauggggcagcugaccuggaacgauuuaauccgcuuaugcaucauggucggggccaacgcaucagacaggauggggaugggcacuacguaccuggcucugauggccgccuucaagaugcgaccgauguucgccgugggccuccucuuccgacgguuaacgagccgcgaggugcuccugcugaccaucgggcucagccuggucgccuccguggaacugccaaacagucuggaggagcugggcgacggacuggccaugggcaucaugaucuugaaguugcugaccgacuuccagucccaccaacucugggccacccugcugucccucacuuucaucaagacuaccuucucucuccacuacgcauggaagaccauggcgaugguccuguccaucgugagucucuucccccugugccugagcacaaccucgcagaagaccacguggcuccccgugcuguuaggcagccucggcuguaagccgcugacgauguuucugaucgccgagaacaagauuugggggcggcgcucguggccgcucaacgaggggauuauggcugucgggaucgucagcauccugcucucuucuuugcugaagaacgaugucccccuugccgggccccuaaucgcgggcggcauguuaaucgcguguuacgucaucagcggaucuagcgcggaccugucgcucgagaaagcagcugaggugucgugggaagaggaggccgagcacuccggcgcuucccacaauauucugguugaggugcaggacgaugggaccaugaaaaucaaggacgaggaacgggacgacacucuuaccauccuccugaaggccacacuguuagccguguccggaguguacccacugaguaucccagccacgcucuucgucugguacuucuggcagaagaagaagcaaagguccggugugcucugggacacccccucgccucccgaaguggagcgggcagucuuagacgacgggaucuaccgaaucaugcagcggggcuugcuggggcgcucccaggugggcguaggggucuuccaagagaacguguuccacacgauguggcacgugacacggggcgcaguccucauguaucaggggaagaggcuggagccuagcugggccagugugaagaaagaccugaucucauacggcggcggguggcggcuucagggcuccuggaacacgggggaggaggugcagguaaucgcgguagaacccggcaagaaccccaaaaacgugcagacggcccccgggaccuuuaagacccccgagggcgaggucggcgcgaucgcgcuggacuuuaagcccgggacgagcggcucccccauugugaaccgcgagggcaaaaucguuggccuuuacggcaauggggucgugaccaccaguggcaccuacgugagcgccaucgcccaggccaaggccucccaggaggguccgcuccccgaaaucgaggacgaaguuuuccggaagcgcaaucugacuaucauggaccugcaccccgguagcgggaagacccggcgcuacuuaccagccauagugcgagaggccaucaagcgcaaguuacgcacccuaauccucgccccgacgaggguagucgccucugagauggcggaggcacuaaagggcaugcccauccgcuaccaaacgaccgcugucaagagcgagcacaccgguaaggagaucguggaccugaugugccacgccacguucacaaugcggcuccugucacccguacgcgugccgaacuacaauaugauuaucauggacgaggcccacuucacugacccaagcuccauagcggcgcggggguacauuagcacucgggucgggaugggggaggcugccgccauauucaugaccgccacgccucccggcucagucgaggcguucccccagaguaacgccgugauccaggacgaggagcgggacauccccgaacgcuccuggaacagcggguacgaauggauaaccgacuucccuggcaagaccgugugguucguccccuccaucaagagcgggaaugacauugccaacugccugcgcaagaacgggaagcgcgugauccaguugucacgcaagaccuucgauacggaauaucaaaagaccaaaaacaacgacugggauuacguggucacuaccgacaucucagagaugggcgcgaacuuucgcgccgaccgugugaucgacccucgccggugcuugaagccagugauccugaaggacggccccgagagggucauccuugccggcccgaugccggugacggucgccuccgcggcgcagcgaagagggcggauugggcgcaaucacaacaaggaaggcgaccaguacaucuacaugggccagccccucaacaacgacgaggaucacgcccacuggaccgaggccaagaugcugcuagauaacauuaauacccccgagggcauaauccccgcccucuucgagccggagagggagaaguccgccgcaaucgacggggaguaccggcuccgcggcgaagcccggaaaaccuuugucgaacucaugcggcgcggggaccugcccguguggcucucuuacaaggucgccucggagggcuuccaguauagcgacagacgguggugcuucgauggagagcgcaauaaccaggugcucgaggaaaauauggauguugagaucuggacgaaggagggggagcggaagaagcuccgcccgcgguggcuggacgcccgcaccuacucugacccccucgcgcuucgagaguucaaggaguuugcggccgggcgccggagcgucuccggggaucugauacuggagauuggcaagcugccgcagcaccugacucagcgcgcccaaaacgcgcucgacaaccuggugauguugcacaacagcgagcagggcgggcgggcuuaccgccacgcgauggaagagcuccccgacaccauugagacccugauguuacucgcgcuuaucgccgugcugaccggcggggucacccucuucuuccugucgggccgggggcugggcaagacuagcaucggucucuuaugcgugauggccuccuccgugcuguuauggauggcguccgucgagccccauuggaucgcagccagcaucauccuugaguucuuccuuauggugcuccuaauccccgagccagaccgucaaaggacgccccaagacaaccagcuggcguacguggucaucggacuccuguuuaugauccuuacgguggcugcgaacgagaugggccuccucgagaccacaaagaaagaccucggaaucggccauguagccgucgagaaccaccaccacgccgcuaugcucgacguggaccugcaucccgccuccgcauggacccuauacgcgguggccaccacgaucauaaccccuaugaugcgacacaccauagagaacacaaccgccaacauaagccucacagccaucgcgaaccaggccgccauccugaugggguuggauaagggcuggcccauauccaagauggacaucggcguaccccucuuagcccucggcuguuacagccaggugaacccacucacccugacggcugcagugcuaaugcucgucgcccacuacgcgaucaucggcccggguuugcaggccaaggcgacccgcgaggcacagaagcggacggcagcuggcaucaugaagaaucccacaguggacgggaucguugccaucgaccuggaccccgugguauacgacgcgaaguucgagaagcaguugggacagaucauguuacugauccucuguacgucucagauacugcugaugcgcaccaccugggcucuuugcgaguccaucacgcuggccacggguccccugaccacccucugggagggcagucccgggaaguucuggaacacaacgaucgccgugaguauggccaacauuuuccgaggguccuauuuggcgggugcuggcuuagcuuuuagccuuaugaagucccucgggggugggcgccgggggaccggggcccagggcgagacccugggagagaaguggaagcgccagcucaaccagcucuccaagagcgaguucaacaccuacaagcgguccgguauaauggaagucgacagaagcgaagcgaaggagggccugaagcgcggggaaacgaccaagcaugcuguauccaggggcaccgccaaacuccggugguucguggagcgcaaccuggucaagcccgaggggaaggucaucgaccuggguugcgggagggggggcugguccuacuacugcgcaggccuaaagaaagugaccgaggucaagggguacacgaagggcggccccggccacgaggagccaauccccauggccacauacggguggaaccuggugaaauugcacuccggaaaggacgucuucuucaucccuccggagaagugcgacacgcugcucugugacaucggggaaagcucaccgaauccgaccaucgaggaggggcgcacgcugcggguccugaaaaugguggagcccuggcugcgcgggaaccaauucugcaucaagauccuuaaccccuacaugcccucaguggucgagacuuuagagcagaugcagcggaagcacggcggcaugcucguuaggaauccguugagucggaacagcacgcacgagauguauuggguguccugcggaacuggcaacaucguuagcgcggugaacaugacuucacgcauguuguuaaacagguuuacgauggcccacaggaagcccacguacgagcgcgacguggaccugggggcagguacccgccacguggccguggagcccgaaguagccaauuuagauaucauuggccagcgcaucgagaacaucaagcacgagcacaagagcaccuggcacuacgacgaggauaacccguacaagacgugggcguaccacgguaguuaugaggucaagccgucuggcagugcaagcagcauggugaacgggguugugaaauugcuaaccaagcccugggacgugauccccauggucacccagaucgccaugaccgacacuacccccuuuggacagcagaggguuuucaaggagaagguagacacgcgcacuccgaaggccaaacgggggacggcacagaucauggaagugaccgcgaaauggcuguggggcuuucucagccgcaacaaaaagccccggaucugcacccgcgaggaguucacccguaaggugcgcagcaacgccgcaaucggcgcgguguucgucgacgagaaccaguggaacuccgcgaaggaggccguggaggaugagcgguucugggaccuuguccaucgcgagcgggagcugcacaagcaggggaagugcgccacgugcgucuacaacaugauggguaagcgcgagaagaaauugggugaguucggcaaggcgaaggggucacgugccaucugguacauguggcugggcgcgcgcuuucuugaguucgaggcccuaggauucaugaacgaggaccacugguucucccgggagaacagccuauccgggguggaaggcgaggggcugcacaaacucggauacauccugcgcgacaucucgaagaucccagggggcaacauguacgcagacgacacugccggcugggacacgcggaucaccgaggacgauuuacagaacgaggcccgcaucacggauaucauggaaccggagcacgcgcuucuggcgcgcuccauuuucaagcuuaccuaccagaacaaggugguccgugugcagcgccccgccaagaaugguacggugauggacgucaucagccggcgcgaucagcgggguuccggucaggucgggaccuacggccucaacaccuucacgaacauggaggcccagcugaucagacagauggagagcgaggggaucuucucccccagcgagcuggaaacccccaaccucgcagagcgggugcuggacuggcuggagaaguacggcgucgagcgccuuaaaagaauggcgaucuccggggaugacugcguggugaagccgaucgacgaccgcuucgcgaccgcccuaacggcccugaacgacaugggcaagguccggaaagacaucccccagugggagccuagcaagggguggaacgacuggcagcagguccccuucugcucccaccacuuccaucagcuaaucaugaaggacggccgcgagauugucgucccaugccggaaucaggacgagcuggugggccgagcccgggugagccagggggcgggauggagccuccgggagaccgccugccuugggaagucguacgcacagauguggcagcugauguacuuucaccggcgcgaccugcgucuagccgcaaacgccaucugcucagcuguccccguggacuggauacccacgucccgcaccacguggaguauccacgcccaucaccaguggaugacgacugaggacaugcucuccguguggaaccgugucuggauagaagagaaccccuggauggaggacaaaacccauaucagcuccuggggcgacgucccguaccuagguaagcgggaagaccaguggugcgguagcuuaaucggccuuaccgcgcgugcgaccugggccaccaacauccaaguggccaucaaccagguccggaggcugauaggaaacgaaaacuaccucgacuacaugacguccaugaaacgguucaagaacgagagugacccggagggcgcccugugguga

SEQ ID NO: 24631 - RNA, 9879 nt, Artificial Sequence
  derived and/or modified CDS sequence (opt11) from DENV-1__JQ045648__SS-prME
uccguuaccaugcucuuaaugcucaugccgaccgcguuggcauuccaccucacuaccagaggaggggaaccccauaugaucgucagcaagcaggagcgggguaagagucugcuguucaaaaccagcgccggugucaauaugugcacuuuaaucgcaauggaccugggcgagcugugcgaagauacaaugaccuacaagugcccccggauuaccgagaccgagcccgacgacguggacugcugguguaacgcaacggauaccugggucaccuacggaaccugcagccagaccggcgagcacagacgugacaagcguucgguggcccucgcgccucacgucggccucgggcuggagacccgcacggagacuuggaugagcuccgagggggccuggaagcagauacaacgggucgagacgugggcccugcggcaccccggguucaccgugaucgcccuguuccuagcccacgcaaucgggacaucgaucacccagaaggggaucaucuucauccuccugaugcuggugacccccuccauggccaugcggugcguaggcaucggcagccgcgacuucguugaggggcucagcggcgccaccuggguggacgucguuuuggagcacggcagcugcgugacuaccauggccaaggauaagcccacgcuggacaucgagcuacugaaaaccgaagucaccaaccccgccgugcugcgaaagcucugcaucgaggccaagaucucuaacaccacgaccgacagccguugcccuacccagggcgaggccacacugguggaggaacaggacgccaacuucgucugccggaggaccuucguggaccggggguggggcaacggcugcgggcuguucggcaaggguucgcuuaucacgugcgccaaguuuaaaugcgucacgaagcuggaggggaagaucguccaguacgagaaucugaaauacagcgugaucguuacugugcauacgggcgaccagcaccaaguggggaacgaauccacugagcacggcaccacagccaccaucacgccccaagcgcccacuaccgagauccaacucaccgauuacggggcgcugacacuggacugcagcccacgcaccggccucgacuucaacgagaugguccugcugaccaugaaggagaaguccuggcucguucacaagcagugguuccuggaccugcccuuacccuggaccagcggggccagcacgucacaggagacauggaaccgccaggaccugcugguaacguucaagaccgcccacgccaagaagcaagaaguaguggugcucggcagccaggagggagcgaugcacacagcucugaccggggccaccgagauccaaacauccgggacgaccaccaucuucgccgggcaccuaaagugccgccucaagauggacaagcugacccugaagggaauguccuaugucaugugcacgggguccuucaagcucgagaaggagcucgccgagacccaacacggcacgguuuuagugcagaucaaguacgaaggcaccgacgcuccgugcaagaucccguuuagcacgcaggacgagaagggggucgcccagaacggccggcugauuacggccaacccgaucgucacugacaaggaaaagcccguuaacaucgaggccgaaccgcccuucggggagaguuacaucguuauaggugcgggcgagaaggcccuuaaauugagcugguucaagaaggggagcagcauagguaagauguucgaggccacugcccgcggggcccggcguauggcaauccucggcgacacggcaugggacuucgggucuauaggcggaguauucaccaguguggggaagcuaguucaucaaaucuuuggcaccgccuacgggguucuguucuccggggugagcuggaccaugaagaucgggaucggcgugcugcucacguggcuggggcugaacucacgcuccacuucccucaguaugaccuguaucgccgucggccuggugacgcuguaccucggugucauggugcaggcggauuccgggugcguaaucaauuggaagggacgggagcugaagugcgguagcggcauuuucgucacuaacgagguccacaccuggaccgagcaauacaaguuccaagcagauagcccgaagcgccuguccgcagccauuggaaaggccugggaagaggggguguguggcauucggagcgccacccgcuuggagaauaucauguggaagcaaaucucuaaugaacugaaucacauccugcucgagaacgacaugaaguuuaccguuguggugggggacguggccggcauccuggcucaagggaagaaaaugauccggccccagccaauggaauacaaguacagcuggaaguccuggggcaaggccaagaucauuggcgcugacgugcaaaacacgaccuucaucauugaugggccuaacaccccggagugccccgacgaucaacgcgcguggaacaucugggagguggaagacuacggcuuugggaucuucaccacuaauaucugguuaaaacuucgggacagcuacacccaagugugcgaucaccggcugauguccgccgccaucaaagacagcaaggcugugcacgccgacaugggcuacuggaucgagucugagaagaaugagaccuggaagcuggcgcgcgcaaguuucaucgagguuaagaccuguaucuggccgaaaagucacacgcuguggagcaauggcguacuggaguccgaaaugaucauccccaagaucuacggggguccaauaagccagcauaacuaccgccccggguacuucacccagacugccggccccuggcaccuggggaagcucgagcuggauuucgaccugugugagggcacgacaguggucgucgacgagcacugcggcaaccggggcccgucucugcgcaccacaaccgugacgggcaagauuauacacgaguggugcugccggagcugcacccugccacccuuacgcuuucguggggaggacggcugcugguacgguauggagauccgccccgugaaagagaaggaagagaaccucgucaaauccaugguaagcgccggcagcggcgagguagacuccuucucgcuggggcugcucuguaucuccaucaugaucgaggaggugaugcggucacgguggucccguaaaauguugaugaccggaacccuggccgucuucuuccuccugaucauggggcaacugacguggaacgacuuaauccguuugugcauuauggugggugcaaacgccagcgaccgcauggggaugggaacaaccuaccuggcccucauggccacguuuaaaaugagaccgauguucgccguagggcugcuguuucggcggcucacaucgagagaggugcugcugcucaccaucggcuuaucacugguggcgagcgucgaacucccaaacucgcucgaggaguuaggcgacgggcuagccaugggcaucaugauccuuaagcugcucacagacuuccagucccaccagcugugggcaacgcuguugucgcugacguucaucaagaccacacugucccuucacuacgcuuggaagaccauggcgaugguauugaguaucgucucccuauucccccucugucugagcacuaccagccagaagaccaccugguuacccgugcuccugggcagcuuggggugcaagccgcuaacaauguucuugaucgccgagaacaagaucuggggcagacgcaguuggccccugaaugaagguauaauggccgugggcaucgucagcauccugcugagcucccugcucaagaaugaugugccucuggcagggccccugaucgccgguggcaugcucauugcgugcuacgugauuagcgggaguucagcagaccugucccuggaaaaggccgcagaggucagcugggaggaggaggccgagcacuccggcgccagccacaauauccucguggaggugcaggaugauggaacuaugaagaucaaagacgaggagagggaugacacccugaccauucuccucaaggcaacucugcuggcgguauccggcguguacccgcucagcauccccgccacacuuuucgugugguacuucuggcagaagaagaaacaaagaagcggggucuuaugggacaccccgucuccgcccgaaguggaacgggcagugcuggacgacggcauuuaccguaucaugcagcgaggcuuacuuggcagaagccagguaggcguggggguguuccaggaaaauguauuccauaccauguggcacguuacccggggcgcggugcugauguaccaagggaagcgccucgagccguccugggcuuccgugaaaaaggaccuuauuagcuacggcggcggguggcggcuucagggcucauggaacacgggagaggaggugcaagugauugccgucgaacccggcaaaaaccccaaaaacgugcagaccgcccccgggaccuucaagacaccggagggcgaagugggugccaucgcgcucgacuucaagcccgggaccagcggauccccuaucgucaaccgcgaagggaagaucgugggguuauacggcaacggcguggucaccaccucaggcaccuaugugagcgccauugcgcaggcaaaggcaagucaggaggggccgcugccggagaucgaggaugagguguuccggaagcgcaaccugacgaucauggaccugcauccaggcuccgguaagacccggcgcuaccugccggccaucguccgugaggccauuaagcgcaagcuccgcacccugauccuggcgccgacccgugugguggcuuccgagauggcggaggcacucaaggggaugccuauccgcuaucaaacgacagcggucaagagcgagcauacgggcaaggagauuguggacuuaaugugucacaccacuuucacuaugaggcuccucucccccguucgcgugccgaauuacaauaugauuaucauggacgaggcacauuucaccgaccccagcuccauagccgcgcgggguuacauaucgacccgggugggcaugggagaggcggccgccauauuuaugacggccacgccgcccgguucuguggaagcguuuccacagaguaacgccguuauccaggaugaggagcgggauaucccagagcgcuccuggaacucgggguacgaguggaucacggacuuccccgguaagacugugugguucgugcccucuauaaaaucuggcaaugauaucgcgaacuguuuacggaagaacgggaaacgcguuauacagcugucccggaagacguucgacaccgaguaucagaagacuaagaacaacgauugggacuacguggugacuacugacauuagcgagaugggcgccaauuuucgcgcggaccgggugaucgacccaaggcggugccucaaacccgucaucuugaaggacgggcccgagcgcgugaucuuggcaggcccgaugccggucaccguggcguccgcugcccaacggcgcgggcggaucggccgaaaccauaauaaggagggggaucaguacaucuauauggggcaaccccucaacaaugacgaggaccacgcgcacuggaccgaggcgaagaugcugcuggacaauaucaauacucccgaggguaucauccccgcacucuucgagccggagagggagaaguccgcagcuaucgacggggaauacaggcugcgcggcgaagcgcggaaaacguucguugagcugaugcgccgcggggacuuaccugucugguugucauacaaaguggccagcgagggcuuccaguauagcgaccgucgguggugcuucgacggcgagcgcaauaaucagguccuugaggagaacauggacguggagaucuggaccaaggagggggagcggaagaagcuccgcccucgauggcuggacgccaggacguacuccgacccccuggcccucagggaguucaaagaguucgcugcuggucgccggagcgugucaggugaccugaucuuggagauaggaaaacuuccgcagcacuuaacgcagcgcgcccagaacgcgcuggauaaccucgucaugcugcacaacagcgagcagggugggcgggccuaccgccacgcgauggaggagcugcccgacacgaucgaaacucucaugcugcuggcguugaucgccguuuugacuggcggcgugacccuguucuuccuguccggacgggggcuggggaaaacaagcauuggccugcucugugugauggcauccagcguccuccucuggauggccucaguggagccccauuggauagcagccagcauuauccucgaguuuuuccugaugguccucuugauccccgagccggaccgccagcggacgccucaggacaaccagcucgccuauguggugauugggcuccuguuuaugauccucaccgucgccgcuaacgaaaugggccugcuagagaccaccaagaaggaccuggguaucggacacguagcgguggagaaccaccaucacgccgccaugcuugacguugacuugcaccccgccuccgccuggacgcucuacgcuguggccaccacgaucauuaccccgaugaugagacacacgaucgaaaauacaaccgccaacaucagccugaccgccaucgccaaccaggcggcaauacucaugggucuggacaagggcuggccgaucucaaagauggauaucggcguuccccuguuagcccugggguguuauagccaggucaacccccuuacgcucacggccgcgguguuaauguuaguggcccacuacgccaucaucggacccgggcuccaagcuaaagccaccagggaggcucagaagcgaacggcugccggcaucaugaagaacccgacggucgacgggaucgucgccauagaucuggacccaguggucuacgacgccaaguuugagaaacagcuuggccagaucaugcuccugauccuuuguaccucccagauacuccuaaugcgcaccacaugggcgcuaugcgagagcauaacgcuagccaccggaccccugaccacccugugggaggggucgccugguaaauucuggaacacgaccaucgccgugagcauggcgaacaucuuccggggguccuaccuugccggugcgggccuagccuucagccuuaugaaaucccucgggggcgggagacggggaaccggggcccaaggcgagacacugggcgaaaaauggaaacgccagcucaaccaacugucaaaaagcgaguucaacacuuacaagaggucgggcaucauggaaguggaccgcucggaggcaaaggagggccuuaagcgcggggagacgaccaagcacgcggucucccgcggcaccgcgaaacuuagaugguuuguggagaggaaccuggugaagcccgagggaaaggucaucgaccucggcugcggccgcggcggguggagcuacuacugcgccgggcugaagaaggugacggaggugaagggguauacaaagggcggacccggucaugaggagcccaucccgauggccaccuacggguggaaccuggucaagcuccacuccggcaaggacguguucuuuaucccgcccgagaagugugauacccugcucugugacaucggagagagcucccccaaccccacaauagaggagggccgaacguuacggguccucaagaugguggagcccuggcugagagggaaccaguucugcaucaagauauugaaccccuauaugcccaguguagucgagacucuggaacagaugcagcggaagcacggcggcaugcugguacgaaauccgcucuccagaaacagcacccacgaaauguauuggguauccugcgggacgggcaacaucgugucagcagucaacaugacguccaggaugcugcugaaccgcuucaccauggcgcaccggaaacccaccuacgagagggacguagaucuaggggccgguaccagacacgucgccgucgagccggagguugccaaccuugauauaaucggacagcgcauagagaacaucaagcaugagcauaagagcacguggcacuacgacgaggauaaccccuacaagacgugggcguaucacggcuccuacgaagugaaaccgagcggcuccgcgagcagcauggugaacgggguggucaaacugcucaccaagccgugggacgugauacccauggucacccagauugccaugacggauacaacgcccuucggccaacaacgggucuucaaggagaagguggacacaaggaccccgaaggcaaaacgggguaccgcccaaaucauggagguaaccgccaaguggcucuggggauuccuguccagaaacaagaagccccggaucugcacacgugaggaguucacgcggaagguacgcuccaaugcagccauuggcgcuguauucguugacgagaaccaguggaacucagccaaggaagcgguagaggacgaaagauucugggaucuuguacaccgagagcgggagcugcauaaacaagggaagugcgcgaccugugucuauaacaugaugggaaaacgcgagaagaaguugggugaguucggcaaggcuaaagguucucgggccaucugguacauguggcucggagccagguuccuggaguucgaggcgcugggcuucaugaacgaggaccauugguuuucccgggagaacagucucagugggguugagggcgagggucuccacaagcuggguuacauccuccgcgacaucaguaagauccccgggggcaacauguacgccgaugacacggccggcugggacacucgcaucacggaggaugaccugcagaaugaagcgcgcaucaccgacauuauggaaccggaacaugcgcuucucgcgaaguccaucuuuaagcugaccuaccagaacaagguggugcgcgugcagcgccccgccaaaaacgggacagugauggaugugaucagccgcagggaucaacgcggcuccggucaagucggaacauauggcuuaaacacuuucaccaacauggaagcacagcucauacgucagauggagagcgaggggaucuucucgcccucugaacuggagacccccaaucuggcagagcgcguacucgacuggcuggagaaguauggcgucgagaggcugaagcggauggccaucuccggggacgauugcguggugaagccaaucgacgaccgguuugcaacggcccucaccgcccuuaacgacauggguaaggugcgcaaggacaucccgcagugggaacccagcaagggguggaacgauuggcagcaggucccauucugcucccaccacuuccaccaauuaaucaugaaggacggccgggagauuguagugccgugccggaaccaggacgagcucguaggccgugcccgcgugagucagggggccggcuggucucugcgggagaccgcaugcuuagggaaaucauacgcccagauguggcagcugauguacuuccaccgucgggaccugagguuagccgccaacgcgauuugcagcgcgguccccgucgauuggauccccacgacgugcacuaccuggagcauacacgcccaccaucaguggaugaccacggaggauaugcucagcguguggaaccggguguggauugaggagaaccccuggauggaggacaaaacccacaucucuagcuggggagacgucccuuaucuggggaagcgcgaggaccaguggugcgggucccugaucgggcuaacggccagggccaccugggcgaccaacauccaaguggcaaucaaccaggugcggcgccugaucggcaacgagaacuaucuggacuacaugacuuccaugaagagguucaagaacgagucagaccccgagggcgcacucugguag

SEQ ID NO: 24632 - RNA, 9879 nt, Artificial Sequence
  derived and/or modified CDS sequence (opt11) from DENV-1__JQ045649__SS-prME
agcgucaccaugcugcucaugcugaugcccaccgccuuagccuuccacuugaccacaaggggcggggagccccacaugaucguguccaagcaggagcgggggaagagccugcuauucaagaccagcgcgggggugaacauguguacccucaucgccauggaccuaggcgagcugugugaggacacaaugacauacaagugcccccggaucacagaaacagagcccgaugauguggacuguuggugcaacgccacugacacguggguuaccuacgguaccugcagccagacuggcgaacaccggcgagauaagcgaaguguggcgcucgccccccacgugggacucggacuggagacccgcacagagaccuggaugagcuccgagggagcguggaagcagauccaacggguggagacgugggcccuccgccacccuggguucaccgucaucgccuuguuccuagcacacgccauaggcacuagcauaacccagaaggggaucaucuuuauucugcugaugcugguaacgccgucaauggccaugagaugcgucggcaucggcagccgcgauuucguugaggggcucucgggugccaccuggguggacgucgugcuugaacacggguccugcguuaccacaauggccaaggauaagccgacguuagacaucgaacuccugaagaccgagguaaccaaccccgccguguugcggaagcucuguaucgaggcgaagaucuccaacaccacgaccgacagcagaugcccuacccagggcgaggccacccuggucgaggagcaggacgcgaacuucgucugucggcggacauucgucgaucgcggcugggguaacggcugcgggcuguucgguaaggggucccucaucacgugugccaaguucaagugcgucaccaagcuggagggcaagauaguccaguacgagaaccugaaguacucggugaucguuaccgugcauacgggcgaccagcaucaggugggcaacgaguccaccgagcacggcaccacugcaaccaucacuccccaagcgccuacaaccgaaauccagcucacugacuacggggcccuaacgcuggauugcucuccgcgcaccggccuagacuucaacgagaugguccugcugaccaugaaggagaagaguugguuaguucacaagcagugguuucuggaccugccccuccccuggaccagcggggcgagcaccucccaggagaccuggaaucggcaagacuugcugguaaccuuuaaaaccgcccacgcaaagaaacaagaagucguggugcucgggucucaagagggcgcgaugcacacggccuugaccggugcuaccgagauccaaacuucaggcacgaccaccauuuucgccgggcacuuaaaaugccgccugaagauggacaagcugacuuuaaagggcaugucguacgucauguguacgggguccuuuaagcucgaaaaggagguggccgaaacccagcacggcacagugcugguccagaucaaguacgaaggcaccgacgcgccaugcaagauuccauucagcacgcaggacgagaagggggucacccaaaacgggcggcugaucaccgccaauccaaucgucaccgauaaggagaagcccgucaacaucgaggccgagccaccauucggggagagcuacauagugaucggcgcaggggaaaaggcgcugaagcuaagcugguuuaagaagggauccagcaucggcaaaauguucgaggcgacggcccgcggggcacggcgaauggccaucuuaggggauacagcgugggacuuuggguccaucgggggcguguucaccagcguuggaaagcugguucaucagaucuucgggaccgcguacgggguucuguucaguggugucagcuggacgaugaaaaucgggauuggcguacugcugacgugguugggcuuaaacucccgcagcaccucccugagcaugaccugcaucgcggugggccucgucacgcuguaucugggcgugauggugcaggccgacagcgggugcgucauaaacuggaagggacgggagcugaagugcggcagcggcaucuucgugaccaacgaggugcauaccuggaccgagcaguacaaguuccaggcugauagcccgaagcgucuguccgcggcgaucgggaaagcgugggaggagggagucugcgguauccgcuccgccacacgcuuggagaacauaauguggaagcagaucucuaacgaguugaaccacauacuacuggaaaacgacaugaaguucaccgugguggucggagacguggcuggcaucuuagcccaggggaagaagaugauacggccccagcccauggagcacaaguauagcuggaagucuugggguaaagccaagaucauaggcgccgaugugcagaacaccacuuuuaucaucgacgggcccaacaccccggagugucccgaugaccagcgcgccuggaacauaugggaagucgaggauuacggcuucgggaucuucacgaccaacaucuggcuaaaacugcgggacucauacacccaggugugugaccaucgccugauguccgcggccaucaaggacagcaaggccgugcacgcugauaugggcuacuggaucgaguccgagaaaaacgaaaccuggaagcuggcaagggcgucauucaucgaagucaaaaccuguauauggcccaagucacacacacuguggagcaacggcguauuagaauccgagaugaucauacccaaaaucuacgggggcccgaucagccagcacaacuaccgccccggguauuucacccagacggcaggcccauggcaccuggguaagcuggagcucgauuucgaccucugcgaaggcacgacaguagucgucgaugagcauugcggcaaccgggggccgucccugcgcaccaccacagugacgggcaagaucauccacgagugguguugcaggagcugcacgcugccgcccuuacgcuuccgcggggaggacggcugcugguacgggauggaaauccgccccguccgggagaaggaggaaaaccuagugaaguccauggucucggccggcagcggcgaggucgacuccuucagccucggucugcucugcaucuccaucaugaucgaggaggugaugcgcucacgguggucccgaaagaugcucaugaccggcacuuuggcuguauucuuuuuacucauugucgggcaacugacauggaacgaccuuauucgccucugcauuauggugggcgcuaacgcgagcgauaggauggggaugggcaccaccuaccuggcccugauggcgacuuuuaaaaugcgcccgauguucgccguggggcuccuguuccggcgccuaaccucccgggaggucuuacuccugaccaucgggcucagccuaguagccuccgucgaacugccgaauagccucgaagaguugggcgacgggcuggcuaugggcaucaugauacuuaagcuucuaaccgacuuucaaucgcaccagcucugggccagccugcugucccuuacguucaucaagaccaccuucagccugcauuacgccuggaagaccauggccauggugcuauccguaguuagccucuucccccugugccuguccacgaccagccaaaagaccacuuggcuccccguauugcugggcucccucggguguaaaccucugaccauguuccugaucgcugaaaacaagaucuggggucgccggagcuggccccucaacgaggggaucauggccgugggcaucgucucaauccugcuauccucgcuccugaagaacgacgugccccucgccgggccgcucaucgccggaggcauguuaaucgcgugcuacgucaucuccggaagcuccgcggaccugagccucgagaaggccgccgaggucucuugggaggaagaggccgaacacagcggugcaucccacaacauacugguggaggugcaggacgacgggacgaugaagauuaaggaugaggaacgcgacgacacccugacuauccuccugaaggcuacccugcuagccgucucugggguguacccccuguccauucccgcaacgcuguucgucugguauuuuuggcagaaaaagaaacagcggagcggaguccuuugggacacccccagcccgcccgagguugagcgcgccguacucgacgacggcaucuaccggaucaugcaacgaggccugcuugggcggagccagguaggcguggggguguuccaggagaacgucuuccacacgauguggcacgugacccgcggcgccguucucauguaccagggcaagcggcuggaacccuccugggcguccgucaagaaggaccuuauuuccuacggcggcggguggaggcuccaaggcucguggaacacuggggaggagguacagguaauagccgucgagcccggcaagaacccaaagaaugugcaaaccgcaccggggacauucaagacacccgaaggcgaagugggcgcaaucgcccuggacuucaagcccgggacguccggaagccccaucgugaauagagaggggaagaucgugggccuguacggcaacgggguggucaccaccagugggacguacguguccgcgaucgcccaggccaaggcgucccaggaggguccgcuccccgagauugaggaugagguguuccgcaagcggaaccugacgauuauggacuugcaccccggauccgggaagacccgcagguaccucccggcaaucguccgcgaggccaucaagcgcaaguuacggacccuuauccucgccccgacccgcgugguggcuagcgagauggcugaagcgcucaagggaaugcccauccgguaccagacgaccgcggucaaguccgagcacaccggcaaggagaucguggaccugaugugucaugccaccuucacgaugcggcuccugagccccgugcgggucccgaacuauaacaugaucauaauggacgaggcccauuucaccgaccccagcagcaucgccgcgcgcgguuacaucuccacccggguuggcaugggggaagccgccgcuauauucaugaccgcaacgccgcccgggagcguggaggccuucccgcaaaguaacgcgguuauccaggacgaggagcgcgacauccccgagaggagcuggaacucagguuaugaguggaucaccgauuuccccgguaagacugugugguucgugcccagcaucaaguccggcaacgacaucgccaauugccuuaggaagaacgguaagcgggucauacagcuuagccgcaaaaccuucgacacggaguaccagaagaccaaaaacaacgauugggauuauguaguuacgacggacauauccgagaugggcgccaacuuccgggcggaucgggucauagacccgagacgcugccuaaagcccguaauccucaaagauggucccgagcgggucauccucgccggccccaugccggugacagucgcguccgcggcucagcgccgagggaggaucggccgcaaccacaacaaagagggcgaucaguauauuuacauggggcagccucuaaauaacgacgaagaccaugcgcauuggaccgaagccaaaaugcugcucgacaauaucaacacacccgaggggauaauccccgcccuguucgaaccagagcgggagaaauccgccgccauagacggugaguaccgccuccggggcgaggcacgcaagaccuuuguugagcugaugcggagaggggaccugcccguguggcuaagcuacaagguggcaagugagggguuccaguacagugaccggcgcuggugcuucgacggcgagcggaacaaucaggucuuggaggagaacauggacguggaaaucuggaccaaggagggggaacguaaaaagcugcggccccgcuggcuggacgcucggaccuauuccgacccccucgcccugagagaguuuaaggaguucgccgcgggccggcgcucugugucaggggaucugauacucgagauaggaaagcugccgcagcaucugacccagagagcacagaacgcccucgacaaucuggucaugcugcacaacuccgagcagggggggcgcgccuaccgacacgcgauggaggagcucccugacacaauugagacacucaugcuucuagcucugaucgcagugcugaccggcggggugacccucuucuuccuaagcggucgagggcugggcaaaaccucaauuggccuccugugcgugauggccagcuccgugcugcucuggauggccucgguggagccccacuggaucgcggcgagcaucauucuggaguucuucuugauggucuuacugaucccggagccggaccggcagcgcacgccacaggauaaccaacuggccuauguagugaucgggcugcuguucaugauccugaccgucgcagcuaaugagauggggcuccuggagacaacaaagaaggaccugggcauaggccaugucgcaguggagaaccaccaccacgccgccaugcucgacgucgacuugcaccccgccagcgcguggacccuauacgcgguggcgacgaccaucauuaccccgaugaugcgccacacaaucgaaaacacgaccgccaacaucucccucacugcaaucgcgaaccaggcagccauucugauggggcuggauaagggcuggcccaucagcaagauggauauagggguaccgcuccuugcccuggguugcuacucccaggucaauccccucacacuuacggcugcgguacugaugcucguggcccacuaugccaucauuggcccgggucugcaagccaaagccacccgugaggcgcagaagcgcaccgcugcaggcaucaugaagaaccccaccgucgacggcauuguggccaucgaccuggacccuguggucuacgacgccaaauucgagaagcaacucggccagaucaugcugcugauucucugcacgagucagauccuguugaugcggaccaccugggcccuuugcgaguccaucacgcuggccacgggcccccugacaacacuuugggaggggagcccgggcaaguucuggaacacgacgaucgcaguauccauggcgaacaucuucagggggagcuaccuggccggcgcgggacuugccuuuagccucaugaagucacuagggggcggucgucgcgguaccggggcccagggcgagacccugggcgagaaauggaagcgacaacucaaccagcuaagcaaaucagaguuuaacacuuacaagcgcuccgggauuauggaaguugaucggagugaggccaaagaaggccugaaacggggggagacaacuaagcacgccgucucgagagggaccgcgaagcugcgcugguucguggagaggaaucuaguuaagccggaggggaaggucaucgaucuaggcugcgggcgcgggggcuggucauacuacugugcggggcugaaaaaggugacagaagugaagggcuacacgaaagggggaccugggcacgaggagcccaucccuauggccacguacggguggaacuuagucaaacugcacagcggcaaggacgucuucuucauuccgcccgagaagugcgacacccugcucugcgauaucggggaguccagccccaacccgaccauagaggagggccguacucugcgcguacugaagauggucgaacccuggcuccgggggaaccaguucugcaucaaaauacuuaacccguacaugccuucugucguugaaacccuggaacaaaugcagcgcaagcacggcgguaugcugguccggaacccgcugagucgcaacuccacccacgagauguacuggguguccugcgggaccggcaacaucgugagcgccgucaacaugaccucacgcaugcuccucaaccgguucacgauggcgcaccguaagcccaccuacgagcgggacguggaucugggggcuggcacacgccacguggccgucgagccugagguggccaaccuggacaucaucggccagcggaucgagaacauaaaacacgagcacaaguccaccuggcacuaugacgaggauaaccccuacaaaacgugggcauaccacgggucauacgaggucaagcccuccggcagugcauccaguauggugaacgggguggucaagcuccugaccaagcccugggacgugauccccauggucacacagaucgccaugacagauacgaccccguucgggcaacagcgggucuucaaagagaagguggauacgcggaccccgaaggccaaaagggggacggcucagaucauggaggucacagccaaguggcuuuggggcuuccugagccggaacaaaaagccccgcauaugcacucgagaggaguucacccguaagguccggaguaaugccgccaucggcgcuguguucguggacgagaaccaguggaacucagccaaagaggcugucgaggacgagagguucugggaccugguacaucgggagcgcgagcugcacaagcaagggaagugcgccacgugcguguacaacaugaugggcaagcgggaaaagaaacugggggaguuuggcaaagcgaaagggucccgagcaaucugguacauguggcugggcgcucgguuccuugaauucgaggcucucgguuucaugaacgaggaucacugguucucuagagaaaauucccugagcgggguggaaggcgagggguuacacaagcucggcuacauccuucgggacaucagcaagaucccggggggcaauauguaugcugaugacacagccggcugggacacucgcaucaccgaggacgaccuaaagaacgaggcccgcauuacggacaucauggagccggagcacgcccuccucgcaaaguccauuuucaaacugaccuaccaaaacaagguggugcggguccagagacccgccaagaaugggacagugauggacgugauuucccgccgcgaccagcggggaagcggucaggucggcaccuauggccucaacaccuucaccaacauggaagcccagcugauccgccagauggaguccgaagggaucuuuagccccuccgagcuggagacucccaaccuggccgagcgggugcuccacuggcuggaaaaguacggcguggagcgccugaaacggauggccaucuccggcgacgacugcgucgugaagcccaucgacgaccgcuucgcgacggcccugacggcccugaacgacaugggcaagguacggaaggacaucccccagugggaacccaguaagggguggaacgauuggcagcagguccccuucugcagccaccacuuccaccaacucaucaugaaggacggcagagagaucgugguaccgugccggaaccaggacgaacucgucggaagggcacgcgugagccagggggcuggaugguccuuacgcgaaaccgcgugccucggcaaaucauacgcacagauguggcagcugauguacuuccaccggcgcgaccuuaggcucgcggcuaacgcgaucugcagugccgugcccguugauuggauccccacgagccgcaccacgugguccauccacgcccaccaccaauggaugaccacggaagacaugcugagcguauggaaccgcgucuggaucgaagagaaucccuggauggaggacaaaacccacauauccagcuggggggaugucccauaccuugggaagcgcgaagaucaauggugcggcucgcucaucgggcuuacggcacgcgccaccugggcgaccaacauccagguggccaucaaccaggucagacgccugaucggaaaugaaaauuaccucgacuauaugacuucaaugaaacgguuuaaaaacgaguccgauccggagggcgccuuaugguaa

SEQ ID NO: 24633 - RNA, 9879 nt, Artificial Sequence
  derived and/or modified CDS sequence (opt11) from DENV-1__JQ045650__SS-prME
agcgugaccaugcuauuaaugcugaugccgaccgcucuggccuuccaccucacuacccggggcggcgaaccgcacaugauagugaguaaacaggagcggggaaagagccugcuguucaagaccucugccggggugaacaugugcacccucaucgccauggaccuaggcgagcugugcgaggacacgaugaccuacaaaugcccacgcauaacagagacugagccggacgacguggauugcuggugcaacgccacggacaccugggugacuuaugguaccugcagccaaacgggcgagcaccggcgcgacaagcgcucggucgcccucgcgccgcacgugggacuugggcuggagacccgcaccgagaccuggaugagcuccgagggcgcguggaagcagauccagcgaguggagacgugggcucuccgccaccccggguucacugugaucgcccuguuccuggcccacgcuaucggcaccagcauaacccagaagggcauuaucuucauccuccugaugcuggugacgcccucgauggcuaugcggugcgucgggauugggagccgugauuucguggaggggcucucaggcgccaccuggguggacgucguacuagagcauggaagcugugucacuacuauggcgaaggacaagcccacgcuugacaucgagcuccugaagaccgaggugaccaauccugccguccugcgaaagcucugcaucgaggcaaagauaaguaacacaacuacagacagccgcugcccgacucagggcgaggccacacugguggaagagcaggaugccaacuucguaugccgacggacguuuguggacagaggaugggggaacggcugcggucuauucggaaaagggaguuugaucacgugcgccaaauucaagugcguuaccaagcuggaaggcaagaucguccaguaugagaauuuaaaauacucagugaucguaaccguccacacgggugaccaacaccaaguugguaacgagucuaccgagcauggcaccaccgccaccauuacgccccaggcgccgaccacagaaauccagcucacagauuauggggcccugacccuggacugcucgccccgcacuggccucgacuucaacgagaugguucugcugacuaugaaggagaagucuuggcucgugcacaagcagugguucuuagaccugccccucccguggaccagcggggccagcacgucccaggaaaccuggaaccggcaggacuugcugguaacuuuuaagacagcacacgcgaagaaacaagagguuguggugcucgggagccaggagggcgcgaugcacaccgcccugacuggggccaccgagauccaaaccuccggcacgacaacgaucuucgccggucaccugaagugccgccuaaagauggacaagcugacacugaaaggcaugucuuaugucaugugcacgggguccuucaaacuggaaaaggaacuggccgaaacccagcacggcaccguacuggugcagaucaaguaugagggcaccgacgcgcccugcaagaucccuuuuagcacgcaagacgagaagggugucacccagaacggccgguugaucaccgccaacccgaucguuaccgacaaggagaagcccguaaacaucgaggccgagccgcccuuuggggaguccuacaucguaaucggcgccggcgagaaggcccucaagcugagcugguucaaaaagggguccagcaucggcaagauguucgaagccacagcccgcggggcgcgccgcauggcaauccuuggugacacagcgugggacuucggguccaucggcgguguguucaccucggucgggaagcugguccaccagaucuucggcacggccuacggaguccuguucuccgggguaucuuggacgaugaaaaucgggaucgggguacuucucacguggcugggccugaacuccaggagcaccuccuuaagcaugaccugcaucgccguggggcuggugacucuuuaccucgguguuauggugcaggccgacucagguugcgugaucaacuggaagggccgggaacugaagugcgggucgggcaucuucguaacuaacgagguacauaccuggacggaacaguacaaguuccaggccgauagcccuaagaggcugagugcggcaaucggcaaggccugggaggagggggugugcggaauccggagcgccacccgccucgagaacaucauguggaaacaaaucucaaacgaacuuaaccacauccugcucgaaaaugacaugaaguucacaguuguggucggagaugucgcaggcauccucgcgcaaggaaagaagaugauccggccccagccuauggagcacaaauacagcuggaaaucaugggggaaggccaaaaucaucggcgccgacguccagaauaccacauucaucauugacgggccgaauacuccggagugcccggacgaucagcgagcguggaacauaugggagguggaggacuauggcuucggcauauucacgaccaauaucuggcugaagcuccgggauagcuacacccaggucugcgaccaccgccucaugucugcggccaucaaggacucgaaagcugugcacgccgacauggguuacuggaucgaaagugagaagaaugaaaccuggaaguuagcccgcgccucguucauagaggucaagacgugcaucuggcccaaaucccacacccucuggagcaauggcguccuggaguccgagaugaucaucccgaagauuuacggcgggccgaucucacagcauaacuaucgcccaggguacuucacgcagaccgcgggccccuggcaccugggaaagcucgagcucgacuucgaccugugcgaggggacgaccguaguggucgacgaacauugcggcaacagggggcccucccuccgcacuaccacagugacagguaagaucauccaugaguggugcugccguagcugcacgcugccgccgcugcgguucagaggggaagauggaugcugguauggaauggagauccgccccgucagggagaaggaggagaaccuaguuaagucuauggugagcgccggcaguggagagguggacaguuuuagccucgggcugcucuguaucucgaucaugaucgaggaagucaugcguagccgguggucgagaaaaaugcugaugaccgguacgcuggccguguucuuccuccugaucguggggcagcugaccuggaaugaccucauccgccugugcauuauggucggcgccaacgcgagcgaccguauggggauggggacgaccuacuuggcccucauggccacuuucaagaugcgcccgauguuugcggugggccuuuuguuccggagauugacgagccgcgaagugcugcuguugaccauaggguuaucucuggucgcuuccguugaauuaccaaacagcuuggaggaacugggugacggcuuggcuauggguaucaugaucuugaaauugcuaaccgacuuccagucccaccaguuaugggccagccuccucucccugacauucauuaagacaaccuucagccugcacuacgccuggaagacgauggcgaugguccuuuccguggugagccuguucccacuuuguuuguccacaaccagccagaagacaaccuggcugccaguccugcucggcucccuggguugcaaaccgcuuacgauguuucucaucgcggagaauaagaucuggggaagacggucguggccacugaacgaggggaucauggccgugggcaucguaaguauuuugcucuccagccugcuaaagaaugacguuccccuugcugggccgcugaucgcggggggcaugcugaucgcuugcuaugugaucucagggucguccgcggaccucucgcuggagaaagccgcagagguguccugggaggaggaagccgagcacagcggcgccucucauaacauccuggucgagguucaagacgauggaacaaugaagaucaaggacgaggagcgcgacgauacccucaccauacuucugaaagcuacucuccuggcaguaagcgggguauacccguuaucaauccccgcuacccucuucgugugguacuucuggcagaagaagaagcagcggagcggagugcucugggacacccccagcccucccgaggucgagagggccguguuggacgacggcaucuacagaaucaugcagagaggccugcucgggcgaucccagguggguguugggguauuucaagagaacguguuccauacgauguggcacgugacccgcggcgcuguucuuauguaccaggggaagcggcuggagccuuccugggcgagcgucaagaaggaccucaucuccuacggcggcggguggcgcuuacagggaucguggaauacgggcgaggaaguccaagugauagcuguggagcccggcaaaaaccccaaaaacgugcagaccgccccggggaccuucaagacccccgagggcgaggugggcgccauugcccuggacuuuaagccggggacguccggcagcccgaucgugaaccgggaagggaagaucgucggccucuacggcaauggcgugguuaccacgucaggaacauacgucuccgccauagcccaggccaaggccagccaggaagggccgcugcccgaaaucgaggacgagguguucagaaagagaaaccugaccaucauggacuuacaccccgggagugggaagacccgccgguaccugccagcgaucgugcgcgaggcgauuaagcgcaagcuccggacccucauccuggcccccacccgcgucguggccagcgagauggccgaggcguugaaaggaaugcccaucagauaccagacuaccgcugugaaauccgagcacacgggcaaggagauagucgaccucaugugccaugccacguucacgaugaggcugcugagcccugugcggguuccgaauuauaacaugauaauuauggacgaggcccacuucacugaccccuccucuaucgccgcgcgcggguacaucuccacgcgggucggcaugggggaggccgccgcaaucuuuaugaccgcuacgcccccggggucagucgaagcauucccgcagucuaacgccgugauccaggacgaggaacgugacauaccggagcggucguggaacuccggguacgaauggaucaccgacuuccccggcaaaaccgucugguucgugccuagcaucaaguccgguaacgacaucgcuaacugucuccgcaagaacggcaagcgugugauucagcugagccgcaagacguuugacacggaguaccagaagaccaagaacaaugacugggacuauguugucacuaccgacauauccgagaugggcgccaacuuccgggcggaccgcgugaucgauccgcgaagaugccugaagcccgucauccuaaaggaugggccagaacgggugauccuggcgggccccaugccggugacaguggcuuccgcggcucagcgccgagggcgcaucggcaggaaccacaacaaagagggcgaccaguacaucuauauggggcagccccugaacaacgacgaggaucaugcgcacuggaccgaggccaagaugcuccuggacaacaucaauacuccagaggggauaauaccagcacuguucgaaccggaaagggagaagagugccgccaucgauggcgaguaccgccuccggggcgaggcgcgaaagacuuucguggaguugaugcggcgcggggaccugccuguauggcucagcuauaagguggccucggagggauuucaguauuccgaccgacgcugguguuucgauggugagcggaauaaccagguuuuagaagagaauauggacguagaaaucuggacgaaggagggggagcgcaagaagcuacguccccgcuggcuugacgcccggaccuauagcgacccccuggcccugcgcgaauucaaggaauucgccgcgggccggagguccgugucgggggaccucauacuggagaucgggaagcugccacagcaccugacccagcgggcccagaacgcccuggauaaccuggugaugcuccacaacuccgagcagggcggucgcgccuaccggcacgcgauggaagagcugcccgacaccaucgagacgcucaugcuccuggcuuuaaucgcagucuugaccggcggggugacccuguucuuccugagcgggcgcgggcucggcaagacgucgaucggccuacugugcgugauggccucaucggucuuguuguggauggccucaguggagccccacuggauugcugccuccaucauccuggaguucuucuugauggugcugcugaucccagagccggaucggcagcgcacuccccaagacaaccagcucgccuauguugugaucgggcugcucuucaugauucucacaguggccgcuaacgagauggggcuucuggaaacuaccaaaaaggaccucgggaucggccacguugcgguggagaaccaucaccacgccgcuaugcuggacguugaccugcacccugcaagcgcguggacccucuacgcgguggccacgacaauuaucaccccgaugaugcgccacacuaucgaaaauacgaccgccaacauuucccugaccgccaucgccaaccaggcggccauccuaauggggcucgacaagggcuggccaaucucuaagauggauaucggcgugccccugcuagcccucgggugcuacucccaggugaacccccucacucuaacggccgcgguccucaugcugguugcccacuaugcuaucaucggcccggggcugcaggcgaaggccacccgagaagcgcaaaagcgcacugccgcaggcaucaugaagaaucccaccguggaugggaucguggccauugaucucgaucccgugguguaugaugccaaguucgaaaaacaguuaggccagaucaugcugcucauucuauguacaagccagauccugcuuaugcggaccaccugggcguugugcgaauccauuacacuggcaacggguccccuaacuacccugugggaggggagcccggggaaauucuggaauaccacgauugccguaaguauggcuaacaucuucagggggagcuaccuggccggcgcugguuuagcauucagccugaugaagagccucgggggcgggagacgcgggaccggggcgcaaggcgagacucuuggcgaaaaguggaagcggcaacuuaaucaacugagcaagagcgaguucaauacauacaagaggagcgggaucauggagguggaccgguccgaggccaaggagggcuugaagcgcggagagacgacuaagcacgcggugucgcggggcaccgccaagcugcggugguucguugagcggaaccuagugaagcccgaagggaaggugaucgaccuaggguguggacgcggcggcugggcguauuacugcgccgggcucaagaaggucaccgaggugaaaggauacaccaagggcggccccggccacgaggaacccaucccuauggccaccuauggguggaaccuggugaagcuacacuccgguaaagacguguucuuuaucccccccgagaagugcgauacauugcugugugacaucggggagagcagucccaaccccaccaucgaggagggccggacgcugcgggugcugaagaugguagagcccuggcugcgggggaaccaauucugcaucaagauacugaaccccuacaugccaagcgucguagagaccuuggaacagaugcagagaaagcacggcgguaugcuggugcguaacccacugucccgcaauagcacccaugaaauguacugggucucuugugguacgggcaacauagugagcgcggugaacaugaccucccgcaugcuccugaaccgguuuacgauggcccaccgaaagccgacguacgagcgagaugucgaccuuggggccggcacacgccacgucgccgucgagcccgaagucgccaaccuugauaucaucggucagcggauugagaacauuaagcacgagcauaagagcacuuggcauuacgacgaggacaacccguacaagacgugggcguaccacggguccuacgaaguaaaacccagcggcuccgccagcagcauggucaacgggguggugaaguuacucacaaagcccugggacgucauccccauggugacccaaaucgcgaugaccgacacgacccccuucggucagcagaggguguucaaggagaagguugacacccggaccccgaaggccaagcgcgggacagcgcagaucauggaggugacggcaaaguggcucuggggcuuccuaucacggaauaagaagcccagaaucugcacccgagaagaauucacccgcaaggugagaagcaacgccgccauuggagccgucuucguggacgagaaucaguggaacuccgcgaaagaagcgguggaggaugagcgcuucugggaccuggugcauagagagcgugagcuccacaagcaggggaagugugccacgugcgucuauaauaugaugggcaagcgggagaagaaguuaggcgaguucggcaaagccaaggggucucgcgcuaucugguacauguggcuaggugcacgguuucuugaguucgaagcacugggcuucaugaacgaagaccacugguucucgcgcgagaacagccucucagggguggagggugaggggcuccacaaguuaggcuacauccuccgggacaucuccaagauccccgggggcaacauguaugccgacgauaccgccgggugggacacccgcauaaccgaggacgaccucaagaacgaggcccgcaucacggauaucauggagccggagcacgcgcugcuagccaaguccaucuucaagcuaacauaccagaacaaggugguccggguacagagacccgccaagaacgggaccgugauggacgugauaucucggcgcgaccagcggggcucaggccaagugggcaccuauggccuaaacacauucaccaacauggaagcccagcugauccgccaaauggagagcgaggggauuuuuucacccagcgagcucgagacccccaaucuggcugagagagucuugcacugguuggagaaguaugggguggaaaggcuaaagcggauggcgaucuccggcgacgacugcguugucaagcccauugacgaucguuucgccacugcccugacggcccucaacgauaugggcaaggugcggaaagacauuccgcagugggaaccaagcaagggguggaaugacuggcagcagguccccuucugcucccaccacuuccaccagcugaucaugaaggacggccgcgaaaucgucgugcccugccggaaccaagacgagcuggugggucgcgccaggguuagccagggagcgggcuggagccucagagagacugccugucuuggaaaauccuaugcacagauguggcagcucauguacuuccaccggcgcgaucuaagacuggccgcgaacgccauauguuccgccguacccguugacuggauccccaccucccgcacgacguggaguauccacgcccaccaucaguggaugacuaccgaggauaugcuguccguauggaaucguguauggaucgaggaaaaucccuggauggaagacaagacccacaucucauccuggggcgacgugccguaccucgggaaacgagaggaccaguggugcgggagucugauuggccugacggcccgggcgacaugggcaaccaacauacagguggccauuaaccaagugcgacgccucaucgggaaugagaacuacuuagacuacaugaccuccaugaagcgguucaaaaaugaaagcgacccggaaggagcccuaugguag

SEQ ID NO: 24634 - RNA, 9879 nt, Artificial Sequence
  derived and/or modified CDS sequence (opt11) from DENV-1__JQ045651__SS-prME
agugugacaaugcuccugauguuaaugcccacugcccuggcuuuccaccucaccacgcgcggcggggaaccccacaugaucguuagcaaacaggaacggggcaagagccugcuguucaagaccagugccggcgugaauaugugcacacucaucgcgauggaccugggcgaacugugcgaagacaccaugacguacaagugcccccggauuaccgaaacugaaccagacgauguagauugcuggugcaacgccacggacaccugggugaccuauggaaccugcagccagacgggcgaacaccggcgggauaagcgcuccguggcccucgcgccgcacguaggccuggggcuagagaccaggaccgagacauggauguccuccgaaggcgcguggaagcagauccagcggguggaaacgugggcgcuccggcacccaggguucacggugaucgcccuguuuuuagcgcaugccaucggcaccucuaucacccagaaggggaucaucuucauacuacugauguuagugacacccuccauggcaaugcggugcguuggcaucgggagccgagacuucguagagggguuauccggggccacuuggguagacgucgugcuggagcacggcucaugugugacaaccauggccaaggacaaaccuacgcuggauaucgagcuccugaagaccgaggucaccaaccccgccgugcugcgaaagcucugcaucgaagccaaaauuuccaacacaacuaccgacucacggugucccacgcagggcgaggccacacugguugaagaacaagacgccaauuucgucugucgacgcacguuuguggaccgaggcugggggaacggaugcgggcuguucggcaaaggaucucucaucacgugcgccaaguuuaagugcguaaccaaacuggagggcaagaucguccaauacgaaaaucuaaaguacagugugaucguuaccguccacacgggcgaccaacaccagguggggaacgagucgacagagcacggcacuaccgccaccaucacuccccaggcgcccaccaccgagauccagcucacggacuacggggcccugacgcuggacugcuccccgcgcaccggccucgacuucaacgagauggucuugcugaccaugaaggaaaaguccugguuaguccacaagcaaugguuccuggaccugccguuacccuggaccagcggggccuccacgucccaggagaccuggaauaggcaggaucugcugguuaccuucaaaaccgcucacgccaagaagcaagaggucguggugcuaggcagccaggagggcgcgaugcacacugcgcugaccggagccaccgaaauucagaccuccggcacuaccaccauauucgccgggcaccugaagugccgccucaagauggacaagcugacccugaagggcaugucuuauguaaugugcacggggucuuucaaauuagaaaaggagcuagccgagacccaacacgguaccgugcuggugcagauaaaguacgaaggcaccgacgcgcccuguaagauccccuucaguacgcaggacgagaagggggucacgcagaacggccggcugaucaccgcuaauccgaucgugaccgacaaggagaagcccgugaacaucgaggcggagccgcccuucggggagucuuacaucgucauaggcgcuggggagaaggcgcucaaguugagcugguucaagaaagguucgagcauagguaaaauguucgaggccacggcccguggggcgagacgcauggccauccugggcgacaccgcgugggauuucggguccaucggcggcgucuuuacuagcguaggaaagcucguccaccagaucuuuggaacugccuaugggguucuguucuccggagugagcuggacgaugaagaucgggauuggcguccuguugaccuggcuggguuugaacucccguagcaccuccuuaagcaugaccuguaucgccguggggcuggugacucuauaccucggcgucauggugcaggccgauuccgguugcgugaucaacuggaagggccgggaauuaaagugcgggagcggcauuuucgucaccaaugaagugcacaccuggaccgagcaguacaaguuccaggcggauagcccgaagagacuguccgcggcgaucggcaaggccugggaggagggcgugugcggcauccggagcgcaacccgccucgagaacauaauguggaagcagaucucuaacgagcugaaucauauacuucuagaaaacgacaugaaguucacggucguuguaggggacgucgccggcauccucgcucaagggaagaagaugauccggccccagccaauggaauacaaauauagcuggaaguccuggggcaaggcuaagaucaucggcgcugaugugcagaauaccacguucauuaucgacgggccuaacaccccagagugccccgacgaccagcgcgccuggaacaucugggagguggaagacuauggguucgggaucuucacgaccaacaucuggcuaaagcuccgggacucguauacccaggucugcgaccaccgucuuaugucggcugcuaucaaggauucgaaggcugugcaugcagauaugggcuacuggaucgaguccgagaagaacgagaccuggaagcuggcccgcgcgagcuucaucgaggugaagacgugcaucuggcccaagucccacacccucuggagcaacggcguacuggaauccgagaugaucauucccaagauuuacggagggccgaucucucagcacaauuaccgccccgguuacuucacccagaccgccggccccuggcaucuggggaaacucgagcuggacuucgaccugugugagggcacgaccgucgucgucgacgagcacugcggcaaccgcggaccuagccucagaaccaccacggugaccggcaagaucauccacgaaugguguugccggagcugcacccugcccccgcugcgcuuccgaggggaggaugguugcugguacggaauggagauccguccggugaaagagaaggaggaaaaccucgucaagaguaugguuagcgccgguagcggcgaaguggauuccuucagccuggggcugcugugcaucuccaucaugaucgaagagguuaugagaucccgcuggucccguaaaaugcugaugaccggaacgcucgcuguguuuuuccucuugaucaugggucaauugacguggaacgaccucauccgccugugcaucauggugggagccaaugcuagcgaucgaauggggauggguaccaccuaccuggccuuaauggcuaccuucaagaugcgaccgauguucgcugucggcuugcuguuucgcaggcuaacaucccgcgagguguugcuucugaccauugggcugagcuugguggccuccgucgaacuccccaacagucuugaggagcucggcgacggccucgcgaugggcaucaugauuuuaaagcugcucaccgacuuccagucccaccagcugugggccacucugcucagccugaccuucaucaagaccacguucucccugcacuacgcuuggaagacgauggcaaugguacucagcauagucucucuauucccucugugucucaguacgaccucccagaagaccacuuggcugccuguccugcuuggcagcuuagggugcaagccgcugacgauguuccucauagccgagaacaagauauggggccggcgcuccuggccccugaacgaaggcauuauggccgugggaaucgucagcauccuucucucaucgcuguugaaaaaugacgucccccuagcagggccccugaucgccggcggcaugcugauugccugcuacgugaucagcggguccucggcggaccucucccuggaaaaggcugcugaggucagcugggaagaggaggccgagcauuccggcgccucgcacaacauacugguugaggugcaggacgacggcaccaugaaaaucaaggacgaggaacgggacgacacccucaccauccugcugaaagcgacacuucuggcugucucgggagucuacccguugucgauaccggccacacucuucgucugguacuucuggcaaaagaagaagcagcgcucugggguccugugggacaccccaagcccacccgagguagagagggccgugcuggacgacggcaucuaccgcauuaugcagcgugggcuuuuaggaagaucccaggugggcgugggaguguuccaagagaacguguuccauaccauguggcaugugacgcggggcgccgugcugauguaccaaggaaagcgccuggagcccuccugggcguccgucaagaaggaucucaucucguauggaggaggguggcggcugcagggcuccuggaacaccggugaagagguccaggugaucgccguggaaccagggaagaaccccaagaacgugcaaaccgcgcccgggaccuucaagacgcccgagggcgaagugggagccaucgcccuggacuucaagccagguacgagcggcuccccaaucguuaaucgcgagggaaaaaucgugggccucuacggcaacgggguggucacuaccagcggaacguacguaagugcgauugcccaggccaaggcgucccaggaggggcccuugcccgagaucgaagacgagguguuuaggaagcgcaaucuuaccauuauggauuuacaucccggcagcgggaagacccgccgauaccugccggcgauaguccgggaggccaucaagcgcaagcugcgcacgcucauucuggcccccacgcgggugguggccagcgaaauggccgaggcgcugaagggcaugccaauccgcuaccagacuaccgccgucaaaagcgagcacaccggcaaggagaucguggaccucaugugucacgccacguucacuaugcggcugcuguccccgguaaggguccccaacuacaauaugaucauaauggaugaggcacauuucaccgacccaucguccauugcugcacguggguacauaagcacccgcgugggcaugggggaagccgccgccaucuucaugacggccacgccgccaggcuccguggaggccuucccgcagagcaacgccgucauccaagacgaggagcgggacauucccgagcgcuccuggaacucgggguacgaguggaucacugacuuccccggcaagaccgugugguuugugccuuccaucaagucaggcaacgacaucgccaacuguuuacggaaaaacgggaagcguguuauccagcuuucccggaaaacguucgauaccgaguaccagaagaccaagaacaacgacugggauuauguggucaccacggacaucagcgagaugggcgcaaacuuccgagcggaccgugucaucgauccgcgccggugcuuaaagccagugaucuuaaaggaugggcccgagcgcgugauccuggcggguccaaugccggucacaguggcgucugccgcgcaaagacgcgggcguauaggucgcaaccacaacaaggagggcgaucaguacaucuauauggggcagccccugaauaaugacgaggaccacgcccacuggaccgaggcaaagaugcuacuggacaauaucaauacccccgagggcaucauaccggcccuguucgagccagagcgcgaaaaguccgccgcgaucgacggugaauaccggcuucgcggcgaggcacgcaagaccuucgucgaguugaugcgcagaggggaccugcccguguggcuguccuacaaaguggccucggagggcuuccaauacagcgaccgccgguggugcuucgacggagagcggaacaaucagguccuggaagagaauauggacguggagauauggacgaaggagggggagcggaagaaacugcgaccccguuggcucgacgcgcgaaccuacagugacccacucgcccugcgggaguuuaaggaguucgccgcgggccgccggagcguguccggggaucucauccuggagaucggcaagcugccgcagcaccucacccagcgcgcccagaacgcccuggacaacuuagucaugcuccacaacagcgagcagggcgggcgagccuaccgccaugcgauggaggagcugccugacaccaucgagacccuaaugcuccuggcccugaucgccgucuuaaccggcggggugacccuguucuuccuguccggacggggucucggcaagaccaguaucggccuguuaugcguaauggccagcucuguguuguuauggauggcuuccguggagccacauuggaucgcggcaagcaucauccuggaguucuuccucauggucuuacucauaccugagccagaccgccagcggacgccccaggacaaccaguuggcuuacguuguuaucgggcugcuguucaugauucucacuguggcggccaacgaaaugggccugcuggagaccaccaaaaaggacuuagggauaggccacguggcgguggagaaccaccaccacgccgccaugcuggacguugaucugcaccccgcguccgcguggacgcucuacgcaguagcgaccaccaucaucacuccgaugaugcgccacacgaucgagaacaccaccgcuaacauuagccugacggccaucgccaaccaggcggccauucugauggggcucgacaagggcuggccuauauccaagauggacauuggcgugccacugcuggcuuugggaugcuauagccaagucaacccccuuacgcuuaccgcagccguccucaugcugguugcacacuacgccauaauaggcccuggccugcaagcaaaggcuacgcgcgaggcccagaagcggacugccgccgggaucaugaaaaacccaacggucgacggaaucguggcaauagaccucgaccccguggucuacgacgccaaguuugagaagcaacuagggcaaaucaugcugcucaucuuaugcacgucgcagauccugcucaugcgcaccaccugggcacugugugaaagcauuacgcuggccaccggcccacucaccacguuaugggaagggucuccgggcaaguuuuggaacacaaccauugccgugagcauggccaacaucuuuagaggguccuaccuggccggcgcgggcuuagccuucagccucaugaagagucuugggggcggccgccgggggacgggugcccagggcgagacucucggcgagaaguggaagcgccaacugaaucaguuguccaagagcgaguucaacaccuauaaacgauccgggaucauggaaguagacagaagcgaggccaaggagggccucaagcgcggggagaccaccaaguacgcagucucccgcgguaccgcgaagcugcggugguuuguggagcgcaaccuggucaagcccgaggggaaggucauugaccugggguguggccgcgggggcugguccuacuauugcgccgggcugaagaaggugacggaggucaagggcuacacaaagggcggucccggccacgaggagcccauuccgauggcuaccuacggguggaaccuagucaaguuacacucgggaaaagauguguuuuucgugccgcccgagaaaugcgacacccuccugugcgacaucggggaaagcagucccaacccgacgaucgaggaggggcgcacccugcgggucuuaaaaaugguggagccguggcugaggggaaaucaguucuguaucaagauccugaaucccuacaugccaagcguugucgagacccuggagcagaugcagcggaagcacgguggcaugcuagugcggaacccacugaguaggaacucgacccacgaaauguacuggguguccugcggcacaggcaacaucgucagcgccgugaacaugacgucaagaaugcuccuuaaccgcuucacuauggcgcacaggaaacccaccuacgagcgcgacguagaccuuggggccggcacgcgccacgucgccguagaaccagaaguggccaaccuggacaucauugggcagcgcaucgagaacauuaagcacgagcacaagagcacuuggcauuaugaugaggauaacccuuacaagaccugggcuuaccacgggaguuaugaggucaagccuagcggcuccgcaagcagcauggugaauggggucgugaaguuauugaccaaacccugggacgucauccccauggucacccagauagccaugacggacacgacccccuucggccagcagcggguauuuaaggaaaagguagacacucgcacgccgaaggccaagagagggaccgcgcaaaucauggagguuaccgcaaaauggcucuggggcuuucugucccgcaauaagaaaccccgaaucugcaccagggaggaguucacgcguaagguacgaucgaaugcggccauaggcgccguguuugucgacgagaaccaguggaacagcgccaaggaggcgguggaggacgaacgauuuugggauuuagugcacagagagcgggagcuacacaagcaggguaagugcgcaaccugcgucuacaacaugaugggcaagcgugagaagaagcugggugaguuugguaaggccaagggcagccgcgcaaucugguacauguggcuuggcgcccgcuuccucgaguucgaggcucugggcuuuaugaacgaagaucauugguucucccgggagaauagccuguccggaguagagggcgagggucuccacaagcugggcuacauccugcgcgauaucagcaagauccccgggggcaacauguacgccgaugacaccgcaggcugggacacccggaucacggaggaugaccuccagaacgaagcucgcaucaccgauaucauggagccggaacacgcgcugcuggccaaguccauauucaagcucaccuaucaaaacaaggugguccgcguucagaggccagccaagaacggaacugugauggacguaaucucuagacgggaccagcgcggcuccggucaggucgggacauacgggcugaauaccuucacuaacauggaagcccagcugauccggcagauggagucugaaggaaucuucucccccuccgaacucgagacccccaaccuggccgaacguguucuggacugguuagagaaguauggagucgaacgguuaaagcgcauggccaucuccggagaugacugcguggugaagccgauugacgacagauucgcgacggcccugaccgcccucaacgacaugggcaaaguccgcaaagacaucccccaaugggagcccagcaagggguggaacgauuggcagcaagucccauucugcucccaucauuuucaccagcugaucaugaaagacggccgggagaucgugguccccugccgcaaccaggacgaacuggucggccgcgcccgcgucagccagggggccggcuggagccuccgggagaccgcgugccuggggaagaguuacgcacaaauguggcagcuaauguacuuccaucgccgggaccuacgccuggcugccaaugcgaucugcagcgcuguccccgucgauuggaucccgaccucucguacgaccugguccauccaugcgcaccaucaguggaugaccaccgaggacauguuauccguguggaaccgcgucuggauugaggagaacccuuggauggaggacaagacccacaucagcuccugggaggacgugccguaccucgguaaacgcgaggaccaguggugcgggagccugaucggccugaccgcccgagcuacgugggccacaaacauccagguugcaaucaaccaagugcgucggcucaucggcaacgaaaauuaucuggacuacaugaccucaaugaaacgguucaagaacgagagcgacccagaaggggcccugugguga

SEQ ID NO: 24635 - RNA, 9879 nt, Artificial Sequence
  derived and/or modified CDS sequence (opt11) from DENV-1__JQ045652__SS-prME
agugugaccaugcugcugaugcuaaugcccaccgcccuggcauuccaccucaccacccggggcggcgagccgcacaugaucgugucuaagcaggagcguggaaagucgcugcuguucaagaccagcgccgggguaaacaugugcacccucauagccauggaccugggcgagcugugcgaggacacuaugacguacaagugcccccggauaaccgagacagagcccgaugacgucgacuguuggugcaacgcgacggacaccugggugaccuacgggaccugcagccagacgggcgagcaccggagggacaagcggucugucgcgcucgcgccccacgugggucugggguuagagacccgcaccgagaccuggaugagcuccgagggcgccuggaagcagauccagcgggucgagacgugggcccugcggcacccaggguucaccgugaucgcccuauuccuugcccacgccaucggcaccagcauuacccagaaggggaucauauucauccuccugaugcuggugacgcccucuauggccaugcggugcgucggcaucgggucccgcgacuuuguggaagggcucuccggcgccaccuggguggacguaguguuagagcacgggucaugcgugacaaccauggccaaggauaagcccacgcucgacauugaguuacugaagaccgaggucaccaaucccgccguguugcggaaacugugcaucgaggcuaaaaucuccaacacgaccaccgacucccgcugccccacccagggggaagccacucugguggaggaacaggacgccaacuucgucugucggaggaccuucgucgacagaggaugggggaacggauguggguuauucggcaaggggucccugauaacgugcgccaaguucaagugcgugacuaaguuggaggggaagaucguccaguacgagaaccucaaguauucagugaucgugacuguccacacaggugaucagcaccagguggguaacgaauccaccgagcacggcacuaccgccaccaucacuccccaagcgcccacaaccgagauucaacucaccgacuacggggcccugacucuggacuguagcccucgcaccggacucgacuucaacgaaaugguccugcugaccaugaaagagaaaaguuggcuggugcacaagcagugguuccuggaccugccacuccccuggaccagcggggccagcaccucccaggagaccuggaaccgucaggaucugcucgugaccuuuaagacagcccacgccaaaaagcaggaggucguggugcugggcagccaagagggcgcgaugcacacggcucuaacaggagcuaccgagauccagaccuccggcacgaccaccaucuuugccgggcaucugaaaugccgccugaagauggacaagcugacccugaaggggaugagcuacguaaugugcacggggucguucaagcucgagaaggagcuggccgagacccagcacggcaccgugcuggugcagaucaaguacgagggcaccgacgcgccgugcaaaauccccuuuagcacgcaggacgagaagggggucacccaaaacggccggcugaucacugccaacccgaucgugacugacaaggagaagcccgugaacaucgaggccgagccgccguuuggggaguccuacaucgugaucggcgccggcgagaaggcgcuaaagcuaagcugguucaaaaagggaagcagcaucggcaagauguucgaggccacggcccgcggugcccggcgcauggccauccugggggacaccgcaugggacuucggguccaucgguggcgucuucaccuccguggguaagcucguccaucaaaucuucggcacagcguauggggugcuguucucuggcguaagcuggaccaugaaaaucggaaucggcguccugcucaccuggcugggacugaacucccgcucuacgucccucagcaugaccugcaucgccguggggcuggugacgcuguauuugggcgucaugguacaggccgacuccgggugcgugaucaacuggaaaggcagagagcugaagugcgggagcggaauuuucgucacaaacgaggugcacaccuggacggagcaguacaaguuccaggcggacagcccgaagcgccucagugcggccaucggcaaggcaugggaggaggggguguguggcauccggagcgcgacacgccucgagaauaucauguggaagcaaaucuccaacgagcugaaccacauccuccucgagaacgacaugaaguucacggucguggugggggaugucgccggcauccuggcgcagggaaagaagaugauccgcccccagccgauggaguacaaauacucguggaaaagcuggggcaaggccaaaaucauuggcgccgacgugcagaacacgaccuucaucauagauggccccaacaccccggaaugucccgacgaucagagagccuggaacaucugggaaguggaggacuacggcuucgggaucuuuacgaccaacaucuggcugaagcucagggacagcuacacccaggucugcgaccaccggcugauguccgcggccaucaaggauagcaaggccgugcacgccgacaugggcuacuggaucgaguccgagaagaacgagacuuggaagcuggcccgcgcgagcuucaucgaggugaagacgugcauuuggcccaagucacacacacuaugguccaacggcguccuggaguccgagaugaucaucccuaagaucuacgggggcccgaucucccagcacaauuaccgccccggcuacuucacccagaccgccggccccuggcaccuggguaaguuggaguuagacuuugaccugugcgagggaacgaccguggugguagacgaacacugcggcaaucggggcccgucccuccgcaccaccacggugaccggcaagaucauccacgaguggugcugucggagcugcacccugccgccccugcgcuuccgcggggaggacggcugcugguacgggauggagauccgacccgugaaggagaaggaggagaaccuuguuaagucuauggugagcgccgguucgggagagguggacucauucucccuggggcugcucuguaucucuaucaugaucgaggaggucaugcggagccgcuggucccggaagaugcugaugacaggcacgcuggcagucuucuuccuccugaucauggggcagcugaccuggaacgaccucauccgucugugcaucauggugggcgccaacgcgagcgaccgcaugggcaugggcaccacuuaccuggcgcucauggccacguucaagaugcggccgauguucgccguuggcuuacuguuccgccgacucaccagucgcgaggugcugcuucucaccaucgggcucucgcugguggccuccgucgagcuccccaacagccuggaggagcugggcgacggcuuagcgaugggcaucaugauccugaaguuacucaccgacuuucagucccaccagcugugggccacgcuguuaagccugaccuucaucaagaccaccuucucccugcacuaugcguggaagacgauggccaugguccucucaaucguaucccuguucccacugugucucagcaccaccucccagaaaacaacguggcuucccgugcugcucggcagccuggggugcaagccgcugaccauguuccucaucgcggagaacaagauauggggcaggcguucauggccacugaacgaggguauaauggccguugguaucgucagcauccugcucuccucccugcuuaaaaacgacgugccucucgccgggccccugaucgccggaggcaugcucaucgccugcuacgucauuaguggauccagcgcggaccucucccuggaaaaggccgccgaggucaguugggaagaggaggccgagcacuccggggcuucucacaacauccugguggaggugcaggacgacgggaccaugaagauuaaggacgaggagagagacgacacccucaccaucuuacugaaggcgacguuacuagccgucagcggaguguauccgcuuagcauccccgccacgcucuucgugugguauuuuuggcagaagaagaaacagcgcucggggguucugugggacacccccagcccgcccgagguagagagagcgguguuagaugacggcaucuaccgcaucaugcagagaggccuucucgggcgcucccaggucggaguggggguguuccaggagaacguuuuccacaccauguggcaugugacgcggggcgccguucugauguaccaggggaaacgccuggagcccagcugggcuagugucaagaaagaucucaucuccuacggcggaggguggaggcugcagggcucguggaacaccggggaggagguccaggugaucgcugucgagccuggcaagaaccccaagaacgugcagacggcccccgggaccuucaaaacgccagagggcgaggugggcgccaucgcccuggauuuuaagcccgggacgaguggcagccccaucgucaaccgcgagggaaaaaucgugggccucuacggcaaugggguggucaccacgagcggaacguacgugagcgcuaucgcccaggcgaaggccucucaggaggggccgcugcccgagaucgaagacgaaguguuucgaaagcgcaaccugaccaucauggaccugcaccccggcagcgguaagacucgccgcuaccugcccgcgaucguccgggaagccaucaagcgcaagcuuagaacguugauccuugcgcccacgcgggucguggccagugagauggccgaggcucugaagggcaugcccauccgauaccagaccacugccgucaagagcgagcacaccggcaaggagaucguggaccuaaugugccaugccacguuuaccaugcgccugcugucacccguacgagucccuaacuacaacaugaucauuauggacgaggcccacuucaccgaccccagcuccaucgccgcucggggauacaucagcacucgcgugggcaugggggaggccgccgcaaucuucaugacggccacgccccccggcaguguagaggccuucccgcagagcaacgccgucauucaggacgaggagcgggacauccccgagcgcuccuggaauagcggguacgaauggauaaccgauuuucccggcaaaacggugugguucgugccauccauuaagaguggcaacgacaucgcgaauugucuccguaagaacgggaagcgcgucauucagcugucccguaagacguucgacaccgaguaccagaagaccaagaacaacgacugggacuacgugguuacaacggacaucucugagaugggcgcuaacuuucgcgcggacagggucaucgacccgcgccggugccugaagccagugauccugaaggacgggcccgagcgcguaauccuugccgggcccaugccggucacgguggccuccgcugcccaacggcgcgggagaaucggccgcaaccacaacaaagagggcgaccaguacauuuacaugggucagccccugaacaacgacgaagaccacgcgcacuggaccgaggccaagauguuacuggacaacaucaacacaccagagggcaucaucccagcccuguucgagccggaacgcgagaaguccgccgccaucgacggggaguaccgacuccgcggcgaggcgcggaagacguucguagaacugaugcgccgcggagaccuccccguguggcucuccuacaagguggcgagcgagggcuuccaguacuccgaccgccgcuggugcuucgacggugagcgaaacaaccaggucuuagaggaaaacauggacguagagaucuggaccaaggagggggagcggaaaaagcugcgcccccgcuggcucgacgcccgcaccuacucagaccccuuagcccugcgcgaguucaaagaauucgccgccggccgccggagcguguccggggaccugauccuggagauaggcaagcugccgcagcaccucacccagcgggcccagaaugcccuggacaaccucgucaugcuccacaacagcgagcagggcgggcgggcguaccgccacgccauggaggagcugcccgacacgauagagacgcugaugcuccuggcccugaucgccgugcucaccggaggugugacccuguucuuucuauccggacgggggcucggaaagacaagcaucggccugcuaugcguuauggccuccagcgugcucuuauggauggccucuguggagccccacuggaucgcggccagcaucauccuggaguucuuucuaaugguacuguuaaucccagagccugaucgucagcggacgccacaggacaaccagcucgccuauguggugaucggucugcuguucaugauccucaccgucgccgcaaacgagaugggccuacuggagaccacuaaaaaggaccucggcauuggccacguggcgguggagaaccaccaccacgcagccaugcuggacgucgaccugcauccggccuccgccuggacgcucuacgcuguggccacgaccaucaucaccccgaugaugcgccacacgaucgagaacaccaccgccaacaucagccugaccgccaucgccaaccaggcagcgauccugaugggguuagacaagggguggccaaucuccaaaauggacaucggcgucccccugcuggcccucgggugcuauagccaggucaacccacugacucugacugccgcggugcucauguuaguggcccacuacgccaucaucggcccggggcugcaggccaaagcgacccgcgaggcgcaaaagcggaccgccgccggcaucaugaagaaucccacggucgacgggaucguggcuaucgaccucgaccccguggucuacgacgcuaaguuugagaagcagcugggccagaucaugcugcucauccugugcaccucccaaauccugcugaugcggaccaccugggcgcugugcgaaagcauuacgcuggccaccggcccccucaccacccuuugggagggcuccccgggcaaguuuuggaacacgaccauugccgugagcauggccaacaucuuccgggggucguaccuggccggcgcgggccucgccuucucgcugaugaagucccuagggggcggucggcgcgggacaggggcccagggcgagacccucggcgaaaaguggaagcgacaauugaaccagcuguccaagagcgaguuuaacacguacaagcgguccgggaucauggagguggacagaagcgaggccaaagaaggccucaagcgcggggagacaacaaaauacgcgguaucccgcggaaccgccaagcugcgaugguucguggagcgcaaucuggugaaacccgaggggaagguuaucgaccugggcugcggccgcggggguuggagcuacuacugcgcuggacucaagaagguaacggaggugaagggcuacacgaagggcggcccaggccacgaggagcccaucccgauggccaccuacggguggaaccuggucaagcugcacuccgguaaggacguguuuuucgugccgcccgagaagugcgacacccuguugugcgacauuggggagucuucccccaacccgacgauugaggagggccgcacccugcguguccucaagaugguggagcccuggcuucgcgggaaucaguucugcaucaagauccugaaccccuauaugcccagcguggucgagacacucgagcagaugcagcggaagcauggcggcaugcuggugcgcaacccgcugucucggaacagcacccaugagauguacuggguauccugugggaccgguaacaucgucagcgccgugaacaugacgagccgcaugcuccugaaccgauuuaccauggcgcaccggaagcccacuuacgagcgcgacguggaccugggggcuggcacccggcacgucgccguggagcccgaggucgccaaccucgacaucaucggccagcgcauagagaacaucaagcacgagcauaagagcacguggcauuacgacgaagacaacccguacaagaccugggccuaccacggguccuacgagguaaagccuagcgggagcgcgagcagcauggugaacggugucgugaagcugcugaccaagcccugggacgugaucccgauggucacccagaucgccaugacggacaccacccccuucggucagcagagaguguucaaggagaagguggacacccgcacgccgaaggccaagcgcggaaccgcccagauuauggaggucaccgcgaagugguuauggggcuuccugucccgcaacaagaagcccaggaucugcacucgcgaggaguuuacgcggaaggugcgcagcaacgcugccaucggcgcgguguucguugacgagaaucaguggaacagugccaaggaggcaguggaggacgaacgguuuugggaccuggugcacagggagcgggagcuacacaagcaggggaagugcgccacuugcgucuacaacaugaugggcaagcgugagaagaagcugggagaguuuggcaaggccaaggggagccgggccaucugguacaugugguugggagcucgcuuccuggaguuugaggcgcugggcuucaugaaugaggaccacugguucucccgugaaaacagccuguccgggguggagggcgagggccugcacaagcugggcuacauucugcgcgacauuucaaaaauccccgggggcaacauguacgccgacgacaccgccggcugggacacccggauuacggaagacgaucuccaaaacgaagcucgcauaacugacaucauggagccugaacacgcccuguuggcuaaguccaucuucaagcucaccuaucagaauaaggugguccgggugcagcggcccgccaagaacgggacugugauggacgucauuagccgccgugaccagcgcggcuccggccagguagggacguacggccugaauacguucaccaacauggaggcccagcugauucgucagauggaaucagaggggaucuucucgcccagcgaacucgagaccccaaaucuggccgaacgugugcuagacuggcucgagaaguacggcgucgagcggcugaagcgcauggccaucucgggggacgacugcguggugaaaccgaucgacgaccgguucgcgacggcacugacggcucucaacgacaugggcaagguccguaaggacaucccccagugggagcccagcaagggguggaacgauuggcaacaagugcccuucugcucccaccacuuccaucaguugaucaugaaggauggacgggagaucguggugccgugccggaaccaggacgagcugguugggcgggcccgcgugagccaaggggccggcuggagccuccgggagaccgcgugucugggcaaguccuacgcccagauguggcaacugauguacuuccaucgccgggaccuccgccuggcagccaacgcgaucugcagcgccgucccgguagacuggauccccaccucccggaccaccuggagcauccacgcccaccaccaguggaugaccaccgaggacaugcugucuguguggaauagggucuggaucgaggagaaccccuggauggaggacaagacgcacaucagcuccuggggcgacguaccauacuuagggaagcgcgaggaccaguggugcggcagccugaucgggcugacggcccgugcgaccugggcgaccaauauccaaguggccaucaaccagguccgccggcuaaucgggaaugagaacuaccuggacuacaugaccuccaugaagcgcuucaagaacgaaagugacccagagggcgcccugugguga

SEQ ID NO: 24636 - RNA, 9879 nt, Artificial Sequence
  derived and/or modified CDS sequence (opt11) from DENV-1__JQ045653__SS-prME
agcgucaccaugcugcugaugcuaaugcccaccgcccuggccuuccacuuaaccacacgcggcggggaaccccacaugaucgugagcaagcaggagcggggaaagagcuuguuguucaagaccagcgcuggggugaacaugugcacccucaucgcuauggaccuaggagagcuaugcgaggacaccaugaccuacaagugcccccggauaaccgagaccgagcccgacgauguggacugcugguguaaugccacagacaccugggugaccuaugggacaugcagccaaacaggagagcaccggcgcgacaaacgguccguggcuuuggcgccgcacguggggcugggacuggagacccggacggagaccuggaugagcuccgagggcgccuggaagcagauccagcgcgucgagacgugggcccugcgccaccccggguucaccgugaucgcgcuguuccuggcccacgcgaucggcacaagcauuacccagaaggggauaaucuuuauccuccugaugcuggugacacccuccauggcaaugcggugcgucggcaucggaagcagggacuuuguggaggggcucuccggcgccacguggguggacgucguccuggagcacgggagcugcguaaccaccauggcuaaggacaagccaacacuggacaucgaguugcugaagaccgaagucacgaaucccgccgugcugcggaagcuaugcaucgaagcgaagauuucuaacaccacgaccgauagccgcugcccgacgcagggcgaggcaacccugguggaggaacaagacgccaacuucgucugccggcgcacgcuaguggaccggggcugggggaacggcugcggucucuucggcaaggggucccugauuacgugcgccaaguucaagugcgugaccaagcuugaggggaagaucguccaguacgagaaccucaaguacucuguuaucgugaccguccacacgggcgaccagcaccaggucgggaacgagucuaccgaacacggcacuacugcuaccauaacgccccaggcgcccaccaccgagauccagcugaccgacuacggcgcccugacguuggacugcucuccccgcacgggccuagacuucaacgagaugguccuucucacaaugaaggagaaguccuggcugguucacaagcaaugguuccuggaccucccccugcccuggaccagcggggccagcacgucccaggagaccuggaaucggcaggaccugcucgucaccuuuaaaaccgcccacgccaagaagcaggaggucguagugcugggcagucaggagggcgcgaugcauacggcccugacgggagccaccgagauacaaaccaguggcacgaccaccaucuuugccgggcaucucaagugccggcugaagauggacaagcugacccucaagggcauguccuacgucaugugcacgggguccuucaagcuggagaaggagcuggcugagacccagcacggcaccgugcuggugcagaucaaguacgaaggcaccgacgcgcccugcaaaauacccuucuccacccaggacgagaagggugucacccaaaacggccggcucaucaccgcaaauccuaucgugaccgacaaagagaagcccgugaacaucgaggccgagccgcccuucggggaaaguuacauugugaucggcgccggcgagaaggcgcugaagcugagcugguucaaaaagggguccagcaucggcaagauguucgaggcuacggcacgcggggcccgccgcauggccauccucggcgauacugcgugggacuucgguucgaucggcggcguguucacgagcguggggaagcuggugcaccagaucuucggcacggccuacggggucuuguucuccggcgugagcuggacgaugaagauugggauaggcguccuccugaccugguugggccucaauuccagaucuaccucccugaguaugaccuguaucgccgugggucuggugacacuguaccugggcgucaugguccaggccgacuccggaugcgugaucaacuggaagggccgggaguuaaaaugcgggagcggcaucuucgucaccaacgaggugcauacuuggacggaacaguauaaguuccaggccgacagcccgaagcgccucucagcggccauugguaaggccugggaggaggggguaugcggaauccggagcgccacccgccuggaaaacaucauguggaaacagaucagcaacgagcuuaaccacauccuccucgagaacgacaugaaguucacagucguggugggcgauguggcuggcauacuggcgcaggggaagaagaugauccggccccagcccauggaguacaaguacagcuggaaguccuggggaaaggccaagaucaucggcgccgacgugcagaacacuaccuucaucaucgacgggccgaacaccccggaaugccccgacgaccagcgggccuggaauaucugggagguggaggacuacggcuucgggaucuucacgaccaacaucuggcucaaguugcgagauagcuacacccaggucugugaccaccggcugaugucggcggcgaucaaagacagcaaggccgugcaugcugacaugggcuauuggauagaguccgagaagaacgagacauggaagcucgcccgggcgagcuucauagaagugaagacaugcaucuggccccgcagucacacccugugguccaacggcguccuggagagcgagaugaucauccccaaaaucuacgggggcccuauaagccagcacaacuaccggcccggguauuucacccagaccgcggggcccuggcaccucgggaagcuggagcuggauuucgaucuaugcgagggaaccacgguaguggucgacgagcauugugguaaccgcggcccgucucugcgcaccaccaccgugaccggcaaaauuauucacgaaugguguugcaggagcuguacccugccgccgcugcgguuccgcggggaggacggcugcugguacgguauggagauccggcccgugaaagagaaggaagagaaucuggucaaguccaugguaagcgccggcagcggagaggucgacucuuucagccuggggcuccuguguauuuccaucaugaucgaggaggucaugaggagccgguggagcaagaagaugcugaugacuggcacgcucgcggucuucuuccuacuaaucauggggcagcucaccuggaaugaccugauccgccugugcauaauggugggggccaaugcgagcgaccggaugggaauggggaccaccuaucucgcacugauggccacguucaagaugcggccgauguucgccgugggguugcucuuccgcagacugaccucccgagaggugcugcuacugaccaucgggcugagccucguggccuccgucgagcuccccaauucuuuggaggagcuaggcgacgggcuggcuauggguaucaugauucugaaguugcugacugacuuucagucccaccagcugugggccacgcuccugucgcugaccuuuaucaagacaacuuuuagucuccauugcgccuggaagacaauggcgaugauccuuagcaucgugucuuuauucccccucugccugaguaccaccucccagaagaccacguggcugcccgucuugcuaggaagccuggggugcaaaccguugaccauguuccugaucgcggagaacaagaucuggggccggcgcuccuggccccugaacgaagggauaauggccguaggcaucgugucaauucuacugagcuccuugcucaagaaugauguuccccuggcggggccgcugauugccggcgggaugcucaucgccuguuacgucauaagcggguccagcgcugaucugagucuggagaaagcggccgaggugagcugggaagaggaagccgaacacuccggcgcgagccacaacauccucgucgaggugcaggacgacgguacaaugaagaucaaggacgaggaacgggacgacacccugaccauccugcucaaggcgacgcuacuggcgguguccggcgucuacccgcucagcaucccugcuacgcuguuugugugguauuucuggcagaagaaaaagcagcgcuccggggugcucugggacacccccagcccgcccgaggucgagcgugccgugcuggaugauggaaucuaccgcaucaugcagcgcggacuccuggggcgcucccaggugggcguagggguguuccaagaggacguguuucacacgauguggcaugucacacggggcgccgugcugauguaccaagggaagcgccucgagccaagcugggcgagcgucaagaaagaccugaucagcuauggcggcggguggcgguugcagggcuccuggaacaccggugaagagguccaggugaucgccguggaaccuggcaagaacccgaagaacguccaaaccgccccggggacauucaagacgccagaaggagaggugggggccaucgcgcucgauuucaagcccgggacuucuggguccccgaucgucaaucgcgagggcaagaucgugggcuuguacggcaauggaguggugaccaccagcggcacguacguaagcgcaaucgcccaggccaaggccucccaggaagggccgcuccccgagauagaggacgaggucuuucguaaacgcaaucucaccaucauggaccugcacccaggcagugggaagacgcggcgcuaccugcccgcgaucgugcgggaggcuaucaagcgcaagcuccguacccugauuuuggcccccacuagagucguggccagugagauggccgaggcgcucaaggguaugcccauccgcuaccagaccaccgccgucaaaagcgaacacaccggcaaggagaucgucgaccugaugugccacgccacguucaccaugcgccugcucucccccgugcgcgugccgaacuauaacaugaucaucauggacgaggcucauuucaccgaccccagcuccauugccgcucggggguacaucagcacccgcgucggaaugggcgaggccgccgccaucuucaugacggccacaccgcccggcuccguggaggcauucccgcaaagcaacgccgugauucaggacgaggagcgagacauccccgagcgcuccuggaacucuggauacgaguggaucaccgauuucccagggaagaccgucugguucgugccgucuaucaagagcggaaacgacaucgccaacugucugcggaagaacgggaagcgcguaauucagcugagucggaaaacuuucgacaccgaguaccaaaagacaaagaacaacgacugggacuacguagugaccacggacauaagcgaaaugggugccaauuuuagagcggaccggguuaucgauccgcgccggugccucaagcccgucauccugaaggacgggcccgagagaguuauacuggcgggcccuaugccaguuaccgucgccuccgccgcacaacggcgcgggcggaucgguagaaaccacaacaaggagggcgaccaguauauuuacauggggcagcccuugaacaacgaugaagaccacgcgcauuggacggaagccaagauguugcuagacaacaucaacacccccgagggcauaauccccgcccucuucgagccggagcgcgagaaauccgccgcaauagacggggaguaucggcugcgaggagaagcgagaaagacguuuguggagcugaugcgccgcggggacuuacccgucuggcuguccuacaagguggccagcgagggcuuccaguauagugaccgccgguggugcuuugacggcgagagaaacaaccaggugcuggaagagaacauggauguggagaucuggacgaaggagggagaacggaagaagcuccgccccagauggcuugacgccagaaccuacuccgacccacuggcccuucgggaguucaaagaguucgccgccggccgccggagcgugucgggagaucucauccuggagauuggcaaacuuccgcagcaccugacccagcgcgcccagaacgcccuggacaaccucgugaugcugcacaauucugagcaaggcgggagagcauaucgccacgcgauggaagagcugccagauacaauugagacuuugaugcugcuggcccucaucgccguccugaccggcggggugaccuuauucuuccucuccggacgcggacugggaaagaccagcauaggccuguugugcgugauggccuccagcguccugcuguggauggcuucaguggagccucauuggaucgcggccagcauaauauuagaguucuuccuaauggugcugcucauacccgagccggaucgccagcgaacgccgcaggacaaccagcuggccuacgucguuaucgggcucuuauuuaugauccugaccguggccgcaaaugagaugggcuugcucgagaccaccaaaaaggaccuggggauaggccacguggcgguggagaaccaucaucaugccgccaugcuggauguagaccuccaucccgcauccgcuuggacgcucuacgcggucgcuaccacuauuaucaccccuaugaugcggcacacaaucgagaauacgacggcaaacauuucccugaccgcaauagcgaaccaggcggccauccucauggggcuggacaagggcuggcccaucagcaagauggacauaggcguaccccuacucgccuuaggcugcuacagccaagucaacccgcugacgcucaccgcugcuguccugaugcuaguggcccacuacgcgaucauaggcccggggcuccaggccaaggccaccagggaggcgcagaagcguaccgccgcugggauuaugaaaaaccccacgguugacgguaucgucgccaucgaccuggaccccgucguguacgacgcuaaguucgagaagcagcuagggcagaucaugcuccugauccuguguaccucgcagauccuccugaugcgcaccaccugggcgcugugcgagucaaucacgcucgccaccgggccccugaccacccugugggagggguccccgggcaaauucuggaacacgacgauugccguuaguauggccaacaucuuccggggguccuaucuugcgggugcaggccuggccuucagccugaugaagagucucgguggcggccggcggggcaccggggcucaaggcgaaacacugggcgagaaguggaaacgccagcugaaccagcucaguaagucggaguucaacaccuacaaacgauccgguaucauggagguggaucgcagcgaggccaaagagggccucaagcgcggcgaaaccaccaagcaugcggucucccgcggcacagccaaacugcgaugguucguugagagaaacuugguaaagcccgaggggaaggugaucgaucucggcugcggccguggugguuggagcuacuacugcgccggauuaaaaaaggucacggaggugaagggguacacuaaaggcgguccggggcacgaggagcccauaccuauggcuaccuacgguuggaaccuggugaagcuccacuccggcaaagacguauucuuuaucccuccagaaaagugcgacacccugcuaugcgacaucggggagucaucgccgaacccgacaaucgaggaggggcgcacccugcgggugcugaaaaugguggagcccuggcugcgagggaaccaguucugcaucaagauccucaacccguacaugccgagcgucguggagacccuugagcagaugcagcgaaagcacggcggcaugcugguacgcaauccgcucucccguaacagcacccacgagauguacugggucuccugugggacgggcaacaucgucagcgccgugaauaugacgucacgcaugcuccuaaaucgcuucacaauggcucacaggaagccuacauacgaaagggacguugaccucggagccggcacccggcacguggccguggagccugagguugccaaccuggacaucauaggccagcgcaucgagaacaucaagcacgaacacaagucaaccuggcacuacgacgaggacaaccccuacaagaccugggcuuaccacgguuccuacgaggugaagcccagcggauccgcgagcuccauggugaacggugucgucaagcuacucaccaagcccugggacgucauccccaugguaacccagaucgccaugacugauaccacccccuucggccaacagcggguguuuaaggaaaaggucgacacgcgcacgccgaaggccaagcggggaaccgcccaaaucauggaggugaccgccaaguggcucugggguuuccugucccgcaauaagaagccccguaucugcacccgcgaggaguucacgcggaaggugcgcagcaacgcggcgauuggagccgucuucguggacgagaaccaguggaacuccgcaaaagaggcgguugaggacgagcgguuuugggaccucguccaccgggagcgggagcugcacaaacagggaaagugcgcgaccugcguauacaacaugaugggcaagcgcgaaaagaagcugggggaguucggcaaggccaaggggagccgcgcgaucugguacauguggcucggcgcacgcuuucuggaguucgaggcgcugggcuucaugaaugaggaccacugguuuucccgggagaacagucucuccgguguggaaggcgagggccugcacaagcugggcuauauccuccgcgacaucagcaaaauccccgggggcaauauguaugcggacgacaccgcaggcugggacacacggaucacggaggacgaucugcaaaacgaagccagaaucacggauaucauggagcccgagcacgcccuguuagcgaaauccaucuucaagcuaaccuaccagaacaaggucgugcgcguacagcgccccgccaagaacgggaccgucauggacguaauaagccgcagggaccagcgcggcuccggccagguggguacguacggucugaacaccuucaccaacauggaggcccagcucauccgacagauggaguccgaggguaucuucucccccucugagcucgagacccccaaccucgccgaacgcguccucgacugguuagagaaguauggaguggaacggcugaagcggauggccaucuccggagacgacugcguagucaagccgaucgaugacagguucgcgacggcccucaccgccuuaaaugacauggguaaggugcgcaaggauaucccccagugggagcccaguaagggguggaaugacuggcagcaagucccauuuugcagccaccacuuccaucagcugauuaugaaggacggacgggaaauaguuguaccgugucgcaaccaggacgaauuggugggccgggcacgcgucagccagggggccggcuggagcuuacgggagaccgcgugccuugggaaauccuacgcccagauguggcagcucauguacuuccaccgacgcgaccugcgccuggcggcaaacgcgaucugcagcgcagugcccguugacuggaucccgaccuccaggaccaccuggagcauacacgcccaccaccaauggaugacaaccgaggacauguugagugucuggaaccgcguauggaucgaggagaauccguggauggaagacaagacccacauuagcuccuggggcgacgugcccuaccuagggaagcgcgaggaccaguggugcggaagccugaucggccucacugcacgagccacgugggcgaccaacauacagguugccaucaaucaggugcgccggcugauagggaacgagaacuaccuugacuacaugaccuccaugaaacgcuucaagaacgaguccgaccccgagggcgcccucugguga

SEQ ID NO: 24637 - RNA, 9879 nt, Artificial Sequence
  derived and/or modified CDS sequence (opt11) from DENV-1__JQ045657__SS-prME
ucuguaaccaugcugcucaugcugaugccuaccgcccuggccuuccaccucacaacccggggcggggaaccgcacaugaucguauccaagcaggaacggggcaagagccugcuguucaagacgagcgcggggguuaauaugugcacccucaucgccauggaucugggugaguucugcgaagacacgaugacauacaaguguccccgcaucaccgaagcggaaccagacgacguggauugcugguguaacgccacugacacgugggugaccuacgggacgugcagccagacuggcgagcaccggcgggacaagcggagcguagcccucgcgccccacguggggcuugggcuggagacgcgcacugagaccuggaugagcuccgagggcgcauggaagcagauccaaagaguggagaccugggcccugcgccaccccggauucacggugaucgcacucuuccuggcucaugcuaucggcaccagcaucacccagaaggggaucaucuucauccugcucaugcuggucacgcccuccauggccaugcggugcguaggcauaggcagccgagacuucguggaggggcuguccggagcgaccugggucgaugucgugcuagagcacggaagcuguguuaccacgauggcaaaggacaagcccacgcuggauaucgagcugcucaagacagaggucacgaaccccgccgugcugcgcaagcugugcaucgaggccaagaucuccaacaccacgacggacagccgcugccccacccagggcgaggcuacccucguggaggagcaggacgccaacuucgucugccggcgcacuuucguugacagaggcuggggaaacggcugcggccuauucgggaagggaagucugauaaccugcgccaaguucaagugcgugacgaaacucgagggcaagauuguccaguacgagaaccugaaguacagcgugaucguaacaguccacacaggcgaccagcaccagguaggaaacgaguccacagagcacggaaccacugccaccaucacgccccaggcccccagcaccgagauacaguuaaccgauuacggggcccucacacuggacuguuccccgcgaacuggcuuagacuucaacgagaugguccuccugacgaugaaggagaagucguggcuagugcacaagcaaugguuuuuagaccugccgcugccguggaccagcggggcaucaaccagccaagagacguggaaccggaaggaucuccuggucacguucaaaacugcgcacgccaaaaagcaggaagugguaguccuggguucccaggagggcgcaaugcauacggcccuuaccggggccacggagauccagacuuccggcaccacuacgauuuucgcagggcaccugaagugccgccugaagauggauaagcucacucugaaggggauguccuacgucaugugcaccggcucuuucaagcuggagaaggagguggcugagacccagcaugggacggugcucguccagauuaaguacgagggcaccgacgcccccugcaagaucccuuucuccacccaggacgaaaagggggucacccagaacggccgccuuauuacagcuaauccgauuguuacggacaaagagaaacccguuaacaucgaggcagagccgcccuucggggagucauauaucgugaucggagcgggcgagaaggcccugaaacuuuccugguucaagaaggggucauccaucggcaaaauguucgaggccaccgcgcguggggcccggcgcauggcgauccucggugacaccgccugggacuucggcucaaucggcgguguguucacguccgucgggaagcuggugcaccaaaucuucgggaccgccuacggcgugcuguucagcggcgucuccuggacuaugaaaaucgggaucggcguacuccucacguggcuggggcucaacucacgcuccacgucgcuauccaugacuugcaucgccgugggucuggucacccucuaccuuggcgugauggugcaggccgauagcgggugcgucaucaacuggaagggccgggagcugaaaugcgggagcggcaucuucgugaccaacgagguacacacguggaccgaacaguauaaauuccaggcugacuccccgaagcgccucagcgcagccauaggcaaggccugggaggagggggucugcggcauccgguccaccacaaggcuggagaauaucauguggaagcagaucagcaacgaacugaaccacauccuccuggagaacgacaugaaguucaccguaguggucggggacguggccggcauccuggcgcaggggaagaagaugauccggccccagcccauggaguacaaguacuccuggaaaagcuggggcaaggccaagaucaucggcgccgacgugcagaacacgaccuucaucauagacggacccaacaccccugagugcccggacgaccagcgcgccuggaacauuugggaggucgaggacuacggcuucgggaucuucaccacgaacaucuggcucaagcugcgggacucauacacccaaguuugcgaccaucgccugaugagcgcggccaucaaggacucuaaagccgugcaugccgacaugggcuacuggaucgaaagugagaagaaugagaccuggaagcucgcucgggcguccuucaucgaggucaagacgugcaucuggcccaagagccacacguuaugguccaacggcgugcuggagagcgagaugaucauccccaagaucuacgggggcccgaucucgcagcauaacuacagacccggguacuucacccagaccgccggccccuggcaccucgggaagcuggagcuggacuucgaccucugcgaaggaaccacggugguaguggacgaacacugcggcaaccgggggccgagccugcgcaccaccaccguuacuggcaagauaauccacgaguggugcugccggagcugcaccuuaccgccccugcgcuucaagggagaggacgguugcugguacgggauggagauccgacccgugaaggagaaggaggagaaccucgucaagagcauggugagcgcuggcuccggcgaggucgacagcuucagucugggacuccugugcaucagcaucaugaucgaggaggugaugcgcagccgguggagccgcaagaugcugaugaccggcaccuuggccguguucuuucugcugaucaugggacagcucacuuggaacgaccugauacgcuuaugcaucauggucggggccaaugcauccgaccgcaugggaaugggcaccaccuaccucgcccugauggcuaccuucaagaugagaccgauguucgccguaggacuccuguuccggcgccucacgagccgggagguacugcuccugaccauugguuugucccucgucgccagcguggagcugcccaacucccuggaggaacucggcgacggguuggcuaugggcaucaugauccugaagcuccuuaccgauuuccaaucucaccagcuaugggccacucuccugucgcuaacguuuauuaagacaacauucucgcuccacuaugccuggaagacaauggccaugguacuuagcauugugagccuguucccucucugccuguccacgaccagccagaagaccacaugguugcccguccuucugggcucccugggguguaagccgcucaccauguuccugaucgcugagaacaaaaucuggggacgcaagagcuggccccugaacgagggcaucauggccgucgggaucgugucaaucuugcuguccagucugcuaaagaacgacgugcccuuagccggaccccugaucgccggcggcaugcugaucgccugcuacgucaucuccgggucguccgcggaccucagccuggagaaggccgccgagguguccugggaagaggaagccgagcauagcggcgcaucccacaacauccucguggagguccaggacgacggaacaaugaagaucaaggacgaggagcgggacgauacccugacaauccugcucaaggcgacucucuuagcuguauccggcguguacccgcucuccauccccgcuacgcuauucgucugguacuucuggcagaagaagaagcagcgcagcggggugcugugggauacccccagucccccugagguggagcgggccguccucgacgacggcaucuaucgcauaaugcagcggggccuuuuggggcgcagccaagugggcgugggugucuuccaggagaacgucuuccacaccauguggcauguuacucgaggcgccguccugauguaccaggggaagcgccuugagcccagcugggcaagcgugaaaaaggaucugaucuccuacgguggcggguggcggcugcaaggaagcuggaacacaggcgaggaggugcaggucaucgccguagagccgggcaagaaccccaagaacgugcagaccgcgcccggaaccuuuaagaccagcgaaggcgaagucggcgccaucgccuuggacuucaagcccgguacgagcggcucaccgaucgugaaccgggaggggaagauuguuggacuguacggaaaugggguagugacuaccucgggcaccuacgugagcgcgaucgcccaagccaaggccucccaggaggguccucucccagagauagaggacgagguguuccggaagcgcaaccugacgauuauggaccugcaucccggcagcgggaagacccgccgcuaccugcccgcgaucgugcgggaggcuaucaagcgaaagcuccggacccucauccuggcccccacccgcguggucgcguccgagauggcugaggcgcucaagggcaugccuauuagauaccagacgaccgccgucaagagcgaacacaccggcaaggagaucguugaccuaaugugccacgcaacguucacgaugcggcugcugucccccguccgcguccccaauuacaacaugaucaucauggacgaggcccacuucaccgacccuagcucgaucgccgcgcggggguacaucagcacccgaguggggaugggggaggccgccgccaucuucaugaccgccacgccgcccggcucggucgaggcguucccccagagcaacgcgguuauccaagaugaggaaagggacaucccugaacgcuccuggaacuccggguaugaguggaucaccgacuuucccggcaagacugugugguucguccccuccauaaagagcggcaaugacauugcuaacugccugaggaagaacgggaagcgcgugauccagcuguccagaaagaccuucgacacagaguaccaaaagaccaagaacaacgacugggauuauguugucacaaccgacaucucagagaugggcgcaaacuuucgcgcagaccgugugauugacccccgucgaugucucaagccggugauacugaaggaugggccggagcgcguaauccuggccggacccaugccugugaccgucgccuccgccgcgcagcggcgcggaagaaucggccgcaaccacaacaaggagggugaccaguauauuuacaugggccagccgcugaauaaugacgaggaccaugcgcauuggacagaggcaaagaugcugcuggauaacaucaacacgcccgagggcaucauccccgcucucuucgagccagaacgggagaagucggccgccaucgauggggaguaccgccuucgcggcgaggcgcggaagaccuucgucgagcugaugcggcgcggggaccucccggugugguuaagcuacaaggucgcgucugagggcuuccaguacucugaucgccgguggugcuucgacggugagcgcaacaaccaggugcuggaagagaacauggauguggagaucuggacgaaggagggggaacggaaaaagcuccguccccgguggcuagacgcccgaacauacuccgacccccuagcacuccgcgaguucaaagaguucgcggcggggcgccggagcguauccggcgaccugauccuggagauaggcaagcucccacagcaccugacccagagagcccagaaugcccuggacaaccucgugaugcugcacaacagcgagcaaggagggcgggccuaucgccaugcgauggaggaguugccggacaccaucgagacgcugaugcugcuggcccucauugccgugcugacgggcggggucacccuguucuuccuuucgggccgggggcugggcaaaacgagcaucggucugcucugcgugauggccuccagcgugcuguuguggauggccuccgucgagccacauuggauagcugccagcaucauccuugaguucuucuuaauggugcuacucauacccgagcccgaccgccagcggaccccgcaggauaaccaacuggcuuacguggucaucgggcuccucuucaugauacugacgguggcugccaacgagaugggccuguuggagacgaccaagaaggaccugggcauuggccacguggcggcagagaaucaccaucaugccgccaugcuggacgucgaccugcaccccgccuccgcuuggaccuuguacgcuguggcuacaaccaucaucacccccaugaugcgacauacaauugaaaacacgacagcgaacauuagcuuaaccgcgauugcuaaccaggccgcgauacucauggguuuagacaaggguuggccgaucagcaagauggacaucggaguuccccugcuagcacuggggugcuauagucaggucaacccucugacccuaacugcggcggugcuaaugcuaguggcccacuacgccauuaucggccccgggcuccaagccaaggcgacccgggaggcccagaagcggaccgccgccggcaucaugaagaaccccaccguugacgggaucguggcgaucgaucuggaucccguggucuacgacgcuaaguucgagaagcagcuuggacagaucaugcuucuuauucugugcaccucccagauccuccugaugcgcaccacuugggccuuaugcgagagcaucacccucgccacggguccccugaccaccuugugggaggguucccccggcaaguucuggaacaccacgaucgccguuagcauggcaaacaucuuccgggggagcuaccucgcgggcgcuggcuuagcguuuucccugaugaaaucgcuaggcggcggccgccggggcaccggcgcacagggcgagacacugggcgagaaauggaagcgacaguugaaccagcucaguaagagcgaguuuaacaccuacaagcgguccggcaucauggagguagaccgcagcgaggcgaaggaaggccuuaaacgcggggagacgaccaagcacgcggucucgcgcggcaccgcuaagcugcggugguucgucgagcguaaccucgugaaacccgaggggaaggucaucgacuugggaugcggucgcggcggguggagcuauuauugcgccgggcugaagaaggugaccgaggugaagggguacacgaagggugggcccggccacgaggagcccauccccauggccacauacggguggaaccuggucaaguugcacucuggcaaggauguguucuucguuccgcccgagaagugugacacccugcuuugcgacaucggggagucuucccccaaccccaccauugaggagggccgcacgcuccggguccuaaagaugguagagccguggcugcgcgggaaccaauucugcauuaaaauauuaaacccguacaugccuagcgugguugaaacuuuggaacaaaugcagagaaaacacggcggaaugcuggugcgcaacccccuaucccguaacagcacccacgagauguacuggguguccugcgggaccggcaauaucgucagcgcggucaacaugaccucccgcauguuacugaaccgguucacaauggcgcaucgaaaacccaccuaugaacgcgauguggacuugggggcuggcacgaggcacgucgcuguggagcccgagguggccaaccuggauauuaucggccaacguaucgagaacaucaaacaugagcauaagagcacuuggcacuacgaugaggacaacccuuacaaaacgugggccuaccacgggaguuacgaggucaagcccagcggcucugccuccagcauggugaacggggucgugaaacuucucaccaagccgugggacgucauccccauggucacgcagaucgcaaugaccgacaccacaccauucggccagcagaggguguucaaggagaagguggacacccgcacuccuaaggcgaagcgggggaccgcacagaucauggaagucacugcgaaguggcuauggggcuuccugucccgcaacaagaagccgcggaucuguacccgcgaggaguucacccggaaggugcgcucaaacgcagccaucggggccguguucgucgacgaaaaucaguggaacuccgcgaaggaggccguggaggaugaacgguucugggaccuuguucacagagagcgcgagcugcacaagcagggcaaaugcgccacgugcgucuacaauaugaugggcaagcgcgagaagaaacugggggaguucggcaaagccaaggggagccgggcgauuugguacauguggcucggcgcgcgcuuccuggaguucgaggcauugggcuucaugaacgaggaccacugguucuccagggagaacagccucuccgggguggagggcgaggggcuccacaagcugggcuacauccuccgcgauaucagcaaaaucccagggggcaacauguacgcugacgacaccgccggcugggacacccgaaucaccgaggacgaccuucaaaaugaggcgcgcaucacggacaucauggagcccgaacacgcgcuacucgcuaaauccaucuucaagcugaccuaccagaacaaggugguucgcguacagagaccggccaagaaugggacugugauggacgucaucagcaggcgggaccagcgcggaucuggccagguuggcacauacgggcugaacacguuuacgaauauggaggcccaacucauccgccagauggagagcgaagagauuuucuccccgagcgagcuugagacccccaaccuggccggucgagugcuggacugguuggagaagcacggaguggagcggcugaagcgcauggcaaucuccggggacgacugcguggucaagcccauagacgaccgguucgccacagccuuaacggcucugaacgacaugggcaaaguccggaaggauaucccgcagugggagcccagcaaaggguggaacgacuggcagcagguccccuuuugcucccaccacuuucaucagcucaucaugaaggacggccgggagaucguaguccccugccgaaaccaggacgagcuugugggcagggcgcgcgugucccagggggcgggcuggagccugagggaaaccgcaugccuggguaaguccuaugcccagauguggcaacucauguacuuccaccgccgggaucugcgccuugccgcgaaugccauaugcagcgccgucccuguggauugggugcccacuucccguacuacguggagcauccaugcccaucaucaguggaugaccaccgaggacaugcucuccguguggaaucgcguguggaucgaggagaauccguggauggaggauaaaacccacaucagcuccuggggcgacgucccauauuugggaaagagagaggaccaguggugcgggagccuaaucggccucaccgcccgcgcgaccugggcaaccaacauacaggucgccauaaaccaggugaggcgcuuaaucggaaacgagaacuaccuggauuacaugaccuccaugaagcgcuucaagaacgagucagacccggagggggcccucugguga

SEQ ID NO: 24638 - RNA, 9879 nt, Artificial Sequence
  derived and/or modified CDS sequence (opt11) from DENV-1__JQ045659__SS-prME
agcguuaccaugcugcucauguugaugccaacagcucuugccuuucaccuaacuacccgaggcggggagccccacaugauugugucaaagcaggagcgcggcaagucccuauuauucaaaaccagcgccggggugaauaugugcacucucaucgcaauggauuuaggcgagcucugcgaggacaccaugaccuauaagugcccccgcaucaccgagaccgaaccagacgacgucgacugcuggugcaacgccaccgauaccugggugaccuauggcacgugcagccagaccggcgagcaccggcgcgacaagcgaucgguggcccucgcgccccacgugggacuuggacuggaaaccaggaccgagacuuggaugagcuccgagggcgcuuggaaacagauccaaaggguggaaacgugggccuugaggcaccccggauucacaguuauugcacucuuccuggcacacgcuauaggcaccucgauaacccagaaaggcauaaucuucauccucuuaaugcuggugacgcccuccauggcuaugaggugcgucgggauagggagccgcgauuuuguggaggggcucuccggcgcgaccuggguggacgugguguuggaacacgggaguugcgugaccacuauggccaaggacaagcccacccuagacaucgagcuuuugaagacugaggucacuaaccccgccgugcugcgaaaacuuugcaucgaggcgaagauuaguaacacuacgacagauucgagaugcccgacgcaaggggaggccacgcuaguggaagaacaagacgccaacuucgugugccggaggacguucguggaucgcggcugggggaauggcugugggcuauuuggcaaagggucucugaucacuugugccaaauucaagugcguuaccaagcuggagggcaagauuguucaguacgagaaccugaaguacagugugauuguuaccguucacacgggcgaucagcaccagguagggaacgaaaguacugaacacggcacaacugccaccauaacuccccaggcgccgaccaccgagauccaacucaccgauuauggggcacugacccuggauugcagcccacguaccggccucgacuucaacgagaugguccugcuuacgaugaaagagaagucauggcucguccacaagcaaugguuccuggaccuacccuugccauggacaagcggcgcuagcacgagccaggagaccuggaaccggcaggaccuacugguuaccuucaagaccgcccaugcaaagaagcaggaagucguggugcucggcagccaggagggugcgaugcacacggcgcuaaccggagccacugagauccagaccaguggcacuaccacaauuuucgcuggacaucugaagugccgccucaagauggacaagcuaacccuaaagggcaugucauacgucaugugcacagggucuuucaagcuugagaaggagguagcggagacccagcacggcacuguguugguccagaucaaguaugagggcaccgacgcacccugcaaaauacccuuuagcacucaggacgagaaaggggcgacccaaaauggccggcuaaucacggccaacccgauaguuacugacaaggagaagcccgugaacaucgaggcugagccucccuuuggggaauccuauaucgucauaggcgcuggcgaaaaggcccugaagcucagcugguucaagaagggguccuccauaggaaaaauguucgaagcuacggcccgcggggccaggcgcauggcgauacugggcgacaccgcuugggacuucgguagcauaggcggcguuuuuaccagcgugggaaaguuaguccaucagaucuucgguacugcguaugguguccucuuuuccggcguaagcuggacgaugaagaucgggaucgggguccugcugacguggcuuggccuaaacucccguucuaccucccugagcaugaccuguaucgccgugggacucguaacgcuguauuugggagucaugguacaggccgacucgggaugcgugaucaacuggaaggggcgagaacugaaaugcgggucgggaaucuucgugaccaaugaggugcacaccuggaccgaacaauauaaguuucaggcggacaguccgaaacgccugucagccgccaucggcaaagcaugggaggaggguguuugcggcauccgaagcgcuacccgccuggaaaacaucauguggaagcagauuuccaaugagcucaaccauauccuacucgagaaugauaugaaauuuaccguaguaguuggugacguaacgggaauccucgcccaaggaaagaagaugaucagaccgcagcccauggaguacaaguacucauggaaguccuggggcaaggccaagauuaucggagccgacgugcagaacaccacuuucauaauugacggccccaauacgccggagugccccgacgaccagcgcgccuggaacauuugggaagucgaggacuacggcuucgggauauucacgacgaacaucuggcuuaaacugagagacagccacacucaagucugugaccaccgccucaugagugcugcgauaaaggacagcaaagccgugcacgcggacaugggcuauuggaucgaguccgagaaaaacgaaacguggaaguuggcgcgggcgagcuucauagaggugaagacguguaucuggcccaaaucccacacccucugguccaacggcgucuuggaauccgagaugaucauccccaagaucuauggcgggccgauaagccagcauaacuaucgccccggguacuucacccaaaccgcugggccuuggcaccuagggaagcuggagcuggacuucgaccugugcgaagggaccacuguggcgguggaugagcauugcggcaaccgcgggccguccuuacgcaccacgacugucacggggaagaucauacacgaguggugcugccguucuugcacccugccgccccuccgcuuccgcggggaggacgggugcugguacggaauggaaauccggcccgugaaagagaaggaagagaaccucgugaaaucuaugguuagcgcuggcagcggagaggucgauagcuucagcuugggucuguugugcaucuccauuaugaucgaggagguaaugcgaagcagguggucccgaaagaugcucaugacuggcacccuggccguauucuuccugcugaucauggggcagcugaccuggaacgaccugauccgccucugcauaaugguuggcgcgaacgccucugaccguaugggcaugggcacuacguaucucgccuugauggcaacuuuuaaaaugcggccgauguuugcgguugggcuauuauuuagacgucugacuucgcgggaagucuugcugcugacuauaggucuaagccugguggcguccauggagcugcccaacagcuuggaggagcuaggggacggacuggcgaugggcauuaugauucucaaacuguuaacggauuuccaaucccaccagcucugggccaccuuacuaucucucaccuuuaucaagaccacguucucccuucacuaugccuggaagacaauggccauggugcugagcaucgugucccucuucccgcugugucuuucgaccacuucccagaagacgaccuggcuccccguacuccuggguagccucggguguaaaccgcugaccauguuucuaaucgccgagaacaagauuuggggccgccgcucauggccccucaaugaggggauuauggcugucggcauagugucaaucuuguugucuucccuccugaagaaugacgugccccucgccgguccccucaucgccggcgggaugcucaucgcguguuacgugauaucagggucgucugccgaccucucacuugaaaaggccgccgagguuagcugggagaaggaggccgaacacuccggcgcgagccacaacauacugguggaaguccaggacgaugggacuaugaagauaaaggacgaggagagagacgacacuuugacgauccuccugaaggccacccuacuggccgugaguggcguauauccgcugagcaucccagcaacgcuguucgucugguauuuuuggcagaagaagaagcagcgcagcggagugcucugggacacaccuucgccgcccgagguuggcagggccguacuggacgacgguauauaccgcaucaugcagcggggacugcuaggccgcagucagguugggguaggcgucuuccaggaaaacguauuucacacgauguggcauguaacccgcggggcaguucucauguaccagggcaagcggcuggagcccucgugggcuuccguaaagaaggacuuaaucagcuaugguggaggcuggcggcuucagggguccuggaauacuggugaggagguccagguuauagccguggaaccugggaagaaccccaaaaacgugcaaaccgcucccggcacuuuuaaaaccccggagggcgaggugggggccaucgcuuuagacuucaagcccgggaccucgggcagucccaucgugaaccgcgaggguaaaauaguuggccuguacggcaacggcgucguaaccacguccgggacuuacguguccgccaucgcucaggccaaggcgucucaggaaggcccucuuccggagaucgaggacgaggucuuccggaagaggaaccugaccaucauggaccugcacccggggagcggcaaaacccgacgauaccuaccggccaucgugcgggaggccauaaagcggaaacuacgcacgcugauccucgcccccacccggguggucgcgucugagauggccgaggcccugaagggaaugcccauacguuaucagacuaccgcugucaaguccgagcacacggggaaggaaaucguugaccuuaugugccacgccacauucacuaugcgucuccuaucccccgugcguguaccgaauuacaacaugaucauuauggaugaggcacacuucaccgauccaaguaguaucgccgcccggggcuacauuucgacccgugugggaaugggggaagcagccgccaucuucaugaccgcgacgccuccuggguccguugaggccuucccgcaguccaacgccgugauccaggacgaggagcgagacauccccgagcgcuccuggaacucagguuaugaguggaucaccgacuuccccggcaagacggucugguucgucccuucgauaaagucggggaacgacaucgcaaacugccugcggaaaaacggcaaacgcguuauacagcugucccgcaagaccuucgacaccgaguaccagaagaccaagaauaacgacugggacuacguggucacgaccgacaucagugagaugggggcgaauuuccgcgcagaccgggugauugacccgcgccggugccugaagccggugauccugaaggacggccccgaacgcgucauccuggcagggccuaugccugugaccguggccuccgcagcgcagcggcgcggcaggaucgggcgaaaccacaacaaagagggugaccaguauauauacaugggccagccccugaacaacgaugaggaccacgcacauuggaccgaggccaagaugcuacuggacaauaucaacacgcccgaggggaucauuccggcacuguucgaaccggagcgggagaaguccgccgcaaucgauggugaauauaggcugcgcggggaggcccguaagaccuuuguagaguugaugcgccggggcgaucugccgguauggcuguccuacaaagucgccagcgaaggguuccaauauucugacaggcgcuggugcuucgacggggagcgcaacaaccaggugcucgaggagaauauggacguagaaauauggaccaaggagggggagcggaaaaagcugcgcccccguuggcuagacgcccguaccuacuccgauccccuggcccugcgagaguucaaggaguucgcggccggaaggcgcagugucuccggagaccugauccucgagauuggcaagcugccccaacaccugacgcagcgcgcccagaacgcacuagauaaccuggugaugcugcacaauagugaacagggugggcgggcguaccgacaugcuauggaagaguugcccgacaccaucgagacacuuaugcugcucgcccugaucgcaguucucaccggaggaguaacccucuucuuccuguccgggcggggccugggcaaaacaagcauuggcuuacugugugugauggccagcucaguguugcucuggauggcguccgucgaaccucacuggaucgccgccuccauuauucucgaguuuuuucuuaugguacuccugaucccggaaccggaccgucagcggacgccccaggauaaccaacuagccuacgugguaauaggauugcucuucaugauccucacuguggcggcuaacgagauggggcugcuugagaccacgaagaaggaccuggggauugggcacguggcugucgagaaucaucaucaugcagccaugcuagacgucgaccugcauccugcuuccgcauggaccuuguacgccguggccaccaccaucaucacgccaaugaugaggcacaccauugagaacaccaccgcaaacaucagccucacggccaucgcgaaccaggcggccauccuaauggguuuagacaagggauggccuaucuccaagauggacaucgguguaccccuacuggccuuaggcugcuauagccaagucaacccccuaacccugacagcggccguucugaugcucguugcucacuacgcaaucaucggcccagggcugcaggcuaaagcaacaagagaagcccagaagaggacggcugccggaaucaugaagaaccccaccguagauggcaucguggccaucgaccuggaccccguuguguacgacgccaaauucgagaaacagcucgggcagauuaugcugcugauccuuugcaccucccagauucuccugaugcgcaccacgugggcccucugcgagagcaucacccuggcuaccgggccacugaccacucuuugggaaggaucgccggguaaauuuuggaacacaacaauugccguuagcauggccaacaucuuccggggguccuauuuagcgggcgccgggcuggccuucagcuuaaugaagucacugggcggcggccgccgugggacgggcgcucagggcgaaacacugggcgagaaguggaagcgccagcucaaccagcugucgaaaagcgaguucaacaccuacaagcgcagcgggauaauggaaguagaucgcucagaagcuaaggaggguuugaaacgcggcgagaccaccaaacacgccgugagccgcgggacggccaaacuccgaugguuuguggagcggaaccugguaaagcccgagggcaaggugauugaccugggcugugggaggggagggugguccuacuacugugcugggcugaaaaaagugaccgaggucaaaggguacaccaaggggggccccgggcacgaggaacccauccccauggcgaccuacggauggaaccucgugaaguugcacucggggaaggacguguucuucaucccacccgagaagugcgacacacuuuugugugacaucggcgagucuucccccaacccgaccaucgaggagggacgcacgcugcggguccugaagaugguggaaccauggcuacgugguaaccaguucugcaucaagauccugaaccccuauaugcccagcgugguagaaacgcuggagcaaaugcagcggaaacacggcgggaugcugguacgcaauccgcuuucccgaaauucgacgcacgagauguacuggguuucaugcggcacugggaacauugucagcgcgguuaauaugaccucccggaugcugcuuaaccgguucaccauggcgcaucgcaagccuaccuacgaacgcgacguggaccugggagccggcacucggcacguagccguggagcccgagguggcuaacuuggacaucaucggacagcgcauugaaaauauaaagcaugagcacaagucaaccuggcacuacgacgaagauaaccccuauaagaccugggcguaccacggcuccuacgaggugaagccuagcgggucggccagcagcauggugaauggcguagugaagcucuugaccaagccgugggacguuauacccauggucacacagauugccaugaccgacacaacacccuucgggcaacaacggguguuuaaagagaagguagacacgcgcacgccgaaggccaaacgggggaccgcccagaucauggaggugaccgcgaagugguuauggggcuuccucucaagaaauaagcggccaaggaucugcacucgggaggaguucacucgcaagguucgaagcaacgccgccaucggcgcuguguuugucgacgagaaccaauggaacuccgcuaaagaggccguggaggacgagagguucugggaccuggugcacagggagcgcgagcuccauaaacagggcaagugcgcaaccugcgucuacaacaugaugggcaagcgggaaaagaagcucggggaguucgggaaggcgaagggaagccgggcgaucugguacaugugguugggagcccgguucuuggaguucgaggcccuuggcuucaugaacgaggaccacugguuuucccgcgagaacagccuguccggcguggagggggagggcuuacacaaacucgguuacauucugcgggacauaucgaagaucccgggcggcaacauguaugccgacgacacggcugguugggauacgagaauaaccgaggaugauuuacagaacgaggcccgcauuaccgacaucauggagccggagcacgcguugcuggcuaagaguaucuucaaauugacuuaucagaacaaggugguacggguucagcgccccgccaagaacggcacggugauggacgucaucucucgacgggaucagcguggguccggccaggugggcacguacggacuuaacacauucaccaacauggaagcgcagcugauccgccagauggagagcgagggcauauucagcccaagcgagcuggagacccccaacuuagccgagcggguucuggacuggcuggaaaaguacggcgucgagagacucaagcguauggcgauaucuggcgacgacugcguggugaaaccgauugacgaccgcuuugccaccgccuugacugcacugaaugacauggguaaagucagaaaggauaucccccaaugggaaccaagcaaaggcuggaacgacuggcaacaggucccauucuguucccaccacuuccaccaacuuauaaugaaagacggacgagagauaguaguucccugucgaaaccaagacgagcuagugggccgcgcccguguuagccaaggagcgggguggagccuacgcgagacugccugccucggaaaguccuacgcccagauguggcaacugauguacuuucaccggcgcgaucuccggcucgcagcgaacgccaucugcucugcuguccccguagacuggauacccaccucacggaccacuuggucaauccaugcccaucaccaguggaugaccacagaggacaugcugucaguuuggaaccgcgucuggaucgaggagaacccauggauggaggacaagacccacaucaguuccuggggcgacgugccauaucucggcaaacgcgaggaccaguggugcggcucucucaucggcuugaccgcuagggcgacgugggccaccaauauccagguggccaucaaccagguccggcggcugaucggcaaugagaacuaccucgacuauaugacgagcaugaaacgguucaaaaacgagagcgaucccgagggagccuugugguga

SEQ ID NO: 24639 - RNA, 9879 nt, Artificial Sequence
  derived and/or modified CDS sequence (opt11) from DENV-1__JQ045661__SS-prME
agcgugacaaugcugcugauguuaaugcccaccgcucucgcuuuucaccuaaccacucggggaggggaaccccacaugaucgugagcaaacaagagcggggcaaaagccuccuguucaagaccucugccggggucaacaugugcacccucaucgccauggacuuaggcgagcugugcgaggacacaaugacauacaaaugcccccggaucaccgagacugagcccgacgacguggacuguuggugcaacgccacugacaccugggugacauacgggaccugcucucaaacgggggagcaucgacgggacaaaagaucgguggccuuagcaccccacgugggccugggccuggagacucgcaccgagaccuggaugucaucggagggcgccuggaaacaaauccaacgggucgagacgugggcccuccgacaucccggcuucaccgugaucgcccuguuccuggcacacgcaaucggcaccagcaucacccaaaaggggaucauauuuauccuccugaugcugguuacgcccuccauggcuaugcgaugugucggcauaggcagcagagacuucguggagggucucuccggcgccacguggguggaugucguacuggagcacggguccugcgugacgacaauggccaaggacaagcccacgcuggacaucgagcuccugaaaaccgaagucaccaacccugcggugcugcggaagcucugcauugaagcgaaaaucucaaacaccacuacggauagcagauguccgacccagggcgaggccacgcucguggaggagcaggaugcgaacuucgucugccggcggacguucguggaucggggauggggcaacggcugcgggcuguucgggaaagguagucucaucacgugugccaaguucaagugugugaccaaacuggagggcaaaaucguccaauacgagaaccucaaguacagcgugaucgugacuguccauacgggggaccaacaccagguggguaacgagaguaccgagcacgggacaaccgcaacaaucacuccccaagcgccgacuacugagauccaacucaccgacuacggggcccuaacccucgauugcagcccccgaaccggccucgacuucaaugagaugguccuucugaccaugaaggagaaauccuggcucgugcacaagcagugguuccuagaccugccccucccauggaccagcggggcgagcacgagccaagagaccuggaauaggcaggaccuguuagugacguucaagaccgcccacgcuaagaagcaggaggucguggugcucggcucucaggagggugcgaugcauaccgccuugacgggcgcgaccgagauccagacaucuggcacgacuaccaucuucgccgggcaccuuaagugcaggcugaagauggacaaauugaccuuaaagggcaugagcuacgugaugugcacagggagcuuuaagcucgagaaagaacuggcugagacccagcacgggacagugcuggugcagauaaaguacgaaggcaccgacgcgccgugcaaaauuccguucaguacacaggacgagaagggggucacccagaacgggcgguugaucaccgccaacccaaucgugaccgacaaggagaagcccgugaacaucgaggccgaaccacccuucggggaauccuacaucguaauaggcgcgggugaaaaggcgcucaagcugucaugguucaagaagggcuccagcaucggcaagauguucgaggcgacggcgagaggggcccggcggauggccauccugggcgacacggcgugggacuucggauccaucggcggcgucuucaccucaguggggaagcucguccaccagauauucgguacggcguaugggguucuauucagcggggugagcuggacaaugaagaucgggaucggcgugcugcucaccuggcugggccucaacucccgcaguaccucacucagcaugacaugcauugccgugggguuggugacgcuguaccucggcgucauggugcaggccgacuccgggugcgugaucaacuggaaaggcagggagcucaagugcggguccggcaucuuugucaccaacgaggugcauacauggaccgagcaguacaaguuccaggccgacagcccaaagcgccuguccgcggccauaggcaaagccugggaggaaggggugugcggcauccggagcgccacccgacucgagaacaucauguggaaacagaucuccaacgaacugaaccacauucugcucgagaacgacaugaaguucacaguggucgugggggacgucgccggcauccuggcgcaagggaagaagaugauccgcccccaaccaauggagcauaaguacagcuggaagucguggggcaaggccaagauuaucggcgcugacguccagaacaccaccuucaucauagacgggccaaacaccccagagugccccgacgaccaacgcgcguggaauaucugggaaguggaggauuaugguuucgggauauucacgaccaacaucuggcucaagcuccgggacagcuacacacaagucugcgaccaccgacugaugucugcggccaucaaggacagcaaagccgugcacgccgacaugggcuacuggaucgaaucggagaaaaacgaaaccuggaagcuggcgcgggcgagcuucaucgaggugaaaacgugcaccuggcccaagucgcacacccucuggagcaacggcguccucgaguccgagaugaucauucccaagauuuauggcggcccgaucucgcagcauaacuacagacccggguacuucacucagacggcagggccuuggcaucuagggaaguuagagcuggacuucgacuugugcgagggcaccaccguggucgucgacgagcacuguggcaaccgggggcccaguuuacgcaccacgaccgugacgggcaagaucauacacgaguggugcugcagaagcuguacacugccgcccuugcgcuucagaggggaagacggcugcugguacggaauggagauucgcccagugaaagagaaggaggagaaccucgucaaguccauggugucugccgguuccggcgagguggacuccuucagccuugggcuguuaugcaucuccaucaugaucgaggaaguaaugcggagccgcuggucccggaagaugcugaugacaggcacgcuggccguguucuuccuccugauagucgggcagcuaacguggaacgaucuuauccgucuuugcaucaugauuggcgccaacgcgucagaucgcauggggaugggaaccacuuaccuggcccucauggccaccuuuaagaugcguccgauguucgccgucggccuguuauuccgccggcucaccucccgcgaggugcugcuguuaaccauugggcugagcuugguggccuccguggagcucccuaacagcuuggaggagcugggugacgggcuagcgaugggcaucaugauccugaaguugcucacggacuuccaaucccaucaacugugggccacccuacuuucgcuuaccuucauuaagaccacuuucucgcugcacuaugccuggaagacuauggccaugguacucucagucgugucccuauucccgcuuugucucagcaccacuucccagaagacgaccuggcugccuguguugcucgguucccuggguugcaagccgcugaccauguuuuugaucgcagagaauaagauauggggccggcgaucguggccccugaacgaagggaucauggccgucggcauagugagcauccucuuaagcucccugcucaagaacgaugugccccucgccgggccccugaucgccggcggcaugcugaucgcuugcuauguuaucucaggguccuccgccgaccuaagccuggagaaagcugccgaaguuagcugggaggaggaggccgagcauuccggcgccagccauaauaucuuaguggagguccaggacgacggaacgaugaagaucaaggacgaggagcgugacgacacccugacgauccuacugaaagcaacucuucuggccgugaguggcguguacccgcuaagcauccccgcaacccucuucgucugguacuucuggcagaagaagaaacagcgcucuggggugcugugggacacccccagcccgcccgagguggaacgggccguccuugacgaugggaucuaccgcaucaugcaacggggccugcucgggcgcucccaggugggcgugggggucuuccaggagaacguguuccacacuauguggcauguaacccggggcgccguccugauguaccaggggaaacgucuggagcccucgugggcgagcgugaagaaggaccucaucagcuacggcggcggguggcggcugcagggcuccuggaacaccggagaagagguucaggucaucgccguggagcccgggaagaaccccaagaacgugcagacugcgcccggcacguuuaagacacccgagggcgaggucggcgccauagcccuggacuucaagccagggaccucaggcucccccauugugaacagggagggcaagaucguaggccucuacgguaacggggucguaaccacgagcggcaccuacgugagcgcgaucgcccaagccaaggcgucccaggagggaccgcugcccgagaucgaggaugaggucuuccggaagcgcaaucuaaccaucauggaccuccacccgggcucaggaaagacucggcgcuaccugccggcgaucgugcgggaggccauaaaacgcaagcugaggacccucauacuggcucccacccgggucgucgccucagagauggccgaggcacugaagggcaugccgauccgcuaccagaccaccgccgucaaaagcgagcacacgggcaaggagauaguugaccucaugugccaugccaccuucaccaugcggcugcugucccccguccgcgugccgaacuacaacaugaucauaauggacgaggcccacuuuaccgaccccagcuccaucgcagcgaggggguacaucaguacaagagugggcaugggggaagccgccgcaaucuucaugacugcuacgccgcccggcuccgucgaggcguucccgcaguccaacgcggugauccaggaugaggagcgggacaucccggaacgcuccuggaacucugguuacgaguggauuacagacuuccccggcaaaacggugugguuuguuccguccauuaagagcgggaaugacaucgccaacugcuugcggaagaacgggaagcgcgugauccagcugucccggaagaccuucgacaccgaguaucagaagaccaaaaacaacgauugggacuauguugucacgaccgacaucagcgagaugggcgccaauuuccgggcggaccgggugauagauccccgccgcugccugaagcccguaauccugaaggaugggcccgagcgcgucauccuggccggccccaugccugugaccgucgccucugcugcccagcggcgcggucgcaucggccgcaaccacaacaaagagggcgaccaauacaucuacaugggacaaccgcugaacaacgaugaggaccaugcccacuggacugaggccaagaugcuucuggacaacaucaacacgccagagggcauuauccccgcccuguucgagccggagcgugagaaauccgccgccaucgacggggaguacaggcuccgaggcgaggcgcguaagaccuucguggagcuaaugcgcagaggagaucuccccguguggcucuccuauaagguugccucagagggcuuccaguauucagaccgccgguggugcuucgacggcgagcgcaauaaucaggugcuggaagaaaacauggauguggagaucuggacaaaggagggggagcggaagaagcugcgcccccgguggcucgacgcccgcacauacuccgacccccuggcacugcgggaguucaaggaguucgcugcugggcgucggagcgucucgggggaccucauccuggagauaggcaagcuaccgcagcaucucacgcagcgcgcccagaacgcccuggacaaccuggugaugcuccacaauucggagcagggugggcgggcuuaccgccaugcgauggaggaacugccugacacuauugagacgcuuaugcuccuagcccugaucgcaguucucaccggcgguguuaccuuauucuuccugucgggcagagggcugggcaagacgagcauagggcugcugugcgugauggcuucaaguguacuccuguggauggcgucgguugagccccacuggauugcggcgaguaucauccuggaauuuuuccucauggugcugcugauccccgaacccgaccgccagcgcacgccacaagacaaccagcucgccuacguugucaucgggcugcuguucaugaucuugacggucgcagccaacgagaugggucugcuugagaccacgaagaaggacuuagggaucggccauguggcgguugaaaaccaucaccacgccgcgaugcuggacguagaccuacaccccgccuccgccuggacacuauacgcagucgcaaccaccaucaucacuccgaugaugcgucauaccaucgagaacaccacggccaacaucagccugacggccaucgcaaaccaggcggccauccugauggggcuggacaagggcuggcccaucuccaagauggauauuggcgucccgcugcuggcacuugggugcuacucccaggugaaucccuugacccugaccgccgcggugcugaugcuagucgcucauuacgccaucaucgggccgggacugcaagcuaaggccacucgggaggcgcagaagcggacggccgccggcaucaugaagaacccaaccguggaugguaucguggcgauugaccucgacccagucguguacgacgccaaguucgagaagcaguuaggccagauuaugcugcuuauccugugcacgucccagauccugcucaugagaaccacgugggcgcugugugagagcaucacccuggccaccggcccccucacgacgcuaugggagggguccccgggcaaguucuggaacacuaccaucgccguaagcauggccaacaucuuccgggguagcuaucuggccggcgccggccucgcauuuagccucaugaagucccucgggggcgggagacgggggaccggggcacagggcgagacccucggagagaaguggaagcgccagcugaaccagcuguccaaaagugaguucaacaccuacaagcguagugggauaauggaggucgaccggagcgaggcuaaggagggccuuaagcgcggggagacuaccaaauacgcgguaucucguggcacggccaaguugcguugguucguggaaagaaaccuggucaagcccgaggggaaggugaucgaccugggcugcggccgcgggggcuggagcuauuauugcgccgggcucaagaaagugacagaggucaagggcuauaccaagggcggccccggccacgaggagcccauaccgauggccacuuacggcuggaauuuggugaagcugcacuccggcaaggacguauucuucaucccgcccgaaaagugcgacacgcucuugugcgacaucggggagaguucucccaacccgaccaucgaagagggccgcacccugaggguucucaagaugguggaacccugguuacggggcaaucaguucugcauuaagauccugaaccccuauaugcccagcgugguggaaacccucgagcaaaugcagagaaagcacgguggcaugcuugugagaaacccguuaucccggaacagcacccacgagauguauugggugaguugcgggacgggcaacaucgucagcgcagugaauaugacuagcaggaugcuuuuaaacagauucacgauggcgcaucggaaacccaccuacgagcgcgacguggaucugggggcuggcacucggcaugucgccguggagccugagguagccaaccucgacaucaucggccagaggaucgagaacaucaagcacgagcacaagagcaccuggcacuacgacgaggacaaccccuacaagaccugggccuaccacggguccuacgaggucaagccgucgggcuccgcuagcagcauggucaauggggucgugaaacucuuaaccaagcccugggacgugauccccauggucacgcagaucgccaugaccgauaccacuccguucggccagcagaggguguuuaaagaaaagguugauacccgcaccccgaaagccaagagagggaccgcccagauuauggaagucaccgccaaguggcucuggggcuuucugucacgcaacaagaagccccggaucugcacgcgagaggaguuuacccggaaggugcgcagcaacgcggcuaucggcgccguguuugucgacgagaaccaguggaacuccgccaaggaggcaguggaggacgaaagguucugggaccuggugcaucgcgagcgggagcuccauaagcaggggaagugcgcgaccugcgucuacaacaugaugggcaaacgagagaagaaacugggggaguucgggaaggccaaaggcagccgggccaucugguacauguggcugggcgcgcgcuuccucgaguucgaggcgcucggcuucaugaacgaggaccauugguucucccgcgagaacagccuguccgggguugagggggagggacuccacaaguuaggcuauauccugcgcgacauuagcaaaaucccagggggcaacauguacgccgacgacaccgccggcugggacacgcgcaucacugaggacgacuugcagaacgaggcccgcaucaccgacauuauggagccagagcacgcccugcucgcgaaguccaucuucaaacucaccuaccagaauaaaguggugcgggugcagcgccccgccaagaacgggacggugauggacguuaucucgcgccgggaccaacgcggcagcggccaaguggggaccuauggccugaacaccuucaccaacauggaggcccaauuaauccggcagauggaaagcgaaggaaucuucagccccucugagcucgaaacacccaacuuggccgaacgcgugcuggacuggcucgagaaauacggcgucgagcggcugaagcggauggccaucuccggggacgacugcgugguuaagccgauagacgaucgauucgcgacagcgcugacagcccugaaugacaugggcaagguccgcaaggacaucccccagugggagcccagcaaaggauggaacgauuggcagcagguccccuuuuguucccaccacuuccaccagcugauuaugaaggacggccgggagauuguggucccguguaggaaccaggacgaguuggugggccgggcccgcgugagccaaggggcgggcuggucccuucgggaaaccgcgugccucgggaagaguuacgcccaaauguggcaguuaauguacuuccaccgccgggaccuccgccuggcugccaacgcaaucugcucugcaguccccgucgacuggaucccaacaucucggaccaccuggagcauccaugcccaucaccaguggaugacaacggaggacaugcuguccguuuggaaccgcgucuggauagaggaaaaccccuggauggaggacaagacucacaucucguccuggggagacgugccauaccucgggaagcgcgaagaucaguggugcgggucucucaucgggcugaccgcccgggccaccugggcgacuaauauccagguugcuaucaaucagguacgccggcucaucgggaacgaaaacuaccuggacuacaugacgagcaugaaacgcuucaagaaugagagcgaccccgagggcgcacugugguga

SEQ ID NO: 24640 - RNA, 9879 nt, Artificial Sequence
  derived and/or modified CDS sequence (opt11) from DENV-1__JQ045663__SS-prME
agcgugaccauguuguuaauguugaugcccaccgcccuggccuuccaccucaccacccgcggcggcgaaccccauaugaucgucagcaagcaggaacggggcaagagccucuuguuuaagaccagcgccggggugaacaugugcacccuaaucgccauggaccugggcgagcucugcgaggauaccaugaccuacaagugcccccgaaucaccgagaccgaacccgacgacguagauugcugguguaacgccacggauacuugggucacauacgggacgugcucccagacgggcgagcaccgccgggauaaacguuccguggcccuggcgccccacguaggccuggggcuggagacccgcaccgaaaccuggaugagcuccgagggcgccuggaagcaaauucaacggguagaaaccugggcccuccggcacccgggguucacggugaucgcacuguuccuggcacacgcgaucggcaccagcaucacacaaaaagggaucauauuuauccuccucaugcugguaacgcccaguauggcaaugcggugcguaggaauuggcagccgcgauuucguggagggguugucuggcgccaccugggucgacgucguuuuggagcacgggucgugcgugaccaccauggcgaaggauaagcccacgcuagacaucgaauugcugaagacugaggugaccaaccccgccguucuccguaagcucuguaucgaggccaagaucuccaacaccacgaccgacagccgcugcccgacccagggagaggccacccucguggaagagcaggacgccaacuucgucugcaggagaaccuucguugaccgagguugggggaacggcugcggccuguucggcaaggguucacuaauuaccugcgcaaaguucaagugcgugaccaagcuugagggcaagaucguccaguacgagaaccugaaguacaguguaaucgugacuguccacacuggcgaccagcaucaggucgggaacgaguccaccgagcacgggacuacagccaccaucaccccccaagcgccuaccaccgagauucagcucaccgacuauggagccuuaacgcuggauugcagcccccgcaccgggcucgacuucaacgagaugguccugcuaaccaugaaggaaaaguccuggcucguacacaagcagugguuucuagaccugccucuccccuggacgagcggugcgagcacgucacaggaaacguggaaccggcaggaccugcuugugacguucaaaaccgcucacgccaagaagcaggaggucgugguccucggcagccaggagggcgcgaugcacacggcccugaccggggccacugaaauccagacauccgguacaaccaccaucuuugcagggcaucugaaaugucgccugaagauggacaagcugacucugaaagggaugagcuacgucaugugcacgggaagcuuuaaacucgagaaagaacuggccgaaacccagcacggcacagugcugguccaaauaaaguacgaggguaccgacgcucccugcaagauucccuucucgacucaggaugagaagggggugacccaaaacgggcggcuuauaaccgccaauccgauuguuacagacaaggagaagcccgugaacaucgaggccgagccucccuuuggggagaguuacaucguuaucggcgccggcgagaaagcgcucaagcuuagcugguucaagaaggggucgagcauugguaagauguucgaggccacggcccgcggagccaggcgcauggccauacugggcgacaccgcgugggacuuuggguccauuggcggaguguucacuucgguggggaagcucguccaucagaucuucggcacagccuacgggguguuauucagcggcgugaguuggacgaugaagauugggaucggcguucugcugacguggcuggggcugaauucccguaguacgucccucuccaugaccugcaucgccgugggguuggugacgcuguaccucggaguuauggugcaggccgauuccgggugcgugaucaauuggaagggccgggaguuaaagugugggagcggcaucuucgucaccaacgaaguccacacuuggaccgagcaguacaaguuccaagccgacuccccgaaacggcuguccgcggccaucggcaaggccugggaggagggaguguguggaauccggagcgccacccgacucgagaacauaauguggaagcagaucuccaacgaacugaaccacauccugcucgagaacgacaugaagcucacggucguugucggggacguugccggcauccuggcgcaagguaagaagaugauccggccccagccaauggaguacaaguauagcuggaaguccuggggcaaagcuaagaucauaggggccgacguccagaauaccacuuucaucauugacggccccagcaccccugagugccccgaugaccagcgcgcuuggaacaucugggagguggaggacuacggcuucgggaucuucacgacuaauauauggcuuaagcugcgggacucccacacccaggucugcgaucaccgccugaugucagcggccaucaaggacagcaaggcugugcaugcggacaugggcuacuggaucgagagugagaagaacgaaaccuggaagcucgcccgggcguccuucaucgaggugaagacgugcauuuggcccaagagccacacgcuguggaguaauggcguccuggagagugagaugauuaucccaaagaucuacggcggcccgaucucccaacauaacuaccggcccggguacuuuacccaaacagccggcccauggcaccucgggaagcuggagcuugacuucgaccucugugaaggcacgaccguggucgucgacgagcacugcgguaaucgggguccgagccugcgcaccaccacggucaccggcaagaucauccacgaauggugcugucggucuugcacccugcccccccuccgauuccgcggggaggacgguugcugguauggcauggagauccggcccgugaaagaaaaggaggagaaccuggucaagagcauggucuccgcaggcucuggcgagguggauagcuucucccugggguuacugugcaucagcaucaugaucgaggagguaaugcggucccgcuggucucggaagaugcuuaugacugggacgcucgccguuuuuuuucuucuuaucaugggccaauuaaccuggaacgaccugauccgucuaugcaucauggucggcgcaaaugcgucggaccgcaugggaaugggcaccacauaccucgcccugauggccacauucaagaugcggcccauguucgccgucggguuacuguuccgccgguugaccaguagagaggugcugcucuuaaccaucgggcugucacucguugccagcguggaguugccaaacucgcuugaggagcucggcgacgggcuggcgaugggcauaaugaucuugaagcuccugacagauuuucaaagccaccagcugugggccacguugcuguccuugaccuucaucaaaaccacuuucagccuccacuacgccuggaagacgauggcaaugguguuauccaucgucucgcuguucccucuuugccuuuccaccaccagccagaagaccacguggcuucccgugcuccuggguucccuggggugcaagccucucaccauguuccugaucgcggagaacaagauuuggggcaggcgcagcuggccgcucaacgaggggaucauggccgugggcaucgucagcauccuccuguccagccucuugaagaaugacgugccgcucgcggguccccugaucgccggaggaaugcucaucgccugcuaugugauaagcggguccuccgcggaccugucccuggagaaggccgcggagguuuccugggaggaggaggccgagcacagcggcgcgucccacaacauacuuguggaagugcaggacgacggaacgaugaaaaucaaggacgaggaacgggacgacacccuaaccauccugcucaaggcgacgcugcuggccgucagcggcguauauccgcucuccauccccgcuacccuguucgugugguauuucuggcagaagaagaagcagcgcagcgggguacuaugggacaccccaucuccgcccgaaguggagcgggccguacuggacgacggcaucuaucgcauuaugcagagaggauugcugggccgcucucaggugggcguggggguguuccaagagaacgucuuucacaccauguggcacguuacgcgcggggccgugcugauguaccaggggaagagauuagaacccagcugggcguccgucaagaaggaccugaucucguacggcggcggguggcggcugcagggcagcuggaauaccggcgaggagguccaggucaucgccgucgagcccggcaagaauucuaaaaacgugcagaccgcccccgggaccuucaagacgccagaaggcgaggucggcgcaaucgcacucgacuucaagcccgguaccaguggcagccccaucgucaaucgcgaagggaagauagucggacuauaugggaacgggguugucaccaccaguggcacuuacguuagcgcgaucgcccaagcuaaggccucgcaggagggacccuuaccggagaucgaagacgaaguauuccggaagcgcaacuuaacgauaauggaccugcaccccgggucggggaaaacacggagauaccugcccgcgaucgugagggaggcuaucaagcgcaagcuccgcacccugauacuggccccgacgaggguggucgcuuccgagauggcugaggcucucaagggcaugcccauacguuaccagaccaccgccguuaaguccgaacacacuggcaaagaaauuguagaccugaugugucacgcgacguucaccaugcgguugcucucacccgugcgcguacccaacuacaacaugauuaucauggacgaggcucacuucaccgacccgagcaguaucgcugcccggggcuacaucucgacccgcgugggcaugggggaggcugcggccauauucaugacggcuacgccucccggcaguguggaggcuuucccccaguccaacgccgucauccaggacgaggaacgggacauccccgagcgcucuuggaacagcggauacgaguggaucaccgacuuccccggcaagaccguaugguucgugcccuccaucaagagcgguaacgacauagccaacugucugcgcaagaacggaaagcgcgucauccagcucucccggaagacuuucgauaccgaauaccaaaagaccaagaacaacgacugggauuacguagucaccacggacaucagcgagaugggcgcuaacuuucgcgcagaccgggugaucgacccccgccgaugccucaaaccugugauuuugaaggacgggccugagcgcgugauacuggccggcccaaugccagucaccgucgccuccgcggcccagcggagagggcggaucgggagaaaccauaauaaggagggcgaccaguacaucuacauggggcagccguuaaauaacgacgaggaccacgcacacuggaccgaggcgaagaugcugcuggacaacauuaacaccccugaggguaucauccccgcccucuuugagccugaacgcgagaaguccgccgcgaucgacggggaguaccgguugcgcggcgaggcgcggaagacguucguagaguugaugagaaggggcgauuuaccgguuuggcugagcuacaaggucgccuccgaggguuuccaguacagcgaccgccgguggugcuucgacggcgagcgcaacaaccaaguucuagaggagaacauggacguggagaucuggaccaaggaaggggagcggaaaaagcucaggccccgguggcuggaugcccgcaccuacucagacccccuggcccuccgcgaguuuaaagaguucgccgcgggucgccgaucaguguccggggaccucaucuuagaaaucggcaagcucccccaacaccugacccagcgcgcccagaaugcucuggacaaccuagugauguugcauaacagcgaacagggagggcgggccuaucgccacgcgauggaggagcuuccggacacgaucgagacguugaugcugcuggcccucauugcagugcugaccggcggggugacccuguuccuuuuauccggccggggacuggggaagaccagcauuggccuucugugcgucauggcuuccagcguacuucucuggauggcgagcguggagccacacuggaucgccgccaguauaauucuggaguucuuucugauggugcuccugauucccgagccggacagacagaggacgccgcaggauaaccagcuggccuaugucgugaucgggcuccuguucaugauucugaccguugcugccaacgagaugggccuccuggagaccaccaaaaaggaccuagggaucggccacguugcgguggagaaucaccaccacgccgccaugcucgacgucgaccugcacccggccuccgcuuggacgcuguaugcuguggccacgacaaucaucacccccaugaugcgccauacgauagagaauaccaccgccaacaucagccuuaccgccaucgccaaccaggcugccauacuuauggggcuggacaagggauggccuaucuccaagauggauauuggcgugccccuguuagcccuggggugcuacucgcaggucaacccccucacguuaacagccgcaguacugauguuaguagcccacuacgccaucaucggccccgggcugcaggccaaagccacccgggaggcgcagaagaggacagccgccggcaucaugaagaauccgacggucgacgguaucguggccaucgaucucgaccccgugguguacgacgccaaguuugaaaaacagcucggccaaaucaugcugcugauacucugcaccucccaaauccugcugaugcgcacaaccugggcgcuuugcgagaguaucacgcuggccaccggccccuugaccacccucugggaggggucccccggcaaguucuggaacacgaccaucgccguuagcauggcgaacaucuuuaggggguccuaccucgccggcgcgggccuggccuucucccucaugaagucccucggugggggacgacgggggaccggggcccagggugaaaccuugggagaaaaguggaaacgccagcucaaccagcuguccaaaucugaguucaacacguacaaacggagugggaucauggaggucgaccgcagcgaagccaaggaagggcugaagcgcggggagaccaccaagcacgcggucucccgcggcacagccaaguuaaggugguucguggagcguaaccucgucaagccggaggggaaggugaucgaucugggcugcggccgcgggggcugguccuacuacugcgcugggcuaaagaaggugaccgaggugaagggcuacacuaagggcggccccggccacgaggaacccaucccgauggccaccuacggguggaaccuugucaagcugcacuccggcaaggacguauucuucaucccuccggagaagugcgacaccuugcucugcgauauaggggagagcucccccaaccccacgaucgaggaggguaggacgcugcgggugcugaagauggucgagccguggcuucgcgggaaucaguucugcauaaagauccugaaccccuacaugcccagugugguagaaacccuggagcagaugcaacgaaaacacggcggcaugcuuguccgaaacccccugucacggaacucaacccacgaaauguacugggugagcugcgggacuggcaauauaguaucugcggucaacaugaccucccgaaugcugcucaaccgguuuacuauggcccaccggaaaccgaccuacgaacgagauguggaccucggagccggcacccggcauguggccgucgaacccgagguugccaaccuagacaucaucggccagcgcaucgaaaacaucaagcacgagcacaaaagcacauggcauuacgacgaggacaacccguauaagaccugggccuaccauggguccuacgaagugaaacccagcggcagcgcguccuccauggucaacggggugguaaaacucuuaaccaaaccgugggaugugauccccauggucacccagaucgcuaugacggacacgaccccuuucggacaacagcggguauuuaaggagaagguggacacccgcacgcccaaggccaagcgggguacugcccagauuauggaggugacagccaaguggcucuggggcuuccucagucgaaauaagaagccgcgcaucugcaccagagaggaguucacccggaagguccgcagcaacgcggcuaucggcgccgucuucguggacgagaaucaguggaacucugccaaagaagccgucgaggacgagagauuuugggaccuggugcaccgcgagcgagagcugcauaagcaggguaagugcgcgaccugcguguacaacaugaugggcaagcgagagaagaagcucggugaguucgggaaggccaaggggucucgggccaucugguacauguggcuaggcgcccgcuucuuggaguucgaggcgcucggcuucaugaacgaggaccauugguucuccagggagaacagccuguccggggucgagggcgagggauuacacaagcucggcuacauucugcgcgacauuuccaaaaucccggguggcaacauguacgccgacgacaccgccggcugggauacacgcaucacggaggacgauuugcaaaacgaggccaggaucaccgacaucauggagcccgagcacgcacucuuagcgaagucaaucuucaaacugaccuaucagaacaaagugguccgcguccagcggccggcuaagaacgguaccgugauggacgugaucagucgccgggaucagcgcggguccgggcagguaggcacauacggccuaaacaccuucaccaacauggaagcacagcuaauccggcagauggagagcgaggggaucuucucccccucugagcuggaaacgccgaaccuugcagagcgagugcucgacugguuggaaaaauacggcguggaacggcucaagcgcauggccaucaguggggacgauugcgucgugaagccaaucgacgaccgauucgcgacggcccugaccgccuuaaacgacaugggcaaggugcgcaaggacaucccucaaugggaaccaucgaaaggauggaacgacuggcagcagguacccuucugcucgcaccacuuccaccaacucauuaugaaagacggccgggagauaguuguccccugccgcaaucaggacgaacuggucggucgggcaagagugucgcagggggcuggcuggaguuugcgggagacagccugcuuggggaaguccuaugcccaaauguggcagcugauguauuuccaucgccgcgaucugcgccucgcugccaaugcgauuugcagcgcggugccaguggacuggauuccaaccucccggacaaccuggagcauccacgcccaucaucaauggaugacaaccgaggacaugcugucaguguggaaccgcguguggauugaggagaacccuuggauggaggacaagacgcacauuagcuccuggggcgacguccccuacuuagggaaacgcgaagaccaguggugugggagcuuaaucggccucaccgcucgggccacgugggcgaccaacauacagguugccaucaaccaggugcggcgguugaucgggaaugagaacuacuuagacuauaugacgucaaugaaacgcuucaagaacgaauccgaucccgagggcgccuuaugguag

SEQ ID NO: 24641 - RNA, 9879 nt, Artificial Sequence
  derived and/or modified CDS sequence (opt11) from DENV-1__JQ045665__SS-prME
agcgugaccaugcugcugaugcugaugcccacggcccuggccuuccaccuuaccgcgcgcggcggggagccacacaugauugugagcaaacaggagcgugggaagucccugcucuuuaagacauccgccggggugaacauguguacguuaaucgccauggaccugggcgagcugugcgaggauacuaugaccuauaaauguccgcggaucacggaaaccgagcccgacgacgucgacuguuggugcaacgccaccgacaccugggugacuuacgggacgugcucccagacgggggagcaccggcgggacaagcgguccgucgcccucgcgccccacguuggucugggccuggaaacgcgcaccgaaacguggaugagcuccgaaggugcuuggaaacaaauucaacggguugagacaugggcccuccgucaucccggguucacuguaaucgccuuauuuuuggcgcaugccaucggcaccagcaucacgcagaaagggauuaucuuuauacuccugauguuaguuaccccuuccauggccaugcggugcgucggcaucggcagccgcgacuucguagagggacucucaggcgccacgugggucgacgucgugcuggaacacgggagcugcguaaccacuauggccaaagauaaaccgacccuggauaucgaacuccugaagacagaggucacaaacccagcuguacuccggaaacucuguaucgaggcgaagaucucaaauacuacuacggauagucgguguccgacccagggcgaggcgacucugguggaggagcaggacgcaaacuucgucugucggcgcaccuucguggaccggggcugggggaacggcugcggguuauucggaaaagguucccucaucacgugugccaaguucaagugcgucaccaaacuggaaggcaaaaucguacaguacgagaaccugaaguacuccgugaucgugaccguccacaccggagaccagcaccagguugggaacgagagcacugaacacggcaccacugcuacuaucacaccccaggccccgacuacagagauucagcucaccgacuacggggcccucacccuggacugcucgcccaggacgggauuagauuuuaacgagaugguccuccugaccaugaaggagaagucauggcucguccacaagcagugguucuuggaccugccucucccguggaccuccggggccagcacaucccaggagaccuggaaucggcaggaccugcuggugacauuuaagaccgcccacgcgaaaaagcaggagguuguuguguuagguagccaggaaggcgccaugcauacggcucugacgggcgccacagaaauucaaaccucggguaccaccacuaucuucgcuggucaccugaagugccgccucaagauggacaaguugacccugaaaggcaugagcuacguuauguguaccgggaguuuuaagcucgagaaggagcuagcagaaacgcagcacggcaccguguugguucagaucaaguacgaggggacugacgccccgugcaagaucccauucagcacacaggaugagaagggggccacgcaaaacggccggcugauuaccgccaacccgauugucaccgauaaggagaagcccgugaacaucgaagccgagccgccuuucggggaaagcuacaucgugaucggggcgggagagaaagcccucaaguuauccugguuuaagaagggcuccagcaucggcaagauguucgaggccaccgcccgcggcgcgcggcgaauggccaucuuaggcgacacggccugggauuuuggcuccaucgggggagucuucaccucagugggcaagcugguacaccagaucuucggcaccgccuaugggguccuguucuccgguguguccuggaccaugaagaucggcaucggcguccugcucacauggcugggccugaacucccgcagcaccagccucagcaugacgugcaucgccgucgggcuggugacccuguaccucggggugaugguccaggcagauucagggugcgugaucaauuggaagggccgggagcugaaaugcgggagcgggaucuucgugacgaaugaagugcacaccuggaccgagcaguauaaguuccaggcugacuccccgaagcgccuguccgccgccaucggcaaggcaugggaggaggguguguguggaauacggagcgcgacccgccuugagaauaucauguggaaacagaucaguaacgaacucaaucacauuuuguuagagaacgacaugaaauuuacuguggucguaggggacguggccggcauccuggcccaaggcaagaaaaugauacguccccagccaauggaauacaaauacagcuggaaauccugggguaaggccaaaaucauaggcgcggauguccagaacacgaccuucaucauagaugggccgaacaccccugaauguccugacgaucagcgugcguggaacaucugggagguagaggacuacggguucgggaucuucacuacgaacaucuggcuaaagcugcgggacucuuacacccaggugugugaccaucgccugaugucggcugccaucaaggacagcaaggccgugcaugcggacaugggguauuggauugaguccgagaagaaugagaccuggaaacuggcccgggccagcuucaucgaggugaagaccuguaucuggccgaaaucccauacgcucuggucaaauggcguacuggaguccgagaugaucaucccgaagauuuacgguggcccgauaagccagcauaacuaucgacccggguacuucacucagaccgcuggacccuggcacuuagggaaguuagaguuagauuuugaucuaugugaaggcacgacggucguggugaaugagcacugugguaacagagggccaucccugagaaccaccaccgucacgggcaaaaucauacacgaguggugcugccggagcuguacccugccacccuuacgguuccgaggggaggacggcugcugguaugggauggagauccgacccgugaaggagaaggaagagaaccuggugaaguccauggucuccgcgggcucaggugagguagacucuuuuucccugggacuccuguguauauccauaaugaucgaagaggucaugcggucccgccugucccggaagauguugaugacaggcacccuggcggucuucuuccugcugauaauggggcaguugacauggaacgacuugauccgccugugcaucauggugggcgccaacgcaagugacaggauggggaugggcaccaccuaccucgcacugauggccacuuucaaaaugaggccgauguucgcugugggacugcuuuuccgccggcugacgucacgcgaaguccuuuuacugacaauugggcugagccucguggcauccguggaacugcccaacagccucgaagagcucggcgacgggcuggccaugggcauuaugauccugaaacuccucaccgauuuccagucccaccaacugugggccaccuugcugagccugacguucaucaagaccaccuucagucuccaccacgcguggaagacuauggccaugauccugagcauuguuucucucuuuccucucugccugagcacgaccucucagaagacgacguggcugcccguguuacugggcaguuuggggugcaagccucucacgauguuccuaaucgccgagaacaagaucuggggucggcgcuccuggccccuuaacgagggaauuauggccguagguauagugagcauccuccucucgucccuccucaaaaacgacguuccccuggcagggcccuuaaucgcgggcgggaugcucaucgcgugcuacgucauuucuggauccucugccgaccugucccuggagaaggccgcagaggugagcugggaggaggaggcggaacacuccggcgccucccacaauauacucgucgagguucaggacgacgguaccaugaaaauaaaagacgaggagcgggaugacacccugacgauuuugcucaaggcuacccuucuggccgugucaggcgucuacccgcuaagcauccccgccacacuuuucgucugguauuuuuggcagaagaaaaagcagcguucuggagugcuaugggauacccccagcccgcccgaggucgagcgugccgucuuagacgacggaaucuaccgcauaaugcagcguggacuccucgggagaagucaggugggcguggggguuuuucaggagaacguuuuccacacuauguggcacguaacccgaggcgcgguccugauguaccaggggaagcggcucgaaccuucgugggcauccguuaaaaaggaccucaucagcuacggagguggguggcggcuacaaggcucauggaacacgggcgaggaagugcaggucaucgcgguggagcccggaaagaaccccaagaacguacagaccgccccgggaacauucaagacccccgagggugaggucggcgcaaucgcccucgacuucaagccggggacgucagguucgcccauagugaaccgagaggggaagauaguaggacuguacggaaauggggucgugacaaccagcgggaccuaugucucugcaauagcccaggcgaaggccucccaggaggggccucugccagagauugaggacgaggucuuccguaagaggaaccucacgauaauggaucuacacccgggaagcgggaagacacggcgcuaccuccccgcaaucgugcgcgaagccauaaagcgcaagcucaggacacugauccuagccccgacccgcguaguggcuagugaaauggcugaggcacucaagggcaugcccaucagguaccagacgaccgccguaaagucugagcacacuggcaaggagaucguugaccugaugugccaugccaccuucaccaugaggcugcugucgcccguccgagugcccaacuacaacaugaucaucauggacgaggcacacuucaccgaccccagcuccauugcggccagaggcuacauuagcacacgcguggggaugggggaggccgccgcuaucuucaugaccgcuacuccgcccggcuccgucgaagccuuuccccaaagcaaugcggugauccaggacgaagagcgggacauccccgagcgcagcuggaauagcggauaugaguggaucaccgacuuuccgggaaagaccguuugguucguccccuccauuaaguccggcaacgacauugcaaacugccugcggaagaauggcaagaggguaauccaacugucccggaagacguucgacaccgaguaccaaaagaccaaaaacaacgauugggacuacguggucaccaccgacauuucggagaugggugcgaacuuccgcgcagaccgggucaucgacccgcgccggugccucaagccugugauacuuaaggacggacccgagcgcguaauccuggccggccccaugcccgugacgguggccuccgcggcgcagagacgagggcguaucggucgcaaccauaacaaggagggcgaccaauacauauacaugggucagccccugaacaacgacgaagaccacgcccacuggaccgaggccaagaugcugcuggacaacauaaacaccccggaggggaucauccccgcccucuucgagccggaacgcgaaaaguccgcggcgaucgauggggaguaccgguuacgcggagaggcacggaaauccuucgucgagcugaugcgccgcggcgaccucccaguuuggcuaagcuacaagguugccuccgaagguuuccaguacuccgaccgccgguggugcuucgacggugagcgcaauaaccaaguacuugaggagaacauggacguggagaucuggacaaaagagggcgagcggaagaagcuccgcccacgaugguuagacgcacgaacguacagcgacccccuggcgcugcgggaauucaaggaguuugccgcuggcagacguuccgugagcggggaccugauacuggagaucggcaaauugccgcagcaucugacccagcgcgcccagaacgcucuggauaacuuaguuaugcuccacaacucugaacagggugggcgggccuaccgccaugcgauggaggagcuacccgacaccauugaaacuuugaugcugcuggcgcucaucgccgugcugacgggcggggucacacuuuucuucuuaagcggacgggggcuggguaagacguccaucggacuguuaugcgugauggcgucuagcguguugcuguggauggcgagcgucgagccccacuggaucgcugcuuccaucauccucgaguucuuccucauggugcuuuugaucccagagccggaucgccaacgaacgccccaggacaaucagcuggcuuacguggucaucggucuccuguuuaugauucugaccguugcggcgaacgaaaugggcuuacucgagacgacuaagaaggaccuggggaucggucacguugcgguggaaaaccaccaccaugccgccaugcuggacguggacuugcauccggccagcgccuggacgcuguacgcgguggccaccacgaucaucacgccgaugaugcgccacacaauagagaauaccacggccaacaucuccuugaccgccauugcuaaucaggccgcuauucucauggggcuagacaagggguggcccauuaguaaaauggauaucggcguacccuuacucgcgcuggggugcuacucgcaggugaacccccugacccuaacugccgccgugcugaugcuggucgcacacuaugcgaucaucggaccuggccuccaagcaaaggccacgagagaagcccaaaagcggaccgccgccggaaucaugaagaaccccaccguggaugggaucguggcgaucgaucuggacccuguaguguacgacgcgaaguucgagaaacaacugggccagaucaugcuccugaucuuguguaccagccaaauccuacugaugaggaccaccugggcccugugcgaguccaucaccuuggcuacaggcccccugacgacgcuuugggaggggagcccgggcaaguucuggaacaccaccaucgccgucuccauggcgaacaucuuucgugggagcuacuuagccggcgccggcuuggcguuuucgcugaugaagucccucgggggcggucguaggggcacgggggcgcagggcgagacccugggcgagaaguggaaacgccagcucaaccagcucagcaaguccgaguucaacacguacaaacggagcggaauaauggagguagaccgcagugaggccaaggagggccugaagcgcggcgagaccacuaaacacgcggucucgcguggcaccgccaaacugcggugguucgucgagcgcaaccuggucaaacccgaagggaaggugaucgaucuuggcugcggccggggcgggugguccuacuacugcgccggguugaaaaaaguuaccgaggucaaaggguacaccaagggugggccaggucacgaggaacccauaccgauggcgacguacgguuggaaccuggugaagcuucacagcgguaaggacguguucuucaucccucccgagaagugugacacccugcugugcgacaucggggaaagcucgccgaacccgaccauagaggaaggccgcacacuccgcguucugaagaugguggagcccuggcugcgcggcaaccaauuuugcauaaaaauccucaaccccuacaugcccucggugguagagacacuggagcagaugcaaaggcgccacggggggaugcuuguucgcaacccgcuaucacgcaacucgacccaugagauguacugggugagcugcgggaccggcaacaucgucucggcagugaauaugaccagccggauguuguuaaaccguuucaccauggcccaccgcaagcccacguacgagcgggauguagaccuuggcgccgguacacgccacguugccguagagcccgaaguggcgaaccuggacaucaucggccagcggaucgagaacaucaagcacgagcacaagagcaccuggcacuacgaugaggauaaccccuacaagaccugggccuaucacgggucuuaugaaguaaagccgucuggcagcgccagcuccauggugaacggagucgugaaacugcuuacgaagccaugggacgucauacccauggugacucagaucgccaugacugauaccacgccguucgggcagcaaagaguauuuaaggagaaaguggacacccggaccccgaaggccaagcgggggaccgcacaaauaauggagguaacagcgaagugguuauggggcuuccugucgcgaaauaaaaagccccgcauuugcacacgagaggaguuuacacggaagguacgguccaacgccgcgaucggcgcgguguucguagacgagaaccaguggaacagcgcgaaggaggccguggaggacgaaagauuuugggaccucguacaccgugagcgcgagcugcacaagcagggaaaaugugcgaccuguguauacaauaugaugggcaagcgggagaagaagcugggggaguucggaaaagcuaagggguccagggcuaucugguacauguggcucggugccagauuuuuggaguucgaagcccuugguuucaugaacgaggaccacugguucagccgcgagaacucccucucugggguggagggcgagggcuuacauaaauugggcuacauauuacgggacauauccaaaauccccgggggaaauauguacgccgaugacacggcuggcugggauaccaggauuacugaggacgaccugcaaaacgaagcgcgcaucacugacaucauggaaccugagcacgccuuacucgcaaagagcaucuucaagcucacguaucagaacaaggucgugcggguucagcgccccgccaagaacggcacugugauggacgucaucagucggcgcgaccagcggggcaguggccagguugggaccuauggccucaacacguucacuaauauggaggcucagcuaauccgccagauggaguccgaagggauauucuccccauccgaauuggagacgccaaaccuggcagaacggguccucgauuggcuugagaaguacggcguugagcgacucaagcggauggcaaucucgggagacgacugcgugguuaagccgaucgacgaucgcuucgccaccgcacucacagcccugaacgacaugggcaaaguccgaaaggacauuccccagugggaacccuccaagggguggaacgacuggcagcagguccccuucugcagccaccacuuccaccagcuaaucaugaaggacggucgcgagauagugguuccgugucggaaccaagacgagcucgugggacgcgcacgggugagccagggggccggcuggucccuucgcgagaccgcaugucugggcaaaaguuacgcccaaauguggcagcucauguauuuccaccggagggaucuccggcucgcggccaaugcgaucugcucggccguacccgucgacuggauaccuacgaccuguaccacguggucuauccacgcccaccaucaguggaugacgaccgaggacaugcucagcguuuggaaccgcgucuggauagaggagaaccccuggauggaggacaagacacacauaucauccuggggggacgugccguaccugggcaaacgcgaggaccaguggugcggcagccucauaggacucacggcgcgagccaccugggccaccaauauccaaguggccauaaaucagguacgucggcucaucgggaacgagaacuauuuagacuacaugacuuccaugaagcgcuucaagaacgagagcgaccccgagggcgcccucugguag

SEQ ID NO: 24642 - RNA, 9879 nt, Artificial Sequence
  derived and/or modified CDS sequence (opt11) from DENV-1__JQ045666__SS-prME
ucaguuacuauguugcucaugcugaugcccacggcgcuagccuuccaucucaccgcccggggcggugaaccccacaugauugugucuaagcaggagcggggcaagagccuguuguucaagaccuccgccggggugaacaugugcacccucaucgccauggacuuaggcgagcuaugcgaggacaccaugaccuacaagugcccccggaucaccgagaccgaaccugacgacguggacugcuggugcaacgcuaccgacacgugggugaccuacgguaccugcagccagacuggggagcaccggcgcgauaagcggucuguggcccuagcaccccaugucggguuggggcuggagacucgaacugagaccuggaugucuuccgagggcgccuggaagcagauucagcgggucgagaccugggcccuccgucaccccggguucacgguaaucgcccuguuucuagcgcacgcgauugguacgagcaucacccagaaggggauuaucuucauccuccuuaugcuggugacccccucgauggcgaugcggugcgucggcaucggcucucgugacuucgucgaagggcucucaggcgcaacguggguggacguuguccuugagcacgggagcugcgugaccaccauggccaaggacaagcccacucuggacaucgagcuccugaaaacugaagucaccaacccugccguccuaagaaagcucugcaucgaggccaaaaucucaaauaccaccacagacagucguuguccuacccagggcgaggccacucucguggaggaacaggaugccaauuucgucugccgccgcacauucguggaccgggguugggggaaugggugcgggcuauucgggaaggggucccucaucaccugugccaaguuuaagugcgugaccaagcuggaaggcaagaucguccaauacgagaaccucaaguacagcgugaucgugaccguccacaccggcgaucagcaucagguggggaacgaguccacggagcacggcaccaccgcgaccaucacgccacaggcccccacgacugagauccagcugaccgacuacggugcccugacacuggacugcagcccccgcacaggccucgacuucaacgaaaugguccuguugaccaugaaggagaagaguuggcucguccauaagcagugguuccuggaccugccccugccguggaccagcggggccagcaccucccaggagacguggaaccgucaagaccugcucgucacguucaaaaccgcccaugcgaagaagcaggagguaguggugcucggcucccaggagggugccaugcacaccgcccugacgggagccaccgagauucagacuuccgggaccacgaccaucuucgccggccaccucaagugccgccucaagauggacaaacugacgcugaaggguaugagcuacguuaugugcacggggagcuucaaguuggagaaagaacuggccgaaacccaacauggcacggugcuggugcaaauuaaguacgagggcaccgacgcaccgugcaagauccccuucagcacccaggacgagaagggcgccacgcaaaacggucggcucauuacggccaacccgaucgucacugacaaagagaaacccguaaacaucgaggcggagccgcccuuuggcgaguccuacaucguuauuggggccggugagaaggcccucaaguugucaugguucaagaaagggucaagcaucggcaagauguucgaagccacagcccgcggggcgcggcgcauggccauacugggcgacacggccugggacuucggguccaucgguggcgucuucaccagcgugggaaagcucgugcaccagaucuucggcaccgccuacggcguccucuuuucuggcgugaguuggaccaugaagaucgggaucggugugcugcucacguggcugggccucaauucccggucaaccucccucagcaugaccuguaucgccguaggacuggugacccuguaccucggcgugaugguccaggcggacagugggugcgugauuaacuggaagggucgggagcugaagugcggaaguggaaucuucgugacaaacgaaguacacacauggaccgagcaguacaaguuccaggccgacagccccaaacgccuuuccgccgcgauaggcaaggccugggaggagggggugugcggcauccgguccgcgacccgccucgagaacaucauguggaagcagaucuccaacgagcucaaucacauccugcucgagaaugauaugaaauucaccgugguggugggggacguggcaggaauccuggcccaagggaagaaaaugauccguccccagcccauggaguacaaguacucuuggaagucuugggguaaagcgaaaaucaucggcgcggauguccagaacacgaccuuuauaaucgacgguccuaacaccccggagugcccagacgaccagcgcgccuggaacaucugggagguggaggacuacggcuucgguauuuuuacaacgaacauuuggcucaagcucagagacucguacacccaggugugugaucaucgccugaugucagcggccauuaaggauucuaaggccguccaugcggacaugggcuacuggauagaaagugagaagaacgagaccuggaagcuggcucgggccagcuucaucgaggugaaaaccugcaucuggccgaaaucgcacacgcucuggucgaacggcguucuggaaagugagaugauaauccccaagaucuacggagggccgaucagccagcacaacuaucgccccggauacuucacccagacggcuggccccuggcacuuggggaagcucgaguuagauuucgaccugugugagggcaccacgguuguggucaaugagcacugcggcaaccgcgggcccucacuccgcacgaccaccguaacuggaaagauaauucacgaguggugcugccggagcugcacccugccaccccugcgcuuccggggugaggacggcugcugguacgggauggaaaucagacccgugaaggagaaagaggagaaccucgugaagucuauggucagcgccggcagcggcgagguugacaguuucagccucggucuucuuuguauauccaucaugaucgaggaggugaugcggagccgacugucccggaagaugcuuaugaccggcacuuuagccgucuuuuuccugcugaucaugggccagcucacguggaacgaccucauccgccugugcaucauggugggcgcaaacgccagcgaccguauggguaugggcacaaccuaccucgcccugauggccaccuucaagaugcggccgauguuugccguuggccuccuauucagacggcugacgucucgcgagguucuucuccugacaaucgggcugagcuuagucgccagcgucgaguugccgaacagccuggaagaacucggcgacgggcuggccauggguaucaugauccuuaagcucuuaaccgacuuccagucucaccagcugugggccacccuacugagccugacguuuaucaaaaccaccuuuucauuacaccacgcguggaagaccauggccaugauucucucgaucgugagucuguucccccucugcuugagcacuaccagucaaaagaccaccuggcucccuguacuauugggcagccuggggugcaagccgcucacaauguuccucaucgccgagaacaagauaugggggcggagguccuggccccugaacgaggguaucauggcggucggcaucgugagcauccuccugagcucucugcuuaaaaacgacgugccucucgccgggccacugaucgcgggcgggaugcuaaucgccuguuacgucauaagcggaucuucugccgaccuuucccuugaaaaggccgccgagguuaguugggaagaggaagcugagcacaguggagcuagccacaauauccuaguugagguccaggacgaugguaccaugaagaucaaggacgaggaacgggacgauacacugaccauccugcuuaaagccacacuacuggcugugucgggcguguauccgcucucaauacccgccacgcuguuugucugguacuucuggcaaaagaagaagcagagaagugggguccugugggauacccccagcccgccugagguagagcgggcgguccuggacgacggcaucuaccgcaucaugcagcggggccuccugggacgcucccaaguaggcgugggggucuuccaggagaacgucuuccacacgauguggcacguuacucggggcgccguccugauguaucaggggaagcgauuggagcccucaugggccuccgugaagaaggaccuuaucagcuacggcggcggguggcgguuacagggcuccuggaacacgggagaggagguccagguuauagccguggaacccggcaagaaccccaagaacguucagaccgcccccgggacauucaagacgcccgagggcgaggucggcgcgaucgcccucgacuucaaaccugggacaagcgggucccccaucguuaaccgcgaaggcaagaucgugggacuguacgguaacggugucgugaccacaagcggcaccuacguuuccgccaucgcgcaggcgaaggccucgcaggaggggccgcuucccgagaucgaggacgaggucuuuaggaaacgcaaccucacaauuauggaccugcaccccggcagcggcaagacccggcguuacuugccggccaucgugcgggaggccaucaagcgcaaacuuaggacacugaucuuggccccaacccgaguggucgcguccgaaauggcggaggcucucaaagggaugcccauacgauaccaaaccaccgccguaaaguccgagcacacuggcaaggagauuguggaccuaaugugccaugccacguucaccaugcgccugcucucgcccguccgggugccaaacuacaauaugaucaucauggacgaagcgcauuuuaccgauccaucauccaucgcggcccggggguacaucagcacccgcguaggcaugggcgaggccgcggcgaucuucaugaccgccacgccgcccgggucggucgaagccuucccgcagagcaacgcugugauccaagaugaggagcgggauauuccagagcgcuccuggaauagcggguacgaguggaucaccgauuucccaggcaaaaccguaugguucguaccauccaucaagagcggcaacgacauugcgaacugucugcggaagaaugggaaacgcgugauucagcugucccgcaagaccuuugacacggaguaccagaagacgaaaaacaacgauugggauuacgugguaaccaccgacaucagcgagaugggcgcuaauuuccgggccgaccgcgugaucgacccgaggcgcugccucaaacccgugauauugaaggacggccccgagcgcguuauacuggccgggccgaugccggugacgguggcguccgcggcccaacgucgagggcggauuggccgcaaccacaacaaggagggagaucaguacaucuauauggggcagccacucaacaacgacgaagaccacgcacauuggaccgaggccaagauguuacuggacaacauuaacacccccgagggcaucaucccggcccucuucgagccggagcgcgaaaaguccgcugccauugacggggaguaccgacuacgaggcgaggcccggaagaguuucgucgagcucaugcggcgcggggacuugcccguguggcucagcuauaaagucgcuagcgaaggcuuucaguacuccgaucgccgguggugcuucgauggagagcgcaacaaccagguucuagaggagaacauggacguagagauauggaccaaggagggggagaggaagaagcuacgcccccgguggcuggacgcccgcacguacucggacccccuagcgcuucgugaguucaaagaguucgcggcgggccgcagauccgucaguggggaccugauccucgagaucggcaagcucccgcagcaccugacccagcgcgcccagaacgcguuggacaaccucguaaugcugcacaacuccgagcagggcgggcgggccuacagacacgccauggaggaguuacccgacaccaucgagacccucaugcugcuugccuuaauagccguccugacggguggcgucacccuguucuuucucucuggccgggggcugggcaagacaaguauuggucugcuuugugugauggcuucauccguacuucuguggauggccuccgucgagccgcacuggauugccgccuccauuauccucgaguuuuuccucaugguacugcucaucccugagccggaucgccagcggacgccccaggacaaucaacuggcuuacgugguaaucggguuacuauuuaugauccugacggucgccgccaacgagaugggucuucuggaaacgacuaagaaagaucuagguaucgggcauguggccguggaaaaccaccaccacgccgccaugcuggacguggaccuccacccugcgagcgcauggacccuguacgccguagcgaccaccaucaucacaccaaugaugcgccacacgaucgagaauaccacggccaacaucucccuaaccgcgaucgccaaccaggcagcaauccucauggggcuggauaagggcuggcccaucagcaagauggacaucggcgucccgcugcuugcucuggggugcuauucccaggucaacccccugacccucacagccgccguucugaugcuggucgcacauuaugccaucauaggccccggccugcaggcgaaggccacgcgcgaggcccagaagcguaccgccgcuggcauaaugaagaauccuaccguugacgggauaguggcgaucgaccuagacccgguagucuacgacgccaaguucgagaagcagcuaggacagaucaugcuacugauccuauguacgagccagauccuccugaugcggacgaccugggcccugugcgagucuauaacgcucgccacgggcccccugacgaccuuaugggagggaagcccgggcaaauucuggaacacaaccaucgcggugucgauggcgaauaucuuccgagggucguaucucgcuggggcuggccuggccuucagccugaugaaaucccucgggggcgggcgcagaggcaccggugcucaaggcgaaacucugggcgagaaauggaagcgucaguuaaaccagcucucgaaauccgaguuuaacaccuacaagcggagcgggaucauggaggucgaccgcucagaggccaaggagggccugaagcgcggugagacuacaaagcacgcagugagccgcggcaccgccaaacuuagaugguucguggagcgcaaccucgucaagccagagggaaaggugaucgaccuaggcugcggccgcggcgguugguccuauuacugugccgggcugaagaaggugacggaggucaagggauauacgaagggaggacccggccacgaggagcccauuccgauggcgacauauggguggaaccuagugaaguuacacagcggcaaggacguguuuuucaucccgcccgagaaaugcgacacccugcucugcgacaucggggagucuagccccaacccuacgauugaggagggccgcaccuuacgggugcugaagaugguggagcccuggcuacgcgguaaucaguuuugcaucaagauacucaaccccuacaugcccuccguggucgagacgcuggagcagaugcagcggagacacggaggaaugcuggugcguaacccucucagccgcaauuccacacaugaaauguacugggucaguugugggaccggcaacaucgucuccgcuguuaacaugaccagccguaugcuccuuaaccgguucacgauggcgcaucgcaaaccaacguacgagcgggacguggaccuaggagccggcacacgccacgucgccguagagcccgagguggcgaacuuagacaucaucggccagcggaucgagaacauuaagcacgagcacaagagcaccuggcacuaugacgaggacaacccauacaaaaccugggccuaccacgggagcuacgaaguuaagccgucagggagcgccagcuccaugguaaacggggucgucaagcugcuaacgaagcccugggacgucaucccaaugguaacccagaucgcuaugacggauaccacuccuuucgggcagcagcguguguuuaaggaaaaaguggacacacggaccccuaaggccaaacgcgggaccgcccagaucauggaggucacugcuaaguggcuguggggcuuccuuucgcgaaauaaaaagccccgcaucugcacccgggaggaguuuacccggaaggugaggagcaacgccgccauaggcgcgguuuucgucgaugagaaccaauggaacagcgccaaggaggccguggaggacgagcgcuucugggaccucgugcaccgggagcgcgagcugcacaagcaggggaagugcgcgacaugugucuacaauaugaugggaaaacgcgaaaagaagcucggggaguucggcaaggccaaagggucccgggcaauaugguauaugugguugggcgcacgguucuuggaguucgaggcccugggauuuaugaaugaggaccauugguucagccgcgagaacagccucagcggcguggagggcgagggguuacacaagcugggguauauccuccgggacaucuccaaaauccccggagggaacauguacgcugacgacacggccggaugggacacccgcauaaccgaggacgaucuccagaacgaggcgcgcaucaccgacaucauggagccggagcaugcgcugcucgccaagaguaucuucaaacucacguaccagaauaagguuguuaggguacagaggcccgccaagaacggaaccgucauggaugucaucucgcggcgagaccagagagggagcggccagguggggaccuacggacugaacacauucacgaacauggaagcacagcucauaaggcagauggaguccgaagggaucuucucgcccucggagcuggagacccccaaccuggcggagcgggugcuagacugguuagagaaauacggcguggagcgucucaagcgcauggccaucagcggggaugacugcguggugaagccgaucgacgaccgcuuugccacugcccugacggcgcugaaugacauggguaagguccggaaggacaucccccagugggagcccucgaagggauggaacgacuggcagcagguucccuucugcucgcaccauuuccaccagcugaucaugaaggauggucgagagauagucgucccgugucggaaccaagacgagcuugugggacgcgcaagagugagccagggggcuggguggucacugcgcgagacggccugccuaggcaagaguuacgcccagauguggcagcucauguacuuucacaggcgcgaccugcgacuggcggccaacgccaucugcuccgccgugcccguggauuggauucccaccagccgcacuacuugguccauccacgcccaccaccaguggaugacgaccgaggacauguuaagcguguggaaucgcguuuggauagaagagaaccccuggauggaggauaagacucauaucuccagcuggggagaugugccguaucuggggaaacgggaggaccaguggugcgggucccugauaggccucaccgcgcgcgccacgugggccaccaacauccaaguggcgauaaaccagguucggcgccugaucgggaaugaaaacuaucuugacuauaugacaagcaugaagcgguucaagaacgaguccgaccccgagggugcucucugguga

SEQ ID NO: 24643 - RNA, 9879 nt, Artificial Sequence
  derived and/or modified CDS sequence (opt11) from DENV-1__JQ045667__SS-prME
agcgugacgaugcugcucaugcugaugcccaccgcucuggccuuccauuugaccacccggggcggggagccccacaugauagugucaaaacaggagcggggcaagagccugcuguucaagaccagcgccggggucaacauguguacccugauagccauggacuugggugagcugugcgaggacaccaugaccuacaaguguccccgcaucacugaaaccgagccagacgacguggacugcugguguaacgcgacggauaccugggugaccuacgggaccugcagccagacgggcgagcaccggcgcgauaaacgguccguggcgcucgcgccccacgugggccugggacuggagaccagaaccgagaccuggaugagcuccgagggcgcauggaagcaaauccagcggguagaaacgugggcccuccgccaccccgguuuuaccgugaucgcccucuuucuggcccacgcuaucggcaccagcaucacccagaaggggaucaucuuuauccuccugaugcuagucacgccgaguauggccaugcgcugcguaggcaucggcucacgagacuuuguagaaggacucuccggcgccaccuggguggacgucguucuggagcacggcagcugcgugacgaccauggcaaaggacaagccuaccuuagacaucgagcuccugaagaccgaggucacgaaccccgccauccugagaaagcucugcaucgaagcgaagauaagcaacaccacgaccaacagccgcugcccgacccaaggcgaggcaacccucguggaggagcaggacgcgaacuucgucugcaggcgcacguucgucgacaggggcugggggaacggcugcgggcuuuuuggaaaggggucccucaucacgugcgccaaguucaagugcgucacgaagcuggagggcaagaucgugcaguaugagaaccugaaauacucagucaucgucaccguacacacaggcgaccagcaucaagucgggaacgaguccaccgagcacgguaccacagccacaaucacgccccaggcgcccacgaccgaaauccaacucaccgacuauggggcccugacgcuggauugcagccccagaaccggccucgacuucaacgaaaugguuuugcugaccaugaagggaaaauccugguugguccacaaacaaugguuccuggaccugccacucccuuggaccuccggcgccagcacgucccaggagaccuggaaccggcaggaucuguuaguuaccuucaagaccgcccacgccaagaagcaagagguggucgugcucggcucucaagagggagcgaugcacacggcccugaccggggccaccgagauccagaccucagguacgaccaccauauucgccggccaccugaagugcaggcucaaaauggacaagcugacccugaaggggaugagcuacgugauguguacgggguccuucaagcuggagaaggaggucgccgagacccagcacggcacuguccuggugcagaucaaauacgaagggacugacgcccccugcaagauccccuucagcacgcaggaugaaaagggcguuacgcaaaacggucggcugaucaccgccaacccgaucgugacggacaaggagaagcccgugaacauagaggccgagccgccauucggcgaguccuacauugugauuggcgccggggagaaggcgcugaaauuaagcugguucaagaagggaaguagcauugggaagauguuugaggccacugccagaggcgcgaggcggauggccauccugggggacacagcgugggacuucgguuccaucggcggcguguucacaagcguaggcaagcugguccaccagauauucgggaccgccuacggagucuuauucuccggagugagcuggacaaugaagauagggaucggcguucugcugaccugguuagggcugaauucccgguccaccuccuuaagcaugacguguauagccgugggccuugugacuuuauaccugggggucauggugcaggcggacuccggcugcgucauuaauuggaaggggcgggagcucaagugcggaagcggcaucuucgucaccaacgaagugcacaccuggacagagcaguauaaguuucaggccgacuccccgaagcgccuguccgccgccaucgggaaggccugggaggagggagugugugggauucggagcgcgacccgcuuggagaauaucauguggaagcagauuuccaacgaguuaaaccauauccugcuggagaacgauaugaaguucacgguuguaguaggcgacguugccgggauccucgcgcagggcaagaagaugauccggccccagcccauggaguauaaauacagcuggaaaucuuggggcaaggccaagaucaucggagcugacgugcagaacacaaccuuuaucaucgacggccccaauaccccggaaugccccgacgaccagcgugccuggaauaucugggagguggaggauuacggguucggcaucuucacgaccaacaucuggcugaagcugagggacagcuacacccaggucugcgaccaccggcucauguccgcggccaucaaggacagcaaggccguccacgccgacauggguuacuggaucgagagcgagaagaacgagaccuggaagcuggccagagccucuuucaucgaagugaagacgugcaucuggccuaaaucccauacccuguggagcaauggcgugcucgaauccgagaugauuaucccgaaaauauacggcggucccaucagccagcacaacuaccgccccggcuacuucacacagacagccgggcccuggcaccuggggaagcuggagcucgacuucgaccugugugagggcacaacggugguggucgaugaacauugugggaaccgcggcccgucccugcgcaccaccacaguaaccgggaagaucauccaugaauggugcugccggaguugcacccugccaccccuccgcuuccggggcgaagacgggugcugguacggcauggaaauccgccccgugaaagagaaggaggagaaccuggucaagaguauggugagugccgggucaggagagguggauucguucucccugggccuauuaugcaucuccauuaugaucgaggaggucaugcgcucacgcugguccaggaagaugcuuaugaccgggacguuagccguguucuuccuccucauaaugggccagcucaccuggaacgaucucauccgacucugcaucauggucggugccaacgcgagcgaucgcaugggcaugggcaccaccuaucuugcccugauggcgacguucaaaaugcggccaauguucgccgugggccuccuguuccgacgccugaccucccgcgaggugcuacuacugacaaucggccucagccugguggcauccgucgaguugccuaacucacucgaggagcugggggacgggcuggcgaugggcauuaugauccucaagcugcugacagacuuucaaucauaucagcugugggcgacacuucuaagccucaccuucaucaagacaaccuuuucccuucauuacgccuggaagacgauggccauggugcugucaaucguaucgcucuucccccugugucugagcaccacuucccagaagaccacuuggcuccccguccugcucgggagccucggcuguaagccgcuaacuauguuuuuaauugccgaaaacaagauuugggggcggagguccuggccccucaacgaggguauaauggccgucgggauaguaaguaucuuacugagcucccuccugaagaaugauguacccuuggccgggccacucaucgccggagggaugcugauggccugcuacgugaucagcggcuccagcgcggaccugucccucgagaaggccgcggagguuucaugggaggaggaggccgagcacuccggggcaagccacaacaucuuaguugaaguucaaggcgaugggacuaugaagaucaaggacgaggaacgggacgauacccugaccaucuuacugaaggcgacgcugcucgccgucucaggcguguacccgcugagcauccccgcaacccuguucgugugguacuucuggcaaaagaagaagcagcgcuccggcgucuuaugggacacccccucuccgccugaggugggacgggcaguacuggacgacggcaucuacagaaucaugcagcggggucugcuuggacguucccaggucggggugggcguguuucaggagaacgucuuccacaccauguggcacgucacgcggggcgccguacuuauguaccaggggaagcgccuggagccuagcugggcgagcgucaagaaggaccuaauuagcuacggcgguggcuggcggcuccaggggaguuggaauaccggcgaggagguccaggugaucgcaguagagcccggcaagaaucccaagaacgugcagaccgcgcccgggacguuuaagacgccagagggcgaggucggggccaucgcccuugacuucaaacccggcaccagugguuccccuaucgucaaccgcgaggggaagaucgugggccuguacgggaacggcguggugacaaccagcgguacguaugugagcgcgaucgcacaagcuaaggcaucccaggagggcccgcugcccgagauugaggaugagguguucagaaagagaaacuugaccaucauggaccugcaccccggcagcgggaagacccggcgcuaccucccggcgauaguccgggaggcuaucaagcgcaagcuucgcacccucauccucgcccccaccagagucguagccuccgagauggccgaggcguuaaagggcaugccaauacgguaccagaccacggccgugaagagcgagcacacugggaaggagaucguggaccugaugugccacgccacguucaccaugcgucuccugucccccgugcgcgucccgaacuacaacaugaucaucauggacgaggcccacuucaccgaccccagcucuaucgccgcgagaggguacaucucuacacgcguugggaugggagaagccgccgccaucuucaugacggcuacgccuccuggcuccguggaggcguuuccgcaaagcaacgccgucauccaggacgaggaaagagacauccccgagcgcaguuggaauagcgguuacgaguggaucaccgauuuccccgguaagaccgugugguucgugccauccaucaagagcggcaacgacauugcuaauugccuccgcaaaaacggcaagcgcgucauccagcucucccgaaagacuuuugacacugaguaccagaagacgaagaacaaugacugggacuacguugugaccacggacaucagcgagaugggggcaaacuuccgcgcggacagaguaaucgacccgaggaggugccugaagcccgugauacugaaggacggcccggagcgugugauucucgccggacccaugccggugacgguggcauccgccgcccagcggcgcgggcggauuggccguaaucauaauaaggagggggaccaguacauauauaugggccagccccugaacaaugacgaggaccaugcgcauuggacugaagcuaagauguuguuggacaacaucaacacccccgaggggauuauccccgcccuguucgagccggagcgcgagaaaagugcugcaaucgacggcgaguaccggcugaggggcgaggcgcggaagacguuugucgagcucaugcgccgaggggacuuacccguguggcuguccuacaagguggcuagcgagggcuuccaguacucggaccgccgguggugcuucgacggggaacggaacaaucagguccuggaggagaacauggacguggagaucuggaccaaggagggcgagcggaagaagcuaaggccccgguggcuggacgcccgcaccuacuccgacccgcucgcucugcgggaguucaaggaguucgccgcuggccgcagaagcguguccggugauuugauccucgagaucggcaagcucccgcagcaucuaacccagagggcccagaacgcacucgauaacuuggucauguugcacaacagugagcagggcgggcgcgccuaccggcacgcaauggaggaacuccccgacacgaucgagacccugaugcugcuggcccuaaucgccguccugacggggggcgugacccucuucuuccuguccgggcggggucuaggcaagaccagcaucggccuccuaugcguaauggccuccagcgugcugcuauggauggccuccguggagccccacuggaucgcggccagcauuauccuggaauucuuccugaugguccuauugauucccgagccggaccgccagcggacgccccaggacaaccagcuggccuacgugguuaucggccuccuguucaugauccugacgguagccgccaacgagauggggcuucuggagacaaccaagaaggaccugggcaucggucacguggccguagagaaucaccaccacgccgccaugcucgacguggaccugcaccccgcauccgccuggacgcuguacgcgguggccaccaccaucauaaccccgaugaugcgccacacgaucgaaaacaccaccgccaauauaagucucaccgccaucgccaaccaagcggccauccugaugggccuggauaaaggcuggcccaucuccaagauggacaucggggugccucuacuagcccugggcugcuacagucaggucaacccccucacgcugaccgcugcggugcugaugcucguggcccacuacgccauuaucggaccuggccugcaggccaaggcgacccgcgaggcgcagaagcggaccgccgccgggauuaugaagaaccccacggucgaugggauuguggccaucgaccuggacccggugguuuacgacgcuaaguucgagaagcaguugggacagaucauguuacuuaucuuaugcacuucccagauccuucucaugcguaccaccugggcguuaugugagagcaucacgcuggccaccgggccccugaccacccuuugggaggguuccccgggaaaguucuggaacacaacaauugccgugagcauggccaacauauuucgagguuccuaccuagccggcgcgggguuggccuucagcuuaaugaagucccucggcgggggccgccguggcacgggggcccagggcgaaaccuugggggagaaguggaaacgccagcucaaucagcuguccaaaagcgaguuuaacaucuacaagcggucgggcaucauggagguggaccgcagcgaggccaaggaagggcucaaacggggagagacgaccaagcacgcggucuccagaggcacugccaagcuccggugguuuguggagcgaaaccuggugaagcccgaagggaaagucaucgaccuuggcugcggccggggcggguggagcuacuacugcgcgggucugaagaaagugacggaggucaagggcuauacgaagggcgggcccggacacgaggagcccaucccgauggccaccuacggcuggaaucuuguuaaguuacacuccgggaaggacguguucuucaucccgccggagaagugcgauacucugcuuugugauaucggagagagcuccccaaacccgaccaucgaggagggcaggacgcuucgugugcuuaagauggucgagcccugguuacgcgguaaccaguucugcauuaagauccuuaacccauauaugccgagcgugguggagacccuagagcaaaugcagcggaaacacggggggaugcuaguccgcaacccgcugagccguaacucaacccacgagauguauuggguguccuguggcaccggcaacaucguaucggccgugaacaugaccucccgaaugcuacucaaucgcuucacgauggcccacagaaagcccaccuacgagcgugacguggaccugggggcgggcacccggcacguggccgucgagccagagguggcaaaucuggacaucaucggccagcgcauugagaacaucaagcacgagcauaagagcacguggcacuacgacgaagauaaccccuacaagacgugggcauaccacggcuccuacgaggugaagccgagcggguccgcgucgucuauggugaacggagucgugaagcuucugaccaagcccugggacgugauccccauggugacccagaucgccaugaccgauacgacucccuuuggccagcagcgggucuuuaaggaaaagguagacacacgcaccccuaaggcgaagcggggcacgauccagaucauggagguaaccgccaaguggcuguggggcuuccucucccgcaauaagaaaccccgcauauguacccgagaagaguucacccggaaagugcggagcaacgcggcaaucggggccguauucguggacgagaaccaauggaacuccgcuaaggaagccgucgaggacgagcgguucugggacuuggugcaccgcgaacgcgagcugcacaagcagggaaagugcgcgacguguguguacaacaugaugggcaagcgcgagaaaaaacucggcgaguucggaaaggccaaggggucccgggccaucugguacauguggcugggggcccgguucuuggaguucgaggcccucggguucaugaacgaggaccacugguucagccgggagaacucgcuguccggggucgaaggggaaggacuccacaaguugggauacauccugcgcgacauaagcaaaauccccggaggcaauauguacgcggacgacacugccgggugggauacccguauuaccgaagacgaccugcaaaacgaggcccggaucacggacauuauggagccggagcacgcgcuguuggccaaauccauauucaagcuaaccuaccaaaauaagguggugcgcguucagcggccagcgaagaacggcaccgugauggacgugaucagcaggagggaucaaagaggcuccggucaggucggcacuuacgggcucaacacauucacgaauauggaggcccagcugauccgacagauggagagugagggaaucuucucccccagcgaguuagaaaccccgaaucuugccgagcgcgugcuagacuggcucgagaaguaugggguggaaaggcucaaacgcauggccaucuccggagacgacugcguagugaaaccaaucgacgaccgguucgccacggcccugacggcccugaaugacaugggcaagguccgcaaggauaucccccagugggagcccagcaaaggguggaacgacuggcagcagguccccuucugcagccaccacuuccaccagcucaucaugaaagacggccgggagauuguggugccgugucgaaaucaggacgagcugguggggcgggcccgagugagccagggcgccggguggucacugcgggagaccgcgugccucgggaaguccuacgcgcagauguggcagcugauguacuuccaccgccgggaucugcgccucgcugcuaacgcaaucugcagcgcugugcccgucgauuggaucccuaccucccggaccacauggagcauccacgcccaccaccaguggaugacuaccgaagauaugcuauccguguggaaccgcguuuggaucgaggagaaccccuggauggaggauaagacccauauaagcuccuggggcgacgucccguaccuggggaagcgagaggaccaguggugcggcagccucaucggacugacagcacgcgcuaccugggccacuaacauccagguggcgaucaaccaggugcgccggcugaucggcaacgagaacuaccuggacuacaugacuucaaugaagcgcuucaagaacgagagcgauccagagggggcccugugguga

SEQ ID NO: 24644 - RNA, 9879 nt, Artificial Sequence
  derived and/or modified CDS sequence (opt11) from DENV-1__KU094071__SS-prME
agugugaccaugcugcucaugcuccugcccaccgcccucgccuuccaccucacaacccgcggcggggaaccgcacaugaucgucuccaaacaggagcggggcaaaagccugcuuuuuaagacuuccgcgggugugaacaugugcaccuugauugccauggacuugggggagcucugcgaggauacgaugaccuacaaguguccccgcaucaccaaggcugagccggaugacguggacugcuggugcaacgcgaccgacacguggguaaccuacggaaccuguucccagaccggcgagcaccggcgagacaaacgguccguggcccuagccccacaugugggacuuggccuggagacgcgcgcagagaccuggaugagcuccgagggggccuggaagcagauccagaaggucgagaccugggcccugcgccacccgggguuuaccguuaucgcgcuguuccucgcccaugccaucgggacaagcauuacccagaaggggauaaucuucauccuccugaugcuagugacacccucaauggccaugcgaugcgucggcaucggcaaccgcgauuucguggaggggcuguccggcggaaccuggguugaugucgugcuggaacacgguagcugcgugacgacaauggcuaaggacaagccgacccucgacauugagcuacugaagaccgagguuacaaacccggcgguacuccgcaaacuguguaucgaggcaaagaucucaaacaccacgaccgacucccgcugcccgacgcagggcgaggcaacccugguggaggagcaggacgcuaacuucguaugccgucggaccuucguggaccgcggguggggcaacgggugcggccucuucgggaagggcagucugauaaccugcgccaaauucaagugcguuacgaagcuggaaggcaaaaucgugcaauacgagaaccugaaguauuccguuaucgugacuguccacaccggggaccagcaccaggucggcaacgagaccacugagcacgggacgaucgcgaccaucaccccucaagcgccaacuagcgagauccagcugacagauuacggcgcccugacucucgacugcuccccgcggaccgggcuggacuucaacgagaugguccugcucaccaugaagagaaagagcuggcuggugcacaagcagugguucuuagaucugccguugccauggacguccggcgccagcacaccccaggagaccuggaaucgugaggaccugcucgugacguucaagacggcacacgcgaagaaacaggaggucgugguacuuggcagccaggagggugccaugcacaccgcccuuaccggagccaccgaaauacagacgagcgggacaaccaaaaucuucgccggccaccucaagugucgacugaaaauggacaagcugacccucaaggggaugagcuacgucaugugcaccggcuccuucaaacuggagaaggagguggccgaaacgcagcacggcacgguacugguccaggucaaguacgaagguacggacgcgcccugcaagaucccguucucaacgcaggacgagaaggguguuacccaaaacggucggcugaucaccgccaaccccauugucacagacaaggaaaagcccguaaacaucgaagcagagccaccauuuggcgaguccuacaucguagucggugcgggggagaaggcccugaagcugagcugguucaagaagggcuccagcaucggaaaaaugcuggaagcgaccgcccgcggcgccaggcgcauggcgauauugggggacacggccugggauuucggcuccaucggcgggguuuuuaccagcguaggcaaauuaguccaccagaucuuugggaccgccuacggugugcuguucuccggggugagcuggacgaugaagaucggcauugguauccuucugaccuggcuggggcucaacucgaggagcgcuucccuuucaaugaccuguauagccguuggcauggugaccuuguaucucggugugaugguucaggcugacuccggcugcguaaucaacuggaaggggcgugagcugaagugcggcagcggcaucuuugugacuaacgagguccacacguggaccgagcaguacaaguuccgcgccgauuccccgaagcgccugagcgccgcaaucgggaaggcuugggaggagggugugugugggauucgaagcgcgacccgucucgagaacauaauguggaagcagaucuccaacgagcugaaucauauucugcuggaaaacgacaugaaguuuacggugguagugggggacgugucagggauccugacccagggcagaaaaaugaucggcccccagcccauggagcauaaguacuccuggaagucgugggggaaggcgaagauuaucggcgccgacguucaaaauaccaccuucaucaucgacggcccgaacacacccgagugccccgaugaucaacgggccuggaauaucugggaaguagaagauuauggcuuuggcauuuucacgaccaacaucuggcucaaguugagggauuccuauacccaggugugcgacccgaggcugaugagcgcugccauuaaggacaguaaggccguacacgccgacaugggauacuggaucgagagcgagaagaacgagaccuggcgccuagcgcgggcguccuuuaucgaagucaagacaugcguguggccgaagagucacacccucugguccaacgggguccuggaauccgagaugauaaucccaaagauuuacggaggccccaucucccaacacaacuaccgaccaggguauagcacccagaccgccgguccauggcaucugggcaagcucgagcuggacuuugaccugugcgaagguacgacagugguggucgacgagcauugcggcaaccgggggccaucccuccgcacaaccaccguaaccggcaagaucauccacgagugguguugccggagcuguacgcuacccccgcuccgcuucaagggagaagacggcugcugguacggcauggaaauccgucccguuaaggacaaagaggaaaaccucgucaaaucccuggugagcgccgguagcggugagguggacaguuucucacugggguuacuuugcgucuccaucaugaucgaggagguuaugcgcagccgguggagucgcaagaugcugaugaccggcacucucgccguguuucucuuacucauaauggggcaguugacauggaacgaccuaauccgccucuguauuauggucggcgccaacgcuucugaccgcaugggcauggggaccacauaccuggcucucaucgccacguuuaagaugcgccccauguucgccgugggccuccuguucagacgccuaaccucccgggaggucuuacugcuaacgaucgggcuuagucugguggccuccguggagcugccaaacucacuugaggagcugggcgacggcuuggcgauggguaucaugauccucaagcugcugaccgacuuccaaucgcaccagcucugggccgcccugcuuagccuuacguucaucaagacuacauucucccuacacuaugccuggaagaccauggcuaugguccugagcacggugucccucuucccgcuaugucugagcaccacaucccguaagaccacauggcucccaguguugcugggcagccucggauguaagccccuuaccauguuccugaucgcugagaacaagaucuggggacggaagucguggccgcucaacgaggggaucauggccgucggcaucgugagcauccuacugucuuccuuacugaagaacgacguaccgcuggcgggcccccucauagccgggggcaugcuaaucgcgugcuaugucauaagcggguccagcgccgaucugucccucgagaaagccgccgaagugagcugggaggaggaggcggagcauuccggcgcuagccacaauauccugguugaaguccaggacgaugggaccaugaaaaucaaggacgaggagcgagacgauacgcugacgauccuccuaaaggccacgcuacuagccguguccggaguguacccaauuuccauccccgccacucuguucgucugguacuuucgacagaaaaagaagcagcgcuccggcgugcugugggacaccccgucgccacccgagguggagagggccguacucgacgacggcauuuaccguauccuccagcggggccugcuggggagaucccaggugggcguaggggucuuucaagaggggguguuccacaccauguggcacgugacuaggggcgcgguccucauguaccaagggaaacgccuggagcccagcugggccuccgugaagaaggacuuaauuagcuacggagggggauggagauuccaggguuccuggaauaccggcgaggaaguccaagugaucgccguagaaccgggcaagaacccgaagaacguacaaaccgcccccgguacuuucaagacgcccgaaggcgagguuggagugaucgcccucgacuuuaagccuggcaccagcggcucuccuaucguaaaucgcgaagggaagaucguuggccuguacgggaacggcguaguaaccaccagcggaacguaugugucggcgauugcccaggccaaggccucccaagagggccccuuaccggagaucgaggacgagguuuuucggaagagaaaccucacaaucauggacuugcaccccggcagugggaaaacccggcgguaucugccugcgaucgugcgcgaagccaucaaacgaaaacuccgaaccuugaucuuggcccccacaagagucguggcauccgaaauggccgaggcgcucaagggcaugccgauccgcuaccagacuaccgccgucaagagcgagcacacagggcgggagauagucgaccugaugugccacgcuacguucacgaugcgccugcucucccccgugcgggugcccaacuauaacaugauuaucauggacgaagcccacuucaccgaccccgccucuaucgcugcccguggcuacauuucgacacgggucgggaugggagaggcugccgccaucuucaugacggcgaccccgccuggcucuguggaggcauucccccaauccaacgcagugauccaggacgaggagcgcgacauccccgaacguucauggaacuccgguuacgacuggaucaccgacuucccagguaagaccguuugguucgugcccagcauuaaguccgggaacgacaucgcuaacugccugcgcaagaacgguaagcgagugauccagcucagucgcaagacauucgacaccgaauaccagaagacaaagaacaacgacugggacuacgucguaaccacggacaucuccgagaugggcgccaacuuccgggccgaccgugucaucgaccccaggcgcuguagcaagcccgugauccuaaaggacgguccggagcgggugauccuggccggcccgaugcccgucaccguggcuucagcagcgcagcgccgcggccggaucggccgcaaccagaacaaggagggcgaccaguacauauauaugggacagccgcugaacaacgacgaagaccaugcccacuggacugaggccaagauguuacuggacaauaucaacaccccugagggaaucaucccagcccuguucgagcccgagcgcgguaagagcgcggcgaucgacggcgaauaccgcuuacggggcgaggcccgcaagacuuucguggagcugaugcggcguggcgaccuacccgucuggcucuccuacaagguggccagcgaaggcuuccaguacuccgaccggaaguggugcuucgauggagaacgaaacaaucaggugcuggaggagaacauggaugucgaaaucuggaccaaggaaggggagcgcaagaagcugagaccgcguuggcuggacgcccguaccuauucagacccccaggcccuccgggaguucaaagaguucgcggcagggcgccggagcguguccggagaccucauccucgagaucgggaagcugccacaacaccuaacccaacgcgcacagaaugccuuggacaaccuggugauguugcacaauagcgaacaaggaggcaaggcuuaccggcacgccauggaggaguugccugacacgaucgagacucugaugcugcucgcgcugaucgccgugcugaccggcggcgugacccucuucuuccuuuccgggcgcggccugggaaagacgaguaucggucuucugugcgugauggcguccagcguccuucuauggguggcguccgucgagccccacuggauagcggcgagcaucauauuggaguuuuuccugaugguccuccugauccccgaaccagaccgacaaagaacaccgcaggacaaccaacuggccuacguggugauuggccugcuguucaugauccugaccguggccgcgaacgagauggggcugcuggagaccacuaagaaggaccugggcaucggacacguggccguagaaaaucaccaucacgccacgaugcucgacguagaccuucgccccgcuuccgccuggaccuuauacgcgguggcaaccacaaucaucacccccaugaugcggcacaccaucgaaaacaccaccgccaacaucagccucacggccaucgcuaaccaggccgccauccugaugggcuuagauaagggguggcccaucuccaagauggacaucggggugccucuccuagcccuggggugcuauagccagguaaauccacccacccucaucgccgcgguccugaugcuuguggcccacuacgccaucaucggccccggccuacaggccaaggccacccgcgaggcgcagaagcguaccgcggcugggaucaugaagaaccccacggucgacggcaucguggccaucgauuuagaccccgugguuuaugacgcuaaauuugagaagcagcugggccagauaaugcuccugauccugugcaccucacagauacucaguaugaggaccaccugggcuuugugcgaguccaucacgcuagccaccggcccacucaccacccugugggaagggucaccggggaaguucuggaacacuacuauagccgugucaauggcgaacaucuuccggggcagcuaucuggccggggcgggccuggccuucccgcugaugaaaagccuaggggguggccgccgcgggaccggcgcccagggggagacacucggcgagaaguggaagcgccaacugaaccagcuuuccaaaagcgaguucaacacauacaagagauccgggauuauggaggucgaucgcagcgaggcuaaggaaggccucaagcgaggggagacgacuaagcacgcgguuucacgagggaccgcuaagcugcggugguucgucgaacgcaaccuggucaagccggagggcaaggucaucgaccucggguguggccgcgggggcuggagcuacuauugcgcaggucugaagaaggugacggaggugaagggguacaccaagggagggcccggccacgaggagcccauaccuauggccaccuacggguggaaccuggucaaguuacacuccgguaaggacguguuuuucacaccacccgagaaaugcgacacgcuauuaugugacaucggcgagagcuccccgaauccgacgauagaggagggaaggacgcuaagaguacuaaagaugguggagccuuggcuccgcggaaaccaauucugcauaaagauucugaaccccuauaugcccagcguaguggaaacccucgagcagaugcagcggaagcacgggggcaugcugguccgaaacccgcugucccgcaauucuacgcacgagauguacuggguguccugugguaccgggaacaucgugagcgccguuaacaugacuuccagaauguuacuuaaucgcuucaccauggcgcaucgaaaaccuaccuacgaacgcgacguggaccugggcgccgggacgcggcacgucgcuguugagccggagguugcaaacuuagacaucaucggccagaggaucgagaacaucaagaacgagcauaagaguaccuggcacuacgacgaggacaaccccuacaaaaccugggccuaucacggaucguaugaggucaagccgucaggcuccgccagcagcauggugaacggcguggugcggcuccuaaccaagcccugggacgugauuccgaugguaacgcagaucgccaugaccgauaccacacccuuugggcagcagcgcguuuucaaagagaagguggacacgcggacccccaaggccaagcgcggcaccgcccagaucauggagguuacugcucggugguuauggggguuccugagcaggaacaaaaagccccggaucugcacgagggaggaguucacacggaaagucaggagcaacgcagccaucggcgccguguucgucgacgagaaccaguggaacuccgccaaagaggcgguagaggacgagcgguucugggaccuggugcacagggaaagggagcuacacaagcaggguaaaugcgcaaccugcguguacaacaugaugggcaagcgcgagaagaagcugggcgaguucgguaaagccaaaggcucucgggccaucugguacauguggcugggggcccgcuuccucgaguucgaggcgcuggguuucaugaacgaggaucauugguucucacgcgagaacagcuuauccggggucgagggcgaggguuuacauaagcuggguuacauccuacgggacaucucgaagaucccaggcgggaacauguacgcggacgacacugccggcugggacacgcgaauuaccgaagacgaccuacagaacgaggccaagaucacggacaucauggagccggaacacgcccugcuggcgaccucaaucuucaagcucacguaccagaacaaggucgugcgggugcagcgcccggcgaagaacgggaccgugauggacguuauuucccggcgcgaccaacgcggguccggccaagucgggaccuacgggcugaacaccuuuacgaacauggaaguacagcuuauccgccagauggagagcgaggggauauucucccccagcgaacuagagacccccaaccuggcagaacgcgugcuagacuggcucgagaagcacggcgucgagcgccugaaacggauggccauuucgggcgaugacugcguggugaagccuaccgaugaucgcuuugccaccgcguuaacggcccuaaacgauauggguaaaguccggaaagauaucccccagugggagccaagcaagggcuggaacgacuggcaacaggugccguucugcucccaccauuuccaccaacugauuaugaaggacgggcgggagaucguugucccuugccggaaccaagaugagcuggugggucgggcccgugucucgcaaggagccggcuggagccugagagagaccgcuugccugggcaaguccuacgcgcagauguggcagcugauguacuuccaccggcgggaucuccggcuggccgccaacgccaucugcucggcgguccccauagacugggugccaaccucccggacuacguggagcauacaugcccaccaccaauggaugaccaccgaggauauguuguccgucuggaaccgagucuggaucgaagagaaucccuggauggaggacaagacccaugugucuuccugggaagacgugccauaccuggguaagagggaggaccaguggugcggcagccuuaucgggcugacggccagagccaccugggccaccaauauccagguugcgaucaaucagguccggcggcucaucgggaacgagaacuaccuggacuacaugaccuccaugaaaagauucaaagacgaaagcgaccuggagggagcccuaugguga

SEQ ID NO: 24645 - RNA, 9879 nt, Artificial Sequence
  derived and/or modified CDS sequence (opt11) from DENV-1__HQ624983__SS-prME
agcgugaccaugcuguuaaugcuggugcccaccgcccuggccuuccaccucaccacccgagggggggagccgcacaugaucguaagcaagcaggagcgaggcaaaagccugcuuuucaagacgagcgcugggguaaacaugugcacccugaucgccauggaccugggcgaauuuugugaggacaccaugaccuacaagugcccccgaaucucggaggccgagcccgacgaugucgacuguugguguaacgccaccgacaccugggugaccuacgggaccugcagccagaccggagagcaccguagggauaagaggagcguggcccucgcgccccacgucggacucggucuggaaacccgaaccgagacuuggaugucgucugagggcgccuggaagcagauucagcggguggagaccugggcacugcgccaucccggguucaccgucaucgcucucuuuuuggcgcaugccaucggcaccuccaucacucagaaggggauuaucuucauccuucuaaugcucgucacgccaucuauggcuaugcggugcguuggcauaggcucccgcgacuucgucgaaggacugagcggagcuaccugggucgacguggugcucgagcacggguccugcgucacgacuauggccaaggacaagccaaccuuagacaucgagcuguugaagaccgaggugacgaaccccgcggugcugcggaagcuguguauugaggcuaaaaucagcaacaccaccaccgacucacgcugcccaacgcagggggaggccacgcuugucgaggagcaggacgccaacuucguaugucggcguaccuucguggauagggguugggggaacgggugcgggcucuucggcaaaggcagccugaucaccugugccaaguucaagugcgucacgaagcucgagggcaagauugugcaguacgagaaccugaaguacuccgucaucgucaccguacacaccggcgaccagcaccaggucgggaacgagagcacggagcacggaacgacggcgaccauaacgccccaggcucccucuacugagauccagcuuacggacuauggggcccucacacuggacugcagccccaggacgggucuggacuuuaacgagauggugcuccugacuaugaaggagaaguccuggcugguucauaagcagugguuccucgaccugccgcucccuuggacguccggggccagcacaucccaagagaccuggaaccggcaggaucuccuugucacguucaagacggcgcacgcgaagaagcaggaaguggugguguuaggcagccaggaaggcgccaugcacaccgcccucaccggggcuaccgagauccaaacguccggcaccaccacgauuuucgcggggcaccugaagugucggcugaagauggacaaacucacucugaagggcaugagcuacgugaugugcaccgguucauucaagcuggagaaggagguggcagaaacccagcacggcacggucuuaguccaaaucaaguacgagggcacggacgcccccugcaagauccccuucagcacgcaggacgaaaaggggguuacccagaauggccggcugaucacggccaacccgaucgucacggauaaggagaaaccagugaacauagaggccgagccgcccuucggggagucguacauugugauaggcgcgggugagaaggcccugaaauuaagcugguucaagaagggcuccucuaucggcaagauguucgaggccaccgcccgcggggcccggcgcauggcgauccucggugauaccgcuugggacuucggguccauaggcggugucuucacguccguggggaaguuagugcaccagaucuucgguacggccuacgggguccuguucuccggcgugucauggaccaugaagauagguaucggcgugcuccugaccuggcuuggcuuaaauucccgaaguacaucccugagcaugacgugcaucgccgucggguuggugacucucuaucugggcgugaugguccaggccgacagcgggugcgugauaaacuggaagggccgggaauugaaguguggguccggcaucuucgugaccaacgaaguccacacuuggacagaacaauacaaguuccaggcggacucaccuaagcgccucuccgccgcgaucggcaaagccugggaggagggugucugcgggauucggagcgcaacccgccuggagaacaucauguggaagcagaucuccaaugagcugaaccacauucugcuggagaacgauaugaaguucaccguagucgucggagacguggcgggcauccuggcgcaggggaagaagaugauccggccgcagccgauggaauacaaguauagcuggaaguccuggggaaaggcgaagaucaucggcgcugacguccagaacacgacuuuuaucaucgacgggcccaacacgccggagugccccgacgaccagcgcgcguggaauaucugggagguugaggacuacggcuucgguaucuucacgacgaacauuuggcucaagcuccgggacagcuacacccaagugugcgaucaccgccugauguccgccgcgaucaaggacagcaaggcgguccacgcagacaugggcuacuggauugagucugagaagaaugagacguggaaacuagccagggcgagcuuuaucgaagugaagacaugcaucuggcccaagucccacacccuguggagcaacggcguguuagaguccgagaugauuauacccaagaucuacgguggcccgaucagccagcacaacuaccggccuggguacuucacccagacggcaggccccuggcacuuagguaaacuggagcuggacuucgaccucugcgaaggcaccaccguagucguugacgagcacugcgggaauagggggccaagccugcgcaccacgacggucaccggcaagaucauccaugaguggugcugucggagcugcacccugccgcccuuacgcuucaaaggggaggacggcugcugguacgggauggagauacggcccgugaaggagaaggaggaaaaccuggucaagagcauggucuccgcuggcagcggugagguugacuccuucagcuugggacuccucugcauauccaucaugaucgaggagguaaugcgcucacguuggucccgcaagauguugaugacggguacgcucgcagucuucuuccugcugaucauggggcagcucaccuggaacgaccuuauccggcugugcaucauggugggcgcaaacgccucugaccgcauggggaugggcaugaccuaccucgcccugauggcgaccuucaagaugcgccccauguuugcggugggacugcuguuccggcgcuuaaccagucgggagguccuacuccugaccaucggucugagccucguggcgucugucgaacugcccaauagccuggaggaacucggcgacggacuggcuaugggcauuaugauccugaagcuucugaccgacuuucagucccaccagcugugggccacgcuacugagccugaccuucaucaaaaccaccuucuccuugcacuacgccuggaaaaccauggcgauggugcugucgauugugagccuuuucccgcucugccuuuccaccaccucccagaagaccacguggcugccgguacuccuugggagccuggggugcaaaccccucaccauguuccugaucgccgagaauaagauuuggggacgcaagagcuggccccugaacgaggggauuauggcgguggggaucguauccauacuccugagcagucuucucaagaacgacgucccccuugcggggccccugaucgcaggcggcaugcucauugcgugcuacgugaucagcggguccagcgcggaccuaagccuggagaaagcagccgaggugagcugggaggaagaagcagagcacuccggcgcgagccacaacauccucgucgaggugcaggacgacgggaccaugaagaucaaggaugaggagcgggacgacacccugacaauccugcucaaggcgacucugcuggccgugucuggggucuacccgcucagcauccccgccacccuguuugugugguacuucuggcagaagaagaagcaacguuccgggguccugugggacacucccucaccgcccgaggucgagcgugcgguguuggacgacggcaucuacaggaucaugcaacggggucuucuggggcgaucccaggugggugucgggguguuucaagagaacguguuccacacaauguggcacgucacgcggggcgcgguguugauguaccaggggaaacgccucgagccaagcugggccuccgucaagaaggacuugaucagcuacgggggcggguggagacugcagggcuccuggaacaccggggaggagguccaggugauagccguggagccuggcaaaaacccgaagaacguccaaaccgcccccgggaccuucaagacgagcgagggcgaggugggcgcaaucgcgcucgauuucaaacccgggacaagcggcucccccaucgugaaccgcgaggguaaaaucgucggccuauacggcaacggggugguaaccaccagcggcacguacgucuccgccaucgcccaagcuaaggcaagccaggagggcccccugccggagaucgaggacgagguauuuagaaaacgcaaccucaccaucauggaucugcaccccggcuccgggaagaccaggcgcuaccugcccgccaucguccgcgaggccaucaagcgcaaguuacgaacacucauccuggccccuacgcgggucgucgccagcgaaauggcugaggcccugaagggcaugcccauccgcuaccagaccaccgccgugaaguccgagcacacagggaaagagaucgucgaccugaugugucaugccacuuucacgaugcggcugcucagccccguucgugugccgaacuacaacaugaucauaauggaugaggcccacuucacugacccuuccaguaucgcggcuagaggguacaucaguacccgcgucggcaugggggaggcagccgccaucuuuaugacggcaacgccgcccgggagcguugaggccuucccucaguccaaugccgucauccaggacgaagaacgugacaucccggagcgcagcuggaacuccggcuaugaguggauaaccgacuucccaggcaagaccguaugguucgugcccagcaucaaguccggaaacgacaucgcaaacugccugcgaaagaacgggaagcgcgucauccaacugagccggaagacguucgacaccgaauaccagaagacuaagaacaacgacugggacuauguggugacaacggacauauccgagaugggcgcgaacuuucgcgccgaccgcguuauagauccccgccggugcuuaaagccgguuauccugaaggaugggcccgagagagucauccuggccgguccuaugcccgucacgguggccuccgccgcgcaacgacgcggccggaucggccgcaaucacaacaaggaaggcgaccaauacaucuauaugggacagcccuuaaacaaugacgaggaccacgcccacuggacugaagccaaaaugcugcucgacaacauaaacaccccagagggcauaaucccugcccucuucgagcccgagcgggagaaguccgccgcaaucgacggcgaauaccgccugcgcggcgaggcccggaagacguuuguggagcugaugcgcagaggggaucucccggucuggcugucauacaagguggccagcgagggauuccaauacuccgaccgccgcuggugcuucgauggcgagaggaacaaccaggucuuagaagagaacauggacgucgagaucuggacaaaggagggggagcggaagaagcuccgcccgcgguggcuggacgcgcgcacguacucagacccccuggcccugcgugaguucaaggaguuugcggcgggccgccgguccgugagcggggaucugauucuggagaucggaaagcucccccagcaccuaacccagcgggcccagaacgcccuggacaaucucgugauguuacauaacuccgagcagggcggccgggcguaucgccacgcaauggaagaacugccggacacgaucgagacgcucaugcuauuggcccucaucgccgucuuaaccgggggagugacgcuguucuuccuuagcggccgggggcuggguaaaacgagcauuggacuguugugcgugauggccagcucaguacuccuguggauggcgagcguggagccccacuggaucgccgccuccaucauucucgaguucuuccugauggugcuccucauccccgagcccgaccgccagagaaccccgcaggauaaccagcucgccuacgucguaaucgggcuccucuuuaugaucuuaaccguagcagcgaacgaaaugggccugcucgaaacaaccaagaaggaccucggcauuggccacgucgccgucgagaaccaccaccacgccgccaugcuugacguagauuugcaccccgccagugcguggacguuguaugccgucgcuaccaccaucauuacuccgaugaugagacacacuauagagaauaccaccgccaacaucucccugaccgccaucgcgaaccaagccgcuauccucauggggcuggacaagggcuggccgauuuccaaaauggacaucggcgugccccugcucgcccuagggugcuacucccaggugaacccccucacgcuaaccgcggccguccugaugcugguggcccacuacgcaaucauagggcccggacugcaggccaaggcgacccgggaggcacagaagcgcaccgccgccggcaucaugaagaacccgacuguggacgggaucgucgcuauugaucucgaccccgucguguacgacgcgaaauuugaaaagcagcugggccaaaucaugcuccugauccugugcaccagccaaauccuacuuaugcgcaccacuugggcccugugugagucuaucacgcuagcaaccggaccacugaccacccugugggagggaucucccggaaaguucuggaacacgaccaucgccguuagcauggcaaacaucuuccgaggguccuaccucgcaggagccggccuagccuuuagccugaugaagucucucgggggcgggcgacggggcaccggggcccagggcgagaccuugggcgagaaguggaaacgccagcugaaccaccucagcaaguccgaauucaacacauacaagcgcagcgggauaauggagguggacagauccgaggcuaaagaaggccugaagcgcggggagaccacgaaacacgccgugagccgcggaaccgccaagcugcgaugguuugucgagagaaaccucgugaaaccggaggguaaggugaucgaccugggcugcggccgcggcggauggagcuacuacugcgccggccugaagaaggucacagagguuaagggguacacaaagggcggccccggccacgaagaacccauucccauggcgacuuauggguggaaccuggugaaacuccacagcggcaaggaugucuucuucgugccgcccgaaaagugcgacacccugcugugcgacaucggggaauccagcccaaaccccacuaucgaagagggccgcaccuuacgggucuugaagaugguugagccuuggcuacgugggaaccaguuuugcaucaaaaucuugaaccccuacaugcccuccgugguggagacccuggagcagaugcagcggaagcacggcggcaugcuaguccgcaauccccucagcagaaacuccacccacgagauguauugggugagcugcgggacuggcaacaucguguccgcugucaacaugaccagccgcaugcugcugaaucguuucacaauggcccaucgcaagccgacauacgagcgcgacguggaucuaggcgcgggaacccggcacguggcagucgagccagagguggccaaucuggacaucaucggccagagaaucgagaauaucaaacacgagcacaaguccaccuggcauuacgacgaggacaacccauauaagacuugggcguaccacgggagcuacgaagucaaacccucaggcagcgccagcuccauggugaacggcguugugaaacuguuaaccaagccuugggauguuaucccgauggugacccagaucgcaaugacggacaccacccccuucggccagcagagggucuucaaggaaaagguggauaccagaacgcccaaggcaaagcggggaacagcccagaucauggaggucaccgcgaaauggcuuuggggcuuccugagccgcaauaagaagccgcggaucugcacccgagaagaauucacgcggaaaguuagauccaacgccgccaucggcgccguguucguggacgagaaccaguggaacagcgcgaaagaggccgucgaggacgagcgguuuugggaccucguccacagggagcgcgaacugcacaagcaggggaagugcgcgaccugcguguacaacaugauggguaagcgcgagaagaagcugggcgaguuuggaaaggcgaagggaagucgggccaucugguacauguggcugggcgcgcgcuuccuggaguucgaggcacugggcuuuaugaacgaggaccauugguucagccgcgagaauucccucagcgggguggagggcgagggguugcacaagcugggcuacauccuccgcgacaucaguaagaucagcgggggcaacauguacgcagacgacaccgccggcugggacaccaggaucacggaggaugauuugcagaaugaggcaaaaauuaccgacaucauggaacccgagcacgcguugcuggccaacuccaucuucaaacugaccuaccagaauaaggucgugcguguccaaagaccggcgaagaauggaaccgugauggaugugauuucccgccgcgaucagcgcggcuccgggcagguaggcacguacggccugaacaccuucaccaacauggaggcccagcucauccgccaaauggaguccgaggggaucuucagcccgagcgagcuggagacccccaacuuagcggagcgggugcucgauuggcuggaaaaguacggcguagaacgccugaagcggauggcuaucagcggagacgacugcguggugaagcccauagacgaccgcuucgccacggcccucacagcccugaacgacaugggcaaggugagaaaggacauaccacagugggagccguccaagggguggaacgacuggcaacagguccccuucuguucccaccacuuccaccagcugauaaugaaagacggcagggagaucguagugcccugccggaaccaagacgagcucgucggccgcgcucgggugucucagggggcgggcuggucccuccgugagaccgcaugccuggggaaguccuacgcccaaauguggcagcuaauguacuuucacagacgcgaccugcggcuggccgcgaacgccauauguucagcagugccagucgacugggugccgaccucccgcacgaccuggagcauccacgcccaccaccaauggaugaccgcggaggacaugcucuccguauggaaccgggucuggaucgaggaaaaccccuggauggaagacaagacccacaucagcuccugggaggaugugccguaccucggcaagcgggaggaccaguggugcggaagccugaucggccucacggcgagggccaccugggccaccaacauccagguugccauuaaccagguccgucgccugaucggcaacgagaauuaccuggacuacaugaccuccaugaagcgguucaagaacgaaagcgacccugagggggcccucugguga

SEQ ID NO: 24646 - RNA, 9879 nt, Artificial Sequence
  derived and/or modified CDS sequence (opt11) from DENV-1__FJ384655__SS-prME
agcgucacaaugcuucucaugcugcuaccaacggccuuagcauuccauuuaacuacccgcgguggcgaaccgcacaugauaguaagcaaacaagagcggggcaaaucccugcuauucaaaacaucggcgggcguaaacaugugcacgcugaucgccauggaucuaggggagcucugcgaagauacaaugaccuacaaaugcccacggauaacggaagcggaaccggaugauguggauugcuggugcaacgcaaccgacacguggguaaccuacgggaccugcagucaaacgggagagcacaggagagacaaaaggagcguggcccucgcaccacauguugggcuaggauuagaaaccaggaccgagacauggaugucgucggaaggcgcauggaaacagauacagaagguggaaacaugggcacuccgccacccaggauucaccgugauagcacucuuccuagcccaugccauuggaaccaguauaacccaaaagggcauaauauucauacuacuaauguuaguaacucccucaauggcgaugcguugcguagguauuggaaauagggacuucgucgaagggcuaagcggggcaacuuggguagacguagugcuagagcacggcucgugcguaacaacgauggcgaagaauaagcccacucuggacaucgagcucuuaaagacagagguaacuaacccugcagugcuccgcaaauuaugcauugaagcaaagauaagcaacacaacgacagauucucgaugcccgacccaaggcgaagcaacgcucguggaagagcaggacgcuaacuucgucugccgacggacauucguggaccgugggugggggaacggauguggcuuguucggaaaagguaguuuacuuacgugugccaaguucaaaugcgucaccaaacucgagggcaaaauaguccaauaugaaaaccucaaguacagcgucauagucacaguacacacgggagaucaacaucaggucggaaacgagacgaccgagcacgggacaauagcuacgauaacgccgcaagccccaacguccgaaauacaacugacggacuacggcgcacuuacacuggauugcuccccaaggacggggcuugacuucaacgaaaugguacuacuuacaaugaaggagaagagcuggcucguacacaaacaaugguucuuagauuuaccccucccauggacuagcggggccagcacuucacaagaaacguggaaccggcaagaccuccucgucacguucaaaacggcgcacgcaaaaaaacaagaaguggucgugcugggaagccaggaaggggcgaugcacacggcacucacuggagcuacggagauacagaccagcggcacuacaacaauauucgccgggcacuuaaagugccggcucaaaauggacaaguuaacccuuaaaggaacgucguaugucaugugcacgggaagcuuuaagcucgagaaggaggucgcggaaacacaacaugggaccguacucguccaggucaaauacgaggguaccgaugccccgugcaagauaccuuuuucaacacaggacgaaaagggcguuacacaaaacggacggcucauaacagccaaccccaucgucacugacaaggaaaagccagucaauaucgaaaccgagccaccuuucggugagucauauauaguugucggggcgggagagaaagcccuaaaguugagcugguucaaaaaaggaucuagcauaggaaaaauguucgaggccaccgcacgaggagcgaggaggauggcaauacuuggcgauaccgcaugggauuucggcucaaucggcggcguauuuacguccgucgggaaacuaguccaccagguuuuugguacggcauacggcguccuguucucuggagucucguggacgaugaaaaucggaauagguauccuacugaccuggcuuggccucaacagcaggagcacguccuugucaaugaccugcauagcaguaggcaugguaacacuguaccugggcgucaugguccaagcagacucaggauguguaauaaacuggaaaggcagagaacugaaaugcgggucgggcaucuucguuacaaacgaaguccauacauggacggaacaauacaaauuccaagcagauucaccuaaacgccuguccgcugccauugggaaagcuugggaagagggaguuugugggauaaggagcgcaaccaggcuugaaaauauaauguggaaacaaauauccaacgagcucaaccacauccuccucgagaacgacaugaaauucacgguuguggucggggaugcaaacgggauccuagcucaaggcaaaaaaaugaucagaccgcagcccauggaacacaaauauaguuggaaauccugggggaaggcuaagauaaucggggcagauauacagaauacgaccuuuauaauagacggucccgauaccccggaaugcccggaugagcaaagggcauggaacaucugggagguagaggacuacggauucgggauauucacgacaaauauauggcugaaacugagggacuccuacacacaaaugugcgaccaccggcucaugagcgcagcaauaaaagacagcaaagccguucacgcugacaugggguacuggauagaguccgaaaaaaacgagaccuggaagcuggcccgugcgaguuuuauagaaguaaaaacuuguaucuggccgaaaagccacacccucuggagcaacggcguccucgaaucagagaugaucauaccgaaaauauacggcggaccgauuucccaacacaacuacagacccggauacuuuacacaaacagcggggccauggcaccuagguaagcucgaacuggacuucgaccugugcgaaggcaccacaguugugguugacgaacacuguggaaaccggggaccaagccuaaggacgacgacagugacagggaagauaauacacgaguggugcugccgaagcugcacacucccgccgcuccguuuuagaggagaggacggguguugguauggcauggaaauccgaccggugaaagagaaagaagagaaccugguacgcagcauggugucggcgggcucaggugaaguggauuccuucucacugggcauccuaugcgucucaauuaugaucgaggaaguaaugcgaucacgaugguccaggaaaaugcugaugaccggaacccuagcggucuuucugcuucuaauaaugggccagcuuacauggaacgaucucauaagacugugcauuauggucggggcaaaugccucagacaagaugggaaugggcacuacguaccuagcacuaauggcgacauucaagaugcggccgauguuugcuguaggccuacuauucagaaggcuggcgucgagagagguguuacuccuuacgauagggcugucccucgucgccaguguggaacugccaaauagccuagaggaacugggagaugggcucgcgaugggaaucaugaugcugaagcuacugacagaauuccaaccacaccaccuuuggacuacccuacucucccucaccuuuauaaagacaacguuaucgcuggacuacgcauggaagacgacagcuaugguccugucaauaguuagccuauuuccacuaugucucagcaccaccucgcaaaaaacgacauggcugccaguguugcuggggaguuucggaugcaaaccacuuacaauguuccucauaaccgaaaacaagauauggggcagaaaauccuggccacucaacgaaggcauaauggcaauaggaauuguuuccaucuuacuaucaagcuuauuaaagaaugacgucccacuagcgggcccguugaucgcuggcggaaugcuaauagcaugcuauguaaucagugggagcuccgcagaucuaucccuagaaaaggccgccgaagugagcugggaagaagaagcggaacacucgggcacgucccacaacauauuggucgagguccaagaugacggggcgaugaaaauuaaggacgaagaacgggacgauacccuuaccauacuauuaaaagcuacgcuacucgcgguaaguggugucuaccccaugucgauuccagcuacauuauuugucugguauuuuuggcaaaagaaaaaacagagaucaggggugcuaugggacacacccuccccccccgaagucgaaggggccgugcucgacgacgggauuuaucggauuuuacagcgugggcuguuagggcguagucaggucggcgucggcguguuccaagacgggguuuuccauaccauguggcacgucacccgaggugccgugcuuauguaccagggaaaacgacuagagccaaguugggcgucagugaagaaagaccuaauaucauacgggggaggguggagguuucaggggucauggaacacaggagaggaaguacaaguaauagcggucgagccaggaaaaaacccgaagaacgugcagacaacacccggaacauucaaaacaccagaaggggagguaggcgcuaucgcgcuagauuuuaaaccgggcacuagcggcucaccaauaguaaguagggagggaaagauaguagggcuauauggcaacggaguggugaccaccagcgggaccuaugucagcgcaaucgcgcaggcgaaggcgagccaggaagggccucuccccgagauagaggaugaaguguuuaagaaaagaaaccuaaccauaauggaccugcauccaggaaguggcaagaccaggagguaccuaccagcaauagucagagaagccauaaagcggaagcuaaggacucugaucuuagcgcccacucgcguagucgccuccgaaauggcagaggcgcugaaagggaugccgauaagguaccagacuacagccgucaaguccgaacacaccggacgugagaucguggaccuuaugugucacgcgaccuucacgaugcgccuguuguccccagugagggugccuaauuauaacaugaucauuauggacgaggcccauuucacagacccagccucuaucgcagcacgcggauauaucuccacacgagucggaaugggugaggcggcggcaauuuucaugacagcgacgccaccgggcagcguggaagcauucccccaaucaaacgcaguaauccaagacgaggagcgggacauccccgaacgcucauggaacagcggcuaugacuggauaacagauuuccccggaaaaacagugugguucgugcccagcauuaaauccgggaacgauauagcgaacugccuuagaaaaaacggcaagagaguaauccaauuaucacgaaaaacauucgauaccgaauaccagaaaacaaaaaacaacgauugggauuaugucguaacgacagacauaagcgaaaugggggccaacuuucgugccgaccgagugaucgacccacgacgcugccugaagccagucaucuuaaaggacggaccggagaggguuauacucgccggaccaaugccaguuaccguagcaucagcagcacagagaagagggaggaucgggaggaaucagaacaaggagggcgaccaguacguuuauauggggcagccacugaacaacgacgaagaccacgcacacuggaccgaagcaaaaaugcugcucgacaauauaaacacacccgaggguauaauaccggcacucuucgaaccggagagagagaaaucggcagcaauagacggcggguaccgccuucgcggugaagcuagaaaaacauucguagaacuaaugagacggggagacuuacccgucugguuaaguuacaaagucgcgagcgaagguuuccaauacagugaccgacgauggugcuucgacggagaacggaacaaccaggugcuggaagagaacauggacguggagaucuggacgaaggagggagagagaaaaaaacuccgaccccgcuggcuggacgcuagaacauauagcgauccccucgccuuacgcgaguucaaagaauucgcagcgggaaggcgaagcgucucaggcgaccuaauccucgaaauaggaaaacucccucaacaccugacgcuaagggcgcaaaacgcacuugauaaccuggucaugcuacacaacagcgagcaaggcgggaaggcauauaggcacgcuauggaggaauugccugacaccauagaaacccuaaugcugcuggcccuaauagcagugcucaccggaggagugacauuguucuuccugucuggaaaaggacuuggcaagaccaguaucggacuccuaugugucacagcuagcagcgcguuacucuggauggccaguguugaaccccauuggaucgccgcgaguaucauauuagaauucuuccuaaugguacuacucauacccgagccagaccgacagaggacaccucaagacaaccaacuagcauacguugucauaggacugcuauucaugauucuaacuguugcagcaaacgagaugggacuacucgaaacgacaaagaaagaccuaggcauagggcacguugccgccgaaaaccaccaacacgcaacuaugcuggauguagaccuaagaccggcuucagccuggacgcuauacgcagucgcaacgaccgucauaacaccaaugaugcgacauacgauugagaauacaaccgcuaacauaagcuugacggcaauagccaaccaagcagccauccuaaugggacucgacaaaggguggccuaucucaaagauggacauaggaguaccauuacucgcacucgggugcuacucccaagucaauccacuuacccuaacagcagcaguccucauguugguagcccacuacgcaaucauagggcccggauugcaggcuaaggcaacccgugaagcacagaagcgaacugcggcgggcauaaugaagaacccuacaguagacggaaucguagcaauagaccuagaccccguaguguaugaugcgaaguuugaaaaacaacugggacaaaucaugcucuuaauacugugcacgagucagauccuccugaugagaacgacgugggcccugugcgagucgauaacucuugcaacuggaccgcugacuaccuuaugggagggcucaccaggcaaguucuggaacaccacgaucgcggugucuauggccaacauuuuuagaggguccuaccucgcuggggcagggcuagcauucagucugaugaagucacuuggagguggaagacgggguaccggggcucaaggcgagacucuaggggagaaguggaaaaggcagcuaaaccaacuuuccaaauccgaauuuaacacauacaagaggucagguaucauggaaguagacagguccgaagcgaaagaggggcuaaaacggggagaaacaaccaaacacgcggucagucgaggcacggcaaaauugcggugguucgucgagcgcaaucucgugaagccggagggaaagguaauagaccuagggugugggcggggcggauggucauacuacugugcaggacuaaaaaaagucaccgaggucaagggcuacaccaaggggggacccggccacgaggaaccaguacccauggccacguacggcuggaaccuaguaaagcuacauuccggcaaagacguuuuuuuuaugccacccgaaaaaugcgauacgcuacugugugacauaggagaauccagcccaaacccuaccauagaagaaggucggacacugcggguacucaaaaugguggaacccuggcuacggggcaaucaguuuuguauuaagauucuaaauccguacaugccgagugucguggagacacuagagcaaaugcaaaggaagcacgguggcaugcucgucaggaacccgcuguccaggaauaguacccaugaaauguauugggugucaugcgggacaggcaacauaguaucagccgugaacaugacuucgagaaugcugcuaaacagauucacuauggcccaucgcaagccgacguacgaacgugacguggaccuaggcgcgggaacgcgacacguagcuguagagcccgaggucgcgaaucuggauauaauuggacaaagaauugagaacaucaaaaacgaacacaagagcacguggcacuacgacgaagacaacccauauaaaacaugggccuaccacgggucguacgaagucaaaccaagcggcagcgccucgagcaugguaaacggaguaguccgacugcugaccaaaccuugggauguaauaccaauggugacccaaaucgcuaugaccgacaccacaccauucgggcagcagcgaguauuuaaggaaaaaguagacacccgcacaccgcgagcaaagagagggacugcacaaaucauggaggugacugcgaaguggcuuuggggcuuccugagccgcaacaaaaaaccucggauaugcacuagagaggaguucaccagaaagguuagaucaaaugcggccaucggcgcaguguucguugacgaaaaucaguggaauuccgcaaaagaagccguagaggacgaacguuucugggaucuaguucaccgcgaacgggaacuacacaagcagggaaagugcgcaacgugcguauacaacaugaugggaaagcgcgagaagaaacucggcgaauucggcaaggcaaagggcaguagggcgaucugguacauguggcuaggagcccgauuccucgaguucgaagcacuaggauucaugaacgaagaucacugguucagucgcgaaaacucccucagugguguggagggcgaggggcugcacaaacuaggauacauauugagggacaucaguaaaauacccggcggaaacauguacgccgacgauacugcagggugggauacccgcauaacggaagacgaucugcaaaaugaggcgaagaucaccgacaucauggaaccugaacaugcccugcuugcaaccagcauauucaaacugacuuaucagaacaaagucgugagaguccaaaggccugccaagaacggcacggucauggacgugaucagcagaagagaccagcggggaucugggcaggucggaacauacgggcuuaauacauucacgaacauggagguacaacucaucagacaaauggaaagcgaaggcauauuccuuccgucagaacucgagacaccgaaccuggcagagcggguguuagauuggcucgaaaagcacggggcagaacgccucaagcggauggcgauaucgggcgacgauugugugguaaaaccuauugaugacagguuugccacggcauugaucgcccugaacgauauggggaaagucagaaaagacauaccccagugggagccuucgaaaggauggaacgacuggcaacaagugccauucugcagccaucacuuccaccaacucauaaugaaagaugguagggaaauagucgugcccugccggaaucaagaugaacuggucggccgugcaagagugagucaaggggcgggguggagccucagagagacugcgugccugggaaaaucauacgcacagauguggcaacuaauguacuuucaucggagggaccucagauuagccgcuaacgcaaucugcagugccguacccguagauuggguccccaccucuaggacaacuuggaguauacacgcgcaccaucaguggaugacgaccgaagacaugcucucaguguggaaccgcguauggaucgaggagaauccguggauggaagacaaaacccacgucucgagcugggaggaaguccccuaccugggaaagagagaggaucaguggugugggagccuaaucggccuaacugcacgggccacaugggcaaccaacauacagguagccaucaaccaagugcgacgccucauagggaacgagaauuaccucgauuacaugaccucuaugaagcgguucaaaaacgaaagcgauccugagggcgcguuaugguaa

SEQ ID NO: 24647 - RNA, 9879 nt, Artificial Sequence
  derived and/or modified CDS sequence (opt11) from DENV-1__KC759167__SS-prME
ucggugaccaugcugcucauguuaaugcccacggcccuggccuuccaccucacaacccgaggcggggagccucacaugaucgugagcaagcaagagcggggcaagucacugcuguuuaagaccucugccgggguuaauauguguacgcucaucgccauggacuugggcgaacuuugcgaagauacgaugaccuacaaguguccacggaucacugaggccgagcccgacgacguggacugcuggugcaacgccaccgacacgugggucacguacgggaccugcagucagaccggcgagcacaggcgcgacaagagaagcguggcccucgcuccccacguggggcuggggcuagagacgaggaccgagacuuggaugucaucagagggcgccuggaagcagauucaacgggucgaaacaugggcacuccgccacccgggguucacggugaucgcccuguuuuuagcgcaugcgaucggcacaagcgugacccaaaaggggaucaucuuuauacuccugaugcuggucacgcccucaauggccaugcggugcgugggcauuggcucaagggauuucguggaaggacuuuccggcgccacaugggucgaugucgugcuugagcacgggucuugcgucaccaccauggccaaggacaagccuacccuugacaucgagcuccuaaagacggaagugaccaaccccgccauccugaggaagcucugcaucgaggcuaaaaucuccaacaccaccaccgacagccgcugcccgacccagggugaggcgcccgagguugaggagcaggacgccaacuucgugugccggcgcaccuucguggaccggggcugggggaauggcugcgggcuguucggcaaggggucucugauuacgugugccaaguucaaaugugugacgaaacuugagggcaagauuguccaguacgagaaucugaaguacagcgugaucgugacgguccauaccggcgaccagcaucaggugggaaacgaguccacugagcacggcacgacagcuaccauaacgccccaggccccuaccacggagauccagcucacagacuacggugcccucacgcuggauugcucuccgcgcacuggccuggacuucaaugagaugguccuccucacgaugaaggagaaguccuggcuaguacacaagcagugguuccucgaccugccccugccguggaccagcggggccagcaccucccaggagaccuggaaccggcaggaccugcuggugacguucaagaccgcccacgcuaagaaacaggaggucgugguauugggcucgcaggaaggcgccaugcacacggcccucaccggggccacggagauacaaaccagcgguacaaccacgaucuuugccgggcaucugaagugccgccucaaaauggauaagcucacucugaagggcaugagcuacgucaugugcacgggguccuucaagcuggagaaagagguggcggagacccagcacgggacugugcucguccagaucaaguacgagggcaccgacgcccccuguaagauccccuucaguacccaggaugagaagggggucacgcagaacggacgucugaucacggccaacccgaucgugaccgacaaagagaagcccgugaacauagaggcuaagccgccuuucggggaguccugcaucgugauaggagcgggcgagaaggcauugaaacugaguugguucaagaagggguccaguaucggcaagauguuugaagccaccgccaggggggcccggagaauggcgauccucggcgacaccgccugggacuucggguccaucggcggcguguucacgucagucgggaagcuaguccaucagaucuuuggcaccgccuacggggugcuguuuuccggagucagcuggaccaugaaaaucggaaucggugugcuccugaccuggcuaggacuaaacucucgcagcacgucccugagcaugaccugcaucgcgguagggcuagugacgcucuaccucggcgugauggugcaagcagacuccggcugcgucauaaacuggaagggccgggagcugaagugcgguaguggcauauuuguuaccaacgaggugcacacguggaccgagcaauacaaguuucaggccgacagccccaagcgccuaucggccgcaaucggcaaggccugggaggagggggucuguggcauccguagugccacccgccuggagaacaucauguggaagcagaucuccaacgagcugaaccacauccuccuggagaacgauaugaaguuuacugugguggugggggacguggcgggcauccuggcccaggggaagaagaugauccggccccagccgauggaguacaaauauagcuggaaguccugggggaaggccaagaucaucggggccgacguucagaacacuacguucaucaucgacggaccuaacacccccgagugccccgacgaucagagggcguggaacaucugggaggucgaggacuacggguucggaauuuucaccaccaacaucuggcugaagcugcgggauagcuacacccaaguuugcgaccaucgccugauguccgccgccaucaaggacucuaaggccgugcacgcagacaugggauauuggaucgagucugagaagaacgagaccuggaagcucgcgcgggccucuuucaucgaggucaagacaugcaucuggcccaaaucccauacccuguggucgaacggugugcuggaguccgagaugauaaucccaaagaucuacgggggccccaucagccagcacaauuaccgccccggauacuucacacagacagccggcccguggcaucucgggaaacuagagcuggacuucgacuuaugcgaggggaccaccguggucguggacgagcacugcggaaacagagggcccucuuuacgaacgaccaccgugaccggcaaaaucauccacgaguggugcugccggagcugcaccccaccgccccugcgcuuccguggcgaggacggaugcugguacggaauggagauacgccccgucaaagagaaggaagagaaccucgugaaaucuauggugagcgcaggcucuggcgaggucgacuccuucucuuugggguuacucuguaucuccaucaugauugaagaggugaugcggagccgcuggucccggaaaaugcugaugaccggcgcccuugcgguguuucuccugcugaucaugggccaguuaaccuggaacgaccugauccgccugugcaucauggucggcgcgaacgccagcgaccgcauggggaugggcacuacguaccucgccuuaauggccaccuuuaagaugcggcccauguucgcggugggacuccuguuccguaagcugacgucccgcgaggugcuacuccugacgaucggguugucucucguggccuccguggagcugcccaacagucuggaggagcucggggacggccuggccaugggcaucaugauucucaaguugcuuacggauuuccaaucccaccagcugugggccacauugcugagccugaccuucaucaaaacgacuuuuagucuccauuaugcguggaagaccauggccaugguccugagcaucgugagucuguuuccccucugccugucuacuaccucccagaagacaaccuggcugcccgugcucuugggcagcuuagggugcaaacccuugaccauguuccugaucgccgagaacaagauuuggggucgccgguccuggccccugaacgagggcaucauggccgucgguaucgugagcaucuuacugagcucccugcucaagaacgacguuccgcuggcagggccccugaucgcgggugguaugcucaucgcgugcuacgucaucagcggguccagcgcugaccugagccuggagaaggccgcugaggugucuugggaggaggaagcggaacacuccggcgccagccacaacauccucguggagguucaggacgacgggaccaugaagaucaaggacgaagagagagacgacacgcugaccauucuccucaaagccacccugcuggccguguccggcguauauccccucagcauccccgcgacgcuguucgucugguacuucuggcggaagaaaaagcagcgcuccggggugcucugggacaccccgucgccgccugagguagagcgcgcgguccucgaugacggcaucuaccgcaucaugcagagggggcuguuggggcgcucacaagucggcguggggguuuuccaggagaacguguuccacacgauguggcacgugacacggggcgcaguccucauguaccaaggcaagcgacuugagcccucgugggccuccguuaagaaggacuugaucaguuacggcgguggguggagacuucagggcuccuggaacaccggggagggcgugcaggucaucgccguggaaccggggaaaaaccccaaaaacguacagaccgcccccgggaccuucaagacccccgagggcgaagugggggcgaucgcccuggacuuuaagccaggcaccagcgggagucccaucguuaaccgcgagggcaaaauagugggccuguacgguaacgguguagugacaacgaguggaaccuacgugagcgccaucgcgcaagcgaaggccucccaggagggcccccugccggagauagaagacgaggucuuccggaagcggaaccucaccaucauggaccugcaucccgggucuggcaagacgcggcgcuacuugcccgccauaguucgcgaggccaucaaacgcaagcuccgcacgcucauccuggcccccacgcgggugguagcguccgaaauggccgaggcccucaagggcaugccaauccgcuaccaaaccaccgccguuaagagcgaguacacggggaaggagaucguggacuuaaugugccacgcuaccuucaccaugcggcugcucucucccgugcgcguccccaacuacaacaugaucauuauggacgaggcgcacuucaccgacccuucuuccaucgcagcccggggauacaucagcacacgcguggggaugggagaggccgcugcuauauucaugacggccacaccgccaggaucugucgaggccuucccacagaguaacgccguaauccaggaugaggaacgggacauccccgagcgcucuuggaacagcggcuacgaguggaucaccgauuucccggggaagaccgugugguucguccccuccaucaagagcgggaaugacauagcgaacugccugcggaaaaacgguaagcgcguuauacagcugucccggaagaccuucgacaccgaguaccagaaaacaaagaacaacgacugggacuacgugguaacgaccgacaucagugagaugggggcuaacuuccgugcggaccgggugaucgauccccggcggugcuugaagcccguuauccugaaggacgggccggaacgggucauccuggcggggccaaugcccgugacugucgccagcgcagcccaacggcgcggccggauagggcgcaaccacaacaaggagggggaccaauauaucuauaugggucaacccuuaaacaacgacgaggaccacgcacacuggacagaggcuaaaauguuacuagauaacauuaacacgccggaggggaucauccccgcccucuuugaacccgagcgcgagaaaucggcggccaucgacggcgaguaccgacugcguggagaagcgcggaagaccuacguggagcucaugcgucggggagaccuccccguguggcugucuuacaaggucgccagcgagggcuuccaguacucagaccgccggugguacuucgacggcgaacgcaauaaucaggugcuggaggagaacauggauguggagauauggacgaaggagggcgagaggaagaagcuccgcccgcgguggcuagacgcccgcaccuacuccgacccucuugcgcuccgggaguucaaggaguuugccgccggccgccggagcgucuccggcgacuuaaucuuggagauagggaaauuaccccagcaccugacgcaacgcgcccagaacgcgcuugacaaucucgucaugcugcacaacagcgagcagggcgggagagccuaccgccacgccauggaagagcugccggacacaaucgagacccucaugcuucuggcccucaucgcaguccugaccggugggguuacgcuguucuuccucuccgggaggggccuaggcaagacuagcaucgggcucuuaugcguuauggcgagcagcgugcugcuguggauggcguccgucgagccacacuggaucgccgccagcauuauccucgaguucuuccugaugguucucuugauccccgagcccgaccgccagcggacgccgcaggacaaccagcuugccuacguugucaucggacuccuguucaugauccuuacaguggcggccaacgaaaugggacugcucgagaccacgaagaaggaucugggcaucggacacguugccguggguaaccaccaccaugccgccaugcuggauguggaucugcacccugcauccgcguggacccuguacgcgguggcaacuaccaucauaacccccaugaugcgccacaccaucgaaaauaccaccgcaaacaucucucugacggcgauugccaaccaggcugccauacuaaugggccuggacaaggguuggccaauuuccaagauggacauuggcgucccgcuccuagcgcuggggugcuacagccaggucaauccccugacuuugaccgcggccgugcugaugcuagucgcccacuaugccaucaucggccccgggcuucaggcgaaagccacccgcgaagcacagaaacggacggccgcaggcauaaugaagaaccccacaguggacggcaucguagcgaucgaucuggauccggucgucuacgaugcgaaguucgaaaaacaacuggggcagaucaugcucuugaucuuaugcacgucacaaauccuccugaugcgcaccacuugggcccugugcgagagcauuaccuuagcuaccggaccccugaccacgcucugggaggggucccccggcaaguucuggaacacgaccauagccguaucuauggcgaacauuuuccgagguucuuauuuagccggcgccggccuggccuucagccugaugaagucccucgggggugggcgccguggaaccggcgcccagggggagaccuuaggcgagaaguggaagcggcagcugaaccagcucuccaagcuggaauucaacagcuacaagcgguccgggaucauggaggucgaccgcagcgaggccaaggagggccugaagcggggggagaccaccaagcacgcagugucccgcgggaccgcuaagcuccgaugguucguggagcgcaaccuggucaagcccgaagguaagguuaucgaccuggggugcgggagaggcggguggucguacuacugcgccgguuuaaagaagguuacggaggucaagggguacacgaagggcgggccgggccacgaagagcccauccccauggcgaccuauggguggaaccucgugaaacuucauuccggcaaggacguguucuucauaccgcccgaaaagugcgauacacugcucugcgacaucggggaguccucccccaaccccacgaucgaggagggccgcacccugcggguccugaagauggucgagcccuggcuccgaggaaaccaguucugcaucaaaauccugaaucccuauaugcccagcguggucgaaacucuggagcagaugcagagaaagcacggaggaaugcucgugcgcaacccucucucacgcaacagcacccacgagauguacuggguguccuguggcacgggcaacaucgugagcgccguaaacaugacaucacgcaugcugcuuaaccguuucaccauggcccaccggaagcccaccuacgaaagggacguugaccugggcgccgggacccgacacgucgccguggagccggagguggcgaaccuggacaucaucggccaacgcauugagaacauuaagcacgagcacaaaagcacauggcacuacgacgaggacaacccauauaaaaccugggccuaccacggguccuacgaggucaagccaagcgguuccagcucguccauggugaacggggucgugaagcuccugaccaaacccugggacgugauccccauggugacccagauagcaaugacugacaccacccccuucggccagcaacggguguucaaggagaagguggacacaaggacgcccaaggccaaacggggcacggcccaaaucauggaaguuaccgcgaaguggcucuggggguuccugagccgcaacaagaagccgcgcaucugcacccgcgaggaauucacgagaaaggugcgcucuaacgccgccaucggagcgguauucgucgacgagaaucaauggaacagcgcgaaagaggcgguggaggacgagcguuucugggaccucgugcacagagagcgggagcugcacaagcaggggaagugcgcgaccugcgucuacaacaugaugggcaaacgcgagaagaagcucggggaguucgggaaggcuaaaggcucacgggccaucugguacauguggcugggggcucgcuuccuggaguucgaggcccucggcuucaugaacgaggaccacugguucagccgggagaacucacuaagcgggguggagggcgaggggcugcacaagcucggcuauauacugcgcgacaucuccaagauucccggcggaaacauguacgcagaugacacagccggcugggacacccgcaucacugaggacgaccugcagaacgaggcccgaauaacggacaucauggagcccgagcacgcguuacuggccaagagcaucuucaaguugaccuaccagaacaaggugguucgugugcaaaggcccgccaagaacgggaccgugauggacgucauaucccgucgugaccagaggggcucaggccaaguggggaccuacggccuuaacaccuucaccaacauggaggcccaacugaucagacagauggaguccgaggagauauucagccccucggaauuggagacccccaaccucgccgagcgcgugcuggacugguuggaaaaguacggcaucgagcgccucaagcgcauggccaucaguggugaugacugcgucguaaagccaaucgacaaccguuucgcaaccgccuugaccgcccugaacgauaugggaaaagugcgcaaggacauaccacagugggagccguccaagggcuggaacgacuggcaacaggucccccucugcucacaccacuuccaccagcugauaaugaaggauggcagggagaucguggugcccugucgcaaccaggaugagcuggucgggagagcccgcgugagccagggagcgggauggagucuccgggagacggccugccucggcaagagcuacgcccagauguggcagcugauguacuuucaccgucgggaccuccgccuggccgcgaacgccaucugcucugccgugcccgucgacuggaucccgaccagccgcacgaccuggucaauccacgcccaccaccaguggaugaccaccgaggacaugcuuagcguguggaaccgaguguggaucgaagagaaccccuggauggaggauaagacgcacaucuccucguggggagauguuccuuaccucggcaagcgcgaggaccaguggugcggcucccugaucggucugaccgcccgggccaccugggccaccaauauccagguugccaucaaccaggugcgacgguuaaucggcaacgaaaacuaucuggacuauaugacgagcaugaaaagauuuaagaacgaauccgaccccgagggcgcccugugguga

SEQ ID NO: 24648 - RNA, 9879 nt, Artificial Sequence
  derived and/or modified CDS sequence (opt11) from DENV-1__JQ048541__SS-prME
agcguaaccaugcugcucaugcuuaugcccaccgcucucgcuuuccaucucacuacuagaggaggggagccucacaugaucgucucgaagcaggagcggggcaagagccugcuguucaagaccucugccggggugaacaugugcacucucauugccauggacuugggagagcugugcgaggacacgaugacauacaagugcccgcgaauaaccgaggcugagcccgacgauguagacugcuggugcaaugcaacggacacgugggugacguauggaaccugcagccagaccggcgagcaccggcgcgauaagcggagcguggcccuagcgccccacguaggucucgggcuggagacccgcacugaaaccuggaugagcagcgagggggccuggaagcagauccagcggguggaaaccugggccuuacgccaucccggguucacggugaucgcgcuguuccuggcgcacgccaucggcaccagcaucacccagaaggggaucaucuucauccucuugaugcuggugacucccuccauggccaugaggugcguaggcauaggcucucgcgacuucguggagggacuauccggagcaaccuggguggauguuguacuggagcacgguagcugcgugaccaccauggccaaggacaagcccacacuggacaucgagcuccuuaagacggaagucaccaacccggcaguguuacggaagcuaugcaucgaggcgaagaucagcaacacuacaacggacucccgcugcccuacucagggagaggccacccugguagaggagcaggacgccaacuucgucugccggcgaacauucguggaccggggcugggguaacggcugugggcuauuugguaagggaucgcucauaacgugugcuaaguucaagugugugacuaagcuggagggcaagaucguccaguacgagaaccugaaguauagcgugaucgugaccguccauacgggugaucagcaccaaguggggaacgaauccacggagcacggaacgacugcuaccaucacgccccaagcaccaacuaccgagauucagcuaaccgacuacggggcccugacccuggacugcucuccccggacgggccucgauuuuaacgagaugguccugcuaaccaugaaggaaaagagcugguuagugcacaagcaaugguuccuggacuuaccacucccauggaccagcggggccucaaccucccaggagacguggaaccggcaggaccucuuagugaccuucaagaccgcccacgcgaagaagcaggaggugguagugcucggcagccaggaaggagccaugcacaccgcgcuaacgggcgcgacagaaauucagaccuccggcaccacgacaauuuucgcagggcaccugaagugcagacucaagauggauaaacuuaccuuaaaagggaugagcuauguaaugugcaccggguccuuuaaacuugagaaagagguggcugagacacaacacggcaccgugcuaguccagaucaaguacgaagguaccgacgcccccugcaagauacccuucuugacccaggacgagaagggggugacacagaacggccggcugaucacggcuaacccgaucgugaccgacaaggagaagccggucaacaucgaagcugagccgccguucggugagucuuacaucguuauuggagcgggcgagaaggcccucaaacuguccugguuuaaaaagggcagcuccauaggcaaaauguuugaggccaccgcccgcggggcccggcguauggcuauccuaggagacacagccugggacuucgggagcaucggcggcguguucacuagcgucgggaaacuugugcaucagauauuuggcaccgcauacggggugcucuuuagcggcgucuccuggaccaugaagaucgggaucggcgugcugcucacuugguugggcuuaaauagccgcuccaccagccucucuaugacuugcaucgccguggggcuggucacccuauaucugggcgugaugguucaggcggacucuggaugcgucaucaauuggaagggcagggaguugaagugcggguccggcauuuucguaacgaacgaggugcacaccuggaccgagcaguacaaauuccaagcggacagcccgaaacgccugagugcagccauuggaaaggccugggaagagggaguuugcgguauucggagugccaccagauuggagaauauaauguggaagcaaaucagcaaugagcuuaaccacauucuccucgagaacgauaugaaguucacgguggugguaggugacguggcgggcauacuggcgcaagguaagaagaugauccgcccccagccaauggaacauaaguacucauggaaguccuggggaaaggcaaagauaaucggggcagacgugcagaacacgacuuuuauuaucgaugggccuaacacuccggagugccccgacgaucagcgggcguggaacaucugggaggucgaggacuacggcuucgggaucuucaccacgaacaucuggcuaaaguugcgggacuccuacacacaggugugugaucaccgcuuaaugagcgccgcgaucaaagacaguaaagccguucacgccgauaugggcuacuggaucgagagcgagaagaacgagaccuggaaacuggcccgcgcgucguucauugaggucaagaccugcauauggccaaagucacacacgcuuuggucaaacggcguguuagagucugagaugaucauccccaaaaucuacgggggcccgauaucucaacacaagcugcgucccggguacuuuacgcagaccgccggcccuuggcaucucgggaagcuggaacuggacuuugaccucugcgagggcaccacgguugucguugacgagcacugcggcaauagagggcccucacuccguacuaccaccgugacaggcaaaaucauucacgaguggugcugccggaguuguaccuugccgccccuccguuuccgcggggaggacggguguugguaugggauggagauccgccccgucaaggagaaagaagagaaccugguaaagagcauggucuccgccggaagcggcgagguagacucuuucucccugggccuccuaugcaucagcaucaugaucgaggaagugaugcggagccgcuggagccgaaagaugcucaugacagggacguuggccgucuucuuucugcugauuauggggcagcucaccuggaacgacuugauccgcuccugcaucauggugggugcaaacgccagcgacagaauggguauggggaccacauacuuggcucucauggcaacguucaagaugcggccgauguucgccgugggcuugcuguuccgccgacucacgucucgcgagguauuguuacucacgaucgggcuaagccuaguugcuuccguagagcuccccaauucauuagaagaacugggcgacgggcucgccaugggcaucaugauacuaaagcugcucaccgacuuucagagucaccaacugugggccaccuugcucagcuuaacguuuauuaagaccaccuucucgcugcacuacgccuggaagaccauggcaaugguccuuagcaucgugucccuuuucccccugugcuugucaacuaccagucagaaaacgacuugguugccagugcugcucggcucacuagggugcaagccuuugacgauguucuugauugccgagaacaagaucuggggcaggaaguccuggccauugaacgaggggaucauggcgguuggcaucgucucaaucuugcucagcucccuucuaaagaacgacgucccccuagcagggccccugauagcaggagggaugcugaucgccuguuaugucaucucugggucgagcgcagaccuauccuuggagaaagccgccgagguaucuugggaggaagaggccgagcacuccggugcgucacacaacauucucguggaaguccaggacgacggaaccaugaagaucaaagacgaggagcgggacgacacccucacgaucuuacugaaggccacccuccuggcuguguccggcguguauccgcugagcauccccgcaacccuguucgucugguacuucuggcagaagaaaaagcaacggucuggagugcuaugggacacccccucuccgcccgagguggagcgcgccguacucgacgacggaauauaccggauuaugcagcgcggacuccucgggcggucccaggugggcguggguguguuccaagagaacgucuuccacacuauguggcacgucacccggggcgcugugcugauguaccaggggaaacggcuggagccgagcugggcguccgucaaaaaggacuuaauaaguuacggcggaggauggcgccuucagggcuccuggaacacgggggaggaggugcaggucaucgcgguagagcccgggaagaauccgaagaaugugcagacggccccagguaccuucaagaccccugagggagaagucggcgcuauugcuuuggacuucaagcccgggacaucaggaucuccgauagucaacagagaggggaaaaucgugggccuuuacggcaauggggucguuaccaccucgggcaccuacgucucggccauugcucaggcaaaggcgucacaggaagggccgcugcccgaaaucgaggaugaagucuuucgcaagcgcaaucucacuauuauggaucuccaccccgggagcgggaaaaccaggcguuaccugccugccauugugagggaagccauuaagcggaagcugcgcacuuugauccuggcucccacucgagugguggcuagugagauggcggaggcccugaaggguaugcccauacgguaccagacgaccgcggucaaaagcgagcauaccggcaaggagaucguggaccucaugugucacgccaccuucacuaugcgccugcugucgccgguacgggugccgaacuacaacaugauuauuauggacgaggcccacuucacugaccccagcuccaucgcggcccgcggguacaucagcacccgagugggaaugggcgaggccgccgccauauuuaugaccgcgacgccgcccggcuccgucgaggcguucccucaaagcaacgccgugauacaggaugaggagcgcgauauaccugagcgguccuggaacucaggguacgaguggaucacugacuucccagguaaaacggugugguuuguaccgucaaucaagagcggaaacgacaucgccaauugccucaggaagaacgggaagcgggugauccaauugucccggaagaccuucgacaccgaauaucaaaagaccaagaacaacgacugggauuauguggucaccaccgacaucagcgagaugggggcgaacuuucgggccgaccgcgugaucgaccccaggcgcugccugaagcccgugauccugaaagacgggcccgagcggguuauucuggcuggucccaugccggugacaguagccuccgcugcucagcgccgagggcgcaucggcagaaaccacaacaaggagggggaccaauacaucuacaugggccagccccugaacaacgacgaggaccacgcccauuggacagaggccaagaugcuccuggacaauaucaacaccccggaggguaucauccccgcccuguucgagccggagcgcgagaagucagcggcaauagauggggaguaucggcucagaggggaggcccgaaaaaccuucguggaacugaugcggcguggggaccuuccugucuggcuuuccuacaaagucgcgagcgagggcuuucaguauucggaucggcggugguguuucgacggcgagcgaaacaaccagguccuggaagagaauauggacgucgagaucuggacgaaggagggggagcguaaaaagcugagaccccgguggcuagaugcgcgaaccuauuccgacccccuggcccugcgcgaguuuaaggaguucgccgccggccggcgcagcguguccggggaucugauacuugagaucggaaagcugccgcagcaccugacccagcgggcccagaaugccuuggacaacuuggugaugcuccacaacagcgagcagggcggcagagcguaccggcaugccauggaggaacuucccgacacgaucgagacauuaaugcugcuagcccucauagccgugcucaccggaggggucacccuauucuuucugucaggcagggggcucgguaagacauccaucggccugcugugcguuauggccuccagcgugcuccuguggauggcguccgucgagccucacuggaucgccgccagcaucauccuggaguucuuucuuaugguguuacugauccccgaacccgaucggcagcgcacgccccaggauaaccagcucgcguacguggucaucggucuguuguucaugauucucacgguugccgcaaacgaaaugggccugcuggagaccaccaagaaggaccucggaaucggccauguugcggucgagaaccaccaccaugccaccaugcuggauguggaccugcaccccgccagugccuggacucucuacgccguugcgaccacgaucaucacacccaugaugcggcauacgaucgagaacaccacggccaacaucagcuuaaccgcaauagcaaaucaggcugccauuuuaauggggcucgacaagggcuggccgaucucaaagauggacaucggaguaccuuuacuggcccuaggcugcuauucgcagguaaacccacuaacgcugacugccgcggugcucaugcuagucgcgcacuaugccaucauuggcccggggcugcaggcuaaggccacccgcgaagcccaaaagcgaaccgccgcggguaucaugaagaaucccacgguggaugguaucguggccaucgaccucgaccccgucgucuacgaugcaaaguuugagaaacagcucggacagaucaugcugcugauccugugcaccagucagaucuugcucaugcggacaaccugggcguugugcgagagcaucacucuggcaaccggcccccucaccacccugugggaaggcucgccaggcaaguucuggaacacgaccaucgccgugaguauggcaaacauuuuccgcgggucauaccuggccggugcggggcucgccuuuagccugaugaagucccucggaggcgggcggcgcgggacuggggcccaaggagagacccucggcgagaaguggaagagacagcugaaccagcuguccaagagcgaguucaacaccuacaagcgcuccgggaucauggagguagaccggucagaggccaaagagggccucaagagaggcgagaccacaaagcacgcuguaucucgcgguaccgccaaacuccguugguuuguugagcgcaaccuagucaagccagaagggaaggugauugaucugggcuguggcagagggggcuggaguuacuacugcgcugggcucaagaaggugacagaggugaagggcuauaccaaagggggcccaggacaugaggagcccauaccgauggccaccuacgguuggaaccuggucaagcuguacucuggcaaagacguguucuuuaugccacccgagaagugcgauaccuuacuuugcgacaucggggagagcucccccaacccgacgaucgaggagggccggacccugcggguccucaagaugguggagcccuggcuucggggaaaucaguucugcauuaaaguacugaacccguauaugccgagcgucguggagacccucgaacagaugcagcgcaagcacggaggcauguuggugcggaauccgcugagucgcaacaguacccaugagauguacugggugucgugcgggaccgguaacaucguauccgccgugaacaugacaagucgcauguuguuaaaccgauuuacuauggcgcaccgcaaacccaccuacgagagggacguagaccugggggcgggcacccggcacguggccgucgaaccagaggucgcgaaccucgacaucauuggccagcggaucgagaacauaaagcacgagcacaagagcacguggcauuacgaugaagacaacccauacaaaaccugggcguaccacggguccuacgaggucaagccgucgggcuccgcgucuagcauggucaacgggguggugaaacuucugaccaagccaugggacgugauacccauggugacccagaucgccaugacggauaccacccccuucggacagcagcggguauucaaggaaaaggucgacacccgcacgcccaaagcgaagagggggaccgcccagaucauggaagugaccgcccgguggcucuggggcuuucucucccgcaacaagaagcccagaauaugcacacgggaagaguuuacgcggaagguaaggagcaaugcggcuaucggagcagucuuuauugacgaaaaccaguggaacuccgccaaggaggcgguugaggaugaacgguucugggaccucguucaccgagagcgggagcuccacaagcaagggaagugcgccacuugcguauacaacaugaugggcaagagagagaagaagcuaggggaauuuggaaaagcgaaggggucccgcgccaucugguacauguggcucggcgcccgcuuccucgaauuugaggcgcugggcuucaugaacgaggaccacugguuuucccgggagaacucacucuccggaguggagggcgagggguugcacaaacuuggcuacauucuucgcgacaucuccaagauccccgggggcaacauguacgcggacgauaccgccggcugggacacuagaauaacagaggacgaucugcagaaugaggccaagaucacagacauuauggagcccgaacaugcacuacuugccaaggccauauucaaacuuaccuaccagaauaaaguagucagggugcagcgcccggccaagaacggaacugugauggaugucauaucccgucgcgaccaacggggcuccggccaaguaggaacguacggucugaacaccuuuaccaacauggaggcucagcucauccgccagauggaauccgaaggaaucuucagccccuccgaacuugagaccccgaaucuggccgagcggguucuggacuggcuugaaaaguacggaguggagcgccuuaagcggauggcaaucuccggcgacgacuguguggucaagccgaucgacgaccgauucgcaacggcucugacagccuuaaacgauaugggcaaaguccggaaggacaucccccagugggaacccuccaagggguggaacgacuggcaacaggugccguucugcucucaccacuuccaccaacuaaucaugaaggacggccgcgagauaguggucccgugccggaaccaggacgagcuggugggucgcgcccgggugagucagggggcaggcuggggccuacgugaaaccgccugcuugggcaaaagcuacgcucagauguggcaauuaauguacuuccaccggcgcgaccugcggcuggccgcgaacgccaucugcagugccguacccguggauugggugccgacaagucguacgaccuggagcauccacgcccaccaccaguggaugaccacagaagauaugcugucagucuggaaccggguauggaucgaggaaaacccauggauggaggacaagacgcauauuucauccugggaggacgugccguaccucgggaagcgcgaagaccaguggugcgguagucuuaucggucugaccgcacgcgcgaccugggccaccaacauccagguugcaaucaaccaggugcgacgccucauuggcaacgagaacuaccuggacuacaugaccaguaugaagcgguucaaaaacgagagcgacccggagggcgcgcugugguga

SEQ ID NO: 24649 - RNA, 9879 nt, Artificial Sequence
  derived and/or modified CDS sequence (opt11) from DENV-1__JN697056__SS-prME
uccgugacaaugcuacucaugcugcuaccgacggcccuaacguuccaucuaacuacgcggggcggcgagccccacaugauaguaagcaaacaggaaagggggaagucauuacucuucaaaacgucggcaggcguaaacaugugcacccugauagccauggaccuaggcgagcuuugcgaugauaccaugacauauaaauguccacgaaucacagaaaccgagccagaugacgucgacugcuggugcaacgcaaccgagaccuggguaaccuauggcacaugcucgcagaccggggaacaccggcgagacaaacgaaguguagcgcuggcaccccacauaggacugggccuggaaacacgaacggaaaccuggaugagcagcgaaggugcguggcgccagauacagaaaguggagaccugggcccugcggcauccaggauucacagucauagcccuauuccuagcacacgccauugguacgagcaucacacagaaagggauaaucuucauccuccucauguuaguaacuccaucgauggcgaugagaugcguaggaauaggaaauagagacuucguagaagggcuaagcggggcaacauggguagaugugguacuagagcaugggucgugcgucacgaccauggcgaaagacaagccaacgcuagacauagagcuccuaaaaacugaagugaccaacccugcaguuuuacgcaagcugugcauagaagcgaagauaagcaauaccaccacagacagccgaugcccuacacagggggaggcuacccuugucgaagaacaagacaccaacuucguaugccgccguacauucguggaccguggguggggcaacggaugcggccuuuucgguaaaggcucccuaauaacaugcgcaaaguuuaaaugcgugacaaagcucgaaggcaaaaucguccaguacgaaaaccucaaauauucagucauaguaacagugcacacuggugaccaacaccaggucggcaaugagacaacagagcauggcacuauagccacgauaacgccucaagcacccacgagcgagauucagcugacggauuacggcgcccucacucuagacuguagcccccgcacaggccuagacuucaacgaaaugguacuacucacuaugaaagaaaagagcuggcucguucacaagcaaugguuccuugaucuaccacuaccauggacaucaggugcuaguacaagccaggaaacguggaaucgccaggaccugcucguuaccuucaaaacugcacacgccaaaaaacaagagguaguggugcucgggucgcaggagggagcgaugcauacagcucucacaggcgccacugagauccagacauccggaaccacaacaaucuucgccggccaccucaagugccgacugaaaauggauaaacuuacgcugaaggguaucagcuacguaaugugcacaggccccuucaaacuggagaaagagguugcggaaacacagcauggcacgguuuuaguccaagucaaauacgaaggaacggacgcgcccuguaaaaucccauucagcagccaggacgagaaaggcgugacccaaaauggaagacucgucacggccaacccgauagugacagacaaggagaagccaguuaacaucgaggcagaaccuccguuuggagaaaguuacauaguuguaggagcuggggagaaagcccuuaagcugagcugguuuaaaaaaggcagcaguaucggcaaaauguuugaagcgacggcgcgcggcgcgagacgaauggccauacugggagauacggcaugggacuucggguccaucggagggguauucacgucgguaggcaaacugguucaccagauauucgggacugcguacgggguacuguuuagugggguaucauggacaaugaaaauagguaucggcaucuugcucacgugguuagggcuaaauucccggaguacgagcuuauccaugaccuguauagcaguuggaaugauaacgcuauaucucgggguuaugguacaggcggacucagguugugucaucaauuggaaaggucgugaacuuaaaugcggauccggcaucuucgugaccaacgaagugcacacauggacggaacaguacaaguuccaggcugacucacccaagagauuaagcgccgccauaggcaaagcgugggaggagggagucugcgggauuaggucugccaccaggcucgaaaauaucauguggaaacaaauaucgaacgagcugaaccacauccuacuugaaaacgacaugaaauucacaguagucguaggggacgugucgggaauccuagcccaaggaaagaaauccauacggccacagcccauggaacauaaauacagcuggaaguccuggggaaaggcaaaaauaaucggagccgacguccaaaauacaaccuucauaauugacggaccgaacacaccagaauguccagacgaccaaagagcguggaauaucugggaaguugaagauuacggcuucggcaucuucaccacaaauauaugguugaagcucagggacagcuacacacagguaugcgaccacaggcucauguccgccgcaaucaaggacucaaaagccguucacgccgacaugggcuauuggauagaaucagaaaaaaaugagacauggaaauuggcccgagccagcuucaucgagguaaagacaugcaucuggcccaagucccacacccuauggaguaacggcgucuuagaaucagaaaugauaauuccuaaaauauacggaggaccaauuucccaacacaauuaccggccaggauauuuuacacagacagcgggccccuggcaccuggggaaguuagagcucgacuucgaccugugcgagggaacaacuguggucguagaugaacacugcggaaaccgcggacccuccuuacggacaacaacagugacaggaaaaaucauccaugaguggugcugccgguccuguacacugccaccgcucagauuuaagggagaggaugggugcugguauggcauggagauccggcccgucaaagagaaagaggagaacuugguuaaaagcauggucucagcaggaucaggcgagguggacagcuucucgcucggucuacucugcauauccaucaugauagaggaagucaugagaagccgauggagcaagaaaaugcuaaugaccgguacgcuagcagucuuccuacuacuaacgaugggacaacuaacuuggaaugaccucauccgucucuguaucaugguaggggcaaaugccucggacaauaugggaauggggaccacauaccucgcguuaauggcuacauuccggaugagacccauguucgccgucggacuucuauuucggagacuaacuaguagggaaguacuccugcucacugucggucuaagccuaguggcaagcguugagcucccuaacucacuagaagaacuaggagacggccuagccauggguaucaugauccucaaacuacuaacagauuuucaaagucaucaacugugggccacgcuccugucacuaaccuuuguaaagacuacuuucucccuucacuacgcauggaagacaauggcaaugauccucuccaucguuagccuacuaccucugugccuaagcaccacuagccaaaaaaccacuuggcuacccguguuacucgggagccucggaugcaagcccuuaacaauguuccuaaucacagaaaacaaaaucuggggcaggaagucauggccccucaacgagggaaucauggccguaggaauaguaucaauccuucuauccucguugcucaaaaacgacguaccccuggcugguccccugauagccggagguaugcucaucgcguguuaugucaucagugggucuagugcggaccucagccucgaaaaagcagccgaggucucgugggaagaggaagcagagcacaguggugccucccacaacaucuuaguagaaauccaagaugacggcacaaugaagauaaaagacgaggaaagggaugacacaaucacaauccuccugaaagccacacuccuagcgauaaguggaguguacccaaugucaauuccagcaacgcuauuuguaugguacuucuggcaaaagcgaaagcaaaggucagguguacuaugggacacgccaucucccccggagguagaaagagccgucuuagaugauggcauauaucgcauauuacagagagggcugcuggggaggagccaaguuggcgugggagucuuucaagagggggucuuucacacgauguggcauguuacacguggagccguacucauguaccaaggcaaaagacuggaaccuagcugggccuccgugaagaaagaccuuauaucguacggaggcggcuggcgauuccaagggagcuggaacacuggcgaagaaguucaggucauagcgguagaaccagggaaaaacccaaaaaacguccaaaccgccccggggaccuuuaagaccagugaaggcgagguuggugccauagcacuagacuucaagccggggacgagcggaagucccaucgugaaccgcgaaggaaaaauagucggauuguacgguaacggaguugucacaacaucggggacauacgugagcgcgauagcgcaggccaaagcaucgcaggagggcccccuacccgaaauagaagacgaaguauuucgcaaacgaaaucucacaauaauggaucuucacccaggcagcggcaaaacgaggagguaccugccagccaucguacgagaggccaucaaacggaaacuccguacccugguccucgcccccacccggguaguggcuucggagauggccgaagcccugaaagguaugccaauaagguaccaaaccacagcaguaaaaucggaacacacgggaagagaaauaguggacuugaugugccacgccacguuuacaaugcgacuccuuagucccguuagggucccaaacuacaacaugaucauaauggaugaagcccacuuuacggaccccgcaaguaucgccgcacgcggcuacauuucgaccaggguaggaaugggagaggcagcagcaauuuucaugacagccacaccgccgggaagcguagaagcguucccgcagucgaacgcggugauccuugacgaggaaaaagauaucccagagcgguccuggaacuccggcuacgacuggaucacagacuucccagggaaaacggucugguucgugccuucaauaaaaagcgggaacgacaucgccaacugccuacgaaagaaugggaaacgaguuauacaacucaguagaaagacuuuugacaccgaauaccagaagacuaaaaauaaugacugggacuacguaguaacuacggacauaagcgaaaugggagcaaauuuucgagcagauagggucaucgacccccggagguguuuaaagccgguaauacucaaagacggcccagagcgcguaauacuggccggcccgaugccaguaacgguggcaagcgcagcacagcgucgugggcgcauaggccgaaaccagaacaaagaaggagaucaauacaucuauaugggccagccgcucaacaacgacgaggaucacgcccacuggacugaggcaaaaauguugcuggacaauaucaacacaccagaagggaucaucccggccuuauuugaaccggaaagggaaaaguccgcagcaaucgacggggaauauagacucagaggggaggcgagaaaaacauucguagagcucaugcgaaggggggaucugccgguguggcucucguauaaagucgcaagcgaaggauuccaauacucagaccgccgaugguguuucgauggcgaaagaaacaaucaagugcuggaggaaaacauggacguagagauauggaccaaagaaggggaacgcaagaaacuaagaccgcggugguuagacgcgcgcaccuauucagaccccuuagcgcuacgcgaauucaaggaguucgcggccggccgccgcagcgucucaggggaccugauuuuggagauagggaaauugccacaacaccuaacucaacgugcccagaacgcccuugacaaucuggugaugcugcacaacagcgagcaaggcgggaaagcuuaccgccacgccauggaggaguugccagacacgauagagacccuaaugcugcuggcguuaaucgcaguuuuaaccgggggggugacgcuguucuuccugagcggaagaggccuuggaaagacaagcauaggccuccucugcgucauguccucaucagcgcuccuauggauggccagcguagagccacacuggauugcagcgaguauaauucuagaauucuuucugaugguacugcugauaccagagccagaccgacaacgcacgccccaggauaaucagcuagcauacguaguaaucggacuucuuuuuaugaucuuaacagucgccgcaaacgagaugggccuacucgagacaaccaagaaagaccuagguaucggacacgcggcugcggagaaccaccaccaugccgcaaugcuagacguagaucuccacccagcgagcgcuuggacccuauacgcaguugccaccacgauuaucacaccgaugaugaggcauacaauagaaaacaccacggccaauauaucccuuacggcuauagcaaaccaagcugcgauacucaugggccuagauaagggguggccgauuagcaagauggacaucggagugccauugcucgcacucggaugcuacucacagguaaacccgcuaacauuaacggcagccguccugaugcuagucgcccauuacgcaaucauagggccaggccuccaggccaaagccacacgcgaagcacaaaaacggacagcagccgguauaaugaagaacccaaccguagacggaauaguagcgaucgaccucgaccccgucgucuacgaugcuaaauucgagaaacaacuaggccaaauaaugcuucucauacugugcacgucgcaaauccuccuuaugaggaccaccugggcgcucugcgaaucgaucacgcucgcgaccggaccccugacgacccugugggagggaucgccagguaaauucuggaacaccacgaucgccguaucaauggcgaacauauuucguggaucuuaccuugcgggggcggggcuugcguucucacuaaugaaaagucuaggcggcggaaggagaggaacaggagcacagggcgaaacauugggagaaaaguggaaaaggcaacuuaaccaacuauccaaauccgaauuuaauauauacaagcgcuccggcauuguagagguagacagaagcgaggcuaaagaaggacugaagagaggagagacuaccaagcacgcggugucacgaggaacagcaaagcuaaggugguucguggaaaggaauuuagucaaaccagaggggaaggugauagaccucggauguggucgaggcgguuggucguauuacugugccggucuaaaaaaaguaacagagguuaaaggcuacacgaaagggggucccggccacgaagagccuaucccaauggcuacguacggguggaaccuagugaagcuauauucuggaaaggacgucuucuucauacccccggaaaaaugcgauacucuguuaugcgacaucggagaguccagucccaacccgacgaucgaagaggguaggacccuccgcguccuaaagaugguagaaccguggcuccgaggcaaccaauucuguauaaaaauuuuaaaucccuacaugccaagcgucgucgagacguuggaacaaaugcaacgaaaacacggcggaaugcucgucagaaacccguuauccagaaacaguacccacgagauguacuggguuuccugcgggaccgguaacauugucuccgccgucaacaugacaucgcgaaugcuauugaaucgauucacaauggcucacaggaaacccaccuacgagcgggacguagaccugggagcaggcaccagacacguugcagucgaaccggaaguagcgaaccucgacaucaucggacaacgcaucgagaacauaaagaacgagcauaaaucaacuuggcacuacgacgaagauaauccauacaaaacaugggcguaccacgguucauacgaggucaaaccgagcgguuccgcaagcucuauggucaacggaguugucagguuauuaacgaagccaugggaugugaucccaauggucacccaaaucgcaaugacagacacaacaccguucggccaacaacguguguucaaagagaaagucgauacucgaaccccaaaggcaaagagagguacggcgcagaucauggaaguuaccgcaaaauggcuguggggcuuccugagccguaacaaaaagccacgaauaugcacaagggaggaauuuacacggaaagugagaucaaacgcggcuaucggagcaguauucguagacgaaaaccaauggaacuccgcaaaagaggccguagaagacgagagauucugggauuuagugcgaagggagagagagcuacacaagcaaggaaagugcgccacgugugucuacaacaugaugggcaaacgagaaaaaaaacucggagaauucggcaaagccaagggaucaagagcgauaugguacauguggcuaggugcgagauuccuagaguucgaagcacugggauucaugaacgaagaccauugguucucacgagaaaacucccuaucaggcguggaaggugagggccuucauaaacuuggguacauuuuacgcgacauuagcaagauaccgggaggaaauauguaugcggacgauacggccggaugggacacacgcauaacagaagacgaccuccaaaacgaggcaaagauaacggacauaauggaaccagagcaugcgcugcucgccacaagcauauucaaacuuacuuaccagaauaaggucguaagaguacagcgacccgccaagaacggaaccgucauggacgugauuagccgaagagaccaacggggcucaggucaagugggaacauacggacugaauacauucacgaacaugggggcgcaacuuauaagacaaauggaaucagaagguaucuuccuacccucagaacuagaaacaccaaaccuagcggggcgcguucuagauuggcuagaaaaacauggaauagaaaggcugcgcagaauggcaauuagcggcgacgacugcgugguaaagccaaucgaugacagauuugccaccgcccuaacggccuugaacgacaugggaaaaguccggaaggauauuccgcagugggagccgagcaaaggauggaacgauuggcagcaaguaccguucugcagccaucauuuucaucagcugauaaugaaggacggacgugagaucguaguccccugcaggaaccaagacgaacuggucgggcgcgcucgggugucgcaaggcgcgggguggagccugagagagacggcuugucuuggaaaaucauacgcucagauguggcaacugauguacuuucacagacgagaccuccggcuagcggccaacgcaauauguagcgcaguacccguugacuggguaccgacuagccgcacgacauggagcauacacgcacaucaccaguggaugacgaccgaggauauguugagcguauggaaccgcguauggauugaagaaaacccauggauggaagacaaaacgcauguuaguucaugggaagacguucccuaucuaggaaaacgagaagaccagugguguggcagccugauagggcucacggcccgagcaaccugggcaacaaacauacagguggcgaucaaucaagugcgccgacucauuggaaacgaaaacuaccucgacuacaugaccuccaugaaacgguuuaaaaaugagucagacccagagggugcucuaugguaa

SEQ ID NO: 24650 - RNA, 9879 nt, Artificial Sequence
  derived and/or modified CDS sequence (opt11) from DENV-1__JN697057__SS-prME
ucgguaaccaugcugcucaugcucaugcccaccgcucuggccuuccacuuaaccacccgcggcggggagccccacaugauugugagcaaacaggagcggggcaagagccugcuguucaagaccucagccggugugaacaucugcacccucaucgccauggaccugggcgagcugugcgaggacacgaugaccuacaagugcccgcgcaucaccgaggccgaacccgacgacguagacugcugguguaacgccacagacacguggguuaccuacgggacgugcagccagaccggcgagcaccggcgcgacaaacgguccguggcccucgcuccccaugugggccugggguuggagacgcgcaccgagaccuggaugucuuccgagggcgccuggaagcagauccagcggguugagaccugggccuugaggcaccccggguucacaguuaucgcccuauucuuggcgcacgcgauaggcacuagcaucacacaaaaagggaucaucuucauccuccucaugcuggugacccccucuauggccaugcggugcgucggaauaggcagccgcgauuucguggaggggcucucgggggccacguggguggacgucgugcuggaacacggaagcugugugaccaccauggccaaggacaagcccacccuggacauugagcuccuaaaaacugaggucacaaacccugcggugcugcguaagcucugcauugaggcgaaaaucuccaacaccaccacggacagccgcugcccgacccagggcgaggcaacccugguggaggagcaggacgccaauuucgucugccggcguaccuucguggaccggggaugggggaacggcugcggccuauucggcaaggggucccucaucacgugcgcgaaguucaaaugcgugaccaagcucgagggcaagaucguacaauacgagaacuuaaaguauagugucaucgugaccguccacaccggcgaccagcaccagguggggaacgaguccacggagcacggcaccaccgcuacuaucacgccacaggcccccacgacggagauacagcucaccgacuacggggcccuaacccuagauuguucuccccgcacgggccucgacuucaacgagaugguccuguuaaccaugaaggagaaguccuggcuugugcacaagcagugguuccuggaccugccccuccccuggacgagcggugccagcaccucccaggagacguggaaccggcaagaccugcuggugacauucaagacagcucacgcgaagaagcaggagguugucgugcucggcagccaggagggcgcgaugcacaccgcccugacaggcgcgacggagauacagaccuccgggacaacgaccaucuucgcuggucaccugaagugccgccuaaagauggacaagcugaccuuaaagggcaugagcuacgucaugugcaccggguccuuuaagcuggagaaggagguggcggagacgcagcacggcaccgugcugguccaaaucaaguacgagggcacagacgcccccugcaagauccccuucagcacccaagacgagaagggggugacgcagaacgggcggcucaucaccgccaacccgauugugaccgacaaggaaaagcccguaaacauugaggccgagccgcccuucggagagucguacaucguuauuggcgcgggcgagaaagcacugaaggucaguugguucaagaagggauccagcauuggcaagauguucgaggcaacugccagaggggcucggcgcauggcgauccugggagauacggccugggacuuuggguccaucggcggcgucuuuacaagcguggggaaguuagugcaccagaucuucggcaccgccuacggaguucuuuucuccggcgucucguggacaaugaagaucgggaucggagugcuccugacguggcuuggccugaacucccguagcaccucccugagcaugaccugcaucgcggucggacuggugacccuauaccugggugugauggugcaggccgacucggggugcgugaucaacuggaagggccgggagcucaagugcgggucaggcaucuucgugacgaacgagguccacaccuggaccgagcaguacaaguuccaggcggauagcccgaagcgccucuccgccgccaucggcaaggccugggaggaaggggucugcggaauacgguccgccacaagacuggagaacaucauguggaagcagaucuccaacgagcuuaaccauauccucuuagaaaacgacaugaaguucaccgucguggugggcgauguggcgggcauccucgcccaggggaagaagaugauccggccccagcccauggagcacaaguacuccuggaaguccuggggaaaggccaagaucaucggcgccgacguccagaacacuaccuucauaaucgaugggcccaacaccccggagugccccgaugaccagcgcgcguggaacaucugggagguggaggauuauggcuucgggauuuuuaccacuaacaucuggcucaagcugcgggacagcuauacccaggugugcgaucaccgccugauguccgccgccaucaaggacagcaaggccguacacgccgacaugggcuacuggaucgaauccgagaagaacgagaccuggaagcuggcgcgggccagcuucaucgaggucaagaccugcaucuggccaaagagccauacgcuguggagcaacggcgugcuggagucugagaugaucauccccaagaucuauggcggcccgaucagucagcacaacuaccgcccgggguauuucacccagaccgcuggucccuggcaccucggcaagcuggagcucgacuuugaccucugcgagggaacaacggucgucguggacgagcacugugggaaccgggggccaucccugagaaccaccacgguuacggguaagaucauucacgaauggugcugccggagcugcacacugccgccucugcguuuccgcggugaggauggcugcugguacgggauggaaaucaggcccgugaaggagaaggaagagaaccuggugaaguccaugguuucggccgguucuggcgaggucgacuccuucagccugggacuccugugcauuuccaucaugaucgaggaagugaugcggagccgcuggucccggaagaugcucaugaccgguacccuggcggucuucuuccugcugauaauggggcaacucacguggaacgaucuuauccgccucugcaucauggugggcgcgaacgccagcgaccgcauggggaugggcaccaccuaucuagccuuaauggccaccuuuaagaugcgaccgauguucgcggucggccuccuguuccgccggcugacgucccgcgagguccugcuccugaccaucgggcugucucuaguggcguccgucgagcugcccaacagccuggaggagcucggcgacgggcuggcuaugggaauuaugauccuuaaauuacugaccgacuuccagucccaucaacugugggugacccugcugagucugacguucaucaagacugccuucagucuccacuacgccuggaagaccauggcgauggugcugaguaucgucucccuguucccccucugccugagcaccacaucccagaagaccaccuggcugcccgugcuccugggcagccuggguugcaagccgcucaccauguucuugaucgcggagaauaagaucuggggacgcaaguccuggccccugaacgaggggauaauggccgugggaaucgucagcauccuccugagcagucugcucaagaacgacgugcccuuagcggggccccugaucgccggcggcauguuaaucgcgugcuacguuaucagcggguccagcgccgaccugucacuggagaaggccgcagaggucagcugggaggaggaagcugaacacuccggcgcgagccauaacaucuugguggagguucaggacgacgggacgaugaagaucaaggacgaggagagggacgacacccugaccauccuacucaaggcgacccuucuggccgucucgggcguuuacccgcucagcauacccgcaacacuguucgucugguacuuuuggcagaaaaagaagcagcguuccggcguccugugggauacgcccagcccgcccgagguggagcgcgccguacucgacgauggcauuuaccggaucaugcagcgcggcuugcuggggcggagucaggucggcguggggguuuuucaagagaauguguuccacaccauguggcacguaacccguggcgcggugcugauguaucaagggaagcggcucgagcccagcugggccuccgucaagaaggaccugaucagcuauggcggcggguggcgccugcagggcuccuggaauaccggagaagagguucaggucaucgcggucgagcccggcaagaaccccaagaacguucagacggccccugggaccuucaaaacucccgagggggaagugggcgccaucgcgcucgacuucaagccuggaaccucagguucccccaucgucaaccgggaacgcaagauugugggccuguauggcaacggaguggucacgaccagcgggaccuacguguccgccaucgcccaggcaaaggcaucccaggagggcccccugcccgagaucgaggacgagguguuccggaagcgcaaccucaccaucauggaccugcacccugggucgggcaagacgcggcgcuacuugccggccaucgugcgugaggccaucaagcgcaaacuucgcacacugauacuggcccccacccgggugguggccuccgagauggcggaggcccugaaggggaugcccaucagguaccagaccacugccgucaagagcgagcauacuggcaaggagauaguggaccuaaugugccacgccacauucaccaugcgacugcucuccccggugcgcgucccgaacuacaacaugaucaucauggacgaggcgcacuucacggacccgagcuccaucgcggcccggggcuacauaagcacccgcguggggaugggcgaggccgccgcuaucuucaugaccgccacgccgcccggguccguggaggccuucccucagagcaacgcggucauccaagacgaggagagagacauccccgaacgcuccuggaacucuggguacgaguggaucacagacuuucccgggaagacggugugguucgugcccucgaucaagagcggcaacgacaucgcgaacugccuucggaagaacggcaagcgcgucauccaacugucccggaagaccuuugacacggaguaccagaaaacgaagaacaaugacugggacuauguggugaccaccgacaucagcgagaugggggcgaacuucagagccgaucgggucaucgacccucgccggugccucaagccagugauccugaaggacggccccgagagggucauccuggccgggcccaugccggugacaguggcauccgccgcgcagcgacgcgggcggaucgggcgcaaccacaauaaggagggcgaccaguacaucuacaugggccagccacucaauaacgaugaggaccaugcucacuggacggaggccaagaugcuguuggacaacaucaacacccccgagggcaucauccccgcacucuucgagccagagcgcgagaaguccgccgcgaucgacggugaguaccggcugcgcggggaggcccggaagaccuucguggaacugaugcgccggggcgaccuccccguguggcuguccuauaaaguggcguccgagggguuccaguacagcgaccgucgauggugcuucgacggcgaacgcaauaaccaaguccucgaggagaacauggauguagagaucuggaccaaggagggcgagcggaaaaagcuccggccccgguggcuggaugcccgcacguauucggacccccuggcucuccgggaguucaaggaguucgcggcagggcgcagaagcguguccggcgaccugauccuggagaucgggaagcucccgcagcaccugacucagagggcccagaacgcccuggauaaccucgucaugcugcacaacagcgagcaagggggacgcgcguacagacacgccauggaagaacuacccgacaccaucgagacccucaugcugcuggcccucaucgccgugcugaccgggggcgugacccuguucuuccuauccggacguggcuuagggaagaccaguaucggccugcucugugucauggccucaagcgugcugcuguggauggcguccguggagccccacuggaucgccgccagcauaauccucgaguucuuccugauggugcugcucauccccgagcccgaccgccaacggacgccccaggacaaccagcuugccuacguggugaucggccuccucuucaugauccugaccgucgccgcgaacgagaugggauugcucgagacgaccaagaaggacuugggcauugggcacguggccguggagaaccaccaucacgccgcuaugcuggacgucgaccuccaccccgcguccgccuggaccuuauacgccguggccaccacgaucaucaccccgaugaugcgccacaccaucgaaaauaccacggccaacaucagccugacugccaucgcgaaccaggccgccauccugaugggccucgacaagggguggcccaucuccaagauggacauaggcguaccccugcucgcucuagguugcuacagccaggugaacccccugacccuuaccgcggcggugcugaugcuugcugcccacuaugcuaucauugggccgggccuccaggcgaaggccacgcgugaggcccagaagagaaccgcagccgggaucaugaagaaccccacuguggacggcaucgucgccaucgaccuggaccccgugguauacgacgccaaguucgagaagcaguuggggcaaaucaugcuacugauccucugcaccucacagauccuccugaugcgcacgacaugggcacugugugagagcaucacccucgccacaggcccccugacgacccuuugggaggguaguccgggcaaguucuggaacacgaccaucgccgucagcauggcgaacaucuuccggggcuccuaccucgccggggccggccuggcguucucacugaugaagucccucggcggggguagacgggggacgggcgcgcagggggagacgcugggcgagaaauggaagcgccagcugaaccagcuguccaagagcgaguucaauacauacaagcggucuggcaucauggagguagaccguagugaggccaaagaggggcuuaaacggggcgagacgacgaagcacgccgugucccgcgggaccgccaagcuccggugguucgucgagcgcaaccucgugaagccugagggaaagguggucgaccuggggugcggccggggcggcuggagcuacuacugcgcaggacugaaaaaggucaccgaggugaaaggguacaccaagggagggcccgggcacgaggaacccauccccauggcgacauacggcuggaacuuggucaaacuucacuccggcaaagacguauucuucauuccgcccgagaagugcgauaccuugcugugcgacaucggcgagagcuccccuaacccgacgauagaggagggccgcacccugcgugugcugaagauggucgagccguggcugcgcggcaaucaguucugcaucaagauccucaacccauacaugcccagcgugguggagacgcuagagcagaugcagcggaagcacgggggcaugcuggucaggaacccgcucucccggaacagcacccacgagauguacuggguguccugcggaaccggcaacaucgugucugccguaaacaugaccagucgcaugcuccugaacagguucaccauggcccaccggaagcccacguacgagcgcgauguggaccugggcgccggcacccggcauguggccguggagcccgagguggcgaaccuggacaucaucgggcagcgcaucgagaacaucaaacacgagcauaagagcaccuggcacuacgacgaggacaaccccuacaaaaccugggccuaccacgggucauacgagguaaaaccgagcgggagugccuccagcauggugaacggcguugucaagcugcuuacgaagcccugggacgugaucccgauggugacccagaucgcgaugaccgacaccacgccuuucgggcagcagcgagucuucaaggagaagguggacaccaggaccccgaaggccaaacggggcacagcgcagaucauggaagugacagcccgcuggcucuggggauuccugucgcggaacaagaaaccccgcaucugcacacgggaggaguucacgcgaaaggucagaagcaacgcugcaauuggugcuguguuuguggacgaaaaccaguggaacucugccaaggaggccgucgaggaugagcgcuucugggaucucgugcaccgggagcgcgagcuacacaagcagggcaagugcgcgaccuguguguacaacaugauggggaagcgggagaagaagcugggcgaguucggaaaggccaagggcucucgcgcgaucugguacauguggcucggugcccgguucuuagaguucgaggcgcugggcuucaugaacgaggaccacugguucucccgugagaacagccucuccggcgucgaaggugagggcuuacacaaacugggguauauccucagggacaucagcaagauacccggcgggaacauguacgccgacgacacggccggcugggacacccgcaucaccgaggaugaccugcagaacgaggcuaaaauuaccgacaucauggagcccaagcacgcacugcucgcuaaggccaucuucaagcugacguaucagaacaagguggugcguguccaacggcccgccaagaacggcaccgugauggacguaauauccagacgggaccagcgcgggagcggccaggucgggaccuacggccugaacaccuuuacuaauauggaggcgcagcugauacggcagauggagagcgagggcaucuuuagccccuccgagcuggagaccccuaaccuggccgagcgcguguuggacuggcuggagaaguaugggguggagcggcugaagcgcauggccaucaguggcgacgacugcgucgugaagccgaucgaugaccgauucgccaccgcccucaccgcgcuaaacgacauggggaagguccgcaaagauaucccccaaugggagcccuccaaaggcuggaaugacuggcagcaggucccauucugcucucaccacuuccaccagcugaucaugaaggacgggcgggagauuguggucccaugccgcaaccaggacgagcucgucggccgggcccgcgugucucagggcgccggauggagccugcgggagacggccugcuuaggcaagucguacgcgcagauguggcagcucauguacuuccacaggcgggaccugcgccuggccgcuaacgccaucuguuccgccgugcccgucgacugggugcccacgucccgcaccaccugguccauccacgcgcaccaccaguggaugacuaccgaggacaugcuaagcguuuggaaccgcguauggaucgaggagaaccccuggauggaggacaaaacccauaucuccagcugggaggacgugccguaccuggggaagcgcgaggaccaauggugcggcucccugaucggucucaccgcccgggccacgugggccacaaacauccagguagccaucaaccagguacgccgccugaucgggaacgagaauuaccuggacuacaugaccagcaugaagcgcuucaagaacgaguccgaccccgagggcgcgcuuugguga

SEQ ID NO: 24651 - RNA, 9879 nt, Artificial Sequence
  derived and/or modified CDS sequence (opt11) from DENV-1__HQ624984__SS-prME
agcgugaccaugcuguugaugcugaugcccaccgcccuggccuuccaccucacuacucggggcggggagccccacaugauuguaagcaagcaggagcggggcaagagccuguuguucaagaccagcgcgggggugaauaugugcacccucaucgccauggaucugggcgagcugugcgaggacacgaugaccuacaagugcccccgcaucaccgaggccgagcccgacgacguggacugcugguguaaugccaccgacacguggguuaccuacgggaccuguagccagacuggcgagcaccgaagggacaagcgguccguggcccuagccccccacguaggccuggggcuggagacgcgcaccgagaccuggauguccucggaaagcgcguggaagcagauccagcgggucgaaaccugggcacuccgccacccgggcuucacggugauagccuuauuccuggcgcacgccaucgggacuucgaucacucagaagggcaucaucuucauccuccuaaugcuggugacccccagcauggcaaugcggugcgucgggaucggcuccagagacuucguugagggcuugagcggugccacguggguggacguaguacuggaacacggcuccugcgugacgaccauggccaaggacaaaccuacccuggacauugagcuccugaagacggaggucaccaacccggcgauccugcggaagcucugcaucgaggcuaaaaucucgaacacaaccacggacucgcgcuguccgacccagggcgaggccacccugguugaagagcaggacgccaacuucgugugccggaggaccuucguugaucggggcuggggcaacgggugcggccuauuugggaagggcucucucaucacgugugcuaaauucaaaugcgugacgaagcuggaggguaagaucguccaguaugagaaccugaaguauuccgucaucgugacgguucacacaggcgaccaacaucagguugguaaugaaagcacggaacacgggacuaccgcgaccaucacgccccaggcccccacgaccgagauccagcucaccgacuauggcgcccucaccuuggacugcagcccccggacggggcucgauuucaacgagauggugcuucugaccaugaaagagaaguccuggcucguccacaagcagugguuccuggaccucccccuucccuggaccagcggcgccuccaccagccaagagacguggaaccggcaggaccugcuggugaccuuuaagacugcacacgcgaagaagcaagagguggucguguuggggucccaggagggcgccaugcacaccgcgcugacgggcgccacagagauccagaccagcgggaccacgaccaucuucgccggccaccugaaaugccgucucaagauggacaaguuaacccugaaaggaauguccuacgugaugugcaccggcagcuucaagcucgagaaggaagucgccgaaacucagcacggaaccgugcuggugcagauaaaguacgaaggcaccgacgcgcccugcaagauucccuuuuccacccaagacgagaagggcguaacgcaaaacgggcgguugaucacggccaacccgauugugaccgacaaggagaagcccgugaacaucgaagccgagccgccguucggcgaaagcuauaucgugaucggugcgggugaaaaggcccuuaagcuauccugguucaaaaagggcagcuccaucgggaaaauguucgaagcgaccgccagaggcgcccggcgcauggcgauccugggggacacggccugggacuucggcuccaucggggguguguucaccuccguagguaaacugguccaccagauauucgggacagccuauggcguucuguucagcggugugucauggaccaugaaaaucggcauugggguccugcugacguggcucggucugaacucccgcuccaccucacuguccaugaccugcaucgccgucggucuagugacccuguaccugggagucauggugcaggcagacagcggaugcguaaucaacuggaagggacgggaacucaagugcggcagcggcaucuucgucacgaaugagguccacaccuggaccgagcaauauaaguuccaggcugauucccccaagagacugucggccgccaucggcaaggccugggaggagggcguuugcgguaucagaucagccacucgcuuggagaacaucauguggaagcagaucagcaacgagcugaaccacauccugcuagagaacgacaugaaguucaccgucguggugggcgacgucgcggggauccuggcccaggguaagaagaugauucggccccaacccauggaguacaaguacuccuggaaauccugggggaaggccaaaaucauuggggccgacgugcagaauaccacuuucaucauagacggcccuaacacaccggagugccccgacgaccagcgcgcguggaauaucugggagguggaggacuacggguucggcaucuucaccacaaacaucuggcugaagcuacgcgacuccuauacccaggugugcgaccaccgccucaugagcgcugcuauaaaggacuccaaggccguucacgccgacaugggguacuggaucgaaagcgagaagaacgagaccuggaaacuggcgcgggccuccuucaucgaggugaagaccugcaucuggcccaagagccacacccugugguccaauggcguucucgagucagagaugaucauaccaaagaucuacggcgggccaaucucccagcacaacuaccgccccggcuacuuuacccagacggccgggcccuggcaucucggcaagcuggagcucgauuucgaccugugugagggaaccacgguuguggucgacgagcacugcggcaaccggggcccuucucugcgcaccacgaccgugacugggaagaucauacacgaauggugcugccgguccugcaccuuaccgccccuccgcuuccgaggcgaagauggguguugguacggcauggagauucgcccugugaaggagaaggaggagaaccuggucaagagcauggugagcgccggguccggcgagguggacagcuucucccucggccugcugugcaucuccaucaugaucgaggaggucaugcggagccgcuggagucguaagaugcugaugaccggaacccuggccguguuccugcuccucaucaugggccagcuaacguggaacgaccucauccgcuugugcaucauggugggggcgaacgccuccgaccggaugggcauggggaccacauaccuggcccucauggccaccuucaagaugcguccgauguucgcggucggacugcuguuccgcaggcucacgagccgcgaggugcugcuucuuacuaucggccugucccugguggcaagcgucgaacuccccaauucccucgaggagcuaggggacggccuggccauggguauaaugauucugaagcugcuaaccgacuuccagagccaccagcugugggccacccugcucagcuuaacguucaucaagaccaccuucagccugcacuacgccuggaaaaccauggcuauggugcucuccaucgucagccuguucccccugugccucuccacgaccagccagaagaccaccuggcugcccguucugcuggguagucugggcugcaagccacugacuauguuccucaucgccgagaacaagaucugggggcgccgcaguuggccacugaacgagggaauaauggccgucggaaucgucagcauccuccucucaagucugcugaagaacgacgugccccuggccggcccccugaucgccggggggaugcugaucgcgugcuacgugaucagcggcagcuccgccgaccucagccuggagaaggccgccgaggucagcugggaagaggaggccgagcacaguggggcgucccauaacaucuugguggaggugcaggacgacggaaccaugaagauaaaggacgaggagcgggacgacacccugaccauccugcugaaggccacgcuccuggccgucagcgggguguacccguuaagcauccccgccacccucuucgugugguacuucuggcagaagaagaagcagcgcucgggcguccugugggacaccccgagcccgcccgagguggagcgagccguucucgacgacgggaucuaccgcaucaugcaaagggggcuccugggccgcagccagguuggggugggggucuuccaggagaacgucuuccacaccauguggcacgugacccgcggggcgguucugauguaccagggcaagcgccuggagcccuccugggccucugucaagaaagaccucaucuccuacgggggcggguggcggcugcagggguccuggaauacgggggaagagguacaggucaucgcgguagagccugggaagaaucccaagaacgugcagaccgccccaggcaccuucaagacguccgagggggaggugggcgcuaucgcgcucgacuucaaacccggcacuagcgggagccccaucgucaaccgcgagggcaagauuguggggcuauacggcaaugguguggucaccaccuccgggacguacgucagcgccaucgcgcaggccaaggcgucacaagagggcccccucccggaaauagaggacgagguguuucggaagcgcaaucugacaaucauggacuugcaccccgggaguggcaagacccggcgcuauuuaccagccaucgugcgggaggccaucaagcgcaagcugcgcacccuuauacuggccccgacucggguuguugccucggagauggcggaggcccugaaggggaugcccauccgcuaccagacgaccgccgucaaaagcgagcacaccggcaaggagaucguugaccugaugugucacgcaacguucacgaugcggcugcuuucccccgugcgcgugcccaacuacaacaugaucauuauggacgaggcccacuuuaccgacccuagcucaaucgcggccaggggcuacaucagcacccgcguugggaugggugaggcggcugcaaucuucaugaccgcgacgccgcccggguccguggaggcuuucccccagagcaacgcccucauccaagacgaggagcgggacaucccggagcgcuccuggaacagcggcuacgaguggauuaccgacuuucccgggaagaccgugugguucgugcccaguaucaagagcgggaacgacaucgccaacugccugaggaaaaacggcaagcgugugauccagcugucgcggaagaccuucgacacggaguaccagaagaccaagaacaacgacugggacuacgucgugaccaccgacauuagcgagaugggggcgaauuuccgcgcagaccggguaaucgauccccggcggugcuuaaaaccggucauacucaaggacggccccgagcgcgugauucuggccgggcccaugcccgucacggucgcguccgccgcgcagcggcgcggacgaaucgggcgcaaccacaacaaggagggcgaccaguacauauacaugggccaaccgcuaaacaacgacgaggaccacgcucacuggaccgaggccaagaugcugcuggauaacaucaacacacccgaggggaucauccccgcccucuucgaacccgagcgcgaaaaauccgccgcgaucgacggcgaguaccggcugcgcggggaggcccggaagacuuucguggagcugaugcgccggggcgaucucccggucuggcugagcuacaaaguggccuccgaaggguuccaguacuccgaccgccgguggugcuucgauggcgagaggaacaaccaggugcuagaggagaacauggacgucgagaucuggacgaaggagggcgagcggaagaagcucagaccccgguggcuggacgcgcgcaccuacucugacccccuggcccuccgggaguucaaggaguuugcggccgggcggcggucuguguccggcgaccugauccuggagauugggaagcucccgcagcaccugacgcagcgcgcccagaacgcccucgacaaccucgugauguuacacaacucggagcagggcggccgggcguaucgucacgccauggaggaguugccggacaccaucgagacacucaugcuccuagcuuuaaucgccguccuuaccgggggcgugaccuuauucuuccucuccgggaggggccucgggaagacgagcaucggccuacucugcgucauggccuccagcguccugcuguggauggcguccguugagccccacuggaucgcagccaguaucauucucgaguuuuuccugauggugcugcucauccccgaacccgaccgccagcggaccccgcaggacaaccagcuggcguacgugguuaucggacuccucuucaugauccugaccguggcggcuaacgagauggggcugcucgaaaccaccaagaaggaucugggcauaggacacgucgccguggggaaccaccaucaugccgccaugcuggacguggacuuacaccccgcaagcgcguggacauuguacgccguagccacgaccaucaucacgcccaugaugcgucacaccaucgaaaacacgaccgccaacauuucacugacagccaucgcgaaccaggccgccaucuuaauggggcuagacaaggguuggccgaucuccaagauggacaucggcgugccacuucucgcucuggggugcuauucccaggugaauccccugacucuaacugccgccguccugaugcugguggcccacuacgccaucaucggccccgggcuccaagccaaggcgacccgcgaggcccagaagaggaccgccgcuggaaucaugaagaacccgacgguggaugggaucguugcgaucgaucuggaccccguuguguacgaugcgaaguucgagaagcagcugggccagaucaugcuccugauacugugcacgucccagauuuugcugaugcgcaccacuugggccuuaugcgagagcaucacucucgccacgggcccccugaccacccugugggaggggucccccggcaaguucuggaacacgacgaucgccguuuccauggccaacaucuuucggggguccuaccucgcgggcgccggccuggccuucucccugaugaaguccuuggggggggggcgccggggcaccggggcccagggcgagacccugggugaaaaguggaagcgucagcugaaccagcucuccaagagcgaguucaacaccuacaagcgguccgggaucacggagguggaccgcagcgaggcgaaggagggccugaagcgcggggagaccacgaagcacgccgugucccgcggaacagccaagcugcggugguuugucgagaggaaccuagucaagccagagggaaaggugaucgaccucggcugcggucgcggcggguggagcuacuacugcgccgggcugaagaaggucacggaaguuaagggguacaccaagggcgggcccggccaugaggagcccauccccauggccaccuacggguggaaccuagugaagcuccacuccggcaaggacguuuuuuucauuccgcccgaaaagugcgacacucugcugugcgacaucggggagagcucccccaauccuacgauagaggagggccgcacccuccgggugcuuaagaugguggagccguggcucagggggaaccaguuuugcaucaagauacucaaccccuacaugcccucugucguggagacuuuagagcagaugcagcggaagcacggcggcaugcuggugcgcaauccccucagucggaacagcacccacgagauguacugggucuccuguggaaccggcaacaucgugagcgcggugaacaugacgucucguaugcuuuuaaaccguuucaccauggcgcaccggaagccgacauaugagcgcgacgucgaccugggggccggcacucggcacguggccguggagcccgaggucgccaaccuggacaucaucgggcagcgcauagagaauaucaaacacgagcacaagucuacuuggcacuacgacgaagacaaccccuacaagacuugggcguaccacgggucauacgaggugaagcccucgggcagcgccagcagcauggugaacggggucguaaagcugcucaccaagccgugggacgucauccccauggugacccagaucgccaugacagacaccacuccguuuggccagcagcggguguucaaggagaagguggacacccgcacgcccaaggccaagagaggaaccgcgcagauuauggaggugaccgcgaaguggcuuuggggcuuccugucucgcaacaagaagccgcggaucugcacccgcgaagaguucacgcggaaggugcgcagcaaugccgccauuggcgccgucuucgucgacgaaaaccaauggaacuccgcgaaggaggccguggaggacgagcgguuuugggaccucguccaccgcgaacgggagcugcacaaacaggggaagugcgccaccugcguguacaacaugaugggcaagcgcgagaagaaacugggggaauucggcaaggccaaggggagccgggccaucugguacauguggcucggcgcccgguuccuggaguucgaggcccugggcuuuaugaacgaggaccacugguucucgcgggagaacagccucucugggguggagggcgagggacugcacaaacugggcuacauacuccgcgacaucucgaagaucccaggcggcaacauguacgccgaugacaccgccggcugggacacccggaucacggaagacgaccuacaaaaugaggcccgcaucaccgacaucauggagccggagcacgcgcugcuugcuaaaagcaucuucaagcugaccuaccagaacaaggucgugcgcgugcaacggccggccaagaaugggaccguuauggacgugaucucccgucgcgaccagcgcggcuccggccaggugggcacauacggccugaacaccuuuaccaacauggaagcccaguugauccggcagauggaaagcgaggggaucuucaguccaagcgagcuggagacccccaaucuggccgagcgcguccucgacugguuagagaaguauggcguggagcggcugaaacgcauggcgaucuccggggacgacuguguggucaagccuaucgacgaccgauucgccacagcccucacugcccugaacgacaugggcaaggugagaaaggacauuccgcagugggagcccaguaagggguggaacgacuggcagcagguucccuucugcagccaccacuuccaccaguuaauaaugaaggacggccgggagauagucgugcccugccgcaaccaggacgagcucgucgggcgggcccgcguaucccagggggcaggcuggagccugcgggagaccgcuugcuuggggaagagcuaugcccaaauguggcagcucauguacuuccaucgccgggaccugaggcuagcggcgaacgccaucuguagcgccgugccgguggacuggaucccuaccuccagaacuaccuggagcauccacgcgcaccaccaguggaugacgacagaggacaugcucuccgucuggaaccgcguguggaucgaggagaaccccuggauggaggacaagacgcacaucagcuccuggggcgaugugccguaccuggggaaacgcgaagaccaguggugcgggagccugaucggacuaaccgcccgggcgacaugggccaccaauauccaggucgccaucaaucaggugcgccggcugaucgggaacgagaacuauuuagacuauaugaccucaaugaagcgcuucaagaacgagagcgauccagaaggcgcccucugguga

SEQ ID NO: 24652 - RNA, 9879 nt, Artificial Sequence
  derived and/or modified CDS sequence (opt11) from DENV-1__HQ891314__SS-prME
agcgugacgaugcugcugauguuaaugcccacagcucuggccuuucaccugacuacccgaggcggagagccccacaugaucgugagcaaacaggagcgagggaagagccugcuguucaagacaagcgcgggggugaauauguguacucuuaucgccauggaccugggugagcuaugcgaagacacuaugacguacaagugcccccggauuaccgaggccgaaccugacgacguagauugcugguguaaugccaccgacacgugggucaccuacgggacuugcucccaaaccggcgagcacaggagagacaaacgauccguggcccuugcgccacacgugggccugggacuggaaacgcggaccgagaccuggaugucaucugagggcgcuuggaagcagauccagcgggucgaaaccugggccuuacgucaucccggguucacggugaucgcccuuuuucuggcgcacgcuauaggcacaucaauaacgcaaaaggggauuaucuucauccuacucaugcuaguaacccccuccauggccaugcgguguguaggcauuggcagcagggacuucguggaagggcucuccggggccacguggguggacguugugcucgaacacgggucgugcgugacuaccauggccaaggauaaaccuacccuagauaucgagcucuugaagacggaggucaccaaucccgcaguccuccggaagcucugcaucgaggccaaaauauccaacacaacaacggacagccgcugccccacccagggggaagccacccuggucgaggagcaagacgcuaacuucgugugucggcgaacguucguugaccgaggcugggggaacgggugugggcuauucggcaaagggucccuucucaccugcgcaaaguucaagugcgugaccaagcuugaagguaagauuguccaguacgagaaccucaaauacuccgugaucguuaccguccauaccggugaccagcaccaggugggaaaugaguccacugagcacggcaccacagcaaccaucacaccucaagcccccacgacugagauccaacuaacugacuacggggcgcugacgcuggacugcucgccucgcacgggccuagacuucacugaaaugguacugcucaccaugaaggagaagagcuggcuggugcacaagcagugguuucuugaccugccgcugcccuggaccucgggugccucuacgucccaggagaccuggaacaggcaggaccugcucgugaccuucaagaccgcccacgcaaagaagcaagaggucguggugcucggcagccaggaaggcgccaugcauacggcguugacaggggccaccgagauccaaacaagugggacaaccacaauauucgccgggcaucucaagugccggcugaagauggacaaacuaaccuugaaaggcauguccuauguuaugugcacggggagcuucaagcuggaaaaggagguugcagagacccagcacggcaccgugcugguacagaucaaguacgagggcaccgaugccccaugcaaaauuccguucucgacucaggaugagaaaggggugacucagaacggcaggcugaucacagccaacccgauugucacugacaaggagaagcccgucaacaucgaggccgagccgcccuucggggaauccuauauuguuauaggcgcgggcgaaaaggcccucaaacugucuugguucaaaaagggguccagcauuggcaagauguuugaggccaccgcccguggcgcacgacgcauggcgaucuuaggggacaccgcgugggacuucggguccaucggggggguguucaccucuguugggaagcucgugcaccagaucuucggcacagcguaugguguucuguucuccggcgucagcuggacgaugaagaucgggaucggggugcugcucaccuggcuuggccuaaacucccgcagcacgucccucagcaugaccugcaucgcugugggacuggucacgcuuuaccucggugucauggugcaagcagacuccgggugcgucauuaacuggaagggccgggagcuuaagugcggcagcgggaucuucgugacgaacgaggugcacacauggaccgagcaauacaaguuucaggcggacagcccgaagcgacuguccgccgccaucggcaaggccugggaggagggggucugcggcauccgguccgcgacacgcuuggaaaacauaauguggaagcaaaucuccaacgaacugaaccacauccuacucgagaaugacaugaaauucacggugguggucggggacguggcuggcauccuagcucaagggaagaagaugaucagaccgcagcccauggagcacaaguacagcuggaaaaacuggggcaaggccaaaaucaucggcgccgacgugcagaacuccaccuuuauaauagacgggcccaacaccccggaguguucggacgaccagcgcgcguggaauaucugggagguugaggacuauggcuucgggaucuucacgacgaacaucuggcucaaacuccgggacuccuacacccaggucugcgaccaccgauugaugagcgccgccaucaaggauucgaaggccguucacgccgauaugggcuacuggaucgagagcgagaaaaaugaaaccuggaaguuggccagggccaguuucaucgaggucaagacaugcauauggcccaagagucauacacucuggucuaauggaguguuggagagugagaugaucauccccaagaucuacggaggccccauuucccagcacaacuaucgcccggguuacuucacucagacagccggccccuggcaucugggaaagcucgagcuggacuucgaccucugcgagggcacuacgguagucguggaugaacauugcggcaaccgggggcccagcuugcgcacaacgaccguaacgggcaagaucauccacgaguggugcugcagguccugcacacugccgccccugcgcuuuaggggcgaggauggcuguugguauggcauggagauccgccccguaaaggagaaggaggaaaaccucgucaaauccauggucagcgccgguuccggcgagguggacagcuucucccugggucuacugugcaucagcauuaugauagaggaggugaugagguccagauggagccggaagaugcugaugaccggcacacuggcgguguucuuccugcugaucauggggcagcugacuuggaacgaccugauccgccucugcauaauggucggcgcgaacgcuucggaccgcauggguaugggcacaaccuaccuggccuugauggcgaccuucaagaugcggcccauguucgcagugggccugcuguuucgacggcuuacgaguagggaggugcuccugcucacgauaggguugagcuuggucgcgagcguggaacucccuaacagucuggaggagcucggcgacgggcucgcaaugggcaucaugauccucaaacuauugacggacuuccaaagccaccagcugugggcaacccugcucuccaugacguuuaucaaaaccacauucucucugcacuaugcuuggaaaaccauggcgaugguucuauccaucguuagccucuuccccuugugucugucuacgacaagccagaagaccacuugguugcccguccugcugggcucucuagggugcaaacccuuaacaauguuucugaucgccgaaaacaagaucuggggccggaagucguggccucuaaacgaggggaucauggccguagguaucgucagcauccugcuuuccagccuacugaagaacgaugugccacuggcugguccacucauagccggcgggaugcuaauugcauguuacgugauauccggcagcucggcugauuugagccuggagaaggcggcugagguuucaugggaagaggaggcagagcacaguggcgcgagucauaauauacugguugagguccaagaugacgggacgaugaagaucaaggacgaggagcgcgacgacacccucacuauccuccuuaaggcaacccuccucgcagugagcgggguguacccccucucgaucccggccacucuuuucgucugguauuucuggcagaagaagaagcaacggagcggcgugcucugggacacccccuccccacccaaaguagaacgcgccguucuggaugauggcaucuaccggaucaugcagcgcggccugcuagggcggagccaggugggcgucggggucuuucaggagaacgucuuucacaccauguggcacgucacacgcggcgcgguacugauguaccagggcaagcgucuggaaccuaguugggccagcgugaagaaggaccugaucucauacggcggcgguuggcgccuccaggguagcuggaauacgggcgaagaaguccagguaaucgcgguggaaccugggaagaaccccaagaacgugcagacagcccccgguacauucaaaacuccugaaggcgaggucggcgccaucgccuuggacuucaagccgggcacauccgguagccccaucguaaacagggagggaaagauagugggacuuuacggcaacgggguugugacaaccagcggcaccuaugugucagcaauagcccaagcaaaggcgagccaggaggggccucucccggagaucgaggacgagguuuuccgcaaacgaaaccuuacgauuauggaucuacacccgggguccgggaaaacgcgccgguauuugccggccauuguccgugaggcgaucaaacgcaagaugcguaccuuaauccuagccccgacccgcgugguggcuucagagauggcggaagcuuugaaaggcaugccgauccgcuaccagacgacagcugugaaguccgaacacaccggaaaggagauaguagaccuaaugugccacgcaaccuuuacgaugagacuguuaucacccguccguguccccaauuauaacaugaucaucauggaugaagcccacuucacugauccgucgagcaucgccgcgcgcggguauauaucaacccggguggguaugggcgaggcagcugcgaucuucaugaccgcgacgccccccggcagcgucgaggcguuuccccaguccaaugcugucauccaggacgaagaacgcgacaucccggagcggaguuggaacucuggguacgaguggauuaccgauuuccccggcaagaccgugugguucgucccgagcauuaaggccggaaaugacauugcuaacugccugaggaagaacggaaagcggguuauacagcugucccgcaagaccuuugauacagaauaccagaagacaaaaaacaacgacugggacuauguggugaccacagauaucagcgagaugggugccaacuucagggccgaccgcgugaucgacccucgacguugccucaagccggugauccugaaggacggaccagagcggguaauucuggcuggcccgaugcccguaacggucgccuccgcggcccagcgacgggggcgaauaggacggaaucacaauaaagagggcgaucaguacaucuauauggggcaaccgcucaauaacgacgaggaccacgcacacuggaccgaggcgaaaaugcugcuggacaacaucaauacccccgaaggaauuauacccgcccucuuugaacccgagagggagaagucggcggccaucgacggggaguauagacugcggggcgaggcccgcaagaccuucguggaguugaugcgucgaggggauuuacccgugugguuauccuacaaggucgccagcgaagguuuccaauacucggaccggagaugguguuuugacggcgaacggaacaaucaaguucuggaggagaacauggacguagagaucuggacuaaggagggagagcgcaaaaaacuccggccccgcuggcuggacgcccgaacuuacucggacccuuuagcgcuacgcgaguuuaaagaauucgccgcuggccggcgcagcguuuccggggaccugauauuagagaucgggaaauuaccgcaacacuuaacucagcgggcccaaaacgcgcuggacaaccucgugaugcuccacaauucagagcaaggcgggcgcgccuaccggcacgcuauggaagaacuucccgacacgaucgagacgcuaaugcuccuggcacucauagccguacugaccggaggggucacccucuuuuuccuuucuggcaaggggcugggcaagaccucaaucggccuccugugcgugauggcguccagcgcccugcuguggauggccaguguggagccccacuggaucgcagcgagcaucaucuuggaguucuuucugaugguccugcuaaucccggaacccgaccgccagcgaaccccacaggauaaccagcuggcguacgucgucauagggcuccuguucaugauccugacaguggccgccaacgaaaugggucuguuagagacaaccaagaaggaccuugggauuggccacgucgcaguggaaaaccaucaccacgccgcgaugcuggacguggaccuccaccccgccucggccuggacccuguacgccguggccacgacuauuaucacgccgaugaugcgccauaccaucgaaaacacgaccgcgaacauaagccugaccgccaucgccaaccaggccgcgaucuuaaugggguuggacaagggcuggcccauauccaagauggauauaggcgugccuuuacucgcccuggggugcuacagccaggucaaucccuugacccuaacagccgccguauuaaugcugguggcccacuaugcuaucaucggcccuggccuccaggccaaggccacccgggaggcccaaaaacgcacagcugcuggaaucaugaaaaaucccaccaucgacgguaucguagcuaucgaccucgaccccgugguguaugacgcuaaguucgagaagcagcugggacagaucaugcucuugauccuuugcacaucccagauucuccucaugcguaccacaugggcccugugcgaauccaucacacuagccacaggcccccuuaccacccuaugggaaggguccccgggaaaauucuggaacacuaccaucgcggucuccauggccaacauuuuccggggauccuaccucgccggcgcgggccucgcuuucagcuuaaugaaguccuuaggggguggucgccgcggcaccggggcacagggugagacacugggcgagaaguggaaaagacaguuaaaucagcugaguaagagcgaauucaacaccuacaagagguccgggauaauggaggucgaucgaagcgaggcaaaggagggucugaagcggggggaaacgaccaaacacgccgugucccgcggcacugccaaacugcggugguucguagagcgcaaccucgugaagccggaggggaaggugaucgaccugggaugcgggcgcggggguuggucuuacuacugcgccgggcugaagaaggucacagaagugaagggguacacuaaaggcgggccaggucaugaagaacccauuccgauggccacguaugguuggaaucuggugaaacuccacagcggcaaagacguguuuuucaucccgcccgaaaagugcgauacucugcuuugugacaucggagagagcucucccaaccccacgauugaggagggucgcacgcuacggguacugaagaugguggagccuuggcuaaggggcaaccaauucugcauuaagauccucaacccuuacaugcccucugucgucgagacccuugagcagaugcagcguaagcacggaggcaugcuggugcguaauccccucucccggaauuccacacacgagauguacuggguguccugcgggaccggcaacauugugagugccgugaacaugaccucccgcaugcugcuuaaccgcuucacgauggcacaccggaagcccaccuaugagcgcgacguagaucucggggccggcacgcggcacguggcgguggagccggaaguugcuaaccuugacaucaucgggcaacgcaucgagaacauaaagcacgagcacaagucaaccuggcacuacgacgaagacaauccuuauaagacgugggccuaccauggguccuacgaagugaagcccagcggcuccgccucgucgaugguuaacggggucgucaaguugcucacuaagccgugggacgugaucccuauggugacucagaucgcuaugaccgacacgacccccuucggccaacagcggguauucaaggagaagguagacacccgcacuccaaaagcgaaaaggggaacggcccagaucauggaggugacagcacgcuggcugugguccuucuuaagccgcaacaagaaaccaaggaucuguacccgggaggaguucacucguaaggugcgguccaaugcugccaucggcgccguguucguggacgagaaccaauggaacagugccaaggaagccgucgaggaugaucgcuuuugggaccucguccaucgggagcgggagcugcacaagcaggguaaaugcgcuacuugugucuacaacaugauggguaagcgcgagaagaaguuaggcgaguucgggaaggcaaagggcucccgcgcgaucugguauauguggcuaggggcucgguuccuggaguucgaagcccucggauucaugaaugaggaccacugguucucccgggagaacucucucuccggcguagagggggagggccugcacaaguugggguacauccuccgggacauuuccaagauccccggcggaaacauguacgcagacgauaccgcgggcugggacacccguauuaccgaggacgaccugcaaaacgaggcuaagauuacggacauaauggagccagagcacgcccuucuagccaaaucgaucuucaaguugaccuaccagaauaaggucgugcgcgugcagcgcccggccaagaacggcacugucauggauguaaucucacgcagggaccaacgcgggagcggccaagugggaaccuaugggcugaauacguucacuaacauggaggcgcagcucauccggcaaauggaaagcgaggagaucuucucgcccaaugagcuggaaacccccaacuuagcugagcgcguccuagauuggcuagagaaauacggcguggagcguuuaaaacgcauggcgauaucuggcgaugacugcguugucaagccuaucgacgaccgguucgcaaccgcccuuacggcgcugaacgacaugggcaaggugcguaaggauaucccccagugggagccaaguaagggguggaacgacuggcagcaaguccccuucugcagccaccauuuccaccaguugaucaugaaagacggccgagagaucguugugccaugccgcaaucaggaugaauuggucggccgggcgcgcguaagccagggggcuggguggucccugcgggagacagccugcuuagguaagucguacgcacaaauguggcagcucauguacuuccaccgccgggacuugcgccuggccgcaaacgccaucuguagcgccgucccgguggauuggguacccaccucacggaccacuuggagcauucacgcgcaucaccaguggaugacgaccgaggacaugcucucuguguggaacagggucuggauagaagaaaaucccuggauggaggacaaaacacgagugagcucuugggaagacguucccuacuugggcaagcgcgaagaccaauggugcggcagccucaucggccucacggcgcgcgccacaugggccaccaacauccaaguugccaucaaccagguccggcgccugauuggaaacgagaauuauucagacuacaugacaagcaugaagcgguuuaagaacgaguccgagcccgagggcgcacugugguga

SEQ ID NO: 24653 - RNA, 9879 nt, Artificial Sequence
  derived and/or modified CDS sequence (opt11) from DENV-1__HQ891315__SS-prME
ucagugaccaugcugcucaugcuuaugccuacagcgcuggccuuccaccucacaacaagaggcggggagccccacaugaucgugagcaagcaggagcggggcaagagccugcucuucaagaccagcgccggggugaacaugugcaccuugaucgccauggaccugggcgagcugugcgaagacacuaugaccuacaagugcccccggaucacagaggcagagcccgaugauguagacugcuggugcaacgcaaccgauacguggguuaccuacgggaccugcucccagaccggcgaacaccggagagauaagcgauccguugcccucgcgccccauguaggacuggggcuggagacucgcaccgagaccuggaugucuuccgagggcgccuggaagcagauucaacggguagaaaccugggcucugcgccaccccggguuuacagucaucgcccuguuccuugcucacgcaaucggcaccagcaucacacagaagggaaucaucuucauccuccuaaugcuggugacccccuccauggccaugagaugcgucggcaucggcucgcgcgacuucgucgagggcuuaagcggcgccacguggguggaugucguguuagagcaugggagcugugugaccaccauggccaaggacaagcccacccuggacauugaguugcugaagacggaggucaccaacccugccgugcucagaaaauuaugcauugaggcgaaaaucucgaacaccaccacggacaguagaugucccacccaaggcgaagccacucugguggaggagcaggacgccaacuucgucugccgucgcacguucguggaccggggcugggggaacggauguggucuguucggcaagggguccuuacugacgugcgccaaguucaagugcgucacaaaacuggagggaaagaucguccaguacgagaaccucaaguacagcgugauagugaccguacacacuggcgaccaacaccaggucgguaacgaguccaccgagcauggcaccacagcaaccaucacgccccaggcccccaccaccgagauacagcugaccgauuacggggcccugacccucgacugcagccccagaacgggcuuagacuucaacgagaugguccugcucaccaugaaggagaagucuuggcugguacacaagcagugguuccuagaccucccacugccauggaccagcggggccaguacgucccaggagaccuggaacagacaggaccuccucgugaccuuuaaaacugcccaugcgaagaagcaggaggugguggugcugggcagccaggagggcgccaugcacaccgcccuaaccggggccaccgagauccaaaccuccggcacaacgacuauauucgccgggcaccuuaagugccgucugaagauggauaagcugacacucaagggcaugucuuacgucaugugcacugguaguuucaagcuggagaaagagguggcggaaacgcaacacggcaccguccucguucagaucaaguacgaggguacggacgccccuuguaagauccccuuuagcacccaagacgagaaagggguaacgcagaacggcagacugaucaccgccaacccgaucgugaccgauaaggagaagcccgucaacauugaggccgagcccccuuucggggaauccuacaucgugaucggcgcgggcgagaaggcccucaaguuaagcugguucaagaagggguccagcaucggcaagauguuugaggccaccgcucgcggggcacggaggauggcgaucuuaggcgacaccgccugggacuuuggcuccaucggcggcguguuuaccuccgucgggaagcucgugcaccagaucuucggcacggcguacgggguguuauucucgggcgucucauggaccaugaagauugggaucggcguacugcucacuuggcugggucugaacucccgcagcaccuccuuaucgaugacgugcauugccguugggcuggucacgcuguaccucggggugauggugcaagcggacuccggguguguaaucaauuggaagggcagggaacugaagugcgggucuggcaucuucgugacgaaugaggugcacaccuggaccgagcaguauaaguuccaggcggacagcccaaagaggcugucugccgccaucggcaaggcgugggaagagggagucugcggcauucggucugccacccgccucgaaaacaucauguggaagcagaucuccaaugagcucaaccauauuuugcucgaaaacgacaugaaauucaccgugguaguaggggacguggcgggcauucuggcacaggggaaaaagaugauacggccacagcccauggaacauaaguauagcuggaaaaacuggggcaaggccaaaaucaucggcgccgacgugcagaacuccacguucaucaucgacggacccaauaccccggaguguucagacgaccagcgcgcguggaacauuugggaggucgaagacuacggcuucgggauauucaccaccaacauuuggcugaagcuccgggacuccuacacgcaggugugcgaccaccgccugaugagcgccgcaauuaaggacuccaaggcugugcaugcagacaugggcuauuggaucgagagcgaaaagaacgagaccuggaagcuggcacgcgcuuccuuuaucgagguuaagaccugcauauggccaaagucccauacccucugguccaacggcgugcucgaaagcgaaaugaucauccccaagaucuacgggggccccauaagccagcacaacuaccgcccgggguacuucacgcagacagccggccccuggcacuuagggaagcucgagcuggacuuugaccugugcgagggcacaacugugguugucgacgagcacugcgggaaccgggggcccagccuccgcacgaccaccguuaccggcaagauaauacacgaguggugcugucgguccugcacgcugccccccuuacgcuuuagaggggaggacggcugcugguacgggauggagauccgcccgguuaaggagaaggaggagaaucucguuaagagcaucgugagcgcuggcagcggggagguggacagcuucucccugggucuguuaugcaucagcauuaugaucgaggagguaaugcggucccgcuggagccggaaaaugcugaugaccgggacacuugccguguucuuccuacugaucaugggccaacugaccuggaacgaccucauccgccucugcaucaugguaggcgcgaaugccuccgaccgcaugggcaugggcacgaccuaccucgcccucauggccacguucaagaugcggccgauguucgccgugggucugcuguuccgcaggcucaccucucgagaggugcugcugcucacgaucggccugucccuagucgcaagcguagaacucccgaauagucuagaggagcucggcgacggccucgcgaugggcaucaugauccugaagcugcucacugacuuccagucccaccaauugugggccacccugcucuccaugaccuucaucaaaaccaccuucagccuacacuaugccuggaagaccauggcgaugguacugaguaucgugagccucuuuccccugugucuguccaccacgucacagaagaccaccuggcucccugugcuuuugggcucacucggaugcaaaccccugaccauguuccugaucgccgagaacaagaucuggggccggaaaaguuggccgcugaacgagggaaucauggccgucggcaucgugagcauccuauugucuagccuccugaagaaugacgugccguuagccggaccccucaucgcuggcggcaugcugaucgcuugcuacgucauuuccggcaguuccgccgacuuaagccuagagaaggccgcagaagugaguugggaggaggaagcggaacacucaggcgcgucccacaacauccugguggagguccaggacgacgggacgaugaagaucaaggacgaggagcgggacgacacccuuaccauccuccugaaggccacccuacucgccguuagcggcgucuauccccuguccaucccggccacccuguucgucugguacuucuggcagaagaaaaagcagcggagcggggugcucugggauacgccaagcccgcccaagguagagcgcgcuguguuagaugacggcaucuaccggaucaugcagcgaggccugcuggggcggucacagguagggguaggcgucuuccaggagaaugucuuccacaccauguggcaugugacccgcggcgcggucuugauguaccagggcaaacggcuggagccguccugggccagcgugaagaaagaccugaucuccuacggcggcggauggcggcuucaggguagcuggaacacaggggaggaaguacaagucaucgccguggagcccggcaagaaccccaaaaacgugcagacggcccccgggacauuuaagacuccggagggcgaggucggagccaucgcgcuggacuucaagcccggcaccuccggcagccccaucgugaaccgggaggggaaaaucgugggccuguacggcaacgggguggucacgaccagcggaaccuauguuuccgcgaucgcccaggccaaggcgagccaagaggggccccuccccgagauagaagacgaggucuuccgcaagcggaaccucaccaucauggaccugcacccuggauccgggaaaacgcgccgguaccuucccgccaucgugcgggaggccaucaagaggaagaugagaacccugauccuggccccgaccagggucgucgccagcgagauggcggaggcccucaagggcaugccuaucagguaccagacuacggccgugaagucugagcacaccggcaaggagaucguugaccugaugugccaugcgaccuucaccaugcgccugcucuccccuguccggguacccaacuauaacaugaucaucauggacgaagcccacuucacggacccgagcagcauagcggcgcgcggauacaucuccacccgggugggcaugggagaggcagcagcuauuuucaugacggcaacgccgcccggcagcguagaggccuucccacagucuaacgccgugauacaggaugaggagagagacaucccugagcgaagcuggaacuccggguacgaguggaucacggacuuccccggcaagacugugugguucguccccucaaucaaagccgggaacgacauagcaaauugccuacgcaagaacgggaagcgggugauccagcuaucccgcaagaccuuugacacagaguaccagaaaacgaagaauaacgacugggacuacguugucacuaccgacaucagcgagaugggcgcgaacuuucgggccgaccgcgugaucgacccccggcgcugccucaaaccggugauccugaaggaugggcccgagcgggucauccuugccggccccaugccaguaacagucgcauccgcggcucagcggcgaggacgcaucggccggaaucauaacaaagagggcgaccaguacaucuacauggggcagccucucaacaaugacgaggaccacgcccauuggacggaagccaagauguuauuggauaacaucaacacucccgaaggcaucauccccgccuuguucgaacccgagcgcgagaaguccgcggccaucgacggggaauaccgccugcggggugaagcacguaagaccuucguugaacugaugcggcgcggggaucucccgguguggcuguccuacaaggucgcaagcgaggguuuccaguacagugaccggcgcuggugcuuugauggcgagaggaauaaccaggugcuggaggagaauauggauguggagauuuggacuaaagaaggcgagcgcaagaagcuccgcccccgcuggcuggacgcgcggacauacuccgacccccuggcgcuccgcgaauucaaggaguuugccgccgggaggcgcagcgucucgggggaccugauccuggaaaucggcaagcucccccagcaccucacccagcgggcccagaaugcgcuggacaaccucgugaugcugcacaacagcgagcaggggggucgcgcuuaccggcacgccauggaggagcugccggacaccaucgagacccucaugcuccuagcccucaucgccguccugacgggcgggguuacgcuguucuuccucuccggcaaggggcugggcaagaccucuaucggccuucucugcgugauggcguccagcgcacugcuguggauggccuccguggaaccccacuggaucgcagcgagcaucauucucgaguucuuccucaugguccugcucaucccagagccugaccgccagcggaccccgcaggacaaccaacuggcguacguggugauugggcuacuauucaugauccugacuguugccgcaaacgaaaugggucugcucgagacgaccaagaaggaucuggggaucggucacguggccguggagaaccaccaccacgcugcgaugcuggacgucgaccuacacccggcuagugcauggacccuguaugcagucgcgaccacaaucaucacccccaugaugcgccacaccauagagaacaccacggccaauaucucacugaccgccauagccaaccaggcugcuauccuuauggggcuggacaaggguuggccgaucuccaagauggacaucggggugccccugcucgcucuggggugcuacagccaggugaacccccugacacucaccgcggccgugcugaugcuuguggcgcacuacgcgauaaucggccccgggcuccaggccaaagcgacucgggaggcccagaagcguaccgccgcgggcaucaugaagaauccgacaaucgacgguaucgucgccauugaccuagaccccgucguguacgacgccaaguucgaaaagcaacugggccagauuaugcuccugauccugugcaccucccagauacuccugaugcgcacaacgugggccuugugcgagagcaucacccucgccaccgggcccuugacgacccugugggaggggucacccggcaaguucuggaauaccaccaucgcggugucuauggccaacaucuuccggggauccuaccuagccggcgccggacucgcauucagccugaugaagucccuuggcggcgggcgccgggggacuggggcccagggcgaaaccuuaggcgagaaguggaaacgccaacucaaccagcuauccaagucugaguucaacaccuacaaacggucagguaucauggaggucgaucgcagcgaggccaaggagggccugaagcgcggagagaccacuaagcaugcagugucccgcgguaccgcaaagcugcggugguucguugagagaaaccucgucaagccggaagggaaggugaucgaccugggcuguggcagaggcggaugguccuacuacugcgcggggcuuaagaagguaaccgaggucaaggguuacaccaagggcggacccggccacgaggagcccauccccauggccacauauggauggaaccucguaaaacuacacuccggcaaggacgucuucuucaucccgcccgaaaagugcgacacacugcuuugcgacaucggggagagcucccccaaccccacgaucgaagaagggcgaacccuccgggugcugaagaugguggagccgugguuacgcgggaaccaguucuguaucaagauucuaaacccuuacaugcccucgguaguggagacgcuggaacagaugcagcggaagcacggcggcaugcugguccgcaacccccucucucguaacuccacccaugaaauguacuggguauccugcgggacugguaacaucgugucggccguaaacaugacgucccguaugcugcugaaccgguucaccauggcacaucgcaagccgacguacgagcgggacguugaucucggagccggcacccggcacguggcaguagagcccgaggucgcgaaccuggacaucauaggucaacgcaucgagaauaucaagcacgagcacaagagcacguggcacuacgaugaggacaaucccuacaagacgugggcguaccacggcuccuacgaagugaaacccagcggcuccgccagcaguauggugaacggggucgugaagcuccucacgaagcccugggacgucauuccaauggugacacagaucgccaugaccgacaccacgcccuucggccagcagcggguguucaaggagaagguggacacccggacccccaaggcgaagcggggaaccgcccagaucauggaggugacggcgcguuggcuaugguccuuucuaagucgcaacaagaagccccgcaucuguacccgggaggaauucaccagaaaggugagguccaaugccgcgaucggcgccgucuucguggacgagaaccaguggaacucugcuaaagaggcuguggaggacgaucgauucugggacuugguccaccgggagcgcgagcugcacaagcagggcaaaugcgcgaccugcguguacaacaugauggggaagcgggaaaagaagcugggagaguuugggaaggcgaagggcuccagagcuauaugguacaugugguuaggggcccgguuccuugaguucgaggcccuuggcuucaugaacgaagaccacugguucagccgcgaaaacucccucagcggagucgaaggggaaggccugcauaagcugggcuacauccuccgagauaucuccaagaucccuggcgggaacauguacgccgacgauacggcggguugggacacccgcaucaccgaagacgacuugcagaacgaggcuaagaucaccgacaucauggagcccgaacaugcccugcucgcgaaaucgaucuucaagcugacguaccagaacaaagucgugcgggugcagcggccggcuaagaacggaacgguaauggacgugaucucccgacgggaccagcgcgggagcggccagguggggacguacggccuaaacacuuucacaaacauggaggcgcagcugauccggcagauggaguccgaagaaauauucagcccgaaugagcuggaaacgccgaaccucgcagagcgcguccuagacuggcuggagaaguacggcgucgagcgacuuaagcgcauggccaucuccggugaugauugcgugguuaagccuaucgaugaccgguuugccaccgcccugaccgcgcuaaacgacaugggaaaggugcgcaaggauaucccgcagugggaacccagcaaggguuggaacgacuggcagcagguccccuucugcucccaccacuuccaccaguuaaucaugaaggacggccgugagaucgucgugcccugccgcaaccaggacgaacucgugggccgggcacgcgucagucagggagccggauggagccugcgggagacggccugccuugggaaguccuacgcgcagauguggcaauugauguacuuccaccgccgggaccugcgguuagccgccaaugccaucuguagcgcagucccuguggacuggguccccaccucccggaccaccuggucuauccacgcucaccaccaguggaugacgaccgaggacaugcucuccguguggaaucgcgucuggaucgaggagaaccccuggauggaagacaagacccgggucucguccugggaagacgugcccuaccugggaaagcgggaggaccaauggugcggcucgcugaucggucucaccgcccgcgcuacuugggccaccaacauacagguggcaaucaaccagguucggagacugaucgggaacgaaaacuacucggauuacaugaccagcaugaagcgguucaagaacgaguccgagccggagggcgcgcugugguga

SEQ ID NO: 24654 - RNA, 9879 nt, Artificial Sequence
  derived and/or modified CDS sequence (opt11) from DENV-1__HQ891316__SS-prME
agcgugaccaugcugcucaugcugaugccgaccgccuuagccuuucaccucacgacucggggcggggagccccauaugauagugagcaagcaagagcgagguaagagccugcuguucaagacgagcgccggggugaacaugugcacccucaucgcgauggaccugggugaacugugcgaggacacaaugaccuacaagugcccacgaaucaccgaagccgagcccgacgacguggacugcuggugcaacgccaccgacacguggguaaccuacgggaccugcagccagaccggcgagcaccggcgcgacaaacgguccguggcccuugccccucacgugggcuuagggcuugagacgcgcaccgaaaccuggaugagcagugagggagccuggaagcagauccaacggguugagaccugggccuuacgucaucccggguucacggugauugcccuguuucuggcgcacgccaucggcaccucaaucacccagaaggggaucaucuuuaucuuacugaugcuggugacgcccuccauggcaaugcggugcgucggcaucggcagccgcgacuucguugaggggcucuccggagcgacaugggucgacgucgugcuggagcaugggagcugcgugaccaccauggcaaaagauaagcccacacuggauauagagcucuugaagacggagguuaccaacccugcgguacugcggaaacucugcaucgaggccaagauauccaacaccaccacggacagccgcugccccacccagggcgaggccacccugguggaggagcaggacgccaacuucgucugcagacgcaccuucguagaccggggaugggggaacggcugcgggcuguucggcaagggaucccuccuaacgugugccaaguucaagugcgugaccaagcuggagggcaaaauaguccaguacgagaaccucaaauacagcguaauagugaccguccacaccggcgaccaacaucagguggggaacgagaguacggagcacggcaccaccgcgaccaucacaccgcaggcccccacgaccgaaauccagcugaccgacuacggggcccugacccucgacugcagcccccgcacaggccuggacuucaacgagaugguccugcuuaccaugaaggagaaguccuggcuggugcacaagcagugguuucuggaccucccgcugccguggaccagcggggcuagcaccucccaggagacguggaaccggcaagaccugcucgugacuuuuaagaccgcccacgcgaagaagcaggaggucguagugcugggcagccaagagggcgccaugcacaccgcccugacaggggccacggagauccagaccuccgggaccaccaccauauucgcggggcaccucaagugccgccugaagauggacaagcuuacgcucaaggguaugagcuacgucaugugcacuggguccuuuaagcuggagaaggaaguggcggaaacgcagcacggcaccgugcugguccagauuaaguacgagggcaccgacgcccccugcaagauccccuucagcacccaggacgagaaggggguaacgcagaauggccggcugauaaccgccaacccgaucgugaccgacaaggagaagcccgugaacaucgaagcagagccccccuucggggagucuuacauagugaucggagcgggcgagaaagcccucaagcugucuugguucaagaaggggucgagcaucggcaagauguuugaggccaccgccaggggggccagacgcauggcgauccugggcgacacggccugggacuuugggaguaucgggggcguuuucaccucagucgggaagcucgugcaucagaucuuugguaccgccuacggagugcuguucuccggcgucagcuggaccaugaaaaucggcaucggcgucuugcuaaccuggcugggccucaauucccgcagcaccagucuuagcaugaccuguaucgccguggggcuggucacccuauacuuaggcgugaugguucaggccgacuccggcugcgucaucaacuggaagggacgggagcugaagugcggcagcggcaucuucgugacgaacgagguccacaccuggaccgagcaauacaaguuccaggcugacagccccaagcgcuuauccgccgccaucggcaaggcgugggaggaggggguaugugggauccggagcgccaccagacuggagaacaucauguggaagcagaucuccaacgagcugaaccacauccugcucgagaacgauaugaaguuuacagugguggugggggacguggcggguauccuggcccaggggaagaaaaugauccggccccagcccauggagcacaaguacagcuggaagaacuggggcaaggcaaagaucaucggcgccgacguccagaauuccacguucauuauagacgggcccaacaccccggagugcagcgacgaccagcgcgcguggaacauuugggaaguggaggauuacggauuuggaauauuuaccaccaacaucuggcugaaacuccgggacuccuacacccaggugugcgaccaccgccuaaugagcgcagccaucaaggacuccaaggccgugcacgccgauaugggcuauuggaucgagucugagaagaaugagacuuggaagcuggcgcgggccuccuucaucgaggucaagaccuguaucuggccgaagucccacacccucuggagcaacggcgugcuggaaagcgagaugaucauccccaagaucuacggcgggccaaucucgcagcacaacuaccgcccaggguacuucacgcaaaccgcgggccccuggcacuuggggaagcuugagcuggacuuugaucugugugaagggaccaccguggucguggacgagcacugcggcaaccgagggcccagccucaggacgacaacugugaccggcaaaaucauccaugaguggugcugcagguccugcacccucccgccucugcguuuccgcggggaggacggcugcugguacgguauggagauacgccccguaaaggaaaaggaggagaaccucgucaagagcauggugagcgcggguuccggcgagguggauagcuucuccuuagggcugcucugcaucagcaucaugauagaggagguaaugcggucgcgcuggucaagaaaaaugcugaugacgggcacccuggcgguguucuuccuacugaucauggggcagcugaccuggaacgaccucauacgccugugcaucauggucggggcgaacgccuccgacagaauggggaugggcacgaccuaccuagcucucauggccaccuuuaagaugcggcccauguucgccguuggccuccuuuuccgccggcugaccagccgggaggugcugcuguuaacuaucggucugucccuggucgcgagcguagaacucccgaacucacuggaggagcugggcgacgggcucgcuaugggcaucaugauacugaaguugcucaccgacuuccagagccaccagcugugggcaacccuacucuccaugacauucauaaagacgaccuuuagucuacacuacgccuggaagacaauggcgaugguccugucaaucguaagccucuucccccuuugccuguccaccaccagccagaaaaccaccuggcuacccgugcugcugggcucccuagggugcaaaccccugaccauguuccugauagccgagaacaagaucuggggccguaaaucauggccgcuuaacgagggcauuauggccgucggcaucgugagcauucugcuauccucgcucuugaaaaacgacgugccgcuggccgggccucucaucgccggcggcaugcugauugcgugcuacgucaucagugggagcuccgccgaccugagccucgagaaggccgccgagguguccugggaggaggaagcggagcacagcggagcgucccacaacauacugguugagguccaggacgaugggacgaugaagaucaaagacgaagagcgcgacgacacccugaccauccuccucaaggccacccuacucgcuguaagcggcguguacccccuuuccaucccagccacccuguucgucugguauuucuggcagaaaaagaagcagagaagcggggugcucugggauacgccgagcccgcccaagguagagcgcgccguccuggacgacggcauauaccggauuaugcagcgcggccugcuggggcggagccagguuggcguuggggucuuccaggaaaacgucuuccacaccauguggcacgugacccgcggugcagucuuaauguaccagggcaagcgucuggagccguccugggccagcguuaagaaggaccugaucuccuacgggggcggguggcgccugcaaggcagcuggaacacaggggaagaggugcaggucaucgccguggagcccgggaagaauccaaaaaaugugcagacggcccccgggaccuucaaaaccccggagggggaggucggugcgaucgcucuggacuucaaacccgggaccuccggcagccccaucguuaaccgagaggggaagaucgugggccucuacggcaacggugucguaacgaccagcggcaccuacguguccgccaucgcccaggccaaagcaucacaggaggggccgcucccggagaucgaagaugaggucuuccgcaagcguaaccugaccaucauggaccuacaucccggcuccgggaagacacgucgguaccuaccagccaucgugcgcgaggcaaucaagaggaagaugcgcacccugauacuggccccgacccgagugguugccagcgagauggcagaggcccucaagggcaugccgaucagguaccagaccacggccgugaaauccgagcacaccgggaaggaaaucguggaccugaugugucacgccaccuucaccaugcgguuacucagcccggucaggguucccaacuacaacaugaucaucauggacgaggcccacuucacagacccgucuaguaucgcggcccgaggguauaucaguacgcgggucggcaugggugaggcagcggccaucuucaugacagcgacgccgcccggcucagucgaggcguucccccaguccaacgccgugauccaggacgaggagcgcgacaucccggagcggagcuggaacaguggguacgaguggaucacggacuuccccggcaagaccgugugguucgucccaagcauuaaagccggaaaugacauagccaauuguuuacggaagaacgggaagcgagugauccagcugucccgcaagaccuucgacaccgaguaccagaagacgaagaauaacgauugggacuacguggucaccaccgacaucuccgagaugggcgccaacuuccgggccgaccgugugaucgauccccggcggugcuuaaaaccggugauccuuaaagacgggcccgagcgggucauacuggccggucccaugcccguaaccgucgccuccgcggcacagcgucggggccgcaucggacggaaccacaacaaggagggagaccaguacauauacauggggcagccgcucaacaacgacgaggaccaugcccauuggacggaggccaagaugcugcuggauaacaucaacacccccgagggcauuauccccgcccucuucgagcccgagagagaaaagagugcugcuauagauggggaauaccgccugcguggcgaagcccgcaagaccuucguagaacugaugaggcgcggggaccucccgguuuggcuguccuacaaagucgccagcgaaggcuuccaguacagcgaccgccgcuggugcuucgacggugaacguaacaaccaggugcuggaagagaacauggacguggagaucuggaccaaggagggggagaggaagaagcucaggccaagauggcuugacgcgcgcacguacuccgaccccuuagcacuccgcgaguucaaggaguucgcagccggucggcgcagcgucucuggcgaucugauccucgagaucggaaaguuaccccaacaccugacccagcgggcacagaacgcacuggacaaucucgugaugcugcauaacagcgagcagggcgggagggcuuaccggcacgcuauggaggaguugccggacacgaucgagacauuaaugcuccucgcccucaucgccguucuuaccggaggggucacucuguucuuucucuccggcaaggggcugggcaagacuagcaucggacugcuuugcgugauggcguccagcgcgcuccuguggauggccuccgucgagccccacuggauugcagcgucgaucauccucgaguucuuccugaugguccuacucauccccgagcccgaccggcaacggaccccgcaagacaaccagcuugcauacguaguaaucgggcuccuguucaugauccugaccgucgccgccaacgagaugggucuucuagagacgaccaagaaggaccuggguaucggucacguggccgucgagaaucaccaucacgcagcgaugcuggauguagaccuccacccggccuccgccuggacucuuuacgccgucgccaccacgaucaucacccccaugaugagacacaccaucgagaacaccacggcuaacaucagccugaccgccaucgcaaaccaggccgcgauccuuauggggcuggacaagggauggccgaucucgaagauggacaucggcgucccccugcucgcccuggggugcuauucacaggucaacccccugacucucaccgccgcggugcuuaugcugguugcgcauuacgcgaucauuggccccgggcuccaagccaaggcgacucgggaggcacagaagcgcaccgcugcgggcaucaugaagaauccgaccaucgacgggaucgucgccaucgaccucgaccccgugguuuacgacgccaaguucgagaagcaguugggccagauuaugcuccugauucuaugcaccucccaaauacuccugaugcgcacgacaugggcguugugugagagcauaacauuggccaccggcccccucacgacccugugggaggggucuccgggcaaguucuggaacacgacgaucgcggucagcauggccaacaucuuccggggguccuaccucgcgggagcugggcuggcguucucguuaaugaagucccucgggggcgggagacggggcacaggagcccagggcgagacccugggugagaaguggaagcgccagcucaaccagcucucuaaaagcgaguucaauaccuacaagcgguccgggaucauggagguggaccgcucugaggccaaggagggccugaaacgcggggagacuacuaagcacgcggugucccgaggcaccgcaaagcuacggugguucgucgagcgaaaccucgugaagccagaggggaaggugaucgaccugggcugcggcagaggcggguggagcuauuacugcgcgggccugaagaaggucaccgaggugaagggguacaccaagggcggccccggacacgaggagccuaucccgauggcuaccuacggguggaacuuggugaaacuccacuccgguaaggacgucuucuucaucccgccagagaagugcgauacccuucugugcgacaucggugagagcucacccaaccccacuaucgaggagggccgcacccuccgggugcucaagaugguugagccgugguugcgcggaaaccaguucugcaucaagauacucaacccguacaugcccuccguaguggagacgcuggagcagaugcaacggaagcacggcgggauguuggugcgcaacccccucucccggaacagcacccacgaaauguacugggucuccugcggaacgggcaacaucgucucggccgugaacaugaccagucgcaugcuguugaaccgguucacaauggcacacagaaaacccacguacgaacgcgacgucgaucucggggccgguacccgacacgucgcgguagagccugaagucgccaaccuggauauaaucggccagcgcaucgagaauaucaaacacgagcacaaauccaccuggcacuacgacgaggacaacccuuacaagaccugggcuuaucacgggucguacgaggugaagcccucgggcucagccagcagcauggugaacggggucgugaagcugcucacuaagccgugggacgucauuccuauggugacacaaaucgccaugaccgauaccacgcccuucggccagcaacggguauucaaggagaaggucgacacccgcacccccaaggcgaagcgggggaccgcccagauuauggaggugacugcccgcugguuaugguccuuuuuaagccggaacaaaaagccucguauaugcacccgugaggaguucacccgcaaggugcgguccaacgccgcuaucggcgccguuuuuguggacgagaaucaguggaacuccgcuaaggaggcgguggaagacgaucgguucugggaccucguacaccgggagcgcgagcugcacaagcagggcaagugcgccacgugcguauacaauaugauggggaagcgggagaagaagcugggggaauuugggaaggcgaaggggucgagggccaucugguacauguggcucggggcccgguuccuggaauucgaagcccuuggcuuuaugaacgaagaccauugguucagccgcgaaaacucucuaagcggcguggagggggaaggccuacacaagcucggguauauccuccgugacaucuccaagauccccggcgggaacauguacgccgacgacacggcgggcugggacacccgcaucaccgaggaugaccugcagaacgaggcgaagaucaccgacaucauggagcccgagcacgcccugcucgccaagagcaucuuuaagcugaccuaccaaaacaagguugugagaguccaaaggccggccaagaauggcacggucauggacgugaucucccgccgggaucagcgcgggucaggccaggucgguacguacgguuugaacaccuuuacaaacauggaggcgcagcucauccgacagauggaguccgaggagaucuuuucuccuaacgaacuggagaccccgaaucuggccgaacgcguccucgacuggcuggagaaguacgggguagagcggcugaagcgcauggccaucuccggggacgacugcguuguaaagccaauugacgaccgguucgccaccgcccugaccgcccuuaacgacaugggcaaggugcgcaaggacaucccgcagugggagccuagcaagggguggaacgacuggcagcaggucccguucugcucccaccacuuccaccagcuuaucaugaaggacggccgcgagauagucguccccugcaggaaccaggaugagcuuguggggagggcccgcgucagccagggagccggcuggagccugcgugagacugcuugccuggggaaguccuacgcccagauguggcagcucauguauuuccaccgcagggaucugcgccuugccgccaaugccaucugcagcgccgugccgguggauuggguccccacauccagaacaaccuggagcauccaugcccaccaccaguggaugacgaccgaggacaugcuuuccguguggaaccgcguguggaucgaggagaaccccuggauggaggacaagacccgggucagcaguugggaggacgugcccuaccugggcaagcgcgaggaccaguggugcggcagccuaaucggccucacagcccgcgccacgugggccacuaauauccagguggccauaaaccagguccggcgcuuaaucgggaaugaaaacuacuccgacuacaugaccagcaugaagcgguucaagaacgaguccgagccggagggcgcguuaugguga

SEQ ID NO: 24655 - RNA, 9879 nt, Artificial Sequence
  derived and/or modified CDS sequence (opt11) from DENV-1__JN054256__SS-prME
agcguaaccaugcuguuaaugcugaugcccacagcccuggccuuccaucucacgacccgggagggcgagccacacaugaucgugucaaagcaggagcggggaaaaagcuuacuuuuuaagacuagugccggcgugaacaugugcaccuuaauagccauggaccugggagagcugugcgaagacaccaugaccuacaagugcccacggaucaccgaggcggagcccgacgacguggacugcuggugcaacgccaccgauacguggguuacguacgguacgugcagccagaccggggagcaucguagagacaaacggagugucgcgcucgcgccccacgugggccugggccuggagacccgcacggagaccuggauguccuccgagggggcauggaagcagauccagcgagucgagaccugggcgcuccgccaccccggcuucacggugauugcuuuauuccuggcgcacgccauugggaccagcauaacccagaagggcaucaucuucauccuccugaugcuaguaaccccauccauggccaugcggugugucggcaucggcucccgcgacuucgucgaggguuugagcggggccacguggguggacgucgugcuggagcacggcagcugcguaacaaccauggccaaggacaagcccaccuuagacaucgagcuacugaagacggaggucaccaaccccgcggugcugcgcaaacucuguaucgaggcuaagauuuccaacacuaccacggacagcagaugccccacccagggagaggcuacauuggucgaggagcaggacgccaacuucgucuguaggcgcaccuucguggaucgggguuggggcaacgggugcggccuguucgggaagggcuccuuauuaacgugugccaaguuuaagugcgugaccaagcuggaggggaagaucguccaguacgagaaccucaaguacagcgugauugugacaguccauacuggcgaccagcaccaagugggcaacgaguccacggagcacgggaccaccgcgaccaucacgccgcaggccccaaccaccgaaauucagcugaccgauuacggcgcucugacccucgacugcagcccacgcacggggcuggacuuuaccgagaugguccuccucaccaugaaggagaaguccuggcugguucacaagcagugguuccuggacuugccgcuucccuggaccuccggagcguccacuucccaggagaccuggaaccggcaggaccugcuugugaccuucaaaacggcacacgcuaaaaagcaggaggucgugguauuggggagccaagagggcgccaugcacacggcgcugacuggcgccaccgagauucaaaccuccgggacgaccaccauauucgcaggccaccucaagugucgccuuaagauggacaagcugacacucaagggaaugagcuaugucauguguacuggcuccuucaagcuggagaaggaaguggcggaaacccagcacgggaccgugcugguccaaaucaaauacgagggcaccgacgcccccugcaagauccccuucucuacgcaagacgagaagggcgugacucagaacggccggcuaaucaccgccaauccuaucgugaccgauaaggagaaaccaguuaacaucgaggccgagccgcccuucggcgaguccuacauugugaucggcgcgggcgagaaggcauuaaagcugucuugguucaagaagggguccagcauugggaaaauguucgaagcgacagcccgcggcgcccggcgaauggcgauccugggggacacugccugggacuucggauccauugggggaguguuuaccucugucggcaagcuuguucaucagaucuuugggaccgccuacggcguauuguucagcggggucagcuggacuaugaagaucggcaucggugugcugcucaccuggcugggccugaauuccaggucaaccagccucucaaugaccugcauugccgugggccuggucacacuauaucucggggugauggugcaggccgacagcgguugcguuauaaacuggaaagggcgggaacucaagugcggcucggggaucuuugucaccaacgagguccacaccuggaccgagcaguacaaguuccaggccgacagcccgaagcgucuguccgcagccaucggcaaagccugggaggagggcgucugcggcauccggagcgccacccgccuggagaacaucauguggaagcagaucuccaaugagcuuaaccauauccugcucgaaaaugauaugaagcuaacggugguggucggcgacguagcgggcauucuggcccagggcaagaagaugauccggccccagcccauggagcacaaguacagcuggaagaacugggggaaagcuaagaucaucggggccgauguacaaaacuccaccuucauaaucgacggcccgaacaccccggagugcagcgaugaccagcgcgcauggaacauuugggaggucgaggacuauggcuucggcaucuucaccacaaacaucuggcuuaaguugcgggacuccuauacccaggugugugaccaccgcuuaaugucggccgccaucaaggacuccaaggccgugcacgccgacauggguuauuggaucgaaagcgagaagaaugaaacauggaagcucgcgcgcgcguccuucaucgaggucaagaccugcaucuggcccaaaagccacacccugugguccaacggcgugcuggagagcgagaugaucauccccaagaucuacggcgggcccaucucccaacacaauuaccgccccggcuauuucacccagaccgcggggcccuggcaccucgguaagcuggagcuggauuuugaccucugcgaggggaccacgguggucgucgacgagcacuguggcaaccggggccccucguugcgcaccaccaccgugacaggaaagaucauucacgaguggugcugcagaucaugcacccugccgccccuccgcuuccggggcgaggacgguugcugguauggcauggagauccgucccgucaaggagaaggaggagaaccuggugaaauccauggugagcgccggguccggcgaagucgacagcuucucccugggccuccuuugcauuagcauuaugaucgaggagguuaugcggucccgcuggagccggaagaugcugaugacggggacccucgccguguucuuccugcugaucaugggccagcucacauggaacgaccucauccgccugugcaucaugguaggggcgaacgccucagaccgcauggguauggggacgacuuaccucgcccugauggccaccuucaagaugcggcccauguucgccgugggccuucuguuccgccggcugacgagccgcgagguucugcuccugaccaucggccugucguuggucgccagcguggagcucccgaauucccuagaggagcucggggacggucucgcaauggggaucaugauccugaagcucuuaaucgacuuccagagccaccaguuaugggccacgcuccuuaguaugaccuucauaaagacgaccuucucacugcacuacgcguggaaaacuauggcuauggucuuauccauugugagcuuauucccccugugccucuccaccacaagccagaagaccaccuggcugcccgugcuccucggcucccugggcugcaagccccuaacuauguucuuaaucgccgagaacaagaucugggggcgcaagucauggccguugaacgagggcaucauggccguugggaucgugucgauuuuacuauccagccugcugaagaaugacgugccgcucgccggcccccugaucgccgggggcaugcugaucgcgugcuacgucaucaguggcucuuccgccgaccucagcuuggaaaaggccgcggagguguccugggaggaggaggccgagcacucuggggcaucacacaacauacugguggaggugcaagacgauggcacuaugaaaaucaaggacgaggagcgagacgacacgcucaccauacugcucaaggcaacccuccuggccgugagcgggguguacccccuaagcaucccggcuacgcucuucgucugguauuucuggcagaagaaaaaacagcggagcggugugcugugggacacgccuagcccccccaaaguugaacgcgccguccuggacgacgggaucuaucggauaaugcagcgcggcuugcucggccgaagccaggugggagugggcgucuuccaggagaacguuuuccauaccauguggcaugugacccgcggcgcuguccugauguaccagggcaagcgguuagagcccuccugggcuucggugaagaaggaucucaucuccuacgggggaggcuggcgguugcaagggagcuggaauacaggugaggagguucaggucauugcaguggagccugggaagaaccccaagaaugugcaaacagccccgggcaccuucaagacccccgagggggagguuggcgccaucgcgcuugacuucaagccuggcaccuccgggucgcccauugugaaccgggaggguaagaucguuggucucuacggcaacggcgucgugacgaccagcggcaccuacguguccgcuaucgcccaggcaaaggcuagccaggagggcccgcugccggagaucgaggacgaggucuuccgcaaacggaaccugacuaucauggaccuccacccugggucugguaagacucgccgguaccugcccgccaucgugcgcgaggccaucaagcggaagaugcgcacccugauuuuggccccgacacgcguggucgccagcgagauggcggaagcccugaaggggaugcccauccgguaccaaaccacggccgugaaauccgagcacaccgguaaggagauuguggaccugaugugccaugcaacuuucaccaugcgccuucugagccccguccgggugcccaacuacaacaugaucaucauggacgaggcccacuucacggaucccuccagcauagccgcacggggcuauaucucaacccggguggggaugggcgaggccgcugccaucuucaugacggcgacgccgcccggaagcguagaggccuucccucaguccaacgccguuauccaggacgaggagcgagauaucccggagcgaaguuggaacuccggcuacgaguggaucacugacuuccccgggaagaccgugugguucguccccagcaucaaggccggcaacgacaucgcgaacugcuugcgcaaaaacggcaagagagugauacaauuaagccgcaagacauucgacaccgaguaccagaagacuaaaaacaacgacugggacuacguggucaccaccgacauuucggagaugggggccaacuuccgagccgaccgcguaauugacccccggcgcugccugaaaccugugauccuuaaggacggaccagagcgggucauccuggccgggccaaugcccguuaccgucgcauccgcagcacagcgccggggccgcaucgggcggaaccacaacaaggagggcgaccaauacaucuauaugggccagccgcugaacaacgacgaggaccacgcgcacuggacggaggccaagaugcugcucgauaacaucaacacccccgaaggaaucauccccgcccuguuugagccggagagggagaaauccgcggccaucgacggugaguaccgccugcgcggggaggcccgcaagaccuucguggaacucaugcggcgcggcgaccugccgguuuggcuguccuauaaggucgcguccgagggguuccaguacagcgaucggagguggugcuucgacggcgagaggaacaaccagguacucgaggaaaacauggacgucgagaucuggacuaaggagggcgagcgcaaaaaguuacggccccgguggcuggacgcccggacguacuccgacccccucgccuugcgcgaguuuaaggaguuugccgcugggcggcgcucggucuccggggaucugauccuagagaucggcaagcugccccagcacuuaacucagcgggcccagaacgcucuugauaaccuggucauguuacauaacagcgagcagggcggccgcgcguaccggcaugccauggaggagcucccugacaccaucgagaccuugaugcugcucgcccucaucgccgugcugaccggcgggguaacccuguucuuccuguccgggaaaggacuggggaagaccucaauaggccuccugugcguaauggcguccucggcccugcucuggauggccuccgucgagccccauuggaucgccgccagcaucauccuggaguucuuccugauggucuuacugauccccgaacccgaccggcagcggaccccgcaggacaaccagcuagccuacguggugauagggcuccuuuucaugauccugaccgucgccgccaacgaaauggggcuccuggagacaaccaaaaaggaccugggcaucggccauguggccguggagaaccaccaccacgcagcgaugcucgacguagaccuccaccccgccucugcauggacccuguaugccguggccaccacgaucaucacccccaugaugcgccacacaaucgagaauaccacggcgaacaucagccucacggcuauugccaaccaggccgcgauauuaaugggccuggacaagggguggccuaucucaaagauggacaucggcguucccuuacuggcgcucggcugcuacagccaagugaacccccuuacgcugaccgccgccguucugauguugguagcccacuacgcgaucauuggucccggccugcaggccaaggccacucgugaggcacagaaacgcaccgccgcgggaaucaugaagaacccgacaaucgacgggaucguggccaucgaccuggaucccgugguguacgacgcgaaguuugagaagcagcucggccagaucaugcugcugaucuuaugcaccucacagaucuugcugaugcgcacgaccugggcccugugcgagucaaucacccuggccaccggcccucugacgacccucugggaggguuccccgggcaaauuuuggaacaccaccaucgccgucagcauggccaacaucuuucggggcuccuaccuggccggggcaggccuggcauucagccucaugaagucccugggcggcgggcggcgggggacuggcgcccagggggagacgcugggcgagaaguggaagcgccagcugaaccaauuauccaagagcgaguucaacaccuacaaacgaagugggaucauggagguugaccggagugaggcgaaggaagggcuaaaacggggcgagaccacaaagcaugccgucucccgcgguacggccaagcuccguugguucgucgagcgcaaccuggugaagccggagggcaaggugaucgauuuaggguguggccggggcggcuggucguacuacugcgcuggucugaaaaaggucaccgaggugaagggguacacuaaaggcgggccuggccacgaggaacccauccccauggccacguacggcuggaaccucgugaagcugcacuccggcaaggacgucuucuuuaucccgccugaaaagugugacacacugcucugugacaucggcgaaagcucccccaaccccaccauagaggagggucgcacccugcgggugcucaaaaugguggagccguggcuccgcggcaaccaguuuugcaucaagaucuuaaaccccuacaugcccucugucguugagacgcuggagcagaugcagcggaaacacggaggcaugcucguacgcaacccgcugucaagaaacagcacccacgagauguacugggucuccugcggcacaggaaacaucgugagcgcggugaacaugaccuccaggaugcugcuaaaccgguucacuauggcccacagaaaaccgacauacgagcgagacguugaccugggcgccggcacccgacauguagcgguggagcccgaggucgcuaaccuggauauaaucggccaacgcauagaaaacauuaagcacgaacacaagagcaccuggcacuacgacgaggacaaucccuacaagacgugggccuaccacgguuccuacgaggugaagccaucuggguccgccucaagcauggugaacggcgucgugaaacuccucacgaagccgugggacgucauucccauggucacccagaucgccaugaccgacacaacaccauucggacagcagcgcguguucaaagagaaggucgacacccgcacacccaaggccaagcgggguacugcucagaucauggaagucacagcucgcuggcuguggagcuuccucucgcggaacaagaagccgcgcaucugcacccgggaggaauuuacccgcaagguuagauccaacgccgcgaucggggccgucuucguugacgagaaccaguggaacagugccaaggaggccguggaggaugaccgcuucugggaccugguccauagagagcgcgagcugcauaagcagggaaagugcgcgaccugugucuacaacaugaugggcaagcgggagaagaaguugggugaguucggcaaagcgaaggguagccgcgcgaucugguacauguggcugggugcccguuuccuggaguucgaggcacucggguucaugaaugaggaucacugguuuagccgcgagaacucccugagcgguguggagggcgaagggcugcacaaguuggguuacauccugcgggauauauccaagauucccgggggcaacauguacgccgacgacacggcagggugggacacgagaauaacagaggacgaccugcagaaugaggccaaaaucaccgacauuauggagcccgaacacgccuuacuggcaaagagcaucuuuaagcuuacuuaccagaacaaggucgugcggguacagaggccugcgaagaacggcaccgucauggacgugauuucgaggagggaccagcgcgguagcggccaggugggcaccuauggucucaacaccuucacgaacauggaggcccagcucauccgacagauggagucagaggaaaucuucagccccaacgagcucgagaccccuaaccucgccgaacgcguccuggacuggcuggagaaguacgguguggaacgucuuaagcgcauggccaucuccggugacgauugcguggugaaacccaucgacgaccgguucgccaccgcccugaccgcccugaacgacauggggaaggugcggaaggacaucccgcagugggagccaucgaaaggauggaacgacuggcagcaggugccguucugcucccaccacuuccaucagcucaucaugaaggauggacgggagaucgucgugcccugccgcaaccaggacgagcuggugggccgggcccgcgucagccagggagccggauggagccuucgggagacugcgugucucggcaaaaguuacgcucagauguggcagcugauguacuuccaccgacgggaucugaggcucgcagcaaacgccaucugcagcgccgugccgguggauuggguccccacuucccgcacuaccuggagcauccacgcgcaccaccaguggaugacgacggaggauauguuaagcguguggaaccgaguguggauagaggagaaccccuggauggaggacaaaacccggguuagcuccugggaagacgugccauaucuugggaagagggaggaucagugguguggaagccucauaggguugacagccagggccacaugggccaccaacauccagguggcgaucaaucagguccggcgccugauuggcaacgagaacuacuccgacuauaugaccucgaugaagcgguucaagaacgaguccgaaccggagggagcgcugugguga

SEQ ID NO: 24656 - RNA, 9879 nt, Artificial Sequence
  derived and/or modified CDS sequence (opt11) from DENV-1__JN054255__SS-prME
agcgugacgaugcugcucaugcugaugcccaccgcucuagcuuuccaucucaccacccggggcggugagccccacaugauugucagcaagcaagagcggggcaagagcuuacuguucaagaccagcgcggggguaaacauguguacacucaucgcgauggauuugggcgagcugugugaggacaccaugaccuacaagugcccccgcaucaccgaggccgaacccgacgacguggauugcuggugcaacgcuaccgacaccugggucaccuacgggacuuguagccaaaccggcgagcaccggagggacaagcggucugucgcucucgcgccccacguggggcuuggucuggagacgagaaccgagaccuggaugagcagugagggugccuggaaacagauacagcgggucgagaccugggccuuacgccaccccggguucacuguaaucgcccuauuccucgcacacgcgaucggcaccagcaucacucagaaggggaucaucuucauccuccugaugcugguaacccccuccauggcuaugcguugcgucggcaucggcagccgcgacuucguggagggccucagcggcgccacguggguggacguuguccuagagcacgguagcugcgugacaaccauggccaaggacaagccaacacuggacaucgagcuccugaagacggaggucacuaaucccgcggugcugaggaaacucugcauugaggcuaaaaucuccaauacgaccaccgacagccgcugcccgacccagggcgaggccacacugguggaggagcaggacgccaacuucgucugccgacgcaccuucguugaccgggggugggggaacgguugcggguuauuuggaaagggaucccuccugacgugugccaaguucaaguguguuaccaagcuggagggcaagaucguccaguacgagaaccucaaguauagcgugauugugacgguucauacaggcgaccagcaccaaguggggaacgaauccaccgaacacgguaccaccgcgacgaucacaccccaggccccuacgaccgagauacaacugacugacuauggggcccuuacccucgacugcagcccccgcacgggccuggacuucaacgagaugguccugcucaccaugaaggagaagaguuggcugguccacaagcagugguuccuggaucucccucuccccuggaccagcggcgccucuacuucacaggaaacguggaauagacaggaucugcucguaacuuucaagaccgcccacgcgaagaaacaggaggucguggugcugggcagccaggaaggggccaugcacaccgcccugacgggggcaaccgagauccagauguccggcacuaccacgaucuucgcugggcaucucaagugcaggcugaagauggacaagcucacccucaagggcauguccuauguaaugugcacggguuccuucaagcuggagaaggaaguggcggagacgcaacacgggacaguucuuguccagaucaaguacgagggcaccgaugccccaugcaagauccccuucagcacccaggacgaaaagggggucacccagaacggcagacugaucacggccaacccaaucgucaccgacaaggagaagcccgucaauaucgaggccgaaccgcccuuuggcgagaguuacaucgugaucggcgcgggcgagaaggcgcuaaagcugagcugguucaagaagggauccucuauaggcaaaauguucgaagccaccgcccgcggggcccgucguauggcgauccugggcgacacagccugggauuuuggauccauuggcggcguuuucacaucaguugggaaacucgugcaccaaaucuucggcaccgccuacgggguauuauucuccggcguaucuuggacaaugaagaucgggauaggcgugcugcucacgugguugggccugaacucccgcucgacgucccucagcaugaccugcauagcaguagggcuggucaccuuguacuugggcgugauggugcaggccgacuccgggugcgucaucaacuggaaaggccgggagcugaagugugggucggguaucuucgucaccaacgaggugcacacguggacggagcaauacaaguuucaggcggacagcccgaagcgccugucagccgccaucggcaaggcaugggaggaaggcgucuguggcauacgaagugcaacacgccucgagaauaucauguggaaacagaucuccaaugagcugaaccacauacugcucgagaacgacaugaaauucacugugguggugggggacguagcgggcauacuggcccaggggaagaagaugauccggccgcagccuauggagcacaaauacagcuggaagaacugggguaaagccaagaucauaggcgccgacguucagaauaguaccuuuaucaucgaugggcccaacacuccggagugcagcgaugaccagagagccuggaacauaugggaggucgaggacuauggcuucgggauauucaccacaaacaucuggcugaagcuccgggacucguacacccagguaugcgaccaccgucugaugucugcagccaucaaggacuccaaggccgugcacgcggacaugggauacuggaucgagucggagaagaacgagacuuggaagcuggcgcgggcuuccuucaucgaggucaaaaccuguauauggccaaagagccacacccucugguccaacggggugcuggagagcgagaugaucauccccaagaucuacggcggcccuaucucccagcacaacuauaggccggguuacuuuacucagacggccgguccauggcaccuggggaagcucgaguuggauuucgaucugugugagggcacaacugucgucguggacgagcacugcgggaaccgggggcccagcuuacgcacgacuaccgugacggguaagaucauccacgagugguguugcagguccugcaccuugccgccccugcguuuccgcggggaggacggcugcugguacgggauggagauccgacccgucaaggagaaggaagagaaccucgucaagagcaugguguccgccggaagcggcgagguggacaguuuuucccuggggcugcuaugcaucagcaucaugaucgaggaggugaugcggucccguuggagccguaagaugcugaugacggguacacuggccguguuuuuccucuuaaucaugggccaacuuaccuggaacgaccucauccgcuuauguauaauggucggugcgaacgccuccgacaggaugggaaugggcaccacguaccuggcccucauggccaccuucaaaaugcguccgauguucgcaguagggcugcuuuuccgccggcuuaccagccgcgaggugcuauuacugaccauaggucuauccuugguugcguccguggagcucccgaacucccuggaggagcugggagacggccuggcaaugggcaucaugauccugaaacugcucacggauuuccagagccaucagcugugggcaacccucuuauccaugaccuucaucaagaccacguucagccugcauuacgccuggaagaccauggcgaugguccuguccaucgugucguuauuuccccugugcuuaaguaccaccagccagaagacuaccuggcucccgguucugcugggcucccuuggauguaagccccugaccauguuccugaucgccgagaacaagaucuggggccggaaguccuggccgcucaacgaggguauaauggcagucggcauugugagcauccugcugucuagcuuacugaagaacgacgugccucuggcggggccccucauagccggcggcaugcugaucgcaugcuacguuaucucagggucauccgcagaccugagucuugagaaggccgcugaggucuccugggaagaggaggccgagcacucuggcgcgucccauaauaucuugguagagguacaagaugaugggaccaugaaaaucaaggacgaggaacgcgaugacacacucaccauccuccugaaggccacccugcuagccgugagcgguguguauccccuguccaucccggccacccuauucgucugguacuucuggcaaaagaagaaacagcggagcggugugcucugggacacccccagcccgccaaaaguagagaaagccguccuggacgauggcauuuacagaaucaugcagcggggccuacuggggcgaucccaagugggagugggaguguuccaggagaacgucuuucacacgauguggcacgucacccgaggugccguccucauguaccaagggaagcgccuggagccuuccugggccagcgugaagaaggaccugaucucguacggcgggggauggcgucuccaagggucauggaacaccggggaagaggugcaggucaucgcgguagagcccggcaagaaucccaagaacgugcagacugcacccgggacguucaagacaccugagggcgaaguaggcgccauagcucuggauuucaagcccgggacaagugguagccccauugugaaccgggaggggaaaaucguaggccuguauggcaacgggguuguuaccacuucggguaccuacguguccgguaucgcucaggcgaaggccucacaggagggcccccucccggagaucgaggaugaaguguuccggaagcgaaaccugacaauuauggaccugcaccccggguccgggaagacccggcguuaccuccccgccaucgugagggaggccaucaagcggaagaugcggacgcugauucuggccccgacccgugugguggccagcgagauggccgaggcgcuuaagggcaugccuauaagguaccaaacgaccgccguaaaguccgaacauacggguaaggagaucguggauuugaugugucaugccaccuuuacgaugcggcugcucuccccaguacgugugccaaacuauaacaugauuaucauggacgaggcccacuucaccgacccguccucaaucgccgcgcggggcuauaucuccacgcgcgucgggaugggcgaggccgccgccaucuucaugacggccacgccgccagggagcguggaagccuucccucaguccaacgccgugauccaggacgaggagcgggauaucccagagagaagcuggaacuccggcuaugaauggaucacugacuuccccggcaagacugugugguuuguucccagcauuaaggccgggaacgacauagccaacugccugagaaagaacgggaagcgcgugauccaguugucccggaagaccuuugacaccgaguaucagaagacgaagaauaacgacugggacuacguggucacgaccgauaucucggagaugggggcgaacuuccgcgcggaucgugugauugaccccagacggugucucaagccgguuauacugaaggacggcccggagagaguuauuuuggcagggccgaugcccgugaccgucgccuccgccgcacagcggcggggccggaucggccggaaccacaacaaggagggugaucaguacaucuacaugggccagccgcucaacaacgacgaaaaccacgcccacuggaccgaggcuaagaugcugcuggauaacaucaacacgcccgaggggauaauccccgcucuguucgagcccgaacgagagaaaagugccgcaaucgacggcgaguaccgccugcgcggggaggcacggaagaccuuuguggaacucaugcgccggggggacuugccuguguggcuguccuacaagguagccagugagggauuucaguacagcgacagacgauggugcuucgacggggaacggaauaaucaggugcuggaggagaacauggacguggagaucuggacaaaggagggugagcgaaagaagcugcgccccagauggcuggacgcccgcaccuauuccgauccccuggcccucagagaguuuaaggaguucgcggcggggcgccggagcgucuccggugaucugauucucgaaaucgguaagcucccccagcaccugacgcagcgcgcucagaaugcccucgacaacuuagugaugcuacacaacagcgagcaaggcggucgggcguaccgccacgccauggaggagcugccggauaccauagagacauugauguugcuggcgcucaucgccgugcuaacggggggcgucacgcuauucuuuuuauccgggaaaggccugggcaagaccagcauugggcugcucugcgugauggccucuucagcccuguuguggauggccuccguugagccccacuggauagccgcgagcauaauacucgaguucuuccugaugguccugcucaucccagagcccgaucggcagcguacaccgcaggacaaccagcuggccuacguagugaucggccuccucuucaugauccugaccguugcugccaacgagaugggguugcuugagaccacgaaaaaggaccugggaauuggacacguggcuguggagaaccaucaccacgccgcuaugcuugacaucgaccuacaccccgcgucggcauggacccucuacgccgucgccaccaccauaauaacacccaugaugaggcauacaaucgagaacacgaccgcuaacauaagccugacggcgaucgccaaccaagccgccaucuugaugggcuuggacaagggcuggccgauuucgaaaauggacauugguguuccccugcucgcccugggcugcuauagccagguaaauccccugacccucaccgccgcaguucugaugcuuguugcccacuaugcuaucaucggacccggcuuacaggccaaggcuacucgcgaggcccaaaagcggaccgcugcugggaucaugaaaaacccuaccauugacggaaucguugcaaucgaccuugacccgguggucuacgaugccaaguuugagaaacaacugggccagaucaugcugcugauccugugcaccucccaaauccugcugaugcgcacuacaugggcccugugugagucgaucacccucgccaccgggccccugacuacgcugugggagggcagcccagggaaguucuggaacaccaccauagcgguaagcauggcgaacaucuucaggggguccuaccucgcgggggcuggacuagccuuuucacugaugaagucccucggcgggggacggcgcgggaccggugcccagggugagacacugggugagaaguggaaacggcaacugaaccagcucuccaagagcgaguuuaacaccuacaagcgcuccggaauaauggagguggaccguagcgaggccaaggagggguugaagcgcggcgagacuaccaagcacgcuguuuccagagggacagccaaacugcgcugguucguugagaggaaccucgucaaaccugaggggaaggugaucgaccugggcugcgggcgcggcgggugguccuacuacugcgccggccuaaagaaggugaccgagguuaagggauacacuaaggggggccccgggcacgaggagccgaucccuauggcgaccuacggcuggaaucuagugaagcuccacucugggaaggacguguuuuuuaucccgcccgagaagugcgacacgcugcugugcgacauaggcgagagcucaccaaaucccaccaucgaggaggggcgaacguugcgcguccugaagaugguagagccauggcugcggggaaaccaguuuugcaucaaaauccuaaacccuuacaugcccagcguagucgagacacuggagcagaugcagcgcaagcacggcgggaugcucgugcggaacccgcucucccgcaacucaacgcacgagauguacuggguguccugcggaaccgggaacauugucagcgcaguaaacaugaccuccagaauguuacugaaucgcuucacaauggcccaccgcaaaccuacguacgaaagggacguugaccucggcgcaggcacgcgacacguagcgguggaacccgagguggcgaaccuggacaucaucggccaacgcaucgagaacauaaaacaugagcacaagagcaccuggcauuaugacgaggacaaucccuauaagaccugggcauaccacggguccuacgagguaaagcccagcgggagugcgagcagcauggugaacggcaugguaaagcuauuaaccaaaccuugggacguuaucccgauggugacccagaucgccaugaccgacaccacccccuucgggcagcagcgcgucuucaaggagaagguggacacgcggacccccaaggccaagcgcgggacggcgcagaucauggaggugaccgccagguggcuguggagcuuuuugagccgcaacaagaagccgcggauuugcacgcgcgaagaguucacccggaaaguccgguccaacgccgcgaucggcgcgguguucguggacgagaaccaguggaauagcgccaaggaagccgucgaagacgaucgcuucugggacuuggugcacagggagcgggaguuacacaagcaaggaaagugcgcgacuugcguguacaauaugauggggaagcgggagaaaaaacugggcgaguucggcaaggccaaaggguccagagcgauaugguacauguggcucggcgccagguuccuugaguucgaggcacuugguuucaugaacgaggaucacugguucagccgggagaauucccucucaggggucgagggugaggggcugcacaagcugggcuacauccuccgcgacauaucuaagauaccggguggcaacauguacgcugacgacacagcgggcugggauacacggaucaccgaggacgaccugcagaacgaggcgaagaucaccgacaucauggagcccgagcacgcccuguuggccaaguccaucuucaaacugaccuaccagaacaagguuguacgcguccagaggccgucuaaaaacgggacagugauggacguuaucagcagacgcgaccagcgggguuccggccaggucggcaccuauggcuugaacaccuuuaccaacauggaagcccagcuaauccgccagauggagagcgaggagaucuucucccccaacgagcuggagacaccaaaucuugcaaagcggguguuagacuggcucgagaaguacgggguggaacggcugaaacggauggcgaucagcggagacgacugugucgugaagccgaucgacgaccgcuucgccaccgcccucacagcccugaacgacauggggaaggugcggaaggacaucccgcagugggaacccuccaaaggauggaacgauuggcagcaaguucccuucugcagccaucacuuucaccaacugaucaugaaggacggccgcgagaucgucguccccugccgaaaucaggaugagcuugugggucgugcccgggugagccagggcgcggguuggagccugcgugagaccgccugccugggcaagagcuacgcgcaaauguggcagcucauguacuuucaccggcgugaccugcggcuugcagcgaacgccaucugcuccgccgugccggucgacugggugcccacaagccgaaccaccuggucuauccacgcccaccaccaauggaugaccacggaggacaugcucagcguguggaacagagucuggaucgaggagaaccccuggauggaggacaaaacccgcguguccagcugggaggacgugcccuaccuggguaagcgcgaagaccagugguguggcagcuuaaucgggcucaccgcucgcgcgacgugggccacgaacauacaagucgccaucaaccaggugcgccggcugaucgggaacgagaacuacagcgacuacaugaccuccaugaagcgcuucaagaacgagagcgagccggagggcgcccugugguaa

SEQ ID NO: 24657 - RNA, 9879 nt, Artificial Sequence
  derived and/or modified CDS sequence (opt11) from DENV-1__KP406801__SS-prME
agcgugaccauguugcucaugcugcugccaaccgcccucgccuuccaccugaccacucgcggcggugagccccacaugaucgucagcaagcaggagcggggcaagagucuucuguuuaagacguccgcgggggugaacaugugcacccugaucgccauggaccugggcgaacucugcgaggacaccaugaccuacaagugcccccgcaucaccgaggcugaacccgacgacguggacugcuggugcaacgccaccgacacgugggugaccuacgggaccugcagccagaccggcgagcaccggcgcgacaagcgauccguggcccuggcgccccacgugggccuggggcucgagacccguaccgagaccuggaugagcuccgagggcgccuggcggcagauccagaaggucgagaccugggcccugaggcacccugguuucacugugaucgcucuguuccucgcgcacaccaucgguaccagcaucacccagaaggggaucauauucauucugcugaugcucguuacgcccuccauggcgaugcggugcgucggcaucggcaaccgugauuucguggagggacugagcggcgccaccuggguagauguaguccuggagcacggguccugugugaccacaauggcaaagaacaagcccacacucgacaucgagcugcugaagaccgaggucacuaaccccgccguccuccggaaacugugcaucgaggccaaaaucagcaacacuacgaccgacucccgcugcccuacccagggcgaggcaacccugguugaggagcaggacgccaacuucgucugccggcgaacguucguggaccggggcugggggaauggaugcggacucuucggcaaggggagccuucugaccugcgccaaguucaagugcgugaccaagcucgagggcaagaucguccaguacgagaaccucaaguacuccgugaucgugaccguccacacgggcgaccagcaucaggugggcaaugagaccaccgagcauggcacgaucgccaccaucacgccccaggcgcccaccagcgaaauccagcugaccgauuacggggcccucacgcuggacuguagcccccggacgggucuggacuucaacgagaugguccuccuuaccaugaaggaaaaguccugguuagugcacaagcagugguuccucgacuuaccgcugcccuggaccuccggugccaguaccagccaggagacguggaaucgccaggaccuccuggugaccuucaagaccgcccacgccaagaagcaggaggucguggugcugggcucccaggagggcgcgaugcacaccgcccucgccggggccacggaaauccagaugagcggcaccaccaccaucuucgccggacaccugaagugccgccugaagauggacaagcucacgcugaagggcgucagcuacgugaugugcaccgggagcuuuaagcuggagaaggagguggcggaaacccagcacggcaccguccugguccaggugaaguaugagggaacggacgcacccugcaaaaucccuuucuccauccaggacgaaaagggcgucacccagaacggccggcucaucaccgccaacccgaucgccaccgacaaggagaagcccgugaacauagagacggagccgcccuucggggagagcuauaucgugauaggcgcgggagagaaggcccugaagcucuccugguucaaaaaggggucaucuaucggcaagauguucgaggcaacggcgcggggggcccggcgcauggcgauccucggcgacaccgccugggacuuuggguccaucggcggcgucuucacguccguggggaagcugguccaccaggucuucggcacggccuacggaguacuguucucaggcguauccuggaccaugaagaucgggauaggcauccuccugaccuggcuggggcucaacagccgcuccaccucgcugucgaugacgugcaucgcaguagggauggucacccuguaccucggcgugaugguccaggccgacagcggaugcgugaucaauuggaagggccgggaacugaagugcggguccggcauauucguuaccaacgagguacacaccuggacggagcaauacaaguuccaggcggacagcccgaagcgucugucggccgccaucgguaaagccugggaggagggggugugcgguaucagauccgccaccagacucgaaaacaucauguggaagcagaucuccaacgagcuaaaccacauccugcuagagaaugacaugaaguucaccguggucgugggggacgcgaacggcauccugacccaagggaagaagaugauccggccccagccuauggagcacaaguacuccuggaaauccuggggcaaggcgaagaucaucggcgcggacacccagaacacgaccuucaucaucgacggccccgacaccccggagugccccgacgaccagcgcgcuuggaacauaugggagguggaagacuacggcuucgggaucuuuaccacgaacaucuggcugaagcucagagacuccuauacccagaugugcgaccaccgccugaugagcgcggccaucaaggacuccaaggccguccacgccgacaugggcuacuggaucgagagcgagaagaacgagaccuggaaacuggcccgggcguccuucaucgaagugaagaccugcaucuggcccagaagccacacucucuggucaaacggcgugcuggagagugagaugaucauccccaagauauacgggggcccgaucucccagcacaacuaccggcccggauacuucacccagacugccggccccuggcacuugggcaagcucgagcuggacuucgaccugugcgagggcaccacggucgugguagacgagcacugcggcaaccgcgggccgagccuccguaccaccacagucacgggcaagaucauccacgaguggugcugccgauccugcacccugccgccccugcgguucaagggggaggacggcugcugguacgggauggagauccgccccguaaaagagaaggaggagaaucucgugcggucaaugguuagugccggaaguggcgagguggacagcuucucucugggguugcucugugugagcaucaugaucgaggaggucaugcgcucccgguggagccgcaagauguugaugaccggcaccuuggcgguguucuuccuccugaucauggggcagcuuacguggaacgaccuaauccgacugugcaucauggugggcgccaacguuuccgaccgcauggggaugggcaccacauaccuggcgcucauggccaccuucaagaugcguccaauguucgccgucggccugcuguuuaggcgccucacgagccgggaggugcugcugcucaccauugggcugucccugguagcgagcguggagcuccccaacucccuggaggagcugggcgacgggcucgccaugggcaucaugaugcuaaaacugcucacggacuuccagagccaucaacuguggaccacgcugcucucccugacauucaucaagacgacccugagccucgacuaugcguggaagacgaucgccaugguccuguccaucgugagccuguucccucucugccuguccaccaccagccagaagaccacguggcugcccgugcugcugggcucuuucggguguaagccgcugaccauguuccuuaucaccgagaacaagauuuggggccgcagaagcuggccccugaacgaagggaucauggccgucggcaucgugucuauccuucucucuagcuuacugaagaacgacgugccccucgccgggccacugaucgcgggcggcaugcuaaucgccugcuacgucaucuccgggagcuccgccgaccucagccuggagaaagccgccgagguguccugggaggaggaggcggagcacagcggugccucccacaacauccugguggagguccaggacgacgggaccaugaaaaucaaagacgaggagcgcgaugacacccucaccauccugcugaaggcgacccuccucgccgugagcggcguguacccgauguccaucccugcaacccuguucgugugguacuuuuggcagaagaagaagcagcggagcggggugcucugggacaccccuagcccgcccgagguggagcgugcgguccuggacgacggcaucuacaggaucuugcaacgcggcuuacucgggcggagccaggugggcgugggggucuuccaggacggcguguuccacacgauguggcacgugacccgcggggccguccugauguaccagggcaagcggcuggagcccuccugggccagugugaagaaggaccucaucagcuauggagggggguggcgguuccaggggucguggaacaccggcgaggaagugcaggucaucgccguugagcccgggaagaaccccaagaacgugcagaccacgcccggcaccuuuaagaccccggagggcgaagugggggccaucgcgcuugauuucaagcccggaaccuccgggagccccaucgugaaccgggagggcaagaucgugggccuguacgggaacggcgucgugacgaccaguggaacauacguaagcgccauagcccaggccaaagcaagccaggagggcccgcuccccgaaaucgaggacgaggucuucaagaagcgcaacuugaccaucauggacuuacaccccggguccggcaaaacacggcgcuaccuccccgcgaucgugcgggaggccaucaagaggaagcuacgcacccugauccuugcgcccacccgggucgucgccuccgagauggcggaggcccugaagggcaugcccauccgcuaccagaccacggccguuaaguccgaacacaccgggcgggagaucguggaccugaugugccacgccacauuuaccaugcgccuccucagccccguccgggugccuaacuacaacaugauaaucauggaugaggcccauuucaccgaccccgcgucuaucgccgcccgcggcuacaucuccacucgggucgggaugggugaggccgccgcgaucuucaugacagccacgccgcccggguccgucgaggcguucccgcaguccaacgccgugauucaggacgaggagcgcgacauccccgagcgcuccuggaauagcggcuacgacuggaucacggacuuccccggcaagaccgugugguuuguccccucgaucaagucagggaacgacaucgccaacugcuuacgcaagaacggcaagcgggugauucaacucucccgcaagaccuucgacaccgaguaucagaagacgaagaacaacgacugggacuacguugucaccaccgacaucagcgagaugggagcgaacuuucgggccgaccgcgucaucgacccgcggcgaugccugaagcccgugauccugaaggacggcccggagagagugauccucgccgggcccaugccggugaccguggccuccgcggcccagcgccggggccguaucggccgcaaccagaacaaggagggggaccaguacaucuacaugggacagccccugaacaacgacgaggaucacgcccauuggacggaggccaagaugcugcuagacaauaucaacacccccgaggggaucauucccgcacuguucgagccggagcgggagaaauccgcugccaucgauggggaguaccgccugcgcggggaggccaggaagaccuucguagaguuaaugcggcgcggcgaccugcccgugugguuguccuacaaggucgcaagugagggcuuccaguacucggaccggcgcuggugcuucgacggggaaagaaacaaccaggugcucgaggaaaacauggacgucgagaucuggaccaaggagggcgaacguaaaaagcugcggccccgguggcuggacgcucggacguacagcgacccccucgcgcugcgcgaguucaaggaauucgccgccgggcggcgcagcguauccggcgaccugauccuggaaaucggcaaguuaccgcagcaccugacucuacgggcccagaaugcccuggacaaccuggugauguuacacaacagcgagcagggcgggaaagcguaccgccacgcuauggaggagcugcccgacaccaucgagacccugaugcuccuggcgcugaucgccgugcucacugggggcgucacgcuguucuuucuguccgggaagggccucggcaaaacaagcaucggccuguuguguguuauggcguccagcgugcuccuguggauggcuucugucgagccacacuggaucgccgccagcaucauccuggaguucuuucucaugguucuguuaauccccgagccggaccggcagcgcacgccccaggacaaccagcucgccuacguggucaucggccugcuguucaugauccucacaguggcugccaacgagaugggguuacuggagacuaccaagaaggaccucgguaucgggcacguggucgccgagaaccaccaccacgccaccaugcuggacaucgaccugcaucccgcaucugcguggacccucuacgccguggcaacuaccaucaucacccccaugaugcggcacaccaucgagaauacgaccgccaauaucagccugaccgccaucgcgaaccaagccgcaauucugaugggccucgacaagggcuggcccaucuccaagauggacauuggcguuccccugcuggcccucggcugcuacucccaggucaacccacugacucugacagccgcgguccucaugcugguagcccacuacgcuaucaucgggccgggccugcaggccaaggcuacccgcgaggcacagaagcgcaccgccgccggaaucaugaagaaccccaccgucgacggcaucguggcgauugaccucgacccaguggucuacgacgcgaaguucgagaaacagcugggccagaucaugcugcucauccugugcacgucccaaauccugcucaugaggaccaccugggcccugugcgagucuaucacccuggccacggguccccucaccacccucugggaggguuccccggggaaguucuggaacaccacuaucgccgugagcauggcaaauauauuccgcggcuccuaccuggcgggcgcgggucucgccuucagccugaugaagucgcucggcggcggccgccgcgggaccggcgcccagggcgagacccucggggagaaguggaagagacagcugaaccagcugucaaagagcgaauucaacaccuacaagcgcuccggcaucauggagguggaccgguccgaggcuaaggaggggcucaagcgcggcgagacgaccaagcacgcggucucccgggggacagccaagcugcgcugguucguggagcggaaucugguucgccccgagggcaaggucaucgaccugggaugcgggagaggaggguggagcuacuacugcgccggccucaagaaagugaccgaggugaagggguacacgaagggcggccccgggcacgaggagcccaucccgauggccaccuacggcuggaaccuggucaagcuguacuccgggaaggacguguucuucacaccgcccgagaagugcgacacccuccugugugacaucggcgaguccucccccaacccgaccaucgaggaggggcgcacgcugcgggugcucaagauggucgagcccuggcugcgcggcaaccaguucugcaucaagauccugaaccccuauaugcccagcguuguggaaacccucgagcagaugcagcggaagcacggcgggaugcugguccgcaacccgcugucccggaacagcacccaugaaauguacuggguguccugcggcaccgggaacauagucagcgcggucaacaugacgucccgcaugcuccugaaucgcuucaccauggcccaccgcaagcccaccuacgagcgcgacgucgaccucggcgccggcacucggcacguugccgucgagcccgagaucgccaacuuggacaucaucgggcagcgcauugagaacaucaagaacgagcacaagagcacguggcacuacgacgaggacaacccuuacaagaccugggcguaccacggcuccuacgaggugaagccgagcgggagcgccagcuccauggugaacggcgugguccggcugcugaccaaacccugggacgucauccccauggugacccagauugcuaugacggacaccacccccuucgggcagcagcgcguguucaaagagaaggucgacaccagaacgccgaggccaaagcggggcaccgcccagaucauggaggugaccgccaaguggcucuggggauuccuuagcagaaauaagaagccccggaucuguacccgcgaggaguucacgcggaaggugcgcagcaacgcggccaucggagccguauucguggacgaaaaccaguggaacuccgccaaggaggccguggaggacgagaaguucugggaccugguccaccgggagcgcgagcuccacaagcagggcaagugcgcgaccugcguuuacaacaugauggggaagcgggagaaaaaacugggcgaguucggaaaagcaaaggggagcagagccaucugguauauguggcugggcgcccgguuccucgaauucgaggcgcuggguuucaugaacgaggaccacugguucucccgcgagaacagccuguccggcguggagggggaaggccuccacaagcugggguacauccugcgggacaucucgaagaucccgggcggcaacauguacgccgacgacaccgccgggugggacacccgcaucacggaggaugaccuacagaacgaggccaagaucaccgacaucauggagcccgagcacgcccugcuggcgaccuccaucuucaagcuaacauaccagaacaaggucgugcgggugcagcggcccgccaagucaggcacggucauggacgugaucucccgccgggaccagcgcgggagcggccaggugggcaccuacgggcugaacaccuucaccaacauggagguccagcugauacgacagauggaguccgagggcaucuucucccccucagagcucgagaacagcaaccuggccgagcgcgugcuggauuggcuugagaagcacgggguggagcggcugaagcgcauggccaucuccggcgacgacugcgucgugaaaccgacugacgacagauucgccacugcgcugaccgcccucaacgauaugggcaagguucgcaaagauaucccccaaugggagccuaguaagggcuggaacgacuggcagcaggucccuuucugcagccaccacuuccaccagcugaucaugaaggacgggcgggagauaguggugccgugccgcaaccaggacgagcuggucgggagagcccgcgugagccagggcgccggguggagccuccgggagaccgccugccuggguaaguccuacgcgcagauguggcagcugauguacuuccaccgcagggaccuccggcuggcagccaacgccaucugcucggccgugccagucgauugggugccuacgucucggaccacuuggagcauccacgcgcaccaccaguggaugaccaccgaggacaugcuguccguguggaaucgcgucuggaucgaggagaacccauggauggaggacaaaacgcacguuagcuccugggaggacguuccguaccuugggaagcgcgaagaccagugguguggcucgcugauuggccugaccgcccgggccacgugggccaccaacauccaggucgccaucaaccagguacgccggcucauagguaacgagaacuaucuggacuacaugacauccaugaagagauucaagaacgagagcgaccccgagggcgcccugugguga

SEQ ID NO: 24658 - RNA, 9879 nt, Artificial Sequence
  derived and/or modified CDS sequence (opt11) from DENV-1__KP406802__SS-prME
ucugugaccaugcugcucaugcugaugcccaccgccuuggcauuucaucucaccacccgcggcggggagccccauaugaucgugagcaagcaggagcggggcaagagcuugcuguucaagaccagcgcgggcaucaauaugugcacccucauagcgauggaccugggcgagcugugcgaggacacacucaccuacaagugcccacgcaucaccgaggccgagcccgacgacguggacugcuggugcaacgcgaccgauaccugggugaccuacgggacgugcagccagacaggcgagcacagacgcgauaaacgcagcguggcucuggcgccgcacguuggccuggggcucgagacccgcaccgaaacuuggaugucguccgagggcgccuggaagcagauacagaggguggagaccugggcacugcgccaccccggguucacggucaucgcccuguuccucgcgcacgcuauaggcaccucgaucacccagaaagggaucaucuuuauccugcugaugcucgugaccccuucuauggccaugagaugugugggcaucgguucccgcgacuucguugaggggcuuuccggggcaacguggguggacgugguuuuagagcaugggagcuguguaaccaccauggccaaagacaagccuacccucgacaucgagcugcugaagacggaagugaccaauccugcggugcuccggaaacuaugcaucgaggccaagauaucgaacacaacgacggacuccaggugcccgacccagggcgaagccaccuuggucgaggaacaggacgccaacuuuguaugccggcgcaccuucgucgaccgcggcugggggaacgggugcggacucuucggcaaggguucucugaucacgugcgcuaaguucaagugcgugaccaagcuggagggcaagaucgugcaguacgaaaaccuuaaguacagcgucauugugaccgugcacaccggcgaccagcaccaggucggaaacgagucgacggagcacggaaccaccgcuaccaucacgccccaggcccccacgacggagauacaguuaaccgacuauggggcccugacauuagacugcagcccccgcacgggccuggacuucaacgaaauggugcuccucaccaugaaggagaagaguuggcucguucacaagcagugguucuuggaccucccccuacccuggaccagcggagccaguaccucccaggaaaucuggaaccggcaggaucugcucgugacguuuaagaccgcccacgcuaagaagcaggagguaguuguguugggcagccaggagggcgccaugcacaccgcccuuaccggggccaccgagauccagaccuccggcaccaccacgauuuucgccggacaccucaagugccgccuuaagauggacaaacuuacccucaagggcaugagcuaugugaugugcaccggaaguuucaagcucgagaaggagguugcggagacccagcacggcacuguauuggugcagaucaaguaugagggcaccgacgcgcccugcaagauccccuuuaguacccaggacgaaaagggggucacccagaacggccgucuaaucaccgccaacccgaucgucaccgacaaggagaagcccguaaacaucgaggccgaaccgcccuucggagaaucuuacaucgucaucggugcgggugagaaggcccuuaagcugagcugguucaagaagggguccagcaucggcaagauguuugaggcgaccgcccgcggggcacguaggauggcaauccugggagacaccgccugggacuucgggucuaucgggggcguguucacgagcgucggaaagcucguccaccagaucuucggcacggccuacgguguucuguucuccggcguuuccuggaccaugaagaucggaaucggcguccugcugacuuggcucgggcugaacucccgcuccacuucccucagcaugacgugcaucgcaguugggcuggucacccuguaccucggcgugauggugcaagccgauuccgguugcgugaucaacuggaaaggccgggagcucaagugcgggagcggcaucuucgucacgaaugaggugcacacguggacggagcaguacaaguuccaggccgacucaccgaagcgccucagugccgccaucggcaaggccugggaggagggggugugcggcauucggagcgccacccggcuugagaauaucauguggaagcagauuuccaaugagcugaaccacauccugcucgagaacgacaugaaauucaccgucguggucggagacgucgcgggcauccuggcucaggggaagaagaugauacggccccagccaauggaacacaaguacuccuggaaguccuggggcaaagccaagaucaucggcgcggacguucaaaacaccaccuuuaucauagacgggcccaacacaccggaaugccccgacgaccagcgugcguggaacaucugggagguggaggacuacggauucggaaucuucaccaccaacaucuggcucaaacuccgggacagcuauacccaggugugcgaccacaggcugaugucugccgccaucaaagacagcaaggccgugcacgccgauaugggcuauuggauugagucggagaagaaugagacguggaagcuggcgcgggccagcuucaucgaggugaagaccugcaucuggccgaagucccauacgcucuggagcaacggaguccuggaguccgagaugauuauaccuaagaucuacgggggcccaaucagccagcacaacuaccggccugguuacuuuacccagacagccggcccuuggcaccuggggaagcucgagcucgacuuugaccuaugugagggcaccaccgugguggucgacgagcacugcggcaaccgcgggccgucccuccgcacgaccaccguaaccggaaagaucauacacgaguggugcugccgaagcugcacacugccucccuugcgcuuccgcggggaggacggaugcugguacgggauggagauccgccccgugaaggagaaagaggagaaccucgucaaauccauggugagcgccggcagcggcgagguggacaguuuuagccuagggcugcucugcauaagcauaaugaucgaggagguaaugcggagcagauggucccggaaaaugcugaugacuggcacccuggcagucuucuuucuucugaucauggggcagcugaccuggaacgaccucauccgucugugcaucauggugggggcuaaugcaagcgaucgcauggggauggggacgaccuaccucgcccugauggccaccuucaagaugcggccgauguucgccgucggucuguuguucaggcggcuaacuucccgcgagguuuuacugcucacuaucggcuuaagccugguggcguccgucgagcugcccaacagccuggaggagcugggcgacggacucgccaugggcaucaugaucuuaaaguuauugaccgacuuccagucccaccagcuaugggccacgcuguugucgcugaccuucaucaagacgaccuuuucccugcauuacgcauggaagacgauggccauggugcucagcaucguguccuuauucccccucugcuugagcacaacgucacagaaaacaaccuggcuucccgucuugcucgguagcuuggguugcaagccucugaccauguuccuaauugccgagaacaagauuuggggccguaaguccuggccguuaaacgagggaaucauggcgguaggcaucgucagcaucuugcucagcucacuguugaagaacgacgugccccuugccgggccucugaucgccggcggcaugcugaucgcuugcuacgugaucagcggguccucggccgacuugucccuggagaaggccgccgaggucucaugggaagaggaggccgagcacuccggugcuucacauaacauccugguggaggugcaagacgauggcacgaugaagaucaaagacgaggaacgagacgacacacucacaaucuugcugaaggcgacacugcuggcggucuccggcguguacccgcugagcaucccagcaacccucuucgugugguacuucuggcaaaagaaaaagcagcgguccgggguccuuugggacacacccucuccgcccgagguggagagagcgguguuagacgacgguaucuaccggaucaugcagcgcggucugcucggacggagucaagucgguguggggguuuuccaggagaacgucuuccacaccauguggcacguuacccgcggcgcggugcugauguaccaggggaagcggcuggagcccagcugggccuccgugaagaaggaucucaucagcuacggcggcggguggcgccugcagggcuccuggaacacgggggaggaaguacaggugaucgcagucgaacccgguaaaaaccccaagaacgugcagaccgcgcccggaaccuuuaagaccccagagggcgaggugggggccauagcgcuggacuucaagcccgggaccagcggcuccccgaucgucaacagagaggggaagaucguuggccuuuacggcaacggcgugguuacgaccucuggcacguacgugagcgccaucgcccaggccaaggcgucccaggaggggccgcuaccugagaucgaggacgaggucuuccgcaagcggaaccuaacaaucauggacuugcacccaggcagcgggaagacgcgccgguaccugccggccaucgucagggaagccaucaaaagaaaacugcgcacauuaauucuagcccccacccgcgugguugccuccgagauggcggaggcacuaaagggcaugcccauucgguaccaaaccaccgcaguaaagagcgagcacaccggaaaagagaucgucgaccucaugugccacgccaccuucaccaugcgucuguuaucccccgugcgggucccgaacuacaacaugaucaucauggaugaggcccauuucacggaccccagcuccaucgcggcccgcggguacauaagcacucggguuggcaugggggaggccgccgccaucuucaugaccgccacgccgcccggcagcguggaggcauucccgcagagcaacgcuguaauacaggacgaggagcgagacaucccggagcgguccuggaacagcggauacgaguggaucacggacuuccccggcaagaccgugugguucgugcccuccaucaagagcggcaaugacaucgcgaacugcuuacggaaaaacgggaagcgggucauucagcuuucgaggaagaccuucgauaccgaguaccaaaagacgaagaauaaugauugggacuacguggucacuaccgacauaagcgagaugggugcgaacuucagagccgaccgggucaucgacccgcggcgcugccugaagcccgugauccucaaggacggacccgaaagagucauucuagccggccccaugcccgucacugucgccuccgcagcucagcgaaggggacgcgucggccggaaccacaacaaggagggcgaccaguacaucuacauggggcagccccugaauaacgacgaggaccacgcgcacuggacggaggccaaaaugcuucuggacaacauaaacacccccgaaggcaucaucccggcacuguucgaaccggaacgcgagaaauccgccgcgauugacggggaguaccgccuccggggcgaagcaagaaagacuuucgucgaacugaugcguagaggggaucugcccguguggcucucauauaagguugccagcgagggcuuccaguacagcgacaggcguuggugcuucgacggcgagcggaacaaccaggugcuggaggagaacauggacguggaaauauggacaaaggagggggagcgcaagaagcugcggccccgcuggcucgacgcccggacguacuccgacccucuggcucuccgugaauuuaaggaguucgcggcuggacgcagaagcgucucuggggacuuaauucuggagaucggcaaacugccgcagcaccucacccagagagcccagaacgcgcuggacaaccuggugaugcuccacaacagcgagcagggcgggcgggcguaccggcacgcuauggaggagcugcccgacaccauugagacucugaugcuucuugcccugaucgccgugcucaccggcggggucacccuguucuuccugucugggcgcggucuuggcaagacaagcauuggccuccucugcgugauggccucgagcgugcuccuguggauggcguccgucgagccccacuggaucgccgccagcaucauccuggaguucuuccucauggugcugcucaucccggagccggaucggcagcgcacaccgcaggauaaccagcucgccuacguagucaucggauugcuuuucaugauccucaccguggccgcgaacgagaugggccugcuggagacgaccaagaaggaccucgggauaggccacguggcaguagagaaucaucaccaugccgcgaugcuggauguggaccugcaccccgccuccgccuggacccucuacgccguggccaccacgauaaucaccccgaugaugcgccacaccaucgagaacaccacggccaacaucagccugaccgcuauugcgaaccaggccgccauccugauggggcucgauaagggcuggcccaucuccaagauggacaucggcgucccccugcuggcuuuaggaugcuacagccaaguuaacccccugacccucacugcggccgugcucaugcucgucgcccacuacgcgaucauuggcccggggcugcaagccaaggcgacgcgcgaagcacagaagcgaaccgccgccgguauuaugaagaauccaaccguggacgggauuguggcgaucgaccuugaccccguaguuuacgacgcgaaguucgagaaacaacugggccagaucaugcuccucauccucugcacaucucagauccugcucaugcgcacgacgugggcccugugugagagcaucacgcuagcgacuggcccccucacgacccugugggaggggucuccgggaaaguuuuggaacacaacuaucgcggugagcauggccaacaucuuccgcggguccuaccuggcgggggcggggcucgccuucagccugaugaagucauuaggcggcgggagacgugggacgggggcccagggcgagaccuugggggagaaguggaagcggcagcugaaccagcuaucuaagagcgaguucaacaccuacaagcgcuccgggaucauggaggucgaccguagcgaggcgaaggaaggcuuaaagcgcggggagaccacgaagcacgccgugagccggggaaccgcuaagcugcgcugguucguggagcggaaccugguuaaacccgaggggaaagugaucgacuugggcugcgggagagggggcuggagcuacuacugcgcggggcucaagaaggugacagagguuaagggcuacacgaagggcggaccaggccaugaggaacccauccccauggccacguauggcuggaaucugguaaaacugcacuccggcaaggacgucuucuuuauaccgccugagaagugcgacacccuacugugcgacaucggagagucaucccccaacccgaccaucgaggagggccgcacacuacgcgugcucaagaugguugagcccuggcugcgggggaaccaguucuguauaaagauucuuaacccauauaugcccucggugguugagacgcuugagcagaugcagaggaagcacggcggcaugcuggugcguaacccgcugucccgcaauaguacccacgagauguacuggguauccuguggaaccggcaacaucgucagcgcugugaauaugaccuccagaaugcugcugaaucgcuucaccauggcccaccgcaaaccaacauacgaacgugacguggaccugggggccggcacccgucacguggccguggagcccgagguggccaaccucgacauuaucggccagcggauugagaacauaaagcacgagcacaagagcaccuggcacuacgaugaagacaacccauacaaaaccugggcguaccacggguccuaugaggucaagccgucaggcuccgccagcagcauggugaacggggucgucaagcugcugacgaagcccugggaugugauccccauggucacccagaucgccaugaccgacaccacgccauucggccagcaacgcguguucaaggagaagguggacacccggaccccgaaggccaagcgcgggacaacccagaucauggaggucacggcccgguggcuuuggggguuccuuucccgcaacaagaagccucggaucuguacccgcgaagaguucacccggaaggugcgcagcaacgcggccaucggcgcuguguuugucgaugagaaccaguggaacuccgcaaaggaggccguagaggaugagcgguucugggaccuggugcaccgcgagcgggagcuccacaagcaagguaagugcgccacgugcgucuacaacaugaugggcaagcgcgagaagaagcugggggaguucggcaaggccaagggcagccgggccaucugguauauguggcugggcgcgcgauuccucgaguucgaggcgcugggcuucaugaaugaggaccacugguuuuccagagagaacaguuuguccgggguggagggagaggggcuccacaaacuuggcuacaucuuacgggauauuagcaagaucccagggggaaacauguacgccgacgacacagccggcugggacaccaggaucaccgaagacgaccuccagaacgaggccaagauuacagacauuauggagcccgagcacgcccuuuuagccaaggccaucuucaagcugacuuaccagaacaaggucguucgcgugcagcgccccgccaaaaacgggacggucauggaugucauuaguaggcgugaccagcggggcagcggccaaguggggacguacggccugaacacguuuaccaacauggaggcccagcugauccgccagauggagucugagggcaucuuuagccccuccgagcucgagacccccaaccuggccgagcggguccuggacuggcucgagaaguacggcguggagcgcuuaaagagaauggcgaucagcggggacgacugcguaguuaagccgauugacgaucguuucgcaacggcccugacggcccucaacgauaugggcaagguaaggaaggacaucccgcagugggagcccucgaaaggguggaacgauuggcagcagguccccuucugcucccaccacuuccaccaguugaucaugaaagacgggcgcgagauuguggucccgugccgcaaucaggacgagcugguuggucgcgcuagagucucccagggggcuggcuggagccugcgcgagaccgcguguuuaggaaagagcuacgcccagauguggcagcugauguacuuccaccggcgcgaucuccggcuggcggcgaaugcaaucugcuccgccguccccguggacugggugcccacaagccgcaccacgugguccauucaugcccaccaucaguggaugaccaccgaagacaugcuuucggucuggaaucgggucuggaucgaggagaaccccuggauggaggacaagacgcacauuuccagcugggaggacgugccguacuuaggcaaacgcgaggaccaguggugcgggucccugauuggccugacggcccgcgccacaugggccacgaacauccagguggcaaucaaccaggugcgacggcuaauugguaacgaaaacuaccuggacuacaugacgagcaugaagcgguucaagaacgaguccgacccggaaggggcccugugguga

SEQ ID NO: 24659 - RNA, 9879 nt, Artificial Sequence
  derived and/or modified CDS sequence (opt11) from DENV-1__KP406803__SS-prME
ucggugacgaugcugcucaugcugcugccaaccgccuuagccuuccaccugacaacccgaggaggggagccccacaugaucgucaguaagcaggagcgugguaagucucugcuguucaagaccagugccggggucaauaugugcaccuuaaucgccauggaccugggagagcucugcgaagacacuaugacuuauaagugcccccgcauuacugaaacagaacccgaugacguggacugcuggugcaacgccaccgagacuugggugaccuacgggaccugcagccagaccggagagcaccggcgcgacaagcgcuccguggcccucgcgccgcacgucggccuggguuuggaaaccaggaccgagaccuggaugucguccgagggggccuggcggcagauccagaagguggagacgugggcccuacgccaccccgguuucacagugaucgcccuguuccucgcgcaugcgaucggcaccagcaucacgcaaaagggcaucaucuucauccugcugaugcucguuacucccuccauggccaugcggugcgugggcauaggcaaccgagauuucgucgaagggcugagcggcgccacuuggguggaugucguucuugagcacgguuccugcgugaccacgauggccaaggauaaacccacgcuugacaucgagcugcugaagaccgagguuacuaaccccgcagugcuccggaaauugugcaucgaggcgaagauuagcaauaccacgaccgacagucguugucccacccagggggaagcgaccuugguggaggaacaggacacgaacuucgugugcagacgcacuuucgucgacagaggcuggggaaacgguugcggucuguuuggcaaggggagccugaucacgugcgccaaguucaagugugugaccaaacuugaaggcaagauuguccaguacgagaaucuaaaauacucgguaauaguaacaguccacacgggcgaccagcaccagguuggaaacgagacaacggagcacggcaccaccgcuaccaucacuccccaagcccccaccucagagauccaacucacugacuacggggcgcugacccucgacuguagcccccggaccggcuuggauuucaacgaaaugguccugcuuaccaugaaggagaaguccuggcuggugcauaagcagugguuucuggaccucccguugcccuggacgucuggggcuagcaccagccaagagaccuggaaccgccaggauuuacucgugaccuucaaaacggcccaugcgaagaagcaagaagucguagugcugggcucacaggagggcgcgaugcacaccgcccuuaccggggccaccgaaauccagaccucggggacgaccacaaucuuugccgggcacuuaaagugccgccucaaaauggacaagcugacacuaaagggugugagcuaugucaugugcaccgggagcuucaaguuggagaaagaaguggccgaaacccaacauggcacgguccuaguccagguuaaguaugaggguacggacgcuccaugcaagauccccuucuccagccaggaugaaaaaggggucacgcaaaauggccggcuuauuaccgcgaacccgaucgugaccgacaaagaaaagccuguuaacaucgaggccgagcccccauucggggaguccuaccucgucgugggcgccggcgagaaagcccuuaaacuuucgugguuuaagaagggguccucgaucgguaaaauguuugaggcgacagcgcguggggcccggcgcauggcuauccucggcgacaccgccugggauuucggguccaucggcgggguauucacaagcguagguaagcugauucaccagauauucggcaccgccuacggggugcuguucuccggcgugagcuggacgaugaaaaucggaaucggcauucucuuaaccuggcugggccuuaacucccgcagcacaucccugaguaugaccugcauugcugucgguauggugacacuguaucuuggcgugaugguccaggcagacuccgggugcgugaucaacuggaaagguagggagcugaagugcggcagcggcaucuuuguuaccaacgaaguacacacauggacugagcaauacaaguuccaggcggacagcccgaagagacuguccgccgcgaucgggaaggccugggaggaaggggugugcggcauccgaagugcaacccgccuagagaacaucauguggaagcaaaucuccaaugaacugaaccauauccugcucgagaacgacaugaaguuuacgguagucguaggagaugugaacggcauccuggcccaggggaaaaagaugauacggccccagccuauggagcacaaguauagcuggaaaagcugggguaaggcgaaggugauuggggcggacguucagaacaucaccuuuaucaucgacgggcccaacacuccagagugcccugacgaucagcgcgcauggaacauaugggagguggaagacuacgguuucgguauauucaccacgaauaucuggcucaagcugcgggacagcuacacacaggugugcgaccaucgccucaugucagccgcgauuaaggauagcaaggcggugcacgcagacaugggcuauuggaucgagucggagaaaaaugaaacauggaagcugaccagagccagcuucaucgaagugaaaacgugcguuuggccuaaaucucacaccuuguggagcaacggugugcuagaaagugagaugauuauucccaagaucuacggaggaccgaucagccagcacaacuaccgccccggguauuucacacagacggccggacccuggcacuuaggaaaacucgaacuggacuucggccucugugagggcacgaccguggucguggaugagcauugcggcaaucgagggccaucccucagaaccaccaccguuaccgggaagaucauucacgaguggugcugcagaaguugcacacugcccccauuacgcuucaaaggugaggauggguguugguaugguauggagaucaggcccguuaaggagaaagaggaaaaccucgugaaauccaugguaucggcuggcagcggggaggucgacagcuucucacugggccugcugugcauaucuaucaugaucgaggaggucaugcgaagccguuggagucgaaagaugcugaugaccggcacucuggcgguauuccuuuugcugaucauggggcagcucacauggaacgaccucauccggcugugcauuauggucggggcgaaugccagcgacaagaugggcauggguacgaccuaucuugcucugauggccacguuccgaaugcggccuauguucgcggugggucuccucuuccggcgccucaccucccgagagguccuucugcugaccgugggccuaucgcucguggcguccgucgagcugcccaauagucuggaggagcucggcgacggcuuagccaugggcaucaugaugcugaagcucuuaaccgacuuccagucccaucagcuuugggccgcucuguugagccuaaccuucgugaagacgaccuucucacuccauuaugcguggaagaccauggcaaugauucugagcauagucucucuguuuccccucugccugagcacgacgucccagaagaccacuugguugccaguccuccucggcucccugggcugcaagccucucacgauguuuuugauaaccgagaacaagaucuggggacggaaguccuggccccuuaacgaaggaauaauggcuguggggaucguaagcauucuccugagcucgcugcucaaaaaugacgucccgcuggccggcccacugaucgccggcgggaugcuaauugccugcuaugugaucagcggcuccucagccgacuugucccuggaaaaagcggccgaggugagcugggaggaggaggcggaacacuccggugccucacacaacauucuugucgaggugcaagacgauggcacgaugaagaucaaggaugaggagcgggacgacacuuugaccauccugcucaaggcuacgcuccuggccaucucagggguguacccgaugucaauuccugcgacccucuucgucugguauuucuggcagaagaagaagcaacgcuccggcguccuuugggacacccccagcccgcccgaggucgagcgggcgguucuggacgacgggaucuauagaauccuccaaagagggcuucugggaaaaucccaggucggagugggcgucuuccaggagggcguuuuccacaccauguggcaugugacgcgcggagcaguucugauguaccagggcaagcggcucgaaccgucuugggccuccguaaagaaggaccugaucucguacgggggcggguggagauuccaaggcuccuggaacacgggggaggaggugcaggucaucgccguggagcccggcaagaauccgaagaacguccagacggcuccggguaccuucaagacgccagagggggaggucggagcgaucgcccuggauuuuaagcccggaaccagcggcucccccaucgugaaccgggaggguaagauaguugguuuauacggcaauggggucgucacgacaagcgggacguacgugagcgccaucgcgcaagcaaaggcgucccaagagggaccguugcccgagaucgaggacgaggucuuccgcaagaggaacuugacuaucauggauuuacaccccgguucuggaaaaacacgccgguaccugccggccaucgugcgcgaggccauuaaaaggaaacugagaacucucgugcuggccccaacgcgggugguggcgagugaaauggcugaggcccugaaggggauccccauccgcuaccaaaccaccgcugucaaaucugaacacaccggcaaggaaaucgucgaccuuaugugccacgcaaccuucaccaugagguuacuauccccagugcgggugccgaacuacaacaugaucaucauggacgaggcgcacuucaccgaccccgccagcauugccgcgcgcggguacaucucuacgagagucggcaugggugaggcugcggccaucuucaugacggccacgccaccagguaguauggaggcguucccgcaguccaacgcugcgauccaggacgaggagcgggacauccccgagcggagcuggaacuccggcuacgacuggauuacagacuucccggggaagaccgugugguucgugcccucaaucaagucggguaaugacaucgccaauugucuucggaagaacggaaagcgagucguccaguuaucccgcaagacauucgacacagaguaccagaagaccaagaacaacgacugggacuaugugguuaccacggauaucuccgagaugggggccaacuuccgggcagaccgcgugaucgacccgcggcggugcuuaaagccggucaucuuaaaggacgggcccgagagagugauacuggcgggaccgaugccgguuaccguagcgagcgccgcccaacgccggggccggaucgggcggaaccagaauaaggaaggcgaccaguacauuuacaugggacagccccuaaacaacgacgaggaccacgcacacuggaccgaggccaagauguuacuggacaacaucaacacaccugagggcaucauacccgcucuguucgagccggaacgagagaaguccgccgccauagacggggaguaucggcuccguggggaagcacgcaagacguucguggagcuaaugcgacgcggugaccugccgguguggcuaagcuauaagguagcauccgaaggcuuucaguacagcgacaggagauggugcuucgauggcgagcggaacaaccagguccuggaggagaacauggaugucgaaauauggaccaaggagggcgagcggaagaagcugcggcccagauggcucgacgcccguaccuacagcgauccccuggcccuacgcgaguucaaggaauuugcggccgggcggcgcuccgucuccggcgaccuuauccuggagaucgggaagcugccgcagcaccucacccagagggcccagaacgcgcuggacaaccuggucaugcuucacaauuccgagcaaggcgggaaggccuaccgccaugccauggaggagcugcccgacacgauugagacccugaugcuacuugcucucaucgccgugcugaccggcggagucacccuguucuuucucagcggccggggccuuggcaagaccuccaucgggcugcugugcgugauggcauccucagcuuugcucuggauggccagcgucgagccucacuggauagcggccagcaucauauuggaguucuuuuugaugguauugcugaucccagaaccggaccgccagcggacgccccaggacaaccaacucgccuacgucguaaucgggcugcuguucaugauacuaaccgucgccgccaacgagaugggccuucucgaaaccaccaagaaggacuuaggcauuggccacguggcggcagaaagccaccaccacgcggcaaugcuggacgucgaccugcauccugcgucagcguggaccuuauaugccgucgcaaccaccaucaucaccccgaugaugcgccacacgaucgagaacaccaccgccaacaucagccuaaccgccaucgcgaaccaagccgcaauccuuaugggccucgacaagggguggcccauuuccaaaauggacaucggcguaccccugcuugcccucggaugcuacagccagguuaacccgcugacucugaccgcugccguccucaugcugguggcccacuaugccauuaucggcccgggguuacaggcaaaggcgacacgggaggcccaaaagcgcacagccgcaggcaucaugaagaaccccacgguugacgguaucguagccauugaucucgacccggugguguacgacgccaaguucgaaaaacagcuaggucaaauuaugcugcucauccugugcaccucccagaucuuguuaaugcguacgacgugggcccugugcgagucgaucacucucgccacgggcccgcucaccacccuaugggagggaucccccggcaaguucuggaacacgaccaucgcugucagcauggccaacauauuccguggcucuuaccucgcgggcgccggccucgccuuuucguuaaugaaguccuuaggcggcggacgccggggcaccggcgcccagggggagacccucggcgagaaguggaagcgccagcucaaccagcucaguaagagcgaguucaauacuuacaaacguuccggaaucaucgagguggaucguagugaggcgaaggaaggucucaagagaggugaaaccaccaagcaugccgugucgcgcggcaccgcaaaacugcggugguuugucgagagaaaccugguuaagcccgaggggaaggucaucgaccuggggugcggccgcggcggguggagcuacuacugcgcggggcucaaaaaggucacggaagugaagggguauacgaagggcgggccugggcacgaggaacccaucccgauggccaccuacgguuggaaccuggugaagcuguauuccggcaaggacguguucuuuacgccaccugagaagugugauacgcuucugugcgacaucggugaaaguuccccgaauccaacuauagaggaggggcgcacccuucgggugcuccggaugguagagccguggcugcggggcaaccaguuuugcaucaaggucuugaaccccuacaugccuuccguggucgagacccucgagcagaugcagcgcaagcacggcgggaugcugguccgcaauccgcucucacgcaacucgacccacgagauguauuggguguccugcgggaccggcaauaucgugagcgcggucaacaugacuucgcguauguugcugaaccgcuucaccauggcucaccguaaacccaccuacgagcgcgauguggacuugggcgccgggacgcggcauguggcaguagaacccgagguagccaaucucgacaucaucggccaacguaucgagaacaucaagaacgaacacaagagcaccuggcacuacgacgaggacaacccauacaagacuugggcguaucacgggucuuaugaggucaagccaagcggcagcgcauccagcauggugaacggugugguaagacugcugaccaaacccugggacgucauuccaauggugacgcaaauugccaugaccgacaccacccccuuugggcagcagcgggucuucaaggagaagguggacacgcgaacgccgaaagcuaagcggggcacugcgcagaucauggaagugaccgcucgcuggcuauggggguuccugucccggaacaagaagcccaggauaugcacgcgggaagaguucacccggaagguccggagcaacgcugcaauuggggcuguguucguagacgagaaucaauggaacagugcgaaggaagcggucgaggaugagcgcuuuugggaucuggugcaccgcgagcgcgaacuccacaaacaagggaagugcgccacgugcguauacaacaugaugggcaagcgagagaagaagcuaggggaauuuggcaaggccaagggcucccgcgcgaucugguacauguggcugggugcaagauuucucgaguucgaggcccugggauucaugaacgaggaccacugguucucccgcgaaaacucauuaucaggggucgaaggcgagggacuccacaagcucgguuacauccugcgggacauuagcaagauccccggugggaacauguacgcagaugauaccgcuggcugggacacgcgcauaaccgaggacgaccuccagaacgaggccaagaucacggacaucauggagcccgaacaugcacugcuggccacguccaucuucaagcucacguaucaaaauaagguggugcggguucagagacccgccaagaacgggacgguaauggacgugauuucacgucgggaucaacgcggcuccggccaagucggcaccuacggccugaauacuuucaccaacauggaggcccagcugauccgccaaauggagagcgaagggaucuuccuccccuccgagcuggagaccccuaaccuggcugagcgcgugcuugacuggcucgagaaguacggcaucgagcgccugaagcgcauggcgaucagcggggacgauugcguggucaagccaaucgacgaccgcuuugcuaccgcucuaacggcucugaacgauauggggaaggugagaaaggacaucccgcagugggaaccauccaagggcuggaacgacuggcagcagguucccuucugcagucaccauuuccaccagcugauaaugaaggacgggagggagaucguugugccuugccgcaaccaggacgagcucgugggacgggcccggguuucccagggggcgggcuggagccugcgggagacggcuugccuugggaaaucauaugcccaaauguggcagcucauguauuuccaucggcgugaccuaagguuagccgcgaacgcuauuugcucggccguccccgucgacugggucccgaccucucgaaccaccugguccauccacgcccaccaccaguggaugacgacagaggauaugcuaagcguguggaaccgcgucuggaucgaagaaaaccccuggauggaggacaagacccaugucuccucuugggaggacgugccauaccuaggcaagcgggaggaccaguggugcgggucccugaucggccucaccgcccgcgccaccugggccacgaacauccaaguggcuauuaaccaagugcgccggcucauagguaacgagaacuaucuggauuacaugacaagcaugaaacgcuucaagaaugagagugacccugaaggggcccucugguga

SEQ ID NO: 24660 - RNA, 9879 nt, Artificial Sequence
  derived and/or modified CDS sequence (opt11) from DENV-1__KJ438293__SS-prME
ucugugaccauguugcucaugcugaugcccaccgcccuggccuuccaucucacaacuagaggaggugagccacacaugaucgucagcaagcaggagcgcgggaagagucugcuguucaagaccagcgcaggggugaacaugugcacccucaucgccauggacuuaggcgagcugugcgaagauacgaugaccuacaagugcccacggauaaccgaggcugagcccgacgacguugacugcuggugcaacgccaccgacaccuggguuaccuaugggaccuguagccagaccggcgagcaucgaagggacaagcggucuguggccuuggccccgcaugugggccuugggcuggagacccgcaccgaaaccuggaugagcuccgagggggccuggaaacaaauccaacggguugaaacaugggcccuccgucaccccggcuucacggugauugccuuguucuuagcccacgccaucggcacgagcaucacccagaaggguaucauuuucauacuccuaaugcuggugacaccuucgauggccaugaggugcgucggcaucggcucacgcgacuuuguagaggggcuaucgggcgccacguggguggaugucgugcuggagcacgguuccugcgugaccaccauggcuaaggauaaaccaacccuggacauugagcugcuuaaaacugaggucacaaacccagcgauccugagaaagcucugcauagaggccaagaucuccaacaccaccacggacagccgcugucccacgcagggggaggccacacuuguggaggagcaggacgcgaacuucgugugcaggcgcacauucguggacagagguugggggaacggaugcgggcuguucggcaagggguccuugaugacaugcgccaaguucaagugcgugacuaagcuggagggcaagaucguccaguaugagaaccugaaguacagcgucaucgucacugugcauacuggcgaucagcaccaagucggaaacgagaguacggagcacggcaccacggcuacaaucacgccacaggcccccacgacagaaauccaacuaaccgacuacggggcccugacucuggacuguagcccccgaacuggccucgacuucaacgagaugguucugcugacgaugaaggagaaguccuggcucguccacaagcagugguucuuggaucuaccacugcccuggaccagcggugccagcaccucccaggagacuuggaaccggcaggaccugcuggugacuuucaagaccgcccacgcgaagaagcaagagguugucgugcucgguagccaggagggggcuaugcacaccgcccugacaggggccacugagauccagaccucaggcaccacgacaaucuucgcaggucaccucaagugucgccucaagauggacaagcugacccugaagggcaugagcuacgugauguguaccggguccuuuaagcucgaaaaagagguugccgagacgcagcacgggacaguccucguccagaucaaauacgagggcaccgacgcccccugcaagaucccguucagcacccaggaugagaagggggucacgcaaaauggccgacucaucaccgccaacccgaucgugacagacaaggagaagccggugaacaucgaggccgagccgcccuuuggggaauccuacaucgucaucggcgcgggcgagaaggcccuaaaaaucagcugguuuaagaaaggguccuccaucggcaagauguuugaggccaccgcccgcggggcccggcgcauggcgauccugggcgacacggccugggacuucggguccaucggcggcgucuucaccuccguggggaagcugguccaucaaaucuucggcaccgccuacggggugcuauuuucgggagugagcuggacuaugaagauugggaucggcguccucuuaacauggcugggccucaacucccgcagcaccucacugagcaugaccugcaucgcugucggguugguuacccucuauuuaggcgucauggugcaggcugacagugggugugugaucaacuggaagggucgggagcuaaagugcgggagcggaaucuucgugacgaacgaggugcacaccuggaccgagcaguacaaguuccaggcagacucuccgaagcgccucucggcugcgauuggcaaagcgugggaggaaggcgugugcgguauccggagcgccacucgccuggaaaacaucauguggaagcagaucuccaacgagcugaaccacauccuccuagagaacgacaugaaauuuaccgucguggugggcgacgucgcgggcauacuggcccaagggaagaagaugauccggccccagcccauggaguacaaguacagcuggaaguccuggggaaaggcgaagaucauaggagccgacguccagaacacgaccuucauaaucgacgggcccaacaccccggagugcccugacgaccagcgugcguggaacaucugggagguggaagacuacggcuuugguaucuucacgaccaauaucuggcugaagcuuagggacagcuacacccaggugugcgaccaccgacugauguccgcggccaucaaggacucgaaggccgugcaugccgacaugggcuacuggaucgagucugaaaagaaugaaaccuggaagcucgcgcgggccagcuucauugaggugaagacgugcaucuggccgaagucgcacacgcuuuggagcaacggcguccuggagucagagaugaucauucccaagaucuacggcggaccgaucucgcagcauaauuaccgccccggguacuucacccaaaccgccggccccuggcaccucggaaagcuggagcuagacuucgaccucugcgagggcacaacggugguuguugaugagcacugcggcaaccgggggccgucgcugagaacuaccacggugacgggaaaaaucauccacgaguggugcugccgcagcuguacacugccgccccugcgcuuccgcggugaagacggcugcugguacgggauggagaucaggcccgugaaggagaaggaagagaaccuggucaaguccauggugagcgcgggaagcggcgagguugacuccuuuagccuggggcuccugugcaucuccaucaugaucgaggagguaaugcgcagccgcuggucgcggaagaugcugaugaccggcacacucgccguguucuuccuguuaauaaugggacaacucacguggaaugaccuaauacgcuuauguaucauggugggagcgaacgcuagcgaucgcauggggaugggcaccacguaccucgcgcugauggcgacauuuaaaaugcggccgauguucgcuguaggccuccuguucaggagacugacgucacgagaagugcugcuccugacuaucggccugagcuugguggcguccguugagcugcccaacucguuagaggagcucggggacgggcuggccaugggcaucaugauccugaagcuccuaaccggcuuucaaucccaccaguuaugggccacccuccucagccugacauucauaaagacaaccuuuucacuccacuacgccuggaagaccauggcgauggugcugagcaucgucucccuguucccccucugccucagcacgaccucacaaaagaccaccuggcugcccgugcuccugggcagccuggggugcaagccacucacgauguuucugauaacagagaauaaaaucugggggcggaaaucauggcccuuaaacgaggguaucauggccgugggcauugucucuauucuccugagcuccuugcucaagaacgacgugccgcuggccggcccccugaucgcuggcgggaugcucauagccugcuacgucaucucuggcucaucagcggaccugucccuggagaaggccgccgaggucaguugggaggaggaggccgagcacagcggggccagucauaacauccuaguugaggugcaggacgauggcaccaugaagauuaaggacgaggagcgagaugacacuuuaaccauacuucucaaagcgacguuacuggccgucuccgggguguacccacucagcaucccggccacacuguuugugugguacuucuggcagaagaaaaagcagcgguccggcguucugugggacaccccuucaccucccgagguggagcgcgccguucucgacgauggcauauaccgaaucaugcagcgcggccugcugggaaggucccagguuggagugggaguguuucaagagaauguauuucacaccauguggcacgugacgcgcggggcggugcucauguaucagggcaagcggcucgagcccagcugggcaagcgucaagaaggaccugaucagcuacggcgggggauggcgcuugcaaggguccuggaacacuggcgaagagguccaaguaauagcuguggaacccggaaagaacccgaagaacgugcaaaccgcccccggcaccuuuaagacgcccgagggcgaaguaggagcgaucgcccucgacuucaaacccggcaccagcgguucccccaucgucaacagggagggcaagaucguaggccucuacgggaacggcgugguuaccacuagcgguacguacgucagugcgauagcccaggccaaagcuucacaggaagguccgcugcccgagauugaggacgagguguuucggaagaggaaccucaccaucauggaucuacacccugggucagguaaaacccggcgguaccuucccgcaauuguucgggaagccauuaaacgcaagcuccgcacccuuauacucgcccccaccagggugguggcuuccgagauggcggaggcucuuaaggguaugccgauccgguaccaaaccaccgcggucaaaagcgagcacaccgggaaagagaucguugaccucaugugccacgccacguucaccaugcgccugcucucccccgugcgggucccuaacuacaauaugaucaucauggacgaggcccacuuuaccgacccaagcagcaucgcugcgcgcgguuacauaagcacccggguggggaugggcgaggcggccgccaucuuuaugacggcgacaccgcccggcucaguggaggccuuuccccagaguaacgccguaauucaggaugaggaacgcgacauucccgagcgcuccuggaacagcggauacgacuggaucaccgauuuccccggaaagaccgucugguucguaccuaguaucaagagcgggaacgacaucgccaauugccugcggaagaauggcaagcggguuauucagcugucccggaagacauucgacaccgaguaccagaagaccaaaaacaacgauugggauuauguagucacuaccgacaucagcgagaugggggccaauuuucgggcggaccgcgucauagacccgcggcguugccucaagcccgugauccuuaaggacggcccugagcgggugguccuggcagggccaaugccggugaccgucgccuccgccgcgcagcguaggggucgcaucggccgaaaccacaacaaggaaggggaccaguacaucuauaugggccaaccgcucaauaacgacgaggaccacgcgcauuggacagaggccaagaugcugcuggacaacaucaacaccccugaggguaucaucccugcucucuuugagcccgaacgcgaaaagucagcagccaucgauggcgaauaccgcuugcgaggggaggcgcgcaagacguucgucgagcugaugagacgcggcgaccuaccgguguggcucuccuauaagguggccagcgagggcuuucaguacucugaucggagauggugcuucgacggggaacggaacaaccaggugcuggaggagaacauggacguggagaucuggaccaaggagggcgagcgcaagaaauugaggccccgcuggcuggacgcgcggaccuacuccgacccacuggccuugagagaauucaaagaauuugccgcggguagaagaagcguuucaggcgaccucaucuuagaaaucgggaagcuuccgcagcaccugacccagcgugcucaaaacgcccuggacaaccuggugaugcuccacaacucugagcagggggguagggccuaucggcaugcgauggaggagcuacccgauacgaucgagacccucaugcuauuagcucucaucgccgucuugaccgggggagucacacuguucuuccucuccgggcgcggucugggcaaaacgagcaucgggcuauuaugcgugauggccuccagcguccugcuguggauagccuccgucgaaccucacuggauagcggccagcaucauucucgaguucuuccugauggugcugcucauccccgagccugaccggcagcguacgccccaggacaaccagcuggccuacguggucauaggccuccucuuuaugauccuaaccguggcggcaaaugagaugggccugcucgagacgaccaagaaggacuuaggcauuggacauguggcggucgagaaucaccaccaugccgccauccuggacguggaccuccaccccgccucugccuggacgcuguacgcuguggcgaccaccaucaucacccccaugaugcggcauacgaucgaaaacacaaccgccaacauuagucugaccgcuaucgccaaccaggccgccauccugaugggguuggacaagggauggcccauuuccaagauggacaucggggucccccugcucgcucugggcugcuacagccagguuaacccgcugacacucaccgccgcgguacugauguuaguagcacacuacgccaucaucgggccgggccuccaggccaaggcgacacgcgaggcacaaaagcggaccgcggccgggaucaugaagaacccgacgguggacggaaucguggccaucgaccuagacccagucguguacgacgcgaaguuugagaagcagcuuggccaaaucaugcucuugauucuguguaccucccaaauccuccugaugcguaccaccugggcgcugugcgagagcaucacgcuagccaccgggccccucaccacccugugggaggguuccccugggaaguucuggaacacaaccaucgccgugagcauggccaacaucuuucguggcuccuaccucgccggcgcgggccuggcuuuuagccugaugaaaucccucggcggggggcggcgcggaaccggcgcccagggagaaacccugggggagaaguggaagcgacaacugaaucaacucuccaagagcgaguucaauacguauaagagguccggcaucauggaggucgacagaucggaggccaaggagggucuaaagcgcggagaaaccacuaagcacgcggugucgcgggggaccgcaaaacugaggugguucguggagcggaaucucgucaaacccgaggguaaggucaucgaccugggcugcgggcgcgggggguggucuuacuauugcgccggccucaaaaagguaacggaggucaaaggguacaccaagggcggcccuggacaugaggagcccauaccgauggcuacauauggcuggaaccuggugaaacucuacagugggaaggacguuuucuucaucccgcccgaaaagugcgacacacugcugugcgacaucggcgagagcuccccaaacccgacgaucgaggaggggcggacccuccgcguccugaagaugguggagcccugguuacgugggaaucaauucuguaucaagauccucaaucccuacaugcccucuguggucgagacccuggaacagaugcagcgcaagcacggcggaauguuagugcgcaacccuuuaucacgcaauagcacacacgagauguacuggaucaguuguggcaccgggaacaucgucagcgccgucaacaugaccucucggaugcugcugaaucgcuucaccauggcgcaucgaaaacccacauacgagcgagacgucgaccucggcgcaggcacccgccacguggccgucgagcccgagguugcuaaccuggacauuaucgggcagcgaaucgagaacaucaagcacgagcacaagagcaccuggcauuacgaugaggacaacccuuacaagacgugggcauaccacggcuccuacgaggugaagccuucggggucagcaagcagcauggucaacggcguggugaagcugcuuaccaagcccugggaugugauccccauggugacccagauagccaugaccgacaccacaccguucgggcagcagcgcgucuucaaggaaaaggucgacacccggacgccgaaagccaagcgcggcaccgcccaaaucauggaggugaccgcccgaugguuguggggcuuucugucgcgcaacaagaagccccggauuugcacacgggaggaguucacgcggaagguuagaagcaacgcugccaucggggccguauucguugaugagaaccaauggaacuccgccaaagaggcggucgaagacgaacguuucugggaccucgugcaucgcgagcgggaacugcacaaacaggguaagugugcgaccugcguguauaacaugaugggaaagcgcgagaaaaaauugggcgaguuugggaaggcaaaggguagcagagcuaucugguacauguggcucggggcccguuuccuggaguuugaagcgcugggauucaugaacgaggaccauugguucucccgggaaaacagccucuccggaguggagggggagggacuucauaaguuaggguauauucugagggauaucuccaaaauaccaggcgguaacauguacgccgacgacaccgcggguugggacacccggaucacagaggacgaccugcagaacgaggcgaagaucacggacaucauggagccggagcacgcccuacucgcuaaagccauuuucaagcugaccuaucagaacaagguggugcggguucagcgcccugcuaagaacggcaccgugauggaugugauuucccggcgcgaccaacgaggguccggccagguaggcacguacgggcugaacacuuucaccaacauggaggcccagcucauccgucagauggaguccgagggcaucuucagccccuccgagcuggagacccccaaccucgcggagcgggugcucgauuggcuggagaaguacggggucgagcgccugaagcggauggcgaucagcggagacgacugugucguaaagcccaucgacgaucgguucgccacggcguuaacagcgcugaacgacauggggaaggugcggaaggauauaccacagugggagcccucaaagggcuggaacgacuggcagcaaguccccuucugcagccaccauuuccaccaacucaucaugaaggauggucgcgagaucgucguuccaugccgcaaccaagacgagcucgucgggcgagcccgggucagucagggcgcgggcuggagccugcgcgagaccgccugccugggcaagaguuaugcccagauguggcagcugauguauuuccaccggagagaccugcggcuggcagcgaacgcuaucugcuccgccgugccaguggacugggugcccacaagccguacgaccugguccauccacgcccaccaccaguggaugacaacugaggacaugcucagcguuuggaaccggguguggaucgaggagaaccccuggauggaggacaagacgcacaucuccagcugggaggacgugccguaccuggggaagagggaggaccagugguguggcucccugaucggacuuaccgcacgcgcaaccugggccaccaacauccagguggccaucaaccagguucggcgccugaucggcaaugaaaacuaccuugacuacaugaccagcaugaagcgguuuaagaaugagagugaccccgagggugcucucugguga

SEQ ID NO: 24661 - RNA, 9879 nt, Artificial Sequence
  derived and/or modified CDS sequence (opt11) from DENV-1__KJ438296__SS-prME
agcgucaccaugcuucucaugcugaugcccaccgccuuagccuuccaccucacgacccggggcggggaaccgcacaugauggugagcaagcaggagcgaggcaaaagcuuacucuucaagacaucugccggugugaacaugugcacccucauagccauggaucucggcgaguuaugcgaggacaccaugaccuacaagugcccccguaucacagaggcggagcccgaugaugucgacugcugguguaacgccacagacaccugggugaccuacgggacgugcucacagacuggcgagcauagacgcgacaagcgauccguugcccucgcaccccacgugggccucggguuagagacucgaaccgagaccuggaugagcucugagggggccuggaaacagauccagcggguugagaccugggcccuccgccaccccggcuucacggugauagcccuguuccuggcgcaugccaucggcaccucaauaacccagaagggcaucaucuucauccuccugaugcuggugaccccauccauggcgaugcggugcguaggcaucggcagccgcgacuucguggaggggcucuccggugccacuuggguagacgucgugcuggagcaugguagcugcgugacuacaauggccaaagacaagccgacccuggacaucgagcuccugaagacggaggucaccaaccccgcgguacugcggaagcuuugcauugaggccaagaucuccaauaccaccacggauagccgcugcccgacccagggcgaggccacgcugguagaggagcaagacgccaacuuugucugcagacgcacuuucguggaucgggggugggggaauggcugcggguuguucggcaaaggguccuugaucacgugcgcaaaauucaagugcgugacaaagcuggagggaaagaucguucaguaugagaaucugaaguauagcgugaucgugaccguccacacaggggaccagcaccaggugggaaacgaguccacggagcacgggacgaccgcgacuaucacgccccaggcgccaacgacggagauccaacugaccgacuacggggcuuugacccuggacugcuccccucgcacgggcuuagacuucaacgagaugguccugcugaccaugaaggagaaguccugguuggugcacaaacagugguuccuggaucucccccuacccuggacgagcggggccagcaccucccaagagacguggaacaggcaggauuuguuagugacuuuuaagaccgcccacgcgaagaaacaggaagugguuguucucgguagccaggagggcgccaugcauacggcccucaccggagccaccgagauacagaccuccggcaccacgacgaucuucgcugggcaccugaagugcaggcucaagauggacaagcugacucugaagggcaugagcuacgucaugugcacuggcuccuucaagcucgagaaagaaguggcggagacgcagcacgguaccgugcugguacagaucaaguacgaaggcaccgacgccccuugcaagaucccguucaguacucaggacgagaagggugugacacagaacgguagacugaucaccgccaauccgaucgugaccgacaaggaaaagcccguuaauauugaagccgagccgcccuuuggggaguccuacaucguuaucggcgcgggagagaaggccuugaaacucagcugguuuaaaaaggguuccagcaucggcaaaauguucgaggccaccgcccgcggagcgcggcgcauggcgauacucggcgacaccgccugggauuuuggguccaucggcggcgucuucaccucggucggcaagcuggugcaccagauuuucggcacagccuacggggugcuguuuuccggcgucucauggaccaugaagaucgggaucggcgugcugcuuacguggcucggccugaacucccggagcacgucccugucuaugaccugcaucgccguggggcucgugacccuuuaccugggcgugauggugcaggccgacuccgggugcguaauuaacuggaagggccgcgagcucaagugcgggagcggcaucuucguaacgaacgaagugcacacuuggaccgagcaguauaaguuccaggcagacagcccuaagcgccugagugcggccaucgggaaggccugggaggagggggucugcgggauacggagcgccacucgccuggagaacaucauguggaagcagauaucgaacgagcucaaccauauccuccuggagaacgauaugaaguuuaccgugguuguaggggacgucgcgggcaucuuagcccaggggaagaagaugauccggccccagcccauggaguacaaguacagcuggaagucaugggggaaggccaagaucaucggugccgacgugcagaacacgaccuucaucaucgacgggccgaacaccccugaaugcccggacgaucagcgagcguggaacaucugggagguugaggacuacggguucggaauauucaccacgaacaucuggcugaagcugcgggacagcuacacccaagugugcgaccaccgccugauguccgccgcuaucaaggauucaaaggcggugcaugccgacaugggcuacuggaucgaguccgagaagaacgagaccuggaagcuggcgcgggccagcuucaucgaggucaagacuuguaucuggcccaagucccacacgcuguggagcaacggcgugcucgagucggagaugaucauccccaagaucuacgggggcccaaucagccaacacaacuaucggccaggauauuucacacagaccgccggccccuggcaccuggggaagcuggagcucgacuucgaccuuugugagggaaccacgguggucguggacgagcacuguggcaaccgggggccgucccuucgcacgaccaccguaacgggaaaaauaauccacgaguggugcugccggucgugcacgcugcccccccuccgcuuccgcggggaggacggcugcugguacgguauggagauccgccccgucaaagagaaggaggagaaccucgugaaguccauggugagcgcugggagcggugaggucgacuccuucagccucggucuuuuaugcaucuccaucaugaucgaagaggugaugcggagccgcuggucccggaaaaugcuuaugauugggacccuggcgguguucuuccuucucaucauggggcaguuaaccuggaaugaccugauccggcuaugcauuauggucggcgcgaacgcuagcgaucggauggggaugggaacgaccuaccuagcccucauggccaccuucaagaugcggccgauguucgccgugggccuccuguuccgccggcugaccucccgcgagguacuccuucuuacgaucgggcugagcuuggucgcauccgccgaacugcccaacagccuagaggagcugggcgacggguuggcgauggggauaaugauccucaagcuacugaccgacuuccagucccaccagcugugggccacuuugcugagccucaccuucaucaagacgaccuucucccuucacuacgcguggaaaacuauggccauggugcuaucaaucguaucccucauaccccuaugccugucuaccaccucccaaaaaaccaccuggcugcccgugcuguugggaagccucgggugcaagccgcugacaauguuccugaucgccgagaacaagauuuggggccggaagucauggccccucaacgaggggaucauggcaguuggcaucgucagcauccugcugagcucccucuugaagaacgacgugccccuggccgggccccucaucgcgggcggcaugcugaucgcuugcuacgucaucaguggguccucugcagaccugucccucgagaaggccgccgaggucagcugggaagaggaggcggagcacaguggcgcgagccacaacauacuuguggagguucaagacgacgggacgaugaagaucaaggacgaggagcgcgacgacacacugaccauccuccugaaggccacccugcucgccgucuccggcguuuucccgcugagcauccccgccacccuguucgugugguacuucuggcagaagaagaagcagcgguccgggguacucugggacacgccaagcccgccagagguagagcgcgcaguccuggacgacggcaucuacagaaucaugcagcgcggccugcugggucggucccaggucggugugggggucuuccaggagaacgucuuccacaccauguggcacguuacccgcggcgcggugcucauguaccaagggaagcggcuggagccuagcugggcuucggucaagaaagacuuaauuagcuauggagguggcuggcgccuccagggauccuggaacacgggagaagaaguacaggugaucgcagucgaaccgggcaagaaccccaagaacguccagacagcccccgggaccuucaagaccccugagggggaagugggcgcgauagcccuggacuucaagcccgggaccagcggcagucccaucguaaaccgggaagggaaaauaguggggcuguacggaaacgggguggucacgaccagcggcacguacguaucggccaucgcccaggcgaaggcuucccaggaagggccgcuccccgagaucgaggacgagguguuccgcaagcggaaccugaccauaauggaccugcaccccgguuccgggaaaacgcgccgguaccugccggcuaucguccgcgaggccaucaagcggaaguuacgcacccugauccucgcccccacgcgcguaguggcuuccgaaauggccgaggcccugaagggcaugcccauccgguaccagaccacggccgucaaaagcgagcacaccggcaaagagaucguggacuugaugugccacgcaaccuucaccaugcgucucuuguccccagugcggguaccgaacuacaacaugauaaucauggaugaggcgcacuucacggaccccagcucgaucgcagcccggggguauaucagcacucgggucggcaugggcgaggccgccgccaucuucaugaccgccacgccgcccggcuccguggaggccuucccacagagcaaugcggucauccaggacgaagagcgcgacaucccggagcgguccuggaacucggguuacgaguggaucacggacuucccuggcaagaccgugugguucgugcccuccaucaaaagcggcaacgacauagcgaacugccugcguaagaacggaaagagagucauccagcuuucccgcaagaccuucgacaccgaguaccagaagaccaagaacaacgauugggacuacguggugacaaccgacaucagcgagaugggcgcuaacuuucgggccgaccgcgugauagacccacgacgcugccugaaacccguuauccuaaaggacggacccgaacgggugauccucgcaggcccuaugcccgucaccguggccagugcggcucagagaagggggcgcaucggccggaaccacaauaaggagggcgaccaauacaucuacaugggacagccuuuaaacaacgacgaggaccacgcucauuggacggaggccaagauguuauuagacaacaucaacacgcccgagggaaucaucccugcccucuucgaaccagagcgcgagaaauccgcggccaucgacggggaguaccgacuacggggcgaggcccgcaagacauucgucgaacucaugcggcgcggggaccugccaguuugguuguccuacaagguggccucugaaggauuucaguacagcgaccggagguggugcuucgacggcgaacggaacaaccagguccucgaggaaaacauggacguagagauuuggaccaaggaaggggagcguaagaagcuacgcccacgcugguuagacgcccggacguacuccgacccccucgcgcugcgcgaguucaaggaguuugccgccggccggaggagcguauccggggaccugauccucgagauaggcaagcugccccaacaccugacccagcgggcccagaaugcucucgauaaccuuguuaugcugcacaacucagagcaaggcgggagagccuaccgucaugcuauggaggagcugccugacacuauagagacccugaugcuacuagcucugaucgccgugcucacgggagggguuacccucuucuuccuguccggccgcgggcugggcaagaccuccaucggccucuuaugcgucauggcuucaagcgugcuguuauggauggcuuccguggaaccgcacuggaucgccgccuccaucauccuggaauucuuccuuaugguccuccuuauccccgagccggaccggcaacgcaccccucaggauaaccagcuggccuacgugguaauagggcucuuauuuaugauccugaccguagcggccaacgaaaugggucuccuagaaaccacaaaaaaagacuuagggaucgggcacguggcuguggagaaccaccaccacgccgcgaugcucgacgucgaccugcaccccgcgagugccuggacucuguacgccguagccaccacgaucaucacccccaugaugcgccacaccaucgagaacacuacggcuaacaucagccucacagcgaucgccaaccaggcugccauucugaugggguuagacaagggguggcccauauccaagauggacaucggcgucccgcuacuggcccugggguguuacagccaggucaacccccucacccugacggccgccgugcugaugcucguagcgcacuacgccaucaucggcccgggguuacaagcgaaggccaccagagaggcccagaagcgcaccgccgccggcaucaugaagaaccccaccguagacgggaucguggcaaucgaccuggaccccguggucuacgacgccaaguucgagaagcagcucggccagauuaugcuucugauccuuugcacuagucaaauucugcuaaugcggacgaccugggcucucugcgagagcauuacccuagccaccggcccacugacgacccucugggaggggucccccggaaaguucuggaacaccaccaucgccgugucaauggcuaacaucuucagggggagcuaccuggccggugccggccuggccuucucguugaugaagucgcucggcggagggaggcgcgggacgggggcucaaggcgagacccugggcgagaaguggaagcggcgauugaaccagcuauccaaaagcgaguucaacaccuacaagcgcuccgggaucauggaggucgaccgcagcgaggcuaaggagggccugaagcgcggggaaaccaccaagcacgccgucucccgcggcaccgcgaagcuccggugguucguggagcgcaaccuggugaagcccgagggcaaggugaucgaucugggcugcgggcgcggaggcuggagcuauuacugcgccgggcuuaagaaagugaccgaggugaagggauacacaaaaggcgguccgggccaugaggaaccaaucccgauggcgaccuacggguggaaucucgucaaauuacacuccggcaaagacguauucuucaucccccccgagaagugugacacccugcugugcgacaucggcgaaucaucccccaacccuaccaucgaagaaggcaggacgcugcggguguugaagauggucgaacccuggcuccgcgggaaccaauucugcaucaagauccugaaccccuauaugcccagcguagucgagacgcuagaacagaugcagcggaagcauggcggcaugcucguccgcaacccgcuguccagaaacagcacccacgaaauguauuggguguccugcgggaccggcaacaucgugucagccgucaacaugacgucccgcaugcugcuuaaucgcuucaccauggcccacaggaagcccacuuacgaacgcgacguggaccugggugccggcacgaggcauguggcagucgagcccgagguggcgaaucuggacaucaucggacagcgcaucgaaaacauuaagcacgagcacaaaucuaccuggcauuacgacgaagacaauccguacaaaacaugggcuuaccauggauccuacgaggugaagccgagcggcucagcgucuucgauggucaacgggguagucaaacuccugacaaaacccugggacgugauccccauggugacucagaucgccaugaccgacacaacgcccuucgggcagcagcgggucuucaaggagaagguggacacucgcaccccuaaggccaagcgggggacggcccaaauuauggaggugacggcacgcuggcuguggggcuuccucucccggaacaagaagccccgcaucugcacgcgggaggaauuuacccgcaagguccgaucgaacgccgcgaucggcgcggucuucaucgacgagaaccaguggaacuccgcgaaggaggccgucgaggacgagcgcuucugggaccugguccacagagagcgggagcugcacaagcaagggaagugcgcgaccugcguauacaauaugaugggcaagcgagagaaaaagcucggggaguucggcaaggccaaaggcagcagggcgauaugguacauguggcugggggcccgguuccuggaguuugaggcccugggcuucaugaaugaggaccacugguucaguagagagaauagccuguccggcguggaaggagaggggcugcacaaacuuggcuacauucugcgggacaucagcaagauccccgguggcaacauguaugcugacgacacagccggcugggacacacguaucacugaggacgacuugcagaacgaggcuaagaucacagacauaauggaaccagagcacgcacuccuggccaaggccauuuucaagcugacguaccaaaacaaggucguucgcgugcagcggccggccaaaaacgggaccgucauggacgugaucucccgucgggaucagcgcggcagcggacagguagggaccuacggccugaauaccuuuacgaacauggaggcccaguuaauacggcagauggaguccgaagggaucuucagcccguccgagcuggaaacccccaaccucgccgaaagaguccuagacuggcugggcaaguacgggguugagcggcucaagcgcauggcaaucagcggggacgacugcguggucaaaccgaucgacgacagguucgccaccgcgcugaccgcgcucaacgauaugggaaagguaaggaaggauaucccccaaugggagcccuccaagggcuggaaugacuggcagcagguccccuuuugcagccaccacuuccaccagcuaaucaugaaggacggccgggaaaucgucgugccuugccgcaaucaggacgagcugguagggcgugcccgagucucccaaggcgcggguuggagccuacgggagacggcgugcuugggcaagagcuaugcacagauguggcaguuaauguacuuccaccgccgggaccugcgccucgccgccaacgccaucugcuccgcgguccccguggauugggucccuaccucgcggaccaccugguccauccacgcgcaccaccaguggaugacgaccgaggauaugcugagcguguggaaccguguauggaucgaggagaaccccuggauggaagacaagacccacaucuccaacugggaggacguuccguaccuggggaagcgggaggaccaauggugcggaucuuugauaggacugaccgcuagagccacaugggccaccaacauccaaguggcgaucaaccaggugcgcaggcucauagggaaugagaauuaccucgacuacaugaccucgaugaagcgcuucaagaacgagagcgacccugagggcgcuuugugguag

SEQ ID NO: 24662 - RNA, 9879 nt, Artificial Sequence
  derived and/or modified CDS sequence (opt11) from DENV-1__KC692495__SS-prME
agcguaaccaugcuccucaugcugcuuccuacugcccuggccuuucaccugaccacccgcggcggggaaccccauaugaucguuucuaagcaggagcgggggaaauccuuguuguuuaaaacgagcgcugggguaaacauguguacccugauugcuauggaccugggcgagcucugcgaggacaccaugaccuacaagugcccccggauuaccgaggccgagcccgacgacguggacugcugguguaacgccacggauaccugggucacuuacgggacuuguagccagaccggcgagcaccggcgcgagaagcgaagcguugcccuggcgccccacguggggcugggguuagagacccgcaccgagacauggaugagcagcgagggcgccuggaagcaaauccagcgggucgagaccugggcgcuccgacaccccggguucacugugauagccuucuuucuggcgcacgcuauuggcaccagcaucacccagaaggguauuaucuuuauucuccugaugcuggugacccccuccauggccaugcggugcgucggcaucggcaaccgcgacuucguggaggggcuuagcggcgccacaugggucgacguaguacuggagcacggguccugugugaccacuauggcuaagaacaaacccacgcuggacaucgagcuccuuaagacggagguaaccaacccggcggugcuuaggaagcugugcaucgaggccaagaucucuaacaccaccacugacucccgcugccccacccagggcgaagccacguuaguggaggagcaggacgcuaacuuugucugucgccgcaccuucgucgaccgagggugggggaacggcugcgggcuauucggaaaggguagccuccugacgugcgcgaaguucaaguguguuaccaagcuggaggguaagaucguacaauacgagaaccucaaguacuccgugaucguuacgguccacaccggggaccagcaccaaguggguaacgaaacgaccgagcacggcacuaucgcgacgaucacaccccaggcccccacuagcgaaauccagcugaccgacuauggagcccugacgcuagacuguagcccccgcaccggacuggauuucaacgaaaugguucuguugacgaugaaggaaaaauccuggcugguucacaagcagugguuucuggaucuuccgcugcccuggacauccggggccagcaccagccaagaaacauggaaccggcaggaccugcuggugacguuuaagaccgcucacgcuaagaaacaggaggucguggugcuaggcucccaggagggcgccaugcacaccgcucugacuggggccacggagauccaaaccucaggaaccaccacgaucuuugcuggacaccucaaaugccgccugaagauggacaaacuuacucucaaggguaugucguacgucaugugcacugggagcuucaaacuggagaaggagguagcggagacccagcacggaacgguacucgugcagguuaaguaugagggcaccgaugcccccugcaaaauccccuucuccacccaggacgaaaagggggugacccagaacggcaggcugaucacggcgaaucccaucguaaccgacaaggagaagcccgugaacaucgagaccgagccacccuucggggaaucauacaucguggucggcgccggcgagaaggcgcucaagcucuccugguucaagcgcgggagcucaaucggcaagauguucgaggccacagcccgcggggcgaggcgcauggccauccugggcgacaccgcgugggauuucggaucgaucggugguguguuuaccuccgucggaaagcuaguccaccaagucuucggcaccgccuauggugugcuguuuagcggcguguccuggaccaugaagauagggaucggcauucugcuuacguggcugggucugaauagccguuccaccagccucucgaugacauguaucgcuguggggauggugacccuguaccuaggcgucaugguacaggccgacagcgggugugugaucaacuggaagggcagggagcucaagugcggaucggguauuuucgucacgaacgaaguacacaccuggacugagcaguacaaguuccaggccgacagccccaagcgguugagcgcggcgauuggcaaggccugggaagaggggguguguggcauuagaucggccacccggcuggagaacaucauguggaagcagaucagcaacgagcucaaccacaucuugcuggagaacgauaugaaguucaccguagugguaggagaugccaacggcauccuugcgcagggaaagaagaugaucaggccucagccgauggaacauaaguacucguggaagucuuggggcaaggccaaaaucauuggcgcugacauccagaacacaaccuucauuauugacgggcccgacaccccggaguguccagacggccagcgggccuggaauaucugggaagucgaggacuacggguuuggcguauuuaccacuaacaucuggcuaaagcugcgcgauuccuacacacagaugugcgaucaccggcucaugagcgcugcgaucaaggacuccaaggccguucacgcagacaugggcuacuggaucgagagcgagaaaaacgaaacuuggaaacuugcuagggcguccuucaucgaaguuaagaccugcacguggcccaagagccacacucuguggagcaacgguguccuagaaagcgagaugaucauucccaaaaucuucggcgggccgaucucccagcacaacuaccguccgggauacuucacccagaccgccggccccuggcaucuuggcaagcuggaguuggacuucgaccuaugugagggcacaaccgugguuguggaugagcacugcgguaaccgcgggccgagucugaggacuaccacagucaccgggaagaucauccacgaguggugcugccgcuccugcaccuuaccgccccugcgcuuuaggggcgaagacgggugcugguacggcauggagauccggcccgucaaggagaaagaggaaaaccuaguacgcagcaugguguccgccggcagcggggagguugacagcuucucccucggcauccugugcguuagcaucaugauugaggaagugaugcggucccgcuggagucgcaaaaugcuuaugacggggacgcucgcagucuucuuacugcugauaaugggccagcuuaccuggaacgaccugauccggcucugcaucauggugggggccaacgcgagugacaggauggggauggggacaacauacuuggcccuuauggcgacauucaaaaugcggcccauguucgccguggggcucuuauuccgccgccugaccagcagggagguccuccugcucaccauugguuuaucccuaguggccagcguagagcugcccaacucccuggaggaacuuggggacggacuggcgaugggaaucaugaugcucaagcuguugaccgaguuccagccccaucagcucuggacuacguugcugagccucacuuucgucaaaaccacgcugucccuggacuacgccuggaagaccacggcaaugguacuaucaaucguuagucuguucccucuauguuuaaguaccacgucccagaagaccacauggcugccugugcugcucgggucauucggguguaaaccccugaccauguuuuugaucaccgagaacaagauuuggggccggaagaguuggccacucaaugagggcauaauggccauagggauaguaagcaucuugcuauccucucuccugaagaacgacgucccccuggcggguccgcucauugcugguggcauguugauugccuguuacgugauuagcggcuccagcgccgaucugagccuugagaaagccgcagaggugagcugggagcaagaggccgagcacuccggagcgucccauaacauccuggucgaaguccaggaugacgggaccaugaagauaaaagaugaggagcgagacgacacccugaccauacuccuaaaggccacgcuguuagccguguccggcgucuaccccaugagcauccccgcgacacuguucgugugguacuucuggcagaagaagaagcagcggucaggcgugcugugggauaccccgaguccacccgaggucgagcgcgccgugcucgacgacggcaucuaccggauacuucaacgcggccugcugggccgaucccaggugggggucggcguuuuccaggacgggguuuuccacacgauguggcauguaacgcgcggcgcuguucucauguaccagggaaagcggcuugagcccagcugggccuccgucaagaaggaccuuaucagcuacgggggaggguggcguuuccaaggcagcuggaauacaggcgaggagguacaggugauagcuguggagcccggcaagaacccgaagaacguucagaccacccccggcacguuuaaaacccccgagggggagguuggcgcgaucgcccucgauuucaagcccggcacgagcggcuccccaaucgugaaccgggagggcaagauagucggucucuacgggaacgguguggugacuaccagcggcacguauguguccgccaucgcccaggcuaaagcgucucaggaaggcccguugccugagauagaggacgaaguuuucaagaaacgcaaccucaccaucauggaccugcauccgggcagcggcaagacucgucgcuaccugcccgccaucgugcgggaggccauaaaacgaaaacuccgcacccuuauucuggcccccacgcggguaguugcuuccgagauggccgaggcgcuaaaagggaugccgauccgcuaccagaccacugcugucaagagcgagcacaccggaagagaaauaguugaucuaaugugucacgcaacguucaccaugcggcugcucuccccggugagagugcccaacuacaacaugauaaucauggaugaggcgcacuucaccgaccccgccaguauagcugcccguggcuacaucuccaccagggucggcaugggggaggccgcggcgaucuucaugacagccacuccacccggaagcguagaggccuuuccucaguccaacgccguuauucaggacgaggagcgcgauauccccgagcggagcuggaacuccggcuacgacuggaucaccgacuuccccgggaagacugucugguucgugcccagcaucaaguccggcaacgacaucgcgaacugccugcgcaagaacgggaagagagugauacagcugucucgcaagacguucgacacugaguaccagaaaacgaaaaauaaugauugggacuaugucguuaccacggacaucagugaaaugggugcuaacuuccgggcugaccgcgugauugaccccaggcgcugccugaaaccggucauccugaaggacgggcccgagcgggugauccuggccggcccgaugcccgucaccguugcuucagccgcacaaaggcgcggccgcauugggcgcaaccagaacaaggagggcgaccaguauguguacauggggcagccccucaacaacgacgaagaccacgcccacuggacugaggccaaaauguuacuggauaacaucaacacccccgagggcauuauccccgcccucuuugagcccgaacgggagaaauccgccgccaucgacggggaguaccgccugcguggcgaggcgcgcaagacguucgucgaacuuaugcggcgcggcgaucucccggugugguugucguacaaaguggccuccgagggguuccaauauagcgaccggcgcuggugcuuugauggagagcgcaacaaccagguccuggaggagaacauggacguugagaucuggaccaaggagggggaacggaagaaacuccguccccgcuggcuggacgcgcggacauacagugacccgcuggcucuccgggaguucaaggaguucgcugcagggcggcgaagcgugagcggcgaccugauccuagagauagggaaacucccgcagcaccugacacugagagcccaaaacgcgcucgacaacuuggucauguuacacaacuccgagcaaggcggcaaggccuauagacacgccauggaagaacucccugauaccaucgagacacugaugcuguuggcauuaaucgcggugcugacaggcggggugacccucuucuuuuugucaggcaagggccuggggaagaccuccauaggccucuuaugcgugacugcgucaucggcccugcuuuggauggcgagcguagaaccccauuggaucgccgccuccaucauccuggaguucuuccugauggugcuucugauccccgagcccgacaggcagaggaccccucaggauaaccagcuggccuaugucgugaucgggcuccuguucaugauccuuacgguggccgccaacgagaugggcuugcucgagacgacgaagaaggaucuggguauaggcuacgucgccgcggagaaccaucagcacgccaccauguuggacguggaccugcacccggccagcgccuggacccuguacgccguggcgacgacagugaucacccccaugaugcggcacaccaucgagaacaccacggccaacaucucccucaccgcgaucgcaaaccaggcagccauccugaugggcuuggauaagggguggcccaucagcaaaauggacaucggcgucccccuccuggcccuggguugcuacucccaggugaacccgcugacccuuacagcagccguacugaugcucguagcgcauuacgcaaucaucgggcccgggcugcaggccaaggccacccgcgaggcccagaagcgcaccgcggcgggcaucaugaaaaaucccaccgucgacgguaucgucgccaucgaccuggacccugugguguacgacgccaaguucgagaagcaguuaggacagaucaugcuacucauccucugcaccagucaaauacugcuuaugaggacgaccugggcacucugcgaguccauaacccuugcuaccggcccgcugacaacgcugugggagggcagcccaggcaaguuuuggaacaccacgaucgccgucuccauggccaacauuuuccgcgggucuuaccucgcaggggccggccuugcguuuucccuaaugaagucccuagggggagggagacgcggaacgggugcccagggcgagacccugggcgagaaguggaagcgacagcucaaccagcuguccaagagcgaguucaauaccuauaagagauccggaaucauggagguggaccggucggaggccaaggagggccugaaaagaggggaaaccacaaagcaugcagugagcagggggaccgcgaagcucaggugguuuguugagagaaaccugguuaagcccgagggcaagguuaucgacuuggggugcggccgugggggcugguccuacuauugcgccggucugaagaagguuaccgaggugaagggcuacacaaagggcgggccgggccacgaggagccgauccccauggccacguacggcuggaaccucgugaagcugcacucagggaaggacgucuuuuucaugccgcccgagaagugcgacacgcugcugugcgacauuggagagucuagcccgaacccgacuaucgaggaagggaggaccuuacgcgugcucaagauggucgagcccuggcuccggggcaaccaauuuuguaucaagauacugaaccccuacaugccguccgucguggagacccuggagcagaugcaacgcaaacauggcggcaugcucguccggaacccucuaucccgcaacuccacgcacgagauguacugggucagcugcgggaccggaaacaucguguccgccgucaacaugacaucccggaugcugcuaaaccgauucacuauggcccaccgcaagcccacguacgaacgggauguagaccugggggcagggacccgccacguagccguggaacccgagguugcgaaucuugacauuaucggccaacggauugaaaacaucaagaacgagcauaaguccaccuggcauuacgacgaggacaacccauauaaaaccugggccuaccacgggaguuacgaggugaagcccagugggagcgccuccucaaugguaaacggcguggugcgccuccugaccaagcccugggacgucauccccaugguaacacagauugccaugaccgauacgaccccguucggccaacagcggguauucaaggaaaaggucgacacccgcacgccccgggccaagaggggaaccacacaaauaauggagguaaccgccaaauggcucuggggguucuuaagucggaacaagaagccccgcaucugcacccgggaagaguucacccgcaaggugcguagcaacgcugcuauaggcgcaguauuuguagaugagaaucaguggaacagcgccaaggaggcuguagaggacgaacguuucugggaccugguccaccgggagcgcgaauugcacaaacaggggaagugcgccacguguguguacaacaugaugggcaagcgggaaaagaagcucggggaguucggaaaggcaaaggguucccgcgccaucugguauauguggcugggggcucgguucuuagaguuugaggcccugggcuucaugaacgaggaucacugguucagcagagagaacucccuguccgggguagagggcgagggucugcacaagcucggguacauccugcgggauaucuccaagauaccgggcggaaacauguaugccgaugacacggcgggcugggacacccggaucaccgaggacgaucugcagaaugaggccaagaucacggacauaauggaaccagagcaugcccuccuggccaccagcaucuucaaacugaccuaccagaacaaggucgugcgcgugcagcggcccgccaaaaacgggacugucauggacguuaucucccgccgggaccagagagggagcggccagguggggacguauggucucaacaccuucaccaacauggagguccagcucaucaggcaaauggaguccgaagggaucuuccugccgagcgagcucgagacccccaaccuggcggaacgcgcgcuggacuggcucgagaagcacggcgcugagcgucugaaacgcauggccauuuccggggacgacugcguggugaaacccaucgaugaucgguucgcuacggccuuaaccgcccugaacgacaugggaaagguccgcaaagacauuccgcagugggagcccucgaagggcuggaaugacuggcaacagguacccuucuguagccaucauuuccaccagcugaucaugaaggaugggcgggagaucgucgucccaugccgcaaccaggacgaguuggugggccgggcgcgcgugagccagggggcgggauggucucuccgugagacagccugccugggcaagucuuacgcgcagauguggcaacugauguauuuccaccgccgggaccucaggcuggccgcuaacgccauuugcuccgcgguacccguggacugggugcccgccagccguaccaccuggagcauacacgcccaccaccaguggaugacgaccgaggauaugcuguccgucuggaaccgcguauggaucgaggaaaacccguggauggaggacaagacccacgugagcuccugggaagagguucccuaccucggcaagcgcgaagaccaauggugcggaagccugauagggcugaccgcccgggcuacgugggcgaccaacauccagguagccaucaaccaggugcgucggcucaucggcaacgagaacuaccuggacuacaugacguccaugaagcgcuucaaaaacgagagcgaccccgagggugcacugugguga

SEQ ID NO: 24663 - RNA, 9879 nt, Artificial Sequence
  derived and/or modified CDS sequence (opt11) from DENV-1__KC692496__SS-prME
ucagugacaaugcugcuuaugcugcuccccaccgcccucgccuuccaccugacgacccgaggcggggagccccacaugaucgugagcaagcaggagaggggcaagagccuccuguuuaagacuagcgcgggggugaauaugugcacccuaaucgcaauggaccuaggugaacucugcgaggacaccaugaccuacaaguguccacggaucacugaggcggaacccgaugacgucgauugcugguguaaugccaccgacacgugggugaccuacgggacuugcagccagacgggcgaacaccggcgcgagaagcggagcguggcucuggccccacacgugggucuggggcucgaaacccgcaccgagaccuggaugagcagugagggggccuggcggcagauccagcgcgucgagaccugggcccugcgucaccccggguuuacgguuaucgcguucuuccuagcacacgccaucgguaccucaaucacccagaaggggaucaucuuuauccuccuuauguuagugacucccuccauggccaugaggugcgucggcaucggcaaccgggacuucgucgaggggcucucgggcgccacguggguggacgucgugcucgagcacggguccugcgugaccaccauggccaagaacaagcccacccuggacaucgagcuucugaagacggaggucaccaacccagcggucuuacgcaagcucugcaucgaggccaagaucagcaacacuacaacggacucccgaugcccgacccagggggaggccacccuuguggaggagcaggacgcaaacuucgucugccgccggaccuuuguugaucgcggcugggggaacggcugcggacucuucggaaaggguagccucuuaacgugcgccaaguucaagugugugaccaagcuggagggcaagaucguacaguacgagaaccucaaguacagugugauagugacaguccacaccggggaccagcaccagguggggaacgagacgaccgaacacggcaccaucgcgaccaucacgccccaggcgcccacgucagaaauccagcugacagauuacggggcacugacccucgacugcagcccccggaccggccuggauuucaacgagaugguccuguugacgaugaaagagaagucuuggcugguacacaagcagugguuccuggaccucccacugccuuggaccucuggggccagcaccagccaagagaccuggaaccgccaagaccugcucgugacguucaagaccgcccacgcgaagaagcaggaggucguugugcugggcucccaggagggcgcgaugcacaccgcuuuaaccggggccacggagauccagaccucggggaccaccacgauauucgccgggcaccucaagugccgguugaagauggacaagcugacccucaaaggcauguccuacgugaugugcaccgggagcuucaagcuggagaaggagguugcggagacacagcacgggacggugcugguccaggugaaguaugagggcacggacgcgcccugcaagauacccuuuagcacucaggacgagaagggggugacucagaacggcaggcuaaucacggcuaauccgaucgucaccgacaaggagaagcccguuaacaucgagacggagccgcccuucggcgagucauacauuguggucggggccggcgagaaggcgcucaagcuguccugguucaaacgagggagcuccaucggcaagauguucgaagccacugcgcgcggggcccggcggauggccauccugggcgacacggcgugggacuucgggagcaucggcggaguguucaccuccguaggaaagcucguccaccagguguucgggacugcuuacggagugcuguuuucgggcguguccuggaccaugaagauugggaucggaauccugcugacuuggcugggccugaauagccgcuccaccagccuauccaugaccugcaucgcuguugggauggugacccuguaccugggagugauggugcaggcugacagcgggugcgugaucaacuggaaaggacgggaguugaagugugguuccggcaucuuugugacgaacgaagugcacacuuggaccgagcaguacaaguuccaggccgacucgccgaagcgccugagcgcggccaucgguaaggcuugggaagagggcgugugcggcauucgguccgccacccgccuggagaacaucauguggaagcaaaucuccaacgaacugaaccacauccuguuagagaacgauaugaaauucacgguuguaguaggggacgcuaacggcauccucgcgcaggggaagaagaugauccgaccccagcccauggagcauaaauauucauggaaauccugggggaaggcgaagaucaucggggcugauauucagaacacuaccuucaucauugacgggcccgacacaccagagugucccgacggccagcgcgccuggaauaucugggaggucgaggacuacggguuuggugucuucaccacgaacauauggcuuaaacugcgcgacaguuacacccagaugugcgaccaccguuuaaugagcgcugccauaaaggacuccaaggccgugcacgccgacaugggcuauuggaucgaaagcgagaagaacgagaccuggaagcuggcccgugcgucauucaucgaggucaagacaugcacguggccaaaaagccacacacuguggaguaacggggugcucgagucugagaugaucauacccaagauauucggcgggccuaucucccaacacaacuaccgccccggcuacuucacccagaccgccgggcccuggcaccuggguaagcuggaauuggacuucgaucugugcgagggcacgaccguggucgucgaugaacacugcgggaaccgggggccaagccuacgcacuaccacggugacuggcaagauuauccacgaauggugcugccgguccugcacccugccgccccugcgcuuccgaggcgaggaugggugcugguaugggauggagauccgcccgguuaaagaaaaagaagaaaacuugguucggagcaugguguccgccggcagcggggaggucgacagcuucucccuugguauccugugcgucucaauaaugaucgaggaggugaugagaucccgauggagccggaagaugcugaugaccggcacgcucgccgucuuccugcugcucaucaugggccaacugaccuggaaugaccugauucgccucugcauaaugguuggagccaacgcgucggaccgaaugggcaugggcacaaccuacuuagcccugauggcaacguucaagaugcgccccauguucgccguggggcuccucuuccggcgccugaccagccgggagguacuccugcucaccaucggccucagcuuaguugccagcgucgagcugcccaacucccucgaggagcugggggacggccuggcgaugggcauaaugaugcucaagcugcugaccgaauuucaaccccaccagcuguggacaacccugcugagccugaccuuuguaaagacaacgcugucccuggacuacgcguggaagacgaccgccauggugcucagcauugucucccuguucccccugugccuuagcaccacaucccagaagaccaccuggcugccggugcugcucgggagcuucgggugcaagcccuuaacaauguuccucaucaccgagaacaaaaucugggggcgcaaguccuggccccuuaaugaggggaucauggccaucgggaucgugagcauacugcuguccagcuugcugaagaaugacguuccucuggccggccccuugcucgccggcggcauguugaucgccugcuacgugaucagcggcucgagcgccgaccuuucccucgaaaaagccgccgaggugagcugggaacaggaggccgagcauuccggggcgagccauaacauccuggucgaagugcaagacgauggcacaaugaagaucaaagaugaggaacgggacgacacgcucacuauccugcugaaggcaacccuccuggccguguccggggucuaccccaugagcaucccagcgacgcuauucgugugguacuucuggcagaagaaaaagcagcguucgggcgugcucugggacacacccagcccgcccgaaguugagcgggcugugcuggacgacgggauauaccgcauuuuacagcgggggcugcucgggcgcucacaggucggagucggcguguuucaagacggcguauuccacaccauguggcacguuacccggggugccgugcugauguaccaggguaagcgucuggaacccaguugggccucugugaagaaggaccugaucuccuacggaggaggguggcgguuucagggguccuggaacacuggggaagagguccaggugaucgccguggagcccgguaagaacccgaagaacgugcagaccacccccggcaccuucaagacgcccgagggggaggugggcgcgaucgcccuagacuuuaaacccgggacgagcggcucucccaucgugaaccgcgaaggaaagaucgugggccuuuacggcaacgggguggugaccacaucaggcacguacgucagugccauugcacaggccaaggcgucgcaggaagggccccucccagagaucgaggacgagguguucaagaagcggaacuugacaaucauggaucuacacccgggcucaggcaagacccgccgguaccucccugcuauaguucgcgaagccaucaagcggaagcugcggacccugauauuggccccuacccgcgucguggcguccgagauggccgaggcucugaaggggaugcccauccgguaccagacaaccgcugucaagagcgagcacaccggucgcgagaucgucgaccuuaugugccacgccacguucaccaugcggcugcucucaccggugagggugccaaacuacaacaugaucauaauggacgaggcgcacuucacugaccccgccagcaucgcugccaggggcuacauauccacccgcgucggcaugggagaggccgccgccaucuucaugacggccaccccuccugguagcguggaggccuucccccaguccaacgcugugauccaggacgaagaacgggauauucccgagcgcagcuggaacuccggcuaugacuggaucaccgacuuucccgggaaaaccgucugguucgugcccagcauuaaguccggcaacgauaucgcgaacugucugcgcaaaaaugggaagaggguaauccaacucagccgcaagacguucgacaccgaguaccagaagaccaagaacaacgacugggauuaugucgugacuacggauauuuccgagaugggcgcuaauuuccgggccgaccgggugauugacccccgccgaugccugaaacccgucaucuuaaaggacggacccgagagggugauccucgcgggcccgaugccggucaccguggcgagcgccgcccagaggcgcggccgcaucggccggaaccagaacaaggaaggagaccaguacguguacaugggacaaccgcugaacaacgacgaggaccacgcccacuggaccgaagccaagaugcugcucgacaacaucaacaccccugagggcaucaucccugcgcuguuugagcccgagcgggagaaguccgcggccaucgacggggaguauaggcuccgcggcgaggcccggaaaacguucgucgagcugaugcgccggggugaccuccccguguggcugagcuacaagguugccuccgagggguuccaguacucggacaggcgauggugcuuugauggcgagcgcaauaaccagguccucgaggagaacauggacguggagaucuggaccaaggagggggagcggaagaagcuccgaccccgguggcuggaugcgcgcacuuacuccgacccgcucgcgcuacgggaguucaaggaguucgccgccggcaggcgaagcgugucaggcgaccugauccucgaaaucgggaagcugccacagcauuuaacccuccgggcccaaaacgcacuggacaaccuggucaugcuacacaauuccgaacaaggggguaaggcuuaccgccaugcaauggaagaguugccggacaccauagaaacgcugauguugcuggcccuuaucgcagugcucaccggcggggugacccuguuuuuccugagcggcaaaggauuggggaagacguccaucggucuccucugcgucacggcaagcucagccuuacuguggauggccucgguggagccacacuggauagccgcaucaaucauccuggaauuuuuccucauggugcugcugaucccagagcccgacagacagcguacgccccaggauaaccagcucgcauacguggugaucggccuacucuucaugauccucaccguggccgccaacgagauggguuuacuggagacuacgaagaaggaucuggggaucggcuauguagcagcugaaaaccaccagcaugccacgaugcuggacgucgaucuacauccggccagcgccuggacacucuacgccguggcgaccacagucaucacccccaugaugcgccacaccaucgagaauacaacggccaacauauccuugacggcgauagcaaaccaggccgcgauccugaugggccucgacaaggguuggcccaucucgaagauggauaucggcgugccccugcuggcccucgggugcuacucccaagugaacccacuuacccugaccgccgcuguccucaugcugguggcgcacuacgcuaucaucggcccgggucuccaagccaaggccacgcgcgaggcccaaaaacggaccgcggccggcauuaugaagaacccgaccguggacggcaucguugcgauagaucucgaccccguaguguacgacgccaaauucgagaaacagcugggccagaucaugcugcugauccuaugcacaagccagauccucuuaaugcgcacgaccugggcccugugcgaauccaucacucucgccaccggcccgcuaacgacccugugggaggggagccccggcaaauucuggaacaccacuaucgcuguuuccauggccaacaucuuccggggcagcuaccuggccggggccggcuuagccuucagccugaugaaaucccucgguggcggucgccgcgggacgggcgcccagggggaaacucucggagagaaguggaagcgucagcugaaccagcugucuaagagcgaguucaacaccuacaagcgaagcgguauuauggaagucgaccgauccgaggcaaaggaaggccucaaacgcggggaaaccacgaagcaugccgugagcagagguaccgcgaagcuacggugguucguagagcgcaaccucgugaagccggaaggcaaggugaucgaucuggggugcgggcgcgggggcugguccuacuacugcgcuggacuuaagaaggugacggaggugaagggcuacaccaagggaggacccggccacgaggagcccauccccauggccaccuacggguggaaccugguuaagcugcacagcggcaaggacgucuucuucaugccucccgaaaagugugacacgcuccugugcgacauaggugaaucaagcccgaaccccaccaucgaagagggacgcacccugcgaguccucaagaugguggaacccugguugcgcggcaaucaguucugcaucaagauucugaaccccuacaugccguccgucguggagacccucgaacagaugcagcggaagcacggagggaugcuggucaggaacccucugagcagaaauuccacgcacgagauguacugggucagcugcgggacuggcaacauaguguccgccgugaacaugaccagccgcaugcuacuaaacagauucaccauggcccaccggaaaccgacguacgagcgagacgucgaccugggcgcggggacacggcacguggccgucgagcccgaggucgccaaccucgacauuaucgggcagcguaucgaaaacaucaagaacgagcacaaguccacauggcauuacgaugaggacaacccguacaaaaccugggcuuaccacgggaguuaugaggugaagcccuccggcagcgccuccagcauggucaacgggguggugcgucuucugacgaagcccugggacgugauucccaugguaacacagauugcgaugacugacacuaccccguucgggcagcagcgcguauucaaggagaagguugacacccggacgccacgggccaagcggggcaccacgcagaucauggagguuaccgccaaguggcucuggggguucuuaagccgaaacaaaaagccccggauauguacccgcgaggaguucacccggaagguccgcucuaacgccgccaucggcgcggucuucguggacgagaaccaguggaacucagccaaggaggcuguggaggaugagcgcuuuugggacuuaguccacagagaacgggagcuccacaagcaggggaagugugccacgugcguguauaacaugauggguaaacgcgagaaaaagcuaggggaguucgguaaggcgaaaggaucccgggccaucugguacauguggcugggggccagauuccucgaguucgaggcccugggauucaugaacgaggaccacugguucagccgggagaacucgcuguccggcguugagggagaggguuuacacaaacuuggcuacauacugcgcgacaucuccaagaucccgggugggaacauguacgcugacgacacagcgggaugggauacccgcaucacggaggacgaccuccagaacgaggccaagaucacggauaucauggagccugaacacgcccuacuggccaccagcaucuucaaguuaacguaccagaacaagguggugcgggugcagaggcccgccaagaacgggaccgucauggacgugauaucccggcgggaccagcgggguuccggccagguggggacguacggccugaacaccuucaccaacauggagguacaguuaauccgccagauggaguccgaggggaucuuucuccccuccgagcuggagaccccgaaccuggcggagcgggcccucgacuggcuggagaaacacggcgccgaacgccuaaagagaauggcuauuuccggagacgacugcguugugaagcccauugacgaccgcuucgccacggcgcugaccgcucugaacgacauggggaaggugcggaaggacaucccccagugggagcccuccaagggcuggaacgauuggcagcaggucccuuucugcucccaccacuuucaccaguugaucaugaaagacgggcgugaaaucguaguccccugccggaaccaggacgagcucguuggccgcgcccgggucucgcagggugccggcuggucacugcgcgagacagcgugcuuaggcaagagcuacgcucaaauguggcagcucauguacuuccaucgucgggaccugcgguuggcagccaaugccaucuguuccgcgguccccguggacugggugcccgccagccgcaccaccuggagcauccacgcgcaucaccaguggaugacgaccgaggacaugcucuccgucuggaaccgcguguggaucgaggagaacccguggauggaggacaagacccacgugagcuccugggaggagguccccuaccugggcaagcgggaggaccaguggugcggcagcuugaucgggcucaccgcccgcgccacgugggcgaccaauauacagguugcaaucaaccaaguuaggagguuaaucggaaacgagaacuaccuggacuacaugaccuccaugaagcgguucaagaacgagagcgaccccgaaggcgcccucugguga

SEQ ID NO: 24664 - RNA, 9879 nt, Artificial Sequence
  derived and/or modified CDS sequence (opt11) from DENV-1__KC692497__SS-prME
agcgugacaaugcugcucaugcugcugcccaccgccuuagccuuucaucuuaccacccgcggcggggagccacacaugaucgugagcaagcaggagcggggcaaaucgcuguuauuuaagacuagcgccggcgugaacaugugcacccugaucgccauggaccugggcgagcuaugcgaggacacuaugacuuacaaaugcccccguauuacagaggccgaacccgaugacguugacuguuggugcaacgccacggauacaugggugaccuacgggaccugcagccaaaccggcgagcaucggcgcgagaaacgguccguggcucuggccccacaugucggccugggacucgagacccgcaccgagaccuggaugagcuccgagggcgccuggaaacagauacagcggguugaaaccugggcccugcgccaccccggguucacggugaucgccuuauucuuggcgcaugccauuggcaccagcaucacccagaaggguauaaucuucaucuuacugaugcucgugacccccuccauggcgaugcggugcgucggcaucggcaaucgcgacuucguggaagggcucagcggggcaacuuggguggaugucguccuggagcacggguccugcguuaccacaauggccaagaacaagccuacccucgauauugaacugcugaaaacggaagucaccaaucccgcagugcuuaggaagcugugcaucgaggccaaaaucucuaacaccaccacugacucccgcugcccuacccaaggggaggccacccugguggaagagcaagacgccaauuuugucugccggcgcaccuucguggaccguggcugggggaaugggugcggccucuucggcaagggaagccugcuuacgugugccaaguucaaaugcgugaccaagcucgagggcaagaucguccaguacgagaaccuaaaguacuccgugaucguaacgguacacaccggcgaccagcaccaaguggguaacgagaccaccgagcacgggacaaucgcgaccaucacgccccaggcccccacgucagagauccaguuaaccgacuauggugccuuaacuuuagacugcucucccagaaccggccuggauuucaacgagaugguccucuugacgaugaaagagaaguccugguuagugcacaagcagugguuccucgaccugccguuaccguggaccuccggggccuccaccagccaggagaccuggaaccggcaagaccuccuggugacguuuaagacggcucaugcgaagaagcaggaaguuguggugcuaggcagucaggaaggcgccaugcacaccgccuugaccggggccacggaaauucagaccucaggcacuacgaccauauucgccgggcaucugaagugccgccugaagauggacaagcugacccugaagggcaugucuuacgucaugugcaccggcucuuucaagcuggaaaaggagguggcggaaacccagcaugguacggugcugguucaggucaaauacgagggcaccgaugccccaugcaagauccccuuuucuacccaggacgagaagggugugacccagaacggccgucucaucaccgccaaccccaucguaacggacaaagagaagcccgugaacaucgagaccgagccgccguucggggaaagcuacauuguggugggcgccggcgagaaagcgcugaaguuauccugguucaagcgggggagcuccauaggaaagauguucgaagcaaccgcccgcggagcccgccguauggccaucuugggcgacacggcgugggacuucgguucuauuggagggguguuuacauccgugggcaaauuagugcaccaaguguucgggaccgcuuauggggugcuauuuagcggcguuucguggacuaugaagaucggcaucgggauuuugcugacuuggcugggacugaacagcaggagcaccagccugucuaugaccuguaucgcgguggggauggugacacuguaccucggggucaugguccaagccgacucuggaugcguuaucaacuggaagggucgcgaguuaaagugcggcuccggcaucuucguuacgaaugaagugcauacauggaccgaacaguacaaguuccaagcagauucaccuaagcggcugucagcggccaucggcaaagcuugggaggaggggguguguggcauucgcuccgccacacggcucgagaacaucauguggaagcagauaucaaaugagcugaaccacauacugcuugaaaacgauaugaaauucacuguuguggugggggacgccaacgguauccuggcgcaagggaagaagaugauccgcccccaacccauggagcauaaguauuccuggaaguccuggggcaaggcaaagaucaucggcgccgauauccagaacacaacuuucauaauagacgggcccgacaccccagagugcccggacggccagcgcgccuggaacaucugggaggucgaagacuacggguucggcguguuuacuacgaacaucuggcugaagcuccgcgacuccuacacccagaugugcgaccaucguuuaaugucagcggccaucaaggauucgaaggccgugcacgccgauaugggcuacuggaucgagucagagaagaacgagaccuggaagcuggcccgggcguccuuuaucgaaguuaagaccugcacguggcccaagagccacacucuguggaguaacggggugcuagagucagaaaugauaauacccaagaucuuuggcgggccgaucucccaacacaauuaccggcccggguacuucacccagaccgcgggccccuggcaccuggggaaacucgaacuggacuucgacuuaugcgagggcacgaccguggucguggacgagcacugcgguaaccgaggcccgucucuccggaccaccaccgugacggggaagaucauccacgaaugguguugccgcuccugcacacugccgccacugagguuccgcggggaggacgggugcugguacggcauggagauaaggccgguaaaggagaaggaggagaaccucgugcgcagcauggucucggcuggaagcggagaggucgacagcuucucccugggcauucugugcgucagcaucaugauugaggagguuaugcggucccgcuggagccgcaagaugcucaugaccgggacgcuggcaguuuuccuguuacuaauuaugggacagcugaccuggaacgaccucauaagacuaugcauuauggugggggccaaugcuagcgaccgcaugggcaccggcaccacguacuuagcccucauggcgaccuucaagaugcgccccauguuugccguggggcuccuguuccgccgucucacuucacgagagguccugcugcucaccauuggcuuaucacugguggccagcgucgaacuacccaacucccuggaggagcucggagaugggcucgcgaugggcaucaugaugcuuaagcuacucaccgaguuccagccccaccagcucuggaccacccugcuuagccugaccuucgugaagaccacccuaucccuagacuacgcauggaaaaccaccgccauggugcugucgaucguaucccuguuuccacucugccuaagcacgacaucccagaagaccacguggcucccuguacuccuggggagcuucgggugcaaacccuuaacgauguuucucauaacggagaacaagaucugggggcggaaguccuggccccugaaugagggcaucauggcaaucgggaucgugagcauccucuugaguucauuacugaagaacgacgucccacucgcaggcccgcuuaucgcaggcgggaugcugaucgcgugcuacgucaucucuggcaguagcgcagaccuaucccuggagaaggccgcggaggugagcugggagcaggaggcagaacacuccggggcaagccacaacauucugguagagguacaggacgacgguacaaugaagauuaaggacgaggagcgcgacgacacucucacgaucuuacugaaggccacgcuccuggcgguguccggggucuaucccaugucuauacccgcgacccuguucgucugguacuucuggcagaagaagaagcaacgguccggcgugcucugggacaccccuagcccacccgaggucgagcgcgcugugcuggacgauggcauauaucggauccugcagcgcgggcugcucggccggucgcagguggggguaggcguauuccaagaugggguguuucacaccauguggcaugucacgagaggcgccguguugauguaccagggcaaacggcuggagccaaguugggcuuccgugaagaaagaccucaucucuuaugguggaggguggcgcuuccagggcucauggaacacaggggaggagguacaagugaucgcugucgagccaggcaagaacccgaagaacguacagaccacccccggcacguucaagacccccgagggugagguaggagcgaucgccuuagauuucaagcccgggacaagcggcuccccuaucgugaaccgggaaggcaagaucgucgggcuguacggcaauggaguggugaccacgagcggcaccuauguguccgccaucgcccaggccaaggcgagccaggaggggccccucccugagaucgaggacgaaguguucaagaagcgcaaccugaccaucauggaccugcacccaggaagcggcaagaccaggcguuaccugccagccaucguaagagaggcgauaaagcggaaauugcgcacucugauccucgcccccacccgggucguggcguccgagauggcggaggcccucaagggaaugccaauccgcuaccagaccaccgccgucaagagcgagcauacgggacgagagaucgucgaucugaugugucacgccacuuucacuaugcgucuccuguccccgguucgcguacccaacuacaacaugaucaucauggacgaggcgcacuucacagaccccgcaucuaucgccgcacgcggcuacaucuccacccggguugguaugggagaggccgcggccauuuucaugacagcaacuccgccaggaagcgucgaggccuucccccaguccaacgcagugauccaggaugaagagcgcgacauccccgagcggagcuggaauuccggguacgacuggaucaccgacuuccccgggaagacggucugguucguuccaagcaucaaguccggcaacgacauugcgaacugccugcgcaagaacgggaaacgagugauccagcuuagccgcaagaccuuugacaccgaguaccaaaagaccaagaauaaugacugggacuacgucguuacuaccgacaucagcgagaugggggcuaauuuccgugcagaccgcgugauagacccccggcgcugccugaaacccgucauccuuaaggacgguccugaacgcguuauauuggccggcccuaugcccgucaccguugcgagcgccgcgcaacgccggggccgcaucgggcgcaaccagaacaaggagggugaccaguacguuuacauggggcagccucucaacaacgacgaagaucacgcccacuggacagaggcgaaaauguugcucgacaacaucaauacgcccgagggcauuaucccugcgcuguuugagcccgagcgggaaaagucggccgccaucgacggggaguaccgcuugcggggagaggcccgcaagaccuuugucgagcucaugcggcgcggcgaccuccccguguggcugaguuacaagguagccuccgaggguuuccaauauagugaucggagguggugcuuugacggcgagcggaacaaucagguucucgaagagaauauggacguggagaucuggaccaaagaaggagagcgcaagaagcugcggccgcgguggcuggacgcgcggacguacuccgacccgcucgcauugcgcgaguucaaggaguuugcugccggucggcggagcguaagcggcgaccugauccucgagaucgggaagcuaccccagcaccugacguuacgggcccagaacgcgcuagacaaccuggucaugcuccacaauuccgagcaaggcgggaaggccuaccgccaugccauggaagaguuaccugacacuaucgagacucugaugcuccuggcguuaauagccgugcucacgggcgggguaacguuauucuuccuaagcggcaaggguuuaggcaaaacguccauuggauugcugugcgucacugccagcuccgcccuccuguggauggcaagcguggagccccacuggaucgcagcguccaucauuuuggaguuuuuccugauggugcuacugaucccugagcccgacaggcagcgcacuccgcaagacaaccagcuggccuaugucgugauagggcugcucuucaugauccucaccguggcagccaaugagaugggccuguuggagaccaccaagaaggacuuggguauuggcuacguugccgccgagaaucaccagcacgcgaccaugcuggacgucgaucugcacccggcgagcgccuggacccucuacgccguagccacgaccgucaucacaccgaugaugagacacaccaucgagaacacgacggccaacaucuccuugaccgcaaucgccaaccaagccgcuauccuaauggggcucgauaagggguggccgaucucaaagauggacaucggcgucccgcugcuggccuuggggugcuacucccaggugaacccacugaccuuaacggcugccgugcucauguuaguggcgcacuacgccaucauugggcccgggcugcaggccaaggcuacccgcgaagcacagaagaggacugcggccggcaucaugaagaaccccaccguggacggcaucgucgccaucgaucuugauccagugguguacgacgccaaguucgagaaacaacuggggcagaucaugcuucuaauccuuugcacuagucagauccuguuaaugcggaccacuugggcccucugcgaauccaucacccuggccacgggcccgcucacuaccuuaugggaggguagcccggggaaguucuggaacaccacaauagcugucuccauggccaauaucuuccgcggcagcuaccuagccggggcaggacucgcguucucacuaaugaaaucccucgggggagggcggcgggguacuggcgcccagggggagaccuuaggagaaaaauggaaacggcagcugaaccagcuguccaagucugaguucaacaccuacaaacgcucagggaucauggagguggaccggucugaggccaaagagggacugaagcgcggggagacgaccaagcacgccgugucgcggggcaccgcaaaacugcgaugguucguggagcgcaaccugguaaagcccgagggcaaggucaucgaccuggggugcggccgcgggggaugguccuacuacugcgccggacucaaaaaggucaccgaggugaagggauacaccaaaggagggcccggccacgaagagccgauucccauggcuacguacggcuggaacuuaguuaagcugcacagcggcaaggaugucuucuucaugccgccugaaaagugcgacacccuccugugcgacaucggggagucaucuccgaaccccaccaucgaggagggccggacucugcgcguguugaagaugguggagccuugguuacguggcaaccaguucugcaucaaaaucuuaaaccccuacaugccgagcgucgucgaaacgcuugaacagaugcaacgcaagcacggaggcaugcucgugcguaacccgcugagucguaacucaacccacgagauguacugggucagcugcgggacgggcaacaucguguccgccgugaauaugaccagucggaugcuccugaaccgguucacuauggcgcaccgcaaacccaccuacgagcgggacgucgaucucggggcggguacccggcauguugccguugagcccgaagucgccaaccucgacgugaucggccagcggauagagaacaucaagaacgagcauaaauccacuuggcacuacgacgaggacaacccguacaagacaugggcauaccacgggagcuacgaggucaagccaucaggcagcgccucaagcauggugaacggagugguacgccugcugaccaagcccugggacgugauucccauggugacccagaucgcgaugacagacacgaccccauuuggccagcagagagucuuuaaggaaaaggucgauacgcguacgccacgggccaagcggggcacgacccagaucauggaggugaccgcuaaguggcucuggggguuccuguccaggaacaagaagccccgcauuugcacacgggaggaguuuacccguaaaguucggagcaacgccgccaucggugccguguucguggaugagaaccaauggaacagcgcgaaggaggccguggaggacgaacgcuucugggaucucgugcaccgggagcgcgagcuccacaagcaggggaagugcgcgaccuguguguacaacaugaugggcaagcgcgagaagaaacugggggaguucggcaaggcuaaaggguccagagccauaugguacauguggcugggcgcccgguuccucgaguucgaggcccucggcuucaugaacgaggaccauugguucagccgggagaacucccugucugggguggaaggugaggggcuacacaagcuggguuauauccugcgggacaucaguaagauucccggcgggaacauguacgccgaugacacagcggggugggacacccgcaucacggaggacgaccuccagaacgaggccaagaucaccgauaucauggagccggagcacgcccuguuagccacgagcauuuucaagcucaccuaccagaauaaggugguucgcguccaacggcccgccaaaaacgggacagucauggauguuaucucccgccgggaucagaggggcucaggccaggucggcaccuacggccugaacaccuucaccaauauggagguucaacugauccggcagauggaguccgaggggaucuuccuccccucagagcuggagacgccgaaccuggcagagcgcgcgcuggacuggcuagaaaaacacggcgcagagcggcugaaacgcauggccaucaguggggaugauugcguggucaagcccaucgacgaccgguucgcgaccgcucucaccgcccuuaacgauaugggcaaggugcgcaaagacaucccucagugggagcccaguaagggcuggaaugauuggcagcagguuccguucugcucccaccacuuccaccagcugaucaugaaggacgggcgggagauagucgugccgugccguaaccaggacgaacucgugggucgagcacgcguaucccagggugccggcuggagucugcgcgaaaccgccugccuaggcaagagcuacgcucagauguggcagcuuauguacuuccaccgccgggaccugcgccuggccgccaacgccaucuguuccgcggugccaguagacuggguccccgccagccggaccacuuggucuauccacgcgcaccaccaauggaugacuaccgaggacaugcucuccguguggaaucgcguguggauugaggaaaacccguggauggaggacaagacgcaugucagcuccugggaagaggugccuuauuugggaaagcgcgaagaccaguggugcgggagccugauuggccucacggcucgggcuaccugggcuaccaacauccaaguggcaaucaaccagguccgcaggcucaucggcaacgagaacuaucuggacuauaugaccuccaugaagagguuuaagaacgagagcgauccagagggagcucugugguaa

SEQ ID NO: 24665 - RNA, 9879 nt, Artificial Sequence
  derived and/or modified CDS sequence (opt11) from DENV-1__KC692498__SS-prME
ucugugaccaugcugcucaugcugcugcccaccgcccucgccuuccaccugacuacccgcggcggcgaaccgcacaugaucgugagcaagcaggagaggggcaagucccuacucuucaagaccagcgcgggugugaacaugugcacccucaucgccauggaccugggcgagcugugcgaggacaccaugaccuacaaguguccccgcauaaccgaggcggagccugacgacguggacugcuggugcaacgccaccgauaccugggugaccuacggaaccugcagccagaccggcgagcaucggcgcgaaaagcgguccguggcccuggcuccccacgugggccuggggcuugagacgcgcaccgaaacuuggaugagcagugagggcgccuggaagcagauucagcgagucgaaacgugggcucugcgccaccccggguuuacugugaucgcccuguuccucgcgcacgccaucggcaccagcaucacacagaaggggaucaucuucauccugcugaugcucgugacccccuccauggcaaugcggugcgucggcaucggaaaccgcgacuucguugagggguugucgggcgcuacguggguggacguuguacuggagcacgguuccugcgugaccacaauggccaagaacaagcccacccuggacauugagcugcuaaagacggaggucaccaaccccgcggugcuccggaagcucuguauagaggccaagauuucaaacaccacuacugacagcagaugcccaacccaaggcgaggcaacccugguggaggagcaggacgccaacuucgucugcaggaggaccuucguggaccggggcuggggaaacggcuguggccuguuugguaaggguucucugcugacuugugccaaguucaagugcgucaccaaguuggagggcaagaucguucaguacgagaacuuaaaguacucgguaauaguaacaguccacaccggcgaccagcaccagguggggaacgagacuaccgagcauggcaccaucgccaccauuacuccgcaggcccccacauccgagauccagcugaccgacuacggggcucugacccuggacugcagccccagaaccggccucgacuucaacgagauggugcugcuaacaaugaaggaaaaauccuggcuggugcauaagcagugguuccuagaccugccgcugcccuggaccuccggggccagcaccucacaggagaccuggaaccggcaggaccuacuggugacguucaaaacggcccaugcgaagaagcaggaggucguuguguuaggcucacaggagggcgcaaugcacacagcccucacaggugcaaccgagauacagacaucgggcaccacaacaaucuucgccgggcaucucaagugcagacugaagauggacaagcuaacccuaaagggcauguccuaugucaugugcaccgggagcuuuaagcuggagaaggagguugcggagacacagcacgguacggugcugguucagguuaaguacgagggcacagacgcccccuguaagauccccuucuccacccaagacgagaaagggguaacccagaacgggaggcucaucaccgcgaacccgaucgucacggacaaagagaagcccgugaacauugaaacugaaccucccuucggggagagcuacaucguggucggcgccggcgagaaggcgcuuaagcugucaugguucaaacgcgggucgucgauuggcaaaauguucgaggccaccgcccguggggcucgcagaauggccauccucggcgauacagcaugggacuucgggagcaucggcggcguguucacauccguggggaagcugguccaccagguauuuggcacugcguacgggguacuguucucgggagucagcuggaccaugaagaucgggaucggcauccuccugacguggcugggccucaauagccgguccaccagccucuccaugaccugcauugcagugggcauggugacccuguaccucggcgugauggugcaggccgacagcgggugugugaucaacuggaagggccgcgaacugaagugcggguccggcaucuucgucacgaacgaggugcacaccuggacugagcaguacaaguuccaagccgacagcccgaaaaggcuguccgcggccaucggcaaggccugggaagagggggugugcggcauccgcucggcaacacggcucgaaaacaucauguggaagcagauaagcaacgagcugaaccacauacugcucgagaacgacaugaaauucaccgucgugguaggggacgccaacggaauccuagcgcaggggaagaagaugauccgcccgcagcccauggagcacaaauauuccuggaaguccuggggcaaggcaaagaucaucggcgccgacauccagaauacgacuuuuaucaucgacggucccgacaccccggaguguccugacgggcagagggccuggaauaucugggaagucgaggacuacggcuucggcguguuuaccaccaacaucuggcugaagcuccgcgacuccuacacccagaugugcgaccaucggcugaugagcgcggccaucaaggacagcaaggccgugcacgccgacaugggcuacuggaucgagagcgagaagaacgagaccuggaagcuggcccgagcguccuuuaucgagguaaagaccugcacguggccuaagagccacacccugugguccaacggagucuuagagagcgagaugauaaucccuaaaauuuucggcgggccgauuucccagcacaacuaccguccgggcuacuuuacccagaccgccgggcccuggcaccugggcaagcucgagcuggacuuugaccugugcgagggcacgaccgucgucguugacgagcacugcgguaaucgcggcccuagccuccggaccaccacggugaccggaaagaucauccacgagugguguugccgcuccugcaccuuaccaccccugcgguuccgcggcgaggacgggugcugguauggcauggagauaagacccgucaaggaaaaggaggagaaccucgugcguucgaugguguccgcuggcagcggagagguagacagcuuuucccugggcauccugugcgugucgaucaugauugaggaggugaugcguucccgauggagccgcaagaugcuuaugaccgggacacuagccgucuuccugcuccugaucaugggccagcugacauggaaugaccuuauaagacuguguauuauggucggggcuaaugccuccgaccgcaugggcaccggcaccacauaccucgcccucauggccaccuucaagaugcggcccauguucgccguggggcuucuguucaggcgguuaaccagccgcgagguccugcugcucacuauuggccuuagccugguggccagcgucgaguugccuaauucccuggaggaguuaggagacggccucgcgaugggcaucaugaugcugaaacuucucacggaguuccagccgcaccagcuguggaccacccuccucagcuuaacguucgugaagacgacgcugucccucgacuacgccuggaaaaccacugccauggugcugaguaucgucagccuguucccccugugucuaagcacgacaagucagaagaccacauggcugccugugcuccuggggagcuuugguugcaaaccccugaccauguuccucauaacggagaacaagauuugggggcggaaguccuggccucugaacgagggcaucauggccaucggaaucguaucuauacuacuauccucccugcugaaaaaugacgucccgcucgccggcccguuaaucgcuggagggaugcugaucgccugcuaugugaucagcgguuccagcgcagacuuaucccuugagaaggcugcggagguuaguugggaacaagaggcagagcacuccggcgccagccacaacauccuggucgagguucaagaugacggcaccaugaagaucaaagacgaggagcgcgacgacacucuaaccauccuacugaaggcgacgcuccuggcgguguccggggucuacccaaugagcaucccugcaacacuguucgugugguacuuuuggcagaagaagaaacagcggaguggcguacucugggacacccccagcccgccagaggucgagcgcgccguucuggacgacgguauauaccggauccugcagcgcgggcugcucggccggucccaggugggggucggcguguuucaggacggcguguuccacacuauguggcacguaacgcgcggcgccguguuaauguaucagggcaagagacuggagcccucgugggcgucagugaaaaaggaccucaucagcuauggaggcggguggcgcuuccaaggcuccuggaauacuggggaggagguucaggugauagcuguggagcccggcaagaauccgaagaacguccagaccacgcccggcacguucaaaacacccgagggggaggugggcgcgaucgcccuggacuucaagcccgggaccagcggcuccccgaucguuaaccgggaaggcaagauagucgggcuguacggcaacggggucguuaccacgucgggcaccuacgucuccgcuaucgcucaggcaaaggcgucucaagaggguccccuccccgaaaucgaggacgagguuuucaagaagcgcaaccugaccaucauggaucuccacccgggcagcgggaagacacgucgcuaucuccccgcaaucgugcgggaggccaucaagaggaagcuccgcacacuuauccucgcgcccacccggguuguggcguccgagauggccgaggcgcugaaggguaugcccauccgcuaccagacuaccgccgucaagagcgagcacacgggccgggaaaucguggaccucaugugccaugcgacuuucaccaugcgccuucuguccccuguucgggugccgaacuacaacaugaucauaauggacgaagcacacuucaccgacccugccagcaucgccgcacgcggauacaucuccacccgggucggcaugggggaggcggcggcgaucuucaugacugccacgccaccgggcagcgucgaggccuucccacaaucuaacgccgugauccaagaugaggaacgcgacauccccgaacggagcuggaacuccggcuacgacuggaucaccgacuucagcgguaagacugucugguucgugccaucaaucaagagcgggaacgauaucgcgaacugucugaggaagaacgguaagcgggugauccagcucucccgcaagaccuuugauaccgaguaccagaagaccaagaacaacgacugggacuacgucgugacgaccgacaucagcgagaugggcgccaacuuccgggccgaccgcgugaucgacccccggcgcuguuuaaaacccguuauccuaaaggacggaccagagcgcgucauauuggccggccccaugccggucaccguagcgagugcugcccagcgccggggcagaauugggcgcaaucagaacaaggagggcgaccaguacguguacauggggcagccccugaacaacgacgaggaccacgcccacuggaccgaggccaagaugcugcuugacaacaucaacacgcccgaggguaucaucccagcacuguucgagcccgagcgagaaaaguccgccgccaucgauggggaauaccgccugcggggcgaagccaggaagacguuugucgagcucaugcggcguggagaccugccggucuggcuauccuacaaggucgccucagagggguuucaguacuccgaccgucgauggugcuucgauggcgagcggaacaaccagguucuagaggagaauauggacguggagaucuggaccaaggaaggggagcgcaagaaacuuagaccccgcuggcuggaugcccggaccuacucugauccccucgcccugagagaguucaaagaguuugcggccggccggcgcucgguuuccggcgaccugauucucgagaucgggaaacuuccacagcaccugacacuccgggcccagaacgcgcuugacaaccuggucaugcuacacaacagugagcaaggcgggaaggccuaccgccaugcgauggaggaacugcccgacaccaucgagacacugaugcugcuggcccucaucgcggugcucacgggcggcgugaccuuguucuuccuguccgguaagggccucgguaagacgagcauugggcuccugugcgucaccgccucaagcgcccucuuauggauggccuccguggagccccauuggaucgccgcgagcaucauccuggaguucuuccucauggugcuacucauccccgagccggaucggcagcgcacgccucaggacaaccagcuagccuacgucgugaucgggcugcuauucaugauccucacgguggccgccaaugagaugggccuucuggagacaaccaaaaaggaccucgggauaggcuacgucgcugcggaaaaccaccaacacgccacaaugcuugacguggaccugcacccugccucagcuuggacgcucuacgccgucgcgacgaccguaaucaccccgaugaugcggcauacgaucgagaacacgacugccaacauaagccuuaccgccauagccaaucaagccgcuauccugaugggccucgauaagggauggcccaucucuaagauggacauuggagugccacuguuggcccucggaugcuacagccaggugaacccccugacccucacggccgcgguccucaugcugguagcgcacuaugccaucaucggcccgggucugcaagccaaggccacccgcgaggcucagaagcgcaccgcugccggcauuaugaagaaccccaccguugacggcaucgucgcaaucgauuuggaccccgugguguaugacgccaaguucgagaagcagcuggggcagaucauguuguuaaucuuaugcacgucccagauucuccucaugcggaccaccugggcauuaugcgagagcaucacacuugcgacgggcccccucaccacauugugggagggcagucccggcaaguucuggaauaccaccaucgccgugagcauggccaacaucuuccgcggcucuuaccuggccggggcgggccucgcguucagccugaugaaaucccucgggggcgggcggcgggggaccggcgcccagggcgagacgcucggcgagaaguggaaacgccagcucaaccagcuaaguaaaucagaauuuaauaccuacaagcgguccgguaucauggagguagaccgguccgaggccaaggagggccucaagcguggagagacgaccaagcacgccguguccagagggaccgcuaaauugcguugguucgucgagcggaaccugguuaagcccgagggcaaagugauugaccuagggugcggccgcggaggcuggagcuacuacugcgccggguuaaagaagguuaccgaggugaaaggguauaccaagggcgggcccggccacgaggagccaaucccaauggccacguacggguggaaccucgugaagcugcacuccggcaaggacgucuuuuucaugccucccgagaagugcgauacucuccuuugugauaucggggaaagcucccccaacccgaccaucgaggagggccggacacugcgcgugcucaagaugguugaaccuuggcugcgggggaaccaguucugcauuaagauucugaaccccuacaugcccagugucguggagacacucgagcagaugcagcgcaagcacgggggcaugcuaguucggaacccgcugucccgcaacucgacgcacgagauguacuggguguccuguggaaccggcaacaucgugagcgcuguuaacaugaccucccggaugcuccugaaccgcuucacuauggcccaccgaaaaccaacauacgagcgggacgucgaucugggugcggggacccgacacguggcaguggagcccgaggucgccaaucucgacgugaucggccagcggaucgagaacauaaagaacgaacacaaaucgacuuggcacuacgacgaggacaaccccuacaagacgugggccuaccacggguccuacgaagucaagccuagcggcuccgccucgucaauggugaacggggugguccgccugcugaccaagcccugggacgugauccccauggugacccagaucgccaugaccgauacgacccccuuuggccagcagcggguuuucaaggagaagguggacacccguaccccgcgcgccaaaaggggcacgacccaaaucauggaggugaccgccaaguggcucuggggguuccucagccggaacaagaagccccgcaucugcacccgggaggaguucacgcgcaagguccgcagcaacgccgccaucggggcgguguucguagacgagaaccaauggaacuccgcuaaggaggcugucgaagaugagcguuucugggaccucgugcaccgggagcgcgagcuccacaagcaggggaaaugcgcgacaugcguguauaacaugaugggcaagcgcgagaagaaguugggggaguucggcaaggcaaaggguagccgcgccaucugguacauguggcugggggcacgguuccucgaguucgaggcccuggguuucaugaacgaggaucacugguucucccgcgagaacagccuuucaggggucgagggagaggggcuccacaagcuaggcuacauccuacgggauauuagcaaaauacccggcgggaacauguaugcagacgacaccgcgggcugggacacccggaucacggaggacgacuuacaaaacgaggccaagaucaccgauaucauggagccggaacacgcucugcuggccaccucuaucuucaaacugacguaccagaacaaggugguacgcguccagcggcccgccaaaaacgggacggugauggacguuaucagcaggcgggaccagcggggcucaggccaggucgggaccuacggcuuaaauaccuucaccaauauggagguccagcuuauccggcaaauggagagcgagggaaucuuccuucccuccgagcuggagacucccaauuuagcugagcgcgcccucgauugguuggagaagcacggagccgaacggcuaaagcgcauggccaucagcggugacgacugcguugucaagccgaucgacgaucgguucgccacagcacucaccgcccugaaugacaugggcaagguuaggaaggacaucccucagugggagcccagcaaaggcuggaaugacuggcagcagguccccuuuugcagccaccacuuccaccaguuaauuaugaaagacgggcgcgagaucgucgugccgugccgcaaccaggacgagcucgugggucgggcccgcgucagucagggggcugguuggucuuuacgagagaccgccugccuggggaagucauacgcgcagauguggcaacucauguauuuccaccgccgggaccugcggcuggcagccaacgcaauaugcagcgcggugcccguggacuggguaccggcuagccggaccacgugguccauccacgcccaucaccaauggaugaccaccgaagacaugcucagcguguggaaccgggucuggaucgaggagaaccccuggauggaggacaagacccacgucuccagcugggaggaggugccguaccugggcaagcgcgaggaccaauggugcggcucccugaucgggcucacggcccgcgccaccugggcuacuaacauccagguggcuaucaaccagguucgccggcugauaggcaacgaaaacuaccuggacuacaugacuagcaugaagcgcuucaaaaacgaguccgaccccgaaggugcucucugguga

SEQ ID NO: 24666 - RNA, 9879 nt, Artificial Sequence
  derived and/or modified CDS sequence (opt11) from DENV-1__KC692499__SS-prME
agcgugaccaugcuucugaugcuguugcccaccgcccucgccuuccaccugaccacccgcggcggggagccccauaugauagugagcaagcaggagcggggcaagagcuugcuguucaagaccagcgccggggucaacaugugcacccugaucgccauggaucucggcgagcucugugaagacaccaugaccuacaagugcccccguaucaccgaggccgaacccgacgacguugacuguuggugcaacgccaccgacaccugggugaccuacgggaccugcagccaaacuggugaacaccggcgcgaaaagcgguccguggcccuggcgccccacgugggccuggggcucgagacgcgcacggagaccuggaugagcuccgagggcgccuggaaacagauucagagaguggagaccugggcccugcgccauccaggguucaccgugauagccuucuuccuggcacacgccaucggcacuagcauaacccaaaaggggaucaucuucaucuugcuuaugcuggugacccccuccauggccaugcggugcgucggcaucggcaaucgcgacuucguggaggggcucagcggcgccacguggguugacgucgugcuggaacacggguccugcgugaccaccauggccaagaacaagcccacucuggacauugagcuccugaagacggagguuacaaaccccgcgguguuacggaagcucugcaucgaggccaagaucagcaacaccaccaccgacucccgcugcccgacccagggcgaggccacucucgucgaggagcaggacgucaacuucguuugccgucgcacauuuguggaccggggcugggguaacggcugcggucuguuuggcaaggggagccuccugacgugcgccaaguucaagugugucaccaagcuggagggcaagaucguacaguacgaaaaccucaaguacuccgugaucgucaccgugcacaccggcgaccaacaccagguugggaacgagacgaccgagcacggcaccaucgccaccaucacgccccaagcgcccacgagcgagauccaacugaccgacuacggugcccugacccucgacugcagcccccgaaccggucuggacuucaacgagauggugcuccucaccaugaaggagaaguccuggcuagugcacaagcagugguucuuagaccucccgcugcccuggaccuccggggccagcaccagccaagagaccuggaaccggcaggaccugcucgugacguucaagaccgcccacgcaaagaagcaggaggucguggugcucggcagccaggagggcgcgaugcacaccgcccugaccggggcgacggagauccagaccagugguacaacgacgaucuucgccggucaccucaagugccgccugaagauggacaagcugacccucaagggcauguccuacgugaugugcaccggcucauucaagcuggaaaaggagguggccgaaacccagcauggcacgguccugguccaggugaaguacgagggcaccgacgcgcccugcaagauccccuucaguacacaggacgagaaggggguaacccagaacggccggcugauuacggccaacccuauugugaccgauaaggagaagcccgugaacaucgagaccgagccgccauuuggggagagcuacaucgucgugggcgccggcgagaaggcccucaagcugucaugguucaagcgggggagcuccaucggcaagauguucgaagcgaccgcccgcggggcgcggcguauggccauccugggugacacggcgugggacuucggcagcauaggcggcguguucaccuccguggggaaacucgugcaccaggucuucggcaccgcguacgguguccuguucagcgggguguccuggaccaugaagaucgggaucggcauccuguugacguggcugggccugaacagccgguccaccucucucuccaugaccugcaucgccguggggauggucacccucuaccugggggugauggugcaggccgacagcgggugcgucaucaacuggaagggacgcgagcucaagugcggcuccgguauauucgugacgaacgaagugcacaccuggaccgaacaguacaaauuccaggcagacaguccgaagcggcugagcgccgccauuggcaaggccugggaggagggggucugcggcauccgaagcgccacccggcuggagaacaucauguggaagcaaaucagcaacgaacugaaccacauucugcuggagaacgacaugaaguucaccguuguggucggggacgccaacggaauccucgcccaggggaagaagaugauccgcccccagcccauggaauacaaguauuccuggaaguccuggggcaaggcgaagaucaucggcgccgauauccagaauacgaccuucaucaucgacgggcccgacaccccggagugucccgacggccagcgggccuggaacaucugggagguggaggacuacgguuucggcguguucaccacgaacaucuggcugaaacugcgagacuccuauacccagaugugcgaccaccggcucaugagcgccgcgauaaaggacuccaaagccguacacgccgacaugggcuacuggaucgagagcgagaagaacgagaccuggaagcucgcccgcgccuccuucaucgaggugaagaccugcaccuggcccaagagccacacccugugguccaacggggugcucgagagcgagaugaucauccccaagaucuucggcgggccaaucucacagcacaacuaccggcccggcuacuucacccagaccgcggggccuuggcaucugggcaagcuggaguuagacuucgaccugugugagggcacgaccgucguggucgacgagcacugcgggaaccgcggcccgagucugcggaccaccacgguaaccgggaagauaauacacgaguggugcugccgcuccugcacucugccgccacugcgguuucgcggcgaagacgguugcugguauggcauggagauccggcccgugaaggagaaggaggagaaccuggugcgcagcauggucuccgccggcagcggggagguggacagcuucucccucggcauccugugcgugagcaucaugaucgaggagguaaugcggucccgcuggagccgcaagauguuaaugaccgggacguuagccgucuuccugcugcucaucaugggccaguugacuuggaacgaccugauucgucucugcaucauggugggggcgaaugccuccgaccgcaugggcauggggacgaccuaccuggcccugauggccacguucaagaugcggccgauguucgccgucgggcuucuguuccgccgacugaccagccgcgaagugcuccugcugaccaucgguuuaucccuggucgccagcguggagcugcccaacucccucgaggaguugggagacggccuggccaugggcaucaugaugcucaagcugcugaccgaguuccagccccaccaguuauggacgaccuugcugagccucaccuucguaaaaaccacgcugucccuggacuacgcguggaaaaccaccgccaugguauugagcaucgugucgcuguucccacugugccucagcacgacgucccagaagaccaccuggcugccugugcugcucgggaguuucggcugcaagccccugacuauguuccugaucaccgagaacaagaucugggggcggaaguccuggccgcucaacgagggcaucauggcuaucgggaucgucucuauccugcuguccagccuucugaagaacgacgugccccuggccggcccgcucaucgcgggcgggaugcugaucgccugcuaugugaucagcggguccucagcagaucugucccuugagaaggccgccgaagucucaugggagcaagaggccgagcacaguggugccagccacaacauccuuguugaggugcaggacgacgguacaaugaagaucaaggacgaggagagagaugacacccugacuauacuccugaaggccaccuugcucgcugucuccgguguguacccuaugagcauccccgccacgcuguucgugugguacuuuuggcagaagaagaagcagcgguccggcguccugugggacacccccuccccccccgagguggagcgcgcggugcuggacgacggcaucuaccggauccuacaacgcggguuacugggucggucccagguagggguggggguguuccaggacggggucuuccacacgauguggcacgugaccagaggcgccgugcucauguaucaggguaaacgccuggaacccucgugggccuccgucaagaaggaccugauaagcuacgggggcggguggcgcuuccaaggcuccuggaacacgggggaggagguacaggugaucgccguugagcccggcaaaaacccgaagaacgugcagacuacccccggcaccuucaagacgcccgaaggggaggugggcgcaaucgcgcucgacuucaagcccgggacuagcggcuccccgauagucaaccgggagggcaagaucguggggcuauacggcaacgggguggugaccaccagcggcacguacgugucugcgauagcccaagccaaggccagccaggaggggccgcuucccgagaucgaggacgagguguucaagaagcgcaaccucaccaucauggaccugcacccgggcucggggaagacccggcgcuaccugccugcgaucgucagggaggcuaucaagcgcaagcuccgcacacugauacuggcccccacgcgggucguggccuccgagauggcggaggcccucaaggggaugccuauccgcuaccagacaaccgccgucaagagcgagcacacaggacgcgagaucguugaccugaugugccacgccacguucaccaugcgccuccucuccccggugcggguccccaacuacaacaugaucaucauggacgaggcgcacuucaccgaccccgcaagcaucgccgcucgcggguacauauccacgcggguaggcaugggggaggccgcggcgaucuucaugacggccacgccacccggcagcguggaagcuuuuccccaaagcaacgccgucauacaggacgaggagcgcgacauccccgagcggagcuggaacuccgguuacgacuggauugcggacuuccccgggaagaccgugugguucgugcccagcaucaaauccggcaacgacaucgcgaacugccuccgcaagaacgggaaaagggucauccaacugagccgcaagaccuucgacacggaguaccagaagaccaagaauaacgacugggauuacguggugaccacugacaucuccgagaugggcgccaacuuccgggccgauagggucaucgacccccggcgcugccucaagcccgugauccugaaggaugggcccgagcgggucauccuggccggcccgaugccagucacgguggcauccgcagcccagcgccggggccguaucgggcgcaaccaaaacaaggagggagaccaguacgucuacaugggucagccucucaacaacgacgaggaccacgcccacuggaccgaggccaaaaugcugcuggacaacaucaacacccccgagggcaucaucccggcccucuucgagcccgagagagaaaaguccgccgccauugacggggaauaccgccugcggggcgaggcccgcaagaccuucguagagcugaugcggcgcggcgaccuccccguguggcugagcuacaaggucgccuccgagggguuccaauacagcgaucggcgcugguguuucgacggcgagcggaacaaucaggugcuggaggagaacauggacguggagaucuggacuaaggagggggaacgaaagaagcuccggccccgcuggcuggaugcgcggaccuacuccgacccgcuggcccuccgcgaguucaaggaguucgccgccggccgacgcagcgucagcggcgaccugauccuggaaaucgggaaacucccccaacacuuaacccugcgcgcccaaaacgcgcucgauaaccuggugaugcugcacaacuccgagcaaggcgggaaggccuaucgacaugccauggaggagcucccugacaccaucgaaacccugaugcugcucgcccugauagcggugcugacgggcggggucacccucuucuucuuaagcggcaagggcuuggggaagaccucaauugggcuccuaugugugacagccagcuccgccuuacucuggauggccagcguggagccccacuggaucgccgcguccaucauccuggaguucuuccugauggugcuccuaaucccggagcccgaccggcagaggacgccccaggauaaccaacuggccuacgugguaaucgguuugcuguucaugauccugacugucgccgccaacgagaugggccuccuagagaccaccaagaaggauuuggggaucggcuacgucgcagccgagaaccaccagcacgccacaaugcucgacguugaccugcauccggccagcgccuggacccuuuaugccgucgcgaccacagugaucacgcccaugaugcggcacaccauagaaaacaccaccgccaacaucucccucacggccaucgccaaccaggcggcgauccugaugggccuggacaagggguggcccaucagcaagauggacaucggcgugccccuccuggcacugggguguuacucccaggucaacccccuuacccugaccgccgccgugcuuaugcucguggcucacuacgcaaucaucggccccgggcugcaggccaaggccacccgcgaggcacagaagcgcacugcagccggcaucaugaagaaccccacagucgauggcaucguggccaucgaccuggaccccguggucuacgacgccaaauucgagaagcaacucgggcagauaaugcugcugauccucugcaccagccagauccugcugaugcggacuacgugggccuuaugcgagagcauaacccuggcuaccggcccacugacgacgcucugggaggggucccccggcaaguucuggaacaccaccaucgccguguccauggccaacaucuuccguggaagcuaccuggccggcgccggccuggcguucucccugaugaagucccucgggggcgggcggcgcgggacgggcgcccagggggagacgcugggcgagaaguggaagcggcagcucaaccagcuguccaagagcgaguucaacacguacaagcgcagcggaaucauggagguggaccgguccgaggcgaaggagggccucaagcgcggggagaccaccaagcacgccgucagccggggcacggcgaagcuccgcugguucguggagcggaaccuggugaagcccgagggcaaggucaucgaccucgguugcggccgcgggggcuggaguuacuacugugccgggcugaaaaaggugaccgaagugaagggcuacaccaagggcgggccgggccacgaggagccaaucccaauggccacuuacggguggaacuuagucaagcugcacagcggcaaggacguguucuucaugccgccagagaagugcgacacccugcucugcgacaucggggagaguagcccgaaccccacgaucgaagagggccggacccugcgugugcugaaaauggucgagcccuggcuccggggcaaucaguucugcaucaagauccuaaaccccuacaugccguccgugguggagacacuggagcagaugcagcgcaaacauggggggaugcuuguccggaacccacugagccgaaacuccacccacgagauguauugggucagcugcgggacgggcaacaucguguccgcugucaacaugacgagccgcaugcugcucaaccgcuucaccauggcccacaggaagcccaccuacgagcgggacguggaccugggggcagggacgcgccacguggccgucgaacccgagguggcaaaccuggacaucaucggccagcggaucgagaacauuaaaaacgagcacaaguccaccuggcacuacgacgaggacaacccguacaaaaccugggccuaccacggaagcuaugaggucaagcccuccggcucagccagcaguauggugaacggggugguccgccuccugaccaagcccugggacgugaucccgauggucacgcagaucgcgaugaccgacacgaccccguucggccagcagcgggucuucaaggagaagguggacacgcgcacgccccgcgcuaagcgcggcaccacgcagauaauggaggucacagccaaguggcugugggguuuccucucucggaacaagaagccacgcaucugcacccgggaggaguucacccguaagguacggagcaacgccgccaucggcgcgguguucguagacgagaaccaguggaacagcgccaaggaagccgucgaagacgagcgcuucugggaccuggugcaucgggagcgcgagcugcacaaacaggggaaaugcgcgaccugcguguacaacaugaugggcaaacgggagaagaaguuaggggaguuuggcaaggcgaaaggcuccagagccauaugguacauguggcugggcgcccgguuccuggaauucgaggccuugggcuucaugaacgaggaccacugguucaguagggagaauagucugagcggggucgagggcgaggggcugcacaagcucggcuacauccugcgggacaucaguaagauuccgggcgggaacauguacgcagacgacacagcgggcugggacacccgcaucaccgaggacgaccugcagaacgaggccaaaauaacagacaucauggagcccgagcacgcacuucuggccacgagcauauuuaagcugaccuaccagaacaaggucgugcgcguacagcggccggccaagaaugggaccgucauggacguuaucucucgccgggaccagcgcggcagcggccaggucgggaccuacggccucaacacguucaccaacauggagguacagcucauccggcagauggaguccgaggggaucuuucugcccagcgagcucgagaccccgaaccuggcggagagagcccuggauuggcucgagaagcacggcgccgagagguuaaagcgcauggccaucuccggagacgacuguguagucaagcccaucgacgaccgguucgccaccgcccugaccgcccuaaacgacaugggcaaggugcgcaaggauaucccccagugggagcccagcaaaggcuggaacgacuggcagcaggucccguucugcucccaccacuuccaccaacugaucaugaaagacgggagagagaucgugguucccugccgcaaccaggacgaguuggugggccgggcccgcguuagucagggggccgguuggucccuccgggagaccgccugucugggcaagagcuacgcgcagauguggcagcugauguacuuccaccggcgugacuuacgccucgccgccaaugccaucugcuccgcagugccuguggacuggguccccgccagccggaccaccuggagcauacacgcccaccaccaauggaugaccacggaagacaugcuguccguguggaaucgcguauggaucgaggaaaacccguggauggaggacaagacccacgucagcuccugggaggaagugcccuaccucggcaagcgcgaggaccaguggugcggcagccugaucgggcugacugcacgggccacgugggcgacgaacauccagguggccaucaaccagguacgccggcucaucggcaacgagaacuaccuggacuacaugaccucgaugaagcgcuucaagaacgagucggaccccgagggggcccugugguga

SEQ ID NO: 24667 - RNA, 9879 nt, Artificial Sequence
  derived and/or modified CDS sequence (opt11) from DENV-1__KC692500__SS-prME
agcguaaccaugcucuuaaugcugcugccaaccgcgcuugccuuccacuuaaccacccgcggcggggaaccacacaugaucgugagcaagcaagagcggggcaagucgcuccucuucaagaccagcgcgggggugaacauguguacccugauagccauggaccugggcgagcucugcgaagacacgaugacauauaagugcccccgcaucaccgaggccgagcccgaugacguagacugcuggugcaacgccaccgacaccuggguaaccuacggcacaugcagccagaccggcgagcaccggcgcgaaaagcgguccguggcccuggcgccccacgucggccuggggcucgagaccagaaccgaaaccuggaugucaagcgagggugccuggaagcaaauccagcgggucgagaccugggccuugcgucacccgggguucacggugaucgccuucuuccuggcgcacgccaucgguaccagcaucacccagaaggggaucaucuucauccucuuaauguuagugacccccuccauggccaugcggugcgucggcaucggcaaucgcgacuucguggaggggcugagcggcgcaacguggguugacgugguccuugagcaugguucuugcgugaccaccauggccaagaacaagccuaccuuagacaucgagcuccugaagacagaggucacaaaccccgcgguguugcggaagcucugcaucgaggccaagauuagcaacaccaccacggacucccgcugcccgacccagggcgaagcuacccuaguggaggagcaggacgccaacuucgucugccggcgcaccuucguagaccggggaugggggaauggcugcgggcuuuucggcaaggggagucucuuaacgugcgccaaguucaagugcgugacaaagcuggaggguaagaucguacaguacgagaaccucaaguauucaguuaucgugaccguccacaccggcgaccaacaccagguagggaacgagacgaccgaacacggcacaaucgcaaccaucacgccccaggcccccacaagcgagauacaguuaaccgacuacggggcgcugacccucgacuguaguccccguaccggccuggacuucaacgaaaugguccugcucacuaugaaggggaagucguggcuggugcacaagcaaugguuccuggacuuaccuuugcccuggaccuccggcgcaagcaccagccaggagacauggaaucggcaagaccugcucgugacguucaagaccgcccacgcgaagaaacaggaggucguagugcuggggucccaggagggugcgaugcacaccgcccugacgggcgccacggagauccagacuagcgggaccaccacgauauuugccggccaccucaaaugucgcuugaagauggacaagcugacccucaaggggauguccuacgucaugugcaccggcucuuucaagcuggagaaggagguggcggagacccagcacggcacggugcugguccaggugaaguacgaggggacugacgcccccugcaaaaucccguuuuccacccaagaugaaaaggggguuacccaaaacgggcggcugaucacggcaaacccuaucguuacugauaaggagaaacccgugaacaucgagaccgagccgccuuucggugaaagcuauaucguggucggggccggugaaaaagcgcucaagcuguccugguucaaacgcgguagcuccaucgggaagauguuugaagccaccgcccggggcgcccgccgcauggccauccugggggacacggcgugggacuucggcucaaucggcggggucuucaccuccgugggcaaacuuguacaccagguguucgggaccgcauacggggugcuguucagcggcgucuccuggaccaugaagauuggcauagguaucuuacucaccuggcugggucugaacagccgguccacuagccucuccaugaccugcaucgccgugggcauggugacccuguaccugggggugauggugcaggcugacagcggaugcgugaucaacuggaagggccgcgagcucaagugcggauccggcaucuucgucacgaacgaagugcacacuuggaccgagcaguacaaauuccaagccgacucuccgaagcggcugagcgcggccauagggaaggccugggaggaaggggugugcgggauccgcuccgccacucggcuugagaauaucauguggaagcagaucagcaacgaacucaaccauauccugcuugagaacgacaugaaguucacugucguggugggcgacgccaacgggaucuuagcgcagggcaagaagaugauacgcccccagcccauggagcacaaauacuccuggaaguccuggggaaaagccaaaaucaucggggccgacauccagaauacgaccuucauaauagacggccccgacaccccugagugccccgacgggcagcgggccuggaacaucugggaggucgaggacuacggcuucggcguguucaccacgaacaucuggcugaagcugagagacuccuauacccagaugugcgaccaccggcucauguccgcggccaucaaggacuccaaagcgguccacgccgacaugggguacuggaucgagucugagaagaaugagaccuggaagcuggcgcgcgcguccuucaucgaggucaagacaugcacguggcccaagagccacacccugugguccaacgguguauuagagagcgagaugaucauccccaagaucuuugggggcccaaucucccaacacaacuaccggcccggguacuucacccagaccgccggccccuggcaccugggcaagcuagagcucgacuuugacuuaugcgaggggacgacuguggucguggaugagcauugcggcaaccgcgggcccagcuuacggaccacuacggucaccggaaagaucauccacgaguggugcugcagauccugcacccugccgccccugcgguuccgcggggaggacgguugcugguacggcauggaaauccggcccgugaaggaaaaggaggagaaccugguccgcagcaugguguccgccgggaguggcgaggucgacagcuuuucccucgggauccugugcgucucaaucaugaucgaggaggugaugagaucccgcuggagccgcaagaugcuaaugaccggcacgcuggcagucuuccugcugcucaucauggggcagcugaccuggaacgaccugauccgguugugcauuauggugggcgccaacgccuccgaccgcaugggcauggggaccaccuaccuggcccugauggccacguucaagaugagaccgauguuugccgugggacuccuguuccgccggcuuaccucacgcgagguccuccugcugacaaucgggcucucccugguggccucaguggagcugccaaacagucucgaggaacugggagacggccuggccauggggaucaugaugcucaagcugcugacugaguuccagccacaccagcucuggacgacccuguugagccuaaccuuugugaagacgacgcugucccuggacuacgcguggaaaaccaccgccauggugcucagcaucgucucccuguucccccugugucucagcaccacgagucagaagaccacguggcugccgguccugcuuggcagcuucgggugcaaaccucugaccauguuucugaucaccgagaacaagaucuggggccguaaguccuggccccucaaugaagggaucauggccaucggcaucgugagcauccugcugaguucccuccugaagaacgacgucccccuggcgggcccguuaaucgccgguggcauguugaucgcuuguuacgugaucuccggauccagcgccgauuugucguuggagaaggcggcggaagugagcugggagcaggaggccgagcacuccggcgccagccacaacaucuuaguagaggugcaggacgacgggacgaugaagaucaaagacgaggagcgcgacgacacccugaccaucuuacugaaggccacgcugcucgcugugagcggcgucuaccccaugagcauccccgcgacgcuguuugugugguacuucuggcagaagaagaagcagcgcucgggcgugcugugggacacacccagcccucccgaggucgagagagccgugcucgaugacgggaucuaccgcauccugcagcggggccugcuugggcggagccaggugggcguagggguguuccaggauggcgucuuccacaccauguggcaugucacgcgcggcgccgugcucauguaccaggggaagagacuggagcccagcugggcuuccgugaagaaggaucugaucagcuacggugggggcuggcgcuucaagggauccuggaacacgggcgaggagguccaggugaucgcgguggagccaggcaagaacccgaagaacguccagaccacccccgggaccuucaaaacccccgagggcgaagugggggcgauagcccucgacuucaaaccugggacuucggguagcccgauagugaaccgugaggggaagaucgucggccuguaugguaacggcguugugaccaccagcgggacguacgucagcgcgaucgcccaggcaaaggcgagucaggagggucccuuaccugaaaucgaggacgagguguucaagaagcgcaaccucacgaucauggaccugcacccgggcagcggaaagacccgucgcuaccugccggcgaucgugcgggaggccaucaagaggaagcuccgcacccugaucuuggcucccacgcgggucguggccuccgagauggccgaagcgcucaagggcaugcccaucagguaucagacgaccgccgucaagagugagcacacggggcgggaaaucgucgaccugaugugccaugccacguucaccaugcgccugcucucccccgugagggugcccaacuacaacaugaucaucauggaugaggcacacuucaccgaccccgcaagcauagcggcccgcggcuacaucuccacccgggucgggaugggcgaagccgcggccaucuuuaugacggccacgccucccggcagcguggaggccuucccccaguccaacgccguuauccaagacgaggagcgcgacauccccgagcgcagcuggaacuccggguaugacuggaucaccgauuuccccggcaaaaccgucugguucgugcccagcaucaagucugggaacgauauagcgaacugucugcguaagaacggcaaacgggugauccaguuaucgagaaagacguucgacaccgaguaccagaagaccaagaacaacgacugggauuacgucgugaccacggauaucuccgagaugggagcgaacuuccgagcggaccgcgucaucgacccccggagaugucucaaacccguuauccugaaggacggccccgagcgggugauucuggccggcccgaugccugucacaguggcgagcgccgcccagcgcagagggcgcaucggccgcaaccagaacaaggaaggggaccaguacguguacaugggccagccccucaauaacgaugaggaucaugcgcauuggaccgaggccaagauguuacuagacaacauuaacacccccgaggggaucauuccggcucucuucgagcccgagcgggagaaauccgccgccaucgauggcgaguaccgccugcggggcgaggcccgcaagacguucguagaacugaugcggagaggggaccucccaguguggcugagcuacaagguggcauccgagggcuuccaguauagcgaccggcgcuggugcuucgacggggagagaaauaaccaggugcuugaggagaacauggauguggaaaucuggaccaaggagggcgagcgcaagaagcuccgcccccgcuggcuggaugcgcguaccuacucagacccacuggcccuccgcgaguucaaagaguucgcugccgggcggagaagcgucagcggggaccugauccuggagauaggcaagcucccccagcaccugacacugcgggcccagaacgcguuggacaaccuggucaugcugcauaacuccgaacagggcgggaaggcuuaccgccaugccauggaggaacuccccgacaccaucgagacccugaugcugcucgcucugaucgccgugcugacagggggcgugacccucuuuuuccugagcggcaagggauuggguaagaccuccaucgggcucuuaugcgucacggcaagcuccgccuuacucuggauggccagcguggagccccacuggaucgccgcguccaucaucuuggaguucuuccugauggugcuccugaucccggagcccgaccggcagaggacgccucaagacaaccagcuggccuacgucgugaucggccuucuguucaugaucuuaacaguggcggcuaacgagauggggcuacuggagaccacgaagaaggaucugggcauuggauacguggccgcggagaaccaccagcacgccacaaugcucgacguggaccugcacccggccagcgcauggacccuguacgccguggcgaccacggucauaacccccaugaugcggcacaccaucgagaacaccacggccaacaucucccucaccgccaucgcuaaccaggcagcgauccugauggggcuggacaagggcuggcccaucucuaagauggacaucggggugcccuugcuugcgcugggcugcuacucacaggugaacccgcucacucuaaccgcagccguccugaugcuggucgcgcacuacgccaucauaggacccggccuucaggccaaggccacgcgcgaggcacagaagagaaccgcggccgggauaaugaagaaccccaccguggacggaaucguagccaucgaccuggacccugugguguacgacgcgaaguuugagaagcaacucgggcagaucaugcuacuaauccuaugcaccagccagauccugcugaugaggacgacuugggcccucugugaauccaucacccuagccaccgggccacugacgacccucugggagggcucccccggcaaguucuggaacaccaccauagccgucuccauggccaacauauuccgcgggucguaccuggccggcgccgggcuagcguucucccucaugaaaucccugggcggcggccggcgcgguaccggggcccagggcgagaccuuaggggagaaauggaagagacagcucaaucagcuguccaagagcgaguucaacaccuacaagcgcagcggcaucauggaggucgaccgguccgaagcaaaggaggggcugaagcgcggcgagacgacgaagcacgccgugagucggggcacagccaaacugcguugguucgucgagcggaacuugguaaaacccgaagggaaggugaucgaccuaggcugcgggcguggagggugguccuacuacugcgccgggcugaagaaggucaccgagguuaagggcuacaccaagggcgggcccgggcacgaggagccgaucccuauggcaaccuacggcuggaaccucgugaagcugcacagcgggaaggaugucuucuuuaugccgccagagaagugcgacacgcugcucugugacaucggcgaaucgagcccgaaucccaccaucgaggagggacggaccuuacgugugcuaaagaugguggagcccugguuaagagggaaccaguucugcaucaagauccugaaucccuacaugccguccgucgucgagacccuggagcagaugcaacgcaagcacggcgggaugcucgugcggaacccacugagccguaacuccacgcacgagauguacugggucucgugcggcaccggcaacaucguguccgccgugaacaugaccagccggaugcuacucaaccgguucaccauggcacaccguaagcccacguacgaacgggacgucgaccugggggcuggcacccgucacguagcaguggagcccgagguugcgaaccuggauaucaucgggcaacggaucgagaauaucaaaaaugagcacaaauccacguggcacuacgacgaggacaacccauacaagaccugggccuaccacggcucguacgagguaaagcccuccgggagcgccuccucuauggucaacggcguggugcgccuccugacgaaacccugggacgucauccccauggugacccaaaucgcgaugaccgacaccacgccuuucggccagcagcggguguucaaggagaaagucgacacccgcacgccccgggccaagcgggggacuacgcagaucauggaagugaccgccaaguggcuguggggguucuugucccggaacaaaaagccccgcaucugcacuagggaggaauuuacgcgcaaggugcgcagcaacgcggccaucggugcggucuuuguggacgagaaucaguggaacuccgcgaaggaggccguggaggacgagcgcuuuugggacuuaguccaccgggagagagaacuacauaagcagggcaagugcgccacguguguguacaacaugauggggaagcgggaaaagaagcucggcgaguucggcaaggcgaaagggagucgcgccauaugguacauguggcugggggcccguuuccucgaguuugaggcccuaggguucaugaacgaagaccauugguuuagucgagaaaauucccugagcggcguggaaggggaaggccugcauaaguuaggcuacauccugagggacaucuccaagauccccggugggaacauguacgccgacgauaccgcggggugggacacccgcaucaccgaggaugaccuacaaaacgaggccaagauaacggacaucauggagccggagcacgcccugcuggccaccagcaucuucaagcucaccuaccagaacaaggucgugagagugcaacggcccgcgaagaaugggacuguaauggacgugaucucccgccgggaccagcgcggcucaggccaggugggcaccuacggacucaacaccuucaccaauauggagguccaguuaauacggcagauggaauccgagggcauauuucucccuagcgagcucgagacgccuaacuuagcggagcgcgcgcuggacuggcucgagaagcauggggccgagcgccuaaagcgcauggccaucuccggcgacgauugcguggucaagccaaucgacgaccgcuucgccacggcgcugacagcccucaacgacaugggcaagguucggaaggacaucccccagugggagcccucaaagggauggaaugauuggcagcaagucccguucugcagucaccacuuccaccaacucaucaugaaggacggccgagagaucguggugcccugccgcaaccaggacgagcugguggggcgugcgagagugagccagggcgccggguggucgcugagagagaccgccugccugggcaaguccuacgcgcagauguggcagcugauguauuuucaucgcagggaccuccggcuggccgccaacgcgaucugcuccgcaguccccguggacuggguacccgcaagcagaacaacuuggucuauucacgcgcaccaccaguggaugacgacggaggacaugcuguccgucuggaaccgcguguggaucgaggaaaaccccuggauggaggauaagacccacguuucuuccugggaggagguucccuaccucggcaaacgcgaggaccagugguguggcagccugaucggccugaccgcccgggcuacaugggcgaccaacauccaggucgcgauuaaccaggugcgccggcucaucgggaacgaaaacuaccuggacuacaugaccuccaugaagcgcuucaaaaacgagucagaccccgaaggcgcccuaugguaa

SEQ ID NO: 24668 - RNA, 9879 nt, Artificial Sequence
  derived and/or modified CDS sequence (opt11) from DENV-1__KC692501__SS-prME
agcgugacuaugcugcucaugcugcugcccaccgcccucgcguuccaccuaacuacacggggcggggaaccacacaugaucguuuccaaacaagagcggggcaagagcuuacucuucaagaccagcgcgggggugaauauguguacccugaucgccauggaccugggcgagcuuugcgaggauaccaugaccuacaaguguccucgaauaacugaagcggagcccgacgacguggacugcugguguaacgcaacagacacuugggugaccuaugggaccugcagccagaccggcgagcaucggcgcgagaagcgguccguggcgcuggcgccacacgugggccuggggcuggagacccgcaccgagaccuggaugagcucagaaggcgcauggaagcagauucagcgugucgagaccugggcccuacgccaccccgguuuuacggugaucgccuucuuucuggcucaugccauuggcacaagcaucacccagaagggaaucaucuucauccuccugaugcucgugacuccguccauggccaugcggugcguaggaauuggaaaccgcgauuucguggaagggcucagcggcgccaccuggguggacguagugcuggagcacggguccugcgucaccaccauggccaagaauaagcccacccuggacaucgagcuccugaagacggaagucaccaaccccgcgguucugcguaagcuaugcaucgaggcuaagauuucaaacaccaccacggacucccggugcccgacgcaaggcgaagccacccugguggaagagcaggacgccaacuucgucugucggagaaccuuuguggaccgggggugggguaacggcugugggcuguucggaaagggaucgcuccugacgugcgcuaaauuuaaguguguuacaaaguuagaaggaaagaucguccaauacgaaaaccucaaguacuccguuauuguuaccguccacaccggcgaccagcaccagguggggaacgagacgaccgagcacgguaccauugcgacuauuacgccucaggcccccacgagcgagauucaacugaccgauuacggggcucugacacucgacugcucaccccgcaccgggcuggacuucaacgagaugguccugcucacgaugaaggagaaauccugguuagugcacaagcagugguuccuugaucucccacuucccuggacauccggggccuccaccagccaggagacguggaacaggcaggaccuguuggugacguucaagaccgcacacgcgaaaaagcaggaggucguaguucugggcucgcaggaaggggccaugcacaccgcccucaccggggcaacggagauccagacaagcgguaccaccacaaucuucgccgggcaucucaaaugccgucugaagauggacaaguugacauugaagggcauguccuacguuauguguacugggagcuucaagcucgagaaggaagucgcugagacccaacacggcacggugcuaguccagguaaaguaugagggcaccgacgccccaugcaagauuccuuucucaacccaagacgagaagggggugacccagaacgggcgucugaucacugcaaauccuauugucacugacaaagagaagcccguuaacauugagaccgagccucccuucggugagagcuacaucgucgucggagccggugagaaagcgcucaagcugucgugguuuaagcgcgggagcaguauuggcaagauguucgaagcaaccgcgagaggagcacggcgcauggcuauccugggggacacggcgugggacuuugggagcaucggcggcguguuuaccucgguggggaagcucguccaccaggucuucggcaccgccuauggcgugcuguucaguggagucucauggaccaugaagauugggauaggcauucugcucacguggcugggcuugaauagccgguccaccagccugaguaugaccuguaucgcaguggggaugguuacucucuaccugggcgugauggugcaggccgauuccgggugugugaucaacuggaagggucgagagcucaaauguggauccggcaucuucgucacgaacgagguucacaccuggaccgagcaauacaaguuccaggcagacagcccgaagcgguugagcgcggcgaucggcaaggccugggaagagggggugugcgguauccgauccgccaccagacuagagaacaucauguggaagcagaucagcaaugaacuaaaccacauacugcuggagaacgauaugaaguucacggucguggugggggacgccaauggcauucucgcgcagggaaaaaagaugauccgcccccagccuauggagcacaaguacuccuggaagucuuggggcaaggcuaagaucaucggcgccgauauccagaauaccaccuucauaaucgacgggccggacaccccggagugccccgacggucagcgugcauggaacaucugggaggucgaggacuauggguucgggguguucaccacgaacaucuggcucaagcugagagacuccuacacgcagaugugcgaccaucguuugaugagcgcggccauuaaggacuccaaggcaguccacgccgauaugggcuacuggaucgagagcgagaagaaugagaccuggaagcuggcccgcgccuccuucauagaggucaagacaugcacguggcccaagagccacacccucugguccaaugguguccucgagagcgagaugaucauccccaagaucuucggaggcccgauaagucaacauaacuaccggcccggcuacuucacacagaccgccggucccuggcaccugggcaagcuggagcucgacuucgaccugugcgagggcaccaccguggucgucgacgagcacugcgggaacaggggcccgucucugcgcacgacgacggugacagggaagaucauccacgaguggugcugccgcucguguacucugccgccgcugcgguuccgcggcgaggacggguguugguacggcauggagauacggccggucaaggaaaaggaggagaaucucgugcgcagcaugguguccgccggcucaggggagguagacaguuucucccuaggaauucuaugcgugagcaucaugaucgaggaggucaugcgaucccgcuggagccguaaaaugcugaugacuggaacacucgcugucuuccugcugcuuaucaugggccagcuaaccuggaacgaccugauccggcucugcaucauggugggggcgaacgccucagacaggaugggcaugggcacuaccuaccuggcccugauggccacguucaaaaugcggccgauguucgccgucggguuauuauuccgccggcugaccagccgcgagguacuccugcuuacuaucggccucucccugguggcgucugucgagcugcccaacucacucgaggaacuaggggaugguuuggcuaugggcaucaugaugcucaagcugcucaccgaauuucagccccaccagcucuggacgacgcugcugucccucaccuuugugaagacgacgcuguccuuggauuacgcguggaagaccaccgccaugguccucagcaucgugucccuuuucccacugugccucaguaccacaucccagaagacaaccuggcugccgguucugcucgggucguucgguuguaaaccccugacgauguuucuaaucaccgagaacaaaauuugggggagaaagucuuggccgcucaaugaaggcauuauggcgaucgggaucgugucaauccugcucuccagcuuacugaagaacgacgucccccuugcgggcccgcuuauagcaggcgguaugcugauugccugcuaugugauaagcggcucaagcgccgaccugucccucgaaaaggcagcggaaguaagcugggaacaggaggccgaacacuccggggccagccacaauauccuggucgaagugcaggacgacgggacgaugaaaaucaaggacgaggagcgcgaugauacacuuaccauccuacuuaaggccaccuuacucgcggugaguggcguguaccccaugaguauacccgcgacgcuguucgucugguauuucuggcaaaagaagaagcagcgguccggcguguuaugggacacuccaagcccccccgaggucgagcgcgcggugcucgaugacggcauauaccguauccuccagcgcggucugcuaggcaggucccaggugggggucgguguguuucaagacgggguguuccacacgauguggcacguaacccgcggcgcugugcucauguaccagggaaaaaggcuggagcccagcugggccuccgugaagaaagaucugaucucguacgggggcggguggcgcuuccagggcuccuggaauacgggggaggagguacagguaaucgccguagaacccggcaagaacccgaagaauguccaaaccaccccgggcaccuucaagacccccgagggagaggugggcgcgaucgcccuagacuuuaaacccgggaccucuggcucaccuauuguuaaccgggaggagaaaaucgucggccuguaugguaacggggugguuaccaccagcgggacguauguauccgcgaucgcucaggccaaggcgagccaagaggguccccuucccgagaucgaggaugagguguucaagaaacgaaaucucaccaucauggaccuccacccggggagcgggaagacgcggcgcuaccugcccgcuaucgugcgggaggccaucaagcguaaacuccgcacuuugauacuggcccccacgcgggucguggcgagcgagauggccgaggcgcucaaaggcaugccgaucagauaccagaccaccgcgguaaagagcgagcauaccggacgggagaucgucgaccugaugugccacgcaacguucaccaugcgacugcucuccccggugcgcgugccgaacuauaauaugauaauuauggaugaggcgcacuucaccgaccccgccaguaucgcagcccgcggcuacauauccacgcgugucggcaugggugaggccgccgccauauucaugacagccacgccacccggcagcguagaggccuuuccccaguccaacgccgugauccaagacgaggagcgcgacaucccggagcgguccuggaacuccggcuacgacuggauuaccgacuuccccgggaaaacggucugguucgucccgagcaucaagucagggaacgacaucgcgaauugccuacgcaagaacggcaagcgggugauucaacugagccgaaagacguucgacaccgaguaccagaagacgaagaauaacgacugggacuaugucgugaccacggacaucagcgagaugggugccaacuuucgggccgaucgcgugauugacccgaggcgcugucucaaaccggucauccugaaggacggcccagagcgggugauacuggccggaccgaugccgguaacgguggcuucggccgcccaacgucguggcaggauugggcgcaaccaaaacaaggagggugaccaguauguguacaugggacagccccucaacaaugacgaagaccaugcacacuggacggaggcgaagaugcuacuggacaacaucaacacaccagagggcaucauuccugcgcucuuugagcccgaacgggaaaagucugcagcaaucgacggcgaguaucgccugcgcggagaggccagaaagacauucgucgagcugaugcgucgcggggaccuacccguguggcugagcuacaagguggccuccgagggcuuccaauacagugaccggcgcuggugcuuugauggggagcggaacaaccaaguccuagaagagaacauggauguggagaucuggacgaaggagggcgagcgcaagaagcuccggccacgcuggcucgacgcgcggaccuacucugacccucuggcccucagagaguucaaggaauucgccgccgggcggcgcagcguaucuggcgaucugaucuuagagauuggcaagcuaccccagcaccuaacccugcgggcccagaacgcguuagacaacuuaguuauguugcacaacuccgagcaaggaggcaaggccuaccgccaugccauggaggaacuccccgacacgaucgagacccugaugcuucucgccuuaauugcggugcugacagggggcgugacccucuucuuccugagcgguaaggggcuggggaaaaccuccaucggucuguuaugcgucacggcuucguccgcccuccuguggauggccaguguggaaccccacuggaucgccgcguccaucauccuggaguucuuccuuauggugcuccugaucccggagcccgaccgacagcgcacgccucaggacaaccaacuggccuacgucguaauuggccuacuuuucaugauuuugacaguggccgcuaacgaaaugggacuccuggagacgacaaagaaggacuugggcauaggcuacguagccgcagaaaaccaccagcaugcaacuaugcucgacguggacuugcaccccgccagcgccuggacccucuacgccguggcgaccacggucaucacgcccaugaugagacacaccaucgagaauacgacggccaacauaagccucaccgccaucgcgaaccaagccgccauucugaugggacuggauaagggcuggcccaucagcaaaauggacaucggagugcccuugcuagcgcugggaugcuacucucaagugaacccguuaacacugaccgccgcagucuuaaugcucguggcgcauuacgcaauuaucgggcccggccugcaagcgaaggcaacgcgcgaagcucagaagcgcaccgcggcugggaucaugaagaaucccaccgucgacggcauagucgccauugaccuggacccagugguguacgacgccaaguucgaaaagcaacucggacagaucaugcuguugauccucugcaccagccaaaucuuacugaugcggacgaccugggcuuugugcgagagcaucacgcuggcaaccgggccgcugacgacccuuugggaaggcagucccgggaaguucuggaacaccaccaucgccgucuccauggccaacaucuucaggggcagcuaccuggcgggcgccgggcuugcauucucccucaugaaguccuuaggcgggggccgccgggguacgggcgcacagggugaaacccucggggaaaaguggaagaggcaacuaaaccaacugagcaaaagcgaauucaacaccuacaagcgcagcggcaucauggaaguggacagaagcgaggcuaaagaggggcuuaaacggggggagacaacaaagcacgccgugucacgggguaccgcuaaguugcggugguucgucgagcggaacuuagugaagcccgaagguaaggugauugaccugggcugcggucggggcgguuggagcuauuacugcgcaggguuaaagaaagucaccgaggugaagggauacacaaagggcggucccgggcacgaggagccgaucccaauggcaacguauggcuggaaccucgugaaguugcacagcggcaaggacguguucuucaugccgcccgagaagugcgauacacuccucugcgacauuggcgaguccagccccaacccgaccaucgaggagggccgaacccugcgcgugcugaagaugguggagcccuggcuacggggcaaccaguuuugcaucaagaucuugaacccuuacaugccguccgucguggagacccuggagcaaaugcaacgaaaacauggcgggauguuggugcggaauccucugucgcgcaacuccacucacgagauguacuggguaagcuguggcaccggaaacaucguguccgccgugaauaugaccucgagaauguugcucaaccgcuucaccauggcccacagaaagcccacguacgagagggacgucgaucucggggcgggcaccagacacguggccguggagccugagguggccaaccuggacauuauugggcagcgaauugagaacauaaaaaaugagcacaaauccaccuggcacuacgacgaggacaacccguacaaaaccugggcguaccacggcagcuacgaagugaaacccagugguagcgccuccaguauggugaacggcguugugcgcuugcugacgaagcccugggacgucauuccuauggugacccagauugcgaugaccgacaccacgccguuuggccagcagcggguguucaaagagaagguggacaccagaacgcccagagccaagcgcggcaccacucagaucauggaagugaccgcgaagugguuauggggguuccugucccggaacaaaaagccccguaucugcacucgggaggaguuuacccgcaagguacggagcaacgcugccaucggggcuguguucguggacgagaaccaguggaacagcgccaaggaggccguggaggacgaacgcuucugggaucucguccaccgggagagagaguuacauaagcagggcaagugcgccacgugcguguacaacaugauggguaagcgggagaagaagcucggcgaguucgggaaagcgaaaggcagucgcgcaaucugguacauguggcugggcgcccgguuccuggaguucgaggcacucggguucaugaacgaggaccacugguucagccgcgagaauagccugagcggcguugaaggggaggggcugcauaagcucggguauauccugcgggacauauccaagauuccgggcggcaauauguacgcagacgacacggcggggugggacacucgcauaacggaggacgauuuacagaaugaagccaagauuacggacaucauggagccagagcacgcgcugcuugcgacgagcaucuuuaagcugaccuaccaaaacaaagucgugcgcguacagcggccggccaaaaacggcaccgucauggacguaaucucccggcgcgaucagagggggagcggucaggugggcacguacgggcucaauaccuucaccaacauggaaguucagcugauccggcagauggaguccgagggcaucuuccuccccucugagcucgagaccccgaaccuggcggagcgugcccuugacuggcucgagaagcacggggccgagcggcuaaagcgcauggccaucuccggcgacgacugcgugguuaagccaaucgaugaccgguucgcuaccgcccugaccgcccucaacgacauggggaagguucgcaaggauaucccgcagugggagcccucaaaaggauggaaugacuggcagcaagucccguucugcucccaccacuuccaccagcugauaaugaaggacggccgggaaaucgugguccccugccgcaaccaggacgaacugguggggcgggcccgcgugucacagggagccggguggucacuccgggagacagccugccugggcaagagcuacgcgcagauguggcagcugauguacuuccaccgccgugaccuucgccuggcugccaaugccaucugcagugcgguccccguggacuggguacccgccagccggaccaccuggagcauccacgcccaucaucaauggaugacgaccgaggauaugcuuucagucuggaaccggguauggauagaggaaaaucccuggauggaggacaagacccacgugagcucaugggaggagguccccuaccucgggaagcgcgaggaccagugguguggcagcuugaucggucugacggcccgggcuacgugggcaaccaacauccaaguggccaucaaccaagugcgccggcucaucgguaacgagaacuaccuggacuacaugaccuccaugaagcgcuucaagaaugaguccgaucccgagggcgcccugugguga

SEQ ID NO: 24669 - RNA, 9879 nt, Artificial Sequence
  derived and/or modified CDS sequence (opt11) from DENV-1__KC692502__SS-prME
agcgugacgaugcuacucaugcugcuccccacugcacuugcguuucaccucacuacccgcgguggcgaaccccacaugauuguguccaaacaggaacggggcaagagccuccuguucaagacuagcgcgggggugaauauguguaccuugaucgcuauggaccugggcgaacucugcgaagacacgaugacauacaaaugcccccggauuaccgaagccgagccagacgauguggauuguugguguaacgcgaccgauaccuggguuaccuacgggaccugcagccagacgggcgagcaccggcgugagaaacgauccguugcccuggcaccgcacguggguuuagggcucgaaacccgaacagagaccuggaugagcagcgagggggccuggaagcagauccagcgaguggagacuugggcccugcgccacccgggguucacggugaucgcauucuuccuggcgcacgccaucgggaccagcauuacccagaaggggaucaucuucauacuccugaugcugguuacccccuccauggcuaugcgcugcgucggcaucggaaaucgcgacuucguggaaggucuauccggcgccaccuggguggacguggucuuggagcacgggucaugcgucaccaccauggccaagaacaagccaacucuggacaucgaacuccuaaaaaccgaggucacaaaucccgcggugcuacgaaaacucugcaucgaagccaagaucuccaauacuaccacggacucuaggugcccuacccagggcgaggccacccuagucgaggaacaagacgcuaauuucgugugucggcgcaccuuugucgaccggggcugggggaacgguugcgggcuuuucgggaaggggagccuuuugacaugcgccaaauucaagugugugaccaagcuggaaggcaagaucguccaguacgagaaucucaaauacucgguuaucgugacugugcauaccggcgaccaacaccaggugggaaacgagacgaccgaacacggcaccaucgccacuauuacgccucaggcacccacuagcgaaauacagcuuaccgacuauggcgcccugacccucgacugcucgccacguaccggucuugacuuuaacgagaugguccuacucacgaugaaggagaaguccuggcugguacauaaacagugguuucucgaccucccgcugcccuggaccucaggugcgagcacaagccaagagaccuggaaccggcaagaccucuuagugacguucaagacugcgcaugcgaagaaacaggaggucgugguacuuggcucucaggagggcgccaugcacacugcccugaccggggcgaccgagauccaaaccagcgguacaaccacuaucuucgccggccaucucaagugucgccugaagauggacaagcugaccuugaagggcguauccuaugugaugugcaccgggagcuucaaguuagagaaggaaguagcggagacccagcacggcacaguccuuguccaggugaaauacgaaggcacagaugcucccuguaagauccccuucuccacacaggacgagaaggggguuacucagaacggccgccugaucacagccaacccaaucgugaccgacaaggaaaagccagugaacaucgagaccgagccaccguuuggggagucauacauagucgucggcgcgggcgagaaggcgcucaaacuauccugguucaagcgagggaguuccaucggcaaaauguucgaggccacugcacguggggcgcgaaggauggccauccugggcgacacggcaugggacuuuggaagcaucggagggguguucaccuccgucgggaagcuagugcaccagguguucggcaccgcuuacgggguucuguuuagcggcguaaguuggacuaugaagaucgggaucggcauucugcucaccuggcugggccugaacagccggagcaccucgcuuuccaugacuuguaucgccguugggauggucacgcuguaccuuggugugauggugcaggcggauagcgguugcguuauuaauuggaaaggacgcgaacugaaaugcggcucgggcaucuuugugacgaacgaaguccacaccuggacagagcaauacaaguuccaagcugacucucccaagcggcuuagcgcagccauuggcaaggcgugggaggagggggucugugguauuagguccgcgacccgacuggaaaacaucauguggaagcaaaucagcaacgagcucaaccacauccucuuggagaacgauaugaaguucaccgugguagucggugaugccaacggcauacucgcccaggggaagaaaaugauccggccccaaccuauggagcacaaguacuccuggaaaucuugggggaaagcgaaaaucaucggcgccgacauccagaauacgaccuuuaucauugacggcccugacacgccagaaugccccgauggccaacgggcuuggaauauaugggaaguggaagacuacggauucgggguauucaccacgaacaucuggcugaagcugcgcgacagcuauacacagaugugcgaucaccgguuaaugagcgcggccaucaaggacucaaaggcuguucacgcagauauggguuauuggauagagagcgagaagaacgagacguggaagcuggcccgcgcauccuucauugagguuaaaacgugcacuuggcccaagucucauacgcuguggucgaauggggugcucgagucugagaugaucauuccuaagauauucggcggaccgauuucccagcauaacuaccggccuggcuacuuuacccagacggcaggccccuggcaucugggaaagcucgaacuggauuucgaccuuugcgagggcacgacuguagugguggacgaacacugugggaaccggggcccgagccugaggacgacaaccgucacagggaagauuauucacgaguggugcuguagguccugcacccugccgccacugagauuccgaggcgaagacgggugcugguacgguauggagauccggccugugaaggagaaagaggagaacuuggugcgcagcaugguuuccgccggcagcggggagguagauucuuuuucccuagggauucugugcgugagcauuaugauugaggaagugaugcggucccgcuggucucgcaagaugcugaugacggggacacucgcgguguuccugcugcucaucaugggccagcugaccuggaaugacuugauucggcucugcauaaugguuggggcgaacgcguccgaucgcauggguauggggaccacuuaccuggcucugauggcgacuuuuaaaaugcggccgauguucgccgucggccuucuguuccgccgacugaccagccgcgaagugcugcuguugaccaucgggcucucccuugucgcgucgguggagcuacccaacucgcuggaggaguugggcgauggccuggccauggggaucaugaugcuaaaacuucugacugaguuccaaccccaccagcucuggacgacccugcugagccucaccuuugugcggacuacucuguccuuagacuacgccuggaaaaccaccgcaaugguucucagcauugugucccuguucccacuuugccucagcaccacgucccagaaaacgaccugguuaccugugcugcucggcagcuuuggcugcaagccccuaacaauguuccugauuacugagaacaagaucugggggcgcaaguccuggccguuaaacgaggguauuauggcaaucgguaucguuagcauauuacugaguuccuugcugaagaacgaugugccccuugcgggaccgcucaucgcaggcgguaugcugauugcaugcuauguaaucagcggcuccagcgccgaccucucccucgagaaggccgcggaggucagcugggaacaggaagcagaacacagcggggcaagccacaacaucuugguggagguucaagaugacgguacuaugaagauaaaggacgaggagcgagacgacacucugaccauacugcugaaggcaacgcugcuggcuguauccgggguuuauccaaugagcauccccgcaacgcuguucgugugguauuuuuggcagaagaagaaacagcgcuccggcguguuaugggacacgccaagcccacccgaaauggagcgugccguuuuagacgacggaaucuaccgcauccuccagagagggcugcuuggccgcucccagguagggguuggggucuuccaggaugggguguuccacacgauguggcaugucacgcggggcgccgugcucauguaccagggcaagcgccuggaacccucuugggcauccgugaagaaggaucucauuagcuacgggggcggcuggagauuccagggcuccuggaacacgggggaggagguacaggugaucgcgguggagccggguaaaaauccuaagaauguucagacuacccccgguaccuucaagacgcccgagggugaaguaggcgcgauugcccuugacuuuaaaccggguacaagcggguccccgaucguuaaucgcgaaggcaagaucgucgggcuguacgguaacgguguggugacgaccagcggcacguacgucuccgccaucgcccaggccaaggccagccaggaagggccccuaccggagauagaggaugagguguuuaagaagcggaaccucaccauaauggauuugcacccagggucuggcaagaccaggcgguaccuucccgccauuguacgugaggcuauuaagcgcaaacuccggacccugauccuagcccccacccgggugguggcaagcgagauggccgaggcccucaaggggaugcccauccgguaccaaaccacggcggucaagagcgagcacacuggccgcgagaucguagaucugaugugccacgccacauucaccaugcgucuacuuagccccguccgcgugccaaauuacaacaugaucaucauggacgaggcgcacuucaccgauccggcuagcaucgcagcccggggauacaucuccacacgcgucggcaugggggaagcugcugcaaucuucaugacggccacgccucccggcagcguggaggccuucccccaauccaaugccgugauccaggacgaggagagggacauccccgagcgcagcuggaacucuggcuacgacuggaucaccgacuucccaggaaagaccgugugguucguaccuagcaucaaaagcggcaacgacaucgccaacugccugcgcaagaacgggaagcgggugauccaauuaucccgaaagacguucgacaccgaguaccagaaaaccaagaacaacgacugggauuacgucgugacgacggacaucuccgagaugggcgcuaauuuuagggcggaccgggugaucgauccacggcggugcuugaagcccgucauccuaaaggaugggcccgagagggugauccuggccggcccgaugcccgucaccguugcaagcgccgcccaacggcgcggcagaauaggcaggaaccagaacaaggagggggaucaguacguguacaugggucagccccucaacaaugaugaggaccacgcccacuggaccgaggccaagaugcuucuggauaacauaaacacccccgaagguaucauaccggcacucuucgagccggaacgcgaaaaguccgccgccaucgauggcgaguaccggcugcgaggagaggcccggaagacguucguagagcugaugcgccggggcgacuuacccguuuggcucagcuacaagguagcguccgagggauuucaguacucggaccgccgguggugcuucgauggcgagcggaacaaucagguccuggaggagaauauggacguagagaucuggaccaaggagggggagcggaagaaacuccgcccccgcuggcuggaugcgcgcacguauucagacccguuagcgcuacgggaguucaaggaguuugcagcuggccggcgaagcgugaguggggaccugauauuggagauagggaagcucccccaacaccugacucugcgggcccagaacgcccucgauaaccuggucaugcugcacaacagugagcagggaggcaaggccuaucggcacgcuauggaggaguugcccgacaccaucgaaacucugaugcuacuggcccucaucgcagugcugacaggaggggugacacuuuucuuucugagcggcaagggccuggguaagaccucaaucggccuccuuugcguuaccgccucuuccgcccuucucuggauggccucaguggagccccacuggaucgcugcgagcaucauacuagaguucuuccugaugguucuccuaaucccggagcccgaccgccagcggacaccgcaagacaaccaguuggccuacgucgugauagguuuacuguuuaugauauuaaccguggccgccaacgaaaugggucuccuggagaccacgaagaaggaccuggggaucggguacgucgcagcagagaaccaccaacacgccaccauguuggacguggaccuacaucccgccucugccuggacccuguacgcgguagcgacaacgguuaucacgccuaugaugaggcacaccauagagaauaccacggcgaauaucucucucacugccaucgcgaaucaggccgcgauauuaaugggccuggacaagggcuggccaaucuccaaaauggauauuggcguaccucuccuugcccuggggugcuacucccaagucaauccucuuaccuuaaccgccgccguccugaugcucguggcgcacuaugccaucaucggcccgggcuugcaggcgaaggcaacgcgagaggcccagaagcggaccgcggccggcaucaugaaaaaucccacugucgacggcaucgucgcuaucgaccuugacccaguggucuaugaugcuaaguucgaaaagcagcucggacaaaucauguuauuaauacucugcacaucucaaauccugcucaugcgcaccaccugggccuuaugcgaguccauaaccuuagcgaccggcccguuaacgacucucugggaggguucacccggcaaauucuggaauaccaccauagcggugucgauggcaaauaucuuccgggguagcuaccuugccggagcaggccucgcguucucccucaugaagucccucggcggagggcgcagagguacgggcgcgcagggggagacccugggcgagaaauggaaacgccagcucaaccagcuauccaaaagcgaguucaauaccuacaagcgaucaggcauuauggagguggacagauccgaagcgaaggagggccugaagcgcggagagaccacuaagcacgccgugagccguggcaccgcgaagcuccguugguuugucgaacgaaaucugguaaagccggagggaaagguaauugaccuugggugcggccgcgggggcugguccuacuacugcgccgggcucaagaaagugacggaggugaagggguacacaaagggugggccaggacacgaagaacccauuccuauggccaccuauggguggaaccucgugaagcugcacaguggcaaggacgucuucuucaugccgccggagaagugugacacccugcucugugacauuggggaauccagcccaaacccaaccauagaggaaggccgcaccuuaagggugcugaagauggucgagcccugguuacgcgguaaccaauuuuguaucaagauccugaaucccuacaugccgagugucguggaaacccuggagcaaaugcaacggaagcauggaggcaugcucgugagaaacccccugagccguaacuccacgcacgagauguacuggguaucaugugggacaggcaacaucgugucggccgugaacaugaccagccgaauguuacucaaucgcuuuaccauggcccaucggaagcccacguaugagcgcgacgucgaccuuggcgcggggacccggcacguugccguagagccugaggucgccaaccuggacaucaucggucagcgcaucgagaacaucaagaacgagcacaaguccacauggcacuacgacgaggauaacccguauaagaccugggcauaccacggaagcuacgaagugaagccaucaggcagcgcgucgagcaugguaaacgggguagugcgccucuuaacgaaaccuugggacguuauacccaugguuacucagauugcgaugaccgauaccacucccuucgggcagcagcggguguucaaagagaaggucgacacccggacgccccgggcaaaacggggcaccacgcaaauuauggaggugacggccaaauggcuguggggguucuuaucccgcaacaagaagccucggauuuguacucgagaggaguuuacacggaaggugcgcaguaacgccgccaucggggcggucuuuguggacgaaaaccaauggaacucagccaaggaagcuguggaagaugagcgguucugggaccuagugcaccgcgagcgggaacugcacaaacaggguaaaugugcuacgugugucuauaauaugaugggcaagcgcgagaagaaacucggagaguucggcaaggcuaagggcuccagagccaucugguacauguggcugggggcccgcuuucuggaguucgaggcucucggauuuaugaacgaggaucauugguucagccgggaaaacucgcuuuccgggguggaaggggaggggcuacacaagcucggguacauccugagggacaucuccaagaucccgggcggcaacauguacgcagacgacacugcggguugggauacccgcaucaccgaggacgaccugcagaacgaggccaagaucacggacaucauggagcccgaacacgcccuacuggccaugucuauuuucaaacugacguaccagaacaaagucgugcgggugcaacgcccggccaagaacggaaccgucauggaugugauuucccgccgcgaucagcggggcagcggccagguugguacuuacggccucaacacguucaccaacauggagguacaacugaucagacagauggagagcgaagggauuuuccugccaucagaacucgagaccccaaaccucgcggagcgggcuuuggauugguuagaaaaacacggcgcagagcgucugaagcgcauggcuauuucuggggacgauugcgucgugaagccuauugaugaucgcuucgccacggcgcugaccgcccucaacgacaugggcaagguccgaaaggacaucccccagugggagcccagcaaaggcuggaacgauuggcagcaaguacccuuuugcucccaccacuuccaccagcugaucaugaaagacgggcgcgaaaucgugguaccgugccggaaucaggacgaacucguggggagagcccgggucagucagggggcgggcuggucccuccgcgagaccgcuugucuaggaaagagcuacgcacagauguggcaguugauguacuuccaucggcgggacuugcgccuggcggcaaaugccauaugcucugccgucccgguggauugggucccugcgucgcgcaccacauggaguauccaugcacaccaccaguggaugaccacggaggacaugcugucgguauggaaccgcguuuggauagaggaaaauccauggauggaagacaaaacccacgucagcuccugggaggaaguccccuaucucggcaagagagaggaucaguggugcggaucccugaucgggcugaccgcccgcgcaacgugggccacgaauauccagguugccauaucccaggugcgccgccucaucggaaacgagaacuaccuggacuacaugaccagcaugaagcgauucaagaacgaguccgaccccgagggugcacuaugguga

SEQ ID NO: 24670 - RNA, 9879 nt, Artificial Sequence
  derived and/or modified CDS sequence (opt11) from DENV-1__KC692503__SS-prME
uccguaaccaugcuacuaaugcugcucccuacggcacucgcuuuccaccuaacgacaaggggaggagaaccucacaugauugucucuaaacaagaacgagggaaaagccuuuuguucaaaacaagcgcaggcguuaauaugugcacgcuuaucgcuauggaccucggggaauuaugcgaagacacaaugacauauaaguguccccggauuacggaagcggaaccggacgaugucgauugcuggugcaacgcaacugacaccugggucacuuacggaaccuguagccaaaccggugaacacaggcgagaaaaacgauccgucgcccuggcaccacacgugggcuuaggacuagaaacccggacugaaacauggaugucgagugaaggggcguggaagcaaauccagagagucgaaacgugggcacuaagacaucccgguuucacuguaauugcauucuuccucgcacaugcaauuggaacgagcauaacacaaaaaggcauaauauucaucuugcucaugcucgucacacccagcauggcaaugcgaugugugggcauagggaaccgggacuucguagaagggcugaguggugcgacgugggucgacguaguccuggagcauggcuccugcguaacaaccauggccaaaaauaagccaacguuagauaucgaacugcugaagacugagguaacaaauccggccguccugcggaaacuuugcauugaggccaagaucuccaacacgaccacggacucccggugccccacccagggugaggccacgcugguagaagaacaagaugcgaacuuuguaugccgcagaacguuugucgaccggggauggggcaauggcugcggguuauucggcaaaggcucacuacuaaccugugcaaaguucaaaugcgucaccaagcuagaggggaaaauaguacaguacgagaaccugaaguauucagucauuguaacgguccacacuggagaucagcaccaggugggaaacgagacgaccgaacauggaaccaucgcaacaauaacaccccaagcaccgaccuccgaaauccagcucaccgacuacggagcacucaccuuagacuguagcccgcgcaccggccucgacuucaacgagaugguauuacucacaaugaaagagaaaaguuggcucguucacaagcaaugguuucuggaccuaccacucccauggacgagcggcgccucgacgucacaagaaacguggaaccgucaagaucuauuaguaaccuucaaaacagcacacgccaagaaacaggaggugguaguccugggaagccaagagggcgcgaugcacacggcucugacaggcgcgacagaaauucaaacaagcgggacgaccaccaucuucgcagggcaccuaaaaugccgacucaaaauggacagacugacucugaaaggcaugaguuaugucaugugcacgggcagcuucaaacucgagaaagaggucgccgaaacacaacacggaaccguucuaguccaaguaaaauacgagggaacagacgcgccaugcaaaauacccuuuaguacgcaggacgagaagggcgucacccaaaacggaagacugaucacugccaaucccauaguaacggacaaggagaagcccgucaauaucgaaacagaaccuccauuuggugaaucuuacaucgucgucggagcaggcgagaaggcacucaaauuaucaugguucaaaagaggaaguagcauaggaaagauguucgaagcuacggccagaggggccaggcgaauggcaauccugggugacacagccugggacuucgggagcaucggagggguuuucacuucagucgguaagcuaguucaccagguauucggaacggccuacggcguauuauucuccggcgucucguggacgaugaaaauuggaaucgggauacuacugacaugguugggucucaacucgcgcucgacgucgcuaagcaugacaugcauagcgguagguaugguaacgcucuaccucggaguaaugguacaggcagacucaggaugcgucauuaacuggaaaggaagagaguuaaaaugcggcaguggcaucuucguaacgaacgaaguacacaccuggacugagcaauacaaauuccaagcagacucacccaagcgccuuucugcagcuauaggcaaagccugggaagaaggagucugcggaauccgaagcgccacgaggcuagaaaacauaauguggaaacaaauaucgaacgaauugaaccacauccuucuggaaaaugacaugaaauucacgguaguagucggagacgcuaauggcauacuagcgcagggaaagaagaugauacgaccgcaaccaauggaacacaaauacagcuggaaaucaugggggaaagcaaaaauaaucggggcagacauacaaaacacuacauucaucaucgacggucccgauacaccagagugcccugacggucaacgagcauggaacauaugggagguagaggauuauggcuucggaguguuuacaacgaacaucuggcuaaaguugcgcgauucguauacgcaaaucugugaucacaggcucaugagugcggccauaaaagacuccaaggccguccacgccgacaugggauacuggauagagagcgaaaagaacgagaccuggaaacucgcgcgagcauccuucauugaagugaaaacuugcacguggcccaagucacacacccuauggagcaacggcguucucgagucggaaaugauaauccccaaaauauucgggggaccuauaucgcagcauaacuaccggcccggguacuucacgcaaacugccggccccuggcaucuagguaaacucgagcuagacuucgaccucugugaaggcacaaccgugguugucgacgaacacugcggaaaucgcggaccgagccuacgcacaacgaccguaaccggcaagauaauucaugaaugguguugccgcuccugcaccuuaccgccacugagguuuagaggcgaagacggcugcugguacgguauggaaauacgucccgucaaagaaaaggaagagaaucugguacgaaguaugguaucugcggggagcggagagguagacaguuucucccuaggaauuuuaugcgucucgaucaugauagaggaaguaaugagaucgagauggucccgaaaaaugcucaugaucggcacucuagcuguuuuccugcucuuaauaauggggcaauugacguggaaugaccucaucagacuuuguaucaugguaggcgcaaaugcaucagaccgaaugggcaugggaacaacuuaccuugcccugauggcaacauucaaaaugcggcccauguuugcuguuggccuccuguuucggcgacuuacaucacgagagguucuacuuuugaccaucggccugucgcucguagcuucagucgaacucccaaacucucuggaagaacuuggcgacggccucgcaaugggaaucaugaugcucaaacuuuuaacggaguuccagccgcaccagcuauggacaacgcuuuugagucuaacguucgucaaaaccacauuaucgcucgauuaugcguggaaaaccaccgccaugguacucucuaucgucagucuguucccacugugucucuccacaaccucacagaaaaccacguggcuaccuguacuucucggaucauucggauguaagccccugaccauguuucuaauaaccgaaaacaagaucugggggcgaaaaagcuggccccucaacgaagggaucauggcuauugggauaguaagcauacuucucucaucacuacucaagaaugauguaccgcuagcgggcccccugaucgccgggggcaugcuuaucgccugcuacgucaucagcggauccagcgcggaccuaaguuuagagaaagcugccgaagugucgugggagcaagaggcugaacauucgggugccagucacaacauucugguagagguacaagacgauggaacgaugaaaauaaaagacgaagaacgcgacgacacgcucaccauacuccucaaggccacccuacucgcugugagcggggucuacccgauguccauacccgccacccuauucguaugguacuucuggcagaaaaagaagcaaagaagcggaguacugugggacaccccuagcccaccugaggucgagcgcgcagugcucgaugacgguaucuaccgcauacugcaacggggauugcuagggagaagccaaguuggggucggugucuuccaggacggcgucuuccacacuauguggcauguuacacgaggagcgguacucauguaccaaggaaaacgacuagagccaagcugggccuccgucaagaaagaccucaucaguuacgggggaggguggagauuucaaggcagcuggaacacaggugaagaagugcaagucauugccguagaaccggggaaaaaucccaaaaacgugcagacaacgccaggcacguucaaaacaccggaaggagagguuggcgccauagcccucgacuucaagccggggacaagcggaucuccgaucgucaaucgcgaagagaaaauugucggccucuacggaaauggcgucgucaccacaagcggcacauauguaagcgcgaucgcacaggccaaggcgucccaagagggcccucugcccgagauagaagacgaaguguucaagaaaaggaaucucacgaucauggaucugcauccagguagcggaaaaacucgaagauaccuaccagcaaucguacgggaagccaucaagcgaaaacuccgaacccuaauacucgccccaacacggguagucgccagcgagauggcggaagcgcuaaagggaaugccgaucagauaucaaaccacagccguaaaauccgaacauacugguagggaaaucgucgaccugaugugccacgcaacauucaccaugaggcuccugagccccgugcgagugccaaacuauaauaugaucauaauggacgaagcccauuucaccgacccggccagcauagccgcccgaggguacaucuccacucgagugggcaugggcgaagcagcggcuaucuuuaugacagcgacacccccaggaagcgucgaagccuuuccucagagcaacgcagugauacaggaugaggaaagagacauaccagagcgaucguggaacucaggguacgacuggauaaccgacuucccuggaaaaacugugugguucgugccuuccauaaaaagcgggaacgacaucgccaauugccuuagaaagaauggaaaacgggugauccagcuaagccgaaagaccuuugacacggaguaucagaaaacaaagaacaacgacugggacuacguggugaccaccgacaucuccgaaaugggcgcgaacuuccgggcugaccgcguaaucgaccccaggcgcugccugaaaccugucaucuuaaaagaugggccggagcgcgugauucuggcggggccgaugccggucacuguggcaucugcggcgcagcgccggggacggauaggccggaaucaaaacaaggaaggagaucaguacguauacaugggacaacccuuaaacaaugacgaagaucacgcccauuggaccgaagcuaagaugcugcucgacaacauaaacacaccggaaggcauaauuccagcccuauucgaacccgagcgagagaaaagcgcagcgauagauggugaauaccgccugcgaggagaggcgagaaagaccuuugucgaacucaugcgacgcggagaucugccagucuggcugagcuauaaggucgcuuccgaaggcuuccaguauucagaccguagauggugcuucgacggggaacggaacaaccaggucuuggaagaaaacauggauguagaaaucuggacgaaggaaggcgagcgaaagaaacuucggccccgauggcuagaugcacggaccuacuccgauccccuggcccucagggaauuuaaggaguucgcggcagggcgaagaucggucucaggggacuuaauacuagaaauuggcaaauugccccaacaucuuacgcuccgagcccaaaacgcuuuggacaaccuaguuaugcuccauaacagugaacaaggaggaaaagcauaucggcacgccauggaggaguuaccagacacaaucgagacgcuuaugcuccuagcgcugauugccguacugacaggugguguaacauuauuuuuccuaaguggaaaaggacuggguaaaaccucuaucgggcuccucugcguaacagcaucuucggcguuacucuggauggccaguguagaaccccauuggaucgcagccagcauaauccucgaguucuuccucauggugcuacuuauaccugagcccgacagacagcgaacuccacaggauaaccaacucgcguacguaguaaucggacuccuguuuaugauccugacaguggcugcaaacgaaaugggacuccuagaaacaacuaaaaaggaucuugggauaggcuacguggcggcagagaaccaccaacacgcaacgaugcucgauguagaccugcauccagcgagcgccuggacacuauaugcgguggccacgacagucaucaccccaaugaugcgccacaccauagaaaauacaaccgcaaacaucucacuaacugcaaucgcaaaccaagcggccauacucaugggacuggacaagggcuggccuauauccaagauggacauugggguaccacugcuggcucuaggguguuacagucaagucaacccacucacacucaccgcugcagucuuaaugcuugucgcucacuacgcuauaaucggcccgggccugcaagcaaaagccacgagggaagcccagaaacgcacggcagccggcaucaugaaaaacccaacgguugacgguaucguagcaauagaccuagaucccgugguuuaugacgccaaauucgagaaacagcuaggccagauaaugcuucuaauacucugcacgucccagauacuccucaugcggacgacaugggcgcucugcgagagcauaacccucgcuacaggcccacuaacgacccuaugggaaggaucaccuggaaaauucuggaacaccaccaucgcgguaagcauggcgaacaucuuucgcggaucauaccucgccggagcaggccuggccuucagccucaugaaaaguuuggguggagggcgccgaggaaccggagcgcagggggaaacauugggggagaaguggaaacgccaacugaaucaacuaucgaagagugaguucaacacuuacaagagaucugggaucauggaaguugaccgauccgaagccaaagagggacugaaacgaggggaaacgacuaaacacgccguuucccgcggaacggcaaaacuuaggugguucgucgagcggaaccugguaaaaccggaagggaaagucauagaccugggguguggaaggggaggcuggagcuacuacugcgcaggccugaagaaagucacagaagugaaaggauacaccaagggugggccgggacacgaagaaccuaucccaauggccacauacggguggaaccucgucaaacuccacuccggcaaagacguuuucuucaugccgcccgaaaaaugcgacacccuacugugcgacaucggugaaucaucaccaaacccgaccaucgaagagggccgcacccuccguguacuaaagauggucgaaccguggcuccgcggcaaccaguucugcauaaagauacugaacccauacaugcccucggucguagaaacacucgaacaaaugcagcgaaagcacgguggcaugcuaguacgcaauccccucucaagaaacucaacccaugaaauguacugggucuccugcggcacaggcaacauaguuagcgccguaaacaugacaagccgcaugcuacuaaaccgcuucacaauggcacaccgcaagcccacguacgagcgcgauguagaccucggagcagggacgagacauguagcgguugaaccagaaguggccaaccuagacauuauaggccaacgaauagagaacaucaaaaaugaacacaaguccacauggcacuacgaugaagacaaccccuacaagaccugggcguaucacggcagcuacgaagugaagccaucaggaagugcgucuuccauggugaacgguguagugcgccuccucacgaaacccugggacgucauaccgaugguaacacaaauagcgaugacugacacaacaccauucggacaacaaagaguauucaaagagaagguggacaccaggacgccacgagccaagcgagggacaacccaaaucauggagguuacugcgaaaugguuguggggguuccuaucaagaaauaagaaaccaaggaucuguacaagggaggaguucacccggaaggugcgaagcaacgccgcaaucggagccgucuucgucgaugagaaccaauggaacucggcaaaagaggcaguggaagaugaacgguucugggaucuuguacaucgggaacgagagcugcauaaacaaggcaaaugugcaaccugcguguacaacaugauggggaaaagagaaaagaaacugggcgaguucggaaaagccaaaggcucccgcgccauuugguauauguggcugggugcgagauuccuagaauuugaagcgcucggauuuaugaaugaggaucacugguucagcagggagaacucauuaagcggggucgagggagagggccuccacaagcuaggcuacauacuacgagacaucucaaaaaucccuggagggaacauguacgccgacgacacagcugggugggacacacgcauaaccgaggacgaucuacaaaaugaagcgaagauaacugacauaauggagccagaacacgcccuccuagcaaccuccaucuuuaagcugaccuaucagaauaaaguaguaagaguccagagaccagccaaaaauggaacgguaauggacgugaucucccgccgcgaucaaaggggcucaggccaaguggggacuuacgggcucaauaccuucacaaauauggaaguccagcucauacgucaaauggaaagcgaggguaucuuccuaccauccgaauuagaaaccccuaaucucgccgagcgagcucuagacuggcuagagaagcacggcgcagaacgacuuaaaagaauggcaauaagcggugacgacugcguagucaaaccgaucgacgaccgauucgcaaccgcauuaacggcccugaacgauaugggaaaggugaggaaggacauaccucagugggaaccuagcaaaggguggaaugacuggcaacaagucccauucuguucacaucacuuccaccagcugaucaugaaggauggacgugagaucgucguacccugccgcaaccaggacgaacucgucggccgagcgcgaguuagccaaggggcaggguggagccuaagggagacagccugucucggcaagucauacgcacaaauguggcagcucauguacuuccaccgucgagaccuacgccucgcggccaacgcaaucugcagcgcagucccgguggacuggguaccggcgucgcggacgaccuggucaauucaugcacaccaccaauggaugaccaccgaggacauguugucaguuuggaaccggguguggauugaggagaacccguggauggaagauaagacgcacgucagcucaugggaggaagugccauaccugggcaaaagagaagaccaaugguguggcucauuaauagggcuaaccgcacgggccacaugggcaaccaauauucagguggcaauaaaccaaguccgccgccuaauugggaacgaaaacuaccuagauuauaugaccagcaugaagcguuucaaaaacgaaagugaccccgagggcgcucuaugguaa

SEQ ID NO: 24671 - RNA, 9879 nt, Artificial Sequence
  derived and/or modified CDS sequence (opt11) from DENV-1__KC692504__SS-prME
agcgugaccaugcuucuaaugcugcuucccacagcacuggcauuccauuugacuacacgcgguggagaaccccacaugaucgugucuaaacaagaacgcgggaaaagccuacuauucaaaacgucagcaggaguaaacaugugcacguugaucgccauggaucuaggagaacuaugcgaagauacgaugaccuacaaauguccccggaucacagaagcagaaccggacgacguagauuguugguguaacgccacagauacuuggguaacauacggaacaugcagccagacuggggagcaccgaagagagaaaaggagcguagccuuggcuccccauguaggccuaggauuagaaacgcgcacggaaacauggaugucgagcgaaggugcauggaggcagauccaacggguggaaacuugggcacuacgccacccgggauucacggucaucgcauucuuccuagcacacgccaucggcacaagcaucacacaaaaagguaucauauuuauucuucucaugcuagucacuccaucuauggccaugcggugcgucggcauagggaauagggacuucgucgaaggucugucgggcgccaccugggucgauguaguccuugaacacgggucgugcgucacaacaauggccaaaaacaaacccacgcuugacauugaguuauugaaaacagaggucaugaacccggccguacugcggaagcugugcaucgaagcaaaaauaaguaauaccaccacagacagccguugucccacccaaggggaagccacucucguggaggaacaagacgcaaauuucguuugcagacgcacauucguagaucgcggaugggggaauggaugcggccuuuucggaaaaggcagccuccuuacaugcgccaaguucaaaugcgucacaaaacuggagggaaaaaucguccaguacgaaaaccugaaguacucugugauaguaaccguccacaccggagaccaacaccaggucggaaaugagacuacagagcaugggacaauagccacgauaacaccccaggcuccgacaucggagauccagcuaacagauuacggcgcacucacacucgacugcucaccaaggacuggccuagacuuuaacgaaaugguacuccugaccaugaaagagaaauccuggcuaguacacaaacaaugguuccuugaccucccccuuccuuggacauccggagcuucgacaagccaagagacguggaaccgucaagaucuccuggugaccuucaaaacagcacacgcgaaaaagcaggaagucguuguacuagguagucaagaaggcgcgaugcacacagcacugaccggagcaaccgaaauacaaaccagcgggacaaccacaauauucgccggccaccucaagugccgacuaaaaauggacaaguugaccuuaaagggcaugucauacgucaugugcacugggagcuucaaguuggaaaaagaaguagcagaaacccaacacgggacaguguugguacagguaaaguacgaaggcacugacgcaccuugcaagauacccuucagcacccaagaugaaaaagggguaacccagaacggccgauugauuacggcaaacccaaucgugacagacaaggagaaaccgguuaauauagaaacagagccacccuucggcgaaucguauauuguaguaggugcuggagaaaaggccuuaaaacucagcugguuuaaacgagggucgucuaucgggaaaauguucgaagcaaccgccagaggggcaagaagaauggcgauuuuaggcgacacagccugggacuucgguucgaucggcggcguuuucaccucggucggcaagcucguccaccaaguauucggcacagcauacggcgugcuguucucaggaguaucuuggacuaugaagaucggcauaggaauacuacuaaccugguuagggcuaaacucacgaucgacaagccugucuaugacaugcaucgcaguagggaugguaacccuauauuuggggguaauggugcaagcugauagugggugcgucaucaacuggaagggacgcgaauugaaaugcggguccggcaucuucguaacaaacgaaguucacacguggaccgagcaauauaaauuccaagcagacagccccaaacgacucuccgcugccauaggcaaggccugggaagaaggcgucugcgggauucgaucagccacaaggcuugaaaacaucauguggaaacaaaucucuaacgagcucaaccacauccuccucgagaacgacaugaaauucacagucguagucggagacgccaacggaauacuagcucaaggaaagaaaaugauacggccacaacccauggaacacaaauacucguggaaguccugggggaaggcaaaaauuauaggagccgacauccaaaacaccacauucaucaucgacgggcccgacacccccgaaugccccgacggacagcgggcuuggaauauaugggagguugaagauuacggguucggaguguuuacaaccaacauauggcucaaacuucgagauagcuacacacagaugugugaccaccgccuaaugucagcagccauuaaggacucgaaggcgguacacgcagauaugggcuacuggaucgaaucagagaagaacgaaaccuggaagcucgcgcgagccagcuucauagaagugaaaacaugcacauggcccaagucacacaccuuguggagcaacggcguccucgaauccgaaaugauaauccccaaaaucuucggcgggcccauaagccaacacaacuaccgaccaggcuacuuuacacaaacugcagggccguggcaccuuggcaagcuagagcucgauuucgaucucugcgagggaaccacaguaguagucgacgagcacugcggaaaccgggggccuucacuacggacaacaacggucaccggaaagaucauccaugaauggugcugccguucguguacgcugccgccacuccguuucaggggcgaagacggcuguugguacggaauggaaauaaggccagucaaggaaaaggaagaaaaccugguucggagcaugguaucagcgggcagcggggaaguagauucguucucccucgggauccuaugcguaucgaucaugaucgaggaggugaugagaucuagauggucccggaaaaugcuuaugacagggacccuggcaguauuccugcuacuaaucaugggacaacuuacguggaacgaucucauuaggcucuguauaaugguaggcgcuaacgccucagacaggauggggauggguacgacauauuuagcccuaauggcgaccuucaagaugcgaccgauguucgccguaggccuguuauuccgacgccucacaucgagggaagugcugcugcugacaauaggccuaucccucgucgcuuccgucgagcuuccaaacuccuuagaggaacucggagauggacucgccauggggauaaugaugcucaaacuccuaacagaguuccaaccccaccagcucuggaccacacuauuaucccuaaccuucgucaaaacgacccuuucauuggacuacgcauggaagacgacagccaugguccucucaauagugucacucuuuccacuguguuugagcaccaccagucagaaaacgacuuggcuuccaguccuacuggguucauuuggcugcaaaccacugacaauguucuuaaucaccgaaaauaagauuuggggccgaaagucauggccauugaacgagggaauuauggcaauaggcaucgugaguauuuugcugagcagccuucugaagaaugacgucccguuggcgggcccacucauugcgggagggaugcucaucgcguguuauguaauuucaggauccagcgcagaccuaucccuggagaaggcagccgagguauccugggaacaagaagcugaacacagcggcgccagucacaacauccuaguggaagugcaagacgacgggacuaugaaaauuaaagaugaggaacgcgacgacacguuaaccauccuacuaaaagcgacucuucuggcagucuccggagucuacccuaugucaaucccagcgacccuauuuguaugguacuucuggcagaaaaagaaacagcggucgggcguccuaugggacacgccaaguccacccgaaguggagcgagcaguccuagacgacggcaucuaucgaauauugcaaagaggacugcucggacgaagucaagucggcgucggagucuuccaagacggaguauuccauacaauguggcauguaacucguggggccguccuuauguaucagggaaaacgccuagagcccucaugggccagcguuaagaaagaccucauauccuacggagguggguggcgcuuccaaggcagcuggaacacuggagaagagguacaaguaauagcgguugaacccggcaaaaacccgaagaauguccaaaccacgccuggcacauucaagacgcccgaaggagaaguaggagcgauagcccuggacuucaaaccaggcacaagcggaucuccaauugucaaccgcgagggaaagauugucggcuuauacggaaacgggguugucaccacuagcggaacauaugucagcgcaaucgcgcaggcgaaagcaucucaagaggggccauuaccggaaauagaggacgagguauucaagaaacgcaaucuuacgaucauggaccuccacccaggcucgggaaagacucgucgauaucuaccagcaauaguccgcgaagcgauuaagcguaaguuacgcacgcugaucuuagccccgacacggguggucgccagugaaauggcagaagcacugaaagggaugccgaucagauaucagacaacggcaguuaagucagagcacaccggcagagaaaucgucgacuugaugugccaugcgacauucacaaugcgccuccuaagccccguccguguuccuaacuauaacaugauuaucauggacgaagcacacuucacggacccagcaagcaucgcggcuaggggguacaucuccacaagagucggaaugggagaagccgcagcgaucuucaugacugcaacgcccccggggucaguugaggcauucccacaaaguaacgcagugauccaggaugaagaacgcgacauuccagagagaagcuggaacagcggcuacgauuggauuaccgacuucccggggaagaccgucugguuugugccgagcaucaagagcgguaacgauauugcaaauugccuccgcaaaaaugggaaaagagucauccaacuaagccgcaagacauucgacacugaauaucagaaaacaaagaacaaugacugggacuacgucguaaccacugacauaagcgaaaugggcgcaaacuuccgagccgaucgcguuauagauccacgccgaugccuaaaacccgucauacuaaaagacggucccgaaagaguaaucuuagcuggacccaugccaguaacgguagcuagcgcggcacaacggcguggcagaauaggacggaaccaaaacaaggaaggagaccaguauguguacaugggccaaccccugaacaacgaugaagaccaugcgcacuggaccgaagcgaagaugcuccucgacaacauaaauaccccagaaggcauuauuccagcacuuuucgagcccgagcgagagaaaagcgcagccaucgacggagaguaccgacucagaggggaagcgcguaaaacauucguggagcuuaugcgcagaggggaccugcccgucuggcuaagcuauaaaguagcauccgagggguuccaguacagcgauagacgauggugcuucgacggugaacgaaacaaccagguacucgaagaaaacauggaugucgaaauauggacuaaagaaggagaacgaaagaaacuccgaccacguuggcucgacgcccggaccuacagugacccucuagcgcuccgagaauuuaaagaguucgcugcugggagacggagugucaguggcgaccuaauacucgaaauaggaaaacuaccacaacaucugacgcuacgugcacagaacgcccuggacaaccucgucaugcuacauaacucagaacaagguggaaaggcuuaucgacacgccauggaagaacuacccgacacaauagaaacucucaugcuccuggcgcucauugcuguccuaacgggcggcgucacucucuucuucuugagcgggaagggccuaggaaagacaagcaucggccuacuaugcguuaccgcaucaucagcacuccucuggauggccagugucgaaccccacuggauugccgcaaguauaauucuugaguucuuucuaaugguguugcuaauucccgaacccgaccgacaacgcacaccacaagauaaccaacuagcauauguggucauaggacugcuguucaugauacugacagucgcagccaacgaaauggggcuccucgagacgaccaaaaaggaccucggaauaggcuacguggcagcggaaaaccaccaacacgcaacgauguuagacguggacuuacaucccgccagugcguggacacuauacgcggucgcaacuacugugaucacaccgaugaugcgccauacaauagagaacacaacggcgaacauaucacugacagcgauagcgaaccaagcggcaauacuaaugggguuagacaaaggguggccaaucagcaaaauggacaucggaguaccccugcucgcacucgguugcuacagccagguaaacccccugacccuaacggcggccguccucaugcugguagcacauuacgcgauaaucggacccggguugcaagcaaaggcaaccagagaagcgcaaaaacgcacagcggcaggcauaaugaaaaacccgacggucgaugguauaguggccauugaccuagacccagugguuuacgaugccaaauucgaaaagcagcucggacaaauuaugcuauuaauacuauguacgucacagauccuacugaugcguacaaccugggcccugugcgaauccaucacccuagcuacaggcccucucacgacccuaugggagggcagcccagggaaguucuggaauacuacgaucgcagugucaauggccaacgucuuuagaggaagcuacuuagccggcgccggcuuagccuucagccuaaugaaaagccuagggggcggaaggcggggcacuggagcgcagggcgaaacacucggagagaaguggaagcgccaacucaaccaacuaucaaagagcgaguucaacaccuacaagcgcucaggaauaauggaaguggacagauccgaagccaaggaaggccugaaacgaggcgagaccaccaaacaugccgugagccgaggcaccgcgaaguuaagaugguucguagaaagaaaucuagugaagccggagggcaagguaauagaccucgggugcgggagaggaggguggagcuacuauugcgcaggucucaagaaaguaacugaagucaaaggcuacacgaaaggcggaccgggccaugaagaacccauucccauggcgacauauggauggaaccuaguaaaacuucacucaggaaaggacguuuucuuuaugccaccagaaaagugugauacacuacuaugcgacauuggcgagagcaguccgaaccccacaauagaagaaggcaggacacuccgcguauuaaaaaugguggaaccauggcucagaggcaaccaauuuugcauaaagauacuaaacccguauaugccauccguaguggaaacucuugagcaaaugcaacggaaacacggcggcaugcucgugagaaacccucuaucgaggaacuccacacacgagauguacugggucagcugcggaacaggaaacaucguauccgcgguaaauaugacuucgcgaaugcuacucaaccgcuuuacaauggcgcaccguaaacccacauacgaacgagauguugaucucggcgccgggacccgccacgucgccguagaaccagaaguagcuaaccuugacauaauaggacaacguauagaaaacaucaaaaacgaacacaaauccaccuggcacuaugaugaagacaaucccuacaaaacuugggcauaccacggaucguaugaagugaaacccagugggagcgcaagcagcauggugaauggagucguacgccuacucacaaagcccugggaugucauaccuaugguaacacagaucgcuaugacggacacaacaccauucggccaacaaagggucuuuaaagagaaaguagacacucgaaccccacgcgcgaagcgaggcacgacacagaucauggaggugacggcuaaguggcuuuggggauuucucucccgcaacaagaagccccggauauguacccgcgaggaguucacaagaaaaguucgaucaaaugcggccaucggcgcaguuuuuguagacgagaaccaauggaacuccgcaaaagaagccguagaagacgaaagauucugggaccuaguccacagagagagagaguuacacaagcaaggcaagugcgcaacaugcgucuacaacaugaugggaaagagagagaagaaacuaggugaguucggaaaagccaaaggaucccgagccaucugguacauguggcugggcgcaagguuccucgaguucgaagcccucggcuucaugaacgaagaccauugguuuagucgggagaacucgcugucgggaguagaaggcgaggggcuacacaaacucggguauauacuccgagacauaucuaaaauacccggagggaacauguacgcagaugacacggcgggaugggauacacggauaaccgaggacgaccugcaaaacgaagcgaaaaucaccgacaucauggaaccagaacacgcuuuguuggccacgagcaucuucaaacuaacauaucaaaacaaagucguacgcguacaacggccagccaaaaacggcaccgucauggacgucaucucccgaagggaucagcgaggcuccgggcagguaggcaccuacggucucaauacuuuuacaaacauggagguacaacucauaagacaaauggaaucagaagggauuuuucugccguccgaauuagaaacacccaaucuggcggaacgugcacuagauuggcuagaaaaacauggugcggaacgacugaagcguauggccaucuccggcgacgacugcguagucaaacccauagacgaccgauuugccacagcccugacggcgcuaaacgauaugggaaaaguacgcaaagacauaccccagugggagccgucaaagggauggaaugacuggcagcaggucccguuuuguagccaccacuuccaccaauugaucaugaaagacggaagagaaaucgucgucccgugccguaaccaagaugagcuggucggccgagcaagggugucccagggggccgguuggucgcugagagagacugcaugccuagguaaguccuacgcgcagauguggcagcuaauguacuuccaccgcagagacuuaagacuggcagcgaacgcgauuugcuccgccgugccaguugacuggguaccugcaagccgaacaacauggagcauacacgcucaccaucaauggaugacgacagaggauauguuauccguuuggaaucgagucuggaucgaagagaaccccuggauggaagacaaaacgcauguuuccagcugggaggaggucccauaccugggcaagagagaagaucaguggugcggaucgcugauaggucucaccgcacgcgcaacgugggcgacgaacauucagguggcuauaaaucaaguuagacggcugaucgggaacgaaaacuaucuagauuauaugaccucgaugaaacguuuuaaaaacgagucugacccugagggggcgcucugguga

SEQ ID NO: 24672 - RNA, 9879 nt, Artificial Sequence
  derived and/or modified CDS sequence (opt11) from DENV-1__KC692508__SS-prME
agcgugaccaugcuacucaugcucuuacccaccgcacucgccuuccaucugaccacaagggggggggaaccccacaugaucguaagcaagcaagagcggggcaagagucuccuuuuuaagaccucugcgggugucaacaugugcacccugaucgccauggaccugggagaacuaugcgaggacacuaugacuuacaagugccccaggaucaccgaggccgagccugacgacguggacugcugguguaaugcuaccgacaccugggugaccuacgggaccugcucgcagacgggcgagcaccggcgcgaaaagcgguccguggcucuggcgccccaugugggucuggggcucgagacccgcaccgaaaccuggaugucuuccgagggggccuggaagcagauucagcgugucgagaccugggcgcugcgccaccccggguucacggugaucgccuucuuccuggcgcacgccaucggcacuagcaucacgcagaaggguaucaucuucauacuguuaauguuggucacacccuccauggcgaugcggugugucggcaucggcaaccgcgacuucguggaaggacucaguggcgccacuugggucgacgucgucuuggaacacggcuccugcgugacuacuauggccaagaacaagccaacccuggacauagagcuccugaagacggagguaaccaaccccgcggugcugagaaagcugugcaucgaggcuaagaucagcaauacgaccaccgacucccgcugcccgacccagggcgaggcaacccuuguagaggagcaggacgcuaacuucgucugccggagaaccuucguggaucgggguugggggaacggcugcgggcuguucggcaaagguagccuccuaaccugcgccaaguucaagugcguuaccaagcuggaggggaagaucguccaguacgagaaccucaaguacuccguuauugucaccguucacaccggcgaccaacaccaaguggguaacgagaccaccgagcauggcaccaucgcgacgauaacaccacaggcgcccacgagcgagauucaguuaaccgacuauggcgcccugacccucgauugcagcccccggaccggcuuagacuucaacgaaauggucuuguuaacgaugaaggagaaguccuggcuggugcacaaacaaugguuccuggaucucccgcugcccuggaccucuggcgccagcaccagccaggagaccuggaaccggcaggaccuccucgugacguucaagaccgcacacgcuaaaaagcaggagguuguugugcuuggaucccaagagggagccaugcacaccgcacugaccggggccacggagauccagaccagcggcacgaccacgaucuuugccgggcaucucaaaugcaggcugaaaauggacaagcugacccucaaaggcauguccuacguaaugugcaccggguccuucaaacuggagaaagagguggcggaaacccagcacggcacggugcuagugcaagugaaguacgagggcaccgacgcccccugcaagaucccuuucucgacacaagacgaaaagggggugacccagaacggcagacugaucacggccaacccgaucguuaccgacaaggaaaaaccgguuaacaucgagacagaaccccccuucggggagagcuacaucguggucggggcaggcgagaaggcgcucaagcuauccugguucaaacgcgggaguuccaucggcaaaauguucgaggccaccgcccgcggcgcgcgccgcauggcaauccugggcgacacggcgugggacuuugggucgauagguggaguguucaccuccgucgggaaguuaguccaccagguguuuggcaccgccuacggagugcuguuuucaggggucaguuggaccaugaaaaucgggaucggcauccugcucacguggcugggccugaacagccgguccacaagucucuccaugaccugcaucgccgugggcaugguuacccucuaccugggcguuauggugcaggccgacagcgggugcgugaucaacuggaaggggcgcgaacucaagugcgggucggggauauucgucacgaaugagguacacaccuggacggagcaguacaaauuccaggccgacagcccgaagcggcucucugccgccauagggaaagccugggaggagggggugugcggcauccgcucugcgacccgccuugaaaacaucauguggaagcagauaagcaacgaacucaaccauauccugcuggaaaacgauaugaaguucaccguagugguuggggacgccaauggcauccucgcgcagggcaagaagaugauucgcccgcagccuauggagcacaaguacuccuggaaguccuggggaaaggccaagauuaucggcgccgacauccagaacacgaccuucauuauagacgggcccgacaccccggagugccccgacggccagcgggcauggaacaucugggaggucgaggacuacggcuuuggcgucuucaccaccaacauauggcugaagcugagggacuccuauacucagaugugcgaucaccgacucaugagcgcggcaauaaaggacagcaaggccgugcacgccgauaugggcuacuggauugagagcgaaaagaacgaaaccuggaagcucgcccgcgcuuccuucaucgaggucaagaccugcacuuggcccaagagccacacccuguggagcaacggggugcucgaguccgagaugaucaucccgaagaucuuuggcgggccgaucucacagcacaacuaccggcccggcuacuucacacaaaccgcggggcccuggcaccugggcaagcucgagcuagacuucgaccugugcgagggcacgaccgugguuguagacgagcacugcgggaaccggggcccgagccuacggacuaccacggugaccggaaagaucauccaugaauggugcugucgcaguugcacacugcccccccugcgauuccgcggcgaagacgggugcugguacggcauggagauccggcccgucaaggagaaggaggagaaccuggugcgcucuaugguguccgccggcagcggggaggucgacagcuucucccuuggcauucugugcgugagcaucaugaucgaggaggugaugcggucccgcuggagcaggaaaaugcugaugacugggacgcuagcagucuuccugcugcucaucaugggccagcugaccuggaacgaccugauucgccucugcaucaugguuggggccaacgcguccgaccgcaugggcauggguaccacguaucucgccuuaauggcuacguucaagaugcgacccauguucgccguggggcugcuguuccgccgguuaaccagccgcgagguccuccugcugacgaucgggcucagcuuaguggccuccgucgagcugcccaacucgcuagaggagcugggggauggccuggcgaugggcaucaugaugcucaaguugcugaccgaguuccagccgcaccaguuauggacgacucugcugagccucaccuucgugaaaaccacgcugagccuggacuacgcauggaagacaacggccaugguccucagcauugucucuuuauucccccucugccucagcacaacgagccagaagacgaccugguugccggugcugcucggguccuucggcugcaaaccacugaccauguuccugaucaccgagaacaaaaucugggggcggaagucuuggccccuaaacgaggggauuauggccaucgggaucguuagcauccugcuguccagccuccugaagaacgacguaccccuggcaggcccgcuaaucgccggcgggaugcugaucgcaugcuacgugaucucuggcuccuccgcggaccugagccuugaaaaagccgcggaggugagcugggagcaggaagccgagcacuccggagcgucccacaacauccuggucgaaguccaggacgacggcacgaugaagauaaaggacgaggagcgggacgacacccugacgaucuugcugaaggcuacccugcucgccguguccggugucuaccccaugaguaucccugcaacccuguuugugugguacuucuggcagaagaagaagcagcgguccggcguccugugggacacucccuccccgcccgaaguggagcgagccgugcuugacgacgggaucuaccggaucuuacagcgcgggcucuuggguaggagucaagugggggucggcguguuucaggacgggguguuccacaccauguggcacgucaccaggggugccguccucauguaccagggcaagcggcuugagccgagcugggccuccguuaagaaggaccugaucaguuacgguggaggguggagguuccaaggaucuuggaacacaggugaggaaguacaagugaucgccguagagcccggaaagaacccgaagaacguccagaccacccccgguacauucaaaacgcccgagggcgaggugggcgcgauugcccucgacuucaaaccugggaccagcggcucaccgaucguuaaucgggagggcaagauugucgggcuuuauggcaacgggguggugaccacgagcggaacguacgucuccgcgaucgcccaagcuaaggcaagccaggaggggccucugcccgagauagaggacgaaguguucaaaaagcgcaaccugacgauuauggaccuacacccgggcagcggcaagaccaggcgcuaccuucccgccauagucagagaggccaucaagcgcaagcucaggacacugauccucgcccccacgcgggucgucgcuuccgagauggcagaggcucucaaagggaugcccauccgcuaucagaccaccgcagucaagagcgagcacaccggucgggaaauuguggaccuuaugugccacgccacguuuaccaugcgccugcucuccccuguucggguccccaacuacaauaugaucaucauggacgaggcgcauuucaccgaucccgccuccaucgccgcucgcggguacaucuccacccgagucggcaugggcgaggccgcggcaauauuuaugacagccacgccgccaggaucaguggaggccuucccacaaucuaacgccguuauccaggaugaggagcgcgacauacccgagaggagcuggaacuccggcuacgacuggaucaccgacuucccgggaaagacggugugguucgugcccagcauaaagucuggaaacgacauugcgaacugccuccgcaagaacggaaagcgggugauacaacucaguagaaagacguucgacacugaguaccaaaagaccaaaaacaacgauugggacuacgucgucaccacugacaucagugaaaugggcgcgaauuuucgggccgaccgcguuauugacccccggcgcugccucaagcccgucauccugaaagacggucccgagagagucauccuggcgggcccgaugccggucacgguggcgagcgccgcucagcgccggggacguauagggcgcaaccaaaacaaggagggcgaccaauacguguacaugggucagccccucaacaacgacgaagagcacgcccauuggaccgaagccaaaaugcugcuggacaacauaaacacccccgaggguauuauuccggcucucuucgagccugagcgggaaaaguccgccgccaucgauggugaauaccgccugcggggcgaggccagaaagacguucgucgagcucaugcggcgcggggaccugccaguguggcugagcuacaagguugcuuccgaagguuuccaguacuccgaccggagauggugcuuugauggagagagaaauaaucagguucuggaagaaaacauggacgucgagaucuggacaaaggagggggagcgcaagaaacuccggccucgcuggcuagacgcccggacauacucugacccgcuugcccuccgcgaauucaaagaguuugccgccggccgccgaagcgugagcggcgaccucauucuggagaucggcaagcucccucagcacuugacccugcgcgcacaaaacgcgcuagacaaccuagucauguuacauaacuccgagcaaggcgggaaagcauaccgccaugccauggaggaguugcccgacacaaucgagacgcuuaugcuccucgcccugauagccguucugacuggcggggugacccucuucuuccugagcggcaaagggcuggggaagacuuccaucggcuugcugugcgugacggcaagcuccgcucuguuauggauggccucaguugagccccacuggaucgccgcgucaaucauccuggaguucuuccugauggugcuccuaaucccggaacccgaccggcagcguacgccccaagacaaucagcuggcuuacguagugaucgggcuccuguucaugauacugaccguggcagccaacgagaugggccuucuggagaccacgaagaaagaccuagggaucggcuacgucgccgccgagaaccaccagcacgccaccaugcucgacguggauuugcauccggcuagcgcauggacccuuuacgcugucgcgaccacagugaucacccccaugaugaggcacaccauugaaaacaccacggcuaauaucucccuaacagcuaucgccaaccaggccgcaauccucaugggacuggacaaaggguggccgauaagcaagauggacauaggcguaccacuccuugcccugggguguuacucccaggugaacccccucacucuaaccgcggccguccuaaugcucguggcgcauuacgccaucaucggccccggcuugcaggccaaagccacgagagaagcccagaagcgcaccgcggccggaauaaugaagaacccaacuguggauggcaucgucgcuaucgaccuggacccaguagucuacgacgccaaguucgagaagcagcucgggcagaucauguugcugauacucugcaccagccagauauugcugaugcgcaccaccugggcccugugcgaguccaucacccuggcgacuggcccgcucacgacccugugggagggcucgccgggcaaguucuggaacaccaccaucgccguguccauggccaacauauuccgcggcagcuacuuggcaggggccggccuggccuucuccuuaaugaagucccucggcggcgggcggcgaggcacgggcgcucagggggaaaccuugggcgagaaguggaagcggcaacugaaccagcuguccaaaucggaauucaacacauacaagcgcagcgggauaauggagguagaccggagugaggccaaagaaggucugaagcguggcgagaccacgaagcacgccgugucgaggggcaccgcgaagcuccguugguucguagagcggaacuuagugaagcccgaaggaaaggugauagaccugggcugugggagggggggcuggagcuacuacugcgccgggcugaagaagguaaccgaggugaaggguuauaccaagggcgggcccgggcacgaggagccgaucccgauggccaccuacggguggaaucuggucaagcugcacuccggcaaggacgucuuuuucaugccccccgagaagugcgauacgcugcucugugacaucggggagaguagcccgaauccgaccauugaggaggguagaacccuacgcguccuaaaaaugguggagcccuggcuccgaggcaaccaguuuugcauuaagauccugaacccguacaugccuuccgucguagagacucuagaacagaugcagcgcaaacacggcggaaugcucgugcggaacccccuaagccgaaacucaacgcacgagauguacugggugagcugcgggaccggcaacaucguguccgccgugaacaugacaagcaggaugcugcugaaccgguuuaccauggcccacagaaagcccaccuacgagagggauguugaccugggcgcggggacccgacauguagccguggagcccgaaguggccaaucuggacaucauaggccagcguaucgaaaacaucaagaacgagcacaaguccacguggcacuacgacgaggauaacccauacaagacuugggcauaccacgggucauacgaagugaagcccucaggcagcgccuccucaauggucaaugggguugugcgccuccugacgaagcccugggacgucauuccaauggugacccaaauugcgaugacagacaccacuccguucgggcagcagcgaguguucaaggagaaagucgauaccagaacaccccgggccaagcgcggaacgacgcagauaauggaggugaccgcaaaguggcugugguccuuccucagcagaaacaaaaagccucgcaucuguacccgggaggaguucacccgcaaggugcgcucgaacgccgccaucggugcggucuuuguggaugagaaccaauggaacuccgccaaggaggccguggaagacgagcgauucugggaccugguccaccgggagcgcgagcugcacaagcaaggcaagugcgcgacgugcguauauaacaugaugggaaaacgggagaagaagcucggcgaguucggcaaggcgaagggcagccgcgccaucugguauauguggcuaggcgcccgguucuuagaguucgaagcgcucggcuucaugaaugaggaccauugguucucccgcgagaauagcuuguccggcguggaaggcgagggucugcacaagcucggauacauccugcgggauaucucuaagaucccggguggaaacauguacgcggacgacacggcggggugggacacccguauaacugaggacgaccugcagaacgaggccaaaauaacggacaucauggagcccgaacaugcucuccuggccaccuccaucuuuaagcugacguaccaaaacaaggucgugcgaguccagaggcccgccaagaacggcaccguuauggacgugauaagcagacgagaccaacgcggaaguggccaggugggcaccuacgggcucaauaccuucaccaacauggagguccagcugauucggcagauggagagcgagggcaucuuccugccauccgagcucgagacuccgaaccuggcagagcgcgcccuggauugguuagagaagcacggggccgagcggcugaagcgcauggccaucagcggugaugacugcguggugaagcccauagacgaucgguucgccacugcgcugaccgccuuaaacgacauggggaaaguucgcaaagacaucccucagugggagccauccaaaggcuggaacgauuggcaacaagugccguuuugcagccaccacuuccaccaacugaucaugaaggacggccgggagaucgugguccccugccgcaaccaggacgaguuaguggggcgugcccgcgugucccagggcgcaggguggagccuccgggaaaccgcaugucugggaaaauccuacgcucaaauguggcaacugauguacuuccaccgccgggaucuccgccuggccgcaaaugccaucugcuccgccguacccguggacuggguucccgccucucguacuacuuggucuauucacgcccaucaccaguggaugacgacagaggauaugcugagcguguggaaccguguguggaucgaggagaacccguggauggaggacaaaacccacgugucuagcugggaagagguccccuaccuggggaagcgggaggaucaguggugcgggucccugaucggcuuaacggcccgggcaacuugggcaaccaacauacaaguggcgauaaaccaggugcgacggcucauuggaaacgaaaacuaccuggacuacaugaccagcaugaaacgcuucaagaacgagagugaccccgaaggcgcucugugguga

SEQ ID NO: 24673 - RNA, 9879 nt, Artificial Sequence
  derived and/or modified CDS sequence (opt11) from DENV-1__KC692509__SS-prME
uccgugaccaugcuucuaaugcugcugccgacugcauuggccuuccaccuuaccacucguggaggggaaccccacaugaucgugagcaaacaggagcgggggaagucgcuacuguuuaaaacgagcgccggugugaacauguguacccugaucgccauggaccugggggaguuaugcgaggacacuaugaccuacaagugcccccggaucacugaagccgagccggaugacgucgacugcuggugcaacgccaccgauaccugggugaccuacgggacuugcagccagaccggagagcaccggcgcgaaaagcgguccguugcccuggcuccccaugugggccucggccucgagacccggaccgaaaccuggauguccuccgaaggggccuggaagcagauucagcgcguggagaccugggccuugaggcaucccggguucacggugaucgccuucuuccucgcgcaugccaucggcaccucgaucacccagaaggggaucauauucauccucuuaauguuagucaccccguccauggccaugcgcugcgucggaauuggcaaccgcgacuucguggaggggcucuccggcgccacguggguggacgucgugcucgagcauggauccugugugaccaccauggccaagaauaagcccacccuggacaucgagcuccuaaagacggaggucaccaaucccgcgguuuuacguaagcucugcaucgaggccaagaucagcaacaccacaacggacucccgcuguccgacccaaggcgaagccacucugguggaggagcaggacgccaacuuugucugccggcgaaccuucguggaccggggcugggggaaugguugcgggcuguucggaaagggcucucuccugacgugcgcaaaguucaagugcgugaccaaacuggagggcaagaucguucaguacgagaaccucaaguacucugugaucgugaccgugcauacuggcgaccagcaccaagugggcaaugagacgacugagcauggcaccaucgcgacgauaacgccccaggcccccacaagcgagauucagcugacggauuacggcgccuugacucucgacugcucaccccggaccggccuggauuucaacgagauggucuuguugacuaugaaggagaaguccuggcuggugcacaagcaaugguuccucgaccucccucugccauggacauccggcgccagcaccagccaagagaccuggaaccggcaggaccuccucgugacguuuaagacugcacacgcgaagaaacaggagguagucgugcucggcucccaggagggcgccaugcacaccgcccugaccggggccacggagauccagacaagcggaacuacaacaauuuucgcaggucaccuaaagugccgccugaaaauggacaaguugacucucaagggcgucucuuacgugaugugcaccggcagcuucaaacuggagaaagagguugcggagacucagcacgguacggugcugguacagguaaaguacgaaggcacagacgccccuugcaagauccccuucaguacucaagacgagaagggggucacccagaacggcaggcuaaucacugcaaaccccaucgugaccgauaaagaaaaaccagugaacaucgagaccgagccgcccuuuggggagagcuauaucgucgugggugccggcgaaaaggcacugaaguugucuugguucaagcgcgggagcuccaucggcaagauguucgaagccacagcccgcggggcgcgacggauggccauccugggcgacacugcgugggacuucgggucuaucggcggcguguucaccucggucgggaaacucguacaucagguguucggcaccgccuaugggguccuguucagcggcguuucauggaccaugaagaucgggaucgguauccugcuuacguggcuggggcuaaauagccgguccaccucucucuccaugacuugcauagccgugggcauggucaccuuauaccugggagugauggugcaggccgacagcggaugugucaucaacuggaagggccgcgagcucaagugcggguccggaaucuucgucacgaacgaggugcauacuuggaccgagcaguacaaguuccaggccgacagcccgaagcgccucucagcggccaucggcaaagccugggaggaggggguauguggcauccgguccgccacccggcuggaaaauaucauguggaaacaaaucagcaacgagcucaaccacauccugcuggagaacgacaugaaauucacggugguggucggcgaugccaacggcauccucgcgcaggggaagaagaugauuagaccgcagcccauggagcacaaguauucauggaaaagcuggggcaaggcuaagauaauaggagcagacauacagaacacgaccuucaucaucgacgggcccgauaccccggagugcccugacggccagcgggcauggaacaucugggaaguggaagacuacggauucggaguguucaccacgaauaucuggcuuaagcugcgcgauucauacacccagaugugcgaccaccggcucaugucagcggcuaucaaggacuccaaagcuguccacgccgacaugggcuacuggauugagagcgagaagaaugagacauggaagcuggcgcgggcguccuuuaucgaaguaaagaccugcacguggcccaaaagccacacucugugguccaacggaguguuagagagugagaugaucauccccaagauauucggugggccgauuucccagcauaacuauagacccgguuauuucacccagacggcagggcccuggcaccugggcaaacuagagcucgacuucgaccugugugaggggaccaccguugugguagacgagcacugcggcaaucgcggaccgucguuacggaccaccacgguuaccgggaagaucauacacgaauggugcugccgauccugcacacugccgccccuccgguuccgcggcgaggacgggugcugguacgggauggagauccggccgguuaaagaaaaggaagagaaccuggugcgcagcaugguauccgcuggcuccggggagguggacagcuucucguugggcauccucugcgucagcaucaugauagaggagguaaugcggucccgcuggagucgcaagaugcugaugacugggacguuggccguuuuucuguugcucaucaugggucagcugaccuggaacgacuuaauucggcucugcaucauggugggggcaaaugcguccgaucgcaugggcaugggcaccaccuaccuggcccugauggccacauuuaagaugagaccgauguucgccgucggucuccuguuccgccgacugacgagccgagagguucucuuauugaccaucggucuaucccugguagcaagcguggagcugcccaacucucuggaggagcugggcgacggccuggcgaugggcauaaugaugcucaagcugcuaaccgaauuucagccccaccagcucuggaccacacuguuaagccucaccuucguccggaccacucugagucuggacuacgcuuggaagaccaccgccaugguccucagcaucgugucccucuucccccugugccucagcaccacgucccagaagacaaccuggcuuccggugcugcuuggcagcuucggcuguaaaccccugaccauguuccugaucaccgagaacaagaucugggggcgcaagucauggccacucaacgaggguaucauggccaucgguaucgucagcauacuguugucaucucuccugaagaacgacgugccccuugcgggcccacucaucgcgggcgggauguuaauagccuguuacgugaucagcggcuccagcgccgaucucucccucgagaaagcggcugaggucagcugggaacaggaggccgagcacucgggggcgagccacaacauacugguagagguccaggacgacggcacgaugaagauaaaggacgaggagagagacgacacccugaccauccuccugaaggccacccugcucgcugucagcgggguguacccgaugagcauccccgcaacgcuguucgugugguacuucuggcagaagaaaaagcagcgcagugggguccugugggacacaccuaguccucccgagauggagcgggccgugcucgacgacggcaucuaucguauucuacaacggggucuguugggcaggucccagguaggcgucggcguguuucaagauggaguauuccauaccauguggcacgugaccagaggggcgguauugauguaccagggcaagcgcuuagaacccucuugggccagugugaagaaagaccugaucucauacgggggaggguggagguuccaggguuccuggaacacgggagaggagguacaggugaucgccguggagcccggcaagaaucccaagaacguccaaaccacccccgggacguucaagacacccgagggggaggugggcgcgaucgcgcuagacuucaagcccgggaccucuggcuccccgaucgugaaccgcgagggcaagaucgucgggcuguacggcaauggggucguaaccaccagcggcacuuacguauccgccauagcccaagccaaagcgagccaggaggggccgcuaccagaaauagaggaugagguguucaaaaagcgcaaccucaccauaauggaccugcacccgggcagcggcaagacacgccgguaucuacccgccaucgugcgcgaggcgaucaagagaaaacuacggacccugauucuggcuccuacgagggucguggcgucugaaauggccgaagcgcucaaggggaugcccaucagauaucaaaccaccgccguaaagagcgagcacaccgggcgcgagauugucgaccugaugugccaugcaacguucaccaugcgacuauuaucacccgugcgcgugcccaacuacaacaugaucauuauggaugaagcgcacuucaccgaccccgcgagcaucgccgcccggggauauaucuccacccgcgugggcaugggggaggccgcggccaucuucaugacggccacgccacccggcagcguagaagccuuuccacagucgaacgccgugauccaggacgaggaacgggacaucccggaacggaguuggaacuccggcuacgacuggauaaccgacuuccccgggaagaccgucugguucgugcccagcaucaaguccggaaaugacaucgcgaacugccugcggaagaaugggaagcgcgugauucaacugagccgaaagacuuucgacacugaauaccagaagacuaagaacaacgacugggacuacgucgugaccacagauaucucugagaugggggccaacuuccgugccgauagagugaucgacccucgccggugccucaagccugucauccugaaggacgggcccgagcgcgugauucuggccgguccuaugcccguuacgguugccagcgcagcucaacggcgcggccgcaucgggcguaaccagaacaaggagggcgaccaauacguuuacaugggacagcccuuaaauaacgacgaggaccacgcccacuggacagaggccaagaugcugcuggacaacaucaacacucccgaaggcaucaucccagcucucuucgagccagagcgcgagaaguccgcagccaucgacggggaguaccgacugcgcggcgaggcgcgaaaaaccuucgucgagcugaugcgccggggugaccuccccguguggcugagcuacaagguggcgagcgagggauuccaguacagcgaccgucgguggugcuucgauggcgagcgaaacaaccagguccuggaagagaacauggacguagaaaucuggaccaaggagggggagagaaagaagcuccgcccaagauggcuggacgcgcgcacauacuccgacccgcuagcccuccgcgaguucaaagaguucgcugccggccgucguagugugagcggcgaucucaucuuggagauugggaagcuaccccagcaccugacccuucgcgcucagaaugcccucgauaaucuggucaugcuacacaauuccgagcaaggcgggaaggcuuacagacaugccauggaggagcuccccgauaccauagagacguuaaugcugcucgcccucauugcgguguugaccggcgggguuacccucuucuuccucagcggcaagggccuugggaagaccuccaucggccuucugugcgucacggcgucuucugcccugcuguggauggccucaguggagccccacuggaucgccgcguccaucauacuggaguucuuccucauggugcuccugaucccggagcccgaucggcaacggacuccccaggacaaccagcuggccuacgucgugauagggcucuuauuuaugaucuuaacgguggccgccaacgagaugggacuccuggagaccacgaagaaagaccuggggaucggauacguugccgccgagaaccaccagcaugcgacuauguuggacguagaucugcacccggcuagcgccuggacccuguacgcaguggcaacuacggucaucacccccaugaugcgucacacaaucgagaauacgacagccaacauuucccucaccgcaauugccaaucaggccgcgauccugaugggccuggacaagggguggccaaucagcaagauggacaucggagugccucuccuggcgcugggcugcuacucccaggugaacccacucacccugacggcggccguuuuaauguuaguggcgcacuacgccaucaucggccccggacugcaggccaaggccacccgcgaggcucagaagaggaccgcggccgguaucaugaagaauccgaccguggacggcaucgucgccaucgaucuggauccggugguuuaugacgcgaaauucgagaagcagcugggccagauuaugcugcugauccucugcacaagccagauacuccugaugagaacgaccugggcucugugcgaguccauuacccuggcgaccggcccgcucaccacccucugggaggggagcccgggcaaguucuggaauaccacgaucgcaguuuccauggcuaacaucuuccgggguagcuaucuggccggggcgggccuugcguucucacucaugaaaucucucgguggugggcgccggggaacgggcgcacagggggaaaccuuaggagagaaguggaagcgccagcugaaccagcuauccaagagcgaguucaacaccuacaagcgguccgggaucauggagguggaccgauccgaggcgaaggagggccugaagagaggggaaaccacgaaacacgccguuuccaggggcacugcgaagcuccggugguucguagaaaggaaccuggugaagcccgagggcaaggugauagaccuggggugcggccggggugggugguccuacuacugcgcugggcucaaaaaggucaccgaggugaagggcuauacaaagggaggccccggccacgaggagccgauccccauggccaccuauggauggaaccuggugaaacuucacagcgguaaggauguguucuucaugccgcccgagaagugugauaccuuguuaugcgacaucggggaauccucgccgaaucccaccauagaggaggggcgcacccugcgagugcugaaaaugguggagcccuggcuccgcggcaaucaguucugcaucaagauccugaaccccuacaugccaucagucguggaaacccuggaacagaugcagcggaagcauggggguaugcuugugcggaacccccugucacggaacucaacgcacgagauguacugggucagcugcgggacaggaaacaucguuuccgccgugaacaugaccucgcgcaugcugcuaaaccgcuucacuauggcccaccggaagcccacuuacgagcgcgacgucgaucugggcgcggggacccggcacguagccguggagccagaggucgccaaccuggacaucauuggccagcgaauagagaacauaaagaacgaacacaaguccaccuggcacuaugacgaggacaaccccuauaagacaugggccuaccauggcagcuacgaaguaaagccuuccggcagcgccucuaguauggugaacgggguggugagacuccugaccaagccgugggacguaauccccauggugacccagaucgcgaugaccgacacgacgccguucgggcagcagcgcguguucaaggagaagguugacacccggacgccccgagccaagcguggcaccacgcagauuauggaagugaccgccaaguggcuauggggguuccucucccgaaacaagaaaccccgaaucuguacccgcgaggaguucacgaggaaggugcgcagcaacgccgccaucggggcaguuuuuguugacgagaaucaauggaacagcgccaaggaggccguggaggacgaacgguucugggaucugguccaucgcgagcgggaacugcauaagcaggggaagugcgccacauguguguacaauaugaugggaaagcgcgagaagaagcucggagaguucggcaaggcaaaagguucccgggcuauuugguauaugugguugggggcccgcuuccuggaguucgaggccuugggcuuuaugaaugaagaccacugguucucacgggagaacucacugagcgggguggagggggaagggcugcacaagcugggguacauccugcgcgacauauccaagaucccaggagggaacauguacgccgacgacacagcgggcugggacacccgcaucacagaggacgauuuacagaacgaggccaagaucacggacauaauggagccugagcaugcgcuccuggcgaccaguauauuuaaacugacguaccagaacaaggucgugcgggugcaaagaccagccaaaaaugggaccgucauggacgugaucucccgccgcgaccaacggggcucuggacagguggguacguacggccucaacaccuucacaaacauggagguccagcugauacgccagauggaguccgaggggauuuuccugccuagcgagcucgaaacacccaacuuagcggagcgggccuuggacugguuggagaagcacggcgccgagcgccugaagcguauggccaucaguggggacgacugcguggugaagccuaucgacgaucgcuucgccacugcgcugacagccuugaacgauauggggaaaguacguaaggacauuccccagugggaaccaagcaaaggcuggaacgacuggcaacaggucccuuuuugcucccaccacuuccaucaguuaauaaugaaggacggucgcgagaucgugguccccugccguaaccaggaugaguuagugggccgcgcgcgcgucagucaaggggcgggcuggucccuccgcgagaccgccugccuugguaagagcuacgcgcagauguggcagcuuauguacuuccaccggagagaccugagauuggcugccaacgcuaucuguuccgcagucccgguggacugggugcccgccagccgcacuaccugguccauccacgcccaccaccaauggaugacaacugaagacaugcucuccgucuggaaccguguguggaucgaggagaacccguggauggaagacaagacucacguaucauccugggaggaaguccccuauuugggcaaacgggaggaccaguggugcggcagccugaucgggcugacugcacgcgccacaugggccacgaacauucaagucgcgauaucccaggugcggcgccucauuggcaacgagaauuaccuagauuacaugaccagcaugaagcgguuuaagaacgaguccgacccugagggggcucugugguaa

SEQ ID NO: 24674 - RNA, 9879 nt, Artificial Sequence
  derived and/or modified CDS sequence (opt11) from DENV-1__KC692510__SS-prME
agcgugaccaugcugcucaugcugcugccuaccgcgcucgccuuccaccugaccaccaggggcggggagccccacaugaucguuagcaagcaggagcggggcaaaagcuuacuguucaagacauccgcgggggugaacaugugcacccugaucgccauggacuugggcgaguuaugcgaggacaccaugacguacaagugcccccggaucaccgaggcugagcccgacgacguugacugcuggugcaacgccaccgacaccugggucaccuaugggaccugcagccaaacuggcgaacaccggcgcgagaagcgguccguggcccuggcgccccacguuggccugggguuggaaacccgcaccgaaacauggaugagcagcgagggugccuggcgacagauccagcgcgucgaaaccugggcgcuccggcaccccggguucacggugauugccuucuuucuggcgcacgccauaggcaccucaaucacacagaaagggaucauuuucauacuccugaugcuagugacccccuccauggcaaugcgcuguguaggcaucggcaaucgggacuucguugaggggcuuucaggcgccacguggguggacgucgugcuggagcacggguccugcgucaccaccauggcuaagaacaagcccacccuggacaucgagcuccugaagaccgaagucaccaacccggcggugcugaggaagcucugcauugaggcuaagaucagcaacacaacgacugacucccggugcccaacccagggcgaggccacccugguggaggaacaggaugccaacuucgucuguagacggaccuucguggaccguggcuggggcaacggcugcgggcuguucggcaaggggagccuccugacgugcgcaaaguuuaagugcgucaccaagcuggagggaaagaucguccaauaugagaacuugaaguacuccgugaucgucaccgugcauacgggggaccaacaucaggugggcaaugagacaacagagcauggcaccauagcgaccaucacaccgcaggcccccacuagcgaaauccagcugacagacuauggggcacucacccucgacugcucaccccgcaccggccucgauuucaacgagaugguccugcucacuaugaaggagaaguccugguugguucacaagcagugguuccuggauuugccguuaccuuggaccuccggggccucgaccagucaggagaccuggaaccgccaggaccugcucgugaccuucaagaccgcccacgcaaagaagcaggaggucgucguguuaggcucgcaggagggggccaugcacaccgcgcugaccggagccacagaaauccagacgucaggcacgaccacgaucuucgccggacaccucaagugccgguugaaaauggauaagcuaacccucaagggcauguccuacgucaugugcaccgggagcuucaagcucgagaaagagguggcggaaacccagcacggcacuguacugguccaggugaaguacgaggguaccgaugcaccuugcaagauccccuuuuccacucaggacgagaagggggugacacagaacggccggcuuaucacggccaacccgaucgucaccgacaaggagaagcccgugaauauugagaccgagccaccuuucggggagagcuacauaguggucggagcaggugagaaggcgcucaagcuguccugguucaagcgagggagcuccaucgguaagauguucgaggccaccgcccgaggggcccgccggauggcgauccugggcgauacggccugggacuucggaucaaucggaggcguguucaccuccguggggaagcuuguccaccagguguucggcacagccuacgggguacuguucucgggcgugucguggaccaugaaaauagggaucggcauccugcucacuugguuaggccugaacagccgcaguacgagccucuccaugaccugcaucgccgucgggaugguuacccuuuaccugggcgucauggugcaggcggacucaggaugcgugauaaacuggaagggccgggaacucaagugugggucagguaucuucgucacgaaugaggugcacaccuggacugagcaauacaaauuccaggcagacucuccgaagcgccuaagcgcggcgauagguaaggccugggaggagggggugugcggcaucagauccgccaccaggcuggagaacaucauguggaagcagaucucgaacgagcucaaccacauccugcuggagaacgacaugaaauucacugucguggugggggaugccaauggcauccuugcccaggggaagaagaugauucggccacagcccauggagcacaaguacuccuggaaguccuggggcaaggccaagaucaucggcgcggauauccagaacacgacauucaucaucgacgggcccgauacgccggagugcccagauggccagcgagccuggaauaucugggaggucgaggacuacggguucggcguauucaccacgaacaucugguuaaagcugcgggacucauauacccagaugugcgaucaccgguugaugagugcggcaaucaaagacuccaaggcagugcacgccgacaugggcuacuggaucgaguccgaaaaaaacgaaaccuggaagcuggcccgggcguccuucaucgaggucaagaccugcaccuggcccaagagccauacccuguggucuaacggggucuuagaaagcgagaugauuauccccaagauauucggcgggccgauaucccagcacaacuaucgcccgggcuauuucacacagaccgccgggcccuggcaccuuggcaagcucgagcucgacuucgaccucugcgagggcacuaccguggucguugacgagcacugcggaaauagagguccgagccugcgcaccaccacggucaccgggaagauuauacacgagugguguugccgguccuguacccugccccccuuacgauuucggggagaagacggguguugguacggcauggagaucaggcccguuaaggagaaggaggaaaaccuggugcggagcauggugagcgcuggcucgggggaggucgauagcuucucccuuggcaucuugugcgugucuauuaugaucgaggaggugaugcgcucacgcuggagccguaagauguugaugaccgggacgcucgccgucuuccuguugcucaucaugggccagcugacauggaacgaccuaauccgcuugugcauaaugguuggugccaacgcgucagaccggaugggcaugggcaccaccuaucuugcccuuauggcgacguucaagaugaggccaauguuugcggugggucuccuuuuccggcgccuaacgagccgggaaguccuccugcugaccauaggccuaucuuugguagcaagcgucgagcugcccaauagccucgaggaacugggggauggccuggcuauggggauaaugaugcucaagcuguugaccgaguuccagccucaccagcuuuggacgacccugcugagccugacauucguuaagacgaccuugagucuggauuacgccuggaaaaccaccgccauggugcucagcauagucagucuguucccucugugccucagcaccacuucccagaagacuaccuggcugccagugcuuuuggggagcuucgguuguaagccccugacaauguuucugaucaccgaaaacaagaucugggggcgcaaguccuggccccucaacgagggcaucauggccaucgggauuguaagcauccugcugucgagccuccugaagaacgacgucccccucgcaggcccgcucauugcgggggggaugcugaucgccugcuacgugauaagcggcuccagcgcugaucugucccuggagaaggccgcggaagucagcugggagcaagaggccgagcauuccggggccagccauaacauccuggucgaggugcaggacgauggcacgaugaagaucaaggaugaggagcgggacgacacccugacuaucuugcugaaggccacacucuuagccguguccggggucuaccccaugucaauccccgcgacgcuguucgugugguauuucuggcagaagaagaagcaacgcuccggcgugcugugggacacgcccagcccgccagaggucgagcgcgccgugcucgaugacgggauauaccgcauccugcagcgggggcugcugggccgcucccaggugggaguuggcguguuucaagacgggguuuuccacaccauguggcacgucaccaggggcgcuguucuaauguaccaaggcaagcgccuggagcccucuugggccagcgugaagaaagaccuaaucagcuacgguggcggguggcgguuccaaggauccuggaauacgggggaggagguacagguuaucgccguggaacccggaaagaauccaaagaacguccagaccaccccuggcaccuucaagacacccgaaggggaggugggcgcaaucgcacucgacuucaagccagggaccagcggcucuccaaucguuaaucgcgagggcaagauagucgggcuguacggcaacgggguggugaccaccucuggcacguacgucucggccaucgcccaagccaaggcgagccaggaagggccccugcccgagauugaggaugagguguucaagaagcggaaccucaccaucauggaucuccaccccggcagcggaaagacccgucgcuaccugcccgcaauugugcgcgaggccaucaagcggaaacuccggacucugauccuggcccccacgagagucguagccucagagauggccgaggcccucaaggggaugccuauccgguaucagacaaccgcagucaagagcgagcauaccggccgcgaaaucgucgaccugaugugccacgccacguucaccaugcggcugcucuccccggugcgcgugcccaacuacaacaugaucauuauggacgaggcgcauuucaccgaccccgcgagcaucgccgcucguggguauaucuccacuagggucgggaugggggaggcagcagccaucuuuaugacggcuacgccgcccggaagcguagaggccuucccccagucaaacgccgugauccaggacgaagaacgggacauccccgagcguagcuggaacaguggcuacgacuggaucaccgacuuccccgggaagaccguaugguucgucccuagcaucaaguccggcaaugacaucgcaaacugcuuacgaaagaacggaaaacgcgugauccaacuuagccggaagacguucgacaccgaauaucaaaagaccaagaacaaugacugggacuacgucgugaccacggacaucuccgagaugggcgccaauuuccgcgcugaccgggugaucgacccaagacguugccuaaagccugucauauugaaagacgguccagagcgcguuauccuggccggcccgaugcccguaaccguggcgagugccgcccaaaggcguggccggaucggacggaaccaaaacaaggagggcgaccaauacguguacauggggcagcccuugaacaacgacgaggaucacgcccacuggaccgaggccaagaugcugcuggacaauaucaacacccccgagggcaucauccccgcacucuucgaacccgagagagagaagucugccgccaucgacggggaguaccgccuacgcggcgaggcgcgaaagacuuucgucgagcugaugcgccggggcgaccucccuguguggcugagcuacaaggucgcauccgagggcuuccaguacuccgaccgccgguggugcuucgacggggagcggaacaaccagguccuggaggagaacauggacgucgaaauauggaccaaggagggggagcggaagaagcuccgcccgcguuggcuggacgcgaggaccuacagugacccgcuggcccuccgagaguucaaggaguuugccgccgguagacggagcguaaguggcgaccugauacuggaaaucgggaagcucccucagcaccugacccuccgcgcgcagaacgcgcucgacaaucuugucaugcuccacaacuccgagcaaggcgguaaggccuaccggcacgccauggaggagcugcccgacacgaucgagacgcugaugcuccuugcccucaucgcggugcucaccggcgggguuacacucuucuuccuguccggcaagggccuggggaagaccuccauaggccuccugugcguuacggccagcuccgcccuccuuuggauggccagcguugagccccacuggaucgccgcauccaucauacucgaauuuuuccugauggugcugcugaucccggaacccgaccgccagcggacgccacaggacaaccaguuggcguacgucgucaucgggcuacuguucaugaucuuaacgguggccgccaacgagaugggccuccuggagacgacgaagaaggaccuggggauaggcuacgucgccgcggagaaccaucaacaugcaaccaugcucgacguggaucugcacccagccucugccuggacccuguaugcaguggcgaccacagucaucacgcccaugaugcgccauaccaucgaaaauaccacggcgaacaucucccucacggcgaucgcgaaccaggccgcgauccucaugggccuggacaagggguggccaauaagcaagauggacaucggggugccccuucuggcgcugggcugcuacucccaagugaacccgcuaacccugaccgccgccguccugaugcucguggcccauuacgccaucaucggcccaggacugcaggccaaggccacacgggaggcucagaagcggacugcagccggcaucaugaagaaucccaccguggacggcaucgucgccaucgaccuggaccccgugguguacgacgccaaguucgagaagcagcucgggcagaucaugcugcugauacucugcacuagccaaauccugcugaugcgcacgaccugggcucugugcgaguccaucacccuggcgacuggcccgcucacgacccuaugggaggggagccccgguaaguucuggaacaccaccaucgcugucuccauggcgaauauauuuagaggcagcuaccuggcaggggccgggcuagccuucucccucaugaagucccucgggggugggcgcagagggacgggcgcccagggggaaacccuaggugagaaguggaaacgccagcucaaccagcuuucaaagagcgaguucaacacauacaagagaagcgggaucauggaaguagaucgcuccgaagccaaggagggccugaagcgcggggagaccaccaaacacgccguuagccgcgggacugcgaagcuacgaugguuugucgagagaaacuuggugaaacccgagggcaaggucaucgaccugggaugcggccgcggaggauggagcuauuacugcgccgggcugaagaagguuaccgaagugaagggcuauacaaagggcggucccggccacgaagagccgauccccauggccacguacggguggaaucucgugaagcugcacaguggcaaggacguuuucuucaugccaccggagaaaugcgacacccuguuaugugacaucggggaauccagcccgaacccaaccauugaggagggccgcacccugcgggugcugaagaugguggaacccuggcuccgaggaaaccaauuuuguaucaagauccugaaccccuacaugccgucaguuguagagacccuggaacagaugcagcggaagcaugggggcaugcucgugcgcaauccucugagccggaauucuacgcaugagauguauugggucagcugugggaccggcaauaucguauccgccgugaauaugaccagccgcaugcugcugaauagguucacuauggcccaccggaagccuacguaugaacgagacgucgaccuaggcgcggguacucggcacguggccguggaacccgaggucgcgaacuuggacauaaucggccagcggaucgagaacauaaagaacgagcacaagagcacuuggcacuacgacgaagacaaccccuacaaaaccugggccuaccacgggucuuacgaagugaagcccuccgguagcgccuccucuauggucaacggggucguucggcuacugaccaaaccaugggacguaauucccauggugacacaaauugcaaugaccgauaccacuccauucggccagcaacgcguguucaaagagaaagucgacacccggacgccccgcgccaagcggggaaccacacagaucauggaggucaccgccaaguggcuuuggggguuccucucccgaaauaaaaaaccacgaaucugcacccgcgaagaauucacccgaaaagugcguagcaacgccgccaucggcgccgucuuuguggacgagaaucaguggaacagcgccaaggaggccguggaggaugaacgguuuugggaccugguccauagggaacgggagcuacauaagcagggaaaaugugccacguguguguacaacaugaugggcaagcgcgaaaagaaguugggggaguucggcaaggcaaagggcucccgcgcaauuugguacauguggcugggggcaagauuucuggaguucgaggcccucggguucaugaaugaggaucacugguucagccgagagaacucccugagcgggguugagggcgagggguuacacaagcucggcuacauccugcgagacaucuccaagaucccgggcgggaacauguacgcugacgacaccgccggcugggacacgaggaucaccgaagacgaccugcagaacgaagcuaagaucacggauaucauggagccagagcacgccuuacuggccaccagcaucuucaagcugaccuaccagaacaaggucgugcgggugcagcggcccgcaaagaacggcaccgucauggacgugauuuccagacgcgaucaacggggcagcggccagguggguacguacggucucaacaccuucacaaacauggagguucaacuuauccgccagauggaguccgaggggaucuuccugccgagugagcucgagaccccgaaccuggcagagcgagcccuggacugguuagagaagcacggcgcugagcgccuuaagcggauggccauuuccggggacgacugcgugguaaagcccaucgacgaccgcuucgccacggcgcugaccgcccucaaugauaugggcaagguccggaaagacaucccccaaugggaacccagcaaaggcuggaacgacuggcagcaaguuccguucugcucccaccacuuccaccagcuaauuaugaaggaugggcgcgagaucgugguuccgugccggaaccaggacgagcugguggggcgggccagagucagccagggggccggcuggucccuccgcgagaccgccugucugggaaagagcuacgcgcagauguggcagcuuauguacuuucaccggagagaccuccgucuggccgcuaacgccaucugcuccgcaguucccguggacuggguuccugccuccagaaccacguggagcauccaugcgcaccaccaguggaugacgaccgaggacaugcuguccguguggaaccgcguguggaucgaggagaacccguggauggaggacaagacucacgugaguuccugggaggagguccccuaccucggcaagcgggaagaccaguggugcggaagucucauugggcugaccgcacgcgccacgugggcgaccaacauacaaguggccaucaaccaagugcggcgucucaucggcaacgagaacuaccuggauuacaugaccuccaugaaacgguucaagaacgaaagcgaccccgagggggcccuuugguaa

SEQ ID NO: 24675 - RNA, 9879 nt, Artificial Sequence
  derived and/or modified CDS sequence (opt11) from DENV-1__KC692511__SS-prME
agcgugaccaugcugcucauguugcugcccaccgccuuagccuuccacuugacgacccggggcggggagccccacaugaucguaucgaagcaggagcggggaaagagcuuacuguucaagacuagcguggggguuaacaugugcacccuaauagcgauggaccugggcgaacugugugaagacaccaugaccuacaagugcccccgcauuaccgaggccgagcccgacgacguggacuguuggugcaacgccaccgacaccugggugaccuacgggaccugcagccaaaccggcgagcaccgacgcgacaagcgguccguggcccuggcgccccaugucggccuggggcucgagacacgcaccgagaccuggaugagcuccgagggcgcuuggaagcagauccagaagguggaaaacugggcgcugcggcaccccggguucaccgugauagcacuguucuuagcccaugcaauugguacaagcaucacccagaaggggaucaucuucauccuccugaugcucguaacaccguccauggcuaugcgcugcgugggcauuggaaaccgggacuuuguggaggggcugucgggagccaccugggucgauguggugcuggagcacggguccugcguuacgaccauggccaaaaacaagcccacccucgacauugaacuccugaaaaccgaggugacuaacccggcaguucucaggaagcugugcaucgaggcgaaaaucaguaacaccaccaccgacuccaggugcccgacucagggcgaggccacccuggucgaggagcaggaugcuaacuucgugugcaggcggacauucguggaccgcggcuggggaaacggcugcggccucuucggcaagggaucgcuguugaccugcgccaaguucaagugcgucacgaagcucgagggcaagaucguucaguacgagaaccugaaguauuccgugaucguuaccguccacaccggcgaccagcaccaggucgggaacgagaccacggagcacggcacuaucgccaccaucacgccccaagcgccaaccagcgagauccaacuuaccgacuacggggcccucacccuggacugcagcccccggaccggccuugacuucaacgagaugguguugcugaccaugaaggagaaguccuggcucgugcacaagcagugguuccucgacuugccgcugccguggacguccggggccagcaccagccaagagaccuggaaucgccaagaccuacuggucacguucaagacggcucacgccaagaagcaggagguggucguccugggcucccaggaaggcgccaugcacaccgcccucaccggggccacugagauccaaacuagcgggacgaccaccaucuucgcuggccaccugaaaugccggcugaagauggacaagcucaccuuaaaggggaugucuuacgugaugugcaccgguagcuucaagcuggagaaagagguugccgaaacgcagcacggcaccguccugguccaagugaaguacgagggaacugacgcacccugcaagauccccuuccucacccaggaugagaaaggggucacgcagaacggacgccugaucaccgccaacccaaucgugacggacaaggagaagcccgugaauaucgagaccgagccgcccuucggggagucuuacauaguagugggcgccggggagaaagcccugaagcucuccugguucaagaagggguccucaaucggcaagauguucgaggcgaccgcccgcggugcccgccggauggccauccugggggacaccgcuugggacuucggguccaucggcggccuguucacaucuguggggaagcucauccaccagaucuucggcacggcguacgguguacuuuucuccggcguaagcuggaccaugaagaucgguaucggcauccugcucaccuggcugggccugaacucccgcagcaccagucuaagcaugaccugcaucgccguggggauggucaccuuauaccuuggcgugauggugcaggcugacuccgggugcguuaucaacuggaagggccgagagcugaagugcggcagcggcaucuucgugaccaacgaggugcacacguggaccgaacaguacaaguuccaggccgauucuccgaagcggcugucugccgccaucggcaaggcaugggaagagggggucugcggcauccgcagcgccacccggcuggagaacauaauguggaaacaaauauccaacgagcucaauuacauucugcuggaaaacgauaugaaguucaccguggugguuggggacaucaauggaauccucgcccaggguaagaaaaugauccgcccccagccgauggagcacaaguacagcuggaaguccuggggcaaggcgaagaucaucggcgcggacauacagaacacgacguucaucaucgacgggcccgacaccccggagugccccaacgaucagagggcguggaacaucugggagguggaggacuacggcuucgguauuuucaccaccaauauauggcugaaacugcgcgauucccacacgcagaugugcgaccaccggcuaauguccgcugccaucaaggacagcaaagcggugcaugccgacaugggauacuggaucgaguccgagaagaacgagacuuggaagcuggcacgcgccagcuucaucgagguuaagaccuguauauggcccaagagccacacccuguggagcaacggcgugcucgagagcgagaugguaauaccaaagaucuacgggggcccuaucagucagcacaacuaccggcccggguacuucacgcagaccgccggccccuggcaucuagguaagcuagagcucgauuucgaccugugcgagggcaccacugucgugguggacgagcacugcggcuaccgcgggccgucccugcgcaccaccaccgucacuggcaagaucauccacgaguggugcugucgcucguguacacugccgcccuugcgguuucgcggugaggacggcuguugguacgggauggaaauccggcccgugaaggagaaggaggagaacuuggugcgcuccaugguaagcgcgggauccggcgagguggauagcuucagccucggaauccuguguguguccauccugaucgaggaggucaugcggucacgguggucccggaagaugcucaugacaggcacccuggccguguuccugcucuugauuauggggcagcugaccuggaaugaccucauacgccugugcaucauggugggcgccaacgccagugaccgcauggguaugggcacgaccuaccuggcccucauggccaccuuuaagaugcgcccuauguucgcggucgggcuccuguuucgccggcucaccucucgcgaggugcugcuccucacgguggggcucucucuggucgccuccguggaacuccccaacucucuggaagaacugggcgacggacucgccaugggcaucaugaugcucaaguuacucaccgacuuccaaccgcaccagcuauggaccacccugcuuucucugacguucauccggaccucccuguccuuagacuacgccuggaagacgauggcaauggcccugucuaucgucucccuguuuccccucugccucagcaccacgucccagaagaccacauggcugccggugcucuuaggcaguuucgggugcaagccccugaccauguuccucaucacggagaacaagaucuggggccgcaaauccuggcccaucaacgaggggaucauggccgugggcauugucagcauucugcuguccagucuccugaagaacgaugugccccuggccgggccgcucaucgcgggcggcaugcugaucgcaugcuacgugaucagcggguccagcgccgaccuuucccucgaaaaagccgccgaggucagcugggaggaggaggcggagcacuccggcaccagccacaacauccugguagaagugcaggacgacgguacgaugaagaucaaggacgaggaacgagacgacacccugacuauccuccuuaaggcgacguugcucgccguuuccggcguguaucccaugagcauacccgcgacccuguucgugugguacuucuggcagaagaagaagcagcgcucagggguucuuugggacaccccgagcccgcccgaaguagagcgggcggugcuggacgauggcaucuaccgcauccugcagcggggccugcuggggcgaucccaagucggcguggggguguuucaagacgguguauuccacaccauguggcacgugacgcguggggcagugcucauguaccaaggcaagagacuggagcccaguugggccuccgucaagaaggaccugaucagcuauggcgggggcuggcgguuccagggguccuggaacacgggcgaggaaguccaggugaucgccguggaacccgguaagaacccgaagaacgugcagaccacgcccggaacguucaaaacacccgagggcgaggucggggccaucgccuuggauuuuaagcccggcacgagcggguccccgaucgucaacagggaagguaagaucgugggccuguacgguaaugguguggucacuacaucggggaccuacguguccgcgaucgcccaggcgaaggcuacccaggagggcccccugcccgaaaucgaggacgagguguuuaagaagagaaaccucaccaucauggaccugcauccgggaagcggaaagacgcgcagguaccugccggccaucguccgggaagcgaucaagcggaagcuccgcacucugauacuggcccccacacgcgugguggccagcgagauggccgaggcgcucaaaggcaugcccaucagauaccaaaccacggccgucaaauccgagcacacggguagagagauuguggaucugaugugccacgccacguucaccaugcggcugcucaguccgguccggguacccaauuacaacaugaucaucauggacgaggcucacuucacggaccccgccuccauugcagcccgagguuacaucagcacccgcguggggaugggcgaggccgccgcaaucuucaugaccgcgacaccacccggguccguggaggccuucccacagaguaacgcagucauacaggacgaggagcgggacaucccugagcgcuccuggaacagcggauacgacuggaucacggacuucccgggcaagaccgugugguuugugcccuccaucaagagcgggaacgacaucgccaacugucugcggaagaacggcaagcgcgucauucagcugucccggaaaaccuucgacaccgaauaccagaagacgaagaacaaugauugggacuacguggugaccacggacaucagcgaaaugggggccaacuucagggcggaccgugucaucgacccccgccggugccucaagcccgugauccugaaggaggggcccgaacgcgugauccuggccgggccaaugcccgucaccguggccucugccgcgcagcggaggggccggauuggccgcaaccagaacaaggagggggaccaguacaucuacaugggccagccgcucaacaaugacgaggaucacgcacacuggacggaggcgaagaugcugcuggacaauaucaacacgcccgaggggaucaucccagcccucuucgagcccgaacgcgagaaguccgccgcuauugacggcgaguaccggcuacgcggggaagcacggaaaaccuucgucgagcugaugcgucggggugaccucccgguguggcuguccuacaagguggccagcgagggcuuccaguacagcgacagaagguggugcuuugacggugagcgcaacaaccagguccuggaggaaaacauggacguggaaaucuggaccaaagagggcgagcguaagaaacuucgcccccgguggcuggacgccaggacguacagcgacccgcucgccuuacgggaguucaaagaguucgcggccgggcgccgguccgugagcggcgaccugauccuggagaucgggaagcucccccaacaccugacgcugcgagcucaaaacgcccuagacaaucuggucaugcuacacaacagcgagcagggcgggaaggccuaccggcaugcgauggaggagcucccagacaccaucgagaccuuaaugcugcucgcccugaucgccguucugaccgggggcgugacccucuucuuccugagugggaagggccuagguaagaccagcauagggcugcugugcgucauggccuccagcgcccugcucuggauggccuccguagagccccacuggaucgccgccagcaucauucuggaguucuuccugauggugcuccugauccccgagcccgaccgacagcggacaccccaggacaaccagcuggcguacgucgugaucggccucuuguucaugauccugaccguggcggcuaaugagaugggacuccuggagacgaccaaaaaggaccugggaauuggccacgucgccguggagaaccaccaccacgccacaaugcucgacguggaccuccgccccgccuccgcguggacccucuacgccgucgcgacgaccguuaucaccccuaugaugcggcacacuaucgaaaauaccacggcgaacaucagccucaccgccauugcgaaccaggcagccauccugaugggccuggacaagggcuggcccaucuccaagauggacaucgggguuccccuccuggcccugggaugcuauagccaggucaacccgcucacccugacggccgcgguacugaugcucguggcacacuacgccaucauuggacccgggcuucaggccaaggcgaccagagaggcccagaagagaaccgccgccggcauuaugaagaaccccacggucgacgguaucguuaccaucgaccuggaccccgugguuuacgacgccaaauucgagaagcagcucggucagauaaugcugcugauccucugcaccucccagauauugcuuaugcggaccaccugggcgcucugcgagaguaucacacuggccaccgggccgcugaccacccucugggaggggucccccgggaaauucuggaacacgaccaucgccguuagcauggccaacaucuuuagaggcuccuaucuagccggcgcggggcuggcuuucagccucaugaagucacugggcgguggccggcgcggcaccggcgcccagggagagacccugggggagaaguggaagcggcagcucaaccaguuaagcaaguccgaguuuaauacguacaagaaguccggcaucauggaggucgaccgcagcgaggccaaggaagggcugaagcggggcgagaccaccaagcacgcaguaucccgcgguaccgcgaagcugcgaugguucguggaacgcaaccucguuaagccugagggcaaggucaucgacuugggcugcgggcggggcggguggagcuacuacugcgccggccucaagaagguuacugaggugaagggguacaccaagggcggacccgggcacgaggagccgauaccaauggccaccuacggauggaaccuugugaaauuacacuccgggaaggauguauuuuucacgccgcccgagaagugcgacaccuugcugugcgacaucggcgagagcuccccgaauccaacgauagaggaagggcgcacccugagaguucugaagauggucgaacccuggcuacgcgggaaccaauucugcaucaagauccugaaucccuacaugccgagcgugguggagacacuggagcagaugcagcgcaaacacggcgggaugcucguacguaacccccugucccggaacagcacccacgagauguacuggguguccuguggcacggggaauauugugagcgccgucaacaugacuucccgcaugcuauugaacagguuuacaauggcgcaucgcaagcccaccuacgagcgcgacguggaccugggugccggcacuaggcacguggccgucgagcccgagguggccaaccuggauauaaucgggcagagaaucgagaauaucaagaaugagcacaaaagcaccuggcacuaugacgaggacaacccguacaagaccugggccuaccacggcuccuaugaggugaagccgagcggaagugccagcuccauggucaacggcguuguccggcuccuaaccaagcccugggacgugaucccaauggugacucagaucgcaaugaccgacacuacccccuucgggcaacaacgcguuuucaaggagaagguggacacacggacgccccgggcuaagcggggcaccgcucagaucauggaggugaccgccaaguggcuguggggcuuucucagccgcaauaagaagccgcgaaucuguacgcgggaggaguucacuaggaaggucaggagcaacgcggccaucggggccguguucguggacgagaaccaguggaacagcgccaaggaggccgucgaagacgagcgguucugggaccugguccaccgggagcgcgagcugcacaagcagggcaagugcgccacuugcguguauaacaugaugggcaagcgcgagaagaagcucggugaguucggaaaagccaagggcagccgagccaucugguacauguggcugggcgcccgcuuccuggaguucgaggcgcucggguucaugaacgaggaccacugguuuucccgugagaacagucuguccgggguugagggggagggccuucacaagcucgguuacauccugcgcgacauaagcaagaucccgggcggcaacauguacgcagacgacaccgccgggugggacacacggauaacggaggacgaccugcaaaacgaagccaagauuaccgacauuauggaacccgagcacgcccuccuggcgaccuccaucuucaagcugacguaccagaacaagguugugcgcguccagcgucccgccaaaucuggcaccgugauggacgugaucucccgacgcgaccagcgggggagcggccaggucggcaccuacgggcucaacaccuucacgaacauggaggugcagcugauccgccagauggaguccgaaggcaucuucucucccagugaacuggagaccccgaaccucgcaaagaaagugcuggacuggcuagagaagcacggcgccgagcggcucaaaagaauggccaucagcggcgacgacugcgucgugaagcccaucgacgaucgguucgcgaccgcccugacagcccugaacgacaugggcaaggugagaaaggacaucccucagugggagccuucaaaggguuggaacgacuggcagcaggucccauucugcagccaccacuuccaccagcucaucaugaaggacggccgugagaucgugguuccaugccgaaaccaggaugaguuagucggacgggcacgcgucucccagggcgcgggguggagccugcgggaaacggcgugccucgguaaguccuacgcacagauguggcaguugauguacuuccacagacgcgaucuaagacucgccgccaaugcgaucugcagcgcugugcccguugauugggugcccaccagccggaccacuuggucuauucacgcccaccaccaguggaugacuacggaggacaugcugucgguguggaaccgcguauggaucgaggagaacccguggauggaggauaagacccacguguccagcugggaggaggugcccuaccuggggaagcgggaggaccaguggugcggcucccucauuggucugacagcgcgugcgaccugggcgacaaacauccaggucgccaucaaccaagugcgccggcugaucgggaacgagaacuaccuagacuauaugacuagcaugaagcgcuucaagaacgaauccgaccccgaaggcgcgcugugguga

SEQ ID NO: 24676 - RNA, 9879 nt, Artificial Sequence
  derived and/or modified CDS sequence (opt11) from DENV-1__KC692512__SS-prME
agcguaacuaugcuauuaaugcuacucccaaccgcacucgcauuucaucuuacuacaagaggaggagaaccacacaugaucguaucaaaacaagaaaggggaaagagccuguuauucaaaacgagugcuggcgugaauauguguacgcugauagcaauggaucugggugaacuuugcgaagacacgaugaccuauaaaugcccacgaauuacggaggcagaaccagacgacguagacuguugguguaacgcgaccgauacguggguaaccuacgggacuugcucacaaacuggugagcacaggagagaaaaacguagcguggcacuggcgccacacgucgggcucgggcucgaaacacgcaccgagacauggaugagcagcgaaggggcauggaagcaaauccaaagagucgaaaccugggcuuuacgacacccaggguucaccgugaucgcccucuuucuugcgcacgcaauagguaccucaauaacacaaaagggaauaauauucauacugcucauguuaguuacgcccagcauggcgaugcgaugcguaggaauagggaaucgggacuucgucgaaggccucucgggggcgacuuggguggauguagugcuggagcaugggucaugcgugacuacaauggcaaagaacaagccaacgcuggacaucgagcuacuaaaaacggaggucacaaacccagcgguacuaaggaaacuuugcauagaagcaaagauauccaauaccacaacggauucacgcugcccaacgcaaggcgaagcgacccucguggaggaacaagacgccaauuuugugugucgaagaaccuucguagauagaggcuggggaaacgggugcggccuauuugggaaggggagccugcugacaugcgcgaaguucaaaugcgugacaaagcuagagggaaaaaucguacaauaugagaaccucaaguacagcgucauagucacagugcacaccggagaccaacaccaggucggcaacgaaacgacggaacacggaacgauagccacuauaacaccccaggccccuacaucagaaauccaacucaccgacuacggcgcccuaacauuagacugcucaccgagaacaggucuugacuucaacgaaaugguucugcugacaaugaaggaaaagagcuggcuagugcacaaacaaugguuccuagaccucccauugcccuggacauccggagcaagcacaagucaagagacauggaacaggcaggaccuccuagugacauuuaaaacggcgcacgccaagaaacaggaaguaguuguguugggaagccaagaaggugccaugcauacagcgcugaccggcgcaacggaaauucaaaccucaggcaccacaaccauauucgcuggacaccuaaaaugccgacucaaaauggacaaacuaacccuaaaaggcaugagcuacgugaugugcaccgggagcuucaaacuugaaaaagaggucgcugaaacacaacacggcacuguccucgugcagguaaaauacgagggcacggacgcaccgugcaaaauaccauucucuacgcaggaugaaaaaggagucacucaaaacggccgccuaauuacagccaacccgauagugacagacaaggaaaaaccggucaauauugaaacugaacccccguuuggagagaguuacauagugguaggagccggggaaaaagcucugaaacucucaugguucaagcguggcagcucuauugggaagauguucgaagcgacagcgaggggagcccggaggauggcaauacuaggggacacagcgugggacuuuggcuccauuggcgguguauucacgagcgucggaaaacuuguccaccagguuuucgggacagccuacggaguacuuuucucggggguaaguuggacuaugaaaaucgggauuggcauccuccucaccuggcuuggguugaacagcaggucaaccucacuuucgaugacgugcauugcgguagggaugguaacgcucuaucuaggcguaaugguucaggccgacucaggaugcguaaucaacuggaagggccgagaacucaaauguggcuccggaauuuucgucacaaaugaagugcacacguggacugaacaauacaaauuccaagcggacuccccgaaaagauuauccgcagcaaucggcaaggccugggaagagggcgugugugggaucaggucugcaacacgguuagaaaauauuauguggaaacagauuucuaacgagcucaaucacauccuacuagagaaugacaugaaauuuacaguagucgucggggaugcaaaugguauccuugcccagggcaagaaaaugaucagaccccaaccgauggaacacaaauacagcuggaaauccuggggaaaggcgaaaauaauaggggcggacauucaaaacaccacuuuuaucauagacggcccugacacaccggaaugucccgacggacagcgcgccuggaacaucugggaggucgaggacuacggauucggaguauucacaacuaacauaugguuaaaguuacgugacuccuacacacagaugugugaucaucggcugaugucggcugccauuaaagauucgaaggccgugcacgcggauaugggcuacuggaucgagucggagaaaaaugagacauggaaacucgcucgugccagcuucauagaggucaaaaccugcaccuggccuaaaagucacacacuauggucaaacggaguccucgagucugagaugaucauccccaagauuuuuggagggccaauaucccagcauaacuaccguccagguuacuuuacgcagaccgccgggcccuggcacuuggggaagcuagaacuggacuucgaccucugcgaaggaacaacggucgucguggacgaacauugcgguaauagggggcccagcuuaagaacaacaacagucaccggaaagauuauccaugaauggugcugucggagcuguacacuaccgccccuaagauuccgaggggaggacggcugcugguacggcauggaaauccgaccggugaaagagaaagaagagaaccugguuagaaguauggucagugcggggagcggcgaagucgacuccuucucccuaggcauucuauguguaucgauuaugauagaggaggugaugcggucaagauggagccgcaagaugcucaugaccggaacgcuagcagucuuucugcuacuaaucaugggacaacuaaccuggaacgacuuaauacggcucugcauaauggugggcgccaacgcaucagaccgcaugggaauggguacaaccuaccucgcguuaauggcaacauucaagaugcggccuauguucgccguggggcuauuguuucgacgauuaaccagccgcgaggugcuucuacuuacaaucggccuaagccucguugcuagcgucgagcugccuaacagucuagaagaacucggcgacggacucgccauggguauaaugaugcugaagcugcucacggaguuucaaccccaucaacuguggacgacccugcugucacuaaccuucgucaagacuacacugucacucgauuacgccuggaagaccacagcaaugguucugucgaucgugagucuguucccucucugcuugucaacgacuagccagaaaacaacauggcucccgguccuuuuagggaguuucggcugcaaaccacuaacgauguuccuuauaaccgaaaacaaaaucugggggcggaagucguggccgcucaacgaaggaauaauggcaaucgguauagugagcauauuacucagcagccuccucaagaacgaugugccccuugccggaccccuaauagcgggaggcaugcugauagccuguuacgucaucucgggaagcagcgcggacuuaagccuagaaaaagcagccgaaguaucgugggaacaagaggcggagcacucuggcgcuucccauaacauccuagucgaaguucaagacgauggaaccaugaaaauaaaagacgaggagcgcgacgacacucuuacgauauugcucaaagcgacauuacuggcagucaguggagucuaccccaugagcaucccagccacccuuuucgucugguauuucuggcagaagaaaaagcagcguagcggcguauugugggacacaccaaguccuccugaaguagaacgagcggugcuggacgauggaaucuauaggauccuacaacggggccuccugggaaggagucagguaggaguuggggucuuccaagacgggguauuccacacaauguggcacgugacaagaggcgcggugcuaauguaccaagguaaacggcucgaacccucgugggcaagcguaaagaaagaccucaucuccuacggaggcggauggagguuccagggaucauggaauacaggagaagaggugcaagugauagcuguggaaccagggaaaaaccccaaaaacguacaaacgacacccgggaccuuuaaaacaccagagggcgaggucggagcuauagcacucgacuucaaaccgggcacgaguggaagucccauuguaaaucgagaagagaaaaucgugggacuguacggcaacgggguggugaccaccuccggcacguacgugagugcgauagcucaagcgaaggcgucucaggagggcccauuaccggagauugaggacgaaguauucaaaaagagaaaccuuacaauaauggaccuacaccccggaucgggcaaaaccagacgauaccuuccagccaucguccgugaagccaucaagagaaaacuacgaacacuuauacuggcaccuacgagagucguggcaagugaaauggcggaagcgcucaaaggcaugcccauacgcuaccaaacaaccgcagucaagucagaacacaccggccgugagauaguugaccucaugugccacgcaacuuucaccaugagacugcucucaccggugagaguacccaacuacaauaugauaauaauggacgaagcucacuucacagaucccgccaguauagcugcucgaggcuacauaucaacacggguaggaaugggcgaggcggcggcaaucuucaugaccgcuacuccgccagguagcguagaggcguucccgcagucaaaugcagucauccaggacgaggagcgcgacauucccgagaggagcuggaauagcggcuaugacuggauaaccgacuuuccgggaaagacggugugguucguccccucgaucaaaucaggaaaugacaucgcaaauugccuccgcaagaaugggaaaagaguaauccagcugucgcgaaaaacguucgacacggaauaucagaaaaccaaaaacaacgacugggacuacgucguuacaacugacauaucagagaugggggcaaacuuuagagcagaccgaguaaucgaccccagacgaugccuuaaaccuguaauucucaaggauggcccugaaagaguaauacuagcuggacccaugcccguuacggucgccagcgccgcacaaagacggggcagaauaggaagaaaucagaacaaggaaggugaucaguacguuuauaugggacagccccugaacaacgaugaggaccacgcacacuggacagaggcaaaaaugcuucuggacaacauuaacacccccgaaggaauaauaccagcacuauucgagccggagagggagaaaagcgccgcuauagacggcgaguaccgacucagaggcgaagcacgcaaaacguucgucgaacucaugagaagaggugaccuccccguauggcugucauauaagguagcgucagaaggcuuucaauacuccgaucgccgcuggugcuucgacggggaacggaacaaccaaguauuggaagaaaacauggacgucgagauauggaccaaagagggggagaggaagaaauugagaccgcgcugguuagacgcgagaaccuacagugauccucuggcgcuaagggaguucaaagaguucgcagccggcagaaggagcgucagcggcgauuuaauccuggaaauagggaaacugccccagcaccuaacccugcgagcucagaacgcacuugauaaucucguaaugcuccacaacagcgaacaaggcgguaaagcguauaggcacgcgauggaggaauugccagacaccauagaaacacucauguugcuagcccucauagccguacucaccggcgggguaacgcuauucuuccucagcgggaaggggcuuggaaaaacgagcauaggacuacuaugcguuacagcgucaagcgcauuguuauggauggcaagugucgaaccucacuggauugcagcauccaucauacucgaguuuuuccucauggugcuccucauaccagaacccgacagacagagaaccccgcaggauaaucaacuagcguacguugugauaggauuacucuucaugauccugacaguugcggcaaacgaaaugggccuacuggaaaccacgaaaaaggaccuaggcauaggacacguggcugcggaaaaccaucaacauuccaccaugcuagacguagaccuucaccccgcuagcgcguggacccuguacgccguugccaccaccgucauaaccccgaugaugcggcacacaauagagaacacgacagcgaacauaucucugacggcaauagcaaaccaagcagccauccugaugggccuagacaaaggguggccaauuuccaaaauggauaucggaguaccacugcuagcccuaggaugcuacucgcagguaaauccgcuuaccuugacagcagcaguccuaaugcucgucgcccacuacgcgauaauaggaccaggucuacaagcgaaagccaccagagaagcccagaaacguaccgccgcggguaucaugaagaaccccacaguggacggcaucguagccauugaccuagaucccguaguauacgacgcgaaauuugaaaaacaacuaggccagauaaugcuacuuauccucugcacaucacaaauucuccuuaugcggacaacgugggcacuaugcgaaagcaucacccuggcuacgggaccccuaacaacacuuugggaagguagcccagguaaguuuuggaauacaacaauugccgugaguauggcuaacauuuuccgagggucuuaccuagcgggagccgggcuggcuuucucucucaugaagucauuaggcgggggcaggcgaggaaccggcgcccaaggcgaaacccuuggugaaaaauggaaacgccaacuaaaucaguugagcaaaagcgaguucaacacuuacaaacgaucgggcauaauggagguagaccggucggaagccaaagaagguuuaaaacgaggggaaacgacgaaacacgcaguaagccgaggcaccgcaaaguuacgcugguucguagaacguaaccucgucaaaccagaaggcaaggucauagaucuuggguguggccggggcggcuggaguuacuacugcgccggacuaaagaaagucacagaaguaaaaggauacaccaagggaggaccuggccacgaagaaccaaucccaauggccacauauggauggaaucuagugaagcuccacucggggaaagacguauucuucaugccgccugagaagugcgacacucuccuuugcgauauuggggagagcagcccgaauccgacaauagaagagggaagaacccuaaggguccucaaaauggucgaaccguggcuccgcggcaaccaauucuguaucaaaauacuuaauccguacaugcccagcguagucgagacauuggagcaaaugcagcguaaacacggcgguaugcucguacgcaacccccucagucggaacagcacucacgaaauguacuggguaagcugcggaacgggaaacauagugucugcagugaacaugacaagccgaaugcugcuuaaccgcuucacaauggcgcaucggaaacccacguacgagagagacguggaccugggggcagggaccagacacguagcaguggaacccgagguagcaaaccuggacaucauagggcagaggaucgaaaacauaaagaacgagcauagguccacauggcacuacgacgaggacaacccauacaaaaccugggcguaccacgguucauacgaaguaaagccaaguggcuccgccagcucuaugguaaacggcguaguacgccuacuaaccaagccuugggacguaauaccaaugguaacucagaucgcgaugaccgacaccacaccuuuugggcaacagcgugucuuuaaggagaaggucgacacucguacgccaagagcaaagcgcggaacaacccaaaucauggagguaacggccaaauggcucuggggcuuucuaagccggaacaagaagccacguauaugcacccgagaggaguucacccgcaaaguccguagcaaugcugcgauaggagcaguauucgucgacgaaaaccaguggaacuccgccaaagaggcgguggaagacgagcgcuucugggaccugguccaccgagagagggagcuacauaagcaagggaagugcgcaacaugcgucuacaacaugauggggaagcgagagaaaaagcuaggagaguucggcaaggcuaaagggucccgagccauaugguacauguggcugggagcgagguuccuagaauuugaggcucucggauucaugaacgaagaccacugguucagcagagaaaacuccuugagcggggucgaaggggagggccuucacaaacuaggcuacauccuaagagacauuucgaaaauaccaggcggaaauauguacgcagacgauaccgcaggcugggacacgcgaauuacggaagacgaccuccagaacgaagcaaagauuaccgauauaauggagccagaacacgcgcuacucgcgacaucaaucuucaaauugacauaccagaacaaaguaguacgagugcaaagaccagccaaaaacgggacugucauggacguaauaucccgucgcgaccagagaggcagugggcaagucgggaccuacgguuuaaacacauucacaaacauggaagugcaacugauccgccaaauggagucugaaggcaucuuucuccccucggagcuagaaacaccaaaccuagcagaaagggcacucgauuggcucgagaagcauggugccgagcgccugaagaggauggccauauccggcgacgacugcgucguaaagcccauagacgaccgguucgcaaccgcccuaacggccuuaaacgacauggguaaaguacgaaaagauauaccucagugggagcccuccaagggcuggaacgacuggcaacagguaccauucugcucccaucauuuccaucagcuaaucaugaaagaugggcgugaaauagucgugccgugcagaaaucaggacgagcugguugggagagcacgggugucccagggagccggauggucccuccgcgagacugcaugccuuggaaaaucguacgcccaaauguggcagcucauguacuuccaccgccgagaccuacgccucgcggccaacgcaaucugcagcgcgguuccgguagacugggucccggccagcaggacaacauggucaauccacgcacaucaccaauggaugacgacagaagacauguuaucaguauggaacagaguauggaucgaagaaaacccuuggauggaagacaaaacacacguaagcuccugggaagaggucccguaccugggcaagagagaagaccaguggugugguucacucaucggucuaacggccagagcaacaugggccacgaacauucaggucgcaauaaaccaaguccgucgccucauugggaaugaaaacuacuuagauuauaugaccucaaugaagagguucaagaacgaaucggacccggagggggcacuuugguaa

SEQ ID NO: 24677 - RNA, 9879 nt, Artificial Sequence
  derived and/or modified CDS sequence (opt11) from DENV-1__KC692513__SS-prME
agcgugaccaugcugcucaugcugcugcccacugcccucgccuuccaccugaccacccggggcggggagccccacaugaucgugaguaagcaagaaaggggcaagagccugcuauucaaaaccuccgugggggugaacaugugcacccugauugcgauggaccugggggagcucugugaagacacuaugacuuauaaguguccccgcaucacagaggccgaaccggacgacguugacugcuggugcaaugcgaccgauaccugggugacauacggaaccugcagccagacuggcgagcaccggagggacaagcggucgguggccuuggcgccccacgucggccuggggcucgagacgcgcaccgagaccuggaugagcuccgagggagcuuggaaacagauccagaagguggaaaccugggcccugcggcaccccggguucacggugaucgcccuguuccucgcccaugcgaucggcacgaguaucacgcagaaggggaucaucuucaucuuacugaugcucgucacccccuccauggccaugcgcugcgugggcaucggcaaccgugacuucguggaggggcugaguggcgcgacgugggucgacguggugcuggagcacggguccugcgucaccaccauggccaagaacaagcccacucuggacaucgaguuacuaaagacagagguuacaaaccccgccgugcuacgaaagcugugcaucgaggcgaagaucagcaauaccaccacagacucccgcugcccgacccagggcgaagcgacucuuguggaggagcaggaugccaacuucgugugcagaaggaccuucguggaccgcggcugggggaacggaugcggccucuucggcaaggggagccugcugacgugcgccaaauuuaaaugcgucaccaaacucgagggcaaaaucguacaguacgagaacuugaaguacagugugaucgugacggugcacaccggcgaucagcaccagguugggaaugagaccaccgagcacggcaccaucgcaaccaucacaccccaagcgccaacuucugaaauucaacugacugauuacggugccuuaacacuggauuguuccccaagaacgggccuggacuucaaugagaugguccuccugacgaugaaggagaagucauggcuggugcacaagcagugguuccucgaccuuccccugcccuggaccuccggggccagcacgccccaggagaccuggaaccgccaagaccuuuugguuacguucaagaccgcacacgccaagaagcaggagguagugguucugggcucacaggagggcgcgaugcacaccgcacucacgggcgccacugagauccagacuucuggaaccaccacgaucuucgccgggcaccugaagugucgacugaaaauggacaagcucacgcugaaggguaugucauacgugaugugcaccggcuccuucaaguuggagaaggagguggccgaaacccaacacggcacgguguugguacaagucaaguaugagggcaccgaugcgcccugcaagaucccguuucucacgcaggacgagaagggggucacccaaaacggaaggcuuaucacggcaaaccccaucgucaccgacaaggagaagcccguuaacaucgagacagagcccccguucggcgagagcuacauugucgugggcgcaggggagaaagccuuaaaguuauccugguucaagaaggggagcucuauuggcaagauguucgaggcgaccgcccguggagcccgacggauggccauccuaggcgacacggccugggacuucgguagcaucggcggacuguucacuuccguggggaagcucauccaccaggucuucgguacugcuuacggcgugcuuuucaguggcguguccuggacuaugaaaauuggaauuggaauccugcucacauggcugggccugaacagccgcagcacgagccuauccaugaccuguaucgccgucgggauggugacccuguacuuaggcgugaugguacaagcagacagcggcugugugauaaacuggaaaggcagagagcucaagugcggauccggcaucuuugugaccaacgaaguccacaccuggaccgaacaguacaaguuccaggccgacucacccaagcgucugucagcagcuaucgggaaggccugggaggagggagugugcgguauccgcagcgccaccagacuggagaacaucauguggaagcagaucagcaacgaacucaacuacauccugcuggagaacgacaugaaguucaccgucguggugggggauaucaauggcauccucgcccaggggaagaagaugauccgaccccagccgauggagcauaaguacuccuggaaauccuggggcaaggcgaagaucauaggcgcggacauccagaacaccaccuuuauaaucgacgguccggacacgccugagugcccugaugaccagcgggccuggaacauaugggaaguugaggauuacggguucgggaucuucacaacgaacaucuggcuuaagcuaagagauucgcacacccagaugugcgaccaccggcucaugagcgccgcgaucaaggauuccaaggcgguccacgccgacaugggcuauuggaucgagagcgaaaagaaugagaccuggaaauuggcccgcgccuccuuuaucgaagugaagaccugcaucuggcccaagagccacacacugugguccaauggcguucuugaauccgagauggucauccccaagaucuacgggggcccaaucagccagcacaauuaccggcccggcuacuuuacccagaccgccgggccguggcaccucgggaagcuggaacuugacuucgaccuaugcgagggcaccacggucguggucgaugagcacugcggcuaccgcggucccucgcugcggaccaccacagugaccggaaagauuauccacgaguggugcugccgauccugcacgcugccgccccuucgguuccgcggggaggauggcuguugguaugggauggagauccggccggugaaggagaaggaggagaacuuaguccgcagcaugguguccgcgggcucuggcgagguggacucauuuagccucgggauacugugcgucagcauccuuauugaggaggugaugcggucacgauggagccggaagaugcucaugaccggcacccuggcgguguuccugcuucucauuaugggucagcugacuuggaacgaccucauccgccugugcauaauggucggcgccaacgccucugaucgcauggggaugggcaccaccuaccuugcccucauggcuacauuuaagaugcggcccauguucgcaguuggccugcuguuccgccgccuaacuagcagggaaguucuguuacucaccgugggacugucccugguagccagcgucgagcucccaaacucucuggaggagcugggagauggucucgccaugggcaucaugauguuaaagcugcucaccgauuuccagccccaccagcuguggaccacgcugcucagccugacauucauccggacuucccugucgcucgacuacgcauggaaaacaauggcuauggcccugucgauuguaagucuguucccgcuuugccuguccacgaccagccagaaaaccacaugguugccuguguugcugggcuccuucgggugcaagccgcuaacgauguuccucaucaccgagaacaagaucuggggccgcaaaucauggccaauaaacgaggggaucauggccgucggaaucguguccauccugcugaguucccuccugaagaacgacgugccgcuggccggaccucucaucgcgggcgguaugcugaucgcgugcuacgucaucucuggcagcuccgccgaccuaagccucgagaaagcggcugagguguccugggaggaggaggccgagcacagcggcaccucccacaacaucuuaguggagguccaggaugacgggaccaugaagauaaaggacgaggaacgggacgacacccuaacgauccuucugaaggccacccuccucgccgugagcggcguguauccuauguccauuccugccacccuguucguaugguacuuuuggcaaaagaagaagcagcgcaguggggugcugugggauacuccgagcccucccgagguggagcgcgccguccuggacgacggaaucuaccggauccuccagcggggccugcuggggcgcagccaggucggggugggggucuuccaagacggcguguuccacacgauguggcacgugacacgcggggcgguccuaauguaucaggguaaacgcuuggagccuuccugggccagcgugaagaaggaccugaucuccuacggaggggguuggcgguuucagggcaguuggaacaccggcgaggagguacaaguaaucgcugucgagccgggcaagaauccgaagaacgugcaaaccacucccggcaccuuuaagacgcccgagggcgaggucggggccaucgcccucgacuucaagccggggaccucugggucucccauugugaaccgcgagggcaagaucgugggccuguacgggaacgguguggugaccaccuccgggaccuacgugagcgccauagcccaagccaaggccacacaagaggggccccuuccggagauugaagacgaggucuucaaaaaacggaaccucacgaucauggauuuacacccuggguccggcaagacuagacgguaccugccugccaucguccgggaggcgauuaagcggaagcuccgcacccugauccuggccccgacccgcguggucgcaagcgagauggcagaggcgcucaaaggcaugccgaucagauaccagacuaccgccgucaaaagugagcacacagggagagagaucguggaucugaugugccaugccaccuucacgaugcgacuuuuguccccagucagagugccuaacuacaacaugaucaucauggacgaggcccauuucaccgacccugccagcauagcggcccggggcuacauauccacacgugucgggaugggcgaagcagccgccaucuucaugacagcgacgccuccagggagcgucgaggcauucccccaguccaaugccgugauccaggacgaggagcgcgacauaccugagcggaguuggaacuccggguacgacuggaucaccgacuuuccaggcaagaccgugugguucgugcccagcaucaaguccgguaaugacaucgccaauugucugcggaaaaacggcaaacgcgugauacagcucagccggaagacuuucgacacggaauaccagaaaaccaagaacaacgauugggacuauguugucaccaccgacauaucagagaugggggccaacuuccgugcggaucgggugaucgacccccgccgaugcuugaagcccgugauccugaaggagggcccggaacgcguuaucuuagccgggcccaugcccguuacggucgccagcgccgcccagcggcggggccggaucggcagaaaccaaaacaaggagggggaccaguacaucuauaugggccagccccucaacaacgaugaggaccacgcccacuggaccgaggccaaaauguuguuagacaacaucaacaccccggaggggaucauucccgcccucuucgagcccgagcgcgagaaaucagccgcgaucgacggcgaguaccgucugaggggagaggcccggaagaccuucguggaguugaugagaaggggagacuuaccuguguggcucagcuacaaagucgccuccgagggauuccaguacagcgaucgccgguggugcuuugacggggagcgcaacaaccagguccuggaggagaacauggacguggagaucuggacgaaggagggcgaacgaaagaagcuucgcccccgguggcuggacgcacgcaccuacucagacccuuuggcacuccgggaguuuaaagaguucgcggccggaaggcggagcguuuccggcgaccugauccuggagaucggcaaacucccccaacaccugacucugcgcgcccagaacgccuuggacaaccuggugaugcugcacaacagcgagcagggcgggaaggccuacagacacgcaauggaggaacugccggacaccaucgagacccugaugcugcucgcccugaucgcgguucugaccggcggugucacucucuucuuccugagcggaaagggucuaggcaagaccagcauugggcuccuuugcgugauggccagcuccgcucuccuguggauggccagcguggagccgcacuggaucgccgccagcaucauccuggaguucuuucugaugguccuccugaucccugagcccgacaggcagagaacgccccaggacaaccaacuggccuacgucgugaucggacuccuguucaugauucugacggucgccgccaacgagauggggcugcuggagaccacaaaaaaggaccuggguaucgggcacguggccguggaaaaccaccaccaugcaaccaugcucgacguugaccugcgccccgccagcgccuggacguuguaugccguggccaccacagugaucaccccuaugaugaggcacacgauugagaacaccaccgccaauaucucgcucaccgccaucgcgaaccaggcugccaucuuaaugggacuugacaaaggcuggccgaucagcaagauggacaucggggucccguugcuugcucugggaugcuauucccaggucaacccccucacgcugaccgccgcgguacugaugcucgucgcccacuacgcaaucauuggcccugggcuucaggccaaagcuacccgcgaggcccagaagcgcacggccgcgggcaucaugaagaaucccaccguggacggcaucgugaccaucgaccuagauccgguaguguacgacgcuaaguucgagaaacaguugggccagaucaugcugcugauccucugcacgagccagauccugcucaugcggaccacgugggcgcucugugagagcaucacccuggccaccgggccccugaccacguuaugggagggcagccccgggaaguucuggaacaccacaaucgccgucuccauggccaacaucuuccgcggaagcuaucuagccggagcugggcuggccuuuucccucaugaagucccugggcgggggccggcgcgggaccggcgcucagggcgagacccugggcgagaaguggaagcgacagcucaaccagcuguccaagucugaguucaacaccuacaaaaaaaguggcaucauggagguggaccgaagcgaggccaaggaggggcugaagcgcggcgagacaaccaagcacgcggugagccgcgggaccgcuaaacugagaugguuuguggaacggaaucucgugaagccggagggcaaagugauugaccucggcugcggucggggcgggugguccuacuacugcgccggccugaagaaggugaccgaagucaagggguacaccaaggguggcccagggcaugaggaaccuaucccaauggcuacguauggcuggaaccucgugaaguuacacagcgggaaggacguguucuucacaccgcccgagaagugcgacacgcuacuuugcgacaucggagaguccagccccaaccccacaaucgaagaaggucgcacccugcggguccugaaaaugguagagcccuggcuccgcggaaaccaguuuugcaucaaaauacuuaaucccuauaugcccuccguuguggagacccuggagcagaugcaacggaagcacggcgggaugcucgugagaaauccccugagccggaacucaacgcaugagauguauugggugucuugcgggacggggaacauagugucugccgugaacaugaccagccgcaugcugcucaaucgguucacaauggcgcaucgcaaacccacguacgagcgcgauguggaccugggcgccggcacccggcaugucgccgucgagccggaaguagccaaccucgacaucaucgggcagcgcauugagaacaucaagaacgagcacaaaagcaccuggcacuacgacgaggacaaccccuauaaaaccugggccuaccacggaucauacgaggucaagcccuccgguagcgcauccuccauggugaacggcgucgugcgguugcugacgaaacccugggacguaaucccgauggucacccagauagccaugacagauacaacacccuucgggcaacagcgcguguucaaggagaagguggacacccggacgccccgggccaagcgaggcaccgcccagauuauggagguaacggcaaaguggcuguggggcuuccucucccgcaacaagaagccgcggaucugcacccgcgaggaauucacccggaagguccgcagcaacgcggccaucggggccgucuucguugacgagaaccaauggaacuccgccaaggaggccgucgaagacgagcgguucugggaucuggugcauagagagcgggagcuacauaaacagggaaagugcgcgaccugcgucuacaacaugauggggaaacgggagaaaaagcucggagaguucgggaaggcuaaaggcucccgagccauuugguacauguggcugggcgcccgguuccuggaguuugaggcgcucggguucaugaacgaggaccacugguucagccgugagaacucccuuucaggcgucgagggggagggccugcacaaacuuggcuacauccugcgcgacaucucuaagauccccgggggcaacauguaugccgaugacacggccgggugggacacccggaucaccgaggacgacuugcagaacgaggcaaagaucacagauaucauggagcccgagcaugcccuccuggcgaccagcaucuucaagcugaccuaccagaacaaggugguucgagugcagcgccccgccaaguccggcaccguuauggacgucaucagccggagagaucaacggggguccggccaggugggaaccuacgggcuaaauacuuucaccaauauggaagugcagcugauucgccagauggagagcgagggcaucuucuccccgucggagcuggagacccccaaccucgcgaagaaaguccuggacuggcuggagaagcacggugccgagcggcucaagcgcauggccaucuccggcgacgacugcgugguuaagcccaucgaugaccgguucgcgaccgcccugacggccuugaacgacaugggcaagguccggaaagacaucccccagugggagccgagcaagggcuggaacgauuggcagcagguccccuucugcucacaccacuuccaccagcucaucaugaaagacgggcgggagauagugguccccugccgcaaucaggacgagcugguggggcgggcccgcgugucucagggcgccggguggucacugcgggaaaccgcuugccucggcaaaucguacgcccagauguggcagcugauguauuuccaccgacgggaccugcgcuuagcagccaacgccaucugcuccgcgguccccguggauuggguacccaccucucggacaaccuggagcauucacgcccaccaccaguggaugacaaccgaggacaugcuguccgucuggaaucgcguguggaucgaggagaaccccuggauggaggacaagacccacgugagcuccugggaggagguccccuaucuggggaagcgggaggaccaguggugcggcagccugauugggcugaccgcccgcgccacgugggcgaccaacauccagguggccaucaaccagguucgucggcugaucggcucagaaaacuaccucgacuacaugaccaguaugaagcgcuucaagaacgaguccgacccagaaggcgcccuaugguga

SEQ ID NO: 24678 - RNA, 9879 nt, Artificial Sequence
  derived and/or modified CDS sequence (opt11) from DENV-1__KC692514__SS-prME
ucgguuaccaugcuguuaaugcugcugcccaccgcccuggccuuccaccugaccacccgcggcggggagccccacaugaucgugucaaagcaggagcggggcaagucgcuccuuuucaagaccucggccggugugaauaugugcacccugaucgccauggacuuaggcgagcuaugcgaggacaccaugaccuacaagugcccccgcaucaccgaggccgagcccgacgacguggacugcuggugcaaugccaccgacaccuggguaaccuacggaaccugcagccagaccggcgagcaccggcgagagaagcguuccguggcccuggcuccccacgugggucugggucucgagacccgcacggagaccuggaugagcuccgagggcgcuuggcggcagauccaaagggucgagacuugggccuuacggcaccccggcuuuacugugaucgccuucuucuuggcgcacgcgauugguaccagcaucacccagaaggggaucaucuucauccuccugaugcuggugacccccuccauggccaugcgcugcgucggcaucgggaaccgggauuucguggaggggcucagcggcgccacguggguggacgucgugcuugagcacggguccugcgugaccacgauggccaagaauaagcccacacuugacaucgagcuccugaagacggaagucaccaauccagcggugcuccgcaagcucugcaucgaggccaagaucaguaacacgaccacggacucccggugcccgacacagggggaggccacccugguggaggagcaggacgccaacuucgucugccgccggacauucguggacagaggcuggggcaauggaugcgggcuguucggaaaggggagccuccugacaugcgcaaaauucaaauguguaaccaaacuugagggcaaaaucguccaguacgaaaaucucaaguacuccgugaucgugaccguccauaccggcgaccaacaccagguagggaacgagacgaccgagcacggcaccaucgcgaccaucacaccccaggcccccaccagcgagauucagcugacggacuacggggcccugaccuuagauugcagcccccggaccgggcuggacuucaacgagaugguauuacucacgaugaaggagaaguccuggcuggugcauaagcagugguucuuagaccucccgcugccauggaccuccggggcgagcacuucucaggagaccuggaaccgccaggaucugcucgugacguuuaagaccgcacacgcgaagaaacaggagguaguggugcugggcucccaagagggugcgaugcacacagcccugaccggggccacugagauccagacaaguggcaccaccaccaucuuugccgggcaccucaagugccgguuaaagauggacaagcugaccuuaaagggcauguccuaugucauguguaccggcuccuucaaacuggagaaagagguggcggagacccagcacggcacugugcugguccaggugaaguacgagggaaccgacgcccccugcaaaaucccauucucuacccaggaugagaagggggugacccagaacggccgccuaaucacggcaaacccgauagucaccgacaaggagaagcccgugaacauugagaccgagccgccauucggcgaaucuuacaucguggucggggccggugagaaagcgcucaagcugaguugguucaaacgggggagcuccauaggcaagauguucgaagcgaccgcgcguggugcccgccggauggccauucuaggcgauacggcaugggacuucgggagcaucggcggcguguucaccuccguugggaaguugguccaccagguuuucggcaccgcuuacgggguguuguucagcggcgucaguuggacaaugaagaucgggaucggcauacuccugaccuggcugggccugaacagccgcucgaccagccucuccaugacaugcaucgccgucgguauggugacccuguaucuuggcgucauggugcaggccgacagcgggugugucaucaacuggaagggccgugagcucaagugcggguccggaaucuucgucacgaacgaggugcacaccuggaccgagcaguacaaguuccaggccgacucuccgaagcgccugagcgcggccaucgggaaagccugggaggagggggugugcggcauccgguccgccacccgucuagaaaauaucauguggaaacagauuucuaacgagcucaaccacauccugcuggagaacgacaugaaguucaccgucguggugggggacgccaauggcauccucgcacaggggaagaagaugauacgaccccaaccaauggagcacaaguauuccuggaaguccuggggcaaagcaaagauaaucggcgccgacauccagaacacgaccuucaucaucgacgggcccgacaccccggagugccccgacggccagcgagccuggaacaucugggaggucgaggacuacgguuuuggcguguucaccacgaacauuuggcugaagcugcgggacaguuacacccagaugugcgaccaccggcugaugagugcggccaucaaggacucuaaggcagugcacgcugauaugggcuacuggaucgagagcgagaagaacgaaaccuggaagcuggcccgagcgucauuuaucgaggucaagaccugcacguggcccaaaucgcacacccucuggaguaacgguguauuagagagcgagaugaucaucccaaagauuuucggugggccgaucucccagcacaacuaccgccccggcuauuucacccagaccgcagggcccuggcaccuaggcaagcuggaacucgacuucgaccugugcgagggcacgacggugguaguggacgagcacugcgggaaccggggcccgagccugcgcaccaccacggugaccgggaagauuauccacgaguggugcugcagguccugcacucugccgccgcugagguuucgcggcgaggacgggugcugguacggcauggagauccgcccagucaaggaaaaggaggagaaccuggugcggagcaugguguccgccggcuccggggaggucgauucuuucucccucggcauccugugcgucagcaucaugaucgaggaggucaugcgcucgcgcuggagccggaagaugcuuaugaccgggacgcucgccguuuucuuacugcucaucaugggccaacugaccuggaaugaccugauccgccucugcauaauggugggagccaaugcuuccgaccggaugggaaugggcaccaccuaucuggcucugauggcuaccuucaagaugcgcccgauguucgccguuggguuacuguuucggcgccugacgagccgggaaguccuccugcugaccaucggccucucccugguggcgagcgucgaacugcccaacucccucgaggagcugggggacggccuggcgauggguaucaugaugcucaagcugcugaccgaguuccagccccaccagcucuggacgacccugcugagccucaccuucgugaagaccacguuaucccuggacuacgccuggaagaccacagccaugguccucagcaucgucucgcuguuuccccugugccucucaaccacaucucagaagaccaccuggcugccggugcugcucgggucuuucggcugcaaaccccugaccauguuccugauuacagagaacaagaucugggggaggaaguccuggccgcucaacgaagggaucauggcgauaggaaucgugaguauccugcugaguagccuacugaagaacgacgucccccuggcuggcccgcucauugccggcgggaugcugaucgccugcuacgugaucuccgguucuagcgccgaccugucccuagagaaggccgcggaggugagcugggagcaggaggccgagcacucuggggccucacacaacauccugguugaggugcaggacgacggcacgaugaagaucaaggacgaggagcgggacgacacccugaccauccuacucaaggccacacugcucgccguguccggggucuaccccaugagcauccccgcgacgcuguucgucugguacuucuggcagaagaagaagcagcgcuccggcgugcugugggacacccccagcccgcccgaggucgagcgggccguacucgacgacggaauauacaggauccugcagcggggucuguuggggcgcucgcaggucgggguuggaguuuuccaagauggaguguuccacaccauguggcauguaacccguggcgccgugcucauguaucagggcaagcgccuggaacccagcugggccuccgucaaaaaggaccucaucagcuacgggggcggguggcgguuucagggcuccuggaacacaggggaggagguacaggugauugccguagagcccgggaagaacccgaagaacguccagaccacccccggcaccuucaagacgcccgaaggggaggugggcgcgaucgcccucgacuuuaaacccgggaccagcggcagcccuaucgugaaccgcgaaggcaagaucgucgggcuguauggcaaugggguggugaccacaagcggcacauacgucuccgccaucgcccaggccaagaccagccaggaggggccccugcccgagaucgaggacgagguguucaagaagcggaaccuuaccaucauggaccugcacccgggcagcgguaagacccgccgguaccugcccgcgauaguccgcgaggccauuaagcgcaagcuccggacacugauccuugcccccaccagagucguggccuccgaaauggcagaggcccucaaggggaugcccauccgguaccaaaccacggcggucaagagcgagcacaccggacgagagaucgucgaccugaugugccacgccacauucaccaugcggcugcucucccccgugcggguucccaacuacaacaugaucaucauggacgaggcacacuucaccgaccccgccagcaucgccgcccgaggguacaucuccacgcgcgucggcaugggggaggccgcagcgaucuucaugacggcgacgccgcccggcagcguggaagccuucccucagucuaacgccgugauccaggacgaggagcgggacaucccugagcgcagcuggaacuccggcuacgauuggaucaccgacuuccccgggaagacggucugguucguucccagcaucaaguccggcaacgacaucgccaacugcuugcggaagaacgggaagcgggugauucagcugucccggaagaccuucgacacggaauaccagaaaaccaaaaacaacgacugggacuacguagugacgaccgacauauccgagaugggcgcgaacuuccgcgccgaccgagugaucgacccccgccgcugccucaagcccgugauccugaaggacgggcccgagcgcguaauccuggccggcccgaugcccgucacgguggccagcgcagcccagcggcgcggccgcaucgggcggaaccaaaacaaggaaggugaccaguacguguacauggggcagccccuuaauaacgacgaggaccacgcacacuggaccgaagccaagaugcugcuggauaacaucaacacgccugagggcaucauccccgcucucuuugagccugagcgcgagaaguccgcggccaucgauggggaguaccggcuacgcggagaggcccggaagaccuuugucgaacugaugcgcagaggggaccucccgguguggcugagcuacaagguagccuccgaaggauuccaguacagcgaucgccgcuggugcuucgacggcgagcgcaacaaccagguccuggaggagaacauggacguggaaauuuggacgaaggagggggaacggaagaaacuucgcccgagguggcuggacgcccgcaccuacuccgacccucuggcgcuccgggaguucaaggaauuugccgccggccgccggagcgugagcggcgaccugauauuggagauugggaaacucccucagcaccugacccuucgcgcccaaaacgcccuggacaaucuagucaugcugcacaacuccgagcagggcgggaaggccuaucggcacgcaauggaggagcuccccgacacgaucgagacccugaugcugcucgcccugaucgccgugcugaccggcggggugacccucuucuuccugagcggcaagggccuggggaagacguccauuggacuauugugcgucaccgcgagcucagcccuacucuggauggccagcguagaaccccacuggauagcggccuccaucauccuggaguucuuccucauggugcuccugaucccggagccugacaggcagcggacuccacaggacaaccaguuggccuacguagugaucgggcucuuauucaugauccugaccguugcugccaacgagaugggucuccuggaaacgaccaagaaggaccuggggaucggcuacgucgcggccgagaaucaccagcaugcgaccaugcuagacguggaccugcaccccgccucggcuuggaccuuauacgcgguugcaacgaccgucaucacccccaugaugcgccacacaaucgagaacacgaccgcuaacaucucauuaaccgccaucgccaaccaggccgccauacugaugggccuggacaagggguggcccaucagcaagauggauaucggagugccccuccuggcacuggggugcuacagccaggugaacccgcucacacugacggccgccgucuugaugcucguugcccauuacgcgaucaucggccccggccugcaggccaaggccacccgcgaggcccagaagcggaccgccgcaggcaucaugaagaacccaaccguagacggcaucgucgccaucgaccuggacccugugguguacgaugccaaguucgagaagcagcucgggcagaucaugcuguugauucucugcacgagccagauccugcugaugcgcaccaccugggcccucugugaguccaucacccuggccacgggcccgcugacuacccucugggaagggagccccggcaaguucuggaacaccaccaucgcggucuccauggcgaacaucuucaggggcagcuaccuggcgggggccggccuggccuucagcuugaugaagucccucgggggagggcgccgcggaaccggagcgcaaggggagacccugggagagaaguggaagcgucagcucaaccagcuguccaagagcgaguucaacaccuacaagcggagcgggaucauggaaguggaccgauccgaggccaaggaaggccugaagagaggggaaacgacaaagcacgccguaagccgaggcaccgccaagcuacgcugguucgucgagcgcaauuuagugaagccagagggcaaggugaucgaccuugggugcggccgcgguggcugguccuacuauugcgcggggcuuaaaaaggucaccgaggugaagggcuacacuaagggagggcccggucacgaggagccgauccccauggccacguauggguggaaccucgugaagcugcacaguggaaaggacgucuucuucaugccgccggagaagugcgacacccugcucugcgacaucggggaguccucuccgaaucccacaaucgaggagggaaggacccuccgcgugcugaagaugguggaacccuggcuccguggcaaucaguuuugcaucaagauccugaaucccuauaugccguccgucguggagacgcuggagcagaugcagcgcaagcacggggguaugcucguacgcaacccccugagccggaacaguacccacgagauguacugggucagcugcgggacuggcaacauaguguccgcagugaacaugaccagccgcauguuacucaaucgcuucacgauggcccaccggaaacccacuuacgagcgggacgucgaccugggcgccgggacccggcacguggcgguggagcccgaggucgccaaccuggacauaaucggccagcgcaucgagaacauaaagaacgagcacaagucgaccuggcacuacgaugaagacaacccguacaagacgugggccuaccacggaagcuacgaggugaagcccucuggcuccgcguccuccaugguuaacgggguagugcggcuccugaccaaaccgugggacgucauccccauggugacccaaauagcaaugaccgacacgaccccguucggccagcagcgcguguucaaagaaaaggucgacacccggacgccgcgggcgaagcgaggcacaacacaaaucauggaagugaccgccaaguggcuauggggguuccuaucccgcaacaagaagccucggaucugcacccgcgaggaguucacgcggaaggugcgcucgaacgcugccaucggcgccgucuucguggacgagaaccaauggaacagcgcgaaggaggccguggaagacgagcgguucugggaccuuguucaccgcgagcgggagcugcacaaacaagggaagugcgcgaccugcguguacaacaugaugggaaagcgcgaaaagaagcucggugaauuuggcaaggccaagggcucccgagcgauaugguauauguggcugggggcacguuuucucgaguucgaggcccucggcuuuaugaacgaggaucacugguuuucccgggaaaauucccucagcggcguggagggagaggggcugcacaagcuaggcuacaucuugcgagacaucuccaagaucccgggcgggaacauguacgccgacgacacggcgggcugggacacccgcaucacggaggacgaccugcagaacgaggcgaagaucaccgacaucauggagcccgagcacgcucuccuugcaacgagcaucuucaagcugaccuaucagaacaaggucguucgggugcaacgccccgcuaagaaugggacggucauggacguuaucucccggcgggaccagcggggcagcggccagguggggaccuacggccucaacaccuucaccaacauggagguccagcugauccgccagauggaguccgaggggaucuuccuccccuccgaacucgagacgccgaaucuggcugaacgggcguuagacuggcucgaaaagcacggcgccgaacgccugaagcggauggcaauauccggcgacgacugugucgugaagcccaucgacgaucgcuucgccaccgcccuuaccgcuuugaaugacauggguaagguccggaaggacaucccccagugggagcccagcaaggguuggaacgauuggcagcaggucccauucuguucccaccacuuucaccagcugauuaugaaggaugggcgcgagaucgugguucccugccggaaccaggacgagcuggugggacgcgcccgggugagccaaggcgccggcuggaguuuacgcgagaccgccugucugggcaagagcuacgcucagauguggcagcugauguacuuccaccgacgcgaucucagguuagccgcaaacgcaauuuguuccgccgugcccguggacugggugcccgcgagccgcaccacguggagcauccacgcccaccaccaguggaugaccaccgaagacaugcuguccguguggaacaggguguggaucgaggagaacccguggauggaggacaagacgcacguuagcuccugggaggagguccccuaccucggcaagagagaagaccaguggugcgguucccugaucggguuaacggcccgugccacaugggccaccaacauccagguggcgaucaaccagguucgccgccuaauaggaaacgagaacuaccuugauuauaugaccuccaugaagcgguucaaaaaugagagcgacccggagggcgcucugugguga

SEQ ID NO: 24679 - RNA, 9879 nt, Artificial Sequence
  derived and/or modified CDS sequence (opt11) from DENV-1__KC692515__SS-prME
agcgucaccaugcuacugaugcuccuccccacugcacucgcguuccaccuaacuacucgaggcggggaaccccauaugaucgucagcaagcaagaacgcggaaaaucccuacucuuuaaaacuuccgcaggaguaaacaugugcacauuaauagcgauggaccucggggaauugugcgaagacacgaugacuuacaaauguccacgcaucaccgaagcagaaccagaugacguagacuguugguguaaugccacagacaccugggucacguacggaacgugcagucaaacgggggagcauagaagagaaaagcgcucagucgcgcuagcgccccacgugggccuggggcucgaaacgcguacagaaaccuggaugagcucagagggugcguggaagcaaauacagagaguugagaccugggcucuaagacacccaggguuuaccgucaucgcucuauuccucgcucaugccaucgguaccucgauaacgcaaaaagggauaauauucauccuucucaugcuaguaaccccuucaauggcgaugcguugcgucggcaucggcaaucgagacuuuguagaaggauugucgggcgccacguggguggauguaguucuggaacacgguucaugcguaaccacaauggcuaaaaacaaaccaacgcucgacaucgaacuacucaaaacagagguaacaaacccagccguacuacgaaaauuaugcauagaggccaagauaucgaacaccacuacagacucgagauguccaacgcaaggggaagccacccuagucgaggagcaagaugcaaacuuugucugucgccgaacauucgucgaccgaggauggggcaauggcugcgggcuauucggcaagggcucgcugcuaacaugugcgaaauucaagugcguuacaaaguuagaaggaaagauagugcaguacgaaaaucucaaauacucggugauaguaacugugcacaccggggaccagcaccaagucgggaacgagacaaccgagcacggcacaaucgccaccauaacaccccaggcuccgacguccgagauucagcucacggacuauggugcgcuaacccuggacugcagcccccgaacaggccuggauuucaacgaaaugguauuacugacgaugaaagaaaaaucuuggcuaguacauaagcaaugguuccucgaucuaccucuccccuggaccaguggcgcgucaacaucgcaagaaaccuggaacagacaggaccuauuaguaacauucaagaccgcacacgcgaagaaacaagagguuguugugcuggguagccaagaaggcgcaaugcauacugcccucacgggggccacagaaauacaaacuagcggcacuacgacgauauucgcgggucaucucaagugcagacuaaagauggacaagcugaccuuaaagggcaugagcuaugucaugugcacagggucguucaaacucgaaaaagaaguagcggaaacccaacacggaaccguccuaguacaggugaaauacgaagggaccgaugccccauguaagauccccuuuagcacccaggaugaaaaggguguaacgcagaacgggagacucaucacggccaacccaauugugaccgauaaggaaaagccugucaacaucgaaacagagccaccauucggagaaagcuacaucguuguaggcgcgggaggcaaagcccuaaagcugucaugguucaaacgaggaagcagcauagggaaaauguucgaagcaaccgcgcggggcgcgagaagaauggccauacucggugacacggcaugggacuucgggaguauaggcgggguguucacaagugucgggaaacucguccaccagguguucggcacggcauauggagugcuauuuagcggcguaagcuggacgaugaagaucggaaucgggauucugcucacguggcuuggacucaacagucgaucaacaagccucagcaugacgugcaucgcagucggcaugguuacgcucuacuuaggaguaaugguucaagcugacucaggaugcgucauaaauuggaagggacgggaacucaaaugcggcucagggauauucguuaccaacgagguacauacauggacagaacaauacaaauuccaggcugacucaccgaagcgccuuagcgcggccaucgguaaagcaugggaagaaggagucugcggcauacgcucagcaacccgucucgaaaauauaauguggaagcagauaagcaacgaacugaaucacauacuccucgagaacgacaugaaguucacagucguagucggugaugcgaacggcauucuagcccagggcaaaaagaugauacgcccacaaccgauggagcauaaguauagcuggaaaucuuggggaaaagccaaaaucaucggggcggacauacagaauacaaccuuuaucauugauggcccugacacaccagagugccccgacgggcagagagcuuggaacaucugggaagucgaagacuacggcuuuggcgucuuuacgaccaauauauggcuaaaacugagagacucauacacgcagaugugcgaccaccgccuaaugucugcggcaaucaaagacucgaaagcgguacacgcagacaugggauauuggaucgaaagcgaaaagaacgagaccuggaaacuugccagagcuagcuucauagaaguaaagacgugcacuuggcccaaaagccacacguuguggagcaacggaguacucgagagcgagaugauuauuccaaaaauauucggcggaccgaucucucagcacaacuacagaccgggauauuucacccaaaccgcagggcccuggcaccucgggaaauuagaacuagacuuugaccucugcgaaggaaccacuguaguagucgaugaacacugcggcaaucgcgguccuucgcuacgaaccacaaccgugaccgggaaaauuauacacgaauggugcugcagaagcugcacauuaccgccacuccgauuccggggcgaagacggaugcugguacgggauggagauccguccaguaaaagaaaaagaagaaaaccuaguacggucaaugguaucugccgggagcggagaagucgacucguucagccucggaauacuauguguaaguaucaugauagaagaggucaugcguucgcgaugguccaggaagaugcugaugaccggaacgcucgcaguguuucuuuugcucauaaugggccaacuaacguggaacgaucugauucguuuaugcaucauggucggugcgaacgcauccgaucggauggggauggggaccacauaccucgcuuuaauggcgacauuuaagaugaggcccauguuugcaguaggucuccuauucaggcgccucacgucgcgagagguacuguuacugacgaucgggcuaagucucguagcguccguugaacugcccaacucccuggaagaacucggcgacggauuggcgauggggauaaugauguuaaaauuauugacagaguuccaaccucaucaacuguggacaacccuucuaagccuaacguuuguuaagaccacccuaagucucgacuaugccuggaagaccaccgccaugguccuaaguauaguaucacuguucccauuaugccucucaaccacgucgcagaaaacgaccugguuaccaguacugcuggggagcuuuggcugcaaaccgcuaacaauguuccuaauaacagaaaacaagauuugggggcggaaguccuggccacuaaacgaggguaucauggcgauuggcauaguuagcauacugcuauccucccugcucaagaacgacgucccucuagcgggaccacugaucgcagggggaauguugauagccuguuacguaauaagugguucaucagcugaccugucucuagagaaagcggccgaggugagcugggaacaagaagcugaacauaguggggcuagccacaacauccucguggagguccaagacgacggaacaaugaagaucaaggacgaagaaagagacgacacacuaacaauacugcuaaaggcgacccuucuugccgucucaggcguuuaccccaugagcauccccgccacauuguucgucugguacuucuggcagaaaaagaaacaaaggucagguguucugugggacacuccgucaccaccagaagucgagcgggcaguacuagacgauggaauauaccggauacuucaacgcggacuacucgggagaagccaggucggcguggguguauuucaagaugggguauuccacaccauguggcacguuacacggggcgcaguuuuaauguaccaaggcaaacgauuagaaccauccugggcuagcguaaagaaggacuuaauauccuacggcgggggcuggagguuccagggaagcuggaacacgggcgaagaaguucaagugaucgcaguggagccggguaaaaaccccaagaauguucagacaaccccuggcacuuucaaaacaccagagggcgaggucggcgccauagcccuagacuuuaaacccggcacgagcgggagcccaauaguaaacagagaagagaagaucgugggacuguacggcaacggggucgugacaacgagcgguacguacguauccgcgauagcacaggccaaggccagccaggaggggccccugccugagaucgaggacgaagucuuuaagaaaaggaaccugacuauaauggaccuccauccaggaucugggaagacacgaagguaccuacccgcaauuguccgagaagccauaaaacggaaacuccgcacucuuauccucgcgccgacgcgaguggucgcuagcgaaauggcagaggcacucaaagggaugccuauacgauaucaaaccacggcagucaaauccgaacacacgggccgcgaaauaguagaccugaugugccacgcgaccuucacaaugaggcuccuaagccccguccgaguaccaaacuauaauaugauaaucauggacgaagcccacuuuaccgaccccgcgaguaucgcggcccggggcuacauuaguacucgagucgggaugggcgaggcagccgcgaucuucaugaccgcaacgccaccugggagcgucgaggccuucccgcaaaguaacgcugucauucaggaugaggagagagacauuccggagagauccuggaauagcggcuacgacuggauaacagacuucccuggcaagacugucugguuuguacccuccauaaaguccggcaacgauaucgcgaacugccugagaaagaacggcaaacgcguaauccaacuuaguagaaagacguuugacacagaauaccaaaagacaaagaacaacgacugggauuaugucgucacgacggacauaagcgaaaugggagccaacuuccgcgccgacagggugauagacccacgccgaugucuuaagccggugauccugaaagacggacccgaacgugucauacuagcaggcccgaugccuguaacuguagccagcgccgcgcaacgucgagggagaaucgggcgaaaucagaacaaggagggcgaccaauacguguauaugggccaaccacuaaacaacgaugaagaucaugcgcauuggacagaggcaaaaaugcuccuagacaacauaaacaccccugagggaauuaucccggcccucuuugaacccgaacgagagaagucagcggcaauagacggugaauacagacuuaggggcgaggcucgaaaaaccuucguagaauuaaugaggcgcggggaccucccagucugguugucguacaaagucgcaagcgagggguuucaguauagcgaucguagauggugcuucgacggcgaacguaacaaccaaguacucgaggaaaacauggacguggaaauauggaccaaagaaggagagaggaagaaacuccgcccaagaugguuagacgcaagaacauacagugacccucuagcccuccgagaguucaaagaauuugcugccggccggaggucggucagcggagaucugauauuagagaucgggaagcugccacagcaccucacccuucgagcacagaacgcauuggacaaccucguaaugcuccacaauagugagcaaggaggaaaagcguacaggcacgccauggaagaacuaccugauacaauagaaacgcucaugcuccuagcccugaucgcggugcuuacggguggcguaacauuauucuuccuauccgggaaaggauugggcaaaaccagcaucgggcugcuauguguuacagcaaguuccgcccuacuauggauggccuccguggaaccacacuggauagcggccuccauaauccuggaguucuuccugauggugcuacuaauacccgagccagaccgccaaagaacaccgcaagacaaccagcucgcauaugucguuaucggacuccucuucaugauucucacagucgcagcgaacgagauggggcuccuagaaacgacgaagaaggauuuagggauaggacacgucgcagccgagaaucaucagcacuccaccauguuagacguggaucugcacccggcauccgcuuggacacuuuacgccguggcuacgacuguaaucacccccaugaugcgacauaccaucgagaacacaacggcaaauauaucccucacggcaauagcgaaccaggcggcaauacuaaugggucuagacaagggcuggccaaucagcaaaauggacaucgguguccccuugcucgcccuaggguguuacagccaaguaaacccacuuacucugacagccgcaguacucaugcucguggcacacuacgccaucaucggcccggggcuacaggcgaaagccacacgggaagcccaaaagcggaccgccgcugggaucaugaaaaaccccacaguggauggaaucguugccaucgaccucgacccagucguauaugaugcaaaguucgagaagcaacucgggcaaauuaugcuccugauauugugcacaagucaaauucuucucaugcggacaaccugggcgcuaugugaaucgauaacccucgcuaccggaccccucaccacucucugggaggggucgccagggaaauucuggaacacaacaauugcgguaagcauggccaacauuuucaggggaucauaccuggcgggagcaggccuagcguucagccucaugaagagucucgggggcggaaggcgggggacuggcgcacaaggagagacucucggcgagaaauggaaacgccaacuuaaucaauugucaaaaucagaguucaauacguauaaacgaucaggaauaauggaggucgaccgaucggaagcgaaagaagggcuuaagagaggagaaacgaccaaacaugcagucucacgcggaacagcuaagcuccggugguucgucgaaagaaaccuuguaaaacccgaggguaagguuaucgaccuuggaugugggagaggaggguggaguuauuacugcgccggacucaagaaagucacagagguaaaaggauacacgaaagggggaccaggacacgaagaaccgauaccaauggcaaccuacggcuggaaucucgucaaauuacacaguggaaaagacgucuucuuuaugccacccgaaaagugugacacacuccucugcgacaucggcgaaaguucacccaauccaacaaucgaggagggacgcacucuccgggucuuaaaaaugguggagccauggcugagaggcaaccaguuuugcaucaaaauucuaaaccccuacaugcccagcgucguggaaacuuuagaacaaaugcagcgaaagcacggcggcaugcuagugcggaacccgcuaucaagaaacucgacccacgaaauguacugggugaguuguggcaccggaaauauuguguccgcggucaacaugacaucccgaaugcuucucaauagguuuacuauggcacauagaaaaccaacauacgagagagacguagaccucggggccggaacacgacacguggccgucgaaccugaaguugccaaucuagauaucauuggccaaagaaucgagaacaucaagaacgagcaccgguccacauggcacuacgacgaagacaacccauauaaaacgugggcguaccaugggucguacgaaguuaaaccaagcggaagcgcaaguagcaugguuaacgggguagugagacuccucacuaagccgugggauguaauacccauggugacccaaaucgccaugacggacacgaccccauucggccaacagagagucuuuaaggaaaaaguagacacacggaccccaagggcaaaaagaggcaccacgcaaaucauggaagugacggcaaaguggcucuggggauuccuaagccgaaacaagaagccaaggaucugcacccgagaagaguucacacgaaaggugcgaucaaacgcugccaucggggcagucuucguagacgagaaucaguggaacagugccaaagaagccguggaagacgaacgauucugggaccuaguacauagggaaagagagcuucauaaacaaggcaagugcgcaaccugcguguacaacaugaugggaaaacgagagaagaaauugggugaguucggcaaagcaaaaggcucuagggcgaucugguacauguggcucggcgcucgcuucuuggaguucgaagcgcugggauuuaugaacgaggaccacugguucucccgagagaauagcuuaucgggaguagaaggggaaggguuacacaagcuaggcuauauacugagagacaucucuaaaauaccgggcgggaacauguaugcagacgauaccgcaggaugggauacacgaauaaccgaagaugaucugcaaaaugaagccaagauaacagacauaauggaacccgaacacgcccuacuugccacauccaucuucaaacucacguaccagaacaaaguaguaaggguacaaaggccagccaaaaacggcacugugauggacguaauaagucgccgagaucagcgaggcaguggacaggucggaacauacggccuaaacacguucacgaacauggaaguccaacucaucaggcaaauggaaagcgaagguauauuccucccgucagaacuggagaccccaaaccuagcagaacgagcgcucgacuggcucgaaaaacacggagcggagagauuaaaacgaauggcuaucucgggcgacgacugcguaguuaaaccgaucgacgaucgauuugccacagcauuaacagcccucaacgacaugggaaaaguucgcaaagacaucccgcaaugggagccgagcaagggguggaacgauuggcaacaaguuccguuuugcucgcaccacuuucaccaauuaaucaugaaagacggacgagaaauugugguaccauguaggaaccaggacgagcuagugggccgggcucgcgucagccaaggagccgguuggucauugcgagagaccgccugucucggaaaaucauaugcgcagauguggcaacugauguacuuucaccgccgagaccuccgccuagcugcaaaugccauauguuccgccgucccaguggacuggguucccgcgucccgaaccacauggagcauccaugcucaccaccaauggaugacaaccgaggauaugcuaagcguuuggaaccgcguguggaucgaggaaaacccguggauggaggauaagacacacguuagcuccugggaagaggucccguaccuaggaaagcgcgaagaucaauggugcggaucacuaauagguuuaacggcgcgcgccacaugggccacaaacauccaaguggcaauaaaccaaguccgccgccucauugggaaugaaaacuaccucgacuauaugaccagcaugaaacgguuuaagaacgaaagcgauccagaaggggcgcuuugguaa

SEQ ID NO: 24680 - RNA, 9879 nt, Artificial Sequence
  derived and/or modified CDS sequence (opt11) from DENV-1__KC692516__SS-prME
agcgugaccauguuacucaugcugcugcccaccgccuuagcguuccaccugaccaccaggggcggggagccccauaugaucgugagcaagcaggagcggggcaaaagccucuuguucaagacaagcgcgggggugaacaugugcacguugauugcaauggaccuuggagagcucugcgaggacacgaugaccuacaaguguccucgcaucacggaggccgagcccgacgacguagacugcuggugcaacgcuaccgacacuuggguaaccuauggaacuugcagccagaccggggagcaccggcgggagaagcggucgguggcgcuggcuccccacgucggccuggggcucgaaacgcgcacagagacuuggaugagcuccgagggcgccuggaagcagauccagcgggucgagaccugggcccuucgccaccccggguucacggugaucgcguucuuccucgcgcacgccaucggcaccagcaucacccagaaggguauaaucuuuauccuccugaugcucgugacacccuccauggccaugcggugcgucggcaucgguaaccgcgacuucguggaggggcucaguggugcgacgugggucgacgucgugcuugagcacggguccugcgugaccaccauggccaaaaacaagccgaccuuggacaucgagcuucugaaaacggagguuaccaaccccgccgugcugcggaagcucugcauagaggccaaaaucucuaacaccaccacggacucccgcugcccgacccagggcgaggccacacugguggaggagcaggaugcuaauuucgucugccggcgcacauucguggaccggggcugggggaauggcugugggcuguucgguaaggggucccuccugacgugcgcgaaauucaagugcgugaccaaauuggaggggaagaucguccaguacgagaaccucaaguacuccguuaucgucaccguacacacaggcgaccagcaccagguggggaaugagacgaccgagcacggcacaaucgcgaccauaacaccccaagcccccacgagcgagauccagcucaccgacuacggggcccugacccucgacugcagcccccggaccggccucgacuucaacgagaugguucugcucacgaugaaggagaaguccuggcuggugcauaaacaaugguuccuggaccuaccgcugccauggacgaguggggccagcaccucgcaggagacauggaaccgacaggaccugcucguaacguucaagacggcccacgcgaagaaacaggaggucgugguucuaggcucccaggaaggggcaaugcacaccgcccugaccggcgccacggagauccagaccagcggaaccaccacgaucuucgccgggcaccucaagugccgccuuaaaauggacaaacugacccugaaggguaugagcuacgugaugugcaccgggagcuucaagcuggagaaggagguggcggagacccagcacggcacugugcuaguccaggugaaguacgagggcacugacgccccuuguaagauaccauucuccacccaggacgagaagggugugacccagaacggccggcugaucacugcgaacccuauuguaaccgauaaagagaagccggugaacauagaaacugagccgcccuucggggaaagcuacaucguugucggagccggggagaaggcgcucaagcuguccugguuuaagcgcggaagcaguauaggcaagauguuugaggcuaccgcccgcggggcacgccgcauggccauucucggcgacacggcgugggacuucgggagcauuggcgggguguuuaccuccguggggaagcucguccaccagguuuuuggaaccgccuacggagugcuguuuucaggcgucuccuggaccaugaagaucgggaucggcauccugcucacuuggcucggccugaacagccggucgacaagccuuuccaugaccugcaucgccguggggauggugacccuguacuugggcgugauggugcaggccgacucagggugcguuaucaacuggaaggggcgggaacucaaaugcggguccggaaucuucgucacgaacgaggugcacaccuggaccgagcaguacaaguuucaggcugacagcccgaagcgguuaagcgcugccaucggcaaggccugggaagaggggguuugcggaauccgcuccgccacccgccucgaaaauaucauguggaagcagauuucgaacgaacucaaucauauuuuacuggagaaugacaugaaguuuacuguaguggugggagacgccaauggcauccucgcgcaggguaagaaaaugauccgaccccagcccauggagcacaaguacagcuggaagaguuggggcaaggccaagaucaucggcgcugacauccaaaacacgaccuucaucauagaugggccugauacaccggagugccccgacggacagagggccuggaacaucugggaggucgaagacuacggguucggcaucuucacaacgaauauuuggcugaagcugcgcgacuccuacacacagaugugcgaucaucgucucaugagcgcugccaucaaagacuccaaggccguucacgcagacaugggcuauuggaucgaaagcgagaagaacgagacguggaaacucgcucgggcguccuucauugaggugaagaccugcacguggcccaagagccacacccugugguccaacgggguccucgagagcgagaugaucaucccaaagaucuacggcgggccgauuucacagcacaacuaccggccgggcuacuucacccagacagccgggcccuggcacuugggcaagcuggagcucgacuucgaucuaugcgagggcacgacagugguggucgacgagcacugcgggaaccgaggcccaucccuacggaccaccacggugacggggaagaucauccacgaguggugcugccgcuccugcacccugccgccccugcgcuuuagaggcgaggacggcugcugguauggcauggagauccgucccgugaaggagaaggaggagaaccugguccgcaguauggucuccgccggcagcggagagguagacaacuuuagccucggcauccugugcgucuccaucaugaucgaagaggugaugcggagccgcugguccagaaaaaugcugaugaccgggacgcucgccguguuucugcugcucauaaugggccagcuuacauggaacgaccugauccgguuaugcaucauggucggggcaaacgccagcgaucgcaugggcauggguaccacguaccuagccuugauggccaccuucaagaugaggccgauguucgcaguggggcuccucuuuagaaggcugaccucccgagaggugcuauugcugacuauaggucucagccuggucgccucccuggagcuccccaauagccucgaggaacugggggacgguuuagcgaugggcauuaugauguugaagcuucucaccgaguuucaaccccaccaguuguggacaaccuuauugucccugaccuuugugaagaccacccugagccucgacuacgcauggaagaccaccgccaugguccuguccauagugagccuguucccccucugccuguccaccacgagccagaagaccaccuggcugccgguacuucugggguccuuuggcugcaagcccuugacgauguuucucauuacugagaacaagaucugggggcgcaagucguggccgcugaacgagggcaucauggccaucgggaucgucagcauccugcucucgucccugcucaagaacgacgucccccucgcaggcccgcugauugcaggcgggauguuaauagccugcuacgugaucuccggcuccucagcagaccucucccuggagaaggccgcugaggucucuugggagcaggaggccgagcacagcggggccucccauaacaucuuaguggaggugcaggacgacggaacgaugaagaucaaggacgaggaacgcgacgacacccucaccauccugcugaaagccaccuuacuggccgucucugggguguacccuaugaguaucccggcgacguuguucgugugguacuuuuggcagaaaaagaagcagcggagcggcguccuuugggacacccccucaccacccgagguggaacgcgcugugcuggaugacggcaucuaccggauccugcagcgcgggcugcugggccggucacaggucgggguggggguguuucaggacggggucuuccacaccauguggcaugugacccgcggcgccgugcugauguaucagggcaagcggcuggagcccuccugggcgugcgucaaaaaggaccucaucagcuauggcggcggguggcgcuuccagggccuguggaacacgggcgaggagguacaggugaucgcggucgaacccggaaaaaacccgaagaacgugcagaccacccccgguacuuucaagacgcccgaaggggaggugggcgcgaucgcgcuggacuuuaagcccgggaccuccggcagcccgaucguuaaccgggagggcaagaucgucgggcuguacgggaacgggguugugaccaccuccggcacguacgugagcgccaucgcccaggcaaaggccucgcaggaggggccccuuccagaaaucgaggacgagguguucaagaagcguaaccuaacgaucauggaccuccacccgggcuccggcaagacccgucgcuaccugcccgcaaucguccgggaggccaucaagcguaagcugcgcacccucauccuggccccgacccggguggucgcuuccgagauggccgaagcacuuaaggggaugcccauacgcuaccaaaccaccgccguaaagagcgagcauacgggcagagagaucguggaccucaugugucacgccacauucaccaugcgccuacucagccccguucggguccccaacuacaauaugaucaucauggacgaggcgcacuucaccgaccccgccuccaucgcagcccgaggguauaucagcacccggguaggcaugggggaggcugcggcuauauuuaugacggcgacgcccccugguuccguggaggcguucccccaaagcaacgccgucauccaggacgaggagcgcgacauccccgagagauccuggaacagcggcuacgacuggauuaccgacuuccccgggaaaacggugugguucgugccuucaaucaaaagcggcaaugacaucgcgaacugccuacgcaagaacgggaagcgcgucauccagcuguccaggaagacguucgauaccgaguaccagaagaccaagaacaacgacugggacuacguggugaccacggacaucagcgagaugggugccaauuuccgcgccgaccgcguaaucgacccacggcgcugccuaaagcccgugauccugaaggacgggcccgagcggguuauccuggccggcccuaugcccgucaccguugccucugcagcccagcgccggggcagaauugggcggaaccagaauaaggagggggaccaauacguuuacaugggucagccccuaaacaacgacgaggaccaugcccacuggacggaagccaagaugcuccuggacaacauuaauacgccggagggcaucaucccugcgcuguucgagcccgagcgggagaaguccgccgccaucgacggggaguaccggcuccguggugaggcccgcaagacuuuuguggagcugaugcggaggggcgaccugccagucuggcucuccuacaaaguggcgagcgagggguuccaauacuccgacaggcgauggugcuucgacggcgagagaaacaaccagguacuagaggagaauauggacguggagaucuggacuaaggaaggggagcggaagaaacugcgaccccgcuggcucgacgcgcggacauacagcgacccucuggcccucagggaguucaaagaguucgccgccggcaggcgcuccguuucgggugaccucauccuggagaucgggaaacugccccagcaccucacccugagggcccagaacgcgcuggacaauuuagugaugcugcacaauuccgagcaaggcgggaaagccuaccgccacgccauggaggagcugcccgacaccaucgagacgcucaugcuccuggccuugaucgcgguguugacagguggggucacgcuguuuuuucuuuccggcaaaggccuggggaagaccucaauuggccuacuaugcgugacggccucaagcgcacuccuguggauggcgucgguggagccccacuggauugccgcgucuauaaucuuggaguucuuucugaugguccuauuaaucccggaacccgaccggcagcgcacgccgcaggacaaccagcuggccuacgugguaaucgggcuacucuuuaugauccuaaccguagccgccaacgagaugggccugcuagagaccaccaagaaggacuuagggaucggccacguggccgcggagaaccaucagcacgccacuaugcuggacguggaccuccacccagccuccgccuggacccuguacgccguagccaccacggugaucaccccaaugaugcggcacacuauugagaauaccacggcuaacaucagccugaccgccaucgcgaaccaggccgcgaucuugaugggccuggacaagggguggcccauuuccaagauggacauuggcgugcccuuacucgcucuggggugcuacagccagguuaacccgcugacacucaccgccgcuguucuaaugcugguugcgcacuaugccaucaucggacccgggcuccaggccaaggccacgagggaggcccagaagcgcaccgcggcggguaucaugaaaaaccccaccguggacggcaucguggcuaucgaccuggaccccguggucuacgacgccaaguuugagaagcagcugggacagaucaugcuccuaauucugugcaccagccagauccuccuaaugcgaacgaccugggcgcugugcgaauccauuacgcucgcgacuggcccacugacaacccugugggaggggucccccggaaaguuuuggaacacaaccaucgccgugagcauggccaauaucuuucgcgguuccuaccucgccggggccggcuuagcguucagccuaaugaagucccuugggggcgggcggcgcggcacgggcgcccagggcgaaacccugggggagaaauggaagcggcagcugaaccagcucagcaaguccgaguuuaacaccuacaagcgcagcgggaucauggagguggaccguucugaggccaaggagggucugaagcgcggggagaccacgaagcacgcggucagccggggcaccgcgaaacugcgaugguucguugagcggaacuuggugaagcccgaggguaagguuaucgaccuagggugcggacgcggaggcuggucuuauuacugcgcgggccugaaaaaggugacugaggucaagggauacacuaaaggcgggccaggccaugaggagccgauacccauggcuaccuacggguggaaccuggucaagcuccacucuggcaaggacguguucuucaugccgcccgagaagugcgacacgcugcugugcgacaucggggagagcuccccgaacccuaccaucgaggaggggaggaccuugaggguucucaagaugguagaaccuugguugcggggcaaccaguucugcauaaagauacucaaucccuauaugccuucggugguggagacccuugagcagaugcagcgcaagcacgggggcaugcugguccggaauccccucucccguaacucuacgcacgagauguacuggguaucccgggggacgggcaacaucgugagcgccgucaacaugacguccagaaugcuacucaaccgcuucacaauggcccacagaaagcccacguaugagcgcgauguggaucucggggccgggacacggcacguugccgucgagcccgaaguugccaaccuugacaucaucggccagcgcaucgaaaacaucaagaacgagcacaagagcaccuggcacuacgacgaagacaacccguacaagacgugggccuaccacggcuccuacgaggugaaacccucaggauccgccucguccauggucaacggggugguccgucugcucacgaagcccugggauguuauaccuauggugacccaaaucgcaaugaccgacaccaccccguuuggccagcaacgcgucuucaaagagaaaguggacacccggacuccccgggccaagcggggcaccacccagaucauggaggugaccgccaaguggcuguggggguuccugucacgcaacaagaagccgaggaucugcacccgcgaagaguucacccggaagguccgcagcaacgcagccaucggcgcuguauuuguggaugagaagcaguggaacagugccaaggaggccguugaggacgaacgguucugggaccucgugcaccgcgagcgggagcugcacaagcaggggaaaugcgcaaccugcguguacaauaugaugggcaagcgcgagaagaaguuaggggaguucgggaaggcaaagggcucccgggccaucugguacaugugguuaggcgccagguuccuggaguucgaggcccugggcuucaugaacgaggaccacugguucagccgcgagaacagccucucggggguggaaggggaggggcugcacaagcugggguacaucuuacgcgacaucaguaagauccccggggggaacauguacgccgaugacaccgcaggcugggacacccggaucaccgaagacgaccugcagaacgaggcaaagaucacagacaucauggagcccgagcacgcucuccucgccaccucaauauucaagcuuacuuaccaaaacaagguagugagaguucagcgcccugccaagaacggaaccguaauggacgugaucagccggcgugaccaaagaggcuccggccaggucgggacauacggccugaauaccuucaccaacauggaggugcagcucauccgucagauggagucugaggggaucuuuuugccuuccgaacuugagacgccgaaccucgcugagcgggugcuggauuggcuggagaagcacggcgccgagcgccucaaaaggauggcgaucucgggggaugacugugucgugaagcccauugacgaccgcuucgcgacggcucugaccgcgcugaaugacauggggaaggugcggaaggacaucccccagugggagcccuccaagggcuggaacgacuggcaacaggucccguucugcagccaccacuuccaucagcuaauuaugaaggacgggcgcgagaucguugugcccugccgcaaccaggacgaguuggucggccgcgccagagugagucagggugccggcuggucguugcgugagacggccuguuuggggaaaucuuacgcccagauguggcaacucauguauuuccaccgacgcgaccugcggcucgcggccaacgcaaucuguagcgccgugcccgucgacuggguaccgaccucccgcacuacguggaguauccacgcccaucaccaguggaugacgacagaggacauguuauccguauggaaccgcgucuggauagaggaaaaccccuggauggaggacaagacccacgugagcuccugggaggaggugcccuaccugggcaagcgggaggaccaguggugcggcucccucaucgggcugacggcacgcgcaacuugggcuaccaauauucaggucgcgaucaaccaggugcggcgcuuaauuggcaaugagaacuacuuagacuauaugacaagcaugaagcgguuuaagaacgaguccgaucccgagggggcgcugugguga

SEQ ID NO: 24681 - RNA, 9879 nt, Artificial Sequence
  derived and/or modified CDS sequence (opt11) from DENV-1__KC692517__SS-prME
agcgugacaaugcugcugauguuacuucccaccgcccucgccuuccacuugacgacccgaggcggggagccccauaugauagugaguaagcaagaacggggcaagagcuugcuguucaaaaccagugccggggugaacaugugcacccucauugccauggaccugggcgagcucugcgaggacaccaugaccuacaagugcccccgcaucaccgaggccgagccggacgacguggacuguuggugcaacgccaccgacaccugggucacuuaugggaccugcagccaaaccggcgagcaccggcgcgauaaacgguccguggcgcuggcgccacacgugggccugggcuuggagacgcgcacugagaccuggaugagcuccgagggcgcuuggaagcagauacagagaguggagaccugggcccugcgucaccccggguucacuguaaucgcccuguuccucgcgcacgccauaggcacaagcaucacccagaaaggaauuaucuucauccugcugaugcucgugacccccuccauggccaugcggugcguaggcaucggaaaccgcgacuuuguggaggggcugagcggggccacguggguggacgucguucuggagcaugguucaugcgugaccacgauggcuaagaacaaacccacccuggacaucgagcucuuaaaaacagaggucaccaaccccgcgguccuccggaagcugugcauagaggccaagauaagcaacacgaccacggacucccgcugccccacacagggcgaggcgacacugguggaggaacaggacgcaaacuuugucugucggcgaaccuucguggaccggggcugggguaauggcuguggccucuucggcaagggaagcuugcugacgugcgccaaguucaaaugcguaaccaaacucgagggcaagaucguccaguacgagaacuuaaaguacucugucaucgugaccguccacacgggcgaccaacaccagguggguaacgagaccaucgagcacggcacuaucgcgaccauaacgccccaagcaccgaccagcgagauacagcugaccgacuacggggcccucacccuggacuguagucccagaacaggguuagacuucaacgaaaugguguuacugacuaugaaggaaaaguccugguuaguucacaagcagugguuccucgaccugccgcugcccuggacuuccggggccagcacaccccaggaaaccuggaaccgacaggaccuuuuagugaccuuuaagacggcgcacgcgaagaagcaggaggucguggugcugggaagccaggagggcgccaugcacaccgcacucaccggggccaccgaaauccagacguccgggacgaccaccaucuucgccgggcaccugaagugccgcuuaaagauggacaaacucacgcugaaaggcaugucguacgugaugugcacaggcuccuucaagcucgaaaaggaaguggcggagacucagcacgggaccguguuagugcaggugaaguacgagggcacggacgccccgugcaagauuccguucagcacccaggaugagaagggggugacccagaacggccggcucaucaccgccaacccgauagucacggacaaggaaaaguccgugaacaucgaaacugaaccgcccuuuggggagagcuacaucguaguaggcgucggugagaaggcccugaaacugagcugguuuaagaaggggucuuccaucggcaagauguucgaagcaacugcccgcggggcccggcgcauggcuauccucggugacaccgcuugggacuucggguccauaggcggcguguuuacguccgucgggaagcuugugcaucaaguauucggaacagcguacggcguucuauucagcggcguguccuggaccaugaagauaggcaucggcauccuccucaccugguuaggccucaacucacguaguacgucucuguccaugaccugcauugccguggggauggucacccuguaucucggcgucaugguacaggccgacagcggcugcgucaucaacuggaaaggccgggaacugaagugcgggucuggcaucuucgugaccaacgagguucacacguggacagagcaguacaaguuccaggccgacucacccaaacgccugagcgccgcgaucggcaaggccugggaggagggggucugcggaauccggagugcgacacgccucgaaaacauuauguggaagcagaucagcaacgaauuaaaccacauccuccuggagaacgacaugaaguuuaccguggugguuggcgaugccaacggcauccucgcccaggguaagaagaugauccgaccccagcccauggagcacaaguacuccuggaaguccuggggcaaagcuaaaaucaucggcgccgacauucagaacaccacguucaucaucgauggcccugauaccccggagugcccggacggccagcgcgccuggaauaucugggagguagaggacuacggguucggcaucuucaccaccaacaucuggcucaagcuacgugacuccuacacgcagaugugcgaccacagacugauguccgccgcgaucaaggacagcaaagccgugcacgcagauaugggcuacuggaucgagagcgaaaagaaugagaccuggaagcuggcccgagccuccuuuaucgaagucaagacgugcaccuggccaaagagccacacgcucuggaguaauggggugcuagagagcgagaugaucauccccaagauuuacggcggcccgauuucccagcacaacuaccggcccggcuacuucacccagaccgcggggcccuggcaccugggcaagcucgagcuagacuucgaccugugugaggggaccacgguugucguugacgagcacugcgggaaccggggcccgagccuccgcaccacaaccgugacggggaagaucauucacgagugguguugccggagcugcacccugccgcccuuacgcuuccggggcgaggacggcuguugguacggaauggagaucaggcccguaaaggagaaggaagagaaccucgugcgguccauggugagcgcagggucuggggagguagacaguuucucgcugggcauccugugcgugagcauaaugauagaagaagugaugcgcucccgguggagucgcaagaugcucaugaccgggaccuuagccgucuuccuacuccugaucaugggccagcugacguggaacgaccucaucaggcuaugcauaauggugggggccaacgccucugaccggaugggcauggggaccaccuaccuggcucucauggcaaccuuuaagaugcgccccauguucgccgucggauuacuguuccggcgccuuacuucgcgggagguccugcugcuaaccaucggucugucccuagucgccagcgucgagcuccccaauucccuggaagaacuuggggaugggcucgccaugggaaucaugaugcugaaacugcucaccgaguuucaaccccaccaguuguggacuacgcugcucagucuuaccuucguaaagaccacccugucccucgacuacgcuuggaagacgaccgccaugguacugagcaucgucucccucuucccccucugccugagcaccaccagccagaagacuacguggcuaccagugcuccuugggagcuuugggugcaauccacugaccauguuccucaucaccgaaaauaagaucugggggcgcaagagcuggccccuaaacgagggcaucauggccaucgggauagugagcauucugcucuccagccugcugaaaaacgacgucccccucgccggcccgcugaucgcgggcgggaugcugauugccugcuacgucaucuccggcagcucagcggaccucucccuggagaaggcugccgaggugagcugggagcaggaggcggagcacuccggggccucacacaacauccucguagaggugcaggaugacggcaccaugaaaaucaaggacgaagagcgcgacgacacccucaccaucuugcugaaggcgacccuacucgccguguccgguguauacccaaugagcauucccgccacucuguucgugugguacuucuggcagaagaagaagcagcgcuccggcgugcuaugggacacgcccucgccgcccaaagucgagcgugcgguauuagacgauggcaucuaccgcauccugcagagagggcugcucggacgcucccaggugggggucggcguguuucaggacggcguauuccacaccauguggcacgucacccggggcgccguguuaauguaccagggcaagcgcuuagagccuagcugggccuccgugaaaaaagaccucauaagcuaugguggaggguggagauuccagggguccuggaacacaggugaggagguccaagugauugccguggagcccggaaagaacccaaagaacgugcagacaaccccgggcaccuucaagacgcccgagggcgaggugggcgccauugcguuagacuuuaagcccgggacgaguggcucaccgaucgugaaccgcgaaggcaagaucguugguuuguacggcaacgggguggugaccaccagcggcaccuacguguccgcgaucgcccaggcgaaagccagccaagaggggccccucccugagaucgaagacgagguguucaagaagcggaaccuuacuaucauggaccugcacccgggcagcggcaagacccgccgguaccuccccgccaucguuagagaggccaucaagcggaaacugcgcacccuuauccucgcccccacccgcgucguggcauccgaaauggcggaggcucugaaggggaugcccauccgguaccagacgaccgccgucaaaucugagcacacaggccgcgagaucguggauuugaugugucacgccaccuucaccaugcggcuccugaguccugugcguguucccaacuacaauaugaucauuauggacgaggcccacuucaccgaccccgcgagcauagccgcccggggguacaucucaacccgcgucggcaugggggaggcggcagcgaucuucaugaccgccacaccccccggcagcguggaggcauucccccagaguaacgcagugauccaggacgaggaacgggacauccccgagcgcagcuggaacuccggguaugauuggaucaccgauuuccccgggaagaccgucugguucgugcccagcauaaagucgggcaacgacaucgccaacugccugcggaagaacgggaagcgcguuauacagcucucgcggaagaccuucgacacggaguaccagaagaccaagaacaacgacugggauuacguggugaccaccgacauuuccgagaugggcgcaaacuuccgggccgacagagugaucgacccgcgccggugccugaagcccgucauccugaaggacggccccgagcgugugauccucgccggcccgaugcccgucacgguagccagcgcggcgcagcgacgcggacggauugggcgcaaccagaacaaggagggcgaccaauacguauauauggggcagcccuugaacaacgacgaggaucacgcgcacuggacggaagcuaagaugcugcucgacaacaucaacaccccagagggcaucaucccggcccuuuucgagcccgaacgcgaaaaguccgcggccaucgauggggaguaccggcugcgcggcgaggcccggaaaaccuuugucgaauuaaugcgccggggcgaccugccagucugguugagcuacaagguggccuccgaaggguuccaguacagugaccgccgguggugcuucgacggcgagcgcaacaaccagguccucgaggaaaacauggauguggagaucuggaccaaggagggagagaggaagaagcugcgcccucggugguuggacgcccggaccuacuccgacccgcuggcgcugcgggaguucaaagaguucgccgccggccgccggagugugaguggcgaccugauccucgagaucgggaagcugccccagcaccuaacgcuccgcgcacagaacgcgcuggacaaccucgucaugcuccacaacagcgagcagggcgggaaggcguaccggcacgcuauggaagaguugcccgacaccaucgagacccugaugcuccuggccuuaaucgccgugcuaacgggcgggguuacccuguucuuccugucaggcaagggccucgggaagaccagcauuggccuccuuugcgucaccgcgagcucggcccuccuguggauggcgaguguggaaccgcacuggaucgccgcaaguaucauauuggaguucuuccuuaugguccuacugaucccugagcccgaccgccagagaacuccucaggacaaccagcucgcguacgucgugaucggacugcuguucaugauccucaccguggccgccaacgaaaugggccuucuggagaccaccaaaaaggaccucgggaucggcuacgucgccgcagagaaccaccagcacgcgaccaugcuggacguggaccuucgcccggcuuccgccuggacacuuuaugcuguggccaccaccgucaucacgccaaugaugcgucauacaauugagaacaccaccgcgaauaucucccugacggccauagccaaccaggcagcgauccugaugggccuugacaagggguggcccaucagcaagauggauaucggcgugccucugcuggcucucgggugcuacucccagguuaacccgcugacccugaccgccgccguucucauguugguggcccacuaugcgaucaucggccccgggcugcaggccaaggcgacccgagaggcucagaagcggacggcggcgggcauuaugaagaaccccaccgucgacggcaucgucgcuaucgaccuagaccccgugguguaugacgcgaaguucgagaagcagcuggggcagauuauguuacucauccugugcaccagccagauacugcucaugcgaaccacaugggccuuaugcgaguccaucacccuggccaccggcccacucaccacgcugugggaggggagccccggaaaguucuggaacaccaccauugcggucucgauggccaacauuuuccgcgggagcuaccuagccggugccggacuagccuucucccucaugaagucauuggguggcgggcggcgcgggaccggcgcgcaaggagagacgcucggcgagaaguggaagcggcagcugaaccaacugaguaaaagcgaguuuaacaccuacaagcgcuccgggaucauggagguggaccgauccgaggccaaagagggucucaagcguggagagacgaccaagcacgcagugucccgaggcaccgccaaauuacgaugguuuguagagagaaaccuggugaagcccgagggcaaggucaucgaccugggguguggacgcgggggcuggucguacuacugcgcggggcucaaaaaggucacggaggucaaggguuacacaaaagguggaccaggccacgaagagccgaucccuauggccacauacggguggaaccuggugaagcugcacagcggcaaggaugucuucuuuaugccacccgaaaagugcgauacccuccugugcgacaucggggaguccagcccgaaccccacgauagaggagggccggacccugcgcgugcucaagauggucgagcccuggcugcggggcaaccaguucugcaucaagauucugaaccccuacaugccgucgguggucgagacgcucgagcagaugcagcgaaagcacggugggaugcugguccggaacccccucagccgcaacaguacccacgagauguacuggguuagcugcgggacagggaacaucguguccgccgucaacaugaccagccggaugcuccugaaccgcuucacuauggcgcaccgcaagcccacuuaugagcgggauguagauuuaggcgcgggcacgcgccacguggcgguagagccugaagucgcaaaccuugacaucaucggccagaggaucgaaaacaucaagaaugagcacaagagcacauggcacuacgaugaggacaacccguacaagaccugggcguaucacgggucuuacgaggugaagcccucuggcagcgccucaagcauggucaacggggugguccgucugcugaccaagcccugggacgucauuccuauggugacgcagaucgccaugacugacaccaccccguuuggacagcagcggguauucaaggagaaggucgacaccagaacuccccgggcgaagcgcgggaccacccagaucauggaggugacggccaaguggcuuuggggcuuccugucucggaacaagaaaccaaggauaugcacccgggaggaguucacccgcaaggugcggagcaaugccgccaucggugccgucuucguugacgaaaaucaguggaacagcgcgaaggaggcuguugaagacgagcgcuucugggaccucguccaucgggagcgugagcuacacaagcaagggaaaugcgcuaccugcguguacaacaugaugggcaagagggagaaaaagcugggggaauucggcaaggcuaaaggcagccgcgcaauuugguauauguggcugggggcccgguuccucgaguucgaggccuuaggauucaugaaugaggaccacugguucucucgcgagaacagucugagcggggucgagggcgaggggcuccauaagcugggauacauccugcgagacaucuccaaaaucccgggcggcaacauguacgccgacgacacggccggcugggacacccgcaucaccgaggacgaccuccaaaacgaggcuaagaucacggacauaauggagccugagcacgcccugcuggcuacgucgaucuucaaauuaacguaccaaaacaaggucgugcgcguucagcggcccgccaagaacgggaccgucauggaugugauauccaggcgggaccagcggggcuccggccagguugggacauacggucugaauacguucaccaacauggaaguccaacuggugagacaaauggaguccgaagggauuuucuugcccagugagcuggaaacgccgaaucuggccgagagggugcucgacuggcuggaaaagcacggcgucgagcggcuuaaacgcauggcgaucuccggugacgauugcgugguuaaacccaucgacgaccgcuucgcaacagcccuaacugcccugaacgacaugggcaagguucgcaaagacauaccccagugggagccgagcaaaggcuggaaugacuggcagcaggugccuuuuugcucccaccacuuccaccagcugaucaugaaagacggucgcgaaaucguaguccccuguaggaaccaagacgagcuuguuggucgggcccgugugagucagggggcgggcuggucccugcgggagaccgccugucuagggaagagcuaugcgcagauguggcagcucauguacuuucaccggcgggacuugagacuggccgccaacgcaauaugcuccgccguccccguggauuggguaccgacaagccggaccaccuggagcauacacgcccaccaucaguggaugacgaccgaggacaugcucuccgucuggaacagggucuggaucgaggagaacccuuggauggaggacaagacccacguguccuccugggaggagguccccuaccugggcaagcgcgaggaccaauggugcgguucguuaaucgggcucaccgcgcgugccaccugggcaacuaacauacaaguggcuaucaaucaagugcgccggcuuauuggcaaugagaauuaucuggauuacaugacgucgaugaagcgcuucaagaacgaaucugaccccgagggggcccucugguga

SEQ ID NO: 24682 - RNA, 9879 nt, Artificial Sequence
  derived and/or modified CDS sequence (opt11) from DENV-1__KC762649__SS-prME
agcgugacaaugcugcugaugcugaugcccaccgcccuggccuuccaccuuaccacccgggggggggagccucacaugaucgugucgaaacaggagcguggcaagagccugcuguuuaagaccucagccggcgugaacauguguacccuaaucgccauggaccugggcgagcugugcgaagacacccugaccuacaaguguccccgaaucaccgaggcggagccugacgacguggacuguuggugcaacgcuaccgacaccugggugaccuacgggaccuguagccagaccggcgagcaccggcgcgacaagcggaguguggcauuggcgccgcacgugggacuggggcucgagacccgcaccgagacguggaugagcuccgagggcgccuggaagcagauccagcgggucgagaccugggcccugcgccacccggguuucacgguaaucgcccuguuccuggcgcacgccauaggcgccagcaucacucagaagggcaucaucuucauccugcugaugcucguuacccccucaauggcaaugcggugcguuggaaucggcagccgcgacuucguggaggggcuguccggcgccaccuggguugaugucgugcuggagcacggaagcugcgugacgaccauggcgaaggauaagcccacccucgacaucgagcugcugaagaccgaggucaccaaucccgccgugcuccggaagcugugcaucgaggccaagaucuccaacaccaccaccgauagccgguguccgacgcagggagaggcgacgcugguggaagagcaggacgccaacuuugucugccggcgcaccuucguggaucggggcugggggaacggcugcggauuauucggcaaggggucccugaucacgugcgcgaaguucaagugcgugagcaagcuggagggcaaaaucguccaguacgagaaucucaaguacuccgucauugugacaguacauacaggcgaccagcaucaagucggaaacgagagcaccgagcacggcaccacggccaccauaacgccccaggcacccaccacagaaauacagcugacggacuacggggcccugacccucgauugcagcccccggacuggcuuggauuucaacgagaugguccugcucaccaugaaggagaaauccugguuaguacacaagcagugguuccuggaccucccccugcccuggacgagcggagcgagcaccagccaggagacauggaaccggcaggaccuacucgugacauucaagacugcgcacgccaagaagcaggaggucguagugcugggcucccaggaaggagccaugcauaccgcccugaccggggccacagagauccagacgucaggcaccaccaccauauucgcgggccaccucaagugucgccugaagauggauaagcugacgcuuaagggcauguccuacgucaugugcaccgguagcuucaagcuggagaaggagguugcugagacccagcaugggaccgugcugguccagaucaaguacgagggcacggacgcacccugcaagauccccuucuccacccaggacgagaagggggugacacagaacggccggcuaaucacagccaauccgauagugacagacaaagagaagccagucaacaucgaggcggagccccccuuuggggagagcuacaucgugaucggcgccggcgagaaggcccucaagcugaguugguucaagaaggggagcuccaucggcaaaauguucgaggccaccgcccgcggugcgcggcgcauggcuauacuuggcgacaccgccugggacuucgggagcaucggcggcguguucaccuccgucgggaagcucgugcaccagaucuucgggacggcguacggagugcuguucagcggcgucuccuggaccaugaagaucgggauuggcguguuacucacguggcugggcuugaacagccggaguacuagucucucgaugacgugcaucgcgguggggcuggucacacuguaccucggugugaugguacaggcugauagcgggugcgucaucaauuggaagggacgggagcugaagugcgggagcggcaucuucgugaccaacgaaguacauaccuggacggagcaguacaaguuccaggccgacuccccgaagcgccuuagcgcggcaauaggcaaggcuugggaagaaggggucugcggcauccgguccgcgaccagacucgagaacaucauguggaagcagaucagcaacgagcugaaccacauccugcucgagaaugacaugaaguucacugugguagucggggauguagccggcauccuggcccaggggaagaagaugauccggccccagccaauggagcauaaguacuccuggaaauccuggggcaaggccaagaucaucggcgcggacgugcagaacaccacguucauaaucgacgggcccaacacgccggagugccccgacgaccagcgggccuggaacaucugggaggucgaggacuacggcuucgggaucuucaccaccaacaucuggcugaagcuccgggacucuuauacccaggugugcgaccaucgccugaugucggccgccaucaaagacuccaaagcagugcaugcggacaugggcuacuggauagagagcgagaagaacgagacguggaaacuggcccgggccuccuucauugagguaaagaccugcaucuggccuaagucucacacccucugguccaacggcgugcucgaaagcgagaugaucauccccaagaucuaugggggcccgauuucccagcacaacuaccgccccggguacuucacccagacagccggccccuggcaccuggguaaacucgagcuggacuucgauuuaugcgagggcacgaccguggucguggacgagcacugcggcaaccgggggccgagcuugcgcaccacuaccgugacuggcaagauaauacacgaguggugcugccgguccugcacucugccgccccugcgcuuccgaggagaagacgguugcugguauggaauggagauccgccccgucaaggagaaggaggagaaccucgucaagagcauggugagcgccggcuccggcgaggucgacagcuucuccuuagggcuccucugcauuagcaucaugaucgaggaggugaugcguucccgcuggagccggaagaugcugaugacgggcaccuuggcgguauucuuuuuacugaucauggggcagcugaccuggaacgaucucauucgccugugcaucaugguuggggccaacgccuccgaucgcauggggaugggcaccacuuaccuggcccucauggccaccuucaagaugcggccgauguucgcggugggccugcuguuccgucggcucaccagccgcgaggugcugcuccucaccaucggacugucccuggucgccagcguggagcuccccaauucccuggaagagcucggcgacggucuagcaauggggaucaugauccucaagcuuuuaaccgacuuccaaagccaccaguugugggccacccugcucucccugacguucaucaagaccacguucagcuugcacuacgcuuggaagaccauggccaugguccucuccaucgugagccuguucccccugugccucuccacaaccagccagaaaacgaccuggcugcccgugcuacuagggucccuggggugcaagccgcugaccauguuccuaaucgcggagaacaagaucuggggccgcaagagcuggccccugaaugaggguauaauggcuguaggcauaguguccauacugcucuccucucugcugaagaacgaugugccccucgccgggccccucaucgcgggcggcaugcugaucgcgugcuacgucauauccgguagcuccgccgaccugagcuuggagaaagcagccgaggugaguugggaggaggaggccgagcauagcggggccucccacaacauccugguggagguccaggaugacggcaccaugaagaucaaggacgaggagcgcgacgacacgcucaccaucuuguuaaaggccacccuccuggccguaucaggcguguacccgcuuuccaucccagccacccucuucguuugguacuucuggcagaagaagaagcagcguucaggggugcuaugggacacccccagcccgccugaaguugaacgcgcgguucuggacgacggcaucuaccggauuaugcagcgcggucugcucggucggagccagguaggagugggcgucuuccaggagaacguguuccacaccauguggcacgugacucgcggagccguccugauguaccaggggaagcgguuagagcccuccugggccagcgugaagaaggaccucaucuccuauggcggcggguggagacuucagggcagcuggaacaccggggaggaggugcagguaaucgccguagagcccgggaagaaucccaagaacgugcagacugcccccgggaucuucaagacgcccgagggcgaagucggagcgauugcccuggacuucaagccagggaccuccggcagccccaucguuaaccgggaggggaagauugugggccucuacggcaacggggucgugacgaccucaggcacauacguguccgccaucgcucaggcaaaggccucccaggaggggccccugcccgagaucgaagacgaggucuuucgcaagcggaaucugaccaucauggaccuccaccccggcuccgggaagacccgccgguacuuaccggcaaucguucgcgaggcaaucaagcggaagcugcgcacccucauccuggccccuacgcgagugguagcgagcgagauggccgaggcccugaagggcaugcccauccgcuaucagaccaccgccguaaaguccgagcacaccggcaaggagaucguugauuuaaugugccacgccacguucaccaugcgccugcugagccccguccgggugccgaacuauaacaugaucaucauggaugaggcucacuucaccgaccccaguagcaucgccgcccgcggauacaucuccacccggguuggcaugggggaggccgccgccaucuucaugacggccacgccgcccgggagcgucgaggcuuucccgcaguccaaugcggugauccaggacgaggagcgcgacauccccgagcggagcuggaacuccggguacgaauggaucaccgacuuucccggcaagacugugugguucgugccgucaauuaaguccggcaacgacauugcaaacugccuccgcaagaacggaaagcgugugauacagcugagccgcaagacguucgacacagaguaccagaagaccaagaauaacgacugggauuacgugguaacuacagacaucuccgagaugggcgcuaacuuccgggcugacagggugaucgauccgcggcgcugccugaaaccagugauccuaaaagacgggccggagcgugucauccuggcaggccccaugccggugacugucgccagcgcggcccaacgccggggccgcguaggccggaaucacaacaaggagggcgaccaauacaucuacauggggcagccccugaacaacgacgaggaccacgcccacuggacugaagccaagaugcuccuggacaacaucaacaccccggagggcauuauccccgcccuguuugagccggagcgcgagaagucugcggcgaucgacggggaguaccggcuccggggcgaggcccgcaaaacuuucguggagcucaugcggcgcggggaccugcccgucuggcugagcuacaagguggccagcgagggcuuccaguauagcgaccggcgcuggugcuucgacggcgaacggaacaaccaggugcuggaggagaacauggacguagaaaucuggacgaaggagggagaacgcaagaagcugcgcccccgcuggcucgacgcccggaccuacagcgaccccuuggcgcugcgcgaguuuaaggaauucgcggccggccggcgcuccgugagcggugacuugauccuggagaucggcaagcugccgcagcaucucacccagcgcgcccagaacgcucuggacaaccugguaaugcugcacaacuccgaacagggcgggcgcgccuaccggcacgcgauggaggagcugcccgacacgauagaaacacugauguuacuggcccuaaucgccguccucaccggcggggugacccuauucuuccugagcggccgcgggcucggcaagacuagcaucggccugcugugcguuauggcuagcuccguccuuuuauggauggccagcguggagccccauuggaucgccgcauccauuauccuggaauucuuccucauggugcugcugauccccgaaccggaccgacaaagaacgccccaggacaaccagcucgccuacguugugaucgggcugcuguucaugauacucaccguggcagccaacgagaugggccugcuagagaccaccaaaaaagaccucgggaucggccacgucgccguggagaaccaccaccaugcagccaugcuggacguagaccugcauccagcgagcgccuggacgcucuaugcagucgccaccaccauaauuacgccaaugaugagacacacgauagagaacaccaccgccaacaucucccugaccgcgauugccaaucaggccgcgauccugauggggcucgacaagggcuggcccaucagcaagauggacaucggcgugccccugcuggcgcucgggugcuacucccaggugaaccccuugacucugaccgccgccguccucauguugguggcccacuacgcuaucaucggcccggguuuacaggcgaaggccacccgcgaggcccagaagagaacugcagccggcaucaugaagaaccccacgguggacgggauagucgcaaucgaccucgauccagugguguaugacgccaaguucgaaaaacagcugggccagaucaugcugcucaucuugugcaccucucagauuuuacucaugcggaccaccugggcgcugugcgaaaguauuacgcuggccaccggcccccucacgacccuaugggaggggagcccaggcaaguucuggaacacuacuaucgccgucuccauggcgaacaucuucagagggagcuaccuggcaggcgcgggccucgcauucagccuuaugaagucccucgggggcgggcggcgcgggacgggggcgcaaggcgagacccuuggcgagaaguggaagcggcaacugaaccagcugagcaaguccgaauucaacacguauaaacgcagcgggaucauggagguggaccggucugaggcuaaggagggacucaagcggggggagacgaccaagcacgcggugagccggggcaccgcgaagcugcguugguucgucgagcggaaccuggugaaacccgaggguaagguuaucgaccugggcugcggucgugggggcuggucauacuacugcgcggggcucaagaaggucaccgaggugaagggcuacaccaagggcgggccgggccacgaggagcccaucccgauggcgaccuacggguggaaucugguaaagcugcauuccggaaaggacgucuucuucaucccgcccgagaagugcgacacccucuugugcgacaucggggagucuagcccuaauccuacgaucgaggaaggccguacucugcguguucucaagaugguggagcccuggcugcgggggaaccaguucugcauaaagauccuaaacccuuacaugccguccgucguggagacgcucgagcaaaugcagcgcaagcacgguggcaugcuugugcggaacccgcugagccgcaacucgacccacgagauguacugggucucuuguggaacgggcaacauugucagugcugugaacaugacaagccggaugcuccugaaccgcuucaccauggcucaccgaaagcccaccuacgagcgagacguagaccuaggggcgggcacccgccacguggccguggagcccgaggucgcgaaucucgacauaauuggccagcggaucgagaacaucaagcacgagcacaaguccacguggcacuaugacgaagacaaccccuauaagacaugggccuaucacgggagcuacgagguuaagccgagcggcagcgccagcuccauggucaacgggguggugaagcuguuaaccaaacccugggacguuauccccaugguaacccagauugccaugacggacaccaccccuuucggccaacagcgcgucuuuaaggagaaggucgauacuaggacccccaaggcuaagcgcgggaccacccagaucauggaggugaccgcgcgguggcucuggggcuuccugagccgcaacaaaaagccccguaucuguaccagagaagaguucacccggaaggugcguuccaacgccgccaucggcgccguguucgucgacgagaaucaguggaacagcgcgaaggaagccgucgaggacgaacgguucugggaccugguccaccgcgagcgggaacuccacaagcaggggaagugcgcuaccugcguguacaacaugauggguaagcgcgaaaagaagcugggggaguuugggaaagccaaggggagccgagccaucugguacauguggcugggcgcccguuuccuugaguucgaggcccuuggauucaugaacgaagaccacugguucagccgggagaacagucucucggggguggagggcgaaggucuacacaagcugggcuacauucugcgcgacaucuccaagaucccugggggcaacauguacgccgacgacacggcgggcugggacacacggaucaccgaggaugaucuccagaacgaggccaagaucaccgacaucauggagccggaacaugcgcugcuggccaaggccaucuucaagcucaccuaucagaacaagguagugcgcgugcagcgccccgccaagaacgggacggucauggacgugaucagucggcgcgaccagcgcgguuccggccagguagggaccuauggccugaacaccuucacaaauauggaggcccagcugauccgccagauggaaagcgaggggaucuucucccccagcgagcucgagacgcccaaccuggccgagcggguccuggacuggcuugaaaaauacggcguggagcggcugaaacggauggccaucuccggggacgacugcguggugaagccgaucgacgaccgcuucgccacagcccugaccgcacuaaacgacaugggcaaggugcggaaggacaucccccagugggagccuagcaagggguggaacgauuggcaacagguccccuucugcucccaccauuuccaucaguuaaucaugaaggacggccgcgagaucgucgugccgugucggaaucaggacgagcugguggggcgcgcgcgcgucagccaaggggccggauggagcuuacgagagaccgccugucugggcaaguccuacgcccagauguggcagcugauguacuuccaccgaagagaccuccggcuggcggccaaugcaauauguagcgccgugcccguggacugggucccgacgucccguaccaccuggagcauucacgcccaucaccaguggaugaccacggaggacaugcugagugucuggaaccggguguggaucgaggaaaaccccuggauggaggacaagacccacauuagcuccugggaggacgucccguacuuaggaaaacgagaggaccaauggugcgggagccugaucggccugaccgcgcgcgcuacgugggccaccaacauccagguggcgaucaaucaggugcggcgucucauugggaacgagaacuaccuagacuacaugaccuccaugaagcgguuuaagaacgaguccgaccccgagggggcccuaugguga

SEQ ID NO: 24683 - RNA, 9879 nt, Artificial Sequence
  derived and/or modified CDS sequence (opt11) from DENV-1__KC762625__SS-prME
ucggucaccaugcugcucaugcugaugcccaccgcccuggccuuccaccucacgacccggggcggggagccccacaugauagugagcaaacaggagcgggggaagagccugcuguucaagaccagcgcaggagugaauaugugcacccucaucgcgauggaucugggggagcugugcgaggauacccucaccuacaaaugcccccgcaucaccgaggccgaacccgacgacguagauugcuggugcaacgcgacagacaccugggugacauacgggaccugcagccagacuggcgagcaccggcgcgacaagcggagcguagcccuggcgccccacgugggacuaggccuggaaacgcgcaccgagacuuggaugagcuccgaaggcgcauggaagcagauccagaggguggaaacuugggcgcugcgacaccccggcuucacagugaucgcccuguuccucgcucaugccaucggcaccagcaucacacagaaagggaucaucuucauccugcugaugcucgucacccccuccauggccaugcggugcgucggcaucggcagccgcgacuuuguggaagggcuguccggcgccacguggguggaugucguucuggagcacggaagcugcgugaccaccauggccaaggacaagcccacgcuagacaucgagcuguuaaagacggaggucaccaaucccgcgguucuccggaagcugugcauagaggccaagaucuccaacaccacaacagauagccgcugcccgacccagggcgaggccacgcugguggaggagcaggacgccaacuuugucugucggagaacuuucguggaccgaggcugggggaacggcugcggccuguucggcaaggggucccugaucacgugcgcuaaauucaaauguguaagcaagcuggagggcaaaauaguccaguaugagaaccucaaguacuccgugaucgugacaguccacaccggcgaccagcaccagguggggaacgagagcaccgagcacggcacgaccgcgaccauaacgccccaggccccuaccacggagauccagcugaccgacuacggggcccugacccuugacugcucaccccggaccggccuggauuucaacgagaugguccugcugaccaugaaagagaagagcuggcuggugcacaaacagugguuccuggaccuaccccugcccuggaccaguggggccuccacuagccaggagaccuggaaccggcaagaccugcucgugacguucaagaccgcccacgcgaagaagcaggaggucguggugcuggguucucaagagggcgcuaugcacaccgcccugaccggcgcuacggagauccagaccagcggcacgacaacgauuuucgcuggucacuuaaagugccgccugaaaauggacaaguuaacucugaagggcauguccuacgucauguguaccgggucguucaagcuggaaaaggagguggcggagacccagcauggcaccguucugguccagaucaaguacgaaggcaccgacgcccccugcaagaucccguucuccacgcaggacgagaagggagugacccagaacggccggcugaucacggccaacccgaucguaaccgacaaggagaagcccgugaacaucgaggccgagccgcccuucggggagagcuacaucgugaucggggcgggcgagaaggcccucaagcugucuugguucaagaaggggagcuccaucggcaaaauguucgaggccaccgcucgcggggcccggcguauggcgauccugggcgacaccgccugggacuucgggagcauaggcggcguguucacgucuguggggaaguuggugcaccagaucuucggcacggccuacggagugcuguucagcggugucuccuggaccaugaagaucgggauuggcgugcugcucaccuggcugggccugaacagccgcucuacgagcuuauccaugaccugcaucgccguggggcuggucacccuauacuuaggcgugauggugcaggccgacagcggaugcgucauaaacuggaagggccgagagcugaagugcgggagcggcaucuucgugaccaaugaggugcacacuuggacagaacaguacaaguuccaggcggacuccccgaagagacuguccgcggccaucggcaaggcgugggaggagggugucugcggcauccggagugcgacucgccucgaaaacauuauguggaagcagaucagcaacgaacugaaccacauuuuacucgagaacgacaugaaauucaccgugguggucggggauguggcgggaauccuggcccaggggaagaagaugauucgaccccagccuauggagcacaaguacuccuggaagucuuggggcaaggccaagaucaucggcgccgacguacaaaacacaacguucauuauugacgggcccaacacuccggagugccccgacgaccagcgagcguggaacauaugggagguagaggauuauggauucgggaucuucaccacuaacauuuggcugaagcuccgggauuccuacacccaggugugcgaccaccgcuugaugagcgccgccaucaaggacuccaaagccgugcacgccgauaugggguauuggaucgagagcgagaagaacgagacguggaagcuggcccgggcguccuuuauagaggugaagagcugcauuuggcccaagucucauacgcucuggucuaacggcguacuugagagcgagaugaucaucccgaagauauaugggggcccgaucagccagcacaacuaccgccccggguacuucacacaaacagccgggcccuggcaucuggggaagcucgagcuugauuuugaccucugcgaaggcaccaccguggucgucgacgagcacugcggaaaccgggggccgucccuccgcaccacgaccgugaccggaaagaucauccacgaguggugcugccggagcugcacccucccgccgcugcgcuuccgcggggaagauggcugcugguacggcauggaaauccgccccgucaaggagaaggaggagaacuuagucaagagcaugguguccgccggcagcggcgaggucgacuccuucucuuuagggcugcucugcauauccaucaugaucgaggaggugaugcggagccgcuggagucggaagaugcugaugacgggcacauuagccguguucuuccugcugauaaugggucaguuaaccuggaacgaccucaucaggcugugcauaauggugggcgcgaaugccucagaccgcauggguaugggcaccacguaccuggcccucauggccaccuucaagaugcggccgauguucgccgugggccuucuguuccgccggcucacuucccgugagguccugcugcucaccaucggucugagccugguagccagcguggaacuccccaacucacuggaggaguugggcgacgggcuugccaugggcauuaugauccuuaagcugcucacggacuuccagucccaucagcugugggccacccugcucagccugaccuucaucaagaccacguuuucacugcacuacgccuggaagacuauggcgaugguccucucgaucgugucccuguuuccacugugccucagcaccaccucccagaagacgaccuggcuacccguccuucucgguagccuggggugcaagccgcugaccauguuccucaucgccgagaacaagaucuggggcagaaagagcuggccccuaaacgaggggaucauggccgucggcaucgugaguauccuauuaagcucccugcuuaagaacgacgugccccucgccgggccccucaucgccggcggcaugcugaucgcgugcuacgucauuagcgggagcagcgccgaccucucccuggagaaagccgccgaggugagcugggaggaagaggccgagcacuccggugcuagccacaacauccugguggagguucaagacgacgggacgaugaagaucaaggaugaggagagggacgacacgcucacaauccuguuaaaggccacccuccuggccgugucgggagucuacccucuuagcaucccugcgacccucuucgucugguacuucuggcaaaaaaagaagcagcgauccggggugcugugggacacacccagcccgccagagguggaacgcgccgugcuggacgacggcaucuaccgaaucaugcagcgcggacugcucgggcggucccaggugggcgugggggucuuccaggagaauguuuuccacacuauguggcacgugacccgcggugcgguccugauguaccaggggaagcgguuagagcccucgugggccuccgugaagaaggaccucaucaguuacggcggaggguggcgacugcagggcuccuggaacaccggggaggaggugcaggucaucgccgucgagcccggcaagaaccccaagaacgugcagaccgcccccgggacguucaagacccccgagggagaggucggcgccaucgcucuggauuucaagcccgggaccagcggcagccccauugugaaccgggaggggaagaucgucggccucuacgguaacggcgucgugaccacguccggcacguacgugagcgccaucgcccaggccaaggcgucccaagaggggccgcuccccgagauagaggacgaggucuuccgcaaacggaaucugaccauuauggaccuccaccccggaagcggaaagacgcgccgguaccugccugccauagugagggaggccaucaagcguaagcugcgcacgcucauccuggcccccacccgcgucguagcguccgagauggcggaggcgcugaagggaaugccuauucgguaccagaccacugcagucaagagcgagcacacgggcaaggaaaucguggaccucaugugccacgccaccuucaccaugcgccuguuaucccccguacgggugccgaacuauaacaugaucaucauggacgaggcccacuucaccgacccaagcuccaucgcggcgcguggguacaucagcacgcgggugggcaugggcgaggccgccgccauauuuaugaccgcgacgccucccggcagcgucgaagccuucccgcagagcaaugccgucauucaagacgaggagcgcgacauccccgagcgguccuggaacagcggguaugaguggaucaccgauuuccccggcaagacggugugguucgucccguccaucaagagcggcaacgacauagccaacugccuccgcaagaacgggaagcgggugauccagcucucacgcaagacguucgacaccgaauaccagaagaccaagaacaacgacugggacuaugugguuacgacugacauuagcgagaugggcgcaaacuuccgggcagaccgcgugaucgacccgaggcgcugccuaaaacccgugauccucaaggacgggcccgaacgggucauccuggccggccccaugccggugaccgucgccuccgcugcgcagcgccgagggcgcgugggccggaaccacaacaaggagggugaccaguacaucuacauggggcaacccuuaaacaacgacgaggaccacgcccacuggaccgaggccaaaaugcucuuagacaacaucaacacgcccgagggcaucaucccagcgcuguuugagcccgagcgggaaaaguccgcugcaaucgacggggaguaccgccuccggggcgaggcccggaagacuuucguugaacugaugcgacgcggagaccugccuguguggcucaguuacaaggucgccucggagggcuuccaguacagcgaccggcgcuggugcuucgacggagagcggaacaaccaggugcuggaagagaacauggaugucgagaucuggaccaaggagggggagcgcaagaagcuuagaccacgcuggcuugaugcucggaccuacuccgacccccuggcucugcgcgaguucaaggaguucgcggccggccggcgcagcgucucuggggaccucauccuggagaucgguaagcuaccgcaacaccucacgcagcgggcgcagaaugcccuggauaaccugguuaugcuccacaacagcgagcagggcgggcgcgcguaccggcacgccauggaagagcugccggacaccaucgagacacugaugcuccuggcccugaucgccguccucaccggaggggugacccuguucuuccuguccggucgcgggcuuggcaaaaccucgaucggccugcugugcgugauggccuccagcguacuccuauggauggcguccguggagccccacuggaucgcagccucuaucauccuggaguuuuuccucauggugcugcugauucccgagccagaccggcagcgcacuccacaggacaaccaacucgccuacgucgugaucgggcuguuguucaugauccucacaguggccgcgaacgagaugggccugcuggagaccacgaagaaggaccucgggauaggccauguagccguggagaaccaucaccacgcggccaugcuggacguggaccugcaccccgccuccgcguggacgcuauacgccguggccacgaccaucauuacgcccaugaugcggcacacuauugagaacaccaccgccaacauaagccugaccgccaucgcgaaccaggcggcaauucugauggggcucgacaagggcuggcccaucuccaagauggacaucggcgugccccuguuggcgcucggguguuacagccaggugaaccccuugacccugaccgcggcgguucucaugcugguggcccacuaugccaucaucggaccggggcugcaggccaaagcuacccgagaggcccagaagcgcacagccgccggcauaaugaagaaccccaccguggauggaaucgucgccaucgaccucgaccccgugguauacgacgcgaaguucgagaaacaguuaggccagauuaugcugcucauccugugcaccucccagauccugcucaugcgcacgacuugggcccugugcgagagcaucacccuggcuaccgggccucucacuacgcugugggaaggguccccgggcaaguucuggaacaccaccaucgcggucagcauggcuaacauuuuccgcggaagcuacuuagcgggcgccggccucgccuuuucgcugaugaagucccucgggggggggcggcgggggaccggggcacagggcgagacgcucggcgagaaguggaagcgccagcugaaccaacuguccaagagcgaguuuaacacuuacaagcgcagcgggaucauggagguggaccggagcgaggcgaaggagggccucaagcguggggagacaaccaagcacgccgugucccggggcacugccaaguuacgcugguuugucgaacggaaccugguuaagcccgaggguaaagugauugaccugggaugcggccgcggaggcuggagcuacuacugcgccgggcucaagaaggucaccgagguaaagggcuauaccaagggcgggccugggcaugaggagccuaucccgauggcgaccuacggguggaaccuggugaagcugcacuccgggaaggacgucuucuucaucccgccagaaaagugcgacacgcuccugugcgacaucggggagucgagccccaacccgacuauugaggagggccggacccugcgggugcucaagaugguagagcccuggcugcgggggaaccaguuuugcauaaagauucugaaccccuacaugcccagcgucguggagacccucgagcagaugcagcgaaagcacggcgggaugcugguacggaacccgcugucccgcaacagcacgcacgagauguacugggucuccugcgguaccggcaacauagucagcgcggugaacaugaccucccgaauguugcugaacagauucaccauggcccauagaaagccgaccuacgagcgggacgucgaccugggggccgggacgcggcacguggccguggaaccagaaguugcgaaccucgacaucaucggccagcggauagagaacauuaagcacgagcauaagagcaccuggcacuacgaugaggacaaucccuacaagaccugggcguaccacggcuccuacgaggugaagccgagcgguagugccuccagcauggucaacgggguagugaagcuucugacuaagcccugggacguuauccccauggugacucagaucgcgaugaccgauaccacccccuucggccaacagcgcguguucaaggagaaggucgacacgcgaacaccgaaggcuaagcgcgggacgacccagaucauggaagugacggcccgguggcucuggggauuucugucccgcaacaagaagccgcggauaugcacccgcgaggaguucacccggaaggugcgcagcaacgcggcuaucggcgccgucuucguggacgagaaccaguggaacuccgcuaaggaggcgguggaggacgagcgguuuugggaccugguccaucgcgagcgcgaacuccacaagcaggggaaaugcgcgaccugcguauacaauaugaugggcaagcgcgagaagaagcugggggaguuuggcaaggccaaggggagccgggccauaugguacauguggcucggcgcccgcuuccucgaguucgaagcgcugggcuucaugaacgaagaccacugguucucccgggagaacagccuguccgggguggaaggcgaggggcuccacaagcugggcuacauccugcgggacaucagcaagauccccgggggcaacauguacgccgacgacacggcgggaugggacacucggaucacugaggacgaccuccaaaacgaggccaaaauuaccgacaucauggagccggagcacgcccuucuggcgaaagccaucuucaagcugacguaucaaaacaaaguagugagagugcagcgccccgccaagaacgggacagucauggacgugaucucccggcgcgaccaacggggcagcggccagguggggaccuacggcuugaacaccuucacgaacauggaggcgcagcugauccgccagauggaguccgaggggaucuucagccccuccgagcucgagacccccaaucuggccgagcggguucuggacuggcucgagaaguacgggguggagcgccugaagaggauggcgaucagcggggacgacuguguggucaagcccauagacgaucgcuucgcuaccgcccuuaccgcacucaacgacaugggcaaaguuaggaaagacaucccccagugggaacccuccaagggguggaacgauuggcagcagguccccuucuguagccaccauuuccaccagcugaucaugaaggacggccgagagaucguggugccaugccggaaccaggaugagcugguuggcagggcacgugucagccagggggcuggaugguccuuacgcgagacggcaugucugggcaagagcuaugcgcagauguggcaacugauguacuuucaccggcgcgaccuccgacuggcggcgaaugccaucugcuccgccgugcccguagacuggguacccaccagccgcacaaccugguccauccacgcgcaucaccaguggaugacgacugaggauaugcugagcguguggaaccggguguggaucgaagagaaccccuggauggaggacaagacccacaucuccucgugggaggacgucccguaccucggaaagcgcgaagaucaguggugcgggucacugauaggcuuaaccgccagagcuaccugggccaccaauauccaagucgcuaucaaccaggugcggcgccucaucggaaacgaaaacuaccuggacuauaugaccagcaugaagcguuucaagaacgaguccgaccccgagggagccuuaugguga

SEQ ID NO: 24684 - RNA, 9879 nt, Artificial Sequence
  derived and/or modified CDS sequence (opt11) from DENV-1__KC762635__SS-prME
ucagugaccaugcugcucaugcuaaugccuacggcgcucgccuuucaccuaacuacaagaggaggugaaccgcauaugauagucucgaaacaggaacgggguaaaucccuauuguucaaaacaagcgccggcguaaauauguguacgcuaaucgcgauggaccuaggagaacugugcgaagacacccuaacguacaaaugcccgcgaauaacggaagccgaaccugacgauguagacugcuggugcaacgccaccgacacauggguuacuuacgguacuugcagucaaaccggugaacacagacgagauaaacgcucaguggcguuagcaccacacguagggcuaggauuagaaaccagaacagagacauggaugagcucggagggcgccuggagacaaauacaaaggguagagacuugggcccugaggcaccccggguucaccgucaucgcccuguuccuggcucaugcaauuggaaccuccauaacucagaaaggaauuaucuucauccuacuaaugcucgugacaccaagcauggccaugcgcugcgucggcaucggaaguagagacuucguagagggccuguccggagccacguggguagacguuguccuagaacacggcagcugugugacgacaauggcuaaagauaaaccgacccucgacauagaauugcuaaaaacggaagugaccaaccccgcaguccuacgaaaacucugcaucgaagcaaaaaucagcaacaccaccacagacucgaggugccccacacagggcgaagcgacacuugucgaagaacaagaugccaacuuugucugucgccggaccuucgucgauagaggcuggggaaauggcugugggcuauucggcaaaggaucgcucauaaccugcgcgaaauucaaauguguaaccaaacuagagggaaaaaucguacaguacgagaaccucaaauacagcguuaucguaaccguccacacaggcgaccagcaccagguggggaaugaaagcacggagcacggaacgaccgcgaccauuacgccacaagcgcccaccacugaaauacaacugacagacuacggggcacuuacccucgacuguaguccgaggacaggccuagauuuuaacgagaugguucuucucacaaugaaagaaaagucauggcuaguucacaagcaaugguuccuagaucuaccgcucccauggaccagcggcgcgucuaccucgcaggagacguggaacagacaggaccuccugguaacauucaaaacagcucacgcuaagaaacaagagguaguagugcugggcucacaagagggagcaaugcacaccgcgcucaccggcgcgacggagauacaaaccagcggcacaaccaccaucuuugccggccacuuaaaaugccgacuaaaaauggacaaacucacauugaaaggcaugagcuacgugaugugcacggggagcuuuaaacuagagaaggaaguugcagaaacgcaacacggaaccguacucguucaaauuaaguaugaggggacggaugcgcccugcaagaucccguucuccacccaagacgaaaagggcgucacacagaacggcagacugaucacggcuaacccuaucguaacagacaaagaaaaacccguaaacaucgaggcggagcccccauuuggagaguccuacauaguaauaggagcgggugaaaaggcucugaaacugagcugguucaagaaaggaaguuccaucgggaagauguucgaagccacggcccgcggagcccgaagaauggccauccucggagacacagcgugggauuucggaagcauuggaggaguauucacaucagucggcaagcuaguacaccaaauuuucgggacagccuacgggguucuauucuccggcguaagcuggacaaugaagauaggaauuggagugcuccuuacguggcuaggccuaaacuccaggucaaccucacuaucuaugaccuguaucgccgugggccucguaacccucuaucuuggagugaugguacaagccgacucgggcugcgucauaaacuggaagggacgagaauuaaagugcggguccgggaucuuuguaacgaaugaaguucacacguggacggaacaauacaaauuucaagcagacaguccaaaaagacugucugcagccaucgguaaggcgugggaagaaggcgugugcggcauucguagcgcaacccgauuagagaauauaauguggaagcaaauaucaaacgagcuaaaucacauuuuguuagagaaugacaugaaauucacagugguagugggagacguagcggggauucucgcacagggaaagaaaaugauccgaccacaaccaauggagcacaaauacagcuggaagucaugggguaaagcgaaaaucauaggagcggauguccaaaacacgacauucauaaucgauggaccaaacacccccgagugcccagacgaucaacgcgcguggaacauaugggagguagaagacuacggcuuuggaauuuucacgacaaacaucugguugaaacuaagagauucauauacccaagugugcgaccaccgacuaaugucugcggcgauuaaggacagcaaagccguacacgccgacauggguuauuggauagaguccgagaaaaaugaaacguggaagcucgcgcgagccuccuucauagaagugaaaacaugcaucuggccaaaaagccacacgcuauggaguaauggcguguuagagucugagaugauaaucccaaagauauacgggggaccuauuucacaacauaacuacagaccaggauacuuuacacagaccgccggccccuggcauuuaggcaaauuggagcuagacuuuaaccugugcgaagguacaacaguggugguagacgagcauugcggcaaccgaggcccgagccuaaggacaacaacagucacaggcaaaauaauacacgaguggugcugccgaaguugcaccuuaccaccguuacgcuuccgcggcgaagacgggugcugguaugggauggagauucgacccguaaaggaaaaagaggagaacuuggugaagaguauggucagcgccggguccggggaagucgacuccuucagucugggacuccuaugcauaaguauuaugauagaagaggugaugagaucaagauggagccgcaagaugcugaugacaggaacacuagccgucuucuuccuacucauuaugggucagcuaacauggaacgacuuaauccgccuaugcauuaugguaggcgcuaacgcgagugacaggauggggaugggaacgacguaccuagcucuaauggcgacauucaaaaugcggccgauguucgccguuggcuuguuguucagaagacuaacuucaagggagguguuguuacuaacaaucggccuaucccugguggcuagcgucgaacugccaaauaguuuggaagaacugggggacggacucgcgaugggaauaaugauccuuaagcuacugaccgacuuccaaagccaccaacucugggccacgcugcuaucgcugacguuuaucaagacgacguuuagccuccacuaugcguggaaaacgauggcgaugguacugagcauugucagucucuucccacugugccuauccaccaccucccagaaaacuaccuggcucccgguccugcuggggucacuggggugcaaaccgcugacaauguuucucaucgcggagaacaaaauuuggggccgaaagagcuggccccucaaugaaggcaucauggcaguuggaaucguuaguauccugcugucaucucuacucaaaaacgacgugccucucgcgggccccuugauagccggcggaaugcuaaucgccuguuacguaaucucuggcucaagcgccgaccuaagccuagagaaggcagcggaaguaucaugggaggaagaagcugaacacagcggcgcgucacacaauauacugguagaggugcaggaugacgggaccaugaaaaucaaggaugaggaacgagacgacacacucacaauccuccuuaaagcuacgcuacucgccguauccggggucuauccacuaagcauaccugccacccucuuugugugguauuucuggcagaagaagaaacaaagaaguggagugcucugggacaccccgagcccacccgaaguagaaagggccgugcuagaugauggaauuuaucggauuaugcagagaggauugcuugguagaucacaggucggugugggaguauuccaagagaacguguuccacacgauguggcaugugacgcgaggggcugugcuaauguaccaagguaaaaggcuugagccaucaugggcaagcguaaagaaagaccuaauaagcuauggcgguggcuggcgacuucaagggucauggaacacaggagaagagguacaagucauagccguggaaccagggaaaaauccuaaaaacguccagacagccccagguaccuucaaaacaccagagggugaaguuggcgcgaucgcauuggauuucaaaccggguacgagcggcucgcccaucguaaaucgagaaggaaaaauaguugguuuauacggaaauggggugguaaccacgagugguacguauguaucggcgauagcucaggccaaggcgagccaggagggaccauuaccugagauagaagacgagguguuccgaaaacgcaaucucacuauaauggaccugcacccggguagcggcaagacaaggcgcuaccucccugcgauaguccgggaggcuaucaaaaggaaacucaggacccucauacucgcuccgacaagaguaguggcgagugaaauggcagaagcccugaaaggcaugccuauaagguaccaaaccaccgcagucaagagcgaacauaccggcaaagaaauaguugacuuaaugugccacgccacauucacgaugcggcugcucagcccgguaagagucccgaacuauaacaugauaauaauggacgaagcucacuuuaccgacccgucgucaauagcagcccgaggauacaucucaacaagaguaggcaugggcgaagcagcagcaauuuucaugacugcgaccccgccagguagcguugaggcauucccacaauccaaugcuguuauccaggacgaagaaagagacauucccgagcgcaguuggaacagcggguaugaauggauaacagauuucccgggaaagacagucugguucguccccagcaucaaaaguggaaacgacauagccaacugccuacguaaaaacgggaaacgcgucauacaacucagccggaagaccuuugacacagaauaccagaaaacuaagaacaacgauugggauuacgugguaacaacugacauaucggagaugggggcgaacuuccgagcagaccguguaauagacccccgaagaugccucaaacccguuauuuugaaagacggaccagaacgcgugauacucgcagggccaaugcccgucaccgucgcaucagcagcgcagagacgcggccgagugggacgcaaccacaacaaggaaggcgaucaguacauauacaugggacaaccccuuaauaacgacgaggaccacgcccacuggacagaggcaaaaaugcuccuggauaacaucaauacgccagaagggauuaucccugcgcuauucgagcccgaaagggaaaagagcgcagcaaucgacggggaauaccgccuacguggggaagcucgaaagacguucguagaacuuaugaggcgcggggaccugcccgucuggcucucauacaagguggcguccgaaggcuuccaguacagcgacaggagaugguguuuugauggcgaaaggaacaaccaggugcuagaagagaauauggaugucgagauuuggacaaaagaaggagaaaggaagaagcugagaccgcgcugguuggacgcaagaacguauucagauccccuggccuuacgagaguucaaagaguucgccgcaggcaggcgcucggucagcggggaccugauacuagaaauuggcaaacugccgcagcaccuuacucaacgagcccaaaacgcacucgauaaccuggucaugcugcacaacagcgaacaagggggacgcgcguaucgacaugccauggaagaacuuccggacaccauagagacgcuaaugcuacucgcccugauugcaguccuaaccggaggcgugacccuguucuuccucagcggcagagggcuugggaaaacgagcaucggccugcugugcgucauggccuccaguguacuccuguggauggccagcguagagccccacuggaucgcggccagcauaauucucgaguucuuccucauggugcuccucaucccagagccagacagacagcgaacaccgcaggauaaccaacuggcguauguagugauaggucuauuauuuaugauccuaacagucgccgcaaacgagaugggucuucuagaaacgaccaagaaggaccuagggaucggccacguagcuguugagaaucaucaccaugcugcaaugcucgacguggaucuucacccagcauccgcguggacgcuauacgcagucgcaacuacaaucaucacaccaaugaugcgacacacaauagaaaauacuacggcaaauauaagucuaacagccaucgccaaccaagcagccauccuuauggggcuagauaaagguuggcccaucagcaaaauggacauaggggucccguuacuugcacuaggaugcuacagccaagugaacccccucacucucacugcggcuguucugaugcucgucgcccauuaugcaauuauaggaccaggucuucaagccaaagccacccgagaggcgcaaaaacgcacagcagcagggauaaugaaaaacccuacaguagacggaaucguagcgauugaccuggaccccguuguauacgacgcgaaguucgaaaagcagcugggacaaauaaugcuccuaauccuuuguacaagccaaauacugcucaugaggacuaccugggcccugugcgagagcauaacgcuggcaaccggcccacugaccacccuuugggagggaucgcccgggaaguuuuggaacacgaccauagcgguaaguauggccaacaucuucagaggcucguaucucgcgggcgccggccuugcguucucacugaugaagucgcuuggaggcggaaggcggggcacaggagcacagggagagacccuaggggaaaaauggaaacgccaacucaaccagcucagcaaaagugaauuuaacaccuacaaacgaagcggcaucauggaaguagaucgcucggaggcaaaggaaggacucaaaaggggagagacgacgaaacacgcaguaagccgaggaacugccaagcugcgaugguuuguagagcggaaccucguaaaacccgaaggcaaggucaucgaccuaggaugcggccggggaggauggaguuauuacugcgccggccuuaagaaaguaacagaaguuaaaggguauaccaaagguggccccggccacgaggagccgauacccauggcgacauacggcuggaaucucgugaagcuacacagcgguaaggacgucuucuuuauuccuccggagaagugcgacacacugcugugcgacaucggcgagagcaguccaaacccaacaauagaagagggccggacccuccgaguccuaaagaugguagaaccguggcuaagaggaaaucaguucugcaucaaaaucuuaaacccauacaugcccucagugguagaaacccucgaacagaugcaacgaaaacacggaggcaugcuaguacguaacccuuugucaagaaacagcacacacgaaauguauugggucucgugcggcacggguaacaucgucucggcugugaacaugaccagccggaugcuacucaacagauuuacaauggcccaccgcaagccaacauacgagcgcgacgucgaccuuggagcagguacucggcauguggcaguugaaccggaggucgcaaaccuugauauaauaggucagaggauagaaaacauaaagcaugagcacaaaaguaccuggcauuaugaugaagacaacccuuacaaaacuugggccuaucacggguccuacgagguaaagcccuccggaagugccagcagcaugguaaauggaguggucaaacuacugacuaaaccgugggacguaauaccaauggucacacaaauagcgaugacggacacaaccccauucgggcaacagagggucuucaaagaaaagguggacacccgaacgcccaaagcgaagagaggcacaacucaaauaauggagguaacagcgcgguggcucuggggcuuucuaagcaggaauaagaagccccgaauuugcacccgagaagaauuuaccagaaaagugagaucaaaugccgcaauuggcgcaguguucguggacgaaaaccaauggaacagugcgaaggaggcgguggaggacgaacgcuucugggaucucguacaccgggagagagaacugcacaagcaagggaagugcgccacaugcguauacaacaugaugggaaagcgugagaagaaacuuggcgaguuuggaaaggccaagggaagucgggcaauaugguauauguggcuaggugccagauuccucgaauuugaggcgcucggauucaugaacgaggaccacugguuuagucgcgaaaacucucugucagggguagagggcgaaggauuacacaagcucggcuacauacuacgugauauaucgaaaauacccggcgggaacauguacgcugacgacacugccgguugggacacgcgcaucaccgaggacgaccugcagaacgaggcaaagauuacggacauuauggaaccggaacacgccuugcucgcaaaggcaaucuucaaauugacauaccaaaacaaaguggugcgcguacaaagaccggcaaagaacgggaccgucauggacgucaucucacggagggaucaacgagggagcggccaggucggaacguacggacuaaacaccuucacaaacauggaagcgcagcugauucgccaaauggaaagcgagggaaucuucagcccaucagagcucgagacgccaaaccuagcggagcgcguucuggacuggcucgaaaaauacggcguugaacgccugaaaaggauggcgaucucuggugacgacugcguaguaaagccgauagacgaccguuucgcgacggcucuaaccgcacugaacgacauggguaaaguacgaaaagacauaccacaaugggaacccagcaagggauggaacgauuggcaacagguaccuuucugcucacaccacuuccaccaacugauuaugaaagauggucgcgaaaucguggucccgugcagaaaccaagacgagcucgugggaagggcccgggugagccagggugcgggauggucgcuacgggaaacggcaugccuagguaagaguuacgcacaaauguggcaacucauguacuuccaucgacgugaccuccggcucgcugccaacgcaauaugcagcgcgguaccaguggacuggguccccacgagccgaacgacguggucaauacacgcccaccaucaauggaugacuacagaagauaugcugucggucuggaauagagucuggauagaagagaaccccuggauggaggauaaaacccacauuaguagcugggaagacguccccuaccucggaaaaagagaggaccaguggugcggcucgcucaucggucucacugcgagagcaacaugggcaacgaacauucaagucgccauaaaccaagugcgccggcugauaggcaaugagaacuaucuagauuacaugacaucaaugaaacgauuuaaaaacgaaagugacccagaaggggcguuaugguaa

SEQ ID NO: 24685 - RNA, 9879 nt, Artificial Sequence
  derived and/or modified CDS sequence (opt11) from DENV-1__KC762650__SS-prME
agcgugaccaugcugcucaugcugaugccgaccgcccuugcuuuccaccucacaacacggggcggggagccccacaugauuguauccaagcaggagaggggcaaaagccuccuuuucaagacguccgccggcgucaacaugugcacccuaauagcaauggaccugggcgaacugugcgaggacacucuuacguauaagugcccucggauaaccgaggcggagcccgacgauguugauugcuggugcaacgccacugacaccugggugaccuaugggacaugcucacaaaccggggagcaucgucgggacaagcgguccguagcuuuggcgccucaugugggcuuaggacucgagacuagaaccgagaccuggaugagcuccgaaggcgccuggcggcagauccagcgggucgagaccugggcccuacggcaccccgguuuuacggucauagcucuguuccucgcccacgccaucgggaccagcauuacacagaaagggaucauauucauccugcuaaugcucgugacgcccuccauggccaugagaugcguggggaucggcucgagagauuucgucgagggacucuccggcgccacguggguggacgucguacuggagcaugggagcuguguaaccaccauggcaaaggauaagcccacccucgacauagagcuucugaagacugagguuaccaauccagcgguccuccgcaaguuguguauagaggccaagauuuccaacacgaccacagacucaaggugcccaacucagggagaggccacccugguggaggaacaggacgcuaacuuuguaugucgccggaccuucgucgaucggggcugggguaacggaugcgggcuguucgggaagggcuccuuaauuacgugcgccaaguuuaagugcgugacgaagcuggaggggaagaucgugcaauacgagaaccuuaaguacagcgugaucguaacagugcacaccggagaucagcaccaggugggcaacgaguccacggaacacggcacaaccgcgaccauuacuccccaagcuccuaccacugaaauccagcugacugacuacggggcacugacccuugacugcucuccccggacaggccuggauuucaaugagaugguccuacucacgaugaaagaaaaaucaugguuggugcauaagcagugguuccuagaccucccccugccuuggaccagcggggccagcaccucccaagagacguggaaucgccaggaucugcucguuaccuuuaagaccgcccacgcgaaaaaacaggaggugguggugcuugggagccaggaaggcgccaugcacacggcacugaccggagccaccgagauccagaccucgggcaccacgaccaucuucgcuggacaccucaaguguagacuuaagauggacaagcugacucucaagggcauguccuauguuauguguaccggguccuucaagcuagagaaggagguggcggagacgcagcacgggaccgugcugguccagaucaaguaugaaggcacagacgcccccugcaagauacccuucagcacccaagacgagaaaggggugacacagaacgggcgccugaucaccgcuaacccgaucgugacugauaaggagaagccggugaacaucgaggcggaaccgcccuucggugagucuuacaucgugaucggcgccggugagaaagcccucaaacugagcugguucaaaaaggggucuucgauuggcaaaauguuugaagccaccgcccgcggggcccggcguauggccauccugggcgacacggccugggacuucgggucuauaggcgguguuuucacuagugucgggaaguugguccaccagauauucggcaccgccuauggugugcuguucuccggaguauccuggaccaugaagaucgggaucggcguccuucucacguggcugggacugaacucacggucaacgagcuugagcaugacguguaucgccguggggcugguuaccuuauaccuuggggugaugguacaggcugauuccggaugugucauaaauuggaaaggccgcgagcugaaaugcgggagcggcaucuucgugacgaacgaggugcacaccuggaccgagcaguacaaauuccaggcggacucuccgaaacggcuguccgccgcgaucggcaaagcgugggaagaaggcgucugcggaaucaggucugccacccgguuagagaacaucauguggaaacagaucucaaacgaguugaaccacauacuucuggaaaacgauaugaaauuuaccgucguggucggggacguggcgggcauccuggcucaagggaagaagaugauccgcccccagccuauggagcacaaguauucuuggaaguccuggggcaaggccaagaucaucggcgccgacgugcagaacaccacauucaucauugauggccccaacaccccugaaugucccgaugaccagcgggcauggaacaucugggagguugaggacuacggcuucgggaucuuuacgacgaacaucuggcuuaagcuccgcgauaguuauacccaaguuugcgaucaccggcuaauguccgccgccaucaaagauagcaaagcggugcaugccgauaugggguacuggauugaguccgaaaagaacgagaccuggaaacuggcaagggcuagcuucaucgaggucaaaaccuguauuuggcccaaaucccauacccuuuggagcaacgggguguuagaguccgaaaugauaaucccaaagaucuacgggggucccaucucgcagcacaacuaccggccaggguacuuuacacagaccgcgggccccuggcacuuagggaaauuggaacuggacuucaaccugugcgagggcacuacgguaguaguggacgagcacugcggcaaccgcgggccaucccucagaacgaccaccgugacaggcaagaucauccacgaguggugcugcagaagcuguacccugccgccucugcguuuccgcggggaagacggauguugguacggaauggaaauaagacccguaaaggaaaaggaggagaaccucgugaaguccaugguuagcgcaggcucaggcgaagucgacuccuucagccuugggcuguuaugcaucagcaucaugauugaggaagugaugcgaagccguuggagucgcaaaaugcugaugaccggcacccuagccguuuucuuucugcugaucaugggucagcugacguggaacgaccucauccgccugugcauuauggucggcgcgaacgcaagcgacagaauggggaugggaaccaccuaucuggcccuuauggcuaccuucaagaugaggccgauguucgcuguaggacugcuuuuccggcgccucacgucccgugaaguuuugcuauuaacaaucggguuaagccuggucgcgucuguggaguugcccaacagccuggaggagcugggugacggguuagcgaugggcaucaugauccugaaacugcucacugacuuucagucccaucaguuaugggccacccugcucagcuugaccuuuaucaagacaacauucucccugcauuacgccuggaagaccauggcgaugguacucagcauugugucacuguucccacucugucucuccacgaccucccagaagacaaccuggcugccagugcugcuugguagccuggggugcaagccucucacgauguuccuuaucgcugaaaauaagaucuggggccggaaguccuggccacugaacgagggaaucauggcaguaggcaucgugagcauucugcuaucaagccuguugaagaacgaugucccucucgccggcccuuuaauugccggcgguaugcuuaucgcgugcuacgucaucagcgguuccagcgcggaucucagcuuagagaaggccgcagaggugagcugggaggaagaggccgagcauuccggagcaucgcauaacauccugguggagguccaggacgacgggaccaugaagaucaaggacgaggaacgggacgacacgcucaccauccugcuaaaggccacccuccuggccgucagcggcguguacccgcucuccauucccgcgacauuguuugugugguacuucuggcagaagaagaaacagagauccggggugcugugggauaccccgagcccgcccgaggucgagcgggcggugcuggacgacggcaucuaccgcaucaugcagcggggccucuuagggcgcagccagguggggguagguguuuuucaggagaacguguuucacacuauguggcacgugacgaggggcgccguccucauguaucaagggaagcgucuggagcccagcugggcuucgguuaagaaggaccucauaucguacggcgggggguggcgguugcagggguccuggaacacgggggaggaagugcagguaauagcaguggagcccggcaaaaaccccaagaaugugcagacagcccccgggaccuucaagacccccgagggcgaggucggcgcaauugcucuggauuucaaaccagggacguccggcagccccauagugaaccgggaagguaagauugugggccuguacggcaaugggguaguaaccacuagcggcacuuacguaagugcuaucgcucaagcaaaggcgagccaagaggggccucugccugagaucgaagaugaggucuuucgcaagcguaaucugacgaucauggaccugcacccgggcagcgggaaaaccaggcgguacuuacccgcaaucguccgugaagcuauuaaaagaaaguugcgcacucucauccuggcgccgaccagagugguagccuccgagauggcggaagcccucaagggcaugcccauccgcuaucagacgaccgccgugaagagcgagcacaccggcaaggagaucgucgacuuaaugugccacgccaccuucacuaugcggcugcucucccccguccgggugccaaauuacaauaugauaaucauggaugaggcccauuuuaccgaccccucaucaauagcggcccggggguauaucuccacccgcgugggcaugggugaggccgcggccauauuuaugaccgcuacgccccccggauccgucgaagccuucccucaaucuaaugccgugauccaggacgaggagcgggauauaccggagcgcuccuggaacagcggguacgaguggauuaccgauuuccccgggaagacuguuugguucgugccguccaucaagagcgggaacgacaucgcuaacugccuucggaagaacgggaagcgcgugauccaguugucacggaagaccuucgacaccgaguaucagaaaaccaagaacaacgacugggacuacgugguaacaaccgacauuagugaaaugggcgcgaauuuccgugccgaucgcguuaucgacccgcgccgguguuuaaaaccugugauccucaaagacgggccggagcgagucauccuggcaggucccaugccggugacggucgccuccgccgcccagcggcgcgggaggguaggccgcaaccacaacaaggaaggcgaccaguacaucuauaugggccagccacugaacaaugaugaggaccaugcccacuggaccgaggccaagaugcucuuagacaauaucaacacacccgaagggauuauacccgcgcuuuucgagccggagcgagagaaaucggcggcgaucgacggggaguaccgguugcgcggcgaagcacggaaaaccuucgucgagcuuaugcgccgcggggaucucccggucuggcuuuccuacaaggucgcgucagagggcuuccaguacagcgaccgccgguggugcuuugacggcgagcgcaacaaccaggugcucgaggagaauauggacgucgaaaucuggacgaaagagggugagcggaagaaacuucguccacgguggcucgaugcgcgcaccuacuccgacccccuggcccuucgggaguucaaagaguucgcagcuggucgcagaagcguauccggagaccucauccucgagaucggcaagcugccucagcaucucacccagcgcgcucaaaaugcccuagacaaccugguaaugcuccauaauagcgagcaaggcgggcgggcguaccgacacgcaauugaagagcugcccgacacuaucgaaacacuuauguuacuggcucugauugccgugcuaacuggcgggguaacuuuauucuuccuuuccgggcgagggcucggcaaaaccagcauaggacugcugugcguuauggcauccagcguccuacuauggauggcguccguggaaccccauuggaucgccgcuagcaucauacuggaguucuuccugauggugcuguugauuccagagccggacaggcagcggaccccgcaagauaaccaacucgccuacgugguaaucggacuacuauucaugauccucacgguggccgcgaacgaaaugggccugcuggaaaccaccaaaaaggaccucggcauaggccaugucgcgguggaaaaccaucaccaugccgccaugcucgacguggaucugcaccccgcuagcgcguggacccuguacgcagucgcuacuaccauuauuaccccgaugaugcggcacacgaucgagaacacuaccgcuaacauaagccugaccgccaucgcgaaccaggcugccaucuugauggggcucgacaaggguuggcccauauccaagauggacaucggcgugccccugcuggcccucggguguuacucccaggugaacccccuuacacucacggcggcggucuuaaugcugguggcccauuacgccauaauaggcccgggauuacaagccaaggcgacccgcgaggcgcagaaacggaccgcggccggcaucaugaaaaauccuaccguggacgguauaguagccauugaccuggaccccgucguauaugacgcgaaguucgagaagcaacugggacagaucaugcuauuaauacugugcaccagccagaucuuacuaaugaggaccaccugggcguuaugcgagucuauaacacuggccacuggccccuugaccacccugugggagggguccccuggaaaguucuggaacaccacgauugccgucagcauggccaauauuuuucggggcuccuacuuagcaggcgccggacucgccuucagccugaugaagucccucggaggcggccgccggggcaccggggcgcagggagagacgcucggcgagaaguggaaacgucagcuuaaccagcuaaguaagagcgaguucaauaccuacaaacguuccggaaucauggagguggaccgcagcgaggccaaggagggccuaaagagaggggagacgacgaagcacgccgucucccgcggaaccgccaagcugcggugguucguggagcgcaaccuggugaagcccgagggcaagguaaucgauuugggcugcggccgcggaggguggagcuacuacugcgcagggcugaagaaagugaccgaggucaagggguacaccaagggcggccccggccacgaggaaccgaucccgauggccaccuacggguggaaucugguaaagcugcacucaggcaaggacgucuucuuuaucccgccagagaagugcgacacccuccugugugacaucggggaguccagccccaacccuacaaucgaggagggccgaacguuacgggugcucaagaugguggagccauggcuucgagggaaccaguucuguauuaagauacuaaaccccuacaugcccagcgucguggaaaccuuggagcagaugcagcggaagcauggaggcaugcugguucgcaauccucuaagccggaacagcacucacgagauguacugggucuccugugguacgggaaacaucgugucugcggugaacaugaccucucgcaugcugcucaaucguuucacgauggcccaccgcaaaccuacguacgaaagggaugucgaccucggggcgggcacccggcacguagccgucgagccagaagucgccaaccucgacaucaucgggcaaagaaucgaaaacaucaaacaugagcauaagucaaccuggcacuaugaugaagacaaccccuacaagacgugggcguaccacgguagcuacgagguaaagccgucgggcucggccucaucaauggucaacggggugguuaaauugcugacgaagcccugggacgucauaccaauggugacucagaucgccaugacagacacuacccccuucggccagcaaagaguuuuuaaggaaaagguagacacgcgcaccccgaaggcgaagcgggggacgacccagaucauggagguuacggcccgcugguuguggggcuuucuuucucggaacaaaaaaccacgcaucugcacccgggaggaguucacaagaaaagugcgcagcaacgcggccaucggcgccguuuuuguggacgaaaaccaguggaacuccgccaaggaggcagucgaagacgagcgcuucugggaccugguacaccgagaacgggagcuucacaaacaggggaagugcgcgacaugcguguauaacaugauggggaaacgagagaagaagcugggggaauucggcaaagcaaaggggucuagggccauaugguacauguggcugggagcccguuuuuuagaguucgaagcgcuggguuucaugaacgaggaccauugguuuucuagagaaaacagucuaaguggcguggagggcgaggguuugcauaaacuggguuacaucuuaagagacaucagcaaaauccccgggggcaacauguacgccgacgauacggccggaugggacacccgcaucacugaagacgaccuccagaacgaagcgaagaucaccgauauuauggaaccggagcaugcccuucuggcaaaggcaauuuuuaagcucaccuaucagaauaaagucguucgcguacagcggcccgcaaaaaacgggacggucauggaugucaucucucgccgggaccagagaggcagcggacaagugggcacguauggacuuaacaccuucaccaacauggaggcccaacugauucgccaaauggagagcgagggcaucuuuucacccuccgaacuugagaccccuaaccuggcugagcgcgucuuggacuggcucgagaaauacgguguggagagguuaaaacgcauggcgaucaguggggaugacugcgugguuaagccgaucgacgaucgguuugcaacggcccuuacagcacuuaacgauaugggcaaagugagaaaggacaucccccagugggagcccucgaagggguggaaugacuggcagcaaguccccuucugcagccaccacuuccaccagcugaucaugaaggacggacgggaaaucgucguaccgugcagaaaucaggacgaacuugugggccgggcccgcgucucccagggggcgggauggagcuugcgggagaccgccugccugggaaaaagcuacgcacaaauguggcaguuaauguauuuucaucgccgggaccuccgccuggccgcuaaugcuaucugcuccgccguacccgucgacuggguccccacaucccgcacgaccuggagcauccacgcgcaucaucaguggaugaccaccgaggacaugcuuagcguuuggaacagaguauggauugaggaaaacccguggauggaggacaagacgcacauuuccaguugggaggacgucccguaucucggcaagagagaggaccaguggugcgggucccugauaggucuuacggcccgggcgacuugggccacuaauauccagguagcaaucaaucagguucgccgguuaaucggcaaugagaacuaucuggacuauaugacguccaugaaaagguucaagaacgagucggaucccgagggagcccuuugguga

SEQ ID NO: 24686 - RNA, 9879 nt, Artificial Sequence
  derived and/or modified CDS sequence (opt11) from DENV-1__KC762623__SS-prME
ucugugaccaugcugcucaugcugaugcccaccgcucuggccuuccaccucacuacccggggcggggagccucacaugaucgucaguaagcaggaacggggcaagucacugcuguucaagaccucagccggggugaacaugugcaccuuaaucgccauggaccugggugagcugugcgaagacaccuuaacuuacaaauguccacgcaucaccgaagccgagcccgacgacguggacugcugguguaaugccaccgauaccugggucaccuaugggaccugcagccagaccggggagcaccggcgcgacaagcggagcguggcccuagcgccccacgugggcuuagggcucgagacgcgcaccgagaccuggauguccucagagggcgccuggaagcagauccagcgcguggagaccugggcccugcgccaccccggguucacggugaucgcccuguuccucgcgcacgccauuggaacuagcaucacccagaaggggaucauuuuuauccugcugaugcucguuacgcccuccauggccaugcggugcgucggcaucggcagcagagacuucguggaggggcuguccggcgccacguggguggacgucgugcucgagcacgggagcugcgugaccaccauggccaaggacaagccgacacucgacaucgagcuacugaagacggaaguaaccaaccccgccguguugcggaagcuuuguaucgaggccaagaucuccaacaccacaacggacagccgcugccccacccagggcgaggccacucugguugaggaacaggacgccaacuucguaugccggcgcacauuuguggaccggggcugggggaacggcugcggacuguucgggaaggggagucuuaucaccugcgcgaaguucaagugcgugagcaaauuggaggggaagauaguccaguaugagaaucucaaguacuccgugaucgugaccguccauaccggagaccagcaccagguagggaacgagagcaccgagcacggcacuaccgcgaccaucacgccccaggcccccaccacggagauccagcugaccgacuacggggcccugacccuagacugcagcccccgaaccggccuagauuucaacgagaugguacugcucacgaugaaggagaaguccuggcugguccacaagcaaugguuccucgaccuucccuugcccuggaccagcggggccucuaccagccaggagaccuggaaccggcaggaucuguuaguuacguucaagaccgcccacgcgaagaagcaggaggucguggugcuggggucccaggagggcgccaugcacacggcccugacgggggccacggagauccagaccucuggcaccaccacgaucuucgcugggcaccucaaaugccgccugaagauggacaaacugacccucaaagggauguccuauguaaugugcaccggcucuuuuaagcuggagaaggaaguggcggagacacagcacggcacgguguuaguccagauaaaguacgagggaaccgacgcccccugcaagauccccuucuccacccaagacgagaagggggugacccaaaacggccggcuuaucacggcaaauccgaucgugaccgacaaagagaagcccgucaacauugaggcugaaccgccguucggugagagcuacauagucaucggcgcgggcgagaaggcccucaagcuguccugguuuaagaaggggagcuccaucggcaagauguuugaggcaaccgccaggggggcgcgccgcauggcgauacugggcgauaccgccugggacuucggcagcaucggcggcguauucacguccgucgggaagcucgugcaccagaucuucggaacugccuacggggugcuguucagcggcgucucguggaccaugaagaucgggaucggcgugcuccugacguggcugggccugaacagcaggucaacgagccucuccaugaccuguaucgccgugggccuugucacccuguacuugggcgugauggugcaggcugacagcgggugcgucaucaacuggaaaggucgggaauugaagugcggguccgguaucuucgugaccaacgaagugcacacuuggaccgagcaguacaaguuucaggcggacuccccgaaacgccuuagcgccgccaucggcaaggccugggaggagggggugugcggcauacgguccgccaccaggcucgagaacaucauguggaagcagaucuccaacgagcugaaccacauucuccucgagaacgacaugaaguucaccgugguggucggugacguggcuggcauucuggcccagggaaagaaaaugauccggccccagcccauggagcacaaauacucguggaaguccuggggcaaggcaaagaucaucggcgcagacgugcagaacaccacguucaucaucgacgggcccaacaccccggagugcccggaugaccagcgcgcguggaacaucugggaggucgaggauuacggcuuuggaaucuucacuacgaacauuuggcugaaacuccgggacucuuauacgcaggugugcgaccaucgacugaugagugccgccaucaaggauuccaaagccgugcacgccgacaugggcuacuggaucgagagcgagaagaacgagacguggaagcuggcgcgggccucguucaucgaggucaagucguguaucuggcccaagucccacacccucugguccaacggcguucuggaguccgagaugaucauccccaagaucuacgggggcccaaucucacagcacaauuaccgccccggguacuucacccagacugccggccccuggcaccuggggaagcucgagcuggacuucgaccugugcgagggcaccaccguggucguugacgagcacugcggcaaccgggggcccucccuccgcacgacgaccguaacggggaaaaucauccacgaguggugcugcagaagcuguacccuuccgccccugcgcuuccgcggggaggacggcuguugguaugggauggagauccgccccgucaaggagaaggaggaaaaucucgucaaaagcaugguuuccgccggcaguggcgaagucgauuccuucagccucgggcugcucugcauuuccaucaugaucgaggaggugaugcggucccgguggucccgcaaaaugcugaugacaggcacccuggccguguucuuccuccugaucauggggcagcugacuuggaacgacuugauccgccugugcaucauggucggcgcgaacgccagcgauagaauggggaugggcaccacguaccuggcccuuauggccaccuucaagaugcggcccauguucgccguggggcuccuguuccgccggcucaccucccgagaagugcugcugcucaccaucgggcugagccuggucgcguccguggagcuccccaauucccuggaggagcugggugaugggcucgccaugggcauuaugauccugaagcuucucacggauuuccagucccaccagcucugggcaaccuugcucagccugaccuucaucaagaccacguuuucccugcacuacgccuggaagacgauggcgaugguccucagcaucgugagucuuuucccccugugccucagcaccaccucacagaagacgacauggcugccagugcuguuaggcagccuggggugcaagccgcugaccauguuccucaucgccgagaacaagauauggggccgcaaaagcuggccccugaacgagggaaucauggccgucgggaucguaucuauccugcucucgucccuucugaagaacgacgucccccucgccgggccccugaucgccggcggcaugcugaucgcgugcuacguaaucagcggguccagcgccgaccugucccucgagaaggccgccgaggugagcugggaggaggaggccgagcacuccggcgcgagccauaacauccugguggagguccaggacgacgggaccaugaagaucaaggacgaggaacgcgacgacacguugaccauccugcugaaggccacccuccuggcugucuccggcgucuacccgcugagcauccccgccacccucuuccuaugguacuucuggcaaaagaagaagcagagauccgggguacugugggacacccccagcccgcccgagguggagcgcgccgugcuggacgaugggaucuaccggaucaugcagcgcggccuccuggggagaucccaggucggcgucggggucuuccaggagaaugucuuucacacaauguggcacgugacucgcggagcggugcugauguaccaggggaaacggcucgaacccucgugggccuccgucaagaaggaccugaucagcuacggcggcgguuggcgacugcaaggcucguggaacaccggggaggagguccaggugauagccgucgagcccggcaagaacccgaaaaacgugcagacagcccccggaacauuuaagacccccgaaggcgagguuggagccaucgcgcucgacuucaagcccgggaccagcggcagcccgaucguaaaccgggagggcaagaucgugggccuguacggcaaugggguggucacuacguccggcaccuacgugagcgccaucgcccaggcuaaggcgagucaggaggggccgcugcccgagaucgaggacgagguauuccgcaagcguaaccucacaaucauggaccugcaccccgggagugggaagacccgccguuaucugccggcaaucguucgcgaggccaucaagcggaagcucaggacacugauacuggccccaacgcgcgugguggccucagagauggcagaggcccucaagggcaugccgauccgguaccagaccacggccgucaagagcgagcacaccggcaaggaaaucguggaccugaugugccacgccaccuucaccaugcgccugcucucucccguacgggucccgaacuauaacaugauuaucauggacgaggcccacuucaccgauccgagcuccaucgcggcccgcggguacaucagcacgcgggugggcaugggggaggccgccgccauauucaugaccgcgacgccgcccggcuccgucgaggcauucccgcagagcaacgcagugauucaggacgaggagagggacauucccgaacgauccuggaacagcgguuacgaauggaucacagacuuccccgguaagacggugugguucguuccauccaucaagagcggcaacgauaucgccaacuguuugcgcaagaacgguaagcgugugauccaacugucgcgcaagacguucgacaccgaguaccagaaaaccaagaauaacgacugggacuacguggugacaaccgacauaagcgagaugggugcgaacuuccgggccgaccgcguaauagacccgcggcgcugccucaagcccguaauccugaaggacggacccgagcgagugauucuugccggccccaugccgguaaccguggcguccgcagcgcagcgccgggggagaguaggccggaaccauaacaaggagggcgaccaauacaucuacauggggcagccccucaacaacgacgaggaucacgcccacuggaccgaggccaagaugcugcuggacaacauuaacacgccggagggaaucauccccgcccucuucgagccggagcgcgaaaagucugccgcgaucgacggggaguaccgcuuacggggcgaggcccgcaagacuuuuguggaacugaugcgucgaggggaccuuccugucuggcugagcuacaaaguagcuuccgagggcuuccaguacagcgaccggcgcuggugcuucgacggugaacggaacaaccagguacuggaggagaacauggauguagagauuuggaccaaggagggggagagaaagaaacuccggccccgcuggcuggacgcccggaccuacuccgacccccuggcguuaagggaguucaaagaguucgccgcgggccgccgcagcgucuccggggaccuaauccuagagaucgggaagcucccgcaacaucugacccagcgggcccagaacgcccuggacaaccucgugaugcugcacaacagcgagcaaggcggucgcgcauaccggcacgccauggaggaguugccagacaccaucgagacucucaugcugcuggccuugauagccgugcugacaggcggggucacgcuguuuuuccucuccggccgcgggcugggcaagaccagcaucggccugcucugcgugauggccuccagcguguuacuguggauggcuagcgucgagccccacuggaucgccgccagcaucauccucgaguucuuccugauggugcugcuaauccccgaaccggaccggcagagaacgccccaggacaaccaacuggcguacguggucaucgggcuccucuucaugauccucaccguggcggcgaacgagaugggccugcucgagacgacgaagaaggaccucgggaucggccacguggccgucgagaaccaccaccacgccgcgaugcuggacguggaucuccaucccgcaagugcauggacccuguacgccguggcgaccacgaucaucacgccgaugaugcggcacaccaucgagaacaccaccgccaauaucagccugacggccaucgcgaaucaggccgcuauacucaugggacuggacaaaggcuggcccauaucuaagauggacaucggcgucccccugcuggcccuggggugcuauagccaagugaacccccucacccucacggccgccgugcugaugcuggucgcgcacuacgccaucaucggaccagggcuucaggcgaaagcgacaagagaggcccagaagcgcacggccgccggcauuaugaagaaccccaccguggacgguauagucgcaaucgaccuggaccccgucguuuaugacgcgaaguuugagaaacagcugggccagaucaugcucuuaauccugugcaccucccagauccuccugaugcggacuaccugggccuugugugagagcaucacccucgccaccggcccccuuaccacacugugggaggggaguccgggcaaauucuggaacaccaccaucgccgucagcauggcuaacauauuccgcgguucguaccucgcgggcgcaggacuggccuucucccugaugaagucucucgggggagggcggcgaggcacuggggcccaaggcgagacgcugggcgagaaguggaagcggcaacugaaccagcucucgaagagcgaguucaacaccuacaagcgcuccgggaucauggaggucgaccggagcgaggcgaaggagggccugaaacgcggggagacaaccaaacacgccgugucccggggcacggccaagcugcgcugguuuguugagcggaacuuagucaagccugagggaaaggugaucgaucucggcugcggccgcgggggcuggagcuacuacugcgccgggcuaaagaaggugaccgaagucaagggcuacaccaaggggggucccggacacgaggaacccaucccgauggccaccuacggcuggaaccucgugaagcuccacucugguaaggacguauucuucaucccgcccgagaaaugugacacgcugcugugcgacaucggugagagcucccccaacccuacgaucgaagagggccggacccuaagaguccugaagaugguggagcccuggcugcgggggaaccaauucugcaucaagauccucaacccauauaugcccagcguugucgagacgcuugaacagaugcagcgcaagcacggcggaaugcuagugcguaacccacucucccggaacucgacgcacgagauguacugggugucaugugggaccggcaacaucgucagcgcggugaacaugaccucccggaugcugcugaaucgcuuuaccauggcucaccgcaagcccaccuacgagcgggacguggacuuaggggccggcacgcgccauguugccguugagcccgagguagccaaccuggacaucaucggccagcgcaucgagaacaucaagcacgaacauaagagcacguggcacuacgacgaggacaaccccuacaagaccugggcguaccacgguuccuacgaggugaagccuucgggcagcgccuccuccauggugaacggggugguaaagcugcucaccaaaccgugggacgucauccccauggucacacagaucgcaaugaccgacacgacccccuucggccaacaacgcgucuucaaggagaagguggacacgcggaccccaaaggccaagcgcgguaccacccagaucauggaggucacagcccgguggcuguggggcuuccucucccgcaacaagaaaccccggaucuguaccagagaagaguucacccggaaggugcgcagcaacgcggccaucggagccguauuugucgacgagaaccaguggaauuccgccaaggaggcgguagaagacgagcgguucugggaccucguacacagagagcgggagcugcacaagcaggggaagugcgcgaccugcguguacaacaugaugggcaagcgugagaagaaacugggggaguucggcaaggccaagggcagccgagccaucugguacauguggcucggcgcacgcuuccuggaguucgaggcguuaggcuucaugaacgaagaccacugguucuccagggagaauagccucucgggaguggagggcgaagggcuccacaaguugggcuacauauuaagggacaucagcaagauucccgggggaaacauguacgccgacgacacggccggcugggauacgcggaucacugaggacgacuuacagaacgaggccaagaucaccgacaucauggagccggagcacgcccugcucgcgaaagccauauucaagcugacguaucagaacaaggugguucgagugcaacgccccgccaagaacgggaccgucauggacgucaucucccggagagaccagcggggcagcggccagguggggaccuacggccuaaacaccuucacuaacauggaggcccagcucauuaggcagauggaguccgaggggaucuuuagccccuccgagcuggagacccccaaccuggccgagcggguucucgacuggcuggagaaguacggcgucgaacgccugaagcgcauggcgaucucuggggacgacugcguggucaagccgauugacgaccgcuucgccaccgccuuaaccgcccuaaacgacaugggcaagguccggaaggacaucccccagugggagcccucuaagggguggaacgacuggcagcagguucccuucugcagccaccacuuccaccagcugaucaugaaggacggcagggaaaucguggucccgugccggaaccaggaugagcucguuggccgcgcccggguaagccaaggcgcgggcuggucucugagggagacugccugccugggcaagagcuacgcccagauguggcagcucauguacuuccaccggcgcgacuuacgcuuggccgcuaacgccauaugcuccgccguccccguggauugggugcccaccagccgcaccaccugguccauacacgcccaccaccaguggaugacaacagaggacauguugagcgucuggaaccgcguguggauagaggaaaaccccuggauggaagauaagacccacaucucuagcugggaggacgugccguaccugggcaagcgcgaggaucaguggugcggcagucuaaucggacucaccgcgagagcgacgugggcuaccaacauccaagucgcgaucaaccaggugcggcgacugaucggcaacgagaacuaccuggacuacaugacaagcaugaagcgguucaagaacgaguccgaccccgagggggcccugugguga

SEQ ID NO: 24687 - RNA, 9879 nt, Artificial Sequence
  derived and/or modified CDS sequence (opt11) from DENV-1__KC762632__SS-prME
agcguaacaaugcuccucaugcucaugcccaccgccuuagcauuucaccuuacgacgcgcgggggcgaaccccacaugauaguuucuaaacaagaacgagggaaaagucuccuauucaaaaccagugcugggguuaacaugugcacccucaucgcaauggaucucggggaacugugcgaagacaccuuaaccuauaaauguccucggaucacggaggccgaacccgacgacguagacugcugguguaacgccacggacaccuggguuaccuacgguacaugcagccaaacaggggaacauagaagagacaagcguucuguggcgcucgcgccgcacguuggccucggcuuggaaacccgcacagaaacauggaugagcucggaaggggcauggagacaaaugcaacgaguagagaccugggcacugcgacaucccggcuuuacaguaaucgcauuguuccucgcccacgcgauagggaccucgaucacgcaaaaagggauaaucuucauacuacuuaugcugguuacuccuuccauggcaaugagaugcguaggcauugguagccgggacuucguagaaggucuuaguggggcaacgugggucgacguagugcuugaacacgguuccugcguaaccacgauggccaaagacaagccgacucucgacauugagcuccuaaagacagaagucacaaaccccgcaguccuacgaaaacuaugcaucgaggcaaagaucagcaacaucaccacagacucgaggugccccacacagggcgaggcaacuuuaguggaagaacaagaugccaacuucgucuguagacgcacauuugucgacaggggguggggaaacggcugcggauuauucggaaaaggcagucugaucacgugugcuaaguucaaaugugucacgaaacucgagggaaagaucguccaauacgaaaaucuaaaguauaguguuaucgugacaguccacacuggagaucagcaucagguagguaacgagucgacagaacacggcaccacggcaacaauuacgccgcaagcgcccaccacggaaauccaguuaacggacuacggagcacuaacccuagacugcaguccgaggacgggccuagacuucaacgaaaugguacuucuaacaaugaaggaaaagagcuggcuuguccacaaacaaugguuccuagaccucccgcucccuuggaccucaggggcaucgacgucgcaggaaacauggaauagacaagaccuccugguaacauuuaaaacggcccacgcuaagaaacaagaagucguagugcuugggucgcaagagggggccaugcacaccgcacucacaggagcgacggaaauacaaacuucggggacuacuacaauauucgcagggcaccuaaaaugucgucugaagauggacaaguuaacgcuaaagggaaugagcuacgucaugugcacaggcucuuucaaacucgagaaggagguagccgaaacccaacacggaacagucuuaguucagaucaaguaugaaggaacggacgcgccguguaagauaccauuuucuacucaagaugaaaagggcguaacgcaaaacggcagacuaauaacggccaaucccauaguaacggacaaggaaaaacccgugaacaucgaagcagagccacccuucggcgaaagcuacaucguaaucggggccggggaaaaggcucucaaacucucuugguuuaagaaaggaucaucuaucggaaaaauguucgaggcgacggcaagaggugcccgaagaauggccauccuaggcgauacggccugggacuuuggguccaucggcggcguauucacuucgguggguaagcuaguucaccaaauauucggaaccgcguacgggguacucuucagcggcguuagcuggaccaugaagauagguaucggcguacuccucacuuggcuggggcucaacagccgaaguacuucauuaagcaugaccugcaucgcggucgggcucguaacacucuaucugggaguaaugguccaggccgacucaggaugcgucauaaacuggaagggaagggaacugaaguguggcaguggcauauucgugacgaaugaggugcauacguggacggagcaauacaaguuccaggcugauagcccgaagcgacuuagugcggccaucggaaaagcaugggaggaaggcgucugcggcauccgaagcgcaacaagacucgagaacaucauguggaaacaaaucucaaacgagcucaaccauauauuacucgagaacgauaugaaauucacggucgucguaggcgacguugcaggaauacucgcgcaaggaaagaaaaugauccggccacagccuauggaacacaaguacuccuggaaaagcuggggcaaagccaagauaauaggggcagacguacaaaauacaacauucauuaucgacggcccaaacacaccggagugccccgacgaccaacgugcauggaauauaugggaagucgaagacuacggauuuggaaucuucacgacaaacauauggcuaaaguugagggauagcuauacacaaguaugcgaucacagacucaugagugccgccauaaaggacagcaaagcaguccaugcagauaugggguacuggauagaguccgaaaagaacgaaaccuggaaacuugccagggcaucuuucaucgaaguaaaaacaugcaucuggcccaagagccacacgcucuggagcaauggggugcuagaguccgagaugauaauaccaaaaauauauggcggaccuaucagccagcacaacuaccgccccggcuacuuuacgcagacagcaggaccauggcaccuaggaaaacuugagcuggacuucaaucuaugugaggguacuaccguagucguagacgaacauugugggaacagaggacccucccuacgcaccacuaccguaacgggcaagaucauucacgagugguguugcagaucaugcacccucccaccccucagauuccggggcgaggacgggugcugguacggaauggaaauacggccggugaaagagaaagaggagaaccuaguaaagucaaugguaagcgccggcaguggggaggucgacucauucuccuugggucugcucugcauaagcauuaugaucgaggaggucaugcguagucgauggagccgaaagaugcuaaugaccgggacgcucgccguauucuuccuacuaaucaugggacaacucaccuggaacgaccugauaagacucugcauaauggucggcgcuaaugccucagauagaauggggaugggcacgaccuaccucgcguuaauggccacuuucaaaaugcggcccauguucgcagucggacuacuauuccgaagacugacgagcagagagguccuacuccuaacaauaggacuaucccuaguagcaucaguagagcuacccaacucgcuagaagaacuuggagacggacuagcgaugggcaucaugauccucaaacuauugacagauuuccaaucacaucagcugugggcgacccuauuaagccuaacauucauaaaaacgacauucagucuucauuacgcauggaaaacaauggccaugguacucagcauagucagucuuuucccucucugccuauccacuacaagccagaaaacaacguggcugcccgugcucuuaggaucccuggggugcaaaccccucaccauguuccuuaucgccgagaacaagauuuggggacggaaaagcuggccgcuaaaugagggcauuauggcagugggcauaguaagcauauuauuaagcucacuacuuaaaaacgacgugccccuagcagguccacuaauagccggaggaaugcugaucgcaugcuacguaauaagugguagcucggcugaccuaagccucgagaaggccgcggagguaucaugggaagaagaagccgaacacuccggugcaagccacaauauccuaguagaggugcaagacgacggcacaaugaaaauaaaggacgaggaacgcgaugacacacucacaauauuacugaaggcuacccuauuggcggugagcggggucuacccuuuaagcauccccgccacacuguucgugugguacuucuggcagaagaagaaacaaagaucgggcguauugugggacacgcccuccccaccggaaguggaacgcgcggugcuagacgacggcauauauagaauaaugcaaaggggcuugcucggacgaucccaagugggcguggggguguuccaggaaaacguauuccacacaauguggcaugucacccgcggagcggucuuaauguaccaagggaaaagauuagagccaucaugggcaagcgugaaaaaggaccugauaucguacgggggcggguggagacuccaaggaagcuggaauacaggggaggagguacaagugaucgccguggagccgggaaagaacccuaagaacguucagaccgcgccaggaacauucaaaaccccagaaggagaaguaggggcaaucgcucucgauuucaagccgggaaccagcggaucacccauagucaaccgggaaggcaaaauaguaggguuauacggcaacggcgugguuacgacaucgggcaccuacguaagugcaaucgcgcaggcaaaagcgagccaggaagguccccuucccgaaaucgaagacgaaguauuccgcaaacgcaaucuuacaauaauggaccuacacccaggaagcggcaagacccgacgauaccuuccggcaauagugagagaagcgaucaagcguaagcuccgaacccucauuuuagcgcccaccagagugguagccagcgaaauggccgaagcccuuaagggaaugcccauaagguaccagacaacugccgucaaaucagaacacacagguaaagaaauugucgaucuaaugugccacgcgacauucacgaugcgucuacucucuccagugagggugcccaacuauaacaugauaaucauggacgaagcacauuucacagaccccagcagcaucgcagcgaggggauacauaucgacccgugucgggaugggagaggcagcagcgauauucaugacagcaacaccacccgguucaguugaggcguucccgcaaaguaacgccgucauucaggacgaggaaagggacauuccagaacgaucuuggaacagcggguaugaguggaucacagauuucccaggcaagacgguaugguuuguccccaguaucaagagcggcaacgacauagccaauugucucaggaagaauggcaagcgagucauccagcucucgagaaaaacauucgacacggaauaccagaaaaccaaaaacaacgacugggacuacguuguaaccacggacauuuccgaaaugggagcaaacuuccgcgcggaccgcguaauagauccgaggagaugucucaaaccagucauccucaaggaugggccugagagagucauccuagcggggcccaugccaguaacaguagcguccgccgcgcagagacgcggcagggucggccgaaaccauaauaaggaaggagaccaauacaucuauaugggccaaccacucaacaacgaugaggaccaugcgcacuggacggaggccaagaugcuacuagacaacaucaauaccccggagggaaucauccccgccuuguucgagcccgaaagagagaaaagcgcagccauagacggcgaauaccggcuacgcggcgaagcgagaaaaacauuuguagaacugaugcgccgcggagaucugccuguguggcucucauacaaaguugcgagugaagguuuccaauacucagacagaagguggugcuucgacggugaacgcaacaaucaagugcuugaggaaaacauggacguagaaaucuggaccaaagaaggggagaggaagaaacuccggccccgauggcuagacgccagaaccuacagugacccccuagcacuaagggaguucaaggaauuugcugcuggccggcgguccgucagcggggacuugauacuagaaauagggaagcuaccacaacaccugacgcagcgggcacagaacgccuuggacaacuuagucaugcugcacaacagugaacaaggaggcagggcguaccgacacgccauggaagaacucccagacacaauugaaacgcuaaugcuucucgcccuaauagcggucuugacgggcggcgugacacuguucuuccugaguggacguggacucggaaaaacgucuaucggacuacuaugcgucauggccuccagcgugcuacuauggauggcaucagucgaaccccacuggauagccgcaucaaucauacuagaguuuuucuuaauggugcugcugauccccgaaccggaccgucagcgcacaccacaagauaaccaacuagcauacgucguaaucggccuauuguucaugauacugacagucgcagcgaacgagaugggccuccucgaaacaacuaagaaagacuugggcaucggacaugucgcaguggagaaucaccaccaugcagcgaugcuggacguggaucugcaucccgccucggcuuggacauuauacgccguagcgaccaccauaauaacgccaaugaugcgacacaccauagagaacacaacagcaaacaucagccugacagcgauugcgaaccaagccgcaauccuaauggggcuugacaagggauggccgauaucgaagauggacauuggggucccauuacuagcacuaggguguuacagucaggugaacccauuaacguugacagcagccguccuuaugcugguugcacacuacgcgauaauagggccagggcuccaggcuaaagcgacaagagaagcgcaaaagcgcacagcggcagguauaaugaaaaauccaacgguggacgggaucgucgcaauagaucuagaccccgugguuuacgacgcaaaguucgaaaagcaacuugggcaaauaaugcuacucauccugugcaccucccaaauccuccuaaugaggacuacgugggcacuuugcgaaagcauaacacuggcaaccggcccacucacaacguugugggagggcagucccggaaaauucuggaacacuacuaucgccgucagcauggccaauauauuuagaggcaguuaccuggcgggcgcggggcucgcauucagucuaaugaagucccuaggaggagggaggcgcgggacgggagcccaaggagagacacugggagaaaaauggaaacgccaacugaaccaacucucuaaaucugaguucaacacguacaaacgguccgggauaauggagguggaccgcuccgaagcgaaggaaggccuaaaaagaggggagacaacaaaacacgccgucucucgaggcacagcgaaacuacggugguucguggaaagaaaccugguaaagcccgagggaaaagucaucgaccucgggugcgggcgcggaggguggagcuacuacugugcuggccuaaagaaaguaacggaaguaaagggauauacuaaaggcgggccgggacacgaggaacccauaccgauggcgaccuacggguggaaucugguaaaacugcacucuggcaaagacguguucuuuauaccaccugagaagugcgauacgcucuugugcgacauaggcgagucuagcccuaaccccaccaucgaagagggccgaacgcuccgaguucuuaaaauggucgagcccuggcugcgugguaaccaguuuugcauaaaaauuuugaacccauacaugccgucaguaguugaaacucucgaccaaaugcaacgcaaacauggggguaugcucgugaggaacccccuaucgcgcaauagcacgcacgagauguacuggguaucgugcggaacaggaaacaucguuucagcagugaacaugacgucaagaaugcuccuaaacagauuuaccauggcccacagaaagccgacauaugaacgagacgucgaucugggcgcaggcacaagacacguagcgguggaaccagaggucgccaaccucgacauaaucggccaacggaucgaaaacauaaaacacgaacacaagucgacauggcauuacgaugaagacaacccuuauaaaacaugggcguaccacgggucauacgaaguuaaacccaguggcucggcauccaguauggucaacggaguaguaaaauugcucaccaagccaugggaugucauuccaauggucacacaaauugcuaugacggacacuacuccauucgggcaacagaggguuuucaaggaaaaaguagacaccaggacacccaaagccaagagaggaaccacucaaauaauggaagucaccgcccgguggcuguggggcuuccuaucgcgaaauaagaaaccaagaauauguacccgcgaagaguucacacgaaaggugcgaucgaaugccgcaauaggggccguuuucguagacgaaaaccaguggaauagcgcuaaagaagcaguugaagacgaacguuucugggaccuagugcaccgugaaagagaguuacacaagcaggggaaaugcgcaaccugcguauacaacaugauggggaaacgugagaagaaacuuggugaguucggcaaagcuaaaggaagccgagcgaucugguacaugugguuaggugcgcgguuucucgaguucgaagcacuaggauucaugaacgaagaccauugguucucgcgagagaacucucuaaguggggucgagggugaaggacuccauaaauugggcuacauuuuaagagauaucucaaagauacccggcggcaauauguacgcggacgauacggcagggugggacacaagaaucacagaggaugaucuccagaacgaagccaagauaacagacauuauggaacccgaacaugcucuacucgccaaagccaucuuuaagcugaccuaccagaauaaagucgugagaguucaacguccggccaaaaauggcacagugauggaugugaucucccgacgggaccaacggggaagcgggcaaguuggcacauaugggcuuaacacauucacaaacauggaagcgcagcuaauacggcaaauggaaucggaggggauauuuagcccaagugaacuggagaccccgaaccuagcggagcgcguguuagauuggcucgaaaaguacggaguugagcgccucaagagaauggccauaagcggagacgacugugucgucaaacccauagacgauagauucgcuacggcgcugacagcgcucaacgauaugggcaaaguacgaaaggacauuccgcagugggagccaagcaaaggauggaacgauuggcagcaaguacccuucuguagucaccauuuucaccaacucaucaugaaggacgggcgagaaaucgugguucccuguagaaaccaagacgaacuggucggucgugccaggguaagucaaggcgcgggaugguccuuacgugaaacggcaugcuugggcaaaucauacgcucagauguggcaacuuauguauuuccaccgucgcgaccucaggcucgccgcgaacgcgauaugcagcgccgugccggucgacugggugccaacuucccgcacaacauggaguauccacgcgcaucaccaauggaugacaaccgaggacauguuauccguguggaaccgggucuggauagaagaaaaucccuggauggaggacaaaacacauauuaguagcugggaagacguuccguaucuagggaaacgagaagaucaguggugcggaucacucauaggccuuaccgcccgagcgaccugggcaaccaacauacaggucgcuaucaaucaaguaagacgccugauuggaaacgagaacuauuuagauuacaugaccagcaugaaacgcuuuaagaacgaaucggauccugaaggggcauugugguag

SEQ ID NO: 24688 - RNA, 9879 nt, Artificial Sequence
  derived and/or modified CDS sequence (opt11) from DENV-1__KC762637__SS-prME
ucagugacaaugcugcucaugcugaugcccacagcccuggcguuccaccucaccacccggggcggggagccccacaugaucgugagcaaacaggaacggggcaagucacugcuguucaagaccucugccgggguaaacaugugcacgcucauagccauggaccugggcgagcugugcgaggacacgcuaaccuacaaguguccgcgcaucaccgaagccgagcccgacgauguggacugcuggugcaacgccaccgacacgugggugaccuacggcaccuguagccagacgggcgagcaccggcgcgacaagagguccguggcccuggcgccccacgugggacuggggcuggagacgcgcaccgagacuuggaugucuuccgagggcgccuggaagcaaauccagcgggucgagaccugggcacugagacacccgggauucacggugaucgcccuguuccucgcgcacgccauuggcaccucgaucacacagaaggggaucauauucauucuguugaugcucgucaccccguccauggccaugcggugcgucggcaucggcagccgcgauuucguggagggacuguccggggccacguggguugacguagugcuggagcacgggagcugcgugaccaccauggccaaggacaagcccacccucgauauagagcugcugaagacagaggucaccaaccccgcggugcuccggaagcugugcaucgaagccaagaucuccaacaccaccacagauagccggugcccgacccagggcgaagccacccugguggaggagcaggacgcaaacuucgucugccggaggaccuucgucgaccggggaugggggaacggcugcgggcuguucggcaaagggucccugaucacgugcgccaaguucaagugcguaacgaagcuggagggcaagauaguccaauacgagaaccuuaaauacagcgugaucgucaccguacacaccggcgaccagcaccaaguggggaacgaguccacggaacacggcaccaccgcuaccaucacgccccaggccccgacgaccgagauccaacugacggauuacggggcccugacccucgacuguagcccacgcacggggcuggacuucaacgagaugguccugcucaccaugaaagagaaguccuggcuggugcacaagcagugguuccuggaccucccccugccauggaccaguggggcaagcaccucgcaggagacguggaacaggcaggaccugcucgugaccuucaagaccgcccacgcgaaaaagcaggaggucguggugcugggcucccaggagggcgccaugcacacggcccugacgggugccaccgagauccagaccuccgggaccacgaccaucuucgccggacaccucaagugccgcuugaagauggacaagcuuacacugaagggcaugagcuacgucauguguacgggguccuucaaguuagagaaggagguugccgagacgcagcacggcacgguucugguccaaaucaaguacgagggcaccgacgcccccugcaagauccccuucucgacgcaagacgagaaaggggugacccagaacggacggcugauaaccgccaacccgaucguuaccgacaaggagaaacccgucaacauagaggccgagccgcccuucggggaguccuacauagucaucggcgccggggagaaggcccucaaacugagcugguucaagaagggguccagcaucggcaagauguuugaagccaccgcccgcggggcccggagaauggcgauccugggcgacacggccugggacuucggaucuauaggcggcguuuucacaagcgucgguaagcucgugcaccagaucuuuggcaccgcuuauggggugcuguucuccggcgugucauggaccaugaagauugggaucgggguguugcucacguggcugggacugaacucccgcucuaccucccucagcaugaccuguaucgcggugggacuggucacccucuaccucggcguuauggugcaggccgacagcgggugcgucaucaacuggaagggccgggagcugaagugugggucagguauauucgugacgaacgaggugcacacguggaccgaacaauacaaguuccaggcggacagcccgaagcgccugucagcggccauuggcaaggcgugggaggagggggucugcggcauccggagcgcaacccggcucgagaacaucauguggaagcagaucucuaacgagcugaaccauauccugcucgagaacgacaugaaguucaccgugguggucggggauguggcgggcauccuagcacaggggaagaaaaugauccgcccccagcccauggagcacaaguacaguuggaaguccuggggcaaggccaagaucauaggcgccgacgugcagaacacgaccuucaucaucgacgggcccaacaccccggagugccccgacgaccaaagggccuggaacaucugggaggucgaggacuacggcuucgggaucuuuaccacgaacaucuggcugaaguuacgggacucguacacccaggugugcgaccaccgccugaugagugccgccauuaaagauagcaaagcagugcacgcagacaugggguauuggaucgagagugagaagaaugagacuuggaagcuggcgcgggcgaguuucauagaggucaagaccugcaucuggcccaagucccacacucucuggagcaacggcgugcuggagucggagaugaucauaccuaagaucuacgggggccccaucucgcaacacaacuaccgccccggguacuucacacagaccgccggacccuggcaccuagggaagcucgagcuggauuucgaccucugcgagggaaccacgguuguaguggacgagcacugcggaaaccgggggcccagucugcgcaccaccaccgugacgggcaagaucauccacgagugguguugccggagcugcacccugccgccccugcgcuucagaggugaggacggcugcugguacgggauggagauccgccccgucaaggagaaggaggagaaccucguuaaguccauggucagcgcggguagcggagagguagacucauucagccuggggcucuuaugcaucuccaucaugaucgaagaggugaugcgcagccgcuggucccggaagauguugaugaccggcacgcuggccguguucuuucuccugaucauggggcagcucacuuggaacgaccucauacgucuguguauaauggucggcgcgaaugcgagcgaccggauggggaugggcaccaccuacuuggcccucauggccaccuucaagaugcggccgauguucgccgugggccuguuauuccgccggcucacgucccgcgagguguuacugcucacuaucgggcugagccuggucgcguccguggagcuaccgaacagccuagaggaguuaggcgauggguuagccaugggaauuaugauccugaaacugcucacagauuuccagucccaccagcugugggccacccugcucagccugacguucaucaagaccaccuucucccugcacuacgcguggaaaacgauggcgauggugcucagcaucgugucccucuucccacugugucuuagcacgaccucacaaaagacuaccuggcugccagugcugcucggaagccugggguguaagccccugacgauguuccucaucgccgagaacaagaucuggggccguaaguccuggccccugaaugaggguauaauggcuguaggcaucgucucgauccugcucagcucccugcuuaaaaaugaugucccgcucgccgggccccugauugccggcgguaugcugaucgcguguuacguaaucuccggguccagcgccgaccucuccuuagagaaggcugccgaagugagcugggaggaggaggccgaacacuccggggccagccacaauauccugguagagguucaggaugacgggaccaugaagauaaaggacgaggagcgcgaugacacuuugaccauccuguuaaaggccacccucuuggccguguccggcguguacccccugagcauccccgcuacccucuucguaugguacuucuggcagaaaaaaaaacagcgguccggcguacuuugggacacccccucuccgccagagguggagcgcgccguucuggacgacggcauuuaccggaucaugcagcgcggcuugcucgggcgcucccaggugggggugggggucuuucaagagaacguguuccacaccauguggcacgugacccgcggagcgguccugauguaccaagggaagcggcuggagcccagcugggccuccgugaagaaggaccucaucucuuacggcggcggauggcggcugcagggauccuggaacaccggggaggagguccaggugaucgcaguggaacccgguaagaaucccaagaacgugcagaccgcccccgggaccuuuaagacccccgagggugaggucggugccaucgcgcuggacuucaagcccgggacgagcggcucccccaucgugaaccgggagggcaagauaguuggccucuacggaaacggggucgugaccaccucgggcaccuacgugagcgccauagcccaggccaaagcuucccaagaggggccacugcccgagauugaggacgaggucuuccgcaagcggaaccugacgaucauggaccuccaccccggcagcgguaagacccggcgguaccugccggcuaucgugcgcgaggcgaucaagaggaagcugcgcacccucauccuggccccgacacguguggucgccuccgagauggccgaggcacugaagggcaugcccauccgauaccagacgaccgccgucaagagcgagcacaccggcaaggagaucgucgaccucaugugccacgccaccuuuacgaugcgccugcuuucccccguccgggugccgaauuacaacaugaucauaauggaugaggcccacuuuaccgacccaagcuccaucgcugcacgcggguacaucagcaccagaguuggcaugggggaggccgcugccaucuuuaugaccgcgacgccacccggcuccgucgaggccuucccgcagagcaaugccgugauccaggaugaggagcgcgacaucccagagcgguccuggaacagcggguacgaguggaucaccgauuuucccggcaaaaccgugugguucguccccuccaucaaguccggcaacgacaucgccaacugcuugcgcaaaaacgggaagcgggucauccagcugucccgcaagacuuucgacacggaguaccagaagaccaagaacaacgacugggacuauguggucaccaccgauaucagcgaaaugggcgcaaacuuccgggcagaccgcgugaucgacccgcggaggugccuaaagcccgugaucuuaaaggauggacccgagcgugucauccuugccggaccgaugccggugacggucgccuccgccgcgcagcgccgggggagagugggccggaaccacaacaaggaaggcgaccaguacauuuacaugggucagccacugaacaacgacgaggaccacgcccacuggaccgaagccaagaugcuccuagacaacaucaacacccccgagggcauaaucccggcccuguucgagccugagcgcgagaaguccgccgcgauugacggggaguaccgccuccggggugaggcccgcaaaaccuuuguugagcugaugcggcgcggggaccugcccgucugguuaagcuacaagguggcguccgagggcuuccaguacucugaccggcgcuggugcuucgacggcgagcggaacaaccaggugcuggaagagaacauggauguagagaucuggacgaaggaaggggaacgcaagaagcugcggccccgcuggcucgacgcgcggaccuacuccgacccccuggccuugcgcgaguuuaaagaguucgcggcgggucggcgcagcguuuccggggaccugauccuggaaaucggaaagcugccgcagcaucucacccaacgggcacagaacgcccuagacaaccuggugauguugcacaacucugagcagggcgggcgcgcguaccggcacgccauggaggagcuaccugacacgaucgagacgcugauguuacuugcccugaucgccguccucacugguggggugacgcuauucuuucuguccggcagagggcucggcaaaaccagcaucggccuacuaugcgugauggccuccucugugcucuuguggauggcgagcgucgagccccacuggaucgcggcaagcaucauccuggaauucuuccucaugguucugcugauccccgagccagaccggcagcgcacuccucaggauaaucagcucgccuacgucgugaucggucugcuguuuaugauacuuaccgucgccgcgaacgagaugggccugcuggagaccaccaagaaggaucuugggaucggccacgucgccguggagaaccaccaccacgccgccaugcuggacguggacuuacacccagccuccgcguggacuuuauaugccgucgcuacgaccaucaucaccccgaugaugcgacacaccaucgagaacacgaccgccaacauaagccuaacggcuaucgcgaaccaggccgccauccugaugggucucgacaaaggguggcccaucuccaagauggacaucggcgugccccugcuggcccuaggguguuacagccaggugaacccccugacccugacugcggccguccucaugcugguggcccacuaugcgaucaucggcccggggcugcaggccaaggcgacccgggaggcccagaagcggacagccgccgggaucaugaagaaucccacaguggacgggauaguugccaucgauuuagaccccgugguguacgacgcgaaguucgagaagcagcugggccagaucaugcuguuaauccugugcacgucccagauccuccucaugcggaccaccugggcccugugugagagcauuacacuggcaacgggccccuugaccaccuuaugggaggguuccccgggcaaauucuggaacaccacgaucgccguaagcauggccaacaucuuccgcgggucguaccuggcgggcgccggccucgcauucucccugaugaaguccuuggggggcggccgccgcggaaccggggcccaaggcgagacccucggggagaaguggaagaggcagcugaaccagcuguccaagucagaguucaacaccuacaagcgcagugggaucauggagguggaccggucugaggcgaaggaggggcucaagagaggggagacgaccaaacacgccgugagccggggcaccgcgaagcugcgcugguucgucgagcggaaccuggugaaacccgaagggaaggugauagaccuuggcugcggccgggguggcuggagcuauuauugcgccggucuuaagaagguaaccgaagugaaaggcuacacgaagggcggacccggccacgaggaacccaucccuauggccacauacggauggaaccugguaaagcugcacuccggcaaagacguguucuucaucccgcccgagaagugcgacacgcuccugugcgauaucggggagagcucucccaauccgaccaucgaggaaggccggacgcugcgaguccucaagaugguggagcccuggcugcgaggaaaccaguucugcaucaaaauucugaaccccuacaugccaagcgucguggagacccucgagcagaugcagcgcaaacacggcggcaugcuuguacggaauccccugucacggaauagcacucacgagauguauuggguguccugugggaccggaaauaucguaagcgccgugaauaugacgucccggaugcucuuaaacagauucacgauggcccacagaaagccgaccuacgagcgggaugucgaccugggcgccggcacuagacacguggcuguggagccggaggucgccaacuuggauaucaucggccagcggauagagaacaucaagcacgaacacaagagcaccuggcacuacgacgaagauaaccccuacaagacgugggcauaccacggguccuacgaggugaaaccgagugguuccgccagcagcauggucaacgggguaguuaagcugcugaccaagcccugggacgugauccccauggugacccagaucgccaugaccgauacgacaccguucggccagcaacggguguucaaggagaaagucgacaccaggacuccuaaggccaagcgagggacgacacagauuauggaagugaccgcccgcuggcucuggggcuuccugucccgaaacaagaagccccggaucugcacccgcgaggaguuuacgcggaagguccggagcaacgcggccaucggcgccgucuucguggacgagaaccaauggaacagcgccaaggaggcgguggaggaugagcgauucugggaccuggugcaccgcgagcgggagcuccacaagcaggggaagugugcgaccugcguguacaacaugaugggcaaacgcgagaagaaacugggggaguucggcaaggccaaggggagccgggccaucugguacauguggcuuggcgcgcgguuccucgaguucgaggcgcugggcuucaugaaugaggaucacugguucucccgggaaaacagccuguccgggguggagggcgaggggcuccacaagcugggguacauccugagggacaucagcaagaucccugggggaaauauguaugcggacgacaccgccggcugggacacccggaucacggaggacgaccuccagaacgaggccaaaaucaccgauaucauggaaccugagcacgcccugcuggcgaaggcuaucuucaagcucaccuaccagaacaaaguggugcgcgugcaacgccccgcuaagaacgggaccguaauggacgugauaucccgucgcgaccagcggggcagcggccagguggggacguacggccugaacaccuucaccaacauggaggcccagcuuauacgacagauggagucggaaggcaucuuuucucccuccgagcucgagacccccaaccuggcagagcggguucuggacuggcucgagaaauacgguguugagcgccugaaacggauggcgaucagcggggacgacugcguggucaaaccaauugacgaccgcuucgccacggcccugaccgccuugaacgacaugggcaaggugcggaaagacauuccucagugggagcccucaaagggguggaacgacuggcagcaaguucccuuuugcagccaccauuuccaccagcuaauaaugaaggacggccgcgaaaucgucgugccuugccggaaucaggacgaguuggugggacgcgcccgggucucccagggggccggcuggagccuccgcgaaaccgccugccucggcaagaguuacgcccagauguggcaguuaauguacuuucaccggcgagaucuccggcuggccgcgaacgccaucugcuccgcagugccuguggauuggguucccaccagucgcacgaccugguccauccacgcccaucaucaauggaugaccaccgaagacaugcugagcguauggaaccgcguguggaucgaagagaaccccuggauggaggacaagacgcacaucuccuccugggaggacguuccguacuugggcaagagggaggaccaguggugcggguccuugaucggacugaccgcccgcgccaccugggcaacaaauauccagguggcuauuaaucaggugcggcgccucaucggcaacgagaacuaccuggauuacaugaccaguaugaaacgguucaaaaaugaguccgaccccgagggagcccuuugguga

SEQ ID NO: 24689 - RNA, 9879 nt, Artificial Sequence
  derived and/or modified CDS sequence (opt11) from DENV-1__KC762620__SS-prME
ucggucaccaugcuguuuaugcuccugcccacugcccuggcguuccaccucaccacacgcggcggggagccccauaugaucguguccaaacaggagcggggcaagagcuuguuauuuaagaccuccgccggggugaacauguguacccucauugccauggacuugggcgagcugugugaggacacgaugaccuacaagugcccccgcauaacagagaccgagcccgaugacguggacugcuggugcaacgccacggagacgugggucaccuacgguacgugcagccaaacgggggagcaccggcgcgacaaacgguccguggcucucgcgccccacgugggccuggggcuagagacccgcacggagaccuggaugagcucggagggggccuggaagcagauccagaagguggagacgugggcccuacggcaucccggguucaccgugauagcccuguuccuggcccacgcgaucggcacaucgaucacccagaaggguaucaucuucauccuacugaugcugguaacgcccuccauggccaugcggugcguaggaaucggaaaucgggacuuuguagaagggcugagcggcgcuaccuggguggacguuguauuagagcacggguccugcgugaccaccauggccaaggacaaacccacccucgacaucgagcuccugaagaccgaggucaccaaccccgcaguacugcguaaacugugcaucgaagcuaagaucucaaacacgacgaccgacucccguuguccgacgcagggcgaggcuacacugguggaagagcaggacacgaauuucgugugccgccggacguuuguggaucgcggcugggggaacggcugcgggcuguucggcaaggggagucucaucacgugcgcuaaguucaagugcguaacuaagcuggagggcaagaucguccaguacgaaaaccucaaguacuccgucauagugacgguccauaccggcgaucagcaccagguggggaacgagaccaucgagcacggcaccaccgccaccaucacgccccaggcccccaccagcgagauccagcucaccgacuacggugcgcugacccuggacugcagcccacggaccggccucgacuucaacgagaugguccugcugaccaugaaggagaaguccuggcucgugcacaagcagugguucuuagaccucccgcucccauggaccuccggggccucgacgagccaggagaccuggaacagacaggaccuccuugugaccuucaagacggcccaugcaaagaagcaagaggucguggugcucggaucccaggagggugccaugcacacagcccugacgggggcgaccgaaauccagacgagcggcacgaccacaauuuucgccgggcaccugaagugccggcuuaagauggauaaacugacacugaagggcgucaguuacguaaugugcacugggagcuuuaaacucgagaaggagguggcggagacacagcacggcacaguacugguccaggugaaauacgaggggaccgacgcacccugcaagauccccuucuccagccaagacgaacgcggcguuauucagaacggccggcugaucacggcgaacccgaucguaaccgacaaagagaagcccgugaauaucgaggcggaaccgcccuucggugagaguuacaucgucgugggagcaggcgagaaggcccuaaagcucucaugguuuaagaaggggucgaguaucggaaaaauguucgaggcgacggcccgcggggccagacggauggccauccugggcgacaccgcuugggacuucggguccaucggcggcguuuucacuuccgucgggaaguuggugcaucagauuuuuggcacugcguacggagugcuguucaguggcgucucuuggaccaugaagaucgggaucggcauacugcugacauggcucggccuaaacucccgaaacacgagccuuucaaugacuugcaucgcuguggggauggugacccuguaccugggcgucauggugcaagcagauagcggaugugugaucaacuggaagggccgggagcugaagugcggguccggcauuuucgucaccaacgaggugcacacauggaccgagcaguacaaguuucaggcugacagccccaagcgccucagugccgcgaucggcaaggcuugggaggaggggguaugcgguauccgguccgccaccagacuggagaacauuauguggaagcagaucagcaaugaacugaaccacauccuccuggagaacgacaugaaguucaccgugguggugggggacgucuccggcauccuggcccaaggaaagaagaugauccggccccagcccauggagcauaaguacagcuggaaguccuggggcaaggcaaagaucauuggagcggacgugcaaaacaccacguucaucaucgacgggccgaacaccccggagugccccgacaaucagcgagccuggaauaucugggaaguggaggacuauggguuuggggucuucacaacaaacauuuggcucaagcugcgagacaguuauacucagguuugcgaccaccgauuaaugucagccgccaucaaggauagcaaagcggugcacgccgacaugggcuauuggaucgaguccgagaagaacgagacuuggaagcucgaacgggccagcuucauugaggucaaaaccugcaucuggcccagaucgcauacccuguggagcaacggugugcuggaguccgagaugaucauucccaagacguacgggggcccggucagccagcacaacuaccgcccggguuacuucacccagaccgcuggcccuuggcaccuggggaagcuagagcuggauuucgaccucugcgagggcaccacggucgugguggacgagaacugcgggaaccgcgggccguccuugcguaccacgaccguaaccggcaagauaauccacgaguggugcugccgcagcugcacucugccucccuugcgguucaagggugaagauggcuguugguacgggauggagauccgccccgucaaggagaaggaggagaaccucgugaaauccauggucagugccgggucgggagagguggacuccuuuagucugggacuucugugcaucaguauuaugauugaagaggugaugcggagccgcugguccggcaaaaugcugaugaccgggacccucgcgguuuuccugcugcucacaaugggccagcugaccuggaacgaccugauccgacuaugcaucauggucggggccaacgccagugacaugaugggcaugggaaccaccuaccuggcccugauggccacguuucguaugaggccaauguucgcggucgggcuucuguuccggcgccugaccucccgggaggugcuauuacugacggugggucuaagccuggccgcgucugucgagcugccaaacagccucgaggagcugggggacggccuggcaaugggcaucaugaugcucaagcugcuaacggacuuccagucccaccagcucugggccacgcuccugagcuuaaccuuugugaagaccaccuucucucuucauuacgcguggaagacgauggcuaugauccuuagcauugugucccucuuuccccuuugcuugagcacuaccucccagaaaaccacauggcuccccguucugcuaggaucccucggcugcaagccacugaccaugcugcucauuaccgagaacaagaucugggggcgccguuccuggcccaucaacgagggcauaauggccauugggaucgucucgauccuccugagcucacuccugaagaacgacgugcccuuagcggggccacucaucgcuggcgggaugcugauugccugcuaugugaucucuggcagcagcgcggaccuguccuuagagaaagccgccgaggugagcugggaagacgaggcggagcacuccggagccagccacaacauucugguggagguccaggaugacggcaccaugaagauuaaagacgaggagcgcgacgacacacugacgauuuuacucaaagccacccugcuugccaucuccgggguguacccgaugagcauccccgccacccuguucguuugguacuucuggcagaaaaagaagcaacgguccggcgucuuaugggauacacccagcccacccgagguggagcgcgcgguacuugacgaugguauauaccggauccuacagcggggguugcugggcagaucccaggucgguguaggcguguuccaggaggggguuuuucauacgauguggcacgugaccaggggcgccgugcucauguaccagggcaagcggcuggaacccucaugggccuccgucaaaaaggacuuaaucagcuacggaggugguuggcgcuuccaaggcuccuggaacacaggggaggagguccagguuauagccgucgagccuggcaaaaauccgaaaaauguccagaccacgcccgggaccuucaagaccagcgagggggaagugggggccaucgcgcuggacuucaaacccgggacgagcggcagcccuaucguuaaccgggagggcaaaauugugggguuauacggcaacggggucgucacgacaagcggcacguacguauccgcuaucgcccaggccaaagcaucucaggagggccccuugccggagaucgaagacgagguguuuagaaagaggaacuugacuaucauggacuugcacccggggucuggaaagacacgccgguauuuacccgcgauccuaagggaggccaucaaacggaaacuucgcacccugguccucgccccgacucgcgucguggccagcgagauggcggaggcacucaaagggaugccuaucagauaccagacaacggcugucaaauccgaacauaccgggaaggagauaguggaucugaugugccacgccaccuuuacgaugcgcuuguuaucccccgugcgggucccuaacuacaacaugaucaucauggacgaggcccacuucacagacccagcgagcaucgccgcccgcggguacaucagcacgcgggugggaaugggggaagccgccgcgaucuuuaugaccgccacgccaccaggcuccguugaggccuucccccagagcaacgcaguuauccaggacgaagaacgcgauauccccgagcgguccuggaacagcggcuaugacuggauaacggacuuccccgggaaaacggugugguuuguacccuccaucaaaagugggaacgacaucgcgaauugccugaggaaaaacgggaagaggguagugcaguuaucccgcaagaccuuugacacggaguaccagaagacgaagaauaacgacugggacuacguggugaccaccgacaucuccgagaugggagccaacuuucgggcagaccgcguuaucgacccccggagaugccugaagcccgucauacugaaggacggacccgagagggugauccucgccggucccaugcccguaacagucgccuccgcagcccagcggcggggccgcaucggucggaacagcaacaaggagggggaccaguacguguacauggggcaacccuuaaacaaugacgaagaucacgcccacuggacggaggccaagaugcugcucgacaauaucaacacaccagaggggaucaucccugcccuguuugagcccgagagggaaaagucagcggccaucgacggggaguaccggcugaggggcgaagcucgaaagacuuucguggaguuaaugcggcgcggcgaccuuccggucuggcugagcuacaagguggcuagcgaggguuuccaguacuccgaucggagguggugcuucgauggcgagcgcaauaaucaaguccucgaagagaauauggauguagagaucuggaccaaggagggggagcgcaaaaaacugcggcccagguggcuggacgcucggacguacagcgacccccucgcucuccgcgaguucaaagaguucgcggccgggcggcgcuccguuagcggagaccugauccucgagauaggaaaacugccccagcaccugacacagaaagcccagaacgcccucgacaaccuggugauguugcacaacuccgagcaaggcgggaaggcguaccggcacgcgauggaggagcuccccgacaccaucgaaacccugaugcugcucgccuuaaucgcaguccugacaggagguguuacccucuucuucuugagcggccgcggcuugggaaagaccuccaucggcuuacuguguguuauggcgucuuccgcucugcucuggauggcuagcguugaaccccacuggauagccgccuccauuauccuggaguucuuccugauggugcucuuaauccccgagccagaccggcagcgcacuccccaggacaaucagcuggcuuauguggucaucggguuacuguucaugaucuugacgguugccgccaaugaaaugggccugcucgagacgaccaagaaggaucuggggaucggacacgccgcggcagagaaccaccaccacgccgccaugcucgacguugaccugcacccggccagcgccuggacucuguacgcuguggccaccacgauuauaacgcccaugaugcgucacaccaucgaaaauaccacggccaacaucucgcucacagccauagccaaucaagcggcaauacugaugggccuagauaagggguggcccaucagcaagauggacaucggcgucccacuccuggcccugggcugcuacucccaagugaacccccucaccuugacagcugcgguucugauguugguggcccacuacgccaucauugggcccgggcuacaggcuaaggcaacgcgcgaagcacagaagcggaccgccgccggaauuaugaagaauccgacuguggacggcaucguagcaauagaccuggacccgguuguauacgacgccaaguucgagaaacagcucgggcaaauuaugcugcugauccucugcaccagccagaucuuacugaugcgcacgaccugggcacucugcgaauccaucacccuggccaccggcccccugacaacacucugggaggggagccccggcaaguucuggaacaccacgaucgcgguauccauggccaacauuuuucgcgggagcuaccucgcuggggcgggcuuagccuucagccucaugaaaucccucgguggcgggcggcgcgggaccggcgcgcagggggagacccugggcgagaaguggaagcggcagcucaaccagcuuaguaagagugaguuuaacaucuacaagcgcucggggaucauggaggucgaccgguccgaggccaaagagggccugaaacgcggggagaccacaaagcacgcggugagccgcggcacggcaaagcuccgcugguucguugagcggaaccuggugaagccggaagggaaagugauugaccugggaugcgggcgcggagguugguccuacuacugugccggguuaaagaaagugacugaggugaagggauacaccaagggagggcccggccacgaagagccagugccgauggccacauacggguggaaccuugucaaacugcacuccggcaaggacguauucuucacaccacccgagaaaugcgacacuuuacucugugacaucggggaauccagccccaaccccaccauugaagagggccgaacucugcgugugcugaagaugguggagccguggcuccgcggcaaccaguucugcaucaagauccugaaccccuauaugcccuccgugguggagacccuagagcagaugcagcgcaaacauggcggcaugcucguccgcaacccccugagccgaaacuccacacacgagauguacugggugucaugugguacagguaacaucgucucagccgucaacaugaccagccggaugcuauuaaaccgauucaccauggcacacagaaagccaacguacgagaaggauguggaccugggcgccgggacccgccacguggccgucgagccggagguggcaaaccuggacaucaucgggcagcgcauugaaaacauaaaaaacgaacauaagucgaccuggcacuacgacgaagacaauccauacaagaccugggccuaucacgggagcuacgaggucaagccguccggcucggcgucuagcauggugaauggagugguccgacuucugaccaaaccaugggauguaaucccuaugguuacccagaucgccaugacagacaccacgcccuucgggcagcagcgugucuucaaagagaagguagacacccggacccccaaggcuaagcgcggcaccgcccagauaauggaagugacggcaaaguggcuguggggguuucuuagccggaauaagaagccgcgcauaugcacgcgggaagaguucacccgcaagguccgguccaacgcggccaucggcgccguguucguagaugaaaaccaguggaauuccgcuaaggaggcggucgaggacgaacgcuucugggacuugguacaccgggaacgugaauugcacaagcaagggaagugcgccacgugcguguacaacaugauggggaagcgggagaagaaguugggugaguucgguaaggccaaggguucccgcgccauuugguacauguggcugggggccagauuccucgaguucgaggcgcugggcuucaugaaugaggaccauugguucagcagggagaacuccuugucaggggucgaaggcgaaggguuacauaagcucgguuacauacugcgggauaucuccaagauccccggcgggaaccuguaugccgacgacacugccggcugggauacgcguaucaccgaagacgaccuccagaacgaagccaagauaaccgauaucauggagccagagcacgcccuauuggcgacgagcaucuucaagcuuaccuaucagaacaagguggugcggguccaacggccggccaagaacgguacggugauggacgugauaucccggcgcgaccagcgcggcagcggccaggucgggaccuacgggcugaacacguuuacaaacauggaagcccagcugauccggcagauggagagugaaggaaucuuuagccccagcgaacucgagacucccaaucuggccaagcgugugcucgacugguuagagaagcaugguaucgagcgacuaaaacggauggcgauaucaggggaugacugcguggucaagcccauugacgacagguucgcgacggcguugaccgccuuaaaugauaugggcaaggugcguaaagacaucccgcagugggagccuagcaaaggcuggaacgacuggcagcagguccccuucugcucucaccacuuccaccagcuuauuaugaaggacgggcgggagaucguuguaccgugcagaaaccaggacgaguugaucggccgagcccgcgugagccagggggccggcuggucccuccgagaaacggccugccugggcaagucauaugcucagauguggcaacugauguauuuccaccgccgggaccuacgacuagccgccaaugcgaucugcucagccgugccgguugacuggguccccaccucucggaccacgugguccauccacgcccaucaccaguggaugaccaccgaagacaugcugucggucuggaaucguguguggauugaggaaaaccccuggauggaagacaaaacccacguguccuccugggaggacguucccuaccucgggaaaagagaagaccaguggugcggcucacugauagggcugaccgcucgcgccacgugggcaagcaacauucagguggccauaaaccaggugcggcgccuuauuggcaacgagaacuacuuagauuauaugacuucuaugaagcgcuucaagaaugagucugacccugaaggggcccugugguga

SEQ ID NO: 24690 - RNA, 9879 nt, Artificial Sequence
  derived and/or modified CDS sequence (opt11) from DENV-1__KC762631__SS-prME
agcgugaccaugcuccuaaugcugaugcccacagcccuugccuuccacuuaacaacccggggcggggagccacacaugaccguuagcaagcaagaacgggguaagagcuugcuguuuaagacguccgccggggucaauaugugcaccuuaauugccauggaucugggcgagcugugcgaagacacccucaccuacaaguguccccgcaucaccgaggccgagcccgacgacguggacugcugguguaaugcuacagacaccugggugaccuacgguaccugcagccagaccggcgagcaccgccgugacaaacgcuccguggcccuggcgccccauguggggcuagggcucgagacccgcaccgagacguggaugagcuccgagggcgccuggaagcaaauccaacggguggagacgugggcuuuacgccaccccggguuuaccgugaucgcccuauuccucgcgcacgccaucgguaccagcaucacccaaaaggggaucaucuucauccugcugaugcuggugacacccuccauggccaugcggugcgucggcauuggaucgcgcgacuucguugaagggcuguccggagccaccuggguggaugucgugcuggagcacgguagcugcgugaccaccauggcuaaggacaagccuacgcucgacaucgagcugcugaagaccgaggucaccaaccccgcggugcuccggaagcugugcaucgaggcgaagaucuccaacaccacgaccgacagccgcugcccgacccagggcgaggcuacacuggucgaggagcaggacgcuaacuucgucugccggcgcacguucguggaccguggcuggggaaacgguuguggucuguucggcaaggggucccucaucacgugcgccaaguucaagugcgugacaaagcuggagggcaagauuguccaguacgaaaaucugaaauacagcgugaucgugaccguccacacgggcgaucagcaccagguggggaacgaguccaccgagcaugggaccacugcgaccauuacgccccaggcuccaaccacagagauccaacugaccgacuacggggcccuuacgcucgacugcagcccccgcaccggccuggacuucaacgagaugguccugcucaccaugaaggagaaguccuggcuggugcacaagcagugguuucuagaccucccccugccuuggaccagcggggccagcacgucccaggaaaccuggaaccgucaggaccugcuaguaacguucaagaccgcccacgcgaagaagcaagaggucguggugcugggcucucaggagggcgccaugcacacggcccugaccggggccacugagauacagaccagcggcaccacaacgaucuucgcugggcaccuaaagugccgccugaaaauggauaagcugacccuuaagggcaugucguacgucaugugcacgggcuccuucaagcuggagaaagagguugcagagacccagcacggcacagugcugguccagauuaaguacgagggcaccgacgcgcccuguaagauacccuucucuacgcaggacgagaagggggugacucagaacggcagacuuaucacugcuaacccaaucguaaccgacaaagagaagccagucaauaucgaggccgagccacccuucggggaguccuacauagugaucggcgcgggcgagaaagcccucaagcugagcugguucaaaaaggggaguagcaucggcaagauguucgaggccacggcccgcggugcccggcggauggcgauccugggcgauaccgccugggauuucggaucgaucgguggcguuuuuaccagcguagggaaguugguucaccagaucuucggcacugccuauggggugcuguucuccggcgucagcuggacaaugaagaucgggaucggagugcugcucaccuggcugggccugaacucccgcucgaccucccucagcaugaccugcaucgccgugggucuggugacgcuguaccucggcgugauggugcaggccgauuccgggugcgucaucaacuggaaggggcgggaacugaagugcgggagcggcaucuucgugaccaacgaggugcacaccuggacugagcaguauaaguuccaggcggacagcccgaagagauuaucugccgccaucggcaaggcaugggaggagggggucuguggcauucggagcgccacccgccucgaaaauaucauguggaagcagaucucgaacgagcuaaaccacauccugcucgagaacgauaugaaguucacggugguggucggggacguugcggguauccuggcucaagguaagaagaugauccggccccagcccauggaacacaaguacagcuggaagaguugggggaaagccaagaucauaggggccgacgugcagaacaccacauucaucaucgacgggcccaauaccccggagugcccggacgaccagcgcgcguggaacaucugggaggucgaggacuacggcuucggcaucuucacgaccaacaucuggcugaaauugcgggacagcuacacccaggugugcgaccaccgccugauguccgccgccaucaaggacucuaaggccguccacgccgacaugggcuacuggaucgaguccgagaagaacgaaaccuggaagcuggcgcgggccagcuucaucgaggucaaaaccuguaucuggccuaagucccacacccucuggagcaauggcgugcuggagagugagaugaucauuccuaagaucuacgguggcccgaucagccagcacaacuaccgccccggguauuucacgcagacggccggccccuggcaucucgggaaguuagagcuggacuucgaccugugcgagggcacgaccguggucguggacgagcauugcggaaaucgugggccgucccuccgcaccaccacgguuaccgguaagaucauacacgaguggugcugccguaguugcacccugccgccccugcgcuuccgcggcgaggacggaugcugguacgggauggagauccgcccagucaaggagaaagaagagaaccucgugaaguccauggugucugcgggcagcggcgagguagacuccuucagccuggggcugcucugcauaaguaucaugaucgaggaggucaugcggagucggugguccagaaagaugcugaugaccggcacgcuggccguguucuuccucuugaucaugggccagcugacuuggaacgaccucauccgccugugcaucauggucggcgcgaacgccagcgaccgcauggggaugggcacgacuuacuuggcucucauggccacuuucaagaugcguccgauguucgccgugggucuucuuuuccgccggcuuaccucccgcgagguauugcugcucacgaucgggcuuucucugguggcuucaguggagcucccaaacagccuagaggagcugggcgacgggcucgccaugggcaucaugaucuuaaagcugcucaccgacuuccaaucccaccagcugugggccacgcugcucagccugaccuucaucaagaccaccuucucccuccacuacgccuggaagacgauggcgaugguccucagcaucgucucacuguuuccccugugccuaagcaccaccucccagaagaccaccuggcuacccguacuccuuggcagccuggggugcaagccgcuuaccauguucuuaaucgccgagaacaaaaucuggggccggaaguccuggccccugaaugaagggauuauggccgucggcaucgugagcauccuguugagcucccuccugaaaaacgaugugccccuagccgggccucugaucgccggcggcaugcuaaucgcauguuacgucaucagcggauccagcgcggaccucucccucgagaaggcugccgaggugagcugggaggaggaggccgagcacuccggcgcgagccacaacauccugguggagguacaggacgacgggaccaugaagaucaaggacgaggaacgcgacgacacccucacgauucuguugaaggccacucuccuggccguguccgggguguacccgcugagcauaccggccacccucuucguaugguacuuuuggcagaagaaaaagcaacgguccggugugcugugggacacccccucuccgcccgagguugagcgcgccgugcuggacgacggcaucuaccggaucaugcagcgcgggcugcucggacggucccaggugggcgugggggucuuccaggagaaccuguuucacaccauguggcacgugacgcgcggagcggugcugauguaccaagggaagcggcucgagcccucgugggccuccgucaagaaggaccugaucucauacggcggaggguggcgccugcagggcuccuggaacacuggggaggagguccaggugaucgcggucgagccuggcaagaaccccaagaacgugcagaccgcccccgggaccuucaaaacgcccgagggcgaggugggcgccauugcgcucgacuuuaagcccgggacaagcggcucucccaucgucaaucgggaggggaagaucgugggccuguacggcaacgggguggucaccaccagcggcacguacgugucggccaucgcgcaggcaaaggcgucccaggaggguccguuacccgagaucgaagacgagguguuccgcaaacguaaccucaccauaauggaccugcacccaggcagcgggaagacccgccgguaucugccggccaucguccgcgaggccaucaagcggaagcuccguacccugauccuggcccccacgcgaguuguggccagugagauggcggaggcccucaagggcaugccuauccgguaccagaccaccgccgucaaaucggagcacaccgggaaagagaucguggaccugaugugucacgccacguucacaaugcgccugcuaucccccguucgggucccgaacuauaacaugauaaucauggacgaggcccacuucaccgaccccucuuccaucgcggcccgcggguacaucaguacccgugugggcaugggagaggccgccgcgauuuucaugacggcaacgccccccgguucuguugaggccuucccgcaaagcaacgccgucauccaggacgaggagcgcgacauccccgagcguucguggaaucuggguuacgaguggaucaccgacuuccccggcaagaccgugugguucguccccucgaucaagagcggcaacgacaucgccaacugccugcgcaagaacgggaagcgcgucauccaacucagccgcaagaccuuugacaccgaauaccagaagaccaagaacaacgacugggauuacguggugacaacagacauuuccgagaugggcgccaacuuccgagccgaccgcgucauugacccacggcgaugccugaagcccgugauccuuaaggacgggcccgagcgggugauccucgccggccccaugccagucaccguggccucagccgcgcaaagacgggggcgcgucggccggaaccacaacaaggagggcgaccaauacaucuacauggggcagccccugaacaacgacgaggaccacgcccacuggaccgaagcaaaaaugcugcucgauaacaucaacaccccggagggcauuauacccgcccuguucgagccggagcgcgagaaguccgccgcgaucgacggggaguaccgccugcggggcgaagcccgcaagacguucguggaacucaugcggcgcggggaccugccaguguggcugagcuacaaggucgccuccgagggcuuccaguacucagaccggcgcuggugcuuugacggcgagcggaauaaccaggugcucgaagaaaacauggacguggagaucuggaccaaggagggugagcgcaagaagcugcggccccgcuggcucgacgcccguacguacagcgauccccuggccuugcgcgaguucaaagaguucgcggcgggccggcgcucagucagcggggacuugauccuugaaauuggcaagcugccgcagcaucuuacccagcgggcccagaacgcccuugacaaccuggugaugcugcacaacuccgagcagggcgggcgcgcguauagacacgccauggaggagcuccccgagacgauagaaacacugaugcugcucgcccugaucgccguacugacaggcgggguaacccucuucuuccugagcggccgcgggcugggcaaaaccuccauuggccuccugugcgugauggccagcuccgugcuccucuggauggcgucuguagagccacacuggaucgccgccuccauaauccuggaguucuuccugaugguccuccuuauccccgagccggaccggcaacgcacgccccaggacaaccagcuggccuacgugguuaucgggcuccuguuuaugauccugacaguggccgcgaacgaaauggggcuccuggagaccaccaagaaggaccucgggaucggccacguggccgucgagaaccaucaccacgccgccaugcucgacgucgaccugcaucccgccagcgcguggacgcuguacgccguagccaccaccaucauaacaccgaugaugcggcauacgauagagaacaccacugccaauaucucccucacugccaucgcuaaccaagccgccauccuaauggggcuugacaagggguggccgauuagcaaaauggacauaggcgucccacugcuggccuugggguguuacucccaggugaauccccucacgcugacggccgccgugcugauguuggucgcucacuacgccaucaucggcccuggguugcaagccaaggcgacccgcgaggcucagaagcgcaccgcugccggcaucaugaagaaccccacgguagaugggauaguggccaucgaccuggaccccgucgucuacgacgcgaaguuugagaagcagcucggccaaaucaugcugcugauccuguguaccagccagauccugcugaugcggacaaccugggcccuaugugaguccauaacgcuggccaccggcccccugaccacucucugggaggggaguccuggcaaguucuggaacacgaccaucgccguguccauggccaauaucuucagggggagcuacuuagcgggcgcuggccuggccuucucccucaugaagucccuagggggcgggcggcgcgggaccggggcccagggggaaacccugggcgagaaguggaagcggcagcucaaucagcugagcaaguccgaguucaacacguacaagcgcagcgggaucauggaggucgaccgguccgaggcuaaggaaggucugaaacgcggcgagaccacaaaacacgccgugucgcggggcacagccaagcuccgcugguuuguggagcggaaccucgucaagcccgaagggaaagugaucgaccugggcuguggccgcggggggugguccuacuauugugccggacugaagaaggucacggaggucaaaggcuacaccaagggaggucccggccaugaggagcccaucccaauggccaccuauggguggaaccucgugaaacugcacagcggcaaagacguguucuucaucccuccggagaaaugcgauaccuugcucugugacaucggagaauccagccccaacccgacgauagaggagggccgaacgcugcggguccugaagaugguggagcccuggcuccgggggaaccaauucugcauaaagauacugaacccauacaugcccuccguaguugagacccuggagcagaugcagcgcaagcacggcgggaugcucgugcggaacccgcugagcaggaacaguacccaugaaauguauugggugaguugcgggaccggcaacaucgucuccgcggugaacaugacgagccggaugcugcuaaaccgcuucaccauggcccaccgcaagccuaccuacgagcgggacguggaccugggugcaggcacccgccacgucgccguggagcccgaaguggccaaccuggacauuaucggccagcggaucgaaaacaucaaacacgagcacaaguccacguggcauuacgacgaggacaaccccuacaagaccugggcguaccacggguccuaugaggucaaaccuuccggcagcgcuuccagcauggugaauggcgucguuaagcuccugacgaaacccugggacgugauucccauggucacccagauugccaugacugacacuacccccuucggccagcagagaguguuuaaggagaagguagauacccggacgccgaaggccaagcgcgggaccacccaaaucauggaggucaccgcccgguggcuuuggggcuucuuaagccgcaauaagaaaccucggaucugcacgcgcgaggaguuuacgcggaagguucgcagcaacgccgcgauaggggcuguguucgucgacgaaaaccaguggaacagcgccaaggaggccguagaggacgagcgauucugggagcuggugcaccgugagcgggaguuacacaagcaagggaagugcgcgaccugcgucuacaacaugauggggaaacgcgagaaaaagcucggggaguuuggcaaggcuaaagggucgcgggcuaucugguacauguggcugggcgcccgcuuccuggaauucgaggcgcucggcuucaugaacgaggaccauugguucagcagagagaacuccuugucgggaguggagggcgaggggcugcacaagcucggcuacauccuccgcgacaucuccaagauccccgggggcaacauguacgccgaugacaccgccggcugggauacgcggaucaccgaggacgaucugcaaaacgaggccaaaaucacggacaucauggagccggaacacgcgcuccuggcgaaagcuaucuuuaagcugaccuaucagaacaaggugguacgugugcagcgccccgccaagaacgggacggugauggacgucaucagccggcgcgaccagcggggcucuggccaaguggggacuuacggccucaacacuuucaccaauauggaggcccagcugauccgccagauggaaagcgaggggaucuucucccccagcgagcuggagacucccaaccuugccgagcggguguuagacuggcuggagaaauacggugucgagcgccuuaagcggauggcgaucucaggggacgacugugugguaaagccgaucgacgaccgcuucgccaccgcccugaccgcccugaacgacaugggcaagguacggaaggacauuccgcaaugggagcccagcaagggguggaacgacuggcaacagguccccuucugcucccaucacuuccaccagcucaucaugaaggacggccgcgagaucgugguccccugccggaaccaggacgaguuggugggccgcgcacgggugagccagggggcgggauggagccugcgcgagaccgccugcuugggcaagagcuaugcacaaauguggcaauugauguacuuccaccggcgcgaccugcgccucgccgccaacgccaucugcagcgccgugccuguagacugggugccgacgucccguaccaccuggagcauucacgcccaccaccaguggaugacaacugaggacauguuauccgucuggaaccggguguggauugaggagaaccccuggauggaggauaagacccacaucaguuccugggaggacgugccuuaccugggcaagcgcgaggaccaguggugcgggagccucaucggccugacugcccgcgcgacaugggccacaaacauucagguagccaucaaucaagugcggagguuaaucggcaaugagaacuaucucgacuacaugacguccaugaagcgguucaagaaugagucugaccccgaaggggcccugugguaa

SEQ ID NO: 24691 - RNA, 9879 nt, Artificial Sequence
  derived and/or modified CDS sequence (opt11) from DENV-1__KC762621__SS-prME
agcgugaccaugcugcuuauguugaugcccacugcccuggccuuccaccucaccacccgcggcggggagccccauaugaucguguccaagcaggagcgcggcaagagccugcuguucaagaccagcgccggggucaacauguguacgcuuauagcaauggaucugggcgagcugugcgaagauacgcucaccuacaaaugcccacgaauaacugaagccgagccagacgauguagauuguuggugcaaugccaccgacaccugggucaccuauggaaccugcucucagaccggcgagcaccggcgcgacaagcgguccguugcgcuggcuccucacgugggccugggucucgaaacgcguaccgagacguggaugagcagcgagggcgcauggaagcagauccagcgggucgagacaugggcacugcgccaccccggguucacggugaucgcccucuuucucgcccacgccaucgguaccagcaucacccagaaggggaucaucuuuauccugcugaugcucgugacccccuccauggccaugaggugcgucggcauaggcagccgcgacuucguggagggucuguccggugcaacguggguagacgucgugcuggagcacgggucaugcguuacaaccauggcgaaggacaagcccacccucgacauagagcugcuaaagacggaggucaccaaccccgcugugcuccggaaacuguguauugaagccaagaucuccaauaccaccaccgacagccgcugcccaacccagggagaagccacguugguggaggagcaggaugccaacuucgucugccggcgcaccuuugucgaccgggguugggggaacggcugcgggcuguucggcaaggggucucugauaaccugcgccaaauuuaaaugcguuaccaagcuggagggaaagauuguccaguacgaaaacuugaaguacucugugaucgugacgguccacacgggcgaccagcaccagguggggaacgaguccaccgagcacggaaccaccgccaccauuacgccgcaggcccccacgaccgagauccaguugaccgacuacggcgcccuuacccucgauugcagcccccggacgggccuggauuucaacgagaugguccugcucacgaugaaggagaaguccuggcuggugcacaagcagugguuccuugaccucccccugccauggacgagcggggccagcaccucacaagagacauggaaccggcaagaccugcucgugaccuucaagaccgcccacgcgaagaagcaagaggucguggugcugggcagccaagaaggcgcaaugcacacggccuugacgggcgccaccgagauucagaccuccggcaccacuaccaucuucgcaggucaccucaagugucgcuuaaaaauggacaagcugacccucaaaggcaugagcuacgucaugugcaccgggaguuucaagcuggagaaggaggucgccgagacucagcauggcaccguucuaguccaaauaaaguaugagggcacugacgcgcccuguaagauccccuucucgacccaggaugagaagggggugacgcagaacggacgucuaaucaccgccaacccgaucgugaccgacaaggagaaacccgucaacaucgaggccgagccgccauucggggagagcuacauagugaucggcgcaggcgagaaagcccucaagcugagcugguucaagaaggguuccagcaucgguaaaauguuugaagccaccgcccgcggggccagacguauggcaauccuuggcgacacggcgugggacuucgggaguauaggcgguguguucaccagcgucgggaagcuugugcaccagaucuuuggcaccgcuuacggggugcuguucucaggcgucagcuggaccaugaagauagguauuggcgugcuacugacguggcuagggcugaauucccgcucuaccucacucuccaugacaugcaucgccguuggguuggucacccuguaucucggcgucauggugcaggccgacuccgggugcgucaucaacuggaaaggucgggaacuuaaaugcgggagcggcauuuuugugacgaacgaggugcauacauggaccgaacaauacaaguuucaggcggacagcccuaagcgccugucugcggccaucggcaaggccugggaggagggggucugcggcauccgaagcgcgacccgccucgaaaacaucauguggaagcagaucuccaacgagcugaaccacauccuccucgagaacgacaugaaguucaccgugguggucggggacguugcggggaucuuagcucaggggaagaaaaugaucagaccccagcccauggagcacaaguacagcuggaaguccuggggcaaggccaagauaaucggcgccgacgugcagaacacgaccuucaucaucgacgggccuaacacccccgagugccccgacgaccaacgcgcguggaacauaugggaggucgaggauuacggcuucgggaucuuuaccacgaauaucuggcuaaagcuccgagacucuuacacccaggugugcgaccaccgccugaugucugccgcgaucaaggacucaaaggccguacaugccgacaugggcuauuggaucgagagugagaagaacgagaccuggaagcuggcgcgggcgucauucauugagguaaagaccugcaucuggcccaagucgcacacgcucuggagcaauggcgucuuagaaucggagaugaucauccccaaaaucuacggaggcccgacuagucagcauaacuaccgccccggguacuucacccagaccgccggccccuggcaccuggguaaguuggaacuggacuucgaucugugcgagggcacgacugucgucguggacgaacacuguggcaaucggggaccaucccuccggacuacgacggugacaggaaaaauaauccacgagugguguugucggucgugcacccuuccacccuuacgcuuucggggugaagacggcugcugguaugggauggagauucgcccgguaaaggagaaggaggagaaucucgugaagucaauggugagcgccggcucgggcgaggucgacuccuucagccucgggcuacucugcaucuccaucaugaucgaggaggugaugcggagccgcuggucccggaagaugcugaugaccggcacgcuggcuguguucuuucuccugaucauggggcagcugaccuggaacgaccucaucagacugugcaucauggucggcgcaaaugcuagugaucgcaugggaaugggcacaaccuaccuggcccucauggccacguucaagaugcgacccauguucgcugugggccugcuguuccgccggcucaccucccgugagguguugcugcucacgaucgggcugagcuuagucgcgucgguggagcuccccaacucgcuggaagagcugggugacgggcucgccaugggaaucaugauccugaagcuacucacggacuuucagucccaccagcugugggcaacucugcucagccugaccuuuauuaagaccacguucucccuccacuacgccuggaagacaauggcaauggugcucagcaucguaucccuguucccucuaugccucagcaccacaucccagaagaccacguggcugcccguccuucugggcagccuggggugcaagccgcucacuauguuucucaucgcggagaacaaaauauggggucggaaaaguuggccgcuaaacgaggggaucauggcggucggaaucgugaguauccugcuaagcucccugcugaagaacgacgugccccucgcgggccccuuaaucgcuggcggcaugcugaucgccuguuacgucaucagcgggucguccgccgaucucucauuggagaaggccgccgaggugagcugggaggaagaggccgagcacuccggagcuagccacaacauccugguggagguccaggacgauggcaccaugaagauaaaggacgaggagcgcgacgauacccucacaauccugcugaaggccacgcuccuugccguguccgggguguacccgcugagcauccccgccacucuuuuuguaugguacuuuuggcagaagaagaagcaaagauccgggguacugugggauacacccagcccgcccgagguggagagggccguccuggacgauggcaucuacagaauuaugcagcgcggccugcuggggcggucgcaggucggcgugggggucuuccaggagaauguguuccacaccauguggcacgugacgagaggcgcgguccucauguaucaagggaagcggcuggagcccagcugggccucggugaagaaggaccucaucagcuacggcggcggguggcgccugcaaggguccuggaacacuggggaggagguucaagucaucgcgguggagcccggcaaaaaccccaagaaugugcagaccgcccccgguaccuucaagacgcccgagggcgaggucggcgccaucgcacuggacuuuaagcccgggaccaguggcucccccauagucaaccgggaggggaagaucguggguuuauacggcaacggggucguaacaacaagcggcacguacgugagcgccauugcccaggcgaaggcgucccaagaggggccgcugcccgagaucgaagacgaggucuuccgcaagcggaaucuuacgaucauggacuugcaucccggcagcgggaagacccgccgguaucugccagcuaucgugcgcgaggcuauaaagcggaagcugcgcacccucauccuggccccaacuagggucguggccucagagauggcggaggcccugaagggcaugccaauucgguaccagacuaccgccgucaagagcgagcauaccggcaaggagaucguggaccugaugugccacgccacguucacgaugcgccuguuaucccccguacggguaccgaauuauaacaugaucauuauggaugaagcccacuucaccgaucccagcuccaucgcggcccgcggguacauaagcacccgggugggcaugggggaggccgccgccaucuucaugacggccacgccgcccggcuccgucgaagccuucccgcagagcaacgccgucauucaggaugaggaacgcgauauccccgagcguaguuggaacagcggauacgaguggaucaccgacuuccccggcaagaccgugugguucguccccuccauaaaguccgggaacgacauagccaacugccuccgcaaaaacgguaagcgggugauccagcuuucccgcaagacguucgauaccgaguaccagaagacuaaaaacaacgauugggacuacguggucaccacagacaucagcgagaugggcgcgaacuuccgggccgaccgcgugaucgacccgcguaggugccugaagcccgucauccucaaggacggacccgaacgaguuauccuagccggcccgaugccggugacggucgccuccgccgcgcagagacgcgggcgaguuggccggaaccacaacaaagagggcgaccaauacaucuauaugggccagccccucaacaacgacgaggaccacgcccacuggaccgaggcuaagaugcuccuggacaacaucaauaccccagaaggcaucauccccgcccuguucgagccggaacgcgagaaguccgcggcgaucgacggggaguaccggcuccggggcgaggcccgcaagacuuucguggaacugaugcgacgcggggaccuaccugucuggcuuuccuacaaggucgccagcgagggcuuccaguacagcgacagacgcuggugcuuugacggcgagcggaacaaccagguucuggaggagaacauggacguugagaucuggaccaaggagggggagcgcaaaaagcugagaccccgcuggcucgacgcacggacguauuccgacccccuggcgcuaagggaguuuaaggaguucgcugccgggcggcggucaguguccggggacuuaauccuggaaauuggcaagcugccgcagcacuugacccaacgggcacaaaacgcccuggacaacuuagugaugcuccacaacuccgagcagggcggccgcgcguaucggcacgccauggaagaguuacccgacacgaucgagacccucaugcuccuggcacuaaucgccguacucaccggcggggugacccuguucuuccugucaggccgcgggcucgguaagaccagcauaggccugcugugcgugauggccuccagcguccuccuauggauggcgucaguggaaccccacuggauugccgccagcaucaucuuagaauucuuccugauggugcugcuaauccccgagccggaccggcagcgcacgccccaggauaaucagcucgccuacgucgugaucgggcugcucuucaugauucucaccguggcggcgaaugaaaugggccuguuagagacuaccaagaaggaucucgggauaggcuacgucgcuguggaaaaccaccaccacgccgccaugcuggacguggaccuccaccccgccuccgcguggacacucuaugccguugccaccaccaucauaacuccgaugaugcggcacacgaucgagaacacuacugccaacaucagucucaccgcuauagcgaaccaggccgcgauucuaauggggcucgacaagggcuggccgaucuccaagauggacaucggcgugccuuugcuggccuuggggugcuacucccaggugaacccccugacucugacagcugcgguccucaugcugguagcccacuaugcuaucaucggcccggggcuccaggccaaggcgacccgugaagcccaaaagcgcacugcagccggcaucaugaagaaccccacuguagaugggauagucgccaucgaccucgacccagucguguacgaugcaaaguucgagaagcagcugggccagaucaugcucuugauccugugcaccagucagauucuguuaaugcggaccacgugggcccugugcgaguccaucacgcucgcuacuggcccgcucaccacccugugggagggguccccgggcaaauucuggaacacgaccaucgccgucagcauggccaacaucuuucgcggguccuacuuggcgggagccggccucgccuucagccugaugaagucccucgggggcgggcggcgcgggaccggggcgcagggcgagaccuugggcgagaaauggaagcggcagcugaaccagcuguccaagagcgaguuuaacacguacaagcgcuccggcaucauggagguggaccggagugaggcaaaggagggcuugaagcgcggugagaccacaaaacaugcugugucuagaggcacggccaagcuucgcugguucgucgaacgcaacuugguaaagccggaggggaaagugaucgaccugggaugcggccgcgggggguggagcuacuacugcgccggccucaagaaggugacggaagugaagggcuacacuaagggcggccccggacacgaagaacccauccccauggcuaccuauggguggaacuuagugaagcuacacuccgggaaggacgucuucuucaucccucccgagaagugcgauacccuccugugugacaucggggagagcucccccaacccgacgaucgaggagggccgaaccuuacgcgugcucaagaugguggagcccuggcuccgggguaaccaguucugcaucaagauccugaaccccuacaugcccagcgucguugagacccuagagcagaugcagcgcaaacacggcggaaugcuggugcggaacccgcuuucccggaauaguacccacgagauguauuggguuuccugcgggacaggcaacauagugagugcggugaacaugacgucccggaugcuccugaaccgcuucaccauggcacaccgcaagcccaccuacgaacgagacgucgaccugggggccggcacccgccacgucgccguggagccugaggucgccaaccucgacaucauuggccaacggaucgagaauaucaagcaugagcacaagagcacguggcauuacgacgaggacaaucccuacaagaccugggcuuaucacggguccuacgaagugaaaccgucuggcuccgccaguagcauggugaauggugugguaaaguugcugaccaagcccugggaugucauccccaugguaacccagaucgccaugacagacaccacccccuuuggccaacagaggguguucaaggaaaaggucgacacgcggacgccgaaggccaaaagagggaccacccagaucauggaggugaccgcccguuggcucuggggcuuccugucccgcaacaagaagccccggauaugcacgagggaggaguucacccggaagguucgcagcaacgcggccauuggcgccgucuucguggacgaaaaucaguggaacuccgcaaaggaggcgguggaggacgagcgguuuugggaccugguccauagggagcgagagcuccauaagcaagggaaaugcgcgaccugcguguacaauaugaugggcaagcgcgagaagaagcucggggaguucggcaaagcuaaggggucccgggcgaucugguacauguggcugggcgcaagauuucucgaauuugaggcgcugggcuucaugaaugaggaccacugguuuucccgcgagaacagcuuaaguggggucgagggcgaggggcuccauaagcuugguuacauccugcgggauauuagcaaaauccccggggguaacauguacgccgacgacaccgcaggaugggacacgcgcaucaccgaggaugaccuccaaaacgaggccaaaauuaccgacaucauggagccggagcacgcccugcuggcgaaggccaucuucaagcucacauaucagaacaaggugguuagaguacagcgccccgccaagaacgggacggucauggacgugaucagucggcgcgaccagcgggggagcggccagguggggacauacggccugaacacuuuuaccaacauggaggcccaacuuauccgccagauggaauccgaggggaucuucucacccagugagcuggagacacccaaccuggccgaacggguccuggauugguuagaaaaguacgggguggaacgcuugaagcggauggcgaucagcggggaugauugcguggucaaaccgauugacgaucgcuuugccaccgcccugaccgcccucaacgacaugggcaaggugcggaaggacaucccccagugggagcccuccaaaggguggaacgacuggcagcaaguccccuuuugcagccaccacuuccaccagcucaucaugaaggacggcagagaaaucgucgugccgugccggaaccaggacgagcuagugggccgcgcccgggucucccaaggggcgggcuggagccucagagagacugccugccuugggaaaagcuacgcccagauguggcaacugauguacuuccaucggcgcgaccuccggcuggccgcgaacgccaucugcuccgccguucccguggacuggguccccacgucccgcaccacuuggucgauucacgcucaccaccaguggaugacuacggaggacaugcugagcguguggaaccggguguggaucgaagagaaccccuggauggaggacaagacccacgucuccucaugggaggacgugccguaccucggcaagcgcgaggaucaauggugugggucccugaucggccugaccgcccgcgcgaccugggccaccaacauccagguagccaucaaucaaguccgacgccuaaucggaaacgagaacuaccuggacuacaugacgucgaugaagagauuuaagaaugagucagaccccgagggggcucuaugguga

SEQ ID NO: 24692 - RNA, 9879 nt, Artificial Sequence
  derived and/or modified CDS sequence (opt11) from DENV-1__KC762643__SS-prME
agcgugacuaugcugcucaugcugaugccgaccgccuuagccuuccaucucacgacccggggcggggagccgcauaugaucgugagcaagcaggagcggggcaagagccugcuguucaagaccagcgccggggugaacauguguacucucauugccauggaccugggggagcugugcgaagacacgcucaccuauaaaugcccccgcauaacugaggcugagcccgacgacguggacuguuggugcaaugccaccgacaccugggucaccuacgggaccugcagccagacaggggaacaucggcgcgacaaacggucuguggcccuagcgccccaugugggccuggggcucgagacccgcacggagaccuggaugagcuccgagggcgcauggaaacagauccagcgcgucgagaccugggcacugcgucaccccggguucaccgugauggcauuguucuuggcgcacgccaucggcaccagcaucacccagaagggcauuaucuucaucuugcugaugcucgucacccccucgauggccaugcggugcgucggcaucggaagccgcgacuucguugaggggcuauccggagcaaccuggguggacgucgugcuggagcacgggucgugugugacaaccauggcaaaggacaaacccacccucgacaucgaguugcugaaaacagaggucaccaacccggcggugcuccggaaauuaugcauagaggccaagauuuccaauaccacuacagacagcaggugcccgacccaaggcgaggcaacccuuguggaggagcaggacgccaauuucgucugccggcggaccuucguggaccggggcugggggaacgguugcggccuguucggaaaagggucccugaucacgugcgccaaguuuaagugcgugacuaagcuggagggcaaaaucgugcaguaugagaaccucaaauacagcgugaucgugaccguccacaccggagaccagcaucagguggggaacgaguccacggaacacggcaccaccgcaaccaucacgccccaggcccccacgaccgagauucaguuaaccgacuacggggcccugacccucgacuguagcccccgcacgggacuggacuucaacgagaugguuuuacucaccaugaaggagaaguccuggcugguccauaagcagugguuccuggaccucccccugccguggaccaguggugcaagcacgucccaggagacguggaaccgacaggaucugcuggugaccuucaaaacggcccacgccaagaagcaagagguaguggugcuggguucucaggagggcgccaugcacaccgcacugacaggggccaccgagauucagaccucuggcacuaccacaaucuucgccgggcaccucaagugcagguuaaagauggacaaacugacgcucaaaggcaugucauacgugaugugcaccggguccuucaagcuagagaaggagguggcggaaacgcagcacgguaccguguugguccagaucaaguacgagggcaccgacgccccgugcaagauucccuucaguacccaggaugaaaagggggugacgcaaaacggacgguuaaucaccgccaacccgaucgugacggacaaggagaagccugucaacaucgaggccgagccgcccuucggcgagucauacaucgucaucggcgcuggcgaaaaggcccucaaauugagcugguucaagaagggguccagcauaggaaagauguucgaggccacagccagaggggcccguaggauggcuauccuuggcgacacggccugggacuucggguccaucggcggcguacucaccucugucggcaagcuggugcaccagauauucggcaccgccuacggcgugcuguucucuggagucagcuggaccaugaagaucgggaucggcguucucuugacguggcugggccuuaauucccgcagcaccuccuuaagcaugaccugcauagccguggggcuugucacccuguaccugggggugauggugcaagccgauucggggugcgucaucaacuggaagggacgggagcugaagugcggguccgguauuuucgugacgaacgagguccauaccuggaccgagcaguacaaguuucaggcugacagcccgaagcgccuuagcgccgcuauaggaaaggccugggaggagggggucugugggaucaggagcgccacacgccuggagaacaucauguggaaacaaaucuccaacgaguugaaccauauccuuuuggagaacgacaugaaguuuacuguggugguaggggauguugcgggcaucuuggcccaagggaagaagaugauccgaccacagcccauggagcacaaguacagcuggaaguccuggggcaaggccaagaucaucggcgccgacguucagaacacaacauuuauaaucgacgguccgaacacuccagagugcccugacgaccagcgcgcguggaacaucugggagguggaggacuacggcuuugggauuuucaccacaaacauauggcuuaagcugcgggacucuuacacccaagucugcgaccaucgcuugauguccgccgccaucaaagacagcaaggccgugcacgcugacaugggcuacuggaucgaguccgagaagaaugagaccuggaagcucgcgcgggcaagcuucauugagguaaagaccugcaucuggcccaagucccacacucugugguccaacggcguccuggaauccgagaugaucauccccaagaucuacgggggcccgaccucccagcacaauuaucgccccgguuacuucacccagaccgccggucccuggcaucucgggaagcuggagcuggacuucgaccucugcgagggcacgaccgugguaguggacgagcacugcggcaaccgcggucccucccugcggaccaccaccgucaccggcaagaucauccacgagugguguugccggagcugcacgcugccgccucugcgcuuucgcggugaggacggcugcugguacgggauggagauccguccagucaaagaaaaggaggagaaucuaguaaaguccauggucagcgccggcagcggcgaggucgacuccuucagccuggggcucuuaugcaucucaaucaugaucgaggaggugaugcggagccgguggucccggaagaugcugaugaccggcacgcucgccguguucuuccuguugaucauggggcaauuaaccuggaacgaccugauccgccuuugcaucauggucggcgcgaacgccagcgaccgcauggggaugggcacgaccuaccucgcccugauggccacguucaaaaugcggccgauguucgcugugggacuccucuuccgccgguuaaccucccgugagguccugcuccugaccauaggacugagccuagucgcguccgucgagcucccgaacagccuggaggaacucggcgauggguuggcaaugggcaucaugauccugaagcuccugacggacuuccagagucaccaacugugggccacgcuacugagccugaccuucaucaagacgaccuucucgcuccacuacgcuuggaagacgauggccauggugcugagcauagucucccuguucccccucugccugagcaccaccagccaaaaaaccacguggcugcccgugcuccucggcagccuggggugcaagccgcucacgauguuccuuauagcagaaaacaagaucuggggccguaaguccuggccguugaacgagggcauaauggccgucggaaucguuagcauacuacugaguucccugcugaagaaugacgugccccuagccgggccacugaucgcaggcggcaugcucauugcguguuaugucauuucuggguccagcgccgaccuguccuuagagaaagccgcggaagugagcugggaagaggaagccgagcacuccggagcgagccacaacauccuagucgagguccaagacgauggcaccaugaagaucaaagacgaggagcgcgacgacacccugaccauccugcugaaggccacgcugcuggccgugucuggcguguauccgcucucuauccccgcgacccuguucguaugguacuucuggcagaaaaagaagcagcgguccggggugcugugggacacgccuagcccgcccgagguggagcgggccgugcuugacgacgguauauaccggaucaugcaacgcggccuuuuagggcggucccagguaggcguggggguguuccaggaaaacgucuuccacaccauguggcacgugacgcgcggcgcgguacucauguaccaagggaagcgcuuggaacccaguugggccuccgugaaaaaggaccugaucagcuacgggggcgguuggcgccuccagggcucuuggaauacgggggaagaggugcagguuauugccgucgagcccggcaagaaccccaagaacgugcagaccgcgccggggacguucaaaacgccugagggcgaagucggcgccaucgcucucgacuuuaagcccgggaccucaggcuccccuaucgugaaccgugaggggaagaucguagggcuguacgguaaugggguggugaccacaucaggcacguacgucagcgcgaucgcccaggcgaaggcgucccaggaggggccccuaccagaaaucgaggacgaggucuuuagaaagcguaaccucaccaucauggaccuucaucccggcuccgggaagacacggcgcuaccugccggccauuguuagagaagcgaucaagcggaagcuccgcacucugauccuggcacccacgcguguggucgccuccgagauggcggaggcccucaagggcaugcccauccguuaccaaaccaccgccgucaaaagcgaacauaccgggaaggaaauaguggaccucaugugucacgccacguucaccaugcgcuuauuauccccaguucgggugccgaacuacaauaugaucaucauggacgaggcccacuucaccgauccuagcucgaucgcggcccgcggcuacaucagcacccgggucggaaugggggaggcagccgccaucuucaugacggcgacgccgcccggaucuguugaggccuucccgcagagcaacgccgugauccaggacgaggagcgcgacauccccgagcgguccuggaacagcggauacgaguggaucaccgacuucccgggcaagaccgugugguuuguccccuccaucaaaagcggcaacgacaucgcgaacugcuuacgcaagaacgggaagcgggugauccagcuuucgcgcaagacguucgacaccgaguaccagaagaccaagaacaacgacugggacuacguagucacaacggacauaagcgagaugggugcuaacuucagagccgaucgcgugaucgauccgcggcgcugccucaagcccgugauccugaaagacgggcccgagcgugucauccuggccgguccaaugccagugaccguagccuccgcagcucagcgccgggggcgcgugggccggaaccacaacaaggagggcgaccaguacaucuacauggggcagccgcucaacaacgacgaggaccaugcccacuggaccgaggccaagaugcugcuggacaacaucaauacccccgaggggauuauccccgcgcucuucgagccggagcgcgagaaguccgccgcaaucgacggggaguaccggcugaggggcgaggcccgcaagacguucguggagcucaugcggcgaggggaccugccagucuggcuguccuacaagguugcgucagagggguuccaguacucagaccggcgcugguguuucgacggcgagaggaacaaccaagugcuagaggagaacauggacgucgaaauauggaccaaggagggugagaggaaaaagcuccggccucgcuggcuugacgcucgaaccuacuccgacccccuagcccuccgcgaguucaaagaguuugcggcuggccgaagaucaguauccggggaccugauccuggaaauuggcaaacucccgcagcaccugacucagcgggcccagaacgcccuggacaaucucgugaugcugcacaacagcgaacaaggcggccgggcguaccggcaugccauggaggagcugcccgacacgauugagacccucaugcuacuggcccucaucgcgguccugaccggcggcgucacacucuucuucuuauccgggcgcggguuaggcaagaccagcaucggccugcucugcgugauggccuccuccguuuugcuguggauggccucaguugaaccccacuggaucgccgccucaaucauccucgaguuuuuccugaugguccugcucaucccggagccggaccggcagcguacgccgcaggacaaucagcuggccuacgucgugaucggguuguuauucaugauccugaccguggcagcgaacgagaugggccuucucgagaccacuaagaaggaccuggggaucggccaugucgccguggaaaaccaccaccaugcagccaugcuggacguugaucuccaucccgcauccgcguggacgcuguaugccgucgccacaaccaucauaaccccgaugaugcggcacacgaucgagaacacgacggccaacauaucacugacggccaucgcgaaccaggccgccauccugaugggucuggacaagggcuggcccaucuccaagauggacaucggagugccccugcucgcccugggcugcuacagccaggucaacccccugacgcuaaccgcggcgguauuaaugcugguggcccacuacgccauaaucggcccggggcuccaggccaaggcgaccagagaggcacagaagcgcacagccgccgguaucaugaagaaccccacgguggacgguaucgucgccaucgaccuagaccccgugguguacgacgcgaaguucgagaagcaguuaggccagaucaugcugcugauuuuaugcaccucucaaauucuccugaugagaacgaccugggcccugugcgaguccaucacccuggcuaccggcccccuuacaacacugugggaagggaguccuggcaaguucuggaacacuacgaucgccgucucaauggccaacaucuucagaggcagcuaucuggcgggcgcaggccuggccuucagccugaugaagucccucgggggcgggcggcgagggacuggggcacagggugagacccugggcgagaaguggaagcgacagcuuaaccaacucuccaaaagcgaauucaacacguacaaacgcucuggcaucauggagguggaccggucugaggcgaaggagggccucaagcgcggggaaacuaccaagcaugccgugucccggggcaccgccaagcugcgcugguucguugagcggaaccuaguaaagccggaggggaagguuaucgaucuuggcugcggaagagguggcuggaguuacuacugugccgggcugaagaaggucaccgaagugaagggcuacacaaaaggggggcccggccacgaggagcccauuccgauggccacauaugguuggaaccugguuaagcuccacaguggcaaggacgucuucuucaucccgccagagaaaugcgacacuuugcugugcgacaucggggagucgucccccaacccgaccauugaggagggccgaacccuccgcgugcucaagaugguggagcccuggcugcgggggaaccaguuuugcauaaagauccuuaaccccuacaugcccagugugguggagacccuggagcagaugcagcgcaagcacggcggcaugcuuguaagaaacccgcucucccgcaacucuacccacgagauguauuggguaucuugcgggaccggcaauaucgugucugcggugaacaugacgucacggaugcugcugaaucgcuucaccauggcccaccgcaagccgacuuacgaacgggacgucgauuuaggugccggcacccgccauguggcuguagagccggaggucgccaacuuggacaucauugggcagagaaucgaaaacaucaaacacgagcacaagaguacuuggcauuacgacgaggauaacccguacaagaccugggccuaccaugguuccuacgaggugaagccuagcggaucggcaucauccaugguaaacgggguggugaagcugcucaccaagcccugggacgucauccccaugguaacccagauugccaugacugacaccaccccguucggucagcagaggguguucaaggagaaggucgacacccggacuccgaaggccaagcgcgggaccacccagaucauggaagucaccgcccgguggcuguggggauuccuuucccgcaacaagaagccgcggauaugcacgagggaggaguucauccggaaggugcgcagcaacgccgccauaggcgccguuuucguggacgaaaaccaguggaacuccgccaaggaggcgguugaggacgagcgguucugggaccucguccaccgcgagcgggagcugcacaagcaggggaagugugcgaccugcguguauaacaugauggggaaaagggagaagaagcugggggaguuugggaaggccaaagggagccgggccaucugguacauguggcucggcgcccguuuccuggaauucgaggcgcugggcuucaugaacgaggaccauugguucagucgagagaacagccucuccggcguagagggcgaggggcugcacaagcugggcuacauccuccgugacaucagcaaaauccccgggggcaacauguacgcugacgacacugccggcugggacacacggaucacggaagacgaucuccaaaacgaggccaagaucaccgacaucauggagccggagcacgcccugcuagcgaaagccauuuucaagcugaccuaccagaacaagguugugcgcgugcagcgccccgcaaagaacgggaccgucauggacguuaucucccggcgugaccagcggggcagcggccagguggggacguacggacugaacaccuucacaaacauggaggcucagcucauccgacagauggaguccgaggggaucuucagccccagcgagcuggagacccccaaucuggcggagcgaguccucgauugguuagaaaaguacggcguggaaagauugaaacggauggccaucagcggcgacgacugcguggucaaaccgaucgacgaccgcuuugccaccgcccugaccgcgcugaacgacauggggaagguccgcaaggauaucccacagugggagcccuccaagggguggaacgacuggcagcagguacccuuuugcucccaccacuuccaccagcugaucaugaaggacgggcgcgagaucgucgucccaugccggaaccaagacgagcucguggguagagcacgggucagucagggggcgggauggagccugcgcgaaaccgccugucuaggcaagucuuacgcccagauguggcagcucauguacuuccaccggcgcgaccugcggcuggcagcgaacgccauuugcuccgccgugcccguggacuggguuccgaccagccgcacgaccuggagcauacacgcucaccaccaguggaugacgacagaggacaugcucagcguguggaaccgagucuggaucgaagagaaccccuggauggaagauaaggcacacgucuccagcugggaagacgugccguacuuaggaaagcgcgaagaucaguggugcggaucccugaucggccugacggcacgggccaccugggccacgaacauucagguggccaucaaccagguccggcgccucaucggcaacgagaacuaucuggacuacaugaccagcaugaaacgguucaagaacgaguccgaccccgagggggcucucugguaa

SEQ ID NO: 24693 - RNA, 9879 nt, Artificial Sequence
  derived and/or modified CDS sequence (opt11) from DENV-1__KC762651__SS-prME
agugugaccaugcuguucaugcugcugccuacugcccuugccuuccauuugacaacccggggcggggagccccacaugaucguguccaagcaggagcggggcaagucacuccuguucaagaccuccgccggggugaacaugugcaccuugaucgccauggaccugggcgagcugugcgaagacaccaugaccuacaagugcccacggaucaccgagacagagccggacgacguggacugcugguguaacgccaccgagacaugggucaccuaugggaccugcagccagaccggagaacaccggcgugacaagagguccguugcccuagcgccccauguuggccuggggcuggaaacccgcaccgagaccuggaugucauccgagggagccuggaagcagauucagaaggucgagacgugggcccuccggcaucccgguuucaccgugaucgccuuauuccuggcccacgcgaucgggaccagcaucacccagaagggaaucaucuuuauccuacucaugcuggugacgccgaguauggccaugcgcugcgucgggaucggcaaccgagauuucguagagggauugagcggcgccacuuggguggaugucguguuggagcacgguagcugcgugaccaccauggccaaggacaagcccacgcuggacaucgagcuguugaagacugagguuaccaaccccgcugugcugcgcaagcucuguaucgaagcgaagaucagcaacaccacgaccgacuccagaugccccacacagggcgaggcaacccugguggaggagcaggacacgaauuucguaugccgccggaccuucguagaccgcggcugggggaacggcugcggacuguucggcaaggggagccucaucacuugcgccaaauucaagugcgugacaaaguuagagggcaagaucguccaguaugagaaccugaaguacuccguuaucgugacuguccacaccggcgaucagcaccagguggggaacgagaccacggagcacggcaccacggcgacuaucacgccccaggcccccaccagcgagauccagcugacggauuacggagcacugacccuggacugcagcccucggacgggcuuggacuucaacgagaugguccuguuaaccaugaaggagaaguccuggcucgugcacaagcaaugguuccuggaucugccgcuccccuggacguccggggccagcacgucacaggagacauggaacagacaagaccuguuggugaccuucaagacggcccacgccaagaaacaggaggucguggugcucggcagccaggagggcgcuaugcacacagcuuuaaccggggccaccgagauccagacgagcgguaccaccaccaucuucgcaggccaccugaagugucgguugaagauggacaaacugacacuuaagggcgucuccuacguaaugugcaccgggaguuucaagcucgagaaggaaguggcugagacgcaacacggcaccgucuugguucaagugaaguacgaaggcacggacgcccccugcaagaucccuuucuccagccaggacgagcgcgggguuauacagaacggccgucugauuacugcgaauccgaucgugaccgacaaggagaaacccgugaacauagaggccgagccgcccuuuggggaguccuauaucgucguaggggcaggcgagaaggcucugaaguugagcugguucaagaaggggagcagcaucggcaagauguucgaggcgaccgcccgcggggcccggcguauggcaauccugggcgacacggcuugggacuucggcuccaucggugggguauucaccagcgucgggaagcuggugcaccagaucuucggaacugcguacggggugcuguucucggguguuagcuggaccaugaagaucgggaucggcauccuuuuaacuuggcucggccucaacucgcgcucgaccucccugaguaugaccugcauagccguggggauggugaccuuauaccugggagucauggugcaggcugacuccgggugcgugaucaacuggaaaggcagagaauugaaaugcgggagcggcaucuucgucacaaaugaggugcacacguggaccgaacaguacaaguuucaggcugauagcccgaagcgucucagugccgcgaucgguaaggccugggaggagggugugugcggcauccggucggcuacccggcuggagaacaucauguggaagcaaaucaguaacgagcugaaccacauccuccuggagaaugacaugaaguucaccgucgugguaggggacguaagcgguauucuggcccaggggaagaagaugauucggccccagccaauggagcacaaauacagcuggaaguccugggguaaggcuaaaauaauuggcgcagacgugcaaaauacaacuuucaucaucgacgggcccaauacaccugagugccccgacaaccagagggccuggaacaucugggagguggaggacuaugguuucgggguauucacuacgaacauaugguuaaagcugagagacucauacacgcaggugugcgaucaccgccugaugagcgccgcaaucaaggacuccaaggcugugcacgccgauauggguuacuggaucgagagcgagaaaaacgagaccuggaagcucgagcgagccagcuucaucgaggucaagaccugcauauggccccguucgcauacguuguggucgaauggcgugcuggagagcgagaugaucauccccaagaccuacggggguccggucucccagcacaauuaucgacccggcuacuucacccagaccgccggccccuggcacuuggggaagcucgagcuggacuucaaccucugcgagggaacuaccguagucguggacgagaacugcgguaaccgggggccgucguuacgaaccaccacggucacugggaagauuauucaugaguggugcugccguucauguacccugccgccccugcgguucaagggggaggacggcugcugguacggcauggagauccgccccgucaaggagaaggaggagaaccuggucaaaagcauggucagcgccggcagcggcgagguggacagcuucuccuuagggcuccugugcauuucaaucaugauagaagaaguuaugcggagucgauggagcgguaagaugcugaugaccgggacgcucgcugucuuccugcugcuuaccaugggccaacucacuuggaacgaccugauccggcucugcaucaugguuggggccaaugccuccgacaugaugggcaugggcaccacguaucuggcccugauggcgaccuuccguaugcgcccgauguucgcggucgggcucuuauuucggagacugaccucccgggaggugcuucugcugaccgucggccugagccucguugcuuccguugaacugccaaauucccucgaggagcuaggggacggccuagcaaugggaaucaugaugcucaaauuacugacagacuuccagagccaccagcugugggccacgcugcugucccucacguuugugaagaccgccuucucccugcacuacgcauggaagacgauggccaugauccuguccauagucucccucuucccccugugucuguccacgaccagucagaagaccacaugguugcccgugcuucugggaaguuuaggcuguaagccgcugaccaugcugcucaucaccgagaacaagaucugggggcgccggucguggccccugaacgagggaauuauggccaucggcaucgugagcauccugcuuuccagccuacugaaaaaugacguaccccuugccggcccucugaucgcgggcgguaugcuuaucgccugcuacguuaucuccggcagcuccgccgaccucucgcuggagaaggccgcagaagugaguugggaggacgaggcggagcacagcggggccucacacaauauucugguggaggugcaggacgacggcaccaugaaaaucaaggacgaggagcgcgacgacacccuaacgauccugcugaaggccacccuccuggccaucuccgggguguacccgaugucgauccccgcgaccuuguucgucugguacuucuggcagaagaagaaacaaaggagcggcguucucugggacacgcccagcccgcccgagguggagcgcgcgguccuagacgacggcauuuaucggauacugcagcgcgggcugcucggccggagccaggugggggugggcguuuuccaggaggggguguuccacacgauguggcacgugaccagaggcgccguacugauguaccagggcaagcgacuggagcccuccugggcuagcgugaagaaggaccucaucucuuaugggggcggguggcgguuccagggcagcuggaauaccggggaggagguucaggucauugccguggaacccggaaagaauccuaaaaacgugcagaccacuccgggcaccuucaaaacuuccgagggggaggucggugccaucgcgcuggacuucaagccugggaccagcggcucccccaucguuaaccgggagggcaagauagucgggcuguacggcaacggagucgugacgaccuccggcaccuacguuagcgcaaucgcccaggccaaggccucccaggaggggccccucccggagaucgaagaugaggucuucaggaagcggaaccugacgaucauggacuugcaccccggcuccggcaagacccgcagguaccuccccgcgauccugcgggaggccauaaaacggaaacugcgcacguuggugcuggccccgacucgcguggucgccuccgagauggcggaggcccugaaggggaugcccauccgguaccagaccacggccguuaaaucugagcacacuggcaaagagauaguggaucucaugugccacgccaccuucaccaugcgccugcugucccccguccgggugcccaacuauaacaugaucaucauggaugaagcccacuuuacggacccggcgagcaucgccgcccgggguuauaucucuacccggguggguaugggggaagccgcagcgaucuucaugacugccacaccgcccggcucugucgaggcuuucccccaguccaacgccgugauacaggacgaggagcgagacaucccggagcgaagcuggaacuccggauacgacuggaucacggacuuuccuggcaagaccgugugguucguccccagcauuaaguccggcaacgacaucgcaaacugccuccgcaaaaacgggaagcggguggugcagcugagccgcaagaccuucgacacagaguaccagaaaacgaagaacaacgacugggacuacgucgugaccaccgauaucuccgagaugggcgcgaacuuccgggccgaccgcgucauugacccccggcggugcuuaaagcccgugaucuugaaggacgggcccgagcggguuauccuggccggccccaugcccgucaccguggccagcgcugcccagcgucggggccgcauagggcggaauccgaauaaggaaggcgaccaguacguguauauggggcagccccugaacaacgacgaggaucacgcacacuggacagaggccaagaugcuccuggacaacaucaacacccccgagggaaucauccccgcacuauucgagccagaacgcgagaaauccgcugccaucgacggggaguaccgccuucggggcgaggccagaaagaccuucguggagcuuaugcgccgcggugaucugcccgugugguuaagcuacaagguggcgagcgagggguuccaauacuccgaucgucgcugguguuucgacggcgaacguaacaaccaggucuuagaggagaacauggacguugagaucuggaccaaggagggggaacgcaaaaagcugcgcccccgcuggcuugacgcccggacguauagcgacccccuggcacugcgcgaauucaaggaauucgccgccggccgccgcuccgugaguggcgaucuaauccuggagaucgggaagcugccgcagcaccucacccagaaagcgcagaacgcuuuagacaauuugguuaugcuccauaacuccgagcagggugguaaggcguaccggcacgcaauggaggagcugccugacaccaucgaaacccucaugcuacuggcccucaucgccgugcugaccgguggggugacgcuguuuuuucugagcggacgagggcucgggaagaccucuaucggccuacugugugucauggcuagcagugcccugcuauggauggcuagcguggagccccacuggaucgccgccuccauuaucuuggaguucuuccuaauggugcugcugaucccugagccggaccgccagaggacuccccaggacaaccaacucgcguacgucgugaucggacugcucuuuaugauccucaccgucgccgcuaacgagaugggacugcuggaaacgaccaaaaaggaucuagguauuggccacgccgcggcggagaaccaccaccacgcggccaugcuggacgucgaccugcaccccgccagcgcuuggacccucuacgcgguggccaccacgaucaucacgccgaugaugaggcacacuaucgagaacacuacggcuaacaucucccugaccgccaucgcgaaccaggcggccauccucauggggcucgacaagggguggcccaucagcaagauggacauuggcguaccccugcuagcccucgggugcuacucccaggucaacccccugaccuuaaccgcagcgguauugaugcuggucgcacauuacgccaucaucggcccggggcugcaagccaaggccacgcgagaagcgcagaagcggaccgccgccggcauaaugaaaaaccccacgguggauggcaucguggccaucgaccucgaccccguuguuuacgaugccaaauuugagaagcaacuggggcagaucaugcugcuuaucuuaugcaccagccagauccugcucaugcgcacuaccugggcguuaugugaguccaucacccuggccaccgguccccucacgacacugugggaggggagcccuggcaaguucuggaauacgaccaucgcagugucgauggccaacauuuuccggggcagcuaccuggccggggcgggccucgccuucucccugaugaagucacucgggggcggucggcgcgggacuggcgcccagggggaaacccucggcgagaaguggaaacggcagcucaaccagcuguccaaguccgaguucaacaucuauaaacgcagugggaucauggagguggaccggucugaagcgaaggagggccucaagcgaggggagaccaccaaacacgccgucucccggggcacggccaagcuucgcugguuuguggagcguaaccucgugaagccagaaggcaaagucaucgacuuggggugcggaaggggaggcugguccuacuacugcgccggacucaagaaggugaccgaagugaagggguacacaaaagguggacccggucaugaggagcccgucccgauggccaccuacggauggaaccuggugaagcugcauagcggcaaggacguguucuucacgccgcccgagaaaugcgacacccuccugugcgacaucggggagucaagccccaacccgaccauugaagagggccggacucugcgcguccucaagaugguggagccguggcugcgaggcaaccaguucuguaucaagauuuugaaccccuacaugcccucgguaguugagacccucgagcagaugcaacgcaagcacgggggcaugcugguacgaaacccgcugagccggaacuccacccaugagauguacugggugagcugcgggaccggcaacaucgucuccgcggucaacaugaccagccggaugcuccugaaucgcuucaccauggcgcaccgaaagcccacguacgagcgcgacguggaccugggagcggguacccgccacgucgccguggagcccgaaguagccaaccucgacaucauugggcagcguaucgagaacaucaagaaugagcacaaauccacauggcacuacgacgaagauaaccccuacaagaccugggcauaccacgggagcuacgaggugaagccgucuggcagcgcgucuuccauggugaacgggguuguacgcuugcugacgaagcccugggacgugauccccaugguuacccagaucgccaugaccgacaccacuccauucggccagcaacggguguuuaaagagaaaguugacacccgcaccccgaaggccaaacggggcaccgcccagauuauggaggucacggcgaaguggcucuggggguuccugagccgcaacaagaagccccgcaucugcacccgcgaggaguucacacggaagguccgcaguaaugcggccaucggggccguguucguggacgagaaucaguggaacagcgccaaggaggccgucgaggacgaaagguuuugggaccuggugcaucgcgagcgggagcuccauaagcaggggaaaugcgcaaccugcgucuacaacaugaugggcaaacgagagaagaagcugggagaguucggcaaagcuaagggaucccgggccaucugguacauguggcucggugcccgcuucuuagaguucgaggcgcuaggcuucaugaacgaggaccacugguuuucucgggagaacucucugucggggguggagggcgagggacuccacaagcugggcuacauccuccgcgacaucuccaagauucccggcgggaaccucuacgcugacgacacggcaggcugggacacccggauuaccgaagaugaccugcagaacgaggccaagaucaccgacauaauggagccugaacacgcccugcucgcgacgagcaucuucaagcugaccuaccagaacaagguuguucgggugcagcggcccgcuaaaaacggaacagugauggacguaaucaguagaagggaccaacgcggcucgggccagguugggaccuacggacugaauaccuucaccaacauggaggcacaguuaauaagacagauggaguccgaggggaucuuuagcccuuccgagcuugagacccccaaccucgcaaagcgggugcuugacuggcuagaaaagcacggcaucgagcgccugaagcggauggccauaagcggcgacgacugcguugugaagccuaucgacgaccgcuucgcaaccgcgcuuacugcccugaacgacaugggcaagguacggaaggacaucccccaaugggaacccucaaagggcuggaacgacuggcaacaagugccuuucugcucacaccacuuccaucagcugaucaugaaggacgggcgcgagauuguuguaccgugccggaaucaagacgaacucaucggccgcgcucgggugagccaaggggccggcuggucccugcgagagaccgcgugccugggcaagagcuacgcccagauguggcagcuaauguacuuccaucggcgcgaucuccggcuggccgccaacgcgaucugcuccgcggugccgguagauugggugcccaccagccgcaccacgugguccauccacgcccaucaccaguggaugaccaccgaagacaugcucucagucuggaaccggguguggaucgaggagaaccccuggauggaagacaagacccacgucucgagcugggaggacgugcccuaucuggguaagcgcgaggaucaguggugcggcucccugauaggccuuaccgcgcgcgccacgugggcgagcaacauccagguagccaucaaccagguccgccgacuuaucgggaacgagaacuacuuagacuacaugaccuccaugaagcgguucaagaacgagagcgaccccgagggggcccuuugguga

SEQ ID NO: 24694 - RNA, 9879 nt, Artificial Sequence
  derived and/or modified CDS sequence (opt11) from DENV-1__KC762653__SS-prME
agcgucaccaugcugcucaugcugcuacccacggcccucgccuuccaccugaccaccaggggaggggaaccccacaugauagugagcaagcaagagcgggguaagucguuacucuuuaaaacuuccgccggggugaauauguguacccuaauugccauggaccucggcgagcucugcgaagacacgaugaccuacaagugcccacgcaucaccgagaccgagcccgacgauguggacuguuggugcaacgccaccgagaccuggguuaccuacgggaccugcuaccagaccggcgaacacaggcgggauaagcggucuguggcacuggcuccccacgugggccugggacucgagacccgcaccgagacuuggauguccagcgaaggugcguggcgccagauccagaaaguagagaccugggcacugcgacaccccggguucaccgugaucgcccuauuccucgcucacgcgaucgguacgaguaucacccagaaagggaucaucuucaucuuacugaugcuagugacgcccagcauggccaugcggugcguuggcaucgggaaucgcgauuucgucgagggacuguccggcgcuacuuggguggacgucgugcuggaacacgggagcugcgugacuaccauggcaaaggacaagcccacgcuagauaucgaacuucugaagaccgaggucacgaaccccgcgguucugcguaaacuuuguauagaggccaagaucuccaacaccacgacggacucgcgcugccccacccaaggagaggccaccuuaguggaggagcaggacacgaacuucguuugccggcgcaccuucguggaccgcggcugggggaacggcugcggacucuucggcaagggaagccugaucacgugcgcuaaguucaaaugcgugaccaaacuggagggcaaaauuguccaguacgaaaaucucaaauacucagugauagugacgguccacacuggggaucagcaccaggucggaaacgagacaaccgagcaugguacuacggcaacuauuacuccccaggcuccaaccuccgaaauccaacugacggacuacggcgcccuuaccuuggauugcaguccgagaaccggccuggacuucaacgagaugguccuauugaccaugaaagagaagucguggcugguccacaaacagugguuucuggaccucccuuuacccuggacgagcggcgccuccacaagccaggagacguggaaccggcaggaccugcucgucacguucaaaacagcgcacgccaagaagcaggagguggugguucugggcucgcaggagggcgccaugcacaccgcccugacgggagccaccgaaauccagacuuccgguaccacuaccaucuucgcagggcaccucaagugcaggcuaaaaauggacaagcugacuuugaagggaaugagcuacgugaugugcaccgguuccuucaaacuggagaaggagguggccgagacccagcacggaaccgugcugguacaggugaaguaugagggaacugacgcccccugcaagauccccuucucuucccaggacgagaagggggugacccaaaacgggaggcuaaucaccgcuaacccaaucgucaccgacaaggagaagcccgugaacauagaggccgagccuccuuucggggaguccuaccucguggugggcgccggggagaaagcccugaagcugucgugguuuaagaaggguagcagcauaggcaagauguucgaggcgacagcccgaggggccagacgcauggcaauacucggggacaccgcaugggacuucgggagcauuggcgguguuuuuaccuccguugggaagcugauccaucagauuuucggcaccgcauacgggguacuguucagcggcgugaguuggacuaugaagauaggaaucgggauacuccugaccuggcugggccuaaacucucgcuccacaagucuguccaugacgugcaucgccgucgggaugaucacgcuguaucucggcgucaugguucaggcugacagugggugcgugaucaacuggaaggggagggaacugaagugcgguuccggcaucuucgucacaaaugaagugcacacauggaccgagcaguacaaauuccaggcagacagcccgaagcggcugagcgccgccaucggaaaggcuugggaggaggggguaugcggcauccgguccgcuacacgccucgagaacauaauguggaaacagaucagcaacgagcugaaccacauucuccucgagaaugacaugaaguucacggucguggucggggaggucaacggcauccuggcccagggcaaaaagaugauccggccacagccuauggagcacaaguacuccuggaaguccuggggaaaggccaaagugaucggcgcagacgugcagaacaccaccuuuauuaucgacgggcccaacaccccggagugucccgacaaccagcgcgcguggaacaucugggaggucgaagauuacggguucgggaucuuuacgaccaauaucuggcugaagcuccgggacuccuauacccagguaugcgaccaccgccugaugagcgcggcuauaaaggacuccaaggccguccaugccgauaugggguacuggauagagagcgaaaagaacgagacauggaaacuggcccgggccuccuucaucgaggucaagacguguauuuggcccaagucccacacccucugguccaauggugugcuggaaagcgaaaugaucaucccaaaaauauacgggggcccgauuucccagcauaacuaccgccccggguauuucacacagacagcgggccccuggcacuuaggcaagcucgaauuggacuucgagcugugcgagggaacgaccguaguugucgacgagcauugcggcaaccgugguccguccuuacgcaccacgacggugaccgggaagaucauccacgaguggugcugccggaguugcacccugccuccccugcgcuucaagggagaggacggcugcugguacggaauggagauacggcccguaaaggagaaagaggagaaccucgucaagaguauggugagugccggcaguggcgaggucgauagcuucagccuggggcugcuuugcaucagcauuaugaucgaggaagugaugcgaucccgcuggucucggaagauguuaaugaccggcacucuggccguauuccuccuucugacuauggggcagcuuaccuggaacgaccugauccggcugugcaucauggucggcgcgaacgccuccgacaagauggggauggggacuaccuacuuggcccugauggccacauuccgaaugagaccgaugcuggccgugggcuugcuguuccgucgccuaaccagccgggaaguacucuugcucaccguaggucucucguuagucgccagcgucgaacugccuaauucccuugaggaacugggugacggguuagccaugggaaucaugaugcugaagcugcugacggacuuucagagccaccagcucugggccgcacugcuuucccucaccuucgugaagacgacgcugagccugcauuaugccuggaagacgauggccaugauucugagcaucgugagccuauuuccccuaugcuuaucgaccaccagccagaaaaccacauggcugcccgucuuacucggcuccuuagggugcaagccguuaaccauguuccugauuaccgagaacaaaaucuggggccgcaagagcuggccucugaacgaggggauuauggccgucggcaucguuagcauccucuuaagcucccuucucaagaacgacgucccucucgcgggaccgcugaucgccggcggcauguugaucgccugcuacgugauauccggaucgagugcggaccucagccuggagaaagccgcggaggugucaugggaagaggaggccgaacacaguggggccucacacaacaucuuggucgaggugcaggacgacgggaccaugaaaauuaaggacgaggaacgggacgauacccucaccauacugcugaaggcaacucuccuggcgaucucuggcguauauccgauguccaucccugcaacgcuguucguuugguacuucuggcaaaagaagaagcaacgcagcggaguguuaugggacacccccagcccaccagagguggagaaggccguccuagacgacgguaucuaccguauccugcagcgcggcuuacucggcaagucacaggugggcguaggggucuuucaggagggcguuuuucacacuauguggcacguaacccgcggggccguccucauguaccagggcaagcgccuggaaccguccugggccagcgugaaaaaggaccuaaucucguacggugguggcuggcgauuccagggcagcuggaacaccggcgaggaggugcaggucauagccguggagccggggaagaaccccaaaaacgugcagacggcgcccggaacguucaaaacucccgagggcgaggucggggccaucgcucuggacuucaagccgggcaccuccgggagccccauagugaaucgggaggguaagauuguaggguuauacggaaacggcgucguaacuacuuccggcaccuacgugagcgccaucgcacaggcuaaagccagccaagaaggcccgcuccccgagaucgaggacgagguuuuucggaagcgcaaccuaaccaucauggaccugcaucccgggaguggcaagacucggcgcuaucucccggccaucguccgggaggcaauuaagcgcaagcugagaacgcugguacucgcucccacucgcgucguggccuccgagauggccgaggcacucaagggcaugcccauuagguaccagaccacugccgugaaaagugagcacacgggaaaagagaucgucgaucucaugugccaugcuaccuucaccaugcgccuccugucgccgguccgcguaccgaauuacaacaugaucaucauggacgaggcucauuucaccgaccccgccagcaucgccgcccggggcuauauaagcacgcgagucgggaugggcgaggcggccgccauauucaugacugccacuccacccggguccauggaggccuuuccgcagagcaacgcggccauccaggacgaggaacgcgacauacccgagaggucguggaacucugguuacgacuggauuaccgacuuccccggcaagacaguuugguucguucccucuauuaagagugggaaugacaucgccaacugcuugcgcaaaaacggcaagcgcguaauccagcuauccaggaagacuuuugacaccgaguaccagaagaccaagaacaacgacugggauuacguaguaacgaccgacaucagcgaaaugggugcgaacuuucgggcagaccgggucauagauccgaggaggugccuuaaaccggugauacugaaggauggcccggagcgcgucauuuuagccggucccaugccggucacagucgcauccgcggcccagcgucgcggccggaucgggcgaaaccaaaacaaagagggggaccaguacauuuacaugggccagccccuuaacaacgaugaggaccacgcucacuggaccgaggccaagaugcugcucgauaauauuaacacgcccgaagggaucauccccgcucuguuugagccggaacgggagaaaucugccgccaucgauggcgaauaucgccugcgcggagaagcgcgcaagacauuugucgaacuuaugcgacgaggagaucugccuguuuggcucuccuauaaaguggccagcgagggcuuccaguacagugaccgccgguggugcuucgauggggagaggaacaaccagguccucgaagagaacauggacguugagaucuggaccaaggagggcgagagaaagaaauuacgcccccgguggcuggacgccagaaccuacagcgacccguuggcgcugcgugaguucaaagaguuugccgcuggacgcagaagcgucagcggcgauuugauucucgagaucgguaagcugccucagcaucugacgcaacgggcccaaaaugcccuugacaaucuggucaugcugcauaauucagaacagggaggaaaagcguacaggcacgccauggaggagcuccccgacacuauugagacccugaugcuguuagccuugaucgccgugcugaccggcggcgugacccucuucuuccugagcgggagaggccugggcaagaccucgauagggcuccuaugcgucauggcuuccagcgcccugcucuggauggcguccguggaaccccacuggaucgccgccucgaucauccuugaguucuuccugauggugcuauuaauuccggagcccgaucgacagagaacaccccaggacaaccaauuggccuacgucguuauaggccucuuauucaugauccugaccguggccgcgaacgagauggggcuccuggagacgacgaaaaaggaccugggaaucgggcacgccgccgcagagaaccaccaucaugccgcuaugcuugacguggaucuacaccccgccuccgccuggacucuguaugccguggccaccacgaucaucacgccaaugaugaggcacaccaucgagaauacuaccgccaacaucucgcucacggccaucgccaaccaggcugcaauccugaugggucuggacaagggcuggcccaucucuaagauggacaucggggugccuuugcuggccuugggcugcuauagccaggucaauccucucacccucacugccgcugugcugaugcuuguggcccacuacgcgaucaucgggccgggacugcaggcaaaagccacgcgcgaggcccaaaagcggacggccgcgggaaucaugaaaaacccgaccgucgacgguaucguggccauugacuuagaucccguggucuacgacgccaaguucgagaaacaguugggccagaucaugcuguuaauccucugcaccucacagauacuucuaaugcgcaccacgugggcccucugcgagaguaucacccucgcuacggggccacugacgacucugugggaggguucgccggggaaguuuuggaacaccaccaucgcggugagcauggccaacauuuuccggggcuccuaccuggccggcgcggggcucgcauucucccuaaugaagucccugggcggcgggcgccgcgguaccggcgcacagggcgagacgcuaggugaaaaguggaaacgacaacuaaaccaguuaaguaagagcgaguucaauaccuacaagcgcuccggcauaauggaaguggauagguccgaggccaaagaggggcugaagcgcggcgagaccaccaagcacgccgucucccgcgggacagccaaacuucgcugguucguggagcggaaccucguuaagccagagggaaaggucaucgaccuuggcugcgggcguggaggguggucguacuacugcgcgggucugaagaaggugacggaggugaagggcuacaccaagggcggccccggccacgaggagccgaucccaauggccacuuacggcuggaaccucguuaaacuucauuccgguaaggauguguucuuuacgccgcccgagaagugcgacacccuccugugcgacaucggagagucgucccccaauccgaccauugaggaagggcggacccugcgcgugcugaagauggucgagcccuggcuccggggcaaucaguucugcaucaagguucugaaccccuauaugccaucugugaucgagacacuagagcagaugcagcgcaagcacggcgggaugcuuguacggaacccucugucucguaauuccacgcacgagauguacuggguauccugcggcaccgggaacauuguuucggcggucaauaugaccuccaggaugcuucuuaaccguuuuaccauggcccaccggaagccuacguaugagcgcgauguggaccugggagcgggcacccggcacguggcggucgagcccgaaguggccaaccuggauauaauagggcagcgaaucgagaacauuaaaaaugagcacaaguccaccuggcauuaugacgaggauaaucccuacaagacgugggccuaccacgguuccuaugaagugaagccuuccggcuccgcuucguccauggucaauggcguggugcgguugcuaacuaagccuugggacgucauccccaugguuacccagaucgccaugaccgacacgacaccuuucgggcaacagcgggucuucaaggagaagguggauacccguacaccgaaggcgaagaggggcaccgcacagaucauggaggucacggcccgauggcuguggggguuccuuucucggaauaagaaaccucgcaucugcacacgcgaggaguucaccaggaaaguccgaagcaacgccgcaaucggggccguuuucguugacgaaaaucaguggaacucagcuaaagaagccgucgaggacgaacgcuucugggaucuggugcaccgggagagggagcugcacaagcaggguaagugugcgaccuguguguacaacaugauggggaaacgcgagaagaagcucggcgaguucggcaaggcgaaaggcagccgcgccauaugguacauguggcugggcgccagguuccuggaauuugaggcccuaggguucaugaacgaggaccacugguucucgcgcgaaaauucccucuccggcguagagggggagggccugcacaagcucggguacaucuuacgggacaucagcaagaucccgggagguaauauguaugcagacgacacggccggaugggacacucgcauaaccgaggacgaucugcaaaacgaggccaagaucaccgacaucauggaaccggagcacgcguugcuggccacuucgaucuuuaaacucacauaccaaaacaagguuguucggguacagagacccgcaaagaacggaaccgucauggacguaaucagucggcgcgaccagcgggggucaggccaagugggcaccuaugggcuuaauacguucacaaacauggaggcgcaacugauccggcagauggagagcgagggcaucuucacccccagugaacuggaaacuccuaaucucgcagagcggguccuggacuggcuggagaagcacggcauugaacgucucaagcgcauggcuaucagcggcgacgacugcguggucaaaccgaucgacgaucgguucgcgacggcuuuaacggcgcugaacgacaugggaaaggugcgaaaggacaucccccagugggagcccuccaagggcuggaacgacuggcaacaaguccccuucugcagccaccacuuccaccaguugauaaugaaagauggacgggagaucgucguaccgugucgcaaucaggacgagcugguggggcgggcccgcgucagucagggcgccggguggucauuacgggagaccgccugcuuagguaaguccuaugcacagauguggcagcugauguauuuccacagacgcgaccuucgacucgccgccaacgccaucugcuccgccguucccgucgauugggucccgacaucccggacgaccugguccauacacgcgcaccaccaauggaugacaacugaggacauguuaaguguguggaaccgaguguggauagaggagaaccccuggauggaagauaagacacaugucuccucgugggaggacgugccguaucucgggaagagagaagaccaguggugcggcucacucaucggccuaacggcccgagcaaccugggcuacuaacauucaaguggccauaaaucagguccggcgccugaucggaaacgagaacuaccucgacuauaugacuucuaugaaacgcuuuaagaacgaguccgacccugagggcgcgcuuugguga

SEQ ID NO: 24695 - RNA, 9879 nt, Artificial Sequence
  derived and/or modified CDS sequence (opt11) from DENV-1__KC762640__SS-prME
agugucaccaugcugcucaugcuucugcccacugcucucgccuuucaccugaccacccggggcggggaaccccauaugaucguguccaagcaagagaggggcaagagccucuuauucaaaaccuccgccggggugaacaugugcacccugaucgcuauggaccugggcgaguuaugcgaagacacuaugaccuacaagugcccccgcaucaccgagaccgagcccgacgacguggacugcuggugcaacgcuaccgagaccugggugacuuacggaaccugcucacagaccggggaacaccgucgugauaaacguuccguggcccuagcgccccacgugggucugggguuggagacccgcacggagaccuggaugagcagugagggcgcguggcggcagauacaaaagguggagacgugggcccugcgccauccgggguucaccgugaucgcccuguuccucgcccacgccaucgggaccagcauuacccagaaggggaucauuuucauucugcugaugcucgugacgcccucaauggccaugcggugcguuggcaucggcaaccgcgacuucguggagggccugagcggagccaccuggguggacgucgugcuugagcacggcuccugcguaaccaccauggccaaggacaagcccacgcuggacaucgagcugcugaagaccgaagucaccaaccccgcggugcuccggaagcugugcaucgaggcaaaaaucucuaacaccacgacggacucccgcugccccacucagggcgaggccacccucguagaggaacaggacacgaacuucgucugcaggcgcaccuucguggaccgggguugggggaaugggugcggccuuuucggaaaggggagccugaucacgugcgccaaguucaagugcgucaccaagcuggaaggaaagaucguccaguaugagaacuugaaauacuccgucaucguaacgguccacaccggcgaucagcaccaggucgggaacgagaccaccgagcacggcaccacggccaccauuacgccccaggccccuaccucggagauccagcugacggacuacggggcgcuuacccucgacuguaguccccggaccggcuuagacuucaacgaaauggugcuccucaccaugaaagagaaauccuggcuugugcacaagcagugguuccuagaccugccgcugccguggacguccggggcaagcaccagucaggaaaccuggaaccggcaggaucuguuggucacguucaaaacggcccacgcaaagaagcaggaagucguagugcugggcucccaggagggcgcaaugcacaccgcguuaaccggggcaaccgagauccagacgucaggcaccaccacgaucuucgccgggcaucucaagugccgccugaaaauggacaagcugacgcuaaagggcguuuccuacgugauguguaccggauccuucaaacuggagaaggagguggccgaaacccagcacggcaccguccugguccaggugaaauacgagggcacugacgcccccugcaagauaccauucucaagccaggacgagaaagggguaacucagaauggccggcuaaucacagcgaacccgaucguaaccgacaaggagaagcccgugaauaucgaggcugaaccaccauucggggagaguuacuugguugugggagccggagaaaaggccuuaaaacugagcugguucaagaagggguccagcaucgggaagauguuugaggcgacggcgcgcggagcgcggcgcauggccauccucggcgacaccgccugggacuuuggcuccaucggcggcguguucacuuccgucgguaagcuaauacaccagaucuucggcaccgcguauggggugcuguucaguggcgugagcuggacgaugaagaucgguaucggcauacuacuuacaugguuaggccucaacucccgcucaaccucccugagcaugaccugcaucgccgucgguaugguaacgcuguaccuuggaguaaugguccaggccgauuccggaugcguuaucaauuggaagggcagagagcugaagugugggagcggcauauucguaaccaacgagguccacacauggaccgaacaguacaaguuccaggccgacagcccgaagcgcuuaagugcugcaaucggcaaggccugggaggaggggguaugcggcauccgaagcgccaccaggcucgagaacauaauguggaagcagaucuccaacgaauugaaccacauccuguuggagaaugacaugaaguuuaccguggucgugggggaggugaacggcaucuuagcucaggggaagaaaaugauccggccucagcccauggagcauaaauacagcuggaaguccuggggcaaggcuaaggucauuggcgcugacguucagaacacuacguucauaaucgacgggcccaacacccccgaauguccggauaaccagcgcgccuggaacaucugggagguggaggacuacgguuucgggaucuuuacgacuaacaucuggcugaagcuccgggacuccuacacacagguaugcgaccaccgccuuauguccgccgccauaaaggacaguaaggcgguccacgcggacauggguuacuggaucgaguccgagaagaacgagaccuggaaguuggcccgggcaaguuucaucgagguuaagacgugcauauggcccaagucccauacccugugguccaacggcguccuggaguccgaaaugauuauccccaaaaucuacggggguccaaucagccagcacaacuaccgcccaggguacuuuacccagaccgccgggcccuggcauuuagggaaguuggagcucgacuucgaacuaugcgagggcacuaccgugguggucgaugagcacuguggcaacagagggccgucacuccgcaccaccacggugaccggcaagaucauccacgaguggugcugucggagcugcacauugccuccguuacgauucaagggggaggacggcugcugguacgguauggagauccguccagugaaggagaaggaggaaaacuuaguuaaauccauggugagugcuggcagcggcgagguugacucuuucucucuggggcugcucugcauuuccauaaugauugaggaagucaugcgcagccgguggucgagaaagaugcugaugaccggcacgcuggccguguuccuccuuuugaccauggggcagcucaccuggaacgaccugauccggcuuugcaucauggugggggcuaacgccagcgacaaaauggggaugggcacgaccuaccuugcccugauggccaccuuccgcaugcgcccgauguucgccgucggccuccuguuccggagauugacaagucgggagguucugcucuuaaccgucgggcugagucuaguagcauccguagaauugccuaacucacuggaggaacucggcgacggucuggccaugggaauaaugauguuaaagcuccucacggauuuccagucgcaucagcucugggccgcacuccugucgcuuaccuucgucaagaccacccucucccuacacuacgcguggaagacgauggccaugauacugagcaucgugucccucuuuccccugugucugagcacaaccucucagaaaaccacgugguugcccguccugcuuggcagucuggggugcaagccgcugacgauguuccugaucaccgagaacaagaucuggggccgaaaguccuggccgcucaaugaggggaucauggcugucgggaucgugagcauccugcugagcucccuccugaagaacgacgugccgcuggcggguccccuuaucgccgguggcaugcugaucgccuguuaugugaucagcggguccagcgcagaccugucccuugagaaggccgcggaggugagcugggaagaggaggccgagcauuccggcgccucgcacaacauccugguggaaguccaggacgacgguacuaugaagaucaaggacgaagagagagacgacacucugacuauccuccugaaagccacccugcucgcuaucaguggcguguacccgaugagcauccccgcaacacucuucgugugguacuucuggcagaagaagaagcagcguucggggguccugugggacacccccagcccgccggagguggaaaaggccgugcuggaugacggaaucuaccggauccuccagaggggccugcuggguaagucucaggugggcguugggguguuccaggaggguguuuuucacaccauguggcaugugacccgaggggcugugcucauguaccaggggaagcgccuggagccgagcugggcgucugucaagaaagacuuaauaucauacgguggugguuggcgguuccagggguccuggaacaccggcgaggagguccaggugauugccgucgagcccgggaagaacccgaagaacgugcagaccgcgcccgguacguucaagacccccgaaggcgagguuggcgccaucgcccucgacuucaagcccggcaccucagggucccccaucgucaacagggaggggaagaucgucggccuguacgguaacggcguggucacuacgagcgguacguacgucuccgccaucgcccaggcgaaggccucccaggagggcccgcugcccgaaaucgaggacgagguguuucggaaacgcaaucucaccaucauggaccugcaccccgggagcggcaagacccggcgcuaccugccggccauaguccgggaagccauaaagcgcaaacuccggacgcucgugcuggcucccaccagaguggucgccucggaaauggccgaggccuugaagggcaugcccauuagguaccagaccacagccguaaagucugagcacacugggaaggagauaguggaucuaaugugccaugcgaccuucaccaugcgccuuuuaucccccguccgcgugccaaauuacaacaugaucaucauggacgaggcccacuucaccgaccccgccagcaucgccgcucgggguuacaucucgacgcgagugggaaugggcgaggcugccgccaucuucaugaccgcgacgccgccagggagcauggaagccuucccgcaguccaacgccgccauccaagacgaggagcgggacauccccgagcgcucguggaacucuggcuacgauuggauaaccgacuuucccgggaagacggucugguucgugcccagcaucaaauccgggaacgacauugccaauugccuuaggaagaacggcaagcgcgugauccagcuuucgagaaagacuuuugacacagaguaccaaaagaccaagaauaaugacugggacuacgucgugacaaccgacaucuccgagaugggcgccaacuuccgcgcggaccgggugaucgacccacgccggugucucaaaccagucauacugaaggacggucccgagcgcgugauuuuggccgggcccaugccggugaccguggccagcgccgcucaacggcgcggcagaaucggccgcaaucaaaacaaggagggcgaccaauacaucuacaugggucagccgcucaacaacgacgaggaccacgcgcacuggaccgaggccaagauguugcuggacaacaucaacacgcccgagggcaucauccccgcucucuucgagccggagcgggagaaguccgcggccaucgacggcgaguaccgccugcgcggagaggcucgcaagacauucguggagcuaaugcgucggggcgaccuccccgucuggcuguccuacaagguggccagugagggguuccaguauagcgaccguagguggugcuucgacggggagcgaaacaaccagguuuuagaggagaauauggauguugagaucuggaccaaggaaggagaacgaaagaaguugcgcccccgguggcuggacgcccgcaccuacagcgacccgcuggcacuccgggaguucaaggaguucgccgcgggaaggcgguccguguccggcgaccugauacuggagaucggcaagcucccacagcauuugacucagcgcgcccagaacgcgcucgauaaccugguuaugcugcacaauucugagcagggcggcaaagccuaucggcacgcgauggaggagcugcccgacaccaucgagacccucauguugcuggcccucaucgccguccuuaccgguggcguaacccucuucuuccugucggggcgcggacugggcaagacgagcaucggauugcuaugcguaauggcaaguagugcccuguuauggauggcgagcgucgaaccccauuggaucgcggccuccaucauccucgaguucuuccugauggugcugcucauacccgagcccgaucggcagcgcacaccccaggacaaccaguuggccuauguggugaucggccuccucuucaugauccugaccguggcagcgaacgagaugggccugcuugaaaccacaaagaaagaccugggcaucggacacgccgccgcagagaaccaucaccaugccgcuaugcuagauguugaccuccacccugccagcgcuuggacuuuauacgcugucgcgacuaccauaaucacgccgaugaugcgucacaccaucgagaacaccaccgcgaauaucuccuuaaccgcuaucgccaaccaggccgcgauacuuaugggccuggacaagggcuggcccaucagcaagauggauaucggggugccacugcucgcccugggcugcuacucccaggugaacccccugacccucacggccgccguccugaugcugguggcccacuacgcgaucaucgggccgggcuugcaagccaaggcuacccgcgaggcccagaagcggacggccgcggggaucaugaagaaccccaccguggacggcaucgucgccauugaccuggaccccgucguguacgacgccaaguucgaaaagcagcugggccagauuaugcuccugaucuuaugcacaucgcaaauccuccugaugcggaccaccugggcacugugugaauccaucacgcucgccaccgggccccuaaccacgcugugggaggggagcccagggaaguucuggaauacuacgaucgccgucuccauggccaacauauucaggggcagcuaccucgccggggccggccuggcguucucacucaugaagucccucgggggcggccgccgcgguaccggcgcacagggcgagacgcugggggagaaguggaagcggcagcugaaccagcucaguaaguccgaguucaacaccuacaaacgcagcggcauuauggagguugaccguuccgaggccaaggaggggcuaaagcggggugagacgaccaagcacgccgugagccgggggacggccaagcugcgcugguucgucgagcgaaacuuggugaagcccgaggguaaggugaucgaucucggcugcgggcgcggcggauggagcuacuauugcgccggccugaaaaaggucaccgaagugaagggguacaccaagggcggccccggacacgaagaaccuaucccgauggccacuuacgguuggaaucuagugaagcuguacagcgggaaagacgucuucuucacgccgcccgagaagugcgauacucugcugugcgacaucggcgaauccagcccaaauccgaccaucgaggaggggcggacccuccgcgugcugcggaugguggagccauggcugcgcggcaaccaguucugcauaaagguccucaaccccuacaugcccuccgugaucgagacccuggagcagaugcagaggaagcacggcgggaugcuggugcggaauccgcugagccggaacagcacgcacgaaauguacugggucagcugcggcaccgggaacaucgucuccgccgugaacaugaccucacgcauguuacugaaccgguucaccauggcccaucgcaagcccacguaugagcgggacguagaccucggugccggcacacgccacguggcgguggagcccgagguggccaaccuugagaucaucgggcagcggauagagaauaucaagaacgagcacaaauccaccuggcacuacgaugaggauaaccccuacaagaccugggccuaccacggcagcuacgaggugaagcccagugguagcgcaucaagcaugguaaacggcguugugcgguuauugacgaagcccugggacgucauccccauggugacacaaaucgcgaugacugacacgacccccuucgggcagcagcgcguguuuaaggaaaaggucgacacccggacccccaaagcgaagcgcggcacugcccagaucauggaggugacugcacgauggcuguggggguuccugucgcguaacaagaagccccggaucuguacgcgcgaggaguuuacucguaaggugcgcuccaacgccgcgaucggggccgucuucguggacgagaaccaguggaacuccgcaaaggaggccguggaagacgagagauucugggaccucguccaucgugagcgggagcugcauaagcagggcaagugcgcgacaugcguguacaacaugauggggaagcgggaaaagaagcugggcgaguuuggcaaagcgaagggcucccgggcuaucugguacauguggcucggcgcuagauuccuggaauuugaggcccuggguuucaugaacgaggaccacugguucagccgcgagaacucccugucagguguggagggggaaggccugcacaagcugggguauauccuaagagacauuucuaaaauccccggcggcaacauguacgccgacgacacggcggggugggacacccggaucacggaagacgaccugcagaaugaggcgaaaaucaccgacauaauggagccugagcacgcccugcucgccacgagcaucuucaagcugaccuaccaaaacaaggucguacgcgugcagcggccagccaagaacggcaccgucauggacgugaucucccgccgcgaucagcgggggagcggccaagugggcacuuacgggcugaacacguucacuaacauggaggcccagcucaucagacagauggaguccgaggguaucuucacucccagcgagcuagagaccccuaaccuggccgagcggguccuugacuggcuggagaaacacgggaucgagcgccugaagcggauggcgaucuccggcgacgacugcguggugaagccgaucgaugaccguuucgccacggcacuuaccgcguuaaacgacaugggcaaaguccgaaaggacaucccccagugggagcccagcaagggguggaaugacuggcagcaggucccauucuguucccaccacuuccaccagcugaucaugaaggacggcagagagaucguaguuccgugccgcaaucaggaugaacucguugggcgcgcccgggugagccaaggcgccggguggucccugcgcgagaccgccugccugggcaagucuuacgcgcagauguggcaguugauguacuuccaccggcgcgaccugcgguuggccgccaacgccaucugcagcgccguccccguugacugggugccaacuucccgcacgaccuggagcauccaugcgcaccaccaauggaugaccaccgaagacaugcucucagucuggaaucguguuuggaucgaagagaaccccuggauggaagacaagacccaugugucgucaugggaggacgugccguaccugggcaagagagaggaccaguggugcggcucgcugaucggccucacagcccgggcaaccugggccaccaacauccaaguggccaucaaccaggugcgucgccugauagggaacgaaaacuaucuagacuacaugaccuccaugaagcgguucaagaacgagagcgaccccgagggcgcacucugguaa

SEQ ID NO: 24696 - RNA, 9879 nt, Artificial Sequence
  derived and/or modified CDS sequence (opt11) from DENV-1__KC762645__SS-prME
agcgugaccaugcugcugaugcucaugccgaccgcgcuggccuuccaccucaccacccggggaggugagccccauaugaucgugagcaagcaggagcggggcaagagccugcuuuucaagaccucugcaggggugaacauguguacccuaaucgccauggaccugggcgagcugugugaggacacgcucaccuauaagugcccccggaucaccgaggccgagccggacgacguggacugcuggugcaacgcaaccgacacauggguaaccuacgggaccugcucucagaccggugagcaccggcgcgacaagcggaguguggcccuggcgccgcacguaggccuggggcucgagacgcgcaccgaaacauggaugagcucggagggcgcguggaggcagauucagcggguagaaaccugggccuugcggcaccccggguuuacggugaucgcucuauuccuggcgcacgcaaucggaaccagcaucacucagaaagggauaaucuucauauugcugaugcucgugaccccauccauggcgaugcgcugcgucggcaucggcagccgggauuucguggagggacugucgggcgccacguggguugacgucgugcuggagcacgggucuugcguaacgaccauggcgaaagacaagccuaccuuagauaucgagcuguugaagacggaaguuaccaauccugcggugcuccgcaagcuaugcauagaggccaagaucuccaacaccacuacggacucgaggugcccgacccaaggcgaggccacucucgucgaagagcaggacgccaacuucgucugccgucggacauucguggaccgcggcugggggaacggcugugggcuguucggcaagggaagccugaucacgugcgccaaguucaaaugcgugacaaagcuggagggcaaaauaguucaauacgaaaaccucaaauacuccgugauugugacaguccacaccggcgaccagcaccagguggggaacgaguccacggagcacggcaccaccgcgaccaucacgccccaggcccccacuacggagauucagcugacagauuacggcgcccugacccucgauugcucucccagaacaggccuggacuucaaugagaugguccugcucaccaugaaggaaaagucuuggcuggugcacaagcagugguuccuggaucucccccugcccuggacgaguggggccagcaccagucaggagacguggaaccgccaagaccuguuggugacguucaagaccgcgcaugcgaagaagcaggaagucguaguccucggcagccaggagggagccaugcauaccgcucugacgggggccaccgagauucaaaccagcggcaccacgaccaucuucgccgggcaccucaaaugccgguugaaaauggauaagcugacccucaagggcaugagcuacgucaugugcaccggguccuuuaagcuggagaaggagguagcggaaacgcaacacggcacagugcugguccagaucaaauacgagggcacagacgcacccugcaaaauccccuucagcacccaagacgagaaaggggugacacaaaauggucgcuuaaucacugccaacccgaucguaacugacaaggagaagcccguuaacauugaggccgagccgcccuucggcgagucuuacaucguaauuggcgcgggcgaaaaggcgcuaaagcugagcugguucaaaaaggguuccagcaucggcaagauguucgaagccacagcccgcggggcacgccggauggcgauacugggagacacugccugggacuucggcuccauuggcggcguuuucacaucugucgggaaacucgugcaucagaucuucggcaccgccuauggcgugcuguucucaggcguuagcuggaccaugaagaucgggaucggcgugcugcuaacguggcuggggcugaacagcaggagcacaaguuuaucaaugaccuguaucgcuguggggcuggucacccuuuaccucggcgugauggugcaggcugauuccgggugcguaauaaacuggaaaggacgagagcugaagugcgggagcggcaucuucguaaccaacgaggugcacacguggaccgagcaguacaaguuccaggcagauagcccgaaacggcuuuccgcugccauaggcaaggccugggaagaagggguaugcggcauccgcagcgccacgcggcucgagaacaucauguggaagcagaucuccaaugagcugaaccacauccugcucgagaacgacaugaaguuuacagugguagucggugacguggcgggcauccuggcccaagggaagaagaugauccgcccccagccuauggagcacaaauacagcuggaaguccuggggcaaggccaagaucaucggggccgacgugcaaaacacgaccuuuaucaucgacgggcccaacaccccugagugcccugacgaccagagagcguggaauaucugggagguggaggacuacggauucggcaucuucaccacgaacauaugguugaaacuccgagacucuuacacccaggugugcgaccaccggcugauguccgccgccauuaaggacagcaaggccgugcacgcugacaugggguauuggaucgaguccgagaaaaacgaaaccuggaagcuggcccgcgccagcuucaucgagguaaagaccugcaucuggccaaagucucacacgcuuuggagcaacggggugcuggagucagagaugaucaucccaaagaucuacggagguccgaucagccagcacaacuaccggcccggguacuucacccagacugcagguccuuggcaccuggggaagcucgagcuggacuucaaccucugcgaaggaaccacggucgucguggaugagcacugugguaaccgcgggccgucccuccggaccaccaccgugacgggcaagaucauacacgaguggugcugccguucuugcacccugccgccacugcgguuucgcggcgaggacggcugcugguaugggauggagauccggcccgucaaggagaaggaggagaacuugguuaaauccauggucagcgccggcucgggcgaggucgacuccuucagccugggacugcucugcaucucaauuaugaucgaggaggugaugagaagccgauggucacggaagauguugaugaccgggacucuggccguguucuuccuccugaucaugggccaguugacguggaacgaccucauccgccuguguaucaugguaggcgcgaacgccagcgauagaauggggauggguaccaccuaccuggcccucauggcgaccuucaagaugaggccgauguucgcaguaggucugcuguuccggcgcuugacgucccgggaggugcuacugcucaccauuggucugagccuggucgcguccguggagcuucccaacucccuggaagagcugggcgacgggcuggccauggggaucaugauccugaagcuucucaccgacuuccagagucaccagcugugggccacucugcuuagcuugacguucaucaagaccacuuuuucccuacacuacgccuggaaaaccauggcgaugguacucagcauuguguccuuguuuccccugugccuaaguacaaccucccagaaaaccaccugguuacccguguugcucggcagcuugggaugcaagccguugacgauguuccucaucgccgaaaacaagaucuggggccgcaaguccuggccgcugaaugaagggaucauggcagucggaaucgucagcauccugcucagcucccugcugaaaaacgacguaccccucgccgggccccugaucgcggggggaaugcugaucgcgugcuacguaauuagcgggagcagcgcagaccuaucccuugagaaggccgccgaaguaagcugggaggaggaggccgagcacucuggcgcuagccacaacauccugguggagguccaagacgacgggacuaugaagauaaaagacgaggagcgggacgacacgcucaccauccugcugaaggccacccucuuggccguuuccggcguguacccguuaagcauccccgcgacccucuucgugugguacuucuggcagaagaagaagcagcgcucagggguguugugggacaccccguccccccccgagguggagagagcuguucuggaugauggcauauaucggaucaugcagcggggccugcucgggcgcucccaagugggcgugggggucuuccaggagaacguguuucacaccauguggcacguuacccggggcgccgugcugauguaccaaggcaaaagacuggagccuagcugggccuccgucaaaaaggacuugaucagcuacggcggaggguggcggcuacagggcuccuggaacacgggggaggaagugcaggucauagcaguugagcccggcaagaacccuaagaacgugcagaccgcccccgggaccuucaagacccccgagggcgaggucggugccaucgcguuagacuucaagcccggaacuagcggcucccccaucguuaaccgcgaggggaagauaguggguuuguacggcaacgggguugugacgacaagcggcaccuacgugagcgcaaucgcgcaggccaaggcuucccaggaagggccgcugcccgagaucgaggacgaggucuuccggaagcgcaaccugacgaucauggaccugcacccugggagcgggaagacacggcgcuaccuuccggccauugugcgggaagccaucaagcgcaagcugcgcacccucauccuggcccccacgcggguggucgccuccgaaauggcugaggcccugaagggcaugccuauccgcuaucagacgaccgccgucaagucggagcacacgggcaaggagaucguggaccucaugugucaugcgacauucaccaugcggcugcucucucccgugcgcguuccgaauuacaacaugaucauaauggacgaggcgcacuucaccgaccccagcuccaucgcggcccggggguacaucagcacccgagugggaaugggggaggcagccgcaaucuuuaugacugcaacgccgccaggcuccgucgaggccuucccgcaaagcaacgccgugauucaggacgaggagagagacauaccggagcgcuccuggaacagcggguaugaguggauaaccgacuuccccggcaagacagucugguuuguucccuccaucaagagcggcaacgacaucgccaacuguuugcggaagaacgggaagcgagugauucagcuaagucggaagaccuucgacacggaguaccagaagaccaagaacaaugacugggacuacguggucacgaccgacaucagcgagaugggcgcgaacuuccgcgccgaccgggugaucgacccuaggaggugccugaagcccguuauccucaaggacgggcccgagagagucauccuggcaggccccaugccgguuaccgucgccuccgccgcccaacggcgcggcagggugggccgcaaucacaacaaggagggcgaccaguacaucuacaugggccagccccugaacaacgacgaggaccacgcccacuggacugaggccaagaugcuccuggacaacaucaacacucccgaggggaucauccccgcccuguucgagccggagcgcgagaaguccgccgcgauugacggugaguaccggcuccgcggcgaggccagaaagacauucguagaacugaugcgccgcggggaccuccccgucuggcucuccuacaagguggccagcgagggcuuccaguacagcgaccgcagguggugcuucgacggcgagcgcaacaaccagguguuggaggagaacauggacgucgagauuuggacgaaggagggcgagcggaaaaaacugcgcccccguugguuagacgcccgcaccuacuccgacccccuggcgcugcgggaauucaaggaguucgcggccggccgccggagcguguccggugaccucauucuggagauaggcaaacugccgcagcaccuaacccaacgcgcccaaaacgcucuagauaaccugguuauguuacacaacucagagcagggcgggcgugcuuaccgccacgccauggaggagcugccagauaccauagagacgcugauguuguuagcccugaucgccguccucaccgguggggugaccuuguucuuccuguccggccggggacucggcaagacgucaaucgggcuguuaugcgugauggccagcagcguccuccuguggauggcguccguccagccccacuggauugcugccucaaucauccuggaauucuuucugaugguccugcuaauucccgagccggaccggcagaggacgccccaagauaaccagcuggccuacgucgugaucggucugcuuuucaugauccucacuguggcggcgaacgagaugggccugcuggagaccaccaagaaggaccucggaauuggccacgucgccgucgagaaccaccaccacgccgccauguuggauguagaccugcaccccgccagugcguggacacucuaugccguagccacgaccauaauuacuccgaugaugcgccacacuaucgagaacacuaccgccaauauaucauugaccgccauagcgaaucaggcagcuauauugauggggcucgacaaaggcuggcccaucucgaagauggacaucggugugccucugcuggcacucgguugcuauucucaggugaauccucugacccuaacggcugccguccucaugcugguugcccauuacgcaaucaucgguccggggcuucaggcaaaagcgacuagggaggcccaaaagcggaccgcugcgggcaucaugaagaauccuacaguugacggaaucgucgccauugaccucgaccccgucguguaugacgcgaaguucgaaaaacaacugggccagaucaugcugcucauucugugcacaucccaaauccuacucaugcgcaccaccugggcacuaugcgagagcaucaccuuagccacaggcccccugacaacgcugugggagggaagcccgggcaaguucuggaacacaacgaucgccgucagcauggcgaacauuuuccguggcuccuaccuggcgggcgcaggacucgcuuucagccugaugaagucccucggugguggccgucgggggaccggggcucagggcgagacccucggcgaaaaauggaagcgucagcugaaccaacugucaaagagcgaguucaauaccuacaagcggucgggcauaauggagguugaccgauccgaggccaaggagggcuugaagcgcggggagacgaccaagcaugcgguaucccgcggaaccgccaaacugcgaugguucgucgagcgcaaccugguaaagcccgaggggaaagugaucgacuuaggcugcggcagagguggguggucuuacuauugugccgggcucaagaaaguuacugagguuaagggauacaccaaaggcggaccgggucacgaggaacccaucccgauggcaaccuacgguuggaaccuggugaagcugcacuccggcaaggacguguucuucauaccgcccgagaaaugugacacgcuccugugcgacaucggggagagcucccccaacccgaccaucgaggaaggccgcacccugagggugcucaagaugguggaacccuggcuacgcgggaaccaguucugcaucaagauccugaaccccuacaugcccucagucguggagacucucgagcaaaugcagcggaagcacggcggcaugcucgugcggaauccgcugucccggaauagcacccacgagauguacugggucuccugcgggaccggcaacauagugagcgcggugaauaugaccucccguaugcuccugaaccguuucacgauggcucaccggaagcccacauacgaaagagacgucgaccugggggccggcacccgacacguggccgucgagcccgaggucgccaaccuggacaucaucggucaacggaucgagaauaucaaacacgagcacaagagcaccuggcauuacgacgaggauaaccccuacaagacgugggcguaccacggauccuacgaggucaagccgagcggcucugccagcucgauggucaacggcguaguaaagcugcugacgaagccuugggacgucauccccaugguaacccagaucgccaugaccgacacgaccccauucggccagcagcggguguuuaaggagaaggucgauacccgcaccccgaaggccaagcgugggacgacccaaauaauggaggucaccgcccgcuggcucuggggguuccuaucccggaacaagaaaccucgcauauguacgcgggaggaauucacgcgcaagguucggagcaacgcugccaucggcgccguauucguugacgagaaccaguggaacuccgcaaaggaggcgguggaggacgagcgcuucugggaccugguacaccgggagcgcgagcugcauaagcaggggaagugcgcgaccugcguauacaauaugaugggcaagagagagaagaagcugggggaguuuggaaaagccaaggggagccgcgccaucugguacauguggcuuggagcccgguuccucgaguucgaggcgcugggcuucaugaacgaagaucacugguucucccgcgaaaacagcuuauccgggguggagggcgagggccuccauaagcucggcuacauccugcgagacaucagcaagauccccgggggcaacauguacgcggacgacaccgccggaugggacacuagaaucacugaggacgaccuccagaacgaggccaagaucaccgacaucauggagccagagcacgcgcugcuagcgaaggccaucuuuaagcucacauaccagaacaaagucgugcgcgugcagcggcccgcuaagaaugggaccgugauggaugugaucucccgccgggaccagcgcggcagcggccaggugggcacguacggccugaacaccuucaccaauauggaggcccaacugauucgccagauggagagugaggggaucuucucuccuuccgagcuagagacccccaaucucgccgagaggguccuagacugguuagagaaauacggcgucgagcggcugaagcgcauggcgaucagcggggacgauuguguggucaagccuaucgacgaccgguucgccacggcccugaccgcccucaaugacaugggcaaggugcggaaggauaucccccagugggaacccuccaagggguggaacgacuggcaacagguaccuuuuugcucccaccacuuccaccagcucaucaugaaggacggccgggagaucgucgugccgugccgcaaccaggacgagcuggucggcagagcgcgcgucucccagggggcggguuggagccuccgggagacggccugucugggcaagucguacgcccagauguggcagcugauguauuuucaccgccgggacuuacgucuggccgcaaaugccaucugcucggccgugcccguagacuggguacccaccagccggacgaccugguccauacacgcccaccaccaguggaugaccacugaagacaugcugucgguuuggaauagaguguggaucgaggaaaaccccuggauggaggacaagacgcacaucaguagcugggaggaugucccguaccucggcaagcgcgaagaucaguggugugggucccugaucggucugacagcccgggcgaccugggcgaccaacauucagguugcgaucaaccaagugcgccggcucauaggcaacgaaaacuaccuggacuacaugaccagcaugaaacgcuucaagaacgaauccgaccccgagggugcacugugguga

SEQ ID NO: 24697 - RNA, 9879 nt, Artificial Sequence
  derived and/or modified CDS sequence (opt11) from DENV-1__KC762628__SS-prME
agcgugaccauguugcucauguugcugcccacggcccucgccuuccaccugaccacccggggcggcgagccccacaugaucguuagcaaacaggagcggggcaagagccuccuguucaaaacgagcgcuggggugaacaugugcacacugaucgcuauggaccugggcgaacucugcgaggacaccaugaccuacaagugcccccgcaucacugagaccgagcccgacgauguagacugcuggugcaacgccaccgagacaugggugaccuacgggaccugcagccagaccggagagcaccgaagggacaagcgguccguggcccuggcgccccacgugggccugggucucgaaacccgcaccgagaccuggaugagcuccgagggcgcguggcggcagauccagaagguagagacgugggcccuccgccaccccggguucaccgugaucgcccuguuucucgcccaugcgaucggcaccagcaucacccagaaggggauuaucuucauccugcugaugcucgugacgcccuccauggccaugcggugugucggcauaggcaaccgcgacuucguggaggggcugaguggcgccacguggguggacgucgugcuggagcacgggagcugcguuaccacaauggccaaggacaagccgacgcucgacaucgagcugcugaagacagaggucaccaaccccgccgugcuacggaagcugugcaucgaggcgaagauaagcaacaccacgaccgacucccgcugccccacccaaggcgaggccacccuggucgaggagcaggacacgaacuucgucugccggcgaacauucguagaccggggcuggggcaacggcugcggccuuuucggcaaggggagucugaucaccugcgccaaguucaagugcguuacgaagcuggagggcaagaucguccaguacgagaaccucaaauacuccgugaucgucacaguccauaccggagaucagcaccaaguggggaacgagaccaccgagcacggaacaacggcgaccaucacaccccaggcccccacaucagagauacaguuaaccgacuacggcgcgcugacccucgauugcagccccaggaccggccuggacuucaacgagaugguccuacucaccaugaaggagaaguccugguuggugcauaagcagugguuccuggaccucccacugccauggacgaguggggccucgaccucucaggagaccuggaaccggcaagaccuguuagugaccuucaagacggcccaugcuaagaaacaggagguggugguauugggcucccaggagggcgcgaugcacaccgcguugaccggggcaaccgagauacagacgucuggcacuaccaccaucuucgccgggcaucucaagugccgccugaagauggacaagcuuacacuaaagggagucucauacguaaugugcacggguagcuucaagcuggagaaggagguggccgagacgcagcacggcaccguccugguccaggugaaguacgaggggacggacgcccccugcaagauccccuucuccagucaggacgagaagggaguaacccagaacggcaggcuuaucaccgcgaacccgauagugaccgacaaggagaagcccguaaacaucgaagccgagccgccguucggggaguccuaccucgucguaggcgccggcgagaaggcccugaagcugagcugguucaagaagggcucuucgaucggcaagauguucgaggcgacugcccgcggagcccggcgcauggccauccucggcgacaccgcuugggacuuuggauccaucgggggaguguucaccagcgucgggaagcugauucaccagaucuuuggcaccgcguacggggugcuguucucaggcguaucauggacgaugaagaucgggaucggcauccuccugaccuggcuuggccucaacucccgaagcaccucccuauccaugaccuguaucgccgucgggauggugacgcuuuaccucggcgugaugguccaggcagauucagggugcgugauuaacuggaaagggcgggagcugaagugcgggagcggcaucuucgugaccaacgaggugcauaccuggaccgaacaguacaaguuccaggccgacagccccaagaggcuguccgcugcaaucgguaaggcgugggaggagggggugugcgggaucagaagcgccacccgccuugaaaacauaauguggaagcaaaucuccaacgaacugaaccacauccugcucgagaacgacaugaaguucacgguggucgugggcgaggugaacggcauccuagcgcagggaaagaagaugauccggccccagcccauggagcacaaguacagcuggaaguccuggggcaaggccaaggucaucggcgcugacgugcagaacaccaccuucaucaucgacgggcccaauacuccggagugccccgacaaccaaagggcauggaacaucugggagguggaggacuacggcuucgggaucuuuacgacgaacaucuggcugaagcuccgggauaguuacacucaggucugcgaucaccgucugauguccgcagcaauuaaggacagcaaggccgugcacgccgacaugggcuacuggaucgagucggagaaaaacgagaccuggaagcuggcccgggcaucauucauagaggugaagacgugcaucuggcccaaaucccauacccuauggagcaacggcguccuggaaucagagaugauaauuccaaagaucuacgggggaccgaucagccagcacaacuaucgccccggguacuuuacucagaccgccggccccuggcaucuggggaagcucgagcuggacuucgagcugugcgagggcacgaccgugguggucgacgagcacugcggcucccgggggccgagccuccggaccaccacggugacugguaagauuauccacgaguggugcugccgguccuguacccugccgccgcugcgcuucaagggggaggacggcugcugguacgggauggagauccggcccgugaaagaaaaggaggagaaccucgucaagagcauggugagcgcgggcuccggcgagguggacuccuucucccuggggcugcucugcaugagcaucaugaucgaagaagucaugcgcucacgguggagccgcaagaugcugaugaccgggacauuagcuguguuccuccugcugacuaugggucagcucacauggaacgaccugauucggcuguguaucauggugggcgccaacgccuccgauaagauggggauggguaccacccaccuagcccugauggccaccuuccgcaugcgcccgauguucgcggucggacuccuguuccggcgccugaccucgcgggaggugcugcugcugacgguggggcugucccucguagcgagcguagagcugcccaacucccuggaggagcugggcgauggucuagccaugggcaucaugauguuaaagcuccugacggacuuccagagccaccagcugugggcugcgcuccugucacugacuuucgucaagaccacccucagccugcacuacgccuggaagacgauggcgaugauccugucuaucgucagccucuuccccuugugcuugucgaccacuagccagaagacaacguggcuccccgugcugcucgggucccucgggugcaagccgcugaccauguuucugaucaccgagaacaagaucuggggccgcaagucguggccccuuaacgaggggaucauggccgucgggaucguuagcauccugcuguccucgcuccugaagaacgacgugccccuggccgggccccucaucgccggcggcaugcugaucgccugcuacgucaucagcgggucaucugccgaccugagccuggagaaggcggcggaagugucgugggaggaagaggcagagcacagcggcgccucccacaacauacugguggagguccaagacgacgggaccaugaagaucaaggacgaggagcgggacgacaccuugacgauccuccugaaagccacccuacucgccaucaguggcguguacccgauguccauccccgcgacgcuguucguuugguacuuuuggcagaagaagaagcagcgcagcgguguccuaugggacacccccagcccgcccgagguggagcgggccgugcuggacgacggcaucuaccgcaucuuacagcggggcuugcuggggaagucccagguuggcgucgggguuuuccaggagggcguuuuucacaccauguggcacgugacccgcggggccgugcucauguaccaggguaagcgcuuggagcccuccugggccagcguuaaaaaggaccuaaucuccuacggcgggggcuggagguuccaagggagcuggaacaccggcgaggagguccaggugaucgcugucgagcccgggaagaacccuaagaacgugcagaccgcgcccggcacguucaaaaccccagagggcgaggugggggccaucgcccucgacuucaagcccgguaccuccgggagccccaucgucaaucgcgagggcaagaucgugggccuguacgggaacggcguagucaccaccagcgggaccuacgugagugccauagcccaagcgaaggcaagccaagaggguccguuaccugaaauugaggacgaaguguuuaggaaaagaaaccuuaccaucauggaccuccaccccggcucuggaaagacccgacgguaccucccggccaucguccgcgaagccauaaagcggaagcuccgcaccuuggugcuggcccccacccgggucgucgccagcgaaauggccgaggcccucaagggaaugcccauccguuaccaaaccaccgcggugaaguccgagcacaccggcaaggagauuguggaccugaugugccacgccaccuucacuaugcgccugcucucucccguccgcgugccgaacuauaacaugaucaucauggacgaggcccacuucaccgaccccgcguccaucgccgcgcgugguuacauuucgacgcgugugggaaugggcgaggcggccgccaucuucaugacggcgacgccgcccggcucaaucgaggccuucccgcagaguaacgcggcaauccaggacgaggagcgggacauccccgagcggucuuggaacagcggcuaugacuggaucacggacuuccccggcaagacggucugguucgugcccucuauaaaguccgggaacgacaucgccaacugccuucggaagaauggcaagcgggugauacaacugucccggaaaacauucgauaccgaguaccagaagacgaagaacaacgacugggacuacgucgugacgaccgauaucagcgagaugggggcgaacuucagagcggaccgcgugaucgacccucgacgcugccucaagcccguaauccugaaagacggucccgagagagugaucuuggcggggccgaugccggucaccguggccuccgccgcccaacgccggggcaggaucggccggaaccagaacaaggagggggaucaauacaucuacaugggccagccccucaacaacgacgaggaccacgcgcacuggaccgaggccaagaugcugcuggacaacaucaacacgcccgaggggaucauaccggccuuguucgagccugagcgcgagaaguccgccgccauugacggcgaauaccggcugcgcggggaggcgcgcaagacguucguggagcugaugaggcgcggcgaccucccugucuggcuguccuacaagguggccagcgagggauuccaauauagcgaccggcgcuggugcuucgacggggagcgaaacaaccagguccuggaggagaacauggacguggagaucuggacuaaagagggcgagcgcaagaagcucaggccccgcuggcuggacgcacggaccuacuccgauccucucgcccuccgcgaguucaaggaguucgccgcggggaggcgcucgguguccggagaccugauacuggagaucgggaaguugccgcagcaccugacgcagcgggcucaaaacgccuuagacaaccucgugaugcugcacaacagugagcagggcgggaaagccuaucgccacgcgauggaggagcuucccgacaccaucgaaacccucaugcugcuggcacucaucgccgucuuaaccgggggcgugacccuuuucuuuuuauccgggagaggcuuaggcaagacgagcaucggucugcucugcgugauggccucuagcgcccuguuauggauggcgucagucgagccccacuggaucgccgcauccauaauccucgaguucuuccugauggugcugcucauccccgagccggacaggcagcggacuccccaagauaaccaacuggccuacgucguaauaggucuccucuucaugauccugaccguggccgcgaacgagauggggcugcucgaaacgacgaagaaggaccugggcaucgggcaugccgccgcggagaaccaucaccaugccgcgaugcuggacguagaccuccaccccgccucggcuuggacccuguacgccgucgccaccaccaucaucacgccgaugaugagacacaccauugaaaauaccacagcgaacaucagccugacggccaucgccaaccaagcagcgauccucaugggcuuggacaaaggcuggccuauuuccaagauggacaucggggugccccugcucgcccucggcugcuacagccaggugaacccccugacccucaccgccgccgucuugaugcuggucgcccacuacgccaucaucgggccuggccuccaggcgaaggcuaccagggaggcucagaagcgcacggccgccgggaucaugaagaaccccacaguggacggcauagucgccaucgaucucgaucccgugguguacgacgccaaguuugagaagcagcuaggccagauuaugcuccugauccuguguaccucccagaucuuacucaugcggaccacgugggcccugugugagagcauuacccucgccacggggccucugacaacgcugugggaaggcuccccgggcaaguucuggaacacuacuaucgcggucagcauggcgaacaucuuccgcggcuccuaccucgccggcgccgggcuugcguucagccugaugaagucccucggcgggggccgccgggggaccggagcgcagggcgagacccugggggagaaauggaagcgccagcuaaaccagcucuccaagagcgaguucaacacauauaagcggagcggcaucauggagguggaccgcagcgaagcgaaggaggggcuuaagcguggcgagaccaccaagcaugccgugucccguggcacggccaagcugcggugguuugucgagcgcaaccuggugaaacccgagggcaaggugaucgaccucggcugcgggcgcggcggcuggagcuacuacugugcgggacuaaagaaggucacggaggugaagggauacaccaagggcggccccgggcacgaggagcccaucccaauggccaccuacggcuggaaccuggugaagcuucauagugguaaggacgucuuuuucacgcccccggagaagugcgauacccugcugugcgacaucggugaaucaucucccaauccgaccauagaggaggggcggacccucagagugcugcgcaugguggagcccugguugcggggcaaccaguuuugcaucaaaguccucaaccccuacaugcccagcgugaucgagaccuuagagcagaugcagcggaagcacggcggcaugcuggugaggaacccgcucucccgcaauagcacgcacgaaauguauugggucuccugcggcaccgggaacauagucagcgccguaaauaugacaucccggaugcugcuuaaccgcuuuaccauggcccaccggaagcccacuuacgaacgcgacguugaccugggagccggcacccgccacguugcaguggagcccgaggucgccaaccucgacauuauuggucagcggaucgagaacaucaaaaacgaacacaagucgaccuggcacuaugacgaagauaaccccuacaaaaccugggccuaucacggcuccuaugaggugaagccgagcgggucagccaguaguauggugaacggcguuguucgccugcucacgaaacccugggaugugauacccauggugacacagauagccaugaccgacaccacgcccuuuggccagcagcgcguguucaaggagaaggucgacaccagaaccccgaaagcgaagcggggcaccgcacagauuauggaagugacggccagauggcuguggggcuuccugucccggaacaagaagccccgcauuugcacacgggaggaguucaccaggaagguccgguccaacgccgcgaucggggcagucuucgucgacgaaaaccaguggaacuccgccaaggaggccguggaggacgaacgcuucugggaccucguucaucgggagcgcgagcugcacaagcagggcaagugcgcgacuugcguguacaacaugauggggaagcgggagaaaaagcucggagaguucgggaaggcgaagggcagccgcgcaaucugguacauguggcucggcgcccgauuccucgaauucgaggcccugggguucaugaaugaagaucacugguucucccgcgagaauagccucuccggcguggaaggggagggccugcacaagcugggguacauccucagggacaucagcaagaucccaggcgguaacauguacgccgacgacacagcggggugggauacccgcauaacagaggacgaccugcagaaugaggccaagauuaccgacauuauggagccggagcacgcccugcucgccaccuccaucuucaagcugaccuaccagaacaaggucgugcgggugcagcgccccgccaaaaacggaaccgucauggacguuaucagccgccgggaccagcgggggaguggccagguggggaccuauggccugaacacuuucaccaacauggaggcgcagcucauccggcagauggagagcgaaggcaucuucacccccuccgagcuggagacccccaaccuugccgaacgcguccucgacuggcuggagaagcacgggaucgagcggcuuaagcgcauggcaauauccggcgacgacugcgugguuaagccgaucgacgaccgguucgcuaccgcguuaaccgcgcuaaacgauauggggaagguccgcaaggacaucccucagugggagccguccaagggcuggaacgacuggcagcagguccccuucugcagccaccacuuccaccaacugauuaugaaggacgggagggagaucguugugccguguaggaaccaggacgaacucguggggcgggcccgcgugucccagggggcaggcuggucccugcgggaaaccgcuugccugggcaagaguuacgcacaaauguggcagcucauguacuuccaccgccgggaccugcgccuggcagccaacgcaaucugcagugccguccccguggacugggugccuaccagccggacgacgugguccauacacgcgcaccaccaguggaugaccaccgaggacaugcucagcguauggaaccgaguguggauagaggagaaucccuggauggaggacaagacgcauguguccagcugggaggacgugcccuaccuggggaaacgggaggaccaguggugcggcucccugaucggccucacggccagagcgaccugggcaaccaacauccagguggccauuaaccaggugaggcgccugaucgggaaugagaacuaccuggauuacaugaccagcaugaagcgcuuuaagaacgagucagaccccgaaggcgcgcucugguga

SEQ ID NO: 24698 - RNA, 9879 nt, Artificial Sequence
  derived and/or modified CDS sequence (opt11) from DENV-1__KC762624__SS-prME
agcgugacuaugcugcucaugcugaugcccaccgcccuggcuuuccaccuaaccacgcggggcggggagccccacaugaucgugagcaagcaggagagaggcaagagccuguuauuuaagaccagcgccggggugaacaugugcacucucauugccauggaucugggcgagcugugugaggauacgcucaccuacaagugcccacguaucaccgaggccgagcccgacgacguagacugcugguguaacgcgaccgacaccuggguuaccuauggaaccugcucccaaaccggagagcaccggcgagacaaacgguccguggcccuggcuccccacgugggccuugggcuugagacacgcaccgagaccuggaugagcuccgagggcgccuggaagcagauucaacgcgucgagaccugggccuuaagacacccagguuucacggugaucgccuuauuccucgcgcacgccaucggcaccagcauaacccagaaggggaucaucuucauccugcugaugcucgucacccccuccauggccaugcggugcguagggauaggcagcagggacuucguggaggguuuaucuggcgccacguggguggacgucguacuggagcacggcagcugcgucacaaccauggcaaaggauaaacccacgcucgacaucgagcugcugaagacggagguuaccaaccccgcugugcuccggaagcugugcauagaagccaagaucucgaacacaaccacggauucgcgcugcccgacccagggcgaggccaccuugguggaggagcaggacgccaauuuugucugccggcgcaccuucguggacagagguugggggaacggcugcgggcuguucggcaaggggucccugaucacgugcgccaaguucaagugcgugacgaaguuagagggcaagaucguccaguacgaaaaccucaaguacagcguaauuguaaccguccacaccggcgaccaacaccagguggggaacgaguccacggagcacgggaccacggcgaccaucacgccccaggcacccacuaccgagauucaacucacggauuacggcgcucugaccuuagacugcagcccccgcaccggccuggacuucaacgagaugguccugcuaaccaugaaggaaaagagcuggcugguucacaaacagugguuccuggacuuaccccuacccuggaccucuggcgccagcacgucccaggaaacguggaaucggcaggaucuacucgugacguucaagaccgcccacgcgaagaagcaagaagucgucgugcuggguagccaggaaggcgcuaugcacaccgcccugacgggugccaccgagauccaaaccagcggcacgacgacuaucuucgccggacaccucaagugccggcugaagauggacaagcuaacucuaaaaggcaugagcuacgugaugugcaccggguccuucaagcuggagaaggagguggcugagacacaacacggcaccgugcugguccagaucaaguacgagggcaccgaugcccccuguaaaaucccuuucagcacccaggacgaaaagggggugacgcagaacggacggcugaucaccgccaauccgauugugaccgacaaggaaaagcccgucaacaucgaggccgagccgcccuuuggugaguccuauaucgucaucggcgcgggcgagaaggcucucaagcugagcugguucaagaagggauccagcaucggcaagauguucgaggccacggcccgcggugcccgacgcauggcgauccugggcgauacagcuugggacuucggauccauagggggcgucuuuaccagcgucggaaaacucgugcaccagauauuuggcaccgccuaugggguguuauucucaggcguguccuggaccaugaagaucggaaucggcguguugcucacguggcuggguuugaacucccgcagcacuucccucagcaugaccugcaucgccguugggcuggucacccuguacuugggagugauggugcaggccgacuccgggugcgucauaaacuggaagggccgugagcugaagugcggaagcggcaucuucguaacaaacgagguacacaccuggaccgagcaguacaaauuccaggcggauagcccgaagaggcuaucugccgccaucggcaaggccugggaggaaggcgugugcggcauccgcuccgcuaccaggcuggagaacaucauguggaagcagaucuccaacgagcugaaccacauccugcucgagaacgacaugaaguucacagugguagucggggacgucgcgggaauccuggcccaggggaaaaagaugauccggccacaacccauggagcacaaguacagcuggaagucgugggggaaggcaaagaucaucggggccgaugugcagaauacgaccuucaucaucgaugggcccaacacgccggagugcccugacgaccagcgagcauggaauaucugggagguagaggacuacggcuucgggauuuucaccacgaauauuuggcuaaagcuacgggacagcuacacccaggucugcgaccaccgucugaugagcgcggccaucaaggacagcaaagccguucacgccgacaugggcuacuggauagagucggagaagaacgagacuuggaagcuggcucgggcgagcuucaucgaggugaagacaugcaucuggcccaagucccacacucucugguccaacggcgugcuugaaucugagaugaucaucccuaagaucuacgggggcccgacgucacaacacaacuaccgccccgguuacuuuacucagacugcgggccccuggcaccuggggaagcucgagcuggacuucgaccugugugagggcacgaccguggucguggacgagcacugcggcaaccgggggccgucacuccguaccaccacuguaacuggaaagaucauacacgaguggugcugucggagcugcacccugccgccccugcgcuuccgcggggaagacggaugcugguacgggauggaaaucaggcccguaaaggagaaggaggaaaaucucguaaagucuauggugagugccggcagcggcgaggucgacuccuucagccuggggcugcucugcaucaguauaaugauugaggaggugaugaggaguagguggucccguaaaaugcugaugaccggcacacuggcaguguuuuuccuccugaucauggggcaguuaaccuggaacgaucugauccgccugugcaucauggucggggcgaacgcuagcgaccgcauggguaugggcaccaccuaccuggcccucauggccacguuuaagaugcggcccauguuugccguaggccugcuguuccgccgucuuaccagucgcgaggugcugcuguuaacgauagguuugucgcuuguugcguccguggagcuccccaacagccuggaggagcugggcgacggucucgcuaugggcauuaugauccugaagcuccucaccgacuuucaaucccaccaacugugggccacucugcucagccuaaccuuuaucaagaccaccuucucgcugcauuacgccuggaagacgauggcaaugguuuugagcaucgucucccuauuuccucugugucucagcaccacgucgcagaagacaacguggcugcccguacugcucggcagccuaggcugcaagccgcugaccauguuccuaaucgcagagaacaagaucuggggccggaaguccuggccccugaacgagggaaucauggccgucggcauagucagcauccugcucagcucccugcugaagaacgacgugccucuugccggcccccugauagccggugguaugcugaucgcaugcuacgucaucaguggcuccuccgcggacuuaucccuggagaaagccgcggaggugagcugggaggaggaggccgagcacuccggcgcgucgcacaauauccugguggagguccaggacgacgggacaaugaaaaucaaggacgaggagcgcgacgacacccucacgauccugcugaaagccacguuacuggcgguguccggaguguacccgcugagcauccccgccacuuuguucgucugguacuuuuggcagaagaaaaagcaacgguccggggugcuuugggacacccccagcccacccgagguggaacgggcugucuuggacgacgggaucuaccggauaaugcagcgggggcuccucgggcggagccaggugggcgugggggucuuccaagagaacguguuccacacuauguggcauguuacacgcggcgcaguccugauguaccaggggaagcggcuggagccaagcugggccuccgugaagaaggaccugaucaguuacggcggaggguggcgccugcagggguccuggaacaccggagaggaggugcaagucauagccgucgaacccggaaagaaccccaagaacguacaaacagcccccgggacauuuaaaacacccgaaggcgagguuggcgccaucgcacuggacuucaagcccggcaccagcggcucccccaucgugaaucgggaggggaagauagucggccucuacggcaacggggucguaacgaccagcggcaccuaugugagcgccauugcccaggccaaggcgucacaggaggggccgcugcccgaaaucgaggacgaggucuuccgcaagcggaaucugaccauuauggaccugcaccccggcagcgggaagacccgcagauaccucccggccaucgugcgcgaggcaaucaaacggaagcugcguacauugauccuggcucccacucgugugguagcauccgagauggcggaggccuugaagggcaugcccauucgcuaucagaccacagcuguaaagucagagcauacuggcaaggagaucguagaccucaugugccacgccacguucaccaugcgccugcugagcccuguccgggugccgaacuacaacaugaucaucauggaugaggcccacuucacagaccccagcagcaucgcggcccgcgguuacaucagcacgagggugggaaugggagaggccgcagccaucuucaugacugcuacgccgccuggcuccguagaagccuuuccucaaagcaacgccgugauccaggacgaggaacgugacaucccagagcggucuuggaacagcggguacgaguggaucaccgacuuccccggcaagaccguaugguucguccccucaaucaaguccggcaacgauauugccaacugccuccgaaagaacgggaagcgggugauccaacugucacgcaagacuuucgacaccgaguaccaaaagaccaagaacaacgacugggacuacgugguaacgacggauaucagcgagaugggagcgaacuuccgggccgaccgugucauagacccacggcgcugccuuaagccugucauacucaaggaugggcccgagcgggucauccuggccggccccaugcccgugaccgucgccuccgcugcucaacgcagagggcgcguaggccgaaaccacaacaaggaaggcgaccaguacauuuacaugggucagccgcugaauaaugacgaggaccacgcccacuggacugaggccaagauguugcuagacaacaucaacacccccgagggcauuauuccagcccuguucgagccggagcgcgaaaagagcgccgcgauagauggggaguaccgccuccggggcgaggcccgcaagacguucgucgagcuuaugcggcgcggggaccugcccgucuggcuuuccuacaagguugccagugaaggcuuccaguacuccgaccggcgcuggugcuucgacggcgagcggaacaaccaggugcuugaggagaauauggacgucgagaucuggaccaaggagggugagcgcaaaaagcugaggccccgcuggcucgacgcgcggaccuacuccgauccccuggcucugagagaguucaaggaguucgcggccggacgucgcagcguguccggugaccucaucuuagagaucggcaagcugccucaacaccucacacaaagagcccagaaugccuuagacaaccuggugaugcuucacaacucggagcaaggagggagggcguaccggcaugccauggaggaacugcccgacacgaucgagacccugaugcuccuggcccuuaucgccguccucacuggcggcgucacucuguucuuccuguccggccgcggacucggaaagaccagcaucggucugcugugcgucauggccuccagcguccuucuguggauggcuaguguggagccccacuggaucgccgccagcauaauccuggaguucuuucucauggugcuguugauccccgagccggaccgucaacgaacgccacaggacaaccagcucgccuacgucgugaucgguuugcuguuuaugauacucacaguggcagcgaacgagaugggccugcuggaaacaacuaagaaggaucucgggaucggccauguggcgguagagaaccaccaccacgccgccaugcuggacguggaccugcacccggcauccgcuuggacgcuuuacgccgucgcgaccacuaucaucacgccuaugaugaggcacacgauugagaacacaaccgccaacaucagccuuaccgcuaucgcaaaccaggccgccauccucauggguuuagacaagggguggcccaucuccaaaauggacaucggcgugccucuccucgcuuugggauguuacagccagguuaacccccugacccugaccgcggccguacucaugcuaguugcccacuacgcaauuaucgguccgggacugcaggcuaaggccacccgggaggcccagaagcggaccgccgcaggcaucaugaagaaccccacgguggacggcauagucgccaucgaccucgaccccgugguguacgacgcgaaguucgagaaacaguuggggcagauuaugcugcuaauccugugcaccagccagauccugcucaugcgcaccaccugggcccugugcgagagcaucacgcuugccaccggcccccucaccacacugugggaggggagucccggaaaguucuggaacacgaccaucgccgucagcauggccaauaucuuccgcggguccuaccuggcgggcgcuggccuagcuuucagccugaugaaaucccucgguggcgggcgucgcgggaccggcgcccagggcgagacucuaggggagaaguggaagcggcagcugaaccagcuguccaaguccgaguucaacacguacaagcgcuccggaaucauggagguggaucggucugaggcgaaggaagggcucaagcgcggggagaccaccaagcacgccgucucccggggcacggcaaaacugcgcugguucguggagcggaaccuggugaagcccgaggggaagguuaucgaccugggcugcggccgcgggggcuggagcuacuacugcgccggucucaagaagguaaccgaagugaagggcuauaccaaaggcgggcccggccacgaggaacccauaccgauggccacauauggguggaacuuggugaaguugcacuccggcaaggaugucuucuucauuccgcccgagaagugcgauacccugcuaugugacaucggugagucuuccccaaauccgacaaucgaggagggccggacccugcgcgugcucaagaugguggagcccugguugcggggcaaccaguucuguaucaagauccugaaccccuacaugccaucaguuguggagacgcuagagcagaugcaacgcaagcacggcggcaugcugguccggaauccgcugucccgcaacagcacccaugagauguacuggguuagcugugggaccggaaauaucgucagcgccguaaauaugacgucccgcaugcuucugaaccgcuuuaccauggcccacaggaagcccaccuacgagcgggacgucgacuuaggugccggcacccgccacguggccguggaaccugagguggccaaccucgacaucauugggcagcggaucgagaacauuaagcacgaacacaagagcacguggcacuacgacgaggauaacccuuacaagaccugggcguaccacggauccuacgagguaaagccuagcggcuccgccucgagcauggucaacgggguggugaagcuguuaacuaagcccugggacgucauucccauggugacccagaucgccaugacagacacaacccccuucggucagcagcgcguguucaaggagaagguugacacccggacgccgaaggccaagcgcgggaccacccaaauuauggaggugaccgcgcgguggcucuggggcuucuuaagucgcaacaagaaacccagaauuugcacgcgcgaggaguucacccguaaagugcgcagcaacgcggccaucggggccgucuucguugacgagaaccaguggaacuccgccaaggaggcgguggaagacgagagauucugggaccugguccaccgcgagcgggagcuccacaagcaggggaagugcgcgacuugcguguacaauaugaugggcaagcgcgagaaaaagcuaggugaguucggcaaggccaaggggagccgggccaucugguacauguggcugggugcccgcuuccucgaguuugaggcgcugggcuucaugaacgaggaccacugguucucccgggagaacucucuuuccgggguggagggcgagggguugcacaagcugggcuacauccuucgcgacaucagcaagauccccgggggcaauauguaugccgacgacacggccggcugggacacgcggauuaccgaagacgaccuccagaacgaggccaagaucaccgacauuauggagccggaacacgcccugcuggccaaagcgaucuucaagcucaccuaccagaacaaggucgugcgcgugcagcgucccgccaagaacgggacgguuauggacgugaucucccggcgcgaccaacggggcucaggccaaguggguaccuacgggcugaacaccuucaccaauauggaggcccaacugauccgccagauggagucggaggggaucuucagccccuccgaguuggagacgccaaaccuagccgaacggguccuggacuggcucgaaaaauacggcgucgagcgccuuaagcggauggccaucagcggggacgacugcguagucaaaccgaucgacgaccgguucgcaaccgcucugaccgcccucaacgacaugggaaaggugcgcaaggacauuccccagugggagcccuccaagggguggaaugacuggcaacaggucccguucuguagccaccacuuccaccagcugaucaugaaggauggaagagagaucgucgugccgugccggaaccaggacgaacucgucggccgcgcccgagucucccagggggcaggcuggagccuccgcgagaccgccugccugggcaagagcuacgcccaaauguggcagcugauguacuuccaccggcgcgacuugcgguuagccgcgaacgccaucugcucggccgugccuguagacuggguccccacgagccgcaccacuugguccauccaugcccaccaccaguggaugaccacagaggauaugcuuagcguauggaaccggguguggaucgaggagaaccccuggauggaagauaagacccacgucuccagcugggaggaugugccauaccucggcaagcgugaggaccaguggugcgggucccugauaggccugaccgcccgcgcgaccugggccaccaauauccagguggccaucaaccagguccggcgccucaucggcaacgagaacuaccuggacuacaugacgagcaugaagcgcuucaagaacgagucugaccccgagggggcccucugguga

SEQ ID NO: 24699 - RNA, 9879 nt, Artificial Sequence
  derived and/or modified CDS sequence (opt11) from DENV-1__KC762644__SS-prME
ucugugacgaugcuguuaauguuaaugcccaccgcccuagcauuccaucucaccaccagggggggggaaccccacaugaucguauccaaacaggagcggggcaaaagcuuauuguucaagacauccgccggggugaacauguguacccucaucgccauggacuuaggcgaacugugugaggacacucucacguacaagugcccgcgcauaacugaagccgagccggacgauguggacugcugguguaacgcuaccgacaccugggugacauacgguaccugcagccagaccggagagcaccggcgcgacaaaagguccguggcccuggccccucaugugggacuagggcuugagacgcgcacagagaccuggaugucuuccgagggagccuggaagcaaauccaacgagucgagaccugggcccuccgccauccgggguucacggugauugcccuguuccucgcucacgcaaucggcaccagcaucacccaaaaggggauaaucuucaucuugcugaugcucgugaccccgucuauggcuaugagaugcguuggcaucggcucccgcgacuucgucgagggguugucuggugccacguggguggacgucguccuggaacacgggagcugcgugacuaccauggccaaggacaagcccaccuuggacaucgagcugcugaagacugaggugacaaaccccgcgguguuaagaaagcugugcaucgaggccaagaucaguaacaccacaacagacagccguugcccgacacagggagaggccaccuugguggaggagcaggaugcaaacuucgucugccggcgcaccuuuguugaccggggcugggggaacggcugcggguuauuuggcaaagggagccucauaacgugcgccaaguucaaaugugugacaaagcuggaggggaagaucguccaguacgaaaaucucaaauacagcguuauuguaaccguccacaccggagaccaacaccaggucggcaacgaguccaccgagcacgguaccaccgccaccauaacaccccaggcccccacgacugaaauccagcugaccgacuacggagcgcugacccucgacugcucgccacgcacugggcuggacuucaacgagaugguccugcucaccaugaaggagaaauccuggcuggugcauaagcagugguuucuggaucucccccugccguggaccuccggggccucuaccucccaggaaacauggaaccggcaggaccugcucgugaccuucaaaaccgcccacgcgaagaagcaggaggucgugguuuuaggcucucaggagggcgccaugcacaccgcccugacgggggccaccgagauacagaccucgggcaccacgaccaucuucgcggggcaccugaaaugccgccugaaaauggauaaacugacgcucaaggggaugagcuaugugaugugcaccggguccuucaagcuggaaaaagagguggcugagacgcagcacggcacgguccugguccagaucaaguaugagggaaccgacgcccccugcaagaucccauuuagcacccaggacgagaaaggugugacacagaauggcagacugaucacggccaacccgauagugacugacaaagaaaagccugucaacaucgaggccgaaccgccauucggggaguccuauauaguaauaggcgcgggcgagaaagcccucaagcugucaugguucaagaagggauccucgaucggcaagauguucgaggccaccgcccgaggagcucggcgcauggcgauacugggcgacacggcaugggacuucggguccaucgguggcgucuucacgagcguugggaaguuggugcaucagaucuucggcaccgcuuauggcgucuuguucaguggcgucagcuggacgaugaagaucgguaucggaguacugcucacguggcugggucugaacucccgcuccaccucccucucuaugaccugcaucgccguaggucuggucacacuguaccugggcgugauggugcaggcggacuccggguguguaauaaacuggaagggcagagaacugaaaugcgggagcggcauuuucgugacaaaugaggugcacaccuggaccgagcaguauaaauuccaggcagacagcccaaaacgccuguccgccgccaucggcaaggccugggaggaggggguuuguggcauucggagcgcgaccagauuagagaacaucauguggaaacaaaucagcaacgagcuuaaccacauacugcucgagaacgacaugaaauucaccguggugguuggggauguggcggggauccuggcccaggggaaaaagaugauccggccccagcccauggagcacaaguauagcuggaaguccuggggcaaggccaagaucaucggugccgaugugcagaacacgaccuucaucaucgacgggcccaacaccccggagugucccgacgaccaaagagcguggaacauuugggaaguagaagacuacggcuuuggaauauucaccacgaauaucuggcugaagcuccgggacucauacacacagguaugugaucauagacucauguccgccgccaucaaggacucgaaggccgugcaugccgacaugggcuacuggaucgagagugaaaagaacgagaccuggaagcuggcgcgggcgagcuucaucgagguuaaaaccugcaucuggcccaagucccacacacucuggucuaacggcguguuagagucggagaugauuauuccgaagaucuacggaggcccgaucucgcaacacaacuaucgcccaggauacuucacacagacugccggccccuggcaccuggggaagcucgaacucgacuucgaccugugcgagggcaccaccguggucguggacgagcacugcggcaacaggggccccucccugcgaacaacuacggugacgggcaaaauuauccaugaguggugcugccguaguugcacuuugcccccacugcgcuuuaggggcgaggauggcugcugguaugggauggaaaucaggcccgucaaggagaaggaggaaaaccucgugaaaucgauggucucggccgguagcggagaggucgacucauuuucccuggggcuccuaugcaucuccaucaugauagaggaggugaugcggucgcguuggagucggaagaugcugaugaccggcacccuggccguguucuuccuccugaucauggggcagcuuacauggaacgacuuaauucgccucugcaucaugguaggcgcuaaugccagcgaccgcauggggaugggaacgacguacuuagccuuaauggcuacauucaagaugcgcccaauguuugcggugggccuauuauuccgccgguuaacgucccgcgagguucuguugcugacuaucggguuaagccugguugcaagcguggagcucccuaacucgcuggaagagcucggagacggucucgcaaugggcaucaugauccucaagcugcucaccgacuuccagucccaccagcucugggccacgcugcucagcuugacguuuauuaagaccaccuucucauugcacuacgccuggaagaccauggcgaugguucuuagcaucgugucccucuucccccugugccucucaacaaccucccagaaaaccaccuggcuccccgugcugcucggcagccuggggugcaagccucugacgauguuccucaucgccgagaacaaaauuuggggccggaagagcuggcccuugaacgaggggaucauggccgucggcaucgugucaauccugcucagcucacugcugaaaaacgacgugccccuggcugggccgcugauagcaggcgggaugcugauagcuugcuauguuaucagcggauccagcgccgaccucucucuagagaaagccgcugaagugagcugggaagaggaggccgagcacuccggugcaagccauaacauccugguggagguucaggacgacgguacgaugaagaucaaggacgaggagcgugacgacacuuuaaccauacuccugaaggccaccuugcuggccguguccggcguguacccgcugagcauuccugccacccuauucguuugguauuucuggcaaaagaagaagcagcgguccgggguguuaugggacacccccagcccgcccgagguggaacgcgccguacucgacgacggaaucuaccggaucaugcaacgcggcuugcucgguagaagucagguaggcgugggggucuuccaggagaacguguuccauaccauguggcacgugacccggggugcgguccuuauguaccaggggaagcggcuggagccaagcugggccuccgugaaaaaagaucucaucagcuauggcggaggguggcggcugcagggcagcuggaauacgggagaagaaguccaggugauugcuguggagccgggcaaaaacccgaagaacguacaaaccgcaccggggaccuucaagacucccgagggggagguaggcgcaauagcgcuggauuuuaagcccgggacgagugguucccccauuguuaaucgggagggcaaaaucgugggccucuacggaaacgggguugugaccaccucagggaccuaugugagcgccaucgcccaggcgaaggcgucacaagaggggccgcugcccgagaucgaagacgagguuuuucgcaagaggaaccugacgauuauggaucuccaccccggcucggggaaaaccagacgcuacuuaccggccauuguucgugaggccaucaagagaaagcugaggacccucauccuggcccccacccgcgugguggccagcgagauggccgaagcgcugaaaggcaugcccauucgguaccagacgaccgcugucaagucggaacacaccgguaaggagauuguggaccucaugugccacgccaccuucacaaugcgccugcugucccccgugcgggugccgaacuacaacaugaucaucauggacgaggcccacuucacagaccccagcuccaucgcggcccgcggguauauuagcacucgggugggcaugggggaagcugcugccaucuucaugaccgcgacgccgccaggcuccguugaggccuucccgcagucuaacgcugugauacaggaugaagagcgagacauccccgaacgguccuggaacagcggguaugaguggaucaccgacuuucccgguaagacugugugguuugucccuuccaucaagagcggaaaugacaucgccaacugccuccgcaagaauggcaagcgggugauucagcuuucucgcaagaccuucgauacggaguaucagaagaccaagaacaacgauugggacuacguagugaccaccgacaucucagagaugggcgcgaacuuccgggccgacagggugaucgacccgcggaggugccugaagcccguaauacuaaaggaugggcccgagcgggucauucuggccggccccaugccgguaacugucgcguccgcagcacaacgucgggggcgcgugggaagaaaccacaacaaggagggcgaccaauacaucuacauggggcaacccuuaaacaaugacgaagaccaugcccacuggaccgaggcuaaaaugcuccuggacaacaucaacacgcccgaaggcaucauccccgcccuguucgagccggaacgcgagaaguccgcugcgaucgacggggaguaucgccuuaggggcgaggcacgcaaaacauucguggaacuaaugcggagaggggaccugccgguauggcucuccuacaagguggcgagcgagggcuuccaguacucagaccggcgcuggugcuuugacggggagcggaacaaccagguccuggaggaaaacauggacguugaaaucuggaccaaggagggagagcgaaagaagcugcgcccccgcuggcucgacgcccggaccuacagugacccccuggcccugcgcgaauuuaaggaguucgcggcgggccggcgaagcgucuccggggaccucauuuuggagaucggcaagcugccgcagcaccugacacagcgugcccagaaugcccuggacaaucugguuaugcuccacaauagcgagcaaggcggacgcgcguaucggcacgccauggaggagcuucccgacaccauagagacguuaaugcucuuagcccugaucgccguucucaccggggggguuacccuuuucuuccugaguggccgcgggcucggcaagaccagcaucgggcugcugugcgugauggcuucgagcguacuccucuggauggcauccguggagccccauuggaucgcugccagcaucauccuggaguuuuuccugauggugcugcugauccccgagccagaccggcagcgcacgccccaagauaaccagcucgcuuacgucgugaucggccugcuguucaugauucucacgguggcggcgaacgagaugggccuccuggagacaacgaagaaggaccucgggaucggccacguugccguugaaaaccaccaccaugcagccaugcuggacguagacuuacaccccgccucggcguggacgcucuacgccgucgcaacuacuauaaucacaccgaugaugcggcacaccaucgagaacaccaccgcgaacauuagccucaccgccaucgcgaaccaggcagccauccugauggggcucgacaaaggcuggcccaucuccaaaauggacaucggugugccucugcuugcgcuugggugcuacucucaggugaacccacugacccuaacugcggcuguccucauguugguggcacacuaugccaucaucggaccagggcugcaggcuaaagcgacgcgcgaagcccagaagcgcaccgccgcaggcaucaugaagaacccuacuguugaugggauuguugccauagaccucgacccaguuguguacgaugcgaaguucgagaaacagcugggacagaucaugcugcuaauccugugcacuucccagaucuuacucaugcggaccaccugggcccugugcgagucgaucacacucgccacaggcccccuaacaacccugugggagggguccccgggcaaguuuuggaacacuacgaucgcugucagcauggcgaacaucuuccgaggguccuaccuggcuggggccggccucgccuucucacugaugaaaucccucgggggcgggcggcgcggaaccggugcccagggugagacccucggagagaaguggaaacggcagcugaaccaacuguccaagagcgaguucaauacuuacaagcgcuccgggauuauggagguggaccguucugaggcgaaggagggccucaaaaggggggagacgacaaagcacgccgucuccagaggcaccgcaaaacugaggugguucguugagaggaaccuggugaagcccgaggggaaagucauagaccuuggaugcggccgcgggggcuggagcuacuacugugccgggcugaaaaaggucaccgagguaaaaggauacacgaagggcggucccggccaugaagaaccuauuccgauggccacuuacggguggaaucuggugaagcugcauagugguaaggacguauucuuuauuccacccgagaagugcgacacccuccugugugacauuggggaaagcuccccuaacccgaccauagaggagggacggacacugcgcgugcugaagaugguggagcccugguuacggggcaaccaauucugcauaaagauccugaaccccuacaugccgagcgucguggagaccuuggagcaaaugcaacgcaagcacggcggcauguugguacggaacccgcuaucucgcaacagcacccacgagauguauuggguguccugcgggaccggcaacaucgucagcgcagugaacaugaccagucgaaugcuccugaaucgcuucacgauggcccaccggaagccgacuuacgagcgugauguugaucugggggccgggacccgccacguugccguagagcccgaggucgcgaaccucgacaucaucggccaacggaucgagaacaucaagcaugaacauaagagcaccuggcacuacgacgaagacaacccuuacaagacgugggcauaccauggauccuacgaggugaagccaagcggcucugccaguucuauggucaauggaguagugaaguugcucaccaaacccugggacguuauucccauggugacucaaaucgcgaugaccgacacgaccccuuucggccagcagagaguguucaaggagaagguggauacacggaccccgaaggccaagagagggacgacccaaaucauggagguaaccgcgcgguggcucuggggcuuccugucccgaaacaagaaacccagaauuugcacucgcgaggaguucacgcggaaggugcgcagcaaugcugccaucggcgcgguguucguggaugagaaccaguggaacucagcgaaagaagcugucgaggaugagcgguuuugggaucuaguacaccgcgagcgcgaacuccacaagcaggggaagugugcgaccuguguguacaacaugaugggcaagcgagagaagaaguugggcgaguucggaaaggcgaaaggaagccgggccaucugguauauguggcugggcgccagauuccucgaguucgaggcguuaggauuuaugaacgaggaccacugguucucccgagaaaacagccuguccgggguggagggugaaggucuucacaagcugggauacauccugcgcgacauuagcaaaauccccggggggaacauguaugccgacgauaccgcggggugggacacgcggaucacggaggacgaccuccaaaacgaggccaagauaacugauauuauggagccggagcacgcacugcuggcaaaggccaucuucgagcugaccuaccagaauaaggucgugcgcguccagcgccccgccaagaacgggacagucauggacgugauuagcaggcgcgaccagcggggcaguggucaggucgggaccuacggccugaacaccuucacaaacauggaggcccagcugauccgucagauggaauccgaggggaucuucagccccucugagcuagaaacccccaaccuggcagagaggguccuugacuggcucgaaaaguacggcguggaacgccuaaaacggauggcgaucagcggagacgacugcgucgucaagccgaucgacgaccgauucgcgaccgcccuuacggcacucaacgacaugggcaaggugaggaaagauaucccucaaugggagccaagcaagggguggaacgauuggcagcaaguacccuucugcagucaccacuuccaccaacucaucaugaaagacgggcgcgaaauagucgucccgugccggaaccaggacgagcuggugggccgcgcccgggucucccagggugcuggcuggagccuccgcgagacggccugcuuaggcaagagcuacgcacaaauguggcagcuuauguacuuccaccggcgcgaccuccgacuggccgcgaaugccauaugcucggccgugccuguugacugggucccgaccagccguacgaccugguccauccacgcccaccaucaauggaugaccacggaggauaugcugaguguguggaaccggguguggaucgaggagaaccccuggauggaggacaaaacgcacaucucaaguugggaggaugucccguaccucggcaagcgcgaggaccaguggugcgggucccugaucggccuaacagcccgggcgaccugggccacaaacauccaaguugccauuaaucaggugcggcgccucaucgggaacgagaacuaccuggacuacaugacuagcaugaagcgguucaaaaacgaguccgauccagagggggcccugugguga

SEQ ID NO: 24700 - RNA, 9879 nt, Artificial Sequence
  derived and/or modified CDS sequence (opt11) from DENV-1__KC762630__SS-prME
agcgugaccgugcuguucaugcuguugcccaccgcacucgccuuccacuuaaccacucgaggcggagagccccacaugaucguuagcaagcaggagcgcggcaagagccugcuauucaagaccagcgccggggugaacaugugcacccucaucgccauggaccugggcgaacugugcgaggacacuaugaccuacaagugcccccgcauuacggagacugagcccgacgauguggacugcugguguaaugccacugagaccugggugaccuacggaaccugcagucagacgggcgagcaccggcgcgacaagcgauccguugcccucgcgccacacgugggcuuggggcuagagacccggaccgagaccuggaugagcuccgagggcgccuggaagcagauucagaagguggagacgugggcucuccgccaccccggauucaccgugaucgcucucuuccuugcccacgcgauuggcaccuccauuacccagaaaggcaucaucuucauccuccugaugcuggugacccccuccauggcuaugcguugcgugggcaucggcaaccgagauuucguggagggacucagcggcgcuaccugggucgauguggugcuggagcacgguagcugcgugaccacgauggccaagaauaagcccacgcuggacaucgagcuucugaagaccgaggugaccaaccccgccauucuccggaaguuaugcaucgaggcgaagauaucuaacaccacgacagacuccaggugcccgacccagggagaggccacccugguugaggagcaggacaccaacuucgucugucgccggaccuuuguggaccgcggcugggggaacgguugcggguuguucggaaaagguagccuaaucacaugcgccaaguucaagugugucacgaaacuggaggguaaaaucguccaguacgaaaaucugaaguacuccgugaucgugacuguccauaccggcgaccagcaucagguggggaacgagaccaccgagcacggcacgacagccaucaucacgccucaggcccccaccucagagauccaacucaccgacuacggggcgcuuacguuggacugcagcccccggaccggucucgauuuuaacgagauggucuuguugaccaugaaggagaaguccuggcucguucacaagcaaugguuccucgaucugccgcucccguggaccuccggcgccagcacgucucaggagacauggaaccgccaggacuugcuugucacguucaagaccgcccacgccaagaagcaggagguuguggugcucggcucccaggagggcgccaugcacacagcuuugacuggggccaccgaaauccagaccucuggcaccaccaccaucuucgccggccaccugaaaugucgccucaagauggacaaacugacauugaagggcgucuccuauguuaugugcacggguucguucaagcucgagaaagagguggccgagacccagcacgguaccguucugguccaggugaaauacgagggcaccgacgcccccugcaagaucccguucuccagccaggaugagaagggcgucauccaaaacggacgccuaaucacggcgaacccgaucgugaccgauaaggagaagccuguaaauaucgaggccgagccgcccuucggggaaucuuauaucgucgugggcgccggggagaaggcccugaagcucagcugguucaagaaaggguccaguaucgggaagauguucgaggcgaccgcccgcggcgcccgccggauggcgauccugggagacaccgccugggacuucggguccaucggcggcguguucacgagcgucggaaagcuagugcaucaaaucuucggcacagcguacggggucuuauucuccggcgucucguggaccaugaagauugggaucggaauccugcugacguggcuaggccugaacucucgcaguacgucguugagcaugaccugcauagcuguugggauggugacauuguaccugggugucauggugcaagccgauuccgggugcgugauaaacuggaagggccgcgaacuuaaaugcggguccggcaucuucgucacuaacgaggugcauacguggaccgagcaguacaaguuccaggccgacagcccgaagcgccucuccgccgcgaucgguaaggccugggaggaggguguguguggcaucaggagugccacccgccuagagaauaucauguggaagcagaucuccaacgagcugaaccacauucuccuagaaaacgacaugaaguuuaccgucguggugggcgacgucucaggcaucuuggcccaggggaagaagaugauacgaccccagcccauggagcacaaguacuccuggaaauccuggggcaaggccaagaucaucggugcggacguccagaacaccacuuucaucaucgacgggccuaacaccccggagugcccggauaaucagcgugcauggaacaucugggagguggaggacuacgguuucgggaucuucaccacuaacaucugguuaaagcugcgcgacuccuacacgcaggucugugaccaccggcugauguccgccgccaucaaagacuccaaggcggugcacgcggacauggguuauuggauagagagcgagaagaacgaaacguggaaguuagcccgagccuccuuuaucgaggugaagaccugcauauggccgaagagccacacgcugugguccaacggcgugcucgagucggagaugaucaucccuaaaaucuacgggggacccguuucccagcacaacuaucggccaggguacuucacgcaaaccgccggcccuuggcaccucgggaagcuggaacuugacuucgaucucugcgagggcaccaccguugucguggacgaaaacugcggcaaucgcgggccgagccuccgaacgaccaccguaaccggcaagacgauccacgaauggugcugccgcuccugcacccugccgcccuugagauucaaaggggaggacgguugcugguacgguauggagauucgccccgucaaggagaaggaagagaaucuggucaaaucuauggugagcgcgggcuccggcgaggucgauagcuucucccuggggcuccugugcaucagcaucaugauugaggaagugaugcgcucccgcuggagccgcaaaaugcugaugacaggcacccucgccgucuuccugcugcucacgaugggccagcugacauggaacgaucugauccguuuaugcaucauggucggcgccaacgcauccgacaugauggguaugggaaccacauaccuggcgcugauggccacuuuccggaugcgccccauguucgccgugggccuacuguuucgccgacugaccucuagggagauucucuuguugaccgucggguuaucgcugguagccagcguggagcugccgaacucccucgaggagcugggcgacgggcuggccaugggcaucaugaugcucaagcuacugaccgacuuucagccccaccagcucugggccacgcugcugagccucacuuucgucaagaccacccugucccugcacuacgcguggaagacgauggccaugauccucagcaucgugucccugcugccucucugucuaagcaccacuucacagaagaccaccuggcugccggugcuccugggcagccuggggugcaagccccucacgauguuccugauaaccgagaacaagaucuggggccgacguuccuggccccugaaugaggggaucauggccaucggcaucgucagcauccucuuaagcucccugcuuaagaaugaugugccacuggccgggccccugaucgcaggcggaauguugaucgccugcuacgugauaagcggguccagcgcggaucuaucgcuggagaaagccgccgaggucagcugggaggacgaggccgagcacuccggcgccucacacaacauccucguugaggugcaggacgacggcaccaugaagauaaaggacgaagagcgggaugauacccucacgauccuccuaaaggccacacugcuggucauuucuggcguuuaucccaugagcgugcccgcaacccucuucgucugguacuucuggcagaaaaagaagcagcguuccggggugcugugggacacccccagcccgcccgagguggaacgggcgguccuggacaauggaauauaccgcauacugcagcggggccuuuuagggcgcagucaggugggaguggggguauuccaggagggcguguuccauacgauguggcacgucacccgcggggccguccugauguaucaaggcaagcgguuggagcccagcugggccucggugaaaaaggaccucaucucuuauggcgggggcuggcgguuccagggguccuggaacacgggcgaggaagugcagguuaucgccguggagcccgggaaaaacccgaagaacgugcagaccacgcccggaaccuucaagacccccgagggcgagaucggggccaucgcccuggacuucaagcccgguacaagcggguccccuaucguuaaccgcgagggcaagaucgugggccuauaugggaacggcguggucacaacgagcgggacuuacgugagcgcgaucgcacaagccaaagugucccaggagggcccccucccugagaucgaggacgaggucuuuaggaagcgcaaccugaccaucauggaccuccacccggggucgggcaagacgcggcgauaucugcccgcgaucguccgugaggccaucaaacgcaagcuccggacccucgugcuggcgcccacgcgagucguggcuucugagauggcugaggcccugaagggcaugcccauaagguaccagaccacggcggucaagagcgagcacaccgggaaggagaucgucgaccucaugugccacgccacuuucaccaugaggcugcugucuccggugcgcgugccuaacuacaacaugaucaucauggacgaggcccacuucacggaccccgccuccaucgcugcgcgcggguacaucuccacccgcgucggcaugggagaagccgccgcuaucuucaugaccgccacgccgccugggucaguggaggcguuuccacaguccaacgcugucauucaggacgaagagcgggacaucccggagcgcagcuggaacuccggauacgaguggauaacugauuucccuggcaagaccgucugguucguccccagcaucaaauccgggaacgacauagccaauugccuccggaagaacggcaagcgcguaguacaauugucacgcaagaccuucgacaccgaauaccagaagacaaagaauaacgauugggacuacguagucaccacggacaucuccgaaaugggugccaauuucagggccgaccgugugaucgacccacgccguugccucaagccugugauccucaaggauggccccgagcgugucaucuuggcggggccgaugccugugaccguggccagcgccgcccaaagacgcggucggaucggccguaaccccaacaaggagggggaccaguacgucuacaugggccagcccuuaaacaacgacgaggaccacgcgcauuggacggaggccaagaugcuccuggauaacaucaacaccccggaagggauuaucccugcacuguucgagccagaacgugagaagucggccgccaucgacggugaguacaggcuccgcggggaggcccggaaaaccuucguggaguuaaugcgccggggugaccuacccgucuggcucagcuacaaggucgccagugagggcuuccaauacagcgacagacguuggugcuucgauggggagcgcaacaaccaggugcuggaggaaaauauggacguugagaucuggaccaaggagggcgagcggaagaagcugcgcccucgguggcucgacgcccgaacguacagcgacccccuugcccugcgggaguuuaaggaguucgccgcggggaggagguccgugagcggcgacuugauccuggaaauugguaagcugccccagcaccucacgcugaaggcccagaacgcccuggacaauuuagugaugcugcacaacuccgagcaaggcgggaaggccuaccgccacgccauggaggaguuacccgacaccaucgaaacccucaugcugcucgcgcucaucgcaguacugaccgggggagucaccuuauuuuuccugagcggucgaggccuggguaaaacauccaucgggcuccuuugcguaauggccucguccgcccuguuauggauggcaagcguggaaccccacuggaucgccgcuucaaucauacucgaguucuuccugaugguccugcugauccccgagccggaccgccagcggaccccgcaggauaaccagcuggcauacguugugauuggccuccucuucaugauucugaccgucgccgcgaacgaaauggggcugcucgaaacuaccaagaaggaccugggcauagggcacgccgcggccgaaaaccaccaccacgccgcgaugcuggauguggaccuccaccccgcgagcgccuggacccuguacgccguagccacgacuaucaucacacccaugaugcggcacacaaucgagaacacaacggcgaauauaucccugaccgccaucgccaaccaggcagcgauccucaugggcuuggacaaaggguggccgaucagcaagauggacauaggagucccgcugcucgcccugggcuguuauucucaggugaacccccugacacucaccgcagccgugcugaugcuggucgcccacuacgccauuauuggcccuggccuccaggccaaggccacgcgggaggcccagaagcgcaccgccgcggggauaaugaagaacccaaccguggacggcaucguagccaucgaccuggacccggucauauacgacgccaaguuugagaagcaacugggccagaucauguugcugauccuuugcacuagccagauccuccugaugcggacgaccugggcccugugcgaguccaucacccucgccacugggccccugacuacccucugggagggcucccccgggaaauucuggaacaccacaaucgcaguguccauggccaacauuuuccgcggcagcuacuuagccggcgccgggcuugccuuuuccuuaaugaaauccuugggcgggggaaggcggggaacuggcgcgcagggcgagacccugggugagaaauggaagaggcagcucaaccagcuuuccaaguccgaguucaacauuuauaagcguuccggcaucauugaagucgaccgguccgaggccaaggaagggcugaagcggggcgaaaccacaaagcacgcggucagccgcgggacagccaagcugcggugguuugucgagcgcaaccugguuaagcccgaaggcaaggucaucgaccucggcugcgggcggggggguugguccuauuacugugcuggccugaagaaggugacagagguaaagggguacaccaagggcggcccggggcacgaggagccgaucccaauggccaccuacgguuggaacuuagucaagcuccacagugguaaggacguguucuuuacgccgccggagaagugcgauacccugcugugcgacaucggugaaucgagccccaacccgaccauagaggagggccgcacucuccgcgugcugaagauggucgaacccuggcugcguggaaaccaauucugcauuaagauccucaauccuuacaugcccagugugguggagaccuuggaacagaugcagcgcaagcacggcggaaugcugguccgaaacccccucagcagaaacuccacucaugaaauguacugggucagcugcggcaccgguaacauaguguccgccgucaacaugaccagccggaugcuccugaaucgguucaccauggcccaccgcaagcccacguacgaacgggacguggacuugggcgccggcaccagacacguugcggucgagcccgaagucgccaaccuggacaucaucgggcagcgcaucgagaacaucaagaacgagcacaagucgaccuggcacuacgacgaagacaaccccuacaagaccugggcauaccacggcagcuacgaggucaagcccuccggaucggcuucaagcauggugaacggggugguucggcugcucacuaagcccugggaugucaucccgauggugacccagaucgcaaugacagacaccacaccauuugggcagcagcgcgucuucaaggagaaaguggacacacggacccccaaggcgaagcgcggcacagcccagaucauggaggugacggcacgguggcuguggggcuuccugagccgcaacaagaagccgcggaucugcacccgcgaggaguucacgcggaagguccgcuccaaugccgccaucggcgcgguguucguggacgagaaccaguggaacucugcgaaggaggccgucgaggacgagcgguucugggaccucgugcauagagagcgggagcugcacaagcagggaaaaugcgccacuugcgucuacaacaugauggggaagcgcgagaagaagcugggugaguucgguaaggcaaagggcucccgggccauuugguacauguggcucggggcgcgguuccuggaguucgaggcccugggguucaugaacgaggaccacugguuuaguagagagaacuccuuaagcggcgucgaaggcgagggccugcauaaguuagguuacauccuccgcgacaucucgaagauccccgguggcaacauguacgccgacgacacagccgggugggauacccggaucaccgaggacgaccugcagaacgaagccaagaucacggacaucauggagcccgaacacgccuuacucgccacaagcaucuucaaauuaaccuaucagaacaagguugugcgcguccagcgacccggcaaaaaugggaccgucauggacgugaucucccgccgcgaccagcggggcagcggccaagucgguaccuacggccugaacacguucaccaacauggaggcacagcucaucagacagauggaguccgaggguauuuuuuccccguccgaguuagagacgccuaaccuggcggagcguguguuugacugguuggagaagcacggcaucgagcgccugaagcggauggccaucagcggggacgacugcguggucaagcccaucgacgaccgcuucgccaccgcccugacggcccucaacgacaugggcaaggugcggaaggacaucccccaaugggagccauccaaggguuggaacgacuggcagcaagucccauucugcagccaccauuuccaucagcugaucaugaaggaugggcgcgagaucgugguuccuugccguaaucaggacgagcuggugggcagagcgcgggucucccagggggcgggcuggagccuucgcgagacugccugccugggcaaaagcuacgcacagauguggcagcugauguacuuccaucggcgcgaccuccggcuggcugcgaacgccauuuguuccgccgugccgguggauugggugccgaccagccguaccacguggucgauucacgcccaccaccaguggaugaccacugaggacaugcugagcgucuggaaccggguauggaucgaggaaaaccccuggauggaagacaagacccacgucuccuccugggaggacgugccuuaucucggaaagcgcgaggaucaguggugcggcucccugaucgggcugaccgcgcgggcuacgugggcaacaaacauccagguggccaucaaccagguccggcgccucaucgguaacgagaacuacuuggacuacaugaccuccaugaagcgcuucaagaacgaguccgaccccgagggggcauuaugguga

SEQ ID NO: 24701 - RNA, 9879 nt, Artificial Sequence
  derived and/or modified CDS sequence (opt11) from DENV-1__KC762641__SS-prME
agcgugaccaugcugcucaugcugaugcccaccgcccucgccuuccaccucaccacccggggcggagaaccccacaugaucgugagcaagcaagagcggggcaaaagccuguuauucaagacaagcgcggggguuaacaugugcacccucaucgcaauggaccugggcgagcugugcgaagacacacucaccuacaaguguccccguaucaccgaagccgagccugacgauguggacugcuggugcaacgccacugacacguggguaaccuacgguaccugcagccaaaccggcgagcaccggagggacaagcgcagcguagcccuggcgccccaugucggccuggggcucgagacgcgcaccgaaaccuggaugagcuccgagggugcuuggaagcagauucagcggguggaaaccugggcacuccgccaccccggguucacggugauugcccuguuccucgcgcacgccaucggcaccuccaucacgcagaaagggaucaucuucauccugcugaugcuagugaccccuuccauggccaugcggugcgucggcaucggcagccgcgacuucguggaggggcuguccggcgcaacguggguggacgucgugcuggagcacgggagcugcgugaccaccauggccaaggacaagccuacccucgacaucgagcugcugaagacggaggucacuaauccggcggugcuccggaagcugugcauugaggccaagaucagcaacacaaccacggauagccguugcccgacgcaaggcgaggccacccuggucgaggagcaggacgcgaauuucgucugccggcgcaccuucgucgaccggggcugggguaacggcugcgggcuguucggcaaagggucgcuuaucacgugcgccaaguuuaagugcgugaccaagcuggagggcaagauuguccaguaugagaaccucaaguacagcgucauagugacaguacacaccggcgaccagcaccagguugggaacgaguccacggagcauggaaccaccgcgaccaucaccccgcaagcccccacgaccgagauucaguugaccgacuauggggcccugacccucgacuguagcccacgaacgggccuggacuucaacgagauggugcugcucaccaugaaggaaaaguccuggcugguccauaagcagugguuccuggaccucccccucccuuggaccucaggggccaguaccucccaggagacguggaacagacaggaccugcucgugacguucaagaccgcccacgcgaagaagcaggaggucgugguucugggcagccaggagggcgcaaugcacaccgcccugacgggggccaccgaaauccagaccuccggcaccacgaccaucuuugccgggcaccucaagugccgccugaagauggacaaguuaacccucaagggcaugagcuacgucaugugcacggggaguuucaagcuggagaaggagguggcggagacgcagcacggcaccguccugguccagaucaaguacgagggcaccgacgccccgugcaagauccccuucagcacacaggacgagaagggggugacgcagaauggccggcuaaucaccgccaacccuaucgugaccgacaaggaaaagcccgucaacaucgaggccgagccgcccuucggggagucauacaucguuaucggcgccggcgagaaggcccucaagcugagcugguucaagaaggguuccagcaucggcaaaauguucgaggccaccgcccgcggggcccgccgcauggcgauccugggcgauacggccugggacuuugguagcaucggcggcguguucacuagcgucggaaagcucgugcaccagauuuucggcaccgccuacggugugcuauucuccggggugucuuggaccaugaagaucgggaucggagugcugcucacguggcugggccucaacagccgcagcaccucccucagcaugacgugcaucgccguugggcuggucacccuguaucuaggcgucauggugcaggccgacaguggaugcgucaucaauuggaagggccgcgagcugaagugcgggagcggcaucuucgugacgaacgaagugcacaccuggaccgagcaauacaaguuccaggcggacagccccaagcgccugucugccgccauagggaaggccugggaggagggagucugcggcauucgcagcgccacccgccuggaaaauaucauguggaagcaaaucuccaacgagcugaaccacauucugcucgagaacgacaugaaauucacggugguggucggggacgucgcgggcaucuuagcccaagggaagaagaugauccggccccagcccauggagcacaaguacucuuggaaguccuggggcaaggccaagaucaucggcgccgacgugcagaacacgaccuucaucaucgacgggcccaauaccccggagugucccgacgaccagcgcgcguggaacaucugggaggucgaggacuacggcuucgggaucuucaccacgaacaucuggcuaaagcuccgggacagcuacacccagguaugcgaccaccgccugaugagcgccgcaauuaaagacagcaaggccgugcaugccgacaugggcuacuggaucgaaucugagaagaaugagaccuggaagcuggcgcgggccagcuuuaucgaggucaagaccugcaucuggccaaagucccauacgcuguggagcaauggggugcuggaguccgagaugaucauccccaaaaucuauggaggcccgaucagccagcacaacuaccgcccuggguacuucacccagaccgccggcccauggcaccuggggaagcucgagcuagacuucgaccugugugagggcaccacggucgucguggacgagcauugcggaaaucgggggcccucguugcgcaccaccaccgugacaggcaaaaucauccacgaguggugcugccgaagcugcaccuuaccgccccugcgcuuccguggggaggacggcugcugguaugggauggagauccgaccggugaaggagaaggaggaaaaccucgugaaguccauggugagcgccggcucgggcgaggucgacuccuucagccuugggcugcucugcaucagcaucaugauugaagaagugaugagaagcagguggucucggaagaugcugaugaccggcacccuggcaguguucuuccuccuuauaauggggcagcugacauggaaugaccucauccgccuguguaucauggucggcgcgaaugcguccgaccgcauggggaugggcaccaccuaccuggcccucauggccaccuucaagaugcggccgauguucgcagugggcuugcuguucaggcgguuaacgucccgugaggugcugcuccuaaccauugggcugucacuggucgcguccguggagcucccaaacagccuggaggagcugggcgacgggcucgccaugggcaucaugauccuuaagcugcucaccgacuuccagucccaccagcugugggcgacccuacugagccugacguucaucaagaccaccuucucccugcacuacgccuggaagaccauggcuaugguccucagcaucguaucucuguucccccugugccuuagcacgaccucacagaagaccaccuggcugcccguucugcucggcagccuggggugcaaaccguugacuauguuccucaucgccgagaacaaaaucuggggccggaaguccuggccauugaacgaggggaucauggccgucggcaucguaaguaucuuacugagcucccugcugaagaacgacgugcccuuggcugggcccuuaaucgccggcggcaugcugaucgcguguuacgucauaagcggguccucugcggaccucucccuugaaaaggccgccgaggugagcugggaggaagaagccgagcacuccggcgcgagccacaacauccucguggaaguccaggacgaugggacgaugaagaucaaggacgaggagcgcgacgacacacucaccauccugcugaaagccacccuccuggccguguccgguguguacccgcugagcauccccgcuacccucuucgucugguacuucuggcaaaagaagaagcagcggucuggcguccugugggacacucccagcccgcccgagguugagcgagccguccuggacgauggcauauaucggauaaugcagcgcgggcugcucgggagaucccaagugggcgugggcgucuuccaggagaacguguuccacaccauguggcacguuacccgaggcgcgguccugauguaucaggggaagcgucuggagcccagcugggcauccgugaagaaggaccucaucucauacggcgggggguggcgccugcagggcuccuggaauacgggggaggaggugcagguaauagccguggagccaggcaagaaccccaagaacguccaaaccgcccccgggaccuucaagacgcccgagggggaggucggcgccauugcgcuggacuucaagcccgggacgagcgguucccccaucgugaaccgggaggggaagaucgugggccucuacggaaacggggucgugaccaccagcggcaccuacgugagcgccaucgcccaggcuaaggccucacaggaagggccucuuccugagauugaggacgaagucuuccgcaagcggaaucugacgaucauggaucuccaccccggcagcgggaaaacccguagguaccugccggcaaucguucgggaggcgaucaagagaaagcugagaacccucauccuggccccaacacgcgugguggccuccgagauggcggaagcccugaagggcaugcccauccgguaccagacgacagccgucaaaagcgagcacacuggcaaggagaucguggaccucaugugccacgccacuuucacaaugcgccuguuaagcccagucagaguaccgaacuauaauaugaucaucauggaugaggcccacuucaccgaccccucguccauagcggcccgcggguauaucucuacccggguuggcaugggcgaggccgcggccaucuuuaugaccgcgacgccucccggcuccgucgaggccuucccgcagaguaacgcggugauccaggacgaggagcgcgacauucccgagcggagcuggaacagcggguacgaguggaucacagacuucccgggcaagaccgugugguuugucccguccaucaagagcggcaacgauaucgccaacugucugcgcaagaaugguaagcgugugauccagcuguccagaaagaccuucgauaccgaguaucagaagaccaagaacaaugacugggacuauguggucaccaccgacauuucugagaugggggcgaauuucagggccgaccgcgugaucgauccgcgacgcugccugaaacccguaaucuugaaggacggaccagagcgggucauccuggccggccccaugccgguaacggucgcaucggccgcgcagcgcagagggcgcgugggccggaaccacaacaaagaaggcgaccaguacauauacauggggcagccacuaaauaacgaugaagaccacgcccacuggaccgaagccaagaugcuccuggacaacaucaauacaccggagggcaucauucccgcccuguucgagccggagcgcgagaagagugccgcgauugacggagaguaccgccuacgcggcgaagcccgcaagaccuucgucgagcugaugcggcgcggggaccucccggucuggcucuccuacaaaguggcuagcgaggguuuccaguacagcgaccggcgcuggugcuucgacggcgagaggaacaaccaggugcuggaggagaacauggacgucgagaucuggacgaaggagggggagcgcaagaagcuacggccccgcuggcucgacgcacguaccuacuccgacccccuggcccugcgcgaguucaaggaguucgcggccggacggagaucagugucgggggaccucauccuggagaucggcaagcugccccagcaccucacccagcgggcccagaacgcccuggacaaccuaguuaugcugcacaacagcgagcagggcgggcgugcguaccggcacgccauggaagagcugcccgacaccaucgagacacugaugcuccuagcccugaucgccguccucaccggaggggugacgcuguucuuccuguccggacgcggguugggcaagaccaguaucggucuucugugugugauggcuuccagcguccuuuuauggauggcguccguugagccccacuggaucgccgccagcaucauucuggaguucuuccucauggugcugcugauccccgagccggaucggcagcgcacgccccaggacaaccagcuugcguacgucguuaucgggcugcuguucaugauccucacggugacggccaacgaaaugggccugcuggagaccaccaaaaaagaccucgggaucggccacgucgcgguggagaaccaccaccacgccgccaugcuggacguggaccugcaccccgccuccgcuuggacgcuguacgcggucgccaccaccaucaucaccccgaugaugcggcacacgaucgagaacaccacagccaacaucagccugaccgccaucgccaaccaggcugccauccuaaugggccucgacaagggcuggcccaucuccaagauggauaucggcgugcccuuacuggcccucgggugcuacagccaggugaaccccuuaacccugacugcggcgguguuaaugcugguggcccacuacgccaucaucggcccagggcugcaagcuaaggcgacucgcgaagcucagaagcgcacggccgccggcauuaugaaaaacccgacgguggauggcaucguagccaucgaccucgacccggugguguacgacgccaaguucgagaagcaacuggggcagaucaugcuacucauucucugcaccucccaaauccugcucaugcggaccaccugggcgcugugcgaguccaucacguuagccaccggcccccuaaccacccucugggagggguccccgggcaaguuuuggaacaccaccaucgccgucagcauggccaacauuuucaggggguccuaccucgcuggcgcaggucucgccuucagccucaugaaguccuuggggggggggcggcgcgggaccggggcccagggagagacccugggcgagaaguggaagcgccagcugaaccagcugagcaagagugaguucaacacguacaagcgcagcgggauaauggagguggaucggucagaggccaaggagggccugaagcgcggggaaaccaccaaacacgccguuucccgcggcaccgccaagcugcggugguucgucgagcggaaccuggugaagcccgaggggaaggugaucgacuuaggcugcggucgcgggggcuggucuuacuacugcgcagggcucaagaagguaacggagguaaagggcuacacgaagggcgggcccggccacgaggagcccauaccgauggccaccuacggguggaaccuugugaagcugcauuccggcaaggacguuuucuucaucccucccgagaaaugcgacacccuccugugcgacaucggggagagcucccccaacccgacgaucgaggaggggaggacccugcgcgugcucaagaugguggaacccuggcugcgggggaaccaguucugcaucaagauccugaacccguacaugcccucagucguggaaacccuugagcaaaugcagcgcaagcacggcggcaugcucgugcggaauccgcugucacgcaauagcacccaugaaauguacugggucuccugugggaccggcaacaucgugagcgccgugaacaugacgucccggauguugcugaaucgcuucaccauggcgcaccgcaagcccacauacgaacgggacgucgaccugggggccggcacacgccacguggccguagaacccgaggucgccaauuuagacaucaucggccagagaaucgagaacaucaagcacgaacauaaaagcacauggcacuacgacgaggacaacccguacaagaccugggccuaucacgggucauacgaaguuaagccaucggguuccgcuagcagcauggucaacggcguggugaagcuguuaaccaagcccugggaugucauaccaauggugacccagaucgcgaugacggacaccacccccuucggccagcagagaguguucaaagagaaagucgacacgcggacgccaaaagccaaacgcgggacuacgcagaucauggaggugaccgcccgguggcucuggggcuuccugagucgcaacaagaagccccggauuugcacgcgcgaggaguucacccggaaagugcgcuccaacgccgcgaucggcgccguuuucguggaugagaaccaguggaacuccgcuaaggaggccguggaggacgagcgguucugggacuugguccaucgcgagcgggagcuccacaagcaagggaagugcgcgaccugcguguacaauaugauggguaagcgcgagaagaagcugggggaauucgggaaggccaaagguagccgggccaucugguacauguggcugggcgcccgcuuccucgaguucgaagcccugggcuucaugaacgaagaccacugguuuucgcgggagaacagccuguccgggguggagggcgaggggcugcacaagcugggcuacauccuacgcgacaucagcaagaucccggggggcaacauguacgcggacgacaccgccggcugggacacgagaaucaccgaggacgacuugcagaacgaggccaagaucaccgauaucauggagccggagcaugccuuguuagccaaggcgaucuucaaacucaccuaccagaauaaagucguacgcgugcagcgucccgcuaagaacgggacggucauggacgugaucaguagacgggaccagcggggcagcggccagguuggaaccuacggauuaaacacguucaccaacauggaagcccaacugauucggcagauggaauccgaggggaucuucucgccgucagagcucgagacgcccaaccuggccgagcgcguacuggacuggcucgaaaaguauggcguggagcgccugaagcggauggccaucuccggggacgauugcgugguaaagccgaucgacgaccgcuucgcgaccgcucugacugcccucaacgacaugggcaagguucggaaggacaucccccaaugggagcccaguaagggauggaacgacuggcagcagguccccuucugcagccaccacuuccaccagcugaucaugaaagauggccgcgaaaucguggugccgugccggaaccaggaugagcuggugggccgcgcccgggucagccagggggcaggcuggagccuaagggagaccgcgugccugggcaagaguuacgcccagauguggcagcugauguauuuccaccggagggaccuccggcuggcagcgaacgcgaucugcuccgccgugccgguugauuggguccccaccagccgcaccaccuggagcauccaugcccaccaccaguggaugacaacggaagacaugcugucagucuggaaccggguguggaucgaagaaaaccccuggauggaggacaaaacccacaucucaucaugggaggacgucccauacuuggguaagcgcgaggaccaguggugcgggucccuuaucggccuuaccgcccgcgccaccugggcgaccaacauacagguggccaucaaucaaguacggcgucucaucgguaacgagaacuaccuggacuacaugacgagcaugaagcgguucaagaaugaguccgacccagagggggcccugugguga

SEQ ID NO: 24702 - RNA, 9879 nt, Artificial Sequence
  derived and/or modified CDS sequence (opt11) from DENV-1__KC762648__SS-prME
agcgugaccaugcugcucaugcugaugcccaccgcccuggccuuccaucuuacaacccggggcggagaaccccacaugaucgugagcaagcaggagcgaggcaaaucgcugcuguucaagaccuccgccggggugaacaugugcacccucaucgccauggaccugggcgagcuuugugaagacacguugaccuauaaguguccccgcaucacggaggccgagcccgacgacguggacuguuggugcaacgcuaccgacacgugggugaccuacgggacaugcucgcagaccggcgagcaccggcgagacaaacggucgguggcccuggcaccgcacguuggccugggguuagagacgcgcaccgagaccuggaugagcucggagggcgccuggaagcagauucagcggguugaaaccugggcccuacgccaccccggguucacggugauagcccucuuccucgcgcacgccaucggcacgucaaucacucagaaggggaucaucuucauccuguuaaugcucguuacccccucuauggcuaugcggugcgucgggaucggcagccgcgacuucguggagggccugagcggcgcaaccuggguggacguggugcuggagcacgggagcugcgugaccaccauggccaaggauaaacccacccucgacaucgagcugcugaagacggaggucaccaauccugcgguuuuacggaagcugugcaucgaggccaagaucagcaacaccaccacggacagccguugcccgacccaaggcgaagcgacccugguggaggagcaagacgcaaauuuugucugccggcgcaccuucguggaccggggcuggggaaacggcugcgggcuauuuggcaagggaucgcugauuacgugcgccaaguucaagugugugaccaaguuagagggcaagaucguacaguacgaaaaccuuaaguacagcgugaucgugaccguccacaccggcgaccagcaucaaguggggaaugaguccacagaacacggcaccaccgcgaccaucacgccccaggccccgaccacggagauucagcugaccgacuacggggcccugacccucgacugcagcccgcguacgggcuuagacuucaacgagaugguccugcucaccaugaaggagaaguccuggcugguucacaagcagugguuucuggauuuaccccugcccuggaccuccggggccucgacaucccaggagacguggaaccggcaggaccugcucgugaccuucaagacagcccacgccaagaagcaggaaguugugguccugggaagccaggagggcgccaugcacaccgcccugacgggggcuaccgaaauccagacauccgggaccacuacuaucuucgcggggcaccucaagugccguuuaaagauggacaaauugacccucaagggcaugagcuacgucauguguaccgguuccuucaagcuggagaaggagguggcggagacccagcacggcaccgugcugguccagaucaaauacgagggcaccgacgcccccugcaagauucccuuuagcacccaggaugagaagggggugacacaaaacggcaggcugaucaccgccaacccgaucgugaccgacaaagagaagcccgucaauaucgaggcugagccgcccuucggcgagucauacaucgugaucggcgcgggcgagaaggcacucaaacugagcugguucaagaagggcuccucuaucgggaagauguucgaggccacggcccgcggggccaggcgcauggcgauccugggcgacacggcaugggacuucggguccaucggcggcguguucaccagcguggggaagcuggugcaccagauauucgggacggccuacgguguacuguucagcggcgucucuuggaccaugaagaucgggaucggcgugcugcuuacguggcugggcuugaacucccgcagcacaucucucagcaugaccuguaucgccguggggcuggucacgcuuuaccucggcgugauggugcaggccgacuccgggugcgucaucaauuggaaaggccgggagcugaagugcggcagcggcauuuuugucacgaaugaagugcacaccuggaccgaacaguauaaguuucaggcggacuccccgaagcgccuguccgcugccaucggaaaggccugggaggaagggguaugcggcauccggagcgccacgcgccuggagaacauaauguggaagcaaaucuccaacgagcugaaccacauauuacuggagaaugacaugaaguucaccguagugguuggggacguggcggguauccuggcccaggggaaaaagaugauccggccgcagccgauggagcacaaguacuccuggaaguccuggggcaaagccaaaauaauaggcgcugacguccagaacaccaccuucauaaucgacggccccaacaccccggagugccccgacgaccaaagggcguggaacauaugggaggucgaggacuacggcuuugggaucuucaccacgaacaucuggcugaaguuacgagacagcuauacccaggugugcgaucaccgccugauguccgccgccauaaaagacagcaaggccgugcaugcggacaugggcuacuggaucgaguccgagaagaacgaaaccuggaagcuggcgcgggccagcuuuaucgaggucaaaacaugcaucuggcccaagucccacacgcucuggagcaaugggguccuugaguccgagaugaucauccccaagaucuauggaggcccgauuucgcagcacaacuaucgcccugguuacuucacccagaccgccggccccuggcaccuagggaagcucgaacuggacuucgaucugugcgagggcaccacgguggucguugacgagcacugcggcaaucgggggcccucacucagaaccacuacugucacgggaaaaaucauccacgaauggugcugucggagcugcacgcugccgccccuccgcuuccgcggugaagacggcugcugguacggaauggaaauucgccccgugaaggagaaagaggagaaccucguaaagagcauggugagcgcggggagcggcgaggucgacucuuucagucuggggcuguuauguaucuccaucaugaucgaggaagugaugaggagccgcuggagccggaagaugcuaaugaccggcacacuggccguauucuuuuugcugauuauggggcaguugacguggaacgaccucauacgucugugcauuaugguuggcgcgaaugccagcgaccgcaugggcaugggcaccaccuaucuggcccugauggccacauuuaagaugcggccgauguucgccgugggucuucuguucaggaggcucacgucccgugaagugcugcugcucaccauugggcugucccuggucgcguccguggaguuacccaauagucuggaggagcuaggcgacgggcucgccaugggcaucaugauucugaagcugcucaccgacuuucagucccaccaacugugggccacccugcucagccucacguucaucaagacuacuuucagccugcacuacgccuggaagaccauggcgaugguccucucaaucgugucccuuuucccccugugcuuaagcacuaccucccagaaaacuaccuggcugcccgugcuccucgggaguuuagggugcaaaccguugaccauguuccugaucgcagagaacaagaucuggggccggaaguccuggccccugaacgaggggauuauggccgucgggaucgugucuaucuugcucagcucccugcugaagaacgacguuccucucgcagggccgcugaucgccggcggcaugcucaucgcgugcuacgugauaagcggcucaagcgcugaucucucccuggagaaggcggccgagguuucuugggaggaggaggccgaacacuccggugcgucacacaacauccugguggaaguucaggaugacgggaccaugaagaucaaggacgaggagcgcgacgacacccuaaccauccuacugaaggccacucuacuggccguguccggcguguacccgcugucgaucccugcaacccucuucgucugguacuucuggcaaaagaagaagcaaagguccgggguguugugggacacccccagcccacccgagguugaacgcgccguccuggacgacggcaucuaccguaucaugcagcgcggccugcucggaaggucccaggugggcgugggugucuuucaggagaauguauuccacaccauguggcaugugacccgcggcgcgguccucauguaucaaggcaaaagacuggaacccuccugggcaucugugaagaaagaccucauuagcuacgguggaggguggcgacuucaaggcuccuggaacacuggggaggaggugcaggucaucgccguggagcccggcaagaacccuaagaacgugcaaacugcaccagggacguucaagacccccgagggggaggucggcgccaucgcguuagauuucaagcccgggacgagcggcucccccaucgugaaucgagaggguaagaucgugggcuuguacggaaacggggucguaacgaccagcggcaccuacgugagugccaucgcgcaggccaaggcgucccaggaagggccgcugcccgaaaucgaggaugaggucuuucgcaaacggaaccuaacgauuauggaccuccaucccggcagcgggaagacucgccgcuaccugccugccaucgugcgcgaggccaucaaacguaaguugcgcacccucauccuagcgcccacccgcguggucgccuccgaaauggcggaggcccugaagggcaugccgauccgguaccaaacuaccgccgucaagagcgaacacaccggcaaggagaucguggaccucaugugccacgccaccuucacaaugagacugcuuucccccguccggguaccgaacuacaacaugaucaucauggacgaagcacacuucaccgacccgagcucuauagcggcgcgcggguacaucagcacucgggugggcaugggggaagcggcggccauauucaugaccgcgacaccgccaggaucagucgaggccuucccgcagagcaacgcagugauacaggaugaggaacgggacauccccgagcgguccuggaacagcggguacgaguggaucaccgacuuucccggcaagaccgugugguucguccccuccaucaagaguggaaacgacaucgcuaacugccuacgcaagaacgggaagcggguuauucagcugucccgcaagaccuucgauacggaauaccaaaagaccaagaauaacgacugggauuacguggucaccacugacaucucggaaaugggcgcgaacuucagggccgaccgcgucauugacccgcggcgcugccugaagcccguuauccucaaggacggucccgagcgggucauccuugccggcccuaugccggugacugucgccuccgccgcgcagcgucgggggcgcgugggccggaaccacaacaaggagggcgaccaguacauauacauggggcaaccccugaacaacgacgaggaccacgcccacuggaccgaggccaagaugcuccuagacaacauuaacacccccgagggaaucauccccgcccuguuugagcccgagcgcgagaagucugccgcgaucgacggugaauaccgccugcggggcgaggcccgcaagaccuuuguggaauugaugcggcgcggggaccugcccgucugguugucauauaagguugcuucggaaggcuuccaauauagcgaccgacgauggugcuucgacggcgagcgaaacaaccaggugcuggaggagaacauggauguggagaucuggacuaaagagggggagcguaagaaacugaggccccgcugguuagacgcccguacauacuccgacccccuggcccugcgcgaguuuaaggaguucgcagcaggccgccgcucuguaucaggggacuuaauccuggagaucggcaagcugccucagcaccucacccagcgagcccaaaaugcuuuggacaaccuggugaugcuccauaauucggaacagggcggccgcgcguaccgacaugcaauggaggaguuaccugacaccaucgagacgcugaugcuucuggcccucaucgccgucuugacaggaggggucacccuguucuuucuuuccggccgagggcucggcaagaccagcauaggccugcugugugugauggccuccagcgcgcuccuguggauggccuccgucgaaccgcacuggaucgccgccucgaucauccuggaguucuuccucaugguguuacugauccccgagccggaucggcagcgcacgccacaggauaaccagcucgcguacguggucauugggcugcuguucaugauacucacgguggcggccaacgaaaugggccugcuagagaccaccaagaaggaccucgggaucggucacguggccgucgaaaaccaucaccaugccgccaugcuggauguggauuugcaccccgccuccgcguggacccucuacgccguggccacgaccaucaucaccccgaugaugcggcauaccauugagaacacgaccgccaauaucagccugaccgcgauagccaaccaagccgccauucugauggggcucgacaagggcuggccuaucuccaagauggacaucggcguucccuuguuagcucuuggauguuacagccaggugaacccacugacccugacggcugcugugcugaugcuggucgcccauuacgccauaauuggcccggggcuacaggccaaggccacucgcgaagcccagaagaggaccgccgcuggcauaaugaaaaacccuaccguugacgggaucguugccaucgacuuagaccccgucguuuacgaugccaaguucgaaaagcaguuaggccagaucaugcugcucauacuuugcacuucccaaauuuugcuaaugcggaccaccugggccuuaugcgaaagcaucacccuggccacggguccccuaacgacccugugggagggguccccgggcaaguucuggaacaccacgauagccgugagcauggcgaauauuuuccgggggucuuacuuggccggcgccggucuggccuucaguuuaaugaaaucccuaggaggagggcggcgcgggaccggggcgcagggugagacccucggggaaaaguggaagcggcagcugaaccagcuguccaaaagcgaguucaauaccuacaagcgcuccgggaucauggaggucgaccggagugaggccaaggagggacuaaagagaggggaaacuaccaagcacgccgugucccgcggcaccgccaagcugagaugguuugucgagcggaacuuagugaagccugaggggaagguaaucgaccugggauguggcaggggaggcuggaguuacuacugcgcuggccucaaaaagguaaccgaggucaagggcuacacgaaaggcggccccggccacgaggagcccaucccgauggcgacguauggguggaaccugguaaagcugcacuccggcaaggacguguucuucauaccacccgagaaaugcgacaccuugcugugugacaucggggagagcuccccuaacccuacaaucgaggaggggcggacguuacgcguucucaagaugguugaacccuggcugcgggggaaccaguucugcaucaagauccugaacccuuacaugcccagcguggucgagacuuuagagcagaugcagaggaagcacggcggcaugcuggugcggaauccgcuguccagaaacucaacgcacgaaauguauugggucucgugcgggaccggcaauauagucucggcuguuaacaugacgucacggaugcuccugaacagauuuacgauggcccacaggaaacccaccuacgagcgggacguggaccugggggccggcacccgccacgucgcggucgaacccgagguggcgaaccucgacauuaucggccagcggauugagaauaucaagcacgagcacaagagcaccuggcacuacgacgaggacaauccauacaagacgugggccuaccacggauccuacgaggucaagccguccgguuccgccagcagcauggugaacggggucgugaagcugcucaccaagcccugggacguuauccccaugguuacccagaucgccaugaccgacacgacacccuuuggccagcagcgcguguuuaaggaaaagguagacacccgaacccccaaggccaaacgcgggacgacccagaucauggagguuaccgcgcguuggcucuggggauuccugucccgcaacaagaaaccccggaucugcacgagggaggaguucacgcggaaggugagaagcaacgccgccaucggcgccguguucgucgacgagaaucaguggaacucggcgaaggaggccguggaggacgagcgguucugggaucuagugcacagagaaagagagcuccacaagcaggggaagugcgccaccuguguauacaacaugaugggcaagagggagaagaaacugggggaguucggcaaggccaaagggucacgggcgaucugguacauguggcuaggcgcgcgcuuccuugaguucgaggcccucggcuucaugaacgaggaccacugguuuucccgggagaauagccugagugggguggagggagagggccuacacaagcugggcuacauacugcgugacaucagcaagauacccgggggcaauauguacgccgacgacaccgccggcugggacaccagaaucacggaggacgaccuccagaacgaggccaagauaaccgauaucauggagccggagcacgcgcuacucgccaaggccaucuucaagcucaccuaccagaacaaggugguccgugugcagcgccccgccaaaaacgggaccgugauggacgucaucucucgucgcgaccagagaggcagcggccagguggggacguauggccugaacaccuucaccaacauggaggcccagcuuauccgccagauggaguccgaggagaucuucagccccucggaauuagagacccccaaccuggcggagcgggugcuagacuggcucgaaaaauacggugucgagcgccugaagcgcauggccaucagcggggaugacuguguagugaaaccaauagacgaccgcuuugcaacggccuuaacagcccuuaacgauauggggaaggucagaaaggacauaccccagugggagccgagcaagggcuggaacgacuggcagcagguacccuucugcagccaccacuuccaccagcugaucaugaaggacgggcgcgagauaguggucccgugccggaaccaggacgaguuaguuggccgcgcgcgagugucccagggcgccggcuggagccugcgcgaaaccgcgugccugggcaagagcuacgcccagauguggcagcuuauguauuuucaccggcgcgaccuccggcuggcggccaacgccaucugcucggccguucccguggacugggucccuaccagccgcacuaccuggagcauacacgcccaccaccaguggaugacgacggaggacauguugucggucuggaaccggguguggaucgaggaaaaccccuggauggaggacaagacucauaucucauccugggaggacgugccauaucucgggaaacgcgaggaccaguggugcggcucccucaucgggcugaccgcgagagccaccugggcgaccaacauccagguagccauaaaucaggugcggcgccuaaucgguaaugagaacuaucuggauuauaugacuagcaugaaacgguucaaaaaugaguccgauccggagggcgcccugugguga

SEQ ID NO: 24703 - RNA, 9879 nt, Artificial Sequence
  derived and/or modified CDS sequence (opt11) from DENV-1__KC762622__SS-prME
agcgugaccauguuacucaugcugaugcccaccgcgcuggccuuucaccucaccaccagaggcggggaaccgcacaugaucgugagcaagcaagagcgagggaagucacuacuuuucaagacgagcgccggggucaauaugugcacccugauagcgauggaccugggcgagcugugugaggacacgcuaacguacaaaugucccagaaucacugaggccgaacccgacgacguggacugcuggugcaacgccacugauaccugggugacauaugguaccugcagccaaaccggcgagcaccggcgagauaagcgaucuguagcccuggcgccccacguggggcuggggcucgaaacacgcaccgagacauggaugucauccgagggcgcguggaagcagauccagagggucgaaaccugggcccugcgccaccccggguucacagugauggcgcuguuucucgcgcacgcgaucggcacuucgauuacccagaaggggaucaucuucauacugcugauguuggugacccccuccauggcgaugcggugcguuggcaucggcagcagagacuuuguggaggggcuguccggcgcgacguggguggacguugugcuugagcaugggaguugcgugacaaccauggccaaggauaagccaacccucgacaucgagcugcuaaagacggaggucacuaacccggcgguguugcggaaacugugcaucgaggccaagauuucgaacaccaccacggauagccgcugcccgacgcagggcgaagccacacugguggaggagcaagacgcaaacuucgucugucggaggacguuuguggaccguggcugggggaacggcugugggcuguucggaaaaggaucccugaucacaugcgccaaguucaagugcgugacuaagcuggagggaaagauuguacaguaugagaaccucaaauacucggugauagucaccguccauaccggcgaccagcaccaggugggaaaugaaagcacggagcacggaaccaccgcgacaaucacgccccaagcccccacgaccgagauccagcugacugacuacggggcccugacacuagauuguucgccccgcacgggccuggacuucaacgagaugguccuccuaaccaugaaggagaaguccugguugguacacaagcaaugguuccucgacuuacccuugcccuggaccagcggggcaagcaccagccaagagacguggaacaggcaggaucugcucgugacguucaagaccgcucacgcgaagaagcaggagguaguggugcugggcagccaagagggcgccaugcacaccgcgcugaccggagccaccgaaauccagacauccggcacuaccacaaucuucgccgggcauuugaagugccgccuaaagauggacaaacugacccucaagggcaugagcuacgucaugugcaccgggucguucaagcucgaaaaggagguugcggaaacgcagcacgguaccgugcugguccaaauaaaauacgagggcaccgaugcacccugcaaaauccccuucucgacgcaggaugagaagggggugacgcaaaauggcagacuaaucaccgccaacccgaucguaacagacaaggagaagccgguaaacauagaggccgagccgccguucggggaaagcuacaucgucaucggcgcaggcgagaaagcguuaaagcugucgugguuuaagaaaggcucaagcaucggaaagauguucgaggccacagcccgcggggcgcggcgcauggcgaucuuaggcgacacugccugggacuucggguccaucggcgguguguucacaagcgucgggaaacuugugcaccagaucuucggcaccgcauacgggguucuguuuuccggcguaagcuggaccaugaagaucgguaucggcgugcuguugacguggcugggccugaacucccgcagcaccucccucagcaugacguguaucgcaguggggcuggucaccuuauauuugggcgugauggugcaagccgauucggguugcguaauaaacuggaagggccgggaacugaagugcgggucggggaucuucgugacgaacgaaguccauaccuggaccgagcaguacaaguuucaggcugacuccccgaagcgccuuuccgccgccaucggcaaggcgugggaggaagguguguguggcauccguucggccacuagacuugaaaauaucauguggaaacagaucuccaaugagcugaaccacauucugcucgagaacgacaugaaguuuaccgugguggucggagacguggcaggcauucuggcccaagggaagaaaaugauuaggccccagccuauggagcauaaguauagcuggaaguccuggggcaaggccaagaucaucggggccgauguacagaacacgaccuuuauaaucgacgguccuaauaccccagaguguccugacgaucagcgagcguggaacauaugggaggucgaagacuacggcuucgguaucuucaccacuaacaucuggcugaaacuccgggauagcuauacccaggugugcgaccaucgcuuaauguccgcagcaaucaaggacagcaaagccguucacgccgacaugggcuacuggaucgaguccgagaagaaugaaaccuggaaacuugcgagggccucguucauagagguaaagacuugcauauggccuaaaucccauacucuguggagcaauggcguacuugaguccgagaugaucauucccaagaucuacggcggcccuaccagccagcacaacuaccgccccggguauuuuacccaaacggccggccccuggcauuuggggaaacucgagcuggacuucgaucucugcgaggguacgaccguggucgucgacgagcacugcggcaaccggggucccucgcuccgcacaaccacggugaccggcaaaauaauccacgaguggugcugccgcagcuguaccuuaccgccgcugcgcuuucgcggggaagacggcugcugguacgggauggaaaucagacccguuaaagagaaagaggagaaccucgugaagaguauggugucagccggcagcggggaagucgacuccuuuagucuagggcucuuaugcaucuccaucaugaucgaggagguuaugcggagccgguggucucggaaaaugcugaugacuggcacacuggccguguucuuucuauugaucauggggcaguugaccuggaacgaccucauccgcuugugcaucaugguaggagcgaacgccagcgaccguauggggauggguaccaccuaccuggcccucauggcaacguucaaaaugcggccuauguucgccgugggccugcuguuccggcgguugaccucccgcgaagugcuguuacuaaccaucgggcugagucugguagcgucuguugagcucccgaacagccuggaggagcugggcgauggacucgccaugggcauaaugauccugaagcugcucaccgacuuucagucccaucagcugugggccacgcugcucagccugacauucaucaaaaccaccuucaguuuacacuacgccuggaagaccauggcgaugguguugagcaucgugucccuauucccgcugugucucaguacgaccucucagaagaccacguggcuacccguacuucuagguagcuuagggugcaaacccuugaccauguuccucaucgccgagaacaagaucuggggccggaaguccuggcccuugaacgaagggaucauggcagucgguaucguuagcauccugcucagcucccugcugaaaaacgacgugccacucgcugggccgcugauugccggaggcaugcugauugcaugcuacgucauuagcggguccagcgcugauuugucccuggagaaggccgccgagguuagcugggaagaagaagccgagcacucuggagcgagccacaacaucuugguagaaguccaggaugaugggacuaugaagaucaaggacgaagaacgcgaugacacccuaaccauucugcugaaagccacgcuccuggcggucucaggggucuacccgcuuagcauccccgccacacucuucgugugguauuucuggcagaaaaagaagcaacggagugggguacuuugggauacgcccucuccgcccgagguagagcgcgccguucuggacgacggcaucuaccggaucaugcaacgcggacugcucgggcggagccaggugggggugggagucuuucaagagaacguuuuccacaccauguggcacguuacgcgcggugcuguccugauguaucaggggaagcggcuggagcccagcugggccuccgugaagaaggaccucaucagcuacggcggaggguggcgacugcaggguucguggaacaccggugaggaagugcaggucauugcgguggaacccggcaagaauccaaagaaugugcagaccgcccccgggacguucaagacgcccgaaggcgagguuggcgccauugcccuggacuucaaaccggggacguccggaucgcccauagugaaccgagaggguaagaucgugggcuuauauggcaacggcgucgucacgacgagcggcaccuaugucagcgccaucgcccaagccaaggcgucucaggagggcccguugcccgagaucgaggacgagguguuccgcaagcggaaccugaccaucauggaucuccaccccgggagcgggaagaccagacgguaucugccugccaucgugcgcgaggccauaaagcggaagcugcgaacacucauccuggccccuacgcgcgucgucgccuccgagauggcugaggcccugaagggcaugcccauccgguaccagaccacagccgugaaaagcgagcauaccggcaaggagaucguggaucuuaugugccacgccacauucaccaugcgccuguugucucccguacgagugccgaacuacaacaugaucaucauggacgaggcacacuucacggaccccagcucgaucgccgcgagaggguacauuuccacucgggugggcaugggggaagcggccgccauuuucaugacagccaccccgccaggcaguguggaggcauucccacagagcaacgccgugauccaggaugaggagcgcgacauacccgagcgauccuggaacaguggguacgaguggaucacugacuuucccggcaagaccgugugguucgugccuuccauaaagagcggaaacgauaucgcaaacugucuccgcaagaacgggaagcgaguaauccagcugucacgcaagacuuuugacaccgaguaucaaaagaccaaaaacaaugacugggacuacguggugacgacagauaucagcgaaaugggugcgaacuuccgggcagacagagucauagauccucggcgcugucucaagccugugaucuugaaggacgggcccgagcgggucauucuggccggccccaugccugucacuguggcguccgccgcucagcgccgcggucgcguggggcguaaccacaacaaggagggcgaccaauacaucuauauggggcaaccacugaacaacgacgaggaccacgcccacuggaccgaggccaagaugcuccuggacaacaucaauacacccgagggcaucauccccgcgcuuuuugagcccgagcgcgaaaagagugccgcgaucgacggugaguaccgccucaggggcgaagcgcgcaagacguucguggaacugaugaggcgaggggacuuaccaguauggcucucuuacaaaguggccagcgagggcuuucaauauagugaccggcgcuggugcuuugacggcgaacggaacaaccagguucuggaagaaaacauggaugucgagauauggaccaaggagggugagcgcaagaaauuacggccgcgcugguuagacgcccgcaccuacagcgacccucuagcgcugcgcgaguucaaggaguuugcggccggaagacgcagcguguccggagaccucauccuggagaucggcaagcuaccucagcaucucacgcagcgugcacagaacgcucuggacaaccuggugaugcuccacaacagcgagcagggagggcgggcguaccggcacgccauggaggaguuacccgacacgauugagacccugaugcuccuggcacugauugccguacucacaggcggggugaccuuauuuuuccuaucgggccgcggccucggaaagacaagcaucggccuacugugcguaauggcauccucaguccuucuguggauggcgucaguggagccccauuggaucgccgccagcauaaucuuagaguucuuccugauggugcugcuuaucccagaacccgaucgccagcgcacgccccaggauaaccagcucgccuacguagugaucggauuacuguucaugauccucaccguggccgcgaacgagaugggccuucuggagacuacgaagaaggaccucggcauuggccacguggccguggagaaccaccaucacgccgccaugcuugacgucgaccugcacccggcguccgcauggacccuauaugccguagcgaccacaauaaucaccccgaugaugcggcauacgaucgagaacaccaccgccaacaucagccugacagccauugcgaaccaagcggcuauccugauggggcucgacaagggcuggccaaucuccaagauggacaucggcgugccguugcuggcccucgggugcuacucccaagugaacccccuaacccugaccgcagccguccucaugcugguggcccacuacgcaaucauagguccggggcuacaagccaaggcaacccgcgaggcccagaagcgcacagcggcugguaucaugaagaacccaacgguggacgggaucgucgccaucgaccucgaccccgugguuuaugacgcgaaguucgaaaaacaguugggccagauuaugcugcucauccuguguaccucacagauccuccucaugagaaccaccugggcgcugugcgagagcauuacgcuggccaccggcccccucaccacccugugggaggguucccccggcaaguucuggaauacuacgauagccguaagcauggcgaauauuuuccgcggguccuaccuugcaggcgccggccucgcauucagccugaugaagagucucgggggugggcggcgcgggaccggugcucaaggagagacuuugggggaaaaauggaagcggcaauuaaaucagcuguccaagucggaguucaacacguacaagagauccgggaucauggagguggaccgcagcgaagcaaaggagggccucaagcgcggggagaccaccaagcacgccgugucccguggaaccgcgaaguuacgcugguucguggaacguaaccucgugaaacccgagggcaaaguuaucgaucuggguugcgggcgcgguggcuggaguuacuacugcgcgggccugaagaaagucacggaggugaaaggauacaccaagggcggcccuggccaugaagaaccgaucccgauggccaccuauggguggaaccugguuaaguuacacucuggcaaggacgucuucuucaucccgccagagaagugcgacacccuccugugcgacaucggggagagcagucccaacccgacgaucgaggagggucggacccuucgagugcucaagaugguggaacccuggcugcgggggaaucaguuuuguaucaagauccugaacccauacaugcccagcgucguggagacucucgagcagaugcagcgcaaacacggcggcauguuggugaggaacccgcuaucgaggaacagcacgcacgaaauguacuggguguccugcggaaccggcaacaucgugagcgcggucaauaugacgagucgcaugcuccuuaaccgcuucaccauggcccacaggaagccaacuuaugagcgagacgucgaucugggagcgggcacccggcacguggcaguagagccggagguugccaaccucgacaucaucggacagcggaucgagaauauuaaacacgaacauaagagcacauggcacuaugacgaggacaacccuuauaagaccugggcauaccauggcucuuacgaggugaagccuagcggauccgccucuucgaugguaaaugguguuguuaagcuacugaccaagcccugggacgucaucccaaugguaacgcagaucgcaaugacggauacuacccccuuuggccagcagcguguguucaaggagaagguggacacgcgaacgccuaaagccaaacgcgggacuacccagaucauggaggugaccgcccgguggcucugggguuuccuuucccgcaacaagaagccccgaaucugcacacgcgaagaguucauccgaaaggugagaagcaacgcggccauaggcgccguuuuuguggacgaaaaccaguggaacucugcaaaagaggcgguggaagacgagcgauucugggaccugguucaccgcgagcgggaacuccacaaacaaggaaagugcgcgaccugcgucuacaacaugauggguaagcgcgagaagaagcugggggaguuugggaaggccaaggggagccgggccaucugguacaugugguugggcgcacgguuucucgaguuugaggcccuaggcuuuaugaaugaggaucauugguucucccgagaaaacagccugagcgggguggaaggggaggggcuccauaagcugggcuacauucugcgcgacauuuccaaaauccccgggggcaacauguacgccgacgacaccgccggaugggacaccagaauaaccgaggacgaccugcaaaacgaagccaagaucaccgacaucauggaaccggagcacgcccuucuggcgaaggcaauuuucaagcucaccuaccaaaacaaaguaguaagagugcaacgccccgcaaagaacgggaccguaauggacguuaucuccagacgcgaccaacggggcagcgggcaggucgggacguacggccugaacaccuucacaaacauggaagcccagcugaucaggcagauggaguccgaggggaucuucagccccuccgaacucgaaacaccgaaccuugcugagcgggugcuggacuggcucgagaaguacggcguagagcgccugaagcggauggcuaucucaggcgaugacugugugguuaagccaaucgacgaccgauucgccacugcccuuaccgcccucaacgacauggggaaggugcggaaggauauuccccagugggagccgaguaaagguuggaaugauuggcagcagguucccuucugcagccaccacuuucaucagcugaucaugaaagacggucgcgaaaucgucgugccgugccgaaaccaggacgaacuggugggcagggcccggguuucccagggggcaggcuggucccuccgcgaaaccgccugccucggcaaguccuaugcacagauguggcaguugauguacuuccacagacgcgaccuucgucucgccgcgaaugccaucugcagcgccgugcccguggacuggguaccuacgucacgaacgaccuggucuauccacgcccaccaucaguggaugaccaccgaggacaugcugagcguguggaacaggguguggaucgaggagaaccccuggauggaagauaaagcccacgucucuagcugggaggacgugccguacuuggguaagagagaggaccaguggugcgggucccugaucggccugacagcgcgcgcuaccugggcgacuaacauccagguugccaucaaucaggucaggagacugauuggcaacgagaauuaucuggacuacaugaccucuaugaagcgguucaagaacgaguccgacccagagggagcccugugguga

SEQ ID NO: 24704 - RNA, 9879 nt, Artificial Sequence
  derived and/or modified CDS sequence (opt11) from DENV-1__KC762629__SS-prME
aguguuacaaugcuccugaugcucaugccgacugcacuggcauuccaccuuaccacuagagggggagaaccacauaugguuguaagcaaacaagaacgcgggaaauccuugcuuuucaaaacaagcgcagggguaaauauguguacacuuaucgcaauggaccuaggagaacucugcgaagacacgcugacguauaaauguccccgaauuacggaagccgaacccgaugaugucgacugcugguguaacgcgacugacaccuggguuacauacggaaccugcagccaaacuggugagcaccgcagggacaagcguucagucgcacucgcgccgcacgucgggcuaggauuggagacacguacggaaaccuggaugaguucagagggggcguggcgacaaauccaacgcguagagaccugggcucuccgacaccccggguucacagucauagcacuguuccuagcacacgccaucgggacaaguaucacucagaaggggauaauauuuauccucuuaaugcuggucacaccgucgauggccaugagaugcguugggauaggaagcagggauuucguggagggacugucgggcgcgaccugggucgacguggugcuagaacacgggucgugcgucacaacaauggcaaaggacaaaccgacccucgacauagaauuacuaaagacggagguaaccaauccggccguucugcggaagcugugcaucgaagcaaaaauuucgaacacaaccaccgacucccggugccccacccagggcgaggcgacgcuuguggaggaacaagacgcaaauuucgugugcagacggacguucguggacaggggaugggggaacggcugcggacuauucgggaaaggaucuuugauuacgugcgcaaaauucaagugugugaccaaacucgaaggcaagauuguucaauacgaaaaccuaaaauacagugucauaguaacuguccacacgggagaccaacaucaaguaggaaacgaaucgacagagcauggcacaacagcuacaaucacaccccaagcgcccacgaccgaaauucaacuaacggacuacggugcccuuacacuagauugcuccccgcgaaccggacuagacuucaacgaaaugguacuccuuacaaugaaagagaagucauggcuaguacacaaacaaugguuucuggaucucccgcuccccuggacaucgggggcaucgacuucccaggagacguggaaccgacaagaccuauuaguaacuuucaaaacggcacaugccaagaagcaggaagucgugguacuaggaucccaagagggcgcgaugcacaccgcucuuacaggcgccaccgaaauccaaacgucggguacaaccacaaucuuugcgggccaccuaaagugccgccugaagauggauaaguugacccugaaaggaauguccuacguaaugugcacaggguccuucaagcuagaaaaagagguagcugaaacgcaacacggcaccguccuaguacaaauuaaguacgaaggaaccgaugcgccuugcaaaauacccuucucaacccaggaugagaagggaguuacgcagaauggcaggcuaauaaccgcaaaccccauaguaacagacaaagaaaaaccaguaaacauagaagcagagccaccauuuggggagucguacauugucauaggagccggugagaaaacccuaaaguuauccugguucaagaaaggcagcagcauagggaaaauguuugaagcgacugcgagaggcgcacggagaauggcaauccuaggcgacacagcaugggacuucggcagcauagguggcguauuuacaagcguagguaaacuugugcaccagauauucgguacugccuacggcguacuuuucagcgguguaagcuggacaaugaagauaggcauaggaguucuuuugacuugguuagggcucaacucccgcagcacaucacuguccaugaccuguauagcggucgggcucgucacccucuaucuaggcguaauggugcaggcagacagcggcugcgucaucaacuggaaaggccgcgaacucaagugcggaagcgguaucuucguaacaaacgaaguacacacuuggacagagcaguacaaauuccaggccgacucccccaaaaggcuuagugcggcaaucggaaaagcgugggaagaaggagugugcggcauaagaagcgccaccaggcuagaaaacauaauguggaaacaaaucuccaacgagcugaaccacauccuacuggaaaacgauaugaaguuuacugucguaguaggggacgucgcgggcauucuggcacaaggcaagaaaaugauuagaccccaacccauggagcacaaauacucuuggaaaagcugggggaaagcuaagauaauaggcgccgacguccaaaacacaaccuucauuauagacgggccgaacacaccagaaugccccgacgaucaacgugcguggaauaucugggagguggaagacuacggguucgggauauucacaaccaacauuuggcucaagcuacgggacuccuacacgcaaguuugugaccaucguuuaaugucagcagccauaaaggauuccaaggcgguacacgcggacaugggauacuggaucgaaucagaaaagaacgaaacguggaagcucgcgcgagcuuccuucauagaaguuaagacguguauauggccaaagagccacacccucuggagcaacgguguucuagaaagcgagaugaucauccccaaaauauacgggggcccaaucucacaacacaauuaccgaccaggcuauuucacacaaaccgccgggccuuggcaccucgggaagcuagaguuagacuucaaccucugcgaagguaccaccguuguaguugacgaacacugcggaaacaggggcccaucacugagaaccaccacgguaacaggcaaaaucauucaugaauggugcugccgcagcugcacgcuaccgccgcugcgcuucaggggcgaggacgguugcugguaugggauggaaauccgaccagucaaggagaaagaagagaaccucgugaaaaguaugguaucagccgggucuggagaagucgauuccuucagucuuggucuacuguguauuucaauaaugauagaagaggugaugcgcucuagguggagcagaaagaugcuaaugaccgggacacucgccguauuuuucuuacucaucaugggacaacuaaccuggaacgaccugauaagauuauguauaauggugggggccaaugccagcgaccgaaugggaaugggcaccacuuaccuggcguugauggcgacauucaaaaugcgcccgauguuugcgguaggacuauuguucaggcgcuuaacaaguagggagguacuacuccuaacaauaggucuuagucuaguugcaagugucgaacuccccaacucccuggaggaauugggagacggacuagcaaugggaaucaugauccuaaaacuguuaacggacuuccaaagccaccaacuuugggcgacauuacucagcuugacauucauuaagaccacuuucucgcugcacuacgcauggaagaccauggccaugguacuaucgaucgugucgcuauucccccugugucuuaguaccacuagccaaaagacaacauggcucccuguucuguuagguagccuuggcugcaagccucugacaauguuccuuauagcugagaauaaaauauggggccgaaagagcuggccguuaaaugaaggaauuauggccgucgggauuguuucaauacucuuauccuccuuacucaaaaacgacgugcccuuagcaggaccacucaucgccgggggcauguugauagccugcuaugucauaagcgggagcucagcagaccuuagcuuggaaaaagccgccgaggugaguugggaggaagaagcggagcauuccggcgcgucucacaacauccuaguagaaguccaagacgacgguacuaugaaaaucaaggacgaagaacgagacgacacgcuaacgauccuacuaaaagccacacugcucgcgguaagcggcguauacccacuaagcaucccagcgacuuuauucgugugguacuucuggcagaagaagaagcaaagaaguggaguauuaugggacacccccagcccgccagaaguagagcgagccguccucgacgacggaaucuaccgaauaaugcaaaggggucuccuaggaaggagccagguagggguaggaguauuccaagaaaacguuuuucacacuauguggcauguaaccaggggugcaguccucauguaccaagggaagcggcuugaaccgucgugggccagugucaagaaagaccuuauaagcuacggcggaggguggcgccuccaggggucguggaacacuggggaagaaguucaaguaauagccgucgagcccggcaaaaauccgaaaaacguacaaacugcaccaggaaccuuuaaaacaccagagggggaaguaggcgccauagcauuagacuucaagcccgggaccagugggaguccgauagugaacagagagggcaaaaucgucgggcuuuacgguaacgggguagucacgacuagcgguaccuaugucagugcaauagcucaagcuaaggcaucacaagaaggaccgcucccggaaaucgaggacgaagucuuccgaaaaaggaaccucacgauaauggaccugcacccaggcagcggcaagacgaggcgauaccuaccagcaaucguucgagaagcgauuaaacgaaaacugcggacguuaauccuggcaccgaccagggugguagcgucugaaauggcagaggcccugaaggggaugccaauucgauaccagacaaccgcagugaagucagagcauacagguaaggaaauaguagaccugaugugccacgccaccuucacaaugcgccuucucagccccguaagagucccaaacuacaauaugauaaucauggacgaagcucauuuuacugaccccuccagcaucgcggcacgcggguacaucaguacacgaguuggaaugggagaggccgccgcaaucuucaugacugcaacgccgcccggauccguagaggccuuuccucaaucaaacgcugucauacaggacgaagaacgcgacaucccagaacggucguggaacucuggauaugaguggaucacagacuucccugggaaaacaguaugguucguuccguccauaaagagcggcaacgauaucgcaaauugccuccggaaaaacggcaaacgggugauucaacucucacgaaagaccuucgacacagaauaccagaaaaccaaaaauaacgauugggacuacguggucacaaccgacauuagcgaaaugggcgcaaacuucagggcagacagaguaauagacccaagaagaugccucaagccgguaauacuaaaagauggacccgagcgaguuauauuggccggcccuaugccagugaccguggccagcgcggcucaacggcgagggcgcgucgggcggaaccacaauaaagaaggagaccaguauauauacauggggcaaccucuaaacaaugacgaagaucacgcgcacuggacggaggcgaaaauguugcucgacaauaucaacaccccagaagggaucauacccgcacuguucgaaccagagcgagagaagagugcagcuauagauggggaauaccgacuacguggcgaagcccguaaaacauucgucgaguuaaugcgacgaggagaccuacccgucuggcuuagcuauaaaguggcauccgaaggcuuccaauacucagacaggcguugguguuucgauggggaacguaacaaccaaguauuagaagaaaacauggauguagagauauggaccaaggaaggcgagcgaaagaagcuacgaccacgaugguuggaugccagaaccuacuccgacccguuggcccuaagagaguuuaaagaguucgcugccggaagacgaucgguuucaggcgaccuaauccuagaaaucggcaaacugccccaacaccugacgcaacgagcacagaacgcucucgauaaccuggugaugcuacacaacagcgaacaaggcgggcgagccuaccgacacgcaauggaagaauugccagacaccaucgaaacacuaaugcuguuggcacuaauagccgugcugaccgggggagucacccucuuuuuccucucaggacgcggucuagggaaaacgucgaucggccuucugugcgucauggccucuagcguccuccuguggauggcgagcguggagccucacuggaucgcggcaagcauaauacuagaguucuuccucaugguccugcuaauacccgagcccgauagacaaagaacaccacaagacaaucaacucgcauacguaguuaucggacuguuauuuaugauccuaacagucgccgcgaacgagaugggccuccuagagaccacgaaaaaggaccucggcauugggcacguggcggucgaaaaccaucaucacgccgcaaugcuugacguggaccuucacccagcgagugcauggacccucuaugccguggcaaccacgaucauaacccccaugaugcgccacacgaucgagaauaccacggcaaauauaucgcucacagcaaucgcuaaccaagcagcaauccuaaugggacuagacaagggguggccaauuuccaaaauggauaucgggguaccccuauuggcgcuaggaugcuacucccaggugaacccccucacccuaacagccgcuguacuuaugcuaguagcacacuaugccauuaucggaccaggccuacaggcaaaagcaacgcgggaagcacagaaaagaacugccgccgggaucaugaaaaacccgacggucgauggcauaguagccauagaccuggaccccgucguguaugacgcaaaguuugagaaacaguugggacagauaaugcuacugauacucugcacaucucaaauccuacuaaugcguaccaccugggcccugugugaaagcauuacacucgccacgggaccacucacaacucucugggaaggcagcccugggaaguucuggaacaccacuaucgcgguaucaauggcaaauauauuucgagguaguuaccuggccggcgcagggcucgccuucuccuugaugaaaagccugggcggaggacgucgaggcacuggcgcacaaggcgaaacguuaggagaaaaguggaagcgacagcuaaaccaacuaagcaagucagaguucaacacauauaagcgcucgggcauaauggagguagaccgaagcgaggccaaggaagggcucaaacgaggggagaccacgaagcacgcaguaucaagagggacagcaaagcuacgaugguuuguagaacggaaccuaguuaagcccgaaggcaaggugauagaccuaggcugugggcguggcggcuggagcuauuacugcgcaggccuaaagaaaguaacagagguaaagggauacaccaaaggagggcccggacacgaggaacccaucccaauggcaacauacggauggaauuuagucaaacuacacagcggaaaggauguauucuucauaccgccggagaaaugcgacacucuauugugcgauauuggggaaucaagcccgaacccgaccauagaagagggccggacccuccgaguccuaaagaugguagaacccuggcugcgggguaaccaguucugcauaaaaauccucaacccguauaugccguccgucgucgagacacuagaacaaaugcaaaggaagcacggcggcauguuaguacgaaauccgcuaucccgaaauagcacacacgaaauguacugggugagcugcggaacaggcaacauaguaucugcagucaacaugaccucuagaaugcuucugaaucgcuucacgauggcacaucgcaaaccgaccuacgaacgcgacguagaucuaggagcgggaaccaggcacgucgccgucgagccugaaguagcgaacuuagacaucaucggccaaaggauagagaauaucaagcacgaacacaagagcaccuggcauuacgacgaagacaaucccuacaagacaugggcguaccacggaaguuaugaagucaaaccuuccggaagcgccagcucaauggucaauggagugguaaaauuacuaaccaaaccgugggacgugauaccaauggucacccagauagccaugaccgacacaacuccauuuggccaacagagagucuucaaagaaaaaguagauacacgaacccccaaagcgaagagaggaacuacacagauaauggaagucacggcccgguggcuguggggcuuucucagccgaaauaagaaaccaaggauuugcacacgggaggaguucacgagaaaagugaggaguaacgcggcgauaggggcggucuucgucgacgaaaaucaauggaacucagcgaaagaagcgguggaagacgaaagguucugggaccucgugcacagggaacgagaacuacacaaacaaggcaaaugugcaacgugcguauacaacaugaugggcaagagagagaaaaaguuaggcgaguucggcaaagccaagggcagccgcgccauuugguacauguggcuuggagcacgcuuucuggaauuugaggcccugggcuucaugaacgaagaccacugguucucccgcggaaacagccugagcggaguugaaggagaaggccugcacaagcucggcuauauacugcgggauauuuccaagauaccgggcgggaacauguacgccgacgauacggcaggaugggauacccgcaucaccgaagaugacuuacagaacgaagcuaaaaucacagacaucauggaaccagaacacgcucuccuggcuaaggcgauauucaagcucacauaccagaauaaggucguccgaguccaaagaccggcuaaaaaugggaccguuauggacgugaucagccgccgggaccaaaggggcagcgggcaaguugggaccuacggacucaauaccuucacuaacauggaagcccaacugaucagacagauggaaagcgaagggaucuucucccccagugaauuagaaacaccaaaccucgccgagcgggugcuagauuggcuagaaaaauacggcgucgaacgccucaagcgcauggcuauaagcggagacgauugcguaguuaagccaauugaugacagauuugcaacugcgcuuacagcccuaaaugacauggguaaggugcgcaaagacaucccucaaugggaaccuaguaagggcuggaacgacuggcaacaagucccauucugcagccaccacuuccaucagcucauaaugaaggacggacgagaaaucguuguccccuguagaaaccaagacgaauugguaggucgagcccgagucagucagggagcggguuggagccugagagaaacggcgugccucggcaagaguuacgcccagauguggcagcucauguacuuccaccgacgggaucuccgacuugcugcuaacgcaauauguucggcaguaccaguagacuggguuccgacauccagaacaacguggagcauacaugcacaccaucaauggaugacaacagaagacaugcugagcgucuggaaccgugucuggaucgaagaaaauccauggauggaggacaagacgcauaucagcucgugggaggacgucccauaccuaggaaaacgcgaagaucaauggugcgguucccucauaggccugaccgcacgugccacaugggccacgaauauccaaguggccauuaaccaaguacgccgccuaauagguaacgagaauuaucuggacuacaugaccuccaugaagagauucaaaaaugagucugacccggagggcgcgcugugguaa

SEQ ID NO: 24705 - RNA, 9879 nt, Artificial Sequence
  derived and/or modified CDS sequence (opt11) from DENV-1__KC762627__SS-prME
agcgugaccaugcugcucaugcugaugcccaccgcccuggcauuccaccucaccacccggggaggggagccccacaugauugugagcaagcaggagcggggcaagagccuucuguucaagaccagcgccggggugaacauguguacgcucaucgccauggaccugggcgaacugugcgaggacacccugacguauaagugcccccgcaucaccgaggccgagcccgaugauguggacugcugguguaaugccaccgacacgugggugacauacgggacuugcagccagacgggggagcacaggcgcgacaagcggucgguggcacuugccccccaugugggccuggggcucgagacgcgcaccgaaaccuggaugagcuccgaaggcgccuggaagcagauucagcggguggagaccugggcccugcgccaccccggguucacgguuaucgcgcuguuccucgcgcaugccauaggaacaaguaucacccagaaagggaucaucuucauucugcugaugcugguuaccccauccauggccaugcggugcgucggcaucggcucccgcgacuuuguggaaggauuauccggggcaacguggguagacgucgugcuagagcacgggucaugcguuacgaccauggccaaggauaagcccacccucgacaucgaguuguuaaagacggaggugaccaaccccgcgguguugcggaaauuaugcaucgaggcgaagaucuccaacaccacuacggauagccggugcccgacccaaggggaggccacccucguggaggagcaggacgccaacuucgucugccggagaaccuucguggaucggggcugggggaacggcugcggacuguucggcaaagggucccugaucacgugcgcuaaguucaagugcgugaccaagcuugaaggaaagaucguccaauacgagaaucucaaguacagcgugaucgugaccguccacaccggcgaccaacaccaaguggggaacgaauccaccgagcacgguacuaccgcgacuaucacgccccaggccccuacgaccgagauccagcugaccgacuacggggcgcugacccucgacugcagcccccgcacuggccuggacuucaacgagaugguccugcucaccaugaaggagaagucuuggcugguccauaagcagugguuccuagaccucccccuacccuggaccagcggggccagcaccucucaggagacguggaaccggcaggaccugcucgugaccuucaagaccgcucacgcuaagaaacaggaagucguggugcugggcagccaggagggcgccaugcacaccgccuuaacgggggccaccgagauccagaccuccggcaccacgacgaucuucgccgggcaccucaagugucgucugaagauggacaagcuuacccucaaggguaugagcuacgucauguguaccggguccuucaagcuagagaaggaaguggcggagacucagcacggcaccgugcugguccagaucaaauacgaaggcaccgacgccccuugcaaaauccccuuuagcacccaggaugagaagggggugacgcagaacggccggcugauuaccgcuaaccccaucgugaccgacaaggagaagccugucaacaucgaagccgagccgcccuuuggggaguccuacauuguuauaggcgcaggggaaaaggcccucaagcugagcugguucaagaagggguccaguaucggcaagauguuugaagccaccgcccgcggggcccggcgcauggcgauccucggcgacacggccugggacuucgggucuauuggcggcguguucaccagcgucgggaagcucauccaucagaucuucggcaccgccuacggggugcuguuuucggggguaagcuggaccaugaagaucgggauuggagucuugcucacauggcugggacugaacucccgcucgaccucccucucuaugaccugcaucgccguggggcuggugacccuguaccucggcgucaugguacaggccgacucugggugugugaucaacuggaagggcagggagcugaaaugugggagcggaaucuuugucacgaacgagguacacaccuggaccgagcaguacaaguuucaggcggacagccccaagcgccuguccgccgccaucggcaaggcgugggaagagggagugugcgguauccggagcgccacucgccucgagaacaucauguggaagcaaaucuccaacgagcugaaccacauccuucucgagaacgauaugaaguucaccguaguugugggggaugucgcgggcauccuggcccaagggaaaaagaugauccggccccagccaauggagcacaaguacuccuggaaguccugggguaaggcuaagauaaucggcgcggacgugcaaaauacgaccuucaucauagacggccccaauaccccggagugccccgaugaccagcgcgcguggaacaucugggaaguggaggacuacggcuuugggaucuuuaccacgaauaucuggcucaagcuccgggacagcuacacccaagugugcgaccaccgccugauguccgccgcgauaaaggacagcaaggccgugcacgccgacaugggguacuggaucgagucugagaagaacgagaccuggaagcuugcccgugcgagcuucaucgagguuaagaccugcaucuggcccaaaucccacacccucuggagcaaugguguccuggaauccgagaugaucauccccaagaucuacgggggcccgaucucucagcacaacuauagaccgggguacuucacacagaccgcagggcccuggcaccuggggaagcucgagcucgauuucgacuugugcgagggcaccacgguggugguagacgagcacuguggcaaccgggggccgucccuccgcacuaccaccgugacgggaaaaauaauacacgaguggugcugucggagcugcacccugccgccccugcgcuuccgcggagaggacggcugcugguacgggauggagauccgccccguuaaggaaaaggaggagaaccucgucaaguccauggugagcgccggcuccggcgagguagacuccuucagcuuagggcugcuuuguauuuccaugaugauugaggaggucaugcguagccgguggucgcggaagaugcugaugacaggcacccuggccguguucuuccuccugauaauggggcagcugacauggaacgaccucauccgccugugcaucauggucggagcgaacgcaagugaccgcauggggaugggcaccacuuaccuagcccucauggcuaccuucaaaaugcggccgauguucgccgucgggcugcuguuccgccggcugacgucccgcgaggugcugcugcuaaccaucgggcugagccugguggcuucgguagagcuucccaacagccuggaggagcuaggcgacgggcucgccaugggcaucaugauucugaagcugcucaccgacuuccagucccaccaacugugggcgacccugcucagccugacguucaucaagaccaccuucucacugcacuacgccuggaaaaccauggcgauggugcucagcauuguuucucuguucccccuaugccuuuccacgaccucccagaagaccaccuggcugcccguucugcucggcagccuggggugcaagccgcugacgauguuuuuaaucgccgagaacaagaucuggggcaggaaguccuggccccugaaugaggggaucauggcagugggcaucguaagcauccugcugagcucgcugcugaagaacgacgucccuuuagccgggccccugaucgcgggcggcaugcugaucgccugcuacgugaucagcggguccagcgcggaccucagccuggagaaggccgcagaggugaguugggaggaggaggccgaacacuccggcgcgagucacaacaucuugguggaggugcaggacgacgggacgaugaagaucaaggacgaagagcgcgacgacacccucaccauucugcugaaagccacccuacuggccgucucuggcguuuacccgcugagcaucccggccacauuguucgucugguauuuuuggcagaagaagaagcagcggucgggggucuuaugggacacucccagcccucccgagguugagcgcgccguguuggacgacggcaucuaccggaucaugcagcgcggccugcucgggcggucccaggucggcguggggguguuccaagagaacgucuuccacaccauguggcaugugaccaggggcgcggucuuaauguaccaggggaagcggcuggagcccucgugggccuccgucaagaaggaccuaauaucguacgguggaggguggcgccugcagggcuccuggaauacgggggaggagguccaggugaucgcggucgagccaggcaagaauccuaagaacgugcagaccgccccagggacuuuuaagaccccagagggcgaggugggcgccaucgcgcuggauuucaagcccggcacgucaggcucacccaucgucaaccgggaggguaaaauugugggccucuauggcaacgggguggucacgaccucaggcacauacgucagcgccaucgcccaggccaaggcgucccaggaagggccgcugcccgaaaucgaggacgagguguuucgcaagcggaacuugacgauaauggaccuccaccccggaagcgggaagacccgccgguacuugccagccaucguucgcgaggccauuaagcggaagcugcgcacccucauccuggcccccacacgcgugguggccucugagauggcggaggcccugaagggcaugccaauucgguaccagaccacagcggucaagagcgagcacaccgguaaggagaucguggaucucaugugccaugccaccuucacgaugcggcugcuguccccuguacgugucccgaacuacaacaugaucaucauggacgaggcccacuuuaccgaccccagcuccaucgcggcccggggguacaucagcacgcggguggguaugggggaggccgccgccaucuuuaugacggcgacgccuccaggcuccguggaggccuucccgcaaagcaacgccgucauccaggacgaggagcgcgacauuccugagcggucguggaacagcggguaugaguggaucacggacuuccccggaaagaccguaugguucgugcccucuaucaagagcggaaacgacaucgcgaacugcuuacgcaagaacgggaagcggguaauccagcugucccgcaagaccuucgacacggaguaucaaaagaccaagaacaacgacugggacuacguggugaccaccgacaucagcgagaugggcgccaacuuccgagccgaucgcguaaucgauccgcgacgcugccugaagcccguaaucuuaaaggacgggccggagcgggugauccuggccgggcccaugccggucacgguggccuccgcggcgcagaggcgcggccgcgugggccggaaccacaauaaggagggcgaccaguacaucuacauggggcagccccugaacaacgacgaggaccacgcccacuggaccgaggccaagaugcugcuugacaacaucaacacgcccgagggcauuauacccgcccuuuucgagccggaacgcgaaaagagcgccgcgaucgacggggaguaccgucuccggggcgaggcccgcaaaaccuucguggaacugaugcggaggggggaccugccuguguggcucuccuacaaggucgcgagcgagggcuuccaguacagcgaccggcgcugguguuuugacggcgagcggaauaaccaggugcuugaagaaaacauggacguagagaucuggacgaaggagggggagcgcaaaaaguuacggccccgcuggcucgacgcccgcaccuacuccgacccccuggccuugcgcgaguucaaggaguucgccgccggccggcgcagcgucuccggggacuugauauuagagaucggaaaguuaccgcaacaccucacccagcgggcccagaacgcacuggacaaccuugugauguuacacaacucggagcagggcgggcgcgcauaccggcacgcgauggaagagcuucccgacaccaucgagacgcugauguuacuggcccugaucgccgugcucacaggcggcgucacacuguucuuccuguccggccgcgggcucggcaagaccagcaucggccuccuaugcguaauggccuccagcgugcuccuguggauggcguccguugagccacacuggauugcagcuagcaucauccuggaguucuuccucauggugcugcuuaucccagaaccggaucgucagcgcacuccccaggacaaccagcucgccuauguggucauugggcugcuguucaugauccucacggucgccgcgaacgaaaugggccugcuggaaaccaccaaaaaggacuugggcaucggccacguggccgucgagaaccaccaccacgccgcuaugcuagacguggaccugcaccccgccagcgcguggaccuuauacgccguggcaacgaccaucaucaccccgaugaugcggcacaccaucgagaacacgaccgccaacauaagccuuaccgccaucgcgaaccaggccgccauucugauggggcucgacaaaggcuggcccaucuccaaaauggacaucggcgucccucugcuagcccucgguugcuacagccaggugaacccccugacucucacggcggccguguuaaugcugguagcccacuacgccaucauaggcccggggcuacaggccaaagcgacccgcgaggcccagaagcguacggccgcuggcaucaugaagaaccccacuguggacgguaucguggccaucgaccucgaccccgucgucuacgacgcaaaauucgagaagcagcugggccagauuaugcuucucauccugugcacgucucagauccugcucaugcggacaacgugggcgcugugcgaaucaauuaccuuggccacgggcccccucaccacccugugggaggggagcccaggcaaguucuggaacaccacgauugccgugagcauggccaacaucuuccgcggguccuaccuggcgggggccgggcucgccuucagccugaugaagucgcucgggggcgggcgacgcgggaccggugcccagggcgagacccucggcgagaaguggaagcggcagcugaaccagcuguccaagagcgaauucaacaccuacaagcgcucugguaucauggaggucgaccggagcgaggcaaaggagggccuaaaacgcggggagacuaccaagcacgccguguccaggggcacugcaaagcugcgcugguucguggagcggaaccuggugaagcccgaagggaaggugaucgaccugggcuguggucgcgggggcuggucauacuacugcgccgggcucaagaaagugaccgagguuaagggcuacaccaagggcggcccaggccacgaggaacccaucccuauggccacguacggcuggaaucuggugaagcugcacagcggcaaggacguguucuucaucccgcccgagaagugcgacacccuccuuugcgacaucggagagagcucccccaacccgaccaucgaggaaggccggacgcugaggguccucaagaugguggagccauggcugcgggggaaccaguuuuguaucaaaauccugaaccccuacaugcccagcguggucgagacccucgagcagaugcagcgcaagcacggcggcaugcuggugcggaacccgcugucacgcaacagcacccacgagauguacuggguguccugcgggaccgguaacaucgucagcgcugugaacaugaccucccggauguugcugaaccgcuucacgauggcccacagaaagcccaccuaugagcgggacguagaccugggcgccggcacccgccacguggccguggagcccgaaguggccaaccuugacaucaucggucagcguaucgaaaacaucaagcacgagcacaagagcaccuggcacuacgacgaggacaacccuuacaagacgugggcguaccacgggagcuacgaggucaaaccgagcggcuccgccuccuccauggugaauggggucgugaagcuucugaccaaacccugggacgugaucccuauggugacccagaucgccaugaccgacacgacccccuuuggccagcaacgcguguucaaggaaaagguggacaccagaaccccaaaggccaagcgcgggacuacccagaucauggaggucaccgcccgguggcucugguccuuccuaagccgcaacaagaagccaagaaucugcacccgcgaggaauucacgcggaaggugcgcucuaacgcggcuaucggagcaguauuugucgacgaaaaucaguggaacagcgccaaggaggccguggaggacgagcgguuuugggaccuggugcaccgcgagcgggaguuacacaagcagggcaagugcgcaacuugcgucuacaauaugauggggaagcgcgagaagaagcugggagaguucgggaaggcaaagggcucccgggccaucugguacauguggcugggagcccgcuuucuugaauucgaggcgcugggcuucaugaacgaggaucacugguucagccgggagaacucccugagugggguggagggggaaggccugcauaagcuuggguacauccugcgcgauaucuccaagauccccggcgggaacauguacgccgacgacaccgccggcugggacaccagaaucacggaagacgaccuccagaacgaggcuaagaucaccgacauuauggagccggagcacgcccuccuggcgaaggccaucuucaaguugaccuaccagaauaaggugguacgcgugcagcgccccgccaagaaugggaccgugauggacgucauaagccggcgcgaccagagggggaguggccaggucgggacuuacggccugaacacguucaccaacauggaggcccaguuaauccgccagauggagagcgaaggcaucuucuccccuagcgaguuagagaccuccaaccuggccgagcgggugcuggacuggcucgaaaaguauggggucgagcgccugaaacggauggcgauuagcggcgacgacugcguggugaagcccaucgacgaucgcuucgccacggcccugacugcccucaacgacauggguaagguccggaaggacaucccgcagugggagcccaguaagggguggaaugacuggcagcagguccccuucugcagccaucacuuccaccagcugaucaugaaggacggacgcgagaucguaguccccugccggaaccaggaugagcuggugggccgcgcaaggguuagccagggcgcaggcuggucccuccgcgagaccgccugcuugggcaagagcuacgcccaaauguggcagcugauguacuuccaccggcgcgaccugcggcuggccgcgaacgccauaugcucugccgucccggucgacugggugccgacauccaggacgaccugguccauccacgcacaccaccaguggaugaccacugaggacaugcugagcgucuggaaccggguguggauagaggagaaccccuggauggaggauaagacgcacaucuccagcugggaggacgugccguaucucgggaagcgcgaggaccaguggugcggcucccugauagggcugaccgcucgcgcgacaugggccacgaacauccaggucgccaucaaccaggugcggcgccugaucggcaaugagaacuaccuggacuacaugaccagcaugaagcgguucaagaacgagucugacccggaaggcgcccugugguga

SEQ ID NO: 24706 - RNA, 9879 nt, Artificial Sequence
  derived and/or modified CDS sequence (opt11) from DENV-1__KC762647__SS-prME
agcgugacaaugcugcucauguugacgcccacggcccuugcguuccaccuaacgacccgcggaggggaaccccauaugaucgugaguaagcaggaaaggggaaagagcuugcuguucaagaccuccgccgguguuaacaugugcacgcucaucgcgauggaucugggcgagcugugcgaggacacccucaccuacaagugcccccgaauaacggaagccgaacccgacgacguggacugcugguguaacgcgacggauacaugggugaccuacgggaccuguagccaaacgggcgagcaccggcgcgauaaacgcucuguggcgcuggcgccucauguggggcugggccuagagacccgcaccgagaccuggaugagcuccgagggcgccuggaagcagauccagcgggucgaaacgugggcgcugcgccaucccggguucaccgugaucgcccuauuccucgcgcacgccaucggcaccagcauaacucagaaggggaucaucuucauacuguuaaugcuagugacgcccucuauggcuaugcgguguguuggcauaggcagccgggacuucguggaggggcucuccggugccaccuggguggaugucgugcuggagcacggguccugugugaccaccauggccaaggacaagcccacccuagacaucgagcugcugaaaacggagguaaccaaccccgcugugcuccggaagcuguguaucgaggcaaagauaucuaacacuaccaccgacucacggugcccgacgcagggugaggccacauugguagaagaacaggaugccaacuucgucugccggcguacauucguggaccggggaugggggaauggcugcgggcuguucggcaaggggucccugaucacuugcgccaaguucaagugcgugaccaaacuggagggcaaaaucguucaguacgagaaucuaaaguacucugugaucguuaccguucauacaggggaccagcaccagguugguaaugaguccacggaacacggcaccacagcgacgaucacgccccaggcucccacuaccgagauacagcugacugacuauggggcccugacgcuagauugcagcccacgcaccggccuggacuucaacgagauggucuuguuaaccaugaaggaaaaguccuggcuuguacauaaacagugguuccuggaccucccccugccuuggacaagcggggccagcacgagucaagagaccuggaaucgacaggaccuccucgucaccuucaagacugcccacgcgaagaagcaggagguagugguccuaggaucgcaggagggagccaugcacacggcccuaaccggugccaccgaaauacagacgucugggacaaccaccauuuucgccgggcaccugaagugccgccugaaaauggacaaacucacccucaaaggaaugagcuacgucauguguacgggguccuucaagcuggagaaggagguggcggagacccagcacggcaccguguuaguccaaauaaaguacgagggcaccgacgcccccugcaaaauccccuucaguacgcaagacgagaagggcgucacccagaacggccgucugaucaccgccaacccuauaguuaccgacaaggagaaacccgucaacaucgaggcggagcccccauucggggagaguuauaucguaaucggcgcgggagaaaaggcgcucaaacuuagcugguuuaagaagggguccucgaucggaaagauguucgaggcuacggcucgcggagccaggcgcauggcuauucugggcgacaccgccugggacuucggguccaucggcggaguuuucacaagcgugggaaaguuaguccaccaaaucuuuggcaccgccuacggagugcuguuuuccggcguauccuggacaaugaagauagguaucgguguguuacuuaccuggcuggguuuaaacuccagaagcaccucccucuccaugaccugcaucgccgugggacucgucacccuuuaccucggcguaauggugcaggcugacucggggugcgucauuaacuggaaaggacgggaguuaaagugcggguccggcauuuuugugaccaacgaggugcacaccuggacagagcaguacaaguuccaggcggacagcccuaagaggcucucagcggccauagguaaggccugggaagaagggguuugcggcauccgguccgccacccguuuagaaaacaucauguggaaacagaucuccaacgagcugaaccacauccugcucgagaacgauaugaaguuuaccgugguggugggggacguggcuggcauacuggcccaagggaaaaagaugauccgaccccagccuauggagcacaaguauagcuggaagucuuggggaaaggccaagauaaucggcgcugacguccagaacaccaccuucaucaucgacgggccgaauaccccggagugccccgaugaccagcgcgcguggaacaucugggagguggaagauuacggcuucgggaucuucacgaccaacauauggcugaagcuccgcgauagcuacacccaggucugcgaucaucgccugauguccgccgccauuaaggacucgcgggcugugcacgcggacaugggcuacuggaucgaauccgagaaaaacgagacuuggaagcuggcccgcgccuccuucaucgagguuaagacgugcgucuggccgaaaucccacacccucuggagcaacggcguguuagaguccgagaugaucauccccaagauuuacgggggcccgaucucucagcacaacuaccggcccggguacuucacccagacagccggcccauggcaccucgggaaauuggagcuggacuuugacuuaugcgaaggcacaaccgucgugguggacgagcacuguggcaaucgcgggcccucauugcguaccacgacagucaccggcaagaucauccacgaguggugcuguagaagcugcacccugccgccccuccgguuccgcggagaggacggcuguugguacgggauggagauccggcccgugaaggaaaaggaggagaaccucgugaaguccauggucagcgccgggagcggggagguugauuccuucagcuuggggcugcuuugcauuaguauuaugaucgaggaggugaugcgcagcagauggucccggaaaaugcugaugacaggcacucuggccguuuucuuccuacugaucaugggccaguuaaccuggaacgaccucauccgucucugcauuauggucggcgcuaacgccagcgaccggauggguaugggcacuacguaucuggcucucauggcaacuuucaagaugcgcccaauguucgccguggggcugcuguuccggcgcuugaccucccgugaggugcugcugcucacuauuggguugagccugguagcgagugucgagcuccccaacucucuggaggaacugggcgacggccucgccaugggcaucaugauuuuaaagcugcuuaccgauuuccagucccaucagcugugggcuacguuauugucgcugaccuucauaaaaacaacuuucagucugcacuacgccuggaagacgauggcaaugguguugagcauagugucacuguucccguuaugccucagcaccaccucucagaagaccacguggcugcccguccuacucgggagccugggaugcaaaccucugacgauguuccugaucgccgagaacaagaucuggggccgcaagucuuggccacuaaacgaggggaucauggccgugggcaucgugucuauucuguugagcucccugcugaaaaacgacgucccacuagcagggccucuuaucgccggugguaugcugauugcuugcuacgugaucaguggguccucagccgaccucucauuagagaaagccgcggaggugagcugggaggaggaggccgaacacuccggcgcgagucacaacauccugguggaagugcaggaugauggcacuaugaagaucaaggacgaagagagagacgacacgcucacuauccugcuaaaagcgacgcugcuggccgugucagggguauacccgcuaucgauccccgcgacccucuucguuugguacuucuggcagaagaagaagcagcgcucgggugugcugugggacacgccuagcccgccggagguagagcgggcaguucuagacgacggcaucuaccgcaucaugcagcggggccugcucggucggucccaggugggagucgggguguuccaggaaaacguauuccacaccauguggcacguaacgcggggcgcugugcugauguaccaggggaagcgccucgagccuucgugggccuccgucaagaaagacuuaauaagcuacggcggaggguggcgguugcagggcuccuggaacaccggggaggagguucagguaaucgccgucgagcccgggaagaacccuaaaaauguccaaaccgcccccgggaccuucaagacuccugagggcgaaguaggcgcgaucgcacuggacuucaagcccggaaccagcggcucccccauugugaaccgcgagggaaagaucguuggccucuacggcaacggaguggugacaacaagcggcacguacgucagcgccaucgcccaggcaaaagcaagucaggaggguccguuacccgaaaucgaggaugagguguuccggaaaaggaaucugacuauuauggacuuacaccccggcucaggaaagacccggcgcuaccuuccggcgauuguucgggaggcaauuaagcgaaaguuacgcacccugauccuggcacccaccagggucguggccucagagauggcggaggcccuuaagggcaugcccauucgcuaccagaccaccgcggucaagucugagcacacgggaaaagagaucgucgaucucaugugccacgccacguucaccaugcggcuccuaucccccgugcgagugccgaauuacaauaugauaaucauggaugaggcccauuucaccgaccccucaucgaucgcggcccgcggguauauuagcacccgcguaggcaugggagaggcggcagccaucuucaugaccgcgacuccgccaggcucaguggaggccuucccgcagucgaacgccgugauccaggacgaggaaagggauauccccgaacgcaguuggaacaguggauacgaguggaucaccgacuuccccggcaagaccgucugguucgugccauccauuaagagcggcaacgauauagccaacugccugaggaagaacggaaagcgcguuauucaauugucccggaagacguucgacacagaguaccagaagacgaaaaacaacgacugggauuaugucgucaccacggacauuuccgaaaugggcgcgaacuuccgcgcugaccgggugaucgacccaaggcgcugccugaaacccgucauucucaaggauggucccgaacgcgugauccuggccggacccaugccaguuaccguggcuuccgcagcgcagagacgcgguaggguugggcgcaaccauaacaaggagggggaccaguauauuuacauggggcaacccuuaaacaacgacgaagaucacgcucacuggaccgaagccaagaugcuccuggacaacaucaacacccccgaaggcaucauccccgcccuguucgagccagaacgcgaaaagucugcagcgaucgacggggaauaccggcuccgcggcgaggcccggaagacguuuguggagcugaugcguagaggggaucugccggugugguuauccuacaagguggccagcgagggauuccaguacagcgaucgccgauggugcuucgacggcgagaggaacaaccaagugcuggaggagaacauggacguggagaucuggaccaaggagggggagcggaagaagcuccgccccagguggcuagaugcccgcaccuauucagacccccuagcccugcgggaguucaaggaguucgccgccggccgacggucugugucaggggaccucauucuagagauugguaagcucccucagcaccucacucagaaggcacaaaacgcccuggacaaccugguaaugcuccacaacagcgagcaaggcgguagggcguaccgacacgccauggaggaauuacccgauacgaucgaaaccuugaugcucuuagcccugaucgccguucucaccgguggcgugacccucuucuuucuuuccgggaggggucugggcaagacgagcaucggccuacugugcguuauggcguccucuguuuugcuguggauggcuagcguggagccccauuggaucgcagcaagcauuauucuggaguuuuucuuaaugguccuucugauccccgagccggaccggcagcgcacgccccaagauaaucaguuagccuauguaguaaucggguuauuauucaugauccucaccgucgccgcgaacgagauggguuuacuggagacaaccaagaaggaccucgggauuggccacguggcuguggagaaccaucaccacgcagccaugcuggacgucgaccugcaccccgccucugcauggacccucuacgccguggccaccaccaucaucaccccgaugaugcggcauacgaucgagaacaccacggcgaauauuucgcugacugccaucgcgaaccaggccgccauacucauggggcuugacaaaggcuggcccauuaguaagauggauaucggugugccgcugcuggcacucgguugcuauagucaagugaacccguugacgcuaaccgcggcuguccuuaugcucguggcccauuacgcgauuaucggcccaggguuacaagccaaggcaacccgcgaagcccagaagcgcaccgccgccgggaucaugaaaaacccuacggucgacgggauaguggccaucgaccucgaccccguggucuaugaugcuaaguucgaaaaacagcuggggcagaucaugcuccuuaucuuguguacgucccagauccugcucaugcggaccaccugggcacucugcgagagcaucacgcuggccaccgguccacuuaccaccuuaugggagggguccccgggcaaauucuggaauacuaccaucgccgugagcauggccaauaucuuucgcgggucguaccucgcaggcgccggccucgcguucagcuugaugaagucccucgggggaggucggcgcgggaccggggcgcagggugagacccucggcgaaaaauggaagcggcagcuuaaccaacugagcaaguccgaguucaacacguacaagagaagcgggaucauggaggucgaccggucugaggcuaaggagggucuuaagagaggggagacuaccaaacacgcggucucuagaggcaccgccaaacugcgaugguucguagaacggaacuuagugaagcccgaggggaaggucaucgaucucggcuguggacgcgguggguggagcuacuacugugccggucucaagaaagugaccgaagugaagggcuacacaaagggcggucccggacacgaggagccgaucccgauggccaccuacggcuggaaccuggucaaacugcauuccggcaaggacguguucuucauaccgccggagaaaugugacacccuccugugcgacaucggggagagcagucccaacccaacgaucgaggagggccggacccuccgcgugcucaaaauggucgagcccuggcuacgggggaaccaguucugcaucaagguccugaauccguacaugcccuccgugguugagacccucgagcagaugcaacgcaagcauggcggcaugcuggugcggaacccgcugucccgcaauuccacccacgagauguacugggucucuugugggacuggcaacaucgucucggcugugaacaugacgucccgaauguugcugaacagauucaccauggcccacagaaaacccacauaugaacgggaugucgaccugggggccggcacacgccacguagccguggagcccgagguggcgaaccuugacauaaucggacaacggauugaaaauaucaagcacgagcacaagagcacguggcacuacgacgaggacaaucccuacaagacgugggcguaccacgggaguuacgagguuaagccgucuggcuccgcuagcucuauggugaacggagucguaaaacuucugaccaagcccugggacgugauacccauggucacccaaauugccaugacagacacuacacccuucggccagcaacgcguuuuuaaggagaaggucgauacucggacgccgaaggcgaagcgcgggaccacccagaucauggaggucaccgcccgguggcuuuggggcuuccuuucccgcaacaaaaagccccggaucugcacccgggaggaguucacccgaaaggugagaucuaacgcugcaaucggcgcgguguucgucgacgaaaaccaauggaacuccgccaaggaagccguagaagacgagcgguucugggaccugguccaccgcgaacgggaacuccacaagcagggcaagugcgcgaccugcgucuacaacaugaugggaaagagagagaagaaguugggcgaguucgggaaggccaaagggagccgggccauaugguacauguggcugggcgcccgguuccuagaguucgaggcgcugggcuucaugaacgaggaccacugguucucacgggaaaauucucucagcgggguggagggcgaaggacuccacaaacugggcuacaucuugcgcgacaucagcaaaauccccggagggaacauguacgccgacgacacugcgggcugggauacgagaaucaccgaagaugaccuccaaaaugaggccaagauaaccgauauaauggaaccggagcacgcucuccuugcuaaggcaauauucaagcucaccuaccagaacaagguuguucgcguccagcgaccagccaagaaugggaccguuauggacgucaucucacggagagaccagcgggggucuggucaggugggcaccuacggucugaauacguuuaccaacauggaggcccagcuaauucgccagauggagucugaggggaucuuuucacccuccgaguuggagacucccaaccuggcggagcgggugcuggacuggcucgagaaguacggcgucgagcgccugaagcggauggcgaucagcggcgacgacugcguugugaagccgaucgacgaccgcuucgcuacugcccugacugcacucaacgauaugggcaaaguccggaaggacaucccgcagugggaacccuccaagggcuggaaugauuggcagcaggucccguucugcucgcaccacuuccaccagcugauaaugaaggacggccgcgagaucgugguucccugccggaaucaagacgagcuggugggucgcgcccgggucucccagggggccggcuggagucuucgcgaaccggccugucuggguaagagcuaugcacagauguggcagcugauguacuuccaccgccgcgaccuccgacuggcagcuaacgccauaugcuccgcuguaccuguugacugggugcccaccagccgcacgaccugguccauacacgcacaccaucaguggaugaccacagaggacaugcuaagcgucuggaaccggguauggauagaagagaauccguggauggaggacaagacccacaucuccucgugggaggacguaccuuaucucggcaaacgagaggaccaguggugcgggucgcugauuggacugacugcccgcgcgaccugggccacuaauauucaggucgccaucaaccagguucggcgccucaucgggaacgagaacuacuuggacuacaugacuucuaugaaacgguuuaagaacgaaagcgaucccgaaggggcacucugguaa

SEQ ID NO: 24707 - RNA, 9879 nt, Artificial Sequence
  derived and/or modified CDS sequence (opt11) from DENV-1__KC762639__SS-prME
agcgugaccaugcugcuaauguugacccccaccgcccuggcuuuccaucucacuacccggggcggagagccccauaugauagugucaaagcaggagcggggcaagagccugcucuuuaagacgagcgccggggugaacaugugcacccucaucgccauggaccugggcgagcuaugcgaggacacccucaccuacaaaugcccccggaucacugaggccgagcccgacgacguggacuguuggugcaacgccacggacaccugggucaccuacgguaccugcucgcagacuggggaacaccggcgcgacaagcggagcguugcacucgcgccccacgugggccuggggcucgagacccgcacugagaccuggaugagcuccgagggcgcauggaagcaaauccagagggucgagacgugggcccugcgccaucccggauuuaccgugaucgcccuguucuuagcacacgcuauaggcaccucaaucacccagaaaggcaucaucuucauccuccugaugcucgucacgcccucaauggcuaugcggugugucggcauagguagccgcgacuucguugaggggcugaguggcgcaaccuggguggacgucgugcuugaacaugggagcugcgugacuacaauggccaaggacaaacccacucucgacaucgaguugcugaaaacugaggucaccaaccccgcgguucuccggaagcuauguauagaggccaagaucuccaauacuacgacagacagccgcuguccgacccagggcgaggccacacugguggaggagcaggacgcaaauuuuguaugccggcgcacguucguggacagagggugggggaacggaugcgggcuguucggcaagggcucccugauaacgugcgccaaguucaagugcgugaccaagcuggagggcaaaaucguacaauacgagaaccuuaaguacagcguaaucgugaccguccacacuggcgaccagcaccagguggguaacgaguccacggagcacgguaccaccgcgacuauuacaccccaggcccccacaacggaaauccagcuaaccgacuacggggcccugacucucgacugcaguccccgcaccggccuagacuucaacgagaugguacugcucacaaugaaggaaaaaucuuggcuggugcacaagcagugguuucuggaccuuccgcugcccuggacaagcggggccucaacuagccaagaaacauggaaccgccaggaccugcucgugaccuucaaaacagcccacgccaagaagcaggagguaguagugcucggcagccaggagggcgccaugcauacggcccugaccggggccaccgaaauccagaccuccggcacgacaaccaucuuugccggccacuugaagugccgucuuaaaauggacaagcucacucucaaaggcaugagcuacgucauguguacggggucuuucaagcuggagaaagagguggccgagacccagcacggcaccgugcugguccagauaaaauacgagggaacugacgccccgugcaagauccccuucuccacgcaggacgagaagggggugacacagaacggccgucugaucaccgccaacccgaucgugacagacaaggagaagcccgucaacaucgaggcggagccuccuuucggggaguccuacaucgugaucggcgcuggcgagaaggcccucaaacugagcugguucaagaaggguuccagcaucggcaagauguucgaggccacggcccggggcgcccggcgcauggcuauucugggcgacaccgccugggacuucgggucgaucggcggaguauucaccagcguugggaaacugguucaccaaaucuucggcaccgccuacggagugcuguucucaggcgucucuuggacaaugaagaucgggaucggugugcugcucaccuggcugggacugaacagucgcaguaccucccucucuaugaccugcaucgccguggggcuugucacgcuguaccucggugugauggugcaggccgacuccgggugcgucaucaauuggaagggacgggagcucaagugugggucuggcaucuucgugaccaacgaggugcacaccuggacagagcaguacaaguuucaagcggacagcccgaaacgcuugagugccgccauaggcaaagccugggaggaggguguuugcggcauccggagcgccacccgccuugagaacaucauguggaaacaaaucucaaacgagcugaaccacauccugcucgagaacgacaugaaguuuacggugguggucggggauguugccggcauccucgcgcagggcaagaaaaugauacggccccagcccauggagcacaaauacagcuggaaguccuggggcaaagcgaagaucaucggcgccgacgugcagaacaccaccuucauuaucgacgggccuaacacuccugaguguccggacgaucagcgcgcuuggaacaucugggaggucgaagauuacggcuucgggaucuuuacuaccaacaucuggcugaaacuucgggacucguauacccaggugugugaccaccgccugauguccgccgcgaucaaagauagcagggccguccacgccgauaugggcuacuggaucgaauccgagaagaacgaaaccuggaagcuggcgcgagccagcuucaucgaggucaaaacuugcguguggcccaagucccacaccuuauggagcaacggcgugcuggaauccgagaugaucauccccaagauuuacgggggcccgaucucgcaacacaacuaccggcccggguauuucacucagaccgccggcccuuggcaccucgggaagcuagaguuagacuucgaccugugcgagggcacgaccgucguggucgacgagcauugcggcaaccgcggcccaagccuccggaccacuacagucaccggcaagaucauccaugaguggugcugccgcucaugcacccugccacccuugcgguucagaggggaggauggaugcugguacgguauggagaucaggcccgugaaggagaaagaggagaaccucgugaaguccauggucagcgcagggucuggcgagguugauagcuuuagccuggggcugcuauguaucaguaucaugauugaggaaguuaugcggucucgguggucccgcaagaugcugaugacugguacucuggccgucuuuuuccuauuaaucauggggcagcuuacuuggaacgaccucauccgccugugcaucauggugggcgccaacgcgagcgaccggaugggcaugggcaccaccuaccuggcgcucauggccacauucaaaaugcgccccauguucgccgugggucuguuguuucgcaggcuaaccucccgggaaguccugcuguuaacgaucgggcugagccugguggcauccgucgagcuccccaacagcuuggaggagcugggcgacggguuggccaugggcauaaugauccugaagcugcucaccgacuuucaaucacaccagcugugggccacgcugcucagucucaccuucaucaagaccaccuucagucuucauuacgccuggaagaccauggccaugguacucagcaucguguccuuauucccccugugccucagcaccacaucccaaaagacgaccuggcugcccguccugcucggcagccuaggauguaaaccgcugaccauguuccuaauugccgagaacaagaucuggggccgcaaguccuggccccugaacgagggaaucauggccgugggcaucgugaguaucuuacucagcucccugcuuaagaaugacgucccccucgccgguccccugaucgcggguggaauguuaaucgcauguuacgugauaagcgguuccagcgcagaucucucccuggagaaggcugccgaggugagcugggaggaggaggccgagcacuccggugccagccacaacauccuggucgaggugcaggaugacgggaccaugaagaucaaggaugaggaacgggacgauaccuugaccauccugcugaaggccacgcuccuggccgugucgggcguguacccgcugagcauccccgccacucucuucgugugguauuucuggcaaaagaagaaacagcggagcgggguacugugggacacccccagcccucccgaaguugaacgggcugugcuggacgacgggauuuaccgaaucaugcagcguggccugcugggcaggucccaggugggcgucggaguguuccaggagaacguguuccauaccauguggcacgucacgcggggcgcgguccuaauguaccaggggaagcgccucgagccgagcugggccuccgugaagaaagaccucaucucguaugggggcgguuggcggcugcagggcucauggaacacaggggaggaggugcaagugaucgccguggaacccggcaagaaccccaagaacgugcagaccgcccccgggaccuucaagacgcccgaaggcgagguaggcgccaucgcguuggacuuuaagcccgggaccucuggcucgcccaucgugaaccgcgaggggaagaucgucggccuguacgggaacgggguggugaccaccagcggcacguacgucagcgccaucgcccaggcgaaggcgucgcaagaggggccgcugcccgagaucgaggacgagguguuccggaaacgcaaccugacuauuauggaccuccaccccggcagcgggaagacccggcgauaucucccugccaucgugcgggaggcaaucaagcgcaaacugcgcacccucauucuggcuccgacgcgggugguggccuccgagauggcggaggcacugaagggcaugcccauucgcuaccagaccaccgccgucaagagcgagcacaccgguaaggagaucgucgaucucaugugccacgccacguucaccaugcggcuguuaucgcccgugcgugugccgaacuacaacaugaucaucauggaugaggcccacuucaccgaccccuccucgaucgcggccaggggguacauuucgacgcgggucggcaugggagaggccgcugcaauuuuuaugacggcgacuccgcccggcucgguggaggccuuuccgcagucaaacgcagugauccaggacgaggagcgugacaucccggagcgcucuuggaacaguggguacgaguggaucaccgacuucccgggcaagacaguuugguucgugcccuccaucaaaagcggcaacgacaucgccaacugccucaggaaaaacgggaagcgcgugauccagcuuucacgaaagacguuugacaccgaguaccagaagaccaagaacaacgacugggacuacgucgugacuacggauaucagcgagaugggcgcgaacuucagggccgaccgggugaucgauccgcgccggugcuuaaagcccgucauccucaaggacgggccagagcgcguaaucuuagcagggcccaugccggucaccguagccuccgccgcgcagcggcgcgggcgggugggccggaaucacaacaaggagggcgaccaguacaucuacauggggcagccccugaacaacgacgaagaccaugcccacuggaccgaggccaagaugcuccuggacaacauaaacacucccgaagguaucauccccgcccuuuucgagccggagcgcgagaaguccgccgcuaucgacggugaauaccggcuccgcggcgaggccaggaagacuuucgucgagcugaugcgucgcggggaccugccuguguggcucuccuacaagguggcaagcgagggguuccaguacagcgaccgcagauggugcuucgacggugagaggaauaaccagguccuggaagagaacauggacguggagaucuggacgaaggagggggaacggaagaaacugcgcccgcgguggcucgacgcucgcaccuacuccgacccacuagcccuucgggaguucaaagaguuugcggccggccgccggagcguauccggcgaccucauccuggagaucggcaagcugccgcaacaccugacccagaaggcgcagaaugcccuggacaacuuagucaugcuccacaacagcgagcaaggcggacgggcguacagacacgccauggaggagcuuccugacacgaucgagacccugaugcuccuggcgcugaucgccguguuaacaggcggggucacccuauucuuucuguccggccgcgggcucggcaagaccagcaucggccugcugugcgucauggccuccagcgugcuccuguggauggcguccguugaaccccauuggaucgcggcuagcaucauccuggaguucuucuugaugguucugcucaucccggagccagaccggcagcgcacuccgcaggacaaccagcucgccuacgucgugaucgggcugcuguucaugaucuugacggucgccgcgaacgagaugggccuacuggagacuacaaagaaggaccucgggaucggccacguggcuguggagaaccaccaccacgcggcuauguuagacguagaccugcaucccgccuccgcguggacuuuauacgccguggccacaacgaucaucacuccgaugaugaggcauacgaucgagaacaccacugccaacaucagccugacugcgauagccaaucaagccgccauuuuaauggggcucgauaagggcuggcccaucuccaagauggacaucggugugccccugcuggcccucggcugcuauagccagguaaacccccugacguugacugcagcgguguuaaugcugguggcccacuacgccaucauugggccggggcugcaggccaaggcgacccgagaggcccagaagcgcaccgccgcaggcaucaugaaaaaccccacggucgacgggauaguggcgauugaccuagaccccguggucuacgacgcgaaguucgagaagcagcugggccagaucaugcugcucauccugugcaccucccagaucuugcucaugcggaccaccugggcucuuugugagagcaucacgcuggcuacgggcccccucaccacccugugggagggguccccgggcaaauuuuggaacaccaccauugccguuagcauggccaacaucuuccgcggguccuaccucgccggcgccggccucgcuuucucccugaugaagucccuugggggcgggcggcgcggcaccggggcccagggcgaaacacucggugagaaguggaaacgccagcuaaaccaacugagcaagagcgaguucaacaccuacaagcgguccgguaucauggagguggaccggagcgaggcuaaggaaggccucaagcgcggggaaaccacaaagcacgcuguguccaggggcacggcuaagcugcgcugguucguugagcggaaccuggugaagcccgaggggaaggucaucgaucugggguguggcagagggggcuggagcuacuacugcgccgggcucaaaaaggugacagagguuaagggcuacaccaagggcgggcccggccacgaggagccaauccccauggcaaccuauggguggaaccuggucaagcugcacagcggcaaggacguguuuuucaucccgcccgagaagugcgacacccuccucugcgauaucggggagaguuccccuaacccaacgaucgaagagggcagaacccugcgcguccucaagaugguggaacccuggcugcgggguaaccaguucugcaucaaggugcugaaucccuacaugccaagcguggucgagacccucgagcagaugcaacgcaaacauggcgggaugcuagugcggaacccgcuguccaggaacagcacccacgagauguacugggugucgugcgggaccggcaauaucguaagcgcggugaacaugacaagucggaugcuccucaaccgauucacgauggcccaccgcaaacccaccuaugagcgggacguggaucuaggcgccggcacccgccacgucgccguggagcccgaagucgcgaaccuagacaucaucggccaacgcauagagaacaucaagcacgagcacaaguccacguggcacuacgacgaggacaaccccuauaagaccugggcguaccacgggucguacgagguaaaaccgagcggcagugccagcucuauggucaacggggucgugaagcuguugaccaaaccaugggacgugauuccuaugguuacacaaaucgcuaugacugacacgacuccuuucggucagcagcgcguguucaaggagaaggucgacacgaggacgccgaaagccaaacgcgggaccacccagauuauggaggucaccgcacgguggcucuggggcuuccucucccgcaacaagaagccucggauuugcacccgcgaagaguucacgcggaagguccgcagcaacgcggccaucggcgccgucuucgucgacgagaaucaguggaacagcgccaaggaggcgguggaggacgagcgguuuugggaccuggugcaccgcgagcgggagcuacacaagcaggggaagugcgcgaccuguguauacaacaugaugggcaagcgggagaaaaagcugggggaguucggaaaagcaaaggggagccgggccaucugguacauguggcucggcgcccgcuucuuggaguucgaggcccugggcuucaugaacgaggaccauugguucucccgggagaacagccugagcggggucgaaggagagggucuccacaagcugggcuauauacugcgggacaucagcaagauacccgguggcaacauguacgccgacgauaccgcggggugggauacgcguaucaccgaagacgaccuccaaaacgaggccaagaucaccgacauuauggagccagagcacgcccugcuggcgaaggcgauauucaagcucaccuaccagaacaaagugguccgcgugcagcggcccgccaagaacgggacggugauggaugucauaucccggagggaccagcgcgggagcggccaggugggaaccuacggacugaauacguucaccaacauggaagcccagcuuauccgccaaauggaguccgagggcaucuuuagucccuccgagcucgagacacccaaccuggcugagcggguacuugacuggcuugagaaguacggcgucgaacgcuuaaagcggauggccaucagcggggacgacuguguggugaaacccaucgacgaccgcuucgccaccgcccuaaccgcccucaacgacaugggcaaaguccggaaggacaucccccagugggaaccguccaaaggguggaaugacuggcaacaggugcccuucuguagccaucacuuccaucaguugauuaugaaagacggccgcgaaaucguagucccgugccggaaccaggacgagcugguuggccgggcccgggugucacagggggcgggcuggucgcugcgcgagaccgcaugccugggcaagaguuacgcccagauguggcaacucauguacuuucaccggcgcgaccuucggcuggccgcgaacgccaucuguuccgcggugcccguggauugggugcccacuagccgcaccaccuggagcauccaugcgcaccaccaauggaugacuacagaggacaugcucagcgucuggaaccggguguggaucgaagaaaacccauggauggaggauaagacccacauaagcagcugggaggaugugccauaccucggaaaacgcgaggaccaauggugcgggagucucaucggccugacagcccgcgccaccugggccaccaauauccaggucgccaucaaccagguacggcgccucaucggcaacgagaacuaucuggacuauaugacgaguaugaagagauucaagaacgaguccgacccugagggggcccugugguga

SEQ ID NO: 24708 - RNA, 9879 nt, Artificial Sequence
  derived and/or modified CDS sequence (opt11) from DENV-1__KC762642__SS-prME
agcgugaccaugcugcucaugcugaugcccaccgcucuggccuuccacuugaccacccggggcggggaaccccacaugaucgucagcaagcaggaacgggggaagagccugcuguucaaaaccuccgccggcgugaacaugugcacgcuaaucgccauggaccugggcgagcugugugaggauacccucaccuacaagugcccccggaucaccgaggccgagcccgacgauguggacugcugguguaacgccaccgacaccugggucaccuacgggaccugcagccagaccggcgagcaccggcgggacaagcggucaguggcccuggcaccccacgugggccuggggcucgagacacggacagagacguggaugagcuccgagggcgccuggaagcagauccagcgggucgaaaccugggcacugcggcaccccggguucacggugaucgcucuguuccucgcgcacgccaucggcaccagcaucacccagaaaggcaucaucuucauccugcugaugcucgugacccccuccauggcuaugcggugcguuggcaucggcagucgcgacuucguggaggggcugagcggcgccacguggguggacgucguccuggagcacgggagcugcgugaccaccauggccaaggacaagcccacccucgacaucgagcugcugaagacugaggucaccaacccugcgguuuuacggaagcugugcaucgaggccaagaucaguaacacuaccacggacagccgcugcccgacccagggcgaggccaccuugguggaagagcaggacgccaacuucgucugccggcgcaccuucguggaccggggcugggggaacggcugcgggcuauucggcaaggguucccugaucacgugcgcuaaguucaagugcgugaccaagcuggagggcaagaucguccaauacgaaaacuugaaauacagcgugaucgugacgguccacaccggcgaucaacaccagguggguaacgagucgacagagcacgguaccaccgcgaccaucacuccccaggcucccacgaccgagauccaacugaccgauuacggggcucugacccucgacugcagcccgcgcacgggccuggacuucaacgagaugguccugcucaccaugaaggagaaauccuggcuggugcacaagcagugguuccuggaucugccccugcccuggaccagcggggccagcaccacgcaggagaccuggaaccgacaagaccugcucguaaccuucaagaccgcgcacgcgaagaagcaggagguaguggugcugggcucccaggagggcgccaugcacacggcgcuuaccggggccaccgaaauccaaaccagcgguacgacgaccaucuucgccggacaccucaagugccgucugaagauggacaagcugacccuuaagggcauguccuacgucaugugcacggggagcuucaagcuggaaaaggagguggcggagacccagcacggcaccgugcugguccagauaaaguacgagggcaccgacgcgcccugcaaaauccccuucuccacccaagacgagaagggggugacccagaacggccggcugaucaccgccaaucccaucgugacggacaaagaaaagcccgucaacaucgaggccgagccgccuuucggggagagcuacaucgugaucggagcgggcgagaaggccuugaaguuauccugguucaaaaagggcucauccaucggcaagauguucgaggccacggcccgcggagcucggcgcauggcgauccugggagacaccgccugggacuucgggagcauaggcggcguguucaccuccgucgggaagcucguccaccagaucuucgguaccgccuacggggugcuguucuccggggucuccuggacgaugaagaucgggaucggcgugcugcucaccugguugggccuaaacagucgcuccaccagucucuccaugaccugcaucgccguggggcuggucacacuguaccucggcgugauggugcaggccgacagcgggugcgucaucaacuggaagggccgggagcugaagugcggguccggcaucuucgugaccaacgagguacacaccuggaccgagcaguauaaauuccaggcggacaguccaaagcgccugagcgccgcuaucgguaaggccugggaggagggggucugcggcauccgguccgcgacccgccucgagaauaucauguggaagcagaucagcaacgaacugaaccacauccuucucgagaacgacaugaaguucacgguuguggucggugacguggcgggcauccuggcccaagggaagaagaugauccggccccagccuauggagcacaaguacucuuggaaauccuggggcaaggccaagaucaucggggccgacgugcagaacaccaccuucauuaucgacgggcccaacacaccggagugccccgacgaccaacgcgcguggaacaucugggagguugaggacuacggcuucgguaucuucacgaccaauaucuggcugaagcuccgggacuccuacacccaggugugcgaccaccgccugaugagcgccgccauuaaggacuccaaggccgugcacgcggacaugggcuacuggaucgagagcgagaagaacgagaccuggaaguuagcgcgggccuccuucaucgaggucaagacgugcauauggcccaagucacacacccucuggucuaauggagugcuggagagcgagaugaucauccccaagaucuacgggggcccgaucucccagcacaacuaccgccccggauacuucacccagaccgccggcccguggcaccuggggaaacucgagcucgacuuugaccugugcgagggcacgaccguggucguggacgagcacugcggcaaccgggggccgagccuccgcaccaccacggucaccggcaagaucauccacgaguggugcugccgguccuguacccugccgccccugcgcuuccgcggggaggacggaugcugguacgggauggagauccgccccgucaaggagaaggaggagaaucucgucaagagcaugguguccgccggaagcggagagguugacagcuucagccuggggcugcucugcaucucgaucaugaucgaagaggugaugcggucccgcuggucccggaagaugcugaucaccgguacgcuggccguguucuuccuccugaucauggggcaggucacuuggaacgaccugacccgccucugcaucauggugggcgcgaacgccuccgaccgcauggggaugggcaccacauaccuggcccugauggccaccuucaagaugcgaccgauguucgccgugggccuccuguuccgccggcugacuagccgcgaggugcuccugcugaccauuggccucucccugguggcgaguguggagcugcccaacucgcucgaggaguugggcgacgggcuggccaugggcauaaugauccucaagcugcugacggacuuccaaagccaccagcucugggccacccugcugagccucaccuuuaucaagaccacuuuuagccugcacuacgccuggaaaacgauggcgauggugcugucaauugugagccucuucccccugugccuguccacgaccagccagaagacgaccuggcuccccguccugcugggcucccucgggugcaaaccacugaccauguuccugaucgcugagaacaaaaucuggggccgaaaaaguuggccccucaacgaggguaucauggccgugggcaucguaagcauucugcugagcagccuccugaagaacgacguuccccuggccgggccccucaucgcgggcggcaugcugaucgcgugcuacgugaucuccgggagcucugccgaccugucucucgagaaagccgccgaaguauccugggaggaggaggccgagcacagcggcgcgucccacaacauccugguggaagugcaggacgaugggaccaugaagaucaaggacgaggagcgcgacgacacgcugacgauacuacugaaagccacccugcucgccguaagcggagucuacccccuguccaucccagccacccuguucgugugguacuuuuggcagaagaagaagcagcggagcggggugcuuugggacaccccuagcccgcccgaggucgaacgcgccgugcuggaugacggcaucuaccggaucaugcagcgcggccugcuggggcgcagccagguuggcgucgggguuuuccaggagaauguauuccacacaauguggcacguaacccggggcgccgugcucauguaccaggggaaacggcuggagcccuccugggccagcgugaagaaggacuugaucuccuauggcggcggguggcgccuccagggcagcuggaacaccggggaagaaguccaggugaucgccguggagcccggcaagaaccccaagaacguccagaccgcccccgggacguucaagaccccggagggcgaggugggcgccauugcgcuggacuucaagcccgggaccuccggcagcccaaucguaaaccgggaagggaagauagucggccuguacgggaacgggguggugaccacguccggcaccuacgucucagccaucgcccaggccaaggcgagccaagaggggccguuaccggagaucgaagacgaaguguucaggaagcggaaucugacuaucauggaccugcacccaggcagugguaagacccgccgguaccucccggccaucgugcgcgaggccaucaagaggaaacuucgcacgcugauccucgcccccacccgcgucguggcaagcgagauggcggaggcccugaaggguaugccgauccgguaccagacaaccgccgugaaauccgaacacacgggccgggagaucguggaucugaugugccacgccaccuucaccaugcggcuccugagccccgugcgcgugccgaauuauaauaugaucaucauggacgaggcccacuuuaccgaccccuccagcaucgcggcccggggguauaucucaacacgcgucggcaugggggaggccgccgcuaucuucaugaccgcgaccccgcccggcagcguggaggccuucccgcaguccaacgccguuauccaagacgaggagcgggacauccccgagcggucguggaacuccggguacgaguggaucacugacuuccccggcaagacggucugguucgugcccaguauuaaguccgguaacgacaucgcuaacugccugcggaagaacgggaagcgcgugauccagcucucgcggaagaccuucgacaccgaguaccagaagaccaagaacaacgacugggacuacgucgugacgacagacaucuccgagaugggcgcgaacuuccgcgccgaccgugugauagacccgaggcggugccugaagccagucaucuuaaaggacggucccgagcgcgugauccucgcaggccccaugccggucacaguagccucggcagcgcagcggcgcgggcggaucggccguaaccacaacaaggagggagaccaguacaucuacauggggcagccacucaacaacgacgaggaccacgcucacuggaccgaggcuaagaugcugcuagacaauauaaacacccccgagggcaucauacccgcccuguucgagccagagcgcgagaaguccgccgcgaucgacggggaguaccggcugcgcggcgaggcccggaagaccuucguggaguugaugcgccggggggaccuucccgucuggcugagcuauaaggucgccuccgaaggcuuccaguacagcgaccgccgguggugcuucgacggagagcgcaauaaucaggugcucgaggagaauauggacgucgagaucuggaccaaggagggggagcggaagaagcugcgcccccgcugguuagacgcccgcaccuacagcgacccccucgcucugagggaauucaaggaguucgccgccggccgccgguccgugagcggggaccugauacucgagaucggcaagcugccgcagcaccucacgcagcgcgcccagaacgcccucgacaaccuggucaugcugcacaacuccgagcagggcgggcgggcauaucgccacgccauggaggagcuccccgacaccaucgagacccugaugcugcucgcuuuaaucgccguccugaccggcggggugacccucuucuuccugagcggccgggggcugggcaagacguccaucggccuccugugcgugauggccagcuccguccugcucuggauggcuagcguggagccccacuggaucgccgccucuaucauccuggaguucuuccugaugguauuacugaucccugagccggaccgccagcggacgccucaggacaaccaacuggccuacgucgugaucgggcuccuguucaugauccugaccguggccgcgaacgagaugggccuccuggaaacgacgaaaaaagacuugggaaucggccacgucgccguggagaaccaccaccaugccgccaugcucgacguggaccugcaccccgccagcgcguggacccuguacgccgucgccaccaccaucaucacuccaaugaugcgccacaccauugagaacacuaccgccaacauuucacucacggcaaucgcgaaccaggccgccauccugauggggcucgacaaggguuggcccaucagcaagauggacaucggcgucccccuccuggcccuggggugcuacucccaggucaacccccucacgcugaccgcggccgugcugaugcucguggcacacuacgcgaucaucggcccagggcugcaggccaaggcgacccgcgaggcccagaagcgaacggccgccgguaucaugaagaaccccaccguugacgggaucgucgccauugaccuggaccccgucguguacgacgcgaaguucgagaagcagcucgggcagaucaugcugcugauucucugcaccagccagauccugcugaugcgcacaacgugggcccucugcgaguccauaacccuggccaccggcccccucaccacgcucugggaagggucgccgggcaaguucuggaacaccaccaucgccguguccauggccaacaucuuccgggggagcuacuuggcgggugccggccuagccuucuccuuaaugaaguccuuggggggcggccgccggggaaccggggcccagggcgaaacgcucggcgagaaguggaagaggcagcuuaaccagcugagcaaaucggaguucaacacauacaagcggagcggcaucauggagguggaccgcuccgaagcgaaggagggacugaagcgcggugagacgaccaagcacgccgugagccgcgguacggccaagcuccguugguucgucgagcguaaccuggugaagcccgaggggaaggugaucgaccugggcugcgggcgcggcgggugguccuacuacugcgcuggucugaaaaaggucaccgaggugaaggguuacaccaagggcggccccggccacgaagagcccauaccaauggccaccuacggguggaaccucgugaagcuccacagcggcaaggacgucuuuuucauaccacccgagaagugugacaccuuacuuugcgauaucggggaguccagccccaacccgaccaucgaggagggccgcacccugcgggugcugaagaugguagagcccuggcuccgcgggaaccaguucugcauaaaaauccugaaccccuacaugccauccgucguggagacccuggaacagaugcagcggaagcacggcggcaugcucgugcgcaacccguuaagcaggaacuccacccacgagauguacugggucagcugcggaacgggcaauaucgugucggcgguaaacaugaccagccgcaugcuacucaaccgcuucaccauggcccaccggaaacccaccuacgagcgcgacgucgaccugggggcgggaacgagacacguggccguggagcccgaggucgcaaaccuugacaucaucggccagcgcaucgagaacaucaaguaugagcacaaguccaccuggcacuacgacgaggauaaucccuacaagaccugggcguaccaugggagcuacgaggugaagccguccggcagcgccuccagcauggugaacggcguugugaaacuccugaccaagcccugggacgucauccccauggugacacagaucgccaugaccgacaccacccccuucggucagcagcggguguucaaagagaaagucgacacgcggaccccgaaggccaagcgggggaccgcacagauaauggaggugaccgcucgcuggcuguggggcuuccucagccggaacaagaagccgcgcauuugcacgcgagaagaguucacccggaaggugcgcucaaacgcagcgaucggggccgucuucguggacgagaaccaguggaauagcgcgaaggaggcgguggaggacgagcgcuucugggaccugguccaccgggagcgcgagcugcauaagcaggggaagugcgcgaccuguguguacaacaugaugggaaagcgggagaagaagcugggggaguucggcaaggccaagggaagccgcgcuaucugguacauguggcugggagcacgcuuccuggaguucgaggcacucggcuucaugaacgaggaccacugguucucuagagagaacucccugagcgggguggaaggcgaggggcugcacaagcucgguuacauccugcgggacauuuccaaaaucccaggggggaacauguacgccgacgacaccgccggcugggacacgcgcauuaccgaggaugaccugcagaaugaggccaagauuaccgacaucauggagccggagcacgcgcuccuggccaaggcugucuucaagcugaccuaccagaacaagguggugcgcguccaacggcccgccaagaauggaacgguaauggacguuaucagcaggcgggaccagcgcggcucaggacagguaggcaccuacggccuuaacaccuucacgaacauggaggcgcagcugauccggcagauggagagcgaggggaucuucucccccagcgagcuggaaacgcccaaccucgccgagcgcguucuauacugguuggagaaguauggcgucgagcggcucaaacgcauggccaucuccggggacgacugcgucgugaagccgaucgacgaccgguucgccaccgccuugaccgcccugaacgacaugggaaaggugcgaaaggacaucccccagugggagcccagcaagggguggaacgauuggcagcaggucccauucugcucccaccauuuccaccagcucaucaugaaggacgggcgggaaauaguagugccgugccgcaaccaggacgagcuggucggccgggcgcgcgugagccagggggccggcuggucccugcgggagaccgccugccucggcaagagcuacgcccagauguggcagcugauguacuuccaccgccgggaccugcgccuggcagccaacgccauaugcagcgccguuccugucgacuggguucccacgucgagaacuaccuggagcauccaugcccaccaccaguggaugaccacggaggacaugcuguccguguggaaccgcgucuggaucgaggagaaccccuggauggaggacaagacccauaucagcuccugggaggacgugccguaccuaggcaagcgcgaggaccaauggugcgggagccucaucggccugaccgcgcgagccaccugggccacuaacauccagguggccauuaaccagguucgccggcugaucggcaaugagaacuaccucgauuacaugacguccaugaagcgcuucaagaacgagagugaccccgagggggcccugugguag

SEQ ID NO: 24709 - RNA, 9879 nt, Artificial Sequence
  derived and/or modified CDS sequence (opt11) from DENV-1__JQ915077__SS-prME
agcgugacuaugcugcucaugcugcugcccaccgugcucaccuuccaccugacgacucgggguggugaaccccacaugaucgugagcaagcaggagaggggaaagagccuccuguucaagaccuccgccggggugaacaugugcacccugaucgcaauggacuugggcgaacucugcgacgacaccaugaccuacaagugcccccgcaucaccgagaccgagcccgacgacguggacugcugguguaacgcaaccgaaaccugggugaccuacggcacgugcucacaaaccggcgagcaccggcgcgacaagcgguccguggcgcuggcgccccacguuggcuuggggcucgagacccgcaccgaaacguggaugucguccgagggcgcauggcggcaaauccaaaaaguggagacuugggcccugcgccaccccggguucacggugaucgcgcuguuccuggcccaugcgaucgguaccagcaucacgcaaaaggggauaaucuucauccugcugaugcucguuacccccuccauggccaugcggugcguagggauaggcaaccgcgacuucguggagggguuaagcggcgcgaccugggucgacguggugcuggagcaugguuccugcguaacuacgauggccaaggacaaacccacccucgacaucgagcugcucaagacugaggugaccaacccggccgugcuccggaagcugugcaucgaggccaaaaucucaaacacgaccaccgacucccggugcccgacccagggcgaagccacgcugguggaggagcaggacaccaacuuugugugccggcgcacauucgucgaccggggcugggggaacggcugcggccucuucggcaaggggagccugaucacgugcgcaaaguucaagugugucacgaagcuggagggcaagaucgugcaguacgagaaccucaaguacucggugauuguuaccgugcacacgggcgaccagcaccaggucgggaacgagaccaccgagcacggcacgaucgccaccauuacaccccaggcccccaccagcgaaauccagcugacggauuacggggcccuaacucucgacuguagcccccggaccgggcuagacuucaaugagauggugcugcucacgaugaaggagaaguccuggcuggugcacaagcagugguuccuggaucuccccuugcccuggacauccggggccagcacaagccaggaaaccuggaaccggcaggaccugcucgucaccuucaagaccgcgcacgccaagaagcaggaaguuguuguucuggggucucaggagggggccaugcauaccgcccuuacaggggccacggagauccagacaagcggaaccaccaccaucuucgcggggcaccucaagugccgacugaagauggacaagcugacgcucaaggggaucuccuacgugaugugcaccgggagcuucaagcuggaaaaagagguggccgagacccaacacggcaccguucucguccaggugaaguacgagggaacggacgcccccugcaagauccccuucuccagccaggacgagaagggggucacacagaacggccggcuggugaccgccaacccgauaguuaccgacaaggagaagccagucaacaucgaggccgagccacccuucggggaguccuacauaguggucggcgcgggcgagaaggcccucaagcugagcugguuuaagaagggguccagcaucggcaagauguuugaggccaccgcccgcggggcgcggaggauggccauccucggcgacacggccugggacuucggguccaucgguggcgucuucaccagcguggggaagcucgugcaccagaucuucggcaccgccuaugggguucuguucuccgggguuagcuggacgaugaagaucggaaucggcauccuccuaaccuggcuaggccuaaauucccgcuccaccucccucagcaugacaugcaucgccguggggauggucacgcuuuaccugggcgugauggugcaggcggacagugguugcguaaucaacuggaaaggccgggagcucaagugcgggagcgguauauucguuaccaacgagguucacaccuggaccgagcaauacaaguuccaggccgacagcccuaagcgccuguccgccgccaucggaaaggccugggaggaggggguaugcggcauccggagcgcgacccgccuggagaacaucauguggaagcagaucuccaacgagcucaaccacauccugcuggagaacgauaugaaguucacuguuguggucggagacguuagcggcauccucgcccaggggaaaaagaccauccggccccagccaauggagcacaaguauuccuggaaaucuuggggcaaggccaagaucaucggcgccgacguccagaacaccacuuucauuaucgacgggccuaauacgccggagugcccggaugaccagcgugccuggaacaucugggaggucgaggacuacggauucggaaucuucacgaccaacaucuggcugaaguuacgggacuccuacacccaggugugcgaccauagguuaaugagcgcggccaucaaggacucaaaggccgugcaugccgacaugggauacuggaucgagagcgagaagaacgagacguggaagcuggcgcgcgccuccuucaucgaggucaagacgugcgucuggcccaagagccacacgcugugguccaacggcguguuagagagcgagaugaucauccccaagaucuacgggggacccauaucccagcacaacuaccgcccaggguacuucacccagaccgccgguccuuggcaccuggggaagcuggagcuggacuucgaccugugugagggcacuaccgucgugguggacgagcacugcggcaaccgggggccuucgcugcgcaccacgacaguuaccggcaagaucauccacgaguggugcugccgguccugcacccugccgccccuccgcuucaaaggggaggacggcuguugguacggaauggagauccggcccgugaaggagaaggaggagaaccuggucaaaagcauggugagcgccggcuccggggagguggacuccuucucccucgggcuucugugcaucagcauaaugauagaggaagugaugcgcucccgguggagccgcaagaugcucaugacgggcacccuggucguguuucugcuccugacucugggucagcucaccuggaacgaccugauccggcugugcaucaugguuggcgccaacgcgucggacaacaugggcaugggcacgaccuaucucgccuuaauggccaccuuccgcaugcgcccuauguuugccguggggcuccuuuuccggcggcugaccagucgggaggugcuucuccugacggucgggcugagccucgucgccagcguggagcugcccaacagucuugacgaguuaggagauggcuuggccaugggcaucaugauucugaaguuacugaccgacuuccagagccaccaguuaugggccauccugcuguccuuaaccuucgugaagaccacgcuuagccugcacuacgccuggaaaaccauggcaaugauccuguccaucgugagccuccugccccugugccuaucaacaacaagccagaagacgaccuggcugcccgugcugcucggcucccuagggugcaagccgcugaccauguuccucauuaccgagaauaaaaucuggggcagaaagagcuggccccugaacgaggggauaauggccguagguauagucucaauccuucuauccagucugcugaagaacgacgugccccucgcagggccccuuaucgccggcggcaugcugaucgccuguuacgucaucuccgggagcuccgccgaucucagcuuggagaaggcggccaagguguccugggaggaggaggccgagcauagcggcgcaucccauaacauccugguggagauccaggacgacggcaccaugaagauuaaggacgaggagcgggacgauacgaucaccauccucuuaaaggccacccugcuagcaaucagcggcgucuacccgauguccauucccgccacccuguuuguguggcacuucuggcagaagaagaagcagcgaagcggagugcugugggacacucccagcccgcccgagguggaaaaggccguacuggacgacggcauuuaccggauccuccagcgcggccugcuggggcggagccaaguaggcgucgggguguuucaggagggcguguuucacaccauguggcacgucacccgcggggccguucucauguaccaggggaagcggcuugagccguccugggccagugugaagaaagaucuaaucuccuauggcgggggcuggcgcuuccaggggagcuggaacacaggcgaggagguacaggugaucgcgguggagcccgggaagaaccccaagaauguacagacugcccccggcacguucaagaccucagaaggcgaagugggagcgauugcccuagacuucaagcccggcacaucugggagccccaucgugaauagggaaggcaaaauagucggacuguacggaaacggcguggugacgaccucgggcaccuaugucagugcaaucgcgcaggccaaggccucccaggagggcccucugccggagaucgaggacgagguauuccgcaagcggaaccucacaauuauggaccugcaccccgggagcggcaagacucgccgguaccugccugccaucgugcgcgaggccaucaagcggaagcuccgcacucugguccuggccccgacccgggugguagcgucugagauggcagaggcacucaagggcaugcccauccgcuaucaaacaacggcggucaagagcgagcacaccgguaaggagauaguggaccugaugugucacgccaccuucaccaugcgcuuacucucucccgugcgggucccgaacuacaauaugaucaucauggacgaggcccacuucacggacccggcuagcauagccgcgagaggcuacauauccacccggguggggaugggcgaggcggccgccaucuuuaugacggccacgccgcccgggagcguggaggcuuucccccagagcaaugccgucauacaggacgaagagaaggacaucccggagcguagcuggaacuccggcuacgauuggauaaccgacuuccccggcaagaccgugugguucgugccaucuaucaaguccgggaacgacaucgccaacugccugcggaagaacggcaagcgcguuauccagcugagcagaaagaccuuugacaccgaguaccagaagacuaagaacaacgauugggacuacguggucaccacugauauuuccgagaugggggccaacuuccgcgcggaccgggugauagacccccgccggugccucaagccugugaucuugaaggauggccccgagcgcgucauccuugcggggcccaugcccgugaccguggccagcgccgcccagcggcgagggcggaucggccgaaaucaaaacaaggagggggaccaguacaucuauaugggccagccgcucaacaacgacgaggaccacgcgcacuggacggaggccaagauguuacuggacaacaucaacacccccgaggggaucauccccgcccucuucgagcccgaacgcgaaaagagugccgcaauugacggcgaguaccgccugcgcggggaggcgcgcaagaccuucguggagcugaugcgccggggcgaccucccgguguggcugagcuacaagguggcauccgaaggcuuucaguacuccgacaggcgcuggugcuucgacggggagcgcaauaaucagguccuggaggagaacauggacguggagaucuggaccaaggaaggcgagcggaagaagcuccgcccgcggugguuggacgcgcgcacguacagcgacccgcuggcgcuccgugaguucaaggaguucgcagcggggcgccgguccgugagcggagaccucauccuggagaucggaaaacuuccccagcaccugacccagagagcccagaacgccuuggacaaccucgucaugcuacacaacuccgagcaaggugggaaggcauaccggcacgccauggaggagcugccggacacuaucgagaccaucaugcuccuggcgcugaucgccgugcuaaccgggggagugacgcuuuucuuucugagcgggcgcggauuaggcaagaccuccaucggguuacugugcgucaccucguccagcgugcucuuauggauggccuccguggagccccacuggauagccgcgagcauaauccuggaguuuuuccucaugguccugcugauacccgagccugaucggcagcggacaccccaggacaaccagcucgccuacgugguaaucggucugcuguucaugauacucacaguagccgccaacgagauggggcugcuggagaccaccaagaaggaccucggcaucggacacgccgcggccgagaaucaucaccacgccgccaugcuggacguggaccugcaccccgccucagcguggacgcuuuacgcaguggccaccacgaucaucaccccaaugaugcggcacaccauugagaacacgacagccaacaucagccugaccgcuauugcgaaccaggccgccauacugauggggcucgacaagggcuggccgaucucuaagauggauaucggggugccucuguuagcccucggcugcuacagccaggugaauccccugacacugacggcggcggugcucaugcuggucgcgcacuacgcuaucaucggucccggguugcaggcaaaggcgacccgcgaggcacagaagcggaccgcugccgggaucaugaaaaacccgaccguagacggcauuguggcaaucgaccucgaccccgucgucuaugacgcaaaauucgaaaagcagcugggccagaucaugcugcucauccuuuguacgucccagauccugcuaaugcguaccacaugggcccugugcgagagcaucacacuggccacggggccgcucaccacucuaugggagggcucucccggaaaguucuggaacaccacaaucgccgucagcauggcgaacauauuucggggcagcuaucuggcgggcgccgggcuagccuucucccugaugaagucccugggcgggggccgccgcgggaccggugcccagggcgagacccucggugagaaguggaagcggcaguuaaaccagcucucaaaaagcgaguucaacaccuacaagcgcuccggcaucaucgaggucgaccgguccgaggccaaggaggggcuuaagcgcggcgagacgacaaagcacgcggugucacggggaaccgccaagcugcgcugguucguggagcgaaaucuggucaagccggaggguaaggucaucgaccugggcugcgggcgcggcggguggagcuacuacugugccggccucaagaaggugaccgaggucaagggguacacgaaagggggcccugggcacgaggagccgauccccauggccaccuacggcuggaaucucguaaagcugcacagcgggaaggacguuuucuucauaccgcccgagaagugcgacacgcuccugugcgacaucggggagagcucaccaaaccccacaauugaggagggacggacccugcgcguccucaaaaugguggagccguggcugcgagggaaccaguucugcaucaaaauccugaaccccuacaugcccagcguggucgagacgcucgagcagaugcagcgcaagcacggcgggaugcuggugcggaacccccugucccgcaacagcacccacgagauguacuggguauccugcggcaccggaaauaucgugagcgccgugaacaugacgucgcggaugcuccugaaucgcuuuacgauggcccaccggaagccgaccuacgagcgcgacguugacuugggggccggcacccggcacgucgccguggagcccgaaguggccaacuuagacauaaucgggcagcgcaucgagaacaucaagaacgaacacaagagcaccuggcacuacgacgaagacaaccccuacaagacgugggcguaucacggguccuacgagguaaagccuagcgggagcgccuccagcauggugaacggcgucgugcgccugcucacgaagccgugggauguuauucccaugguuacccagaucgcaaugaccgauacgacaccuuucgggcagcaacggguguuuaaggagaaggucgacacccgcacccccaaggcgaaacggggcacggcccagaucauggaggucaccgcgaaguggcucuggggcuuucugucccgcaacaagaagccucggaucugcacccgcgaggaguucacccggaagguucgcucaaacgccgccauuggugccguguucgucgacgagaaccaguggaacuccgccaaggaggcgguggaggacgagcgguucugggaccugguaagacgggagcgcgaacugcacaagcagggcaagugugccacgugcgucuacaacaugauggggaaacgggagaagaagcugggcgaguucgggaaggccaagggcagccgugcgaucugguauauguggcugggcgcucgguuccuagaguuugaggcccugggguuuaugaaugaggaccacugguuuucccgcgagaauagccuguccggaguggagggggaaggucuccauaagcuggguuacauccugagagacauaucaaagaucccaggcggcaacauguaugccgacgacacggccgggugggacacccgcaucaccgaggacgaccuccagaacgaagccaagaucacggacaucauggagcccgaacacgcucuguuggccaccagcauauucaaguugacuuaucagaacaaagucguucgggugcaacgccccgccaagaauggcaccgugauggacgucaucagccggcgcgaccaacgcgggaguggacaggugggcacguaugggcugaauaccuucaccaacauggaggcccagcugaucaggcaaauggaguccgaggguaucuucucccccuccgagcuagagacccccaaccuggccgggcgcguccuggacugguuagaaaagcacggcacagaacggcugagacggauggcgauuuccggggacgacugugucgugaaacccaucgacgaccgcuucgcaaccgcucugaccgccuuaaacgacaugggcaaggugagaaaagacauuccucagugggagcccagcaagggcuggaacgacuggcagcagguacccuucugcagccaccacuuccaucagcugaucaugaaggacggucgugagaucgugguccccugccggaaucaggacgagcuggucggccgcgcccggguaucccaaggcgcgggcuggagccuccgcgagacggcaugccuggggaaguccuacgcacagauguggcaauugauguacuuccaccgacgcgaccuucggcuggcagccaacgcuauauguagcgcuguccccgucgacugggugcccacgucccgcaccacguggucaauacaugcgcaccaccaguggaugaccaccgaggacaugcuguccguuuggaaccgggucuggaucgaggagaacccguggauggaggacaagacgcacgugagcuccugggaggacgugcccuaucucgggaagcgcgaggaccaguggugcggcagccugaucggacuuaccgcccgggcgaccugggcgacaaacauccaggucgccaucaaucaggugcgccgccuaaucggcaacgagaacuaccuugacuacaugacguccaugaaacgguucaagaacgaaucagacccggagggggcgcugugguga

SEQ ID NO: 24710 - RNA, 9879 nt, Artificial Sequence
  derived and/or modified CDS sequence (opt11) from DENV-1__JQ915079__SS-prME
agcgugaccaugcuguugaugcugcugcccaccgugcucaccuuccaccugaccacccggggcggggagccccacaugaucgugagcaagcaggagcggggcaaaagucuccuguucaaaaccagugccggagugaacaugugcacccugaucgcuauggaucugggcgagcucugcgacgauaccaugacauacaagugcccacgcaucaccgagacagagccggaugacguggauugcuggugcaacgcgaccgagaccugggugaccuaugggacuugcagccagacgggcgagcaccggagggauaagcgguccguggcccuggcgccccacgucggccuggggcucgagacccgcacagagacguggaugucauccgagggcgcauggcggcagauacagaagguggagaccugggcccugcggcaccccggauuuaccgugauagcgcuguuccucgcccacgccaucggcaccucuaucacgcagaaggggauuaucuucauucugcuuaugcucguuaccccauccauggccaugagaugugugggcauuggcaaccgcgacuucguggaggggcuuaguggggcgacgugggucgacguggugcuggagcacggauccuguguuacuacgauggcgaaggauaagcccacccucgacauagagcuguuaaagaccgaggucaccaaccccgccgugcuucggaaguugugcauagaggcaaagaucagcaauacgacuacagacucccgcugcccgacccagggcgaagcaacgcuagucgaggagcaggacaccaacuucgugugucggcgcacuuucguagaccguggaugggggaacgguugcggccucuucggcaagggcagccuuaucacgugcgcuaaguucaagugcgucacgaagcuggaaggcaagauugugcaguacgagaaucucaaguacucagugaucgucaccgugcacaccggcgaucagcaccaggucggaaaugagaccacggagcacggcacgaucgccaccauaacgccccaggcccccaccagcgagauccagcugaccgauuauggggcgcugacccucgacugcagccccagaacgggacuggacuucaacgagauggugcuguuaaccaugaaggagaagucguggcuggugcacaagcagugguuccuggaccucccuuugcccuggacuacgggugccucuaccagccaggaaaccuggaaucggcaggaccugcucgucacguucaaaacagcucacgcaaagaaacaggagguuguaguccugggaagccaggagggagccaugcacaccgcccugaccggggcuacggagauccaaaccaguggaaccaccacgauauucgcggggcaccucaagugcaggcugaagauggacaagcugacccuaaagggcaucagcuacgugaugugcaccggguccuucaagcuugagaaggaaguggcugagacucagcacggcacgguuuuaguccaggugaaauacgaggggacugacgcccccugcaagaucccguucagcucccaggacgagaagggggucacccagaacggucggcugguuaccgcgaacccgaucgugacggacaaggagaggcccgucaacaucgaggccgagccgcccuuuggggagagcuauaucguggugggcgcgggagagaaggcgcuuaaacugucuugguuuaagaagggaagcuccauagguaaaauguucgaggcgaccgcccgcggggcccgccgcauggccauccugggcgacaccgccugggacuucggcagcaucgguggcgucuucaccuccguggggaagcucgugcaccagaucuucggcacggcauacggggucuuauucagcggcguguccuggacaaugaagaucgguaucggcauucugcucaccuggcuuggacuuaacagccggucaaccagccucuccaugacgugcaucgccgugggaauggucacccuguaccucggagugauggugcaagcagacagcgggugcguaaucaacuggaagggccgcgagcucaagugcgguuccggcaucuucguaaccaacgaggugcauacuuggaccgagcaguacaaguuccaggcggacagcccgaagcggcugucagcugccaucgggaaggccugggaggaagggguuugcggaauccgcuccgcgacgaggcuggagaacaucauguggaagcagaucagcaacgagcucaaccacauacuucuggagaacgauaugaaguucaccgugguggucggggacgugucuggcauccucgcccagggcaagaagaccauccgcccccagcccauggagcacaaguacucauggaaguccuggggcaaggcgaagauaaucggcgccgacgugcaaaacaccacguucauaaucgaugggcccaacaccccggagugucccgacgaccagcgggcuuggaacaucugggaggucgaggacuacggcuucgggauauucaccacgaauaucuggcugaagcuacgcgacagcuacacccagguuugcgaccaccggcucauguccgcggccaucaaggacagcaaggccguucaugccgacaugggcuacuggaucgaguccgaaaagaacgagaccuggaagcuggcgcgcgccagcuucaucgaggugaagacuugcguguggcccaagucccacacgcuguggaguaacggcgugcucgaguccgagauggucauuccaaagaucuacggggggccgaucucacagcauaauuacagacccggguacuucacgcagacugccggccccuggcaccucgggaagcuggagcucgacuucgaccugugcgagggcaccaccguaguggucgacgagcauuguggcaaccgcgggcccucccugcggacaaccaccgugaccgguaagauuauccacgaguggugcugccgcucaugcacgcugccgccccugcgguucaagggggaggacgggugcugguacgggauggagauucgccccgugaaagagaaggaggagaaccuggucaaguccaugguaagcgccggcagcggcgagguggacucuuucucccuaggacuucugugcaucuccaucaugaucgaggaggucaugcgaagccgcuggucgcguaagaugcucaugaccggcacccugguggucuuccuucuccugacacuggggcagcucacguggaaugaucugauccgccucugcauaauggugggcgccaacgcgucugacaacauggggaugggcacuaccuaccucgcgcuuauggcaacauuucggaugcggccgauguucgccgucgggcuccucuuucgccggcugacuucccgcgaaguccugcucuuaaccguggggcugagccucguugccagugucgagcugcccaacagccuggaugagcucggugacgggcuggcuaugggcaucaugauccugaagcuccucaccgauuuccaaucccaccagcugugggccacccugcugagccugacguuuguaaagaccacgcucucccuucacuacgccuggaagaccauggcaaugauccugagcaucgugucccuccuuccccucugccuguccacgaccucccagaagacuaccuggcuucccgucuugcucggcagccuggggugcaaaccgcugaccauguuccucauaacggaaaacaagauauggggacggaaguccuggccccugaacgaggggaucauggccguggggaucgugagcauccugcucagcuccuuauugaagaacgacgugccccucgcggggccgcugaucgccggcggcaugcucaucgccugcuaugugaucagcggguccucagcugaucucucccuggagaaggcagccaaggugucaugggaggaggaggccgagcacaguggggccucacacaacauucuggucgagauccaggacgacggcacgaugaagaucaaggaugaggagcgggacgacacaaucaccauacugcuuaaggcuacuuugcuugcgauuuccggcguguacccgaugucuauacccgccacccuauucguauggcauuucuggcagaagaagaagcagcgguccgggguccugugggacaccccgagcccgcccgaaguugagaaggccgugcuggacgauggcauauaccgcauauugcaacgggggcugcuggggcguucccaggucggcgugggggucuuccaggagggggucuuccauaccauguggcacguuacgcgcggugccgugcugauguaccagggcaagcgccuggagccgagcugggccuccgucaagaaggaucuuaucucguacggcgggggcuggcgguuccagggcuccuggaacaugggcgaagagguacaagugaucgcggucgagcccgggaagaaccccaagaacguccagaccgcccccggcaccuucaagaccagcgagggcgaggugggugccaucgcccucgacuucaagcccggcacguccggaagccccauagucaaccgcgaaggcaagaucguaggccuguacgggaacgggguggucaccaccucugggaccuacgugagcgcuaucgcgcaggccaaggccucccaggagggcccccucccggagaucgaagacgagguguuccggaaacgcaaucucacgauuauggaccugcaccccggaucaggcaagacccggcgcuaccuuccggccaucguccgcgaagccaucaagcgcaagcuccgaacgcuggugcuggcgccgacccgcguggucgccagugagauggccgaggcccucaagggcaugccaauccgcuaccagacgaccgcggucaaguccgagcacaccgggaaggaaauaguggaccugaugugccacgccaccuucacgaugagacugcucagccccguacguguccccaauuacaacaugauaaucauggacgaggcccacuuuaccgauccggccuccauugcagcccggggcuauaucagcacccgcguuggcaugggcgaagccgccgccaucuucaugaccgccacaccgcccggguccguggaggcguucccccagagcaacgcagucauccaggacgaggagaaagacaucccggaacgguccuggaacucuggcuacgacuggauaaccgacuucccuggcaagacugugugguucguccccagcaucaagagcgggaacgacaucgccaacugccugcgcaagaacgggaaacgcgugauccaacuaucccgcaagacauucgauacugaguaccagaagaccaagaacaacgacugggacuaugucgugaccaccgacaucagcgaaaugggggccaacuuccgggccgaccgagugauugacccccggcgcugccucaaaccggucauacugaaggacgggcccgagcgggugauccuugcggggcccaugcccgugacgguggccuccgccgcccagcgccggggccgcaucggucggaaucagaacaaagaaggggaccaauacaucuacaugggccagccacucaacaacgacgaggaccacgcgcacuggaccgaggccaagaugcugcuggacaacaucaacacccccgaggggauaauacccgcccucuuugagcccgagcgcgagaaguccgccgcaaucgacggcgaguaccggcugcgcggcgaggcgcgcaagaccuucgucgagcugaugcggcgaggcgacuuaccgguguggcuguccuacaagguagccagcgagggauuccaguacagcgaucgaagauggugcuucgacggggagcggaacaaccaggugcuggaggagaauauggacguggagaucuggacgaaggagggcgaacgcaaaaaguuacggccucgauggcuggaugcccgaacguacuccgacccccucgcccuccgugaguucaaggaauucgcugcggggcggcgcagcgucuccggcgaccugauccuggagaucggaaagcucccucagcaccugacccaacgggcccagaacgccuuagauaaucucgugaugcugcauaacucggagcagggcgggaaggccuaccgucacgccauggaggagcugccggacaccaucgagaccaucaugcugcuggcgcugaucgccgugcucaccggcgggguuacccuuuucuucuuguccgggcgggggcucggcaaaacaagcaucggacuucugugcgugaccucgagcuccgcccuccuguggauggccagcguggaaccccacuggauugcggccuccaucauccuggaguucuuccugaugguccugcugauuccggagcccgacagacagcguacgccgcaggauaaccagcuagccuacgugguaaucggccuauuauucaugauccucaccgucgcggccaacgagauggggcugcuggagaccaccaagaaagaccucggaaucgggcacacggcggccgagaaccaccaccacgcagccaugcuggacguggaccugcaccccgccagcgcuuggacccucuacgccgucgccacgacaaucauaacgcccaugaugcgucacaccaucgagaacacgaccgccaacaucucccugacggccaucgcuaaccaagccgcgauacucaugggccucgacaagggcuggccuaucagcaagauggauauuggagucccccuucuggcccucggcuguuacucgcaggucaauccucugacccugacugccgcagugcucaugcugguugcccacuacgccaucaucgggccgggccugcaggccaaggcgacccgggaggcccaaaagcgcacggccgccgggauuaugaagaacccgacgguugacggcaucguggcuauugaccuggauccagucguguacgaugcgaaguucgagaagcagcuuggccagauaaugcuucucauccugugcaccagccaaauccugcugaugcgcacaacgugggcgcugugcgaguccaucacccucgcgacagggccccucaccacgcugugggagggcagccccgggaaguucuggaacaccaccaucgccguguccauggccaacaucuuccgaggaagcuaccuugcuggugccgggcucgccuucagccugaugaagucccugggggggggcaggcgggggaccggcgcccaaggcgagacgcucggggagaaguggaagcgccaguugaaccagcugucgaagucgcaguucaacacauacaagcggucaggcauuaucgagguagaccgcuccgaggcgaaggaagggcucaagcggggcgagaccaccaagcacgcggugagccgcgguacggccaagcugcgcugguucguggagcgcaaccuugucaagccggagggcaaaguaauagauuuaggcugcgggcggggcggguggucauacuacugcgccggccucaaaaaggugaccgaagucaagggguacacgaagggcggcccaggacacgaggaacccaucccaauggccacguauggcuggaaccucgugaagcugcacucggggaaggacguguucuucaucccgcccgagaagugcgacacccuccuuugcgacaucggcgagagcagucccaaucccacgauagaagaggggcggacccuucggguccugaagaugguugagccguggcugcgcggcaaccaauucugcaucaagauccugaaucccuacaugcccuccguugucgagacccuagagcagaugcagcggaaacacggcggcauguuggugcgcaacccccugagccggaacuccacccacgagauguacugggugagcugcgguacggggaacauugucuccgcagugaacaugaccagccgcaugcuccugaaccgcuucaccauggcccaccgcaaaccgaccuacgaacgggacguagaccugggcgccgguacgcgucacgucgccguggagcccgaggucgccaaccucgacaucaucgggcaacgcaucgagaacaucaagaacgagcauaaauccaccuggcacuacgaugaagacaaccccuacaaaaccugggcguaccauggcagcuaugaggugaagcccuccgggagcgccucuuccauggugaacggcgucguucggcugcugaccaagccuugggacgugauccccaugguaacccagaucgccaugaccgacaccaccccuuuugggcagcagcgcguguucaaggagaagguggacacucggacccccaaggccaagcgcggcaccgcccagauuauggaggucaccgcgaaguggcuuuggggcuuccugagccggaacaagaagccccgcaucugcacucgggaagaauucaccaggaaggugcgguccaacgccgccaucggggccguauucguggacgagaaccaguggaacagcgcuaaggaggcgguggaggacgagcgcuucugggaccuggugcggcgcgagcgcgaguugcacaagcagggcaagugcgcgacaugugucuacaacaugaugggcaagcgcgagaagaagcugggugaguucgggaaggccaagggaucccgggccaucugguacauguggcugggcgcgcgcuuccucgaguucgaggcccugggguucaugaacgaggaccacugguucagccgagagaauucccugagcggcguagagggggaaggccuccacaagcugggguacauccugcgagacaucucaaagauucccggcgguaauauguacgccgacgacaccgccgggugggacacgcggaucaccgaggaggaucuacagaacgaggcgaagaucaccgacaucauggagccugagcacgcgcuuuuagccaccagcaucuucaagcucaccuaccaaaacaaggugguccgcgugcagcggccggccaagaacggcaccgugauggacgucaucucccgccgcgaccagagggggucaggccaagugggaaccuacgggcugaauaccuucacgaacauggaagcccagcugaucaggcagauggagucagaggggaucuucagccccagcgaauuagagacccccaauuuagccgggcgggugcucgacuggcucgagaagcacggaaucgagcgccuacggagaauggcgaucagcggggacgacugcguugugaagcccauagacgaccgguuugccaccgcacucacggcuuuaaacgacaugggcaaggugcgcaaagacaucccgcaaugggagcccucaaagggauggaaugacuggcagcagguccccuucugcagccaccacuuccaccagcugaucaugaaggacgggcgggagaucguggugcccugccgcaaccaggacgaguuaguuggccgggcccgcguuagccagggagccggcuggaguuuacgggagacggcuugccugggcaagagcuaugcccagauguggcagcugauguacuuccaucgccgggaccugaggcuggcagccaacgcgaucugcuccgcagugcccgucgacuggguucccaccucccggacgaccugguccauccacgcccaccaccaguggaugaccacggaggacaugcugagcguguggaaccgugucuggaucgaggagaacccauggauggaggauaagacccacguguccagcugggaagacgugccuuaccucggcaagagagaggaccaauggugcggcucccucaucgggcugaccgcaagggccaccugggcaacgaacauucagguugccaucaaccaagugcgccgccucaucggcaaugagaacuacuuagacuacaugacuagcaugaagcgcuucaaaaacgaguccgauccugagggagcacugugguga

SEQ ID NO: 24711 - RNA, 9879 nt, Artificial Sequence
  derived and/or modified CDS sequence (opt11) from DENV-1__JQ915080__SS-prME
agcgugaccaugcugcucaugcugcugcccacuguacuuaccuuccaccuaaccacacggggcggcgagccccacaugaucgugagcaaacaggagcggggcaagagccuccuguucaagaccuccgccggaguuaacaugugcacgcugaucgcaauggaccuaggcgaguugugcgacgacaccaugaccuacaaaugccccagaaucaccgagaccgagcccgacgacguugacugcuggugcaacgcgaccgagaccugggugaccuacgggaccugcagccagacgggggaacaccggcgcgacaagcgauccguggcccuggcgccccacgugggccuggggcucgagacccgcaccgagacguggaugagcuccgagggcgccuggcggcagauccagaagguggagaccugggcccugcgccaccccggguucaccgugauagcgcuguuccucgcccacgccaucggcaccagcaucacgcagaaggggaucaucuucauccugcugaugcuugucacgccuuccauggccaugaggugcguggggauuggcaaccgcgauuucguggaggggcugaguggcgcgaccugggucgacguggugcuggagcacgggagcugcgugaccacgauggcuaaggacaagcccacccucgacauugagcuguugaagaccgaggugacuaacccugcagugcucagaaagcugugcauugaggccaagaucagcaauacuaccaccgacucccgcugcccgacccagggcgaggccacgcuggucgaggagcaggacacaaacuucgugugccggcgcaccuucguggaccgcgguugggggaacggcugcggccucuucgggaaggggagccugauaacgugcgcgaaguucaagugcgucacuaagcuggaaggcaaaaucgugcaguacgaaaaccucaaauacuccgugaucgucaccgugcacacaggugaccagcaccaagucgggaacgagaccaccgagcacggcacgauagccaccaucacgccccaggcccccaccagcgagauccagcugacugacuacggggcccugacccucgacugcagcccccggaccggccuggacuuuaacgagauggugcugcucaccaugaaggagaagucgugguuggugcauaagcagugguuccuggaucucccgcugccauggacuaccggugccuccaccagccaagaaaccuggaaccggcaggacuuacucguuacguuuaagaccgcgcacgccaagaaacaggaaguggugguccugggcucgcaggagggggccaugcacaccgcccugaccggggccacugagauccagaccuccggcacgaccacgaucuucgcggggcacuuaaagugucgccugaagauggacaaguuaacccucaaaggcaucagcuacgugauguguaccggguccuucaagcuagagaaagagguggccgagacucagcacggcacgguccugguacaggucaaguacgagggcaccgacgccccuuguaagauccccuucagcucccaggacgagaagggggucacccaaaacggucggcuggugaccgccaauccgaucgucacggacaaggagcgccccgucaacaucgaggccgaaccgcccuucggggagagcuacaucguggugggcgcgggcgagaaagcccucaaacuguccugguucaagaaggggucguccaucggcaagauguucgaggccaccgcccgcggggcgcgacguauggccauccuuggcgacacugccugggacuuugggagcaucggcggcgucuucaccuccguagggaagcucguucaucagaucuucgggacggccuacggcguccuguucagcggcguguccuggaccaugaaaaucgggauaggcauccugcucaccuggcucggucugaacagccgguccaccagcuuguccaugacgugcaucgcagugggaauggucacgcuguaccuaggcgugauggugcaggcugacagcgggugcguaaucaacuggaagggccgcgagcucaagugcgggucgggcaucuucgugacuaacgaggugcacaccuggaccgagcaguacaaguuccaagccgacagccccaagcggcugagcgcggccaucggcaaggccugggaggaaggggucugcggcauccgcucagcgacgcggcuggagaacaucauguggaagcagaucuccaacgaacucaaccacauccugcuggagaacgacaugaaguucaccgugguggucggggacguguccgggauccucgcccaggguaagaagaccauccguccccagccaauggagcacaaguacagcuggaaguccugggguaaggccaaaauuaucggcgcagacgugcagaacaccacguuuaucaucgacgggcccaacaccccggagugccccgacgaccagcgggccuggaacaucugggaggucgaggacuacggcuucgggauuuucaccaccaacaucuggcugaagcugcgcgacagcuacacucagguaugcgaccaccggcucauguccgcggcuaucaaggauagcaaagccgugcacgccgacaugggcuauuggaucgaauccgagaagaacgaaaccuggaaacuggcgcgcgccagcuuuaucgaggucaagacuugcguguggccaaagucccacacccuguggagcaacggggugcucgaguccgagauggucauuccgaaaauauacggaggcccgaucagucaacacaacuaccggcccggguacuuuacgcaaaccgccggcccuuggcaccuggggaaacuggaacuagacuucgauuugugcgagggcaccacagugguggucgaugagcacuguggcaacagagggccgucccugcggacgacaacuguaaccggaaagauaauccacgaguggugcugccgcagcuguacgcugccgccccugcgguuuaagggggaggauggcugcugguacgggauggagauucgccccgucaaggagaaggaggagaaucugguaaaguccauggugagcgccggcagcggcgaaguggacuccuucagccucgggcugcugugcaucuccaucaugauugaggaggugaugcggagcagguggagucggaagaugcuuaugacuggcacccugguggucuuccugcuccugacccuggggcagcuaacguggaacgaccugauccgacugugcaucaugguaggcgccaacgccucugacaacauggggaugggcacgaccuauuuagcgcugauggccacauuccgcaugcggccgauguucgccgucgggcuccucuuccgccggcugacuucccgcgagguccuacuccugacaguggggcugagccucguagcguccgucgagcugcccaacagcuuggacgaguuaggggacgggcuggccaugggcaucaugauuuugaagcuacugacggacuuccagucccaccagcugugggccacccucuuaagccugacguucgugaagaccacccucucccugcacuacgccuggaagaccauggccaugauucugaguaucgugucccuccugccccugugccucagcacgaccucccagaagaccaccugguugcccguacugcucggcagccuggggugcaagccacugaccauguuccugaucacagagaacaagaucuggggccggaaguccuggccccugaacgaagggaucauggccguuggcaucguuagcaucuuacucagcucccugcugaagaacgacgucccccucgcggguccccugaucgccggcggcaugcugaucgccugcuacgucaucagcggguccagcgccgaucucucccuggagaaggcggccaaggucagcugggaggaggaggccgagcacuccggcgccagucacaacauccuggucgaaauccaggacgacgggaccaugaagaucaaggacgaagagcgggacgacaccaucaccauccuccugaaggcgacgcuacucgcgaucuccggcguauacccgaugucuauccccgccacccuguuuguauggcacuucuggcagaagaagaagcagcgguccggaguccugugggacacccccagcccgcccgagguggagaaggccgugcuggacgauggaaucuaccgcauccuccaacggggccugcuggggagaagccaagucggcgucgggguguuccaggagggcgucuuccacaccauguggcacguuacccggggggccguguuaauguaccagggcaagcggcuggagcccagcugggccuccgucaagaaggaccugaucagcuacggugggggcuggcgguuccagggcuccuggaacaugggcgaggagguccagguaaucgcagucgaacccgggaagaaccccaagaacgugcagacugcccccggcacguucaagaccagugagggcgaagugggggccauugcccucgacuucaagccaggcacguccgggagcccaaucgucaaccgcgaaggcaagaucgugggccuauacgguaacggcguggucaccaccagcgggaccuacguguccgccaucgcacaggccaaggccagccaggagggcccgcugccggaaaucgaggacgagguguuccguaagcgcaaccucacgaucauggaccugcaccccggguccggcaagacccggcgcuaccugcccgccaucguccgggaggccaucaagcgcaagcuccggacucuaguccuggcgccgacccggguggucgccuccgagauggccgaagcccucaagggcaugcccauccgcuaccagaccaccgcggugaaaucagagcacaccgggaaggaaaucguggaccugaugugccacgccaccuucacgaugagacugcucagccccguccgugugccaaacuacaacaugaucaucauggacgaggcccacuucacugacccggccuccaucgccgcgcggggguacaucagcacccgcgugggcaugggcgaggccgccgccaucuucaugaccgccacuccgcccggguccgucgaggcguucccccagagcaacgccgugauccaggaugaggagaaggacaucccggaacgguccuggaacucuggcuacgacuggaucaccgauuuucccggcaagaccgugugguucguccccuccaucaaaagugggaacgacaucgccaacugccuacguaagaacggcaagcgcgugauccaacugucccgcaagacauucgacacggaguaccagaagaccaagaacaaugacugggauuacgucgugaccaccgacaucagcgagaugggggccaacuuccgggcagaccgcgugaucgacccccggcgcugccucaagccggucauccugaaggauggccccgagcgcgugauccuggcggggcccaugcccgugacgguagccuccgccgcccagcgccggggucgcaucggccgcaaccagaacaaggaaggggaccaauacaucuacaugggccagccgcucaauaacgacgaggaccacgcgcauuggaccgaggccaagaugcugcuggacaacaucaacaccccugaggggaucauccccgcccucuucgagcccgagcgcgagaaguccgccgcaaucgacggcgaguaccgccugcgcggggaggcgcgcaagacuuucguggaacuaaugcgucgcggcgaccucccgguaugguuauccuauaaggucgccagcgagggcuuccaguauagcgaccggcgcuggugcuucgacggggaacggaauaaucaagugcuggaggaaaacauggacguggagaucuggacgaaggagggcgagagaaagaaacuccggccacgcuggcuggaugcccggaccuacuccgacccccuggcccuccgcgaauucaaggaguucgccgcggggcggcgcagcgucuccggcgaccuaauccuggagaucgggaagcucccccagcaccugacccagcgggcccaaaacgcacuggacaaucucgugaugcugcauaauagcgagcagggcggaaaggccuaccgccacgccauggaggaacuuccggacacgaucgagaccaucaugcuccuagcucugaucgccgugcucaccggaggggucacacuguucuuccugucagggcgagggcugggcaagaccagcaucgggcugcucugcgugaccuccagcuccgcccuccuguggauggccagcguggagccgcacuggaucgcggccuccaucauccuagaguucuuccucauggugcugcugauccccgagcccgacagacagcguacuccgcaggacaaccagcucgccuacguggugaucgggcugcuguucaucauccucaccguagcagccaaugagauggggcugcuggaaaccacgaagaaagaucugggcaucggucacacggcggccgagaaccaccaccacgccgccaugcuggacguggaccugcaccccgcgagcgcguggacccucuacgccguggccaccaccaucaucacgccuaugaugagacacaccauugagaacaccaccgccaacaucuccuugacggccauagcgaaccaggccgcaaucuuaaugggauuagacaaaggcuggccgaucucuaagauggacaucggggucccccugcucgcccucggcugcuacucacaggugaacccccugacccugaccgccgcggugcucaugcuggucgcccacuacgccaucaucgggccaggccugcaggccaaggcgacccgcgaggcccagaagcgcacggcagccgggaucaugaagaacccgacuguggacggcaucguugccaucgauuuggaccccgucguguacgacgcgaaguucgagaagcagcuggggcagaucaugcugcucaucuugugcaccagccagauccugcucaugcggaccacgugggcccugugcgagucuaucacccuggccacggggccccucaccacccugugggagggcagccccgggaaguucuggaauacgaccaucgccguguccauggccaacaucuuccgcggcagcuaccuggcaggcgccgggcucgccuucagccugaugaagucccugggcgggggccgccgggggaccggcgcccagggugagacacucggggagaaguggaagcgccaacugaaccagcugagcaagucccaguucaacaccuacaagcggagcggcaucauagaggucgaccgcuccgaggccaaggaagggcucaagaggggcgagaccaccaaacacgcagugagccgcgggacggccaagcuucggugguuuguggagcgcaaccuggucaagccggaaggcaagguuauagaccugggcugcgggcggggcggguggagcuacuacugcgccggccucaagaaggugaccgaggugaagggguacaccaagggcggucccgggcacgaggagccaauccccauggccaccuacggcuggaaccugguuaaguuacacagcgggaaggacguguucuucaucccgcccgagaaaugcgacaccuugcugugcgacaucggcgaguccucucccaacccuacaaucgaggaggggagaaccuugcggguacucaagaugguagaaccauggcugcgcggcaaccaauucugcaucaaaauuuuaaacccguauaugcccuccguggucgagacccuagagcagaugcagagaaaacacggcggaaugcugguccgcaacccccugagccggaacuccacccacgagauguacuggguauccugcggcacgggcaacaucgucuccgccgugaacaugaccagcaggaugcuccugaaccgguucaccauggcacaccgcaagcccaccuacgagcgggacguggaccugggcgccggcacgcgccacgucgcuguggagccggaggucgccaaccucgacaucaucgggcaacgcaucgaaaacaucaagaacgagcacaaguccaccuggcacuacgacgaggacaaucccuacaaaaccugggcguaccacggcagcuacgaggugaagcccuccgguagcgccagcuccauggugaacggcgucgugcgccuguuaaccaagccgugggauguuaucccaauggucacgcagaucgccaugacugacaccacccccuucgggcagcagcgcguguuuaaggaaaagguggacacgcggacccccaaggcgaagcgcggcaccgcacagaucauggaagucaccgcgaagugguuguggggcuuccugagccggaacaagaagccucgcauuuguacccgggaagaguucacccgcaaggugcgguccaacgccgcgauuggggcaguguuuguagacgagaaccaguggaacagcgccaaggaggcgguggaggacgagcgcuucugggaccuagugcgccgcgagcgggagcuccacaagcagggcaagugcgcaaccugcgucuacaacaugauggguaagagggagaagaagcugggggaguucgggaaagccaagggcucccgggccauaugguauauguggcugggcgcgcgcuuccuagaguucgaggcccuuggguucaugaacgaggaccacugguucucgcgggagaacucccugagcgguguggagggggagggccuccacaagcucggguacauccugcgcgacauauccaagauccccggcggcaacauguacgcggacgauaccgccgggugggacacgcgcaucaccgaggaggaccuccaaaaugaagccaagaucaccgacaucauggagcccgagcacgcccugcuggccaccagcauuuuuaagcucacguaccagaacaagguuguccgaguucaacggccggccaaaaauggcaccgugauggacgucaucucgcgccgcgaccagcgggggucgggccaagugggcaccuauggauugaacaccuuuacgaacauggaggcccagcugauucgccagauggaguccgagggcaucuuuucuccauccgaacucgagacccccaacuuggccgggcgugugcuggacuggcuggagaaacacggcaucgagcgcuuacggcgcauggcgauuagcggggacgacugcgucgucaagcccaucgacgaccgcuucgcgacugcccugaccgcucucaacgacaugggcaaagugcgcaaggauaucccgcaaugggagcccuccaagggcuggaaugacuggcagcagguccccuuuugcagccaccauuuccaccagcugaucaugaaggacgggagagagaucguggugcccugccgcaaucaggacgaacuagucggccgggcccgcguuagccagggggcgggcuggucccuccgggagacggccugccugggcaagagcuacgcccagauguggcagcugauguacuuccaccgccgggaccuccgccuggccgccaacgcgaucugcuccgcagugccugucgacugggugcccacaagccggaccaccugguccauccaugcccaccaccaguggaugaccacagaagacaugcugagcguguggaaccgagucuggaucgaggagaacccguggauggaggacaagacccacgugagcuccugggaggacgugcccuaccucggcaagcgggaggaccaauggugcggcucccugauagggcugacugcccgcgcgaccugggccacgaacauccaggucgccauaaaccaggugcgccggcucaucggcaacgagaacuaccuagacuacaugaccucaaugaagcgcuucaagaacgaguccgacccggagggggcacuuugguag

SEQ ID NO: 24712 - RNA, 9879 nt, Artificial Sequence
  derived and/or modified CDS sequence (opt11) from DENV-1__KJ755855__SS-prME
agcgugaccauguugcucaugcugaugcccaccgcccuggcuuuccaccucacuacucggggcggggaaccccacaugaucguguccaagcaggagcggggcaagagcuugcuguucaagaccagcgccggggugaauaugugcacccucauagccauggaccugggggaacugugcgaggauaccaugaccuauaagugcccccggaucaccgaagccgagcccgacgacguggacugcuggugcaacgccacugacacgugggugaccuacgggaccugcagccagacaggcgagcaccggcgcgauaagcgcagcguggcccucgccccucacgugggccuggggcucgagacgcgcgccgaaaccuggaugagcucagaaggggccuggaagcagauccagcguguggagaccugggcccuucgccaccccggguucaccgugauugcgcuguuccuggcccaugccaucggcacuucuaucacgcagaaagguaucauauucauacuccugauguuagugacccccuccauggcaaugcguugcgucggcaucggcagccgggacuucguggagggucucuccggcgccacuuggguggaugucgagcuugagcacgggagcugugugacgaccauggcgaaggauaagcccacucuggacaucgaauuacugaagaccgaggugacgaacccugccguccugcggaaauuaugcaucgaagccaagaucuccaacaccaccaccgacagccgcugcccaacgcagggcgaagccacccugguggaggaacaggacgccaauuuugugugcaggcgcaccuucguugaucggggcugggggaacgguugcgagcuguucgggaagggaagccuccugaccugcgcgaaguucaagugugucacaaagcuggagggcaaaaucgugcaguacgagaaccucaaguacagcgucaucgugacaguccauaucgccgcccagcaccaggucggcaacgagucaacagagcacggaaccacggccaucaucacgccccaggccccaaccaccgagauucaguugacggauuacggagcgcugacguuggacugcucaccccggaccggccuggacuucaacgaaauggugcuccuuaccaugaaggaaaaauccuggcugguccacaagcagugguuucuggaucugccccugcccuggaccagcggggccagcacgucccaggaaaccuggaaccggcuguuccuccuggugaccuuuaagacagcccacgcuaaaaagcaagagguggucgugcuggggagccaggagggggccaugcauacggcgcucacuggcgcaaccgcccuccaaaccuucggcacgacuaccaucuucgccgggcaccuuaauauucgccucaagauggacaaacugacacugaagggcauguccuacgugaugugcacggggucauuuaaacuggagaaggagguggcagagacucagcauggcaccauucuagugcagaucaaauacgaggggacggaugcccccugcaagauccccuucuccacgcaagaugagaagggugugacccagaacggccggcugauuaccgccaacccaaucguaaccgacaaagagaaaccugugaacaucgaggccgagccgccuuucggggaaagcuacaucgugaucggcgccggggaaaaagcgcugaaacucagcugguucaaaaagggcagcuccaucgggaaaauguucgaggccacggcucgcggggcccggcgcauggccauccugggcgacaccgcgugggacuucgggaguaucggagggguauuuaccuccgugggaaagcuggugcaccagaucuucggcaccgccuacgggguccucuucagcggcguguccuggacgaugaaaauuggcaucggugugcugcugaccuggcuuggccugaacuccagguccaccagccugucgaugacgugcaucgccgucggccucgugacacuguacuuaggcgugaugguccaggccgacagcgggugcgugauaaauuggaagggcagggagcucaagugcggguccggaauuuucgugaccaacgaagugcacaccuggaccgagcaguacaaguuccaggccgacucucccaaacgccuuagcgcggccauagggaaggcuugggaagaaggcguaugcggcauccggagugcuacucgccuggaaaacaucauguggaagcagaucucuaacgaguuaaaccauauacuucuggagaacgacuuaaaguuuaccguagucgugggagacguggcgggcauacuagcccaggggaaaaagaugauccggccccaacccauggaacacaaguacuccuggaaaaacugggggaaagccaagaucaucggggccgacguccagaacagcaccuucaucaucgacggaccuaacaccccggagugcuccgacgaucagcgcgcauggaacaucugggagguggaagacuacggcuucgggaucuucaccacgaacauauggcugaagcuccgggauaguuacacucaagugugugaccaccgccugaugagcgccgcaaucaaggacagcaaggccguccacgccgacaugggguauuggaucgaauccgagaagaacgaaaccuggaaacuugcccgggcuagcuucauugaggucaagaccuguacguggcccaagucccacacccucuggagcaacggggugcuugagucugagaugaucauccccaaaaucuacggcggucccauuucacagcacaacuacucgccgggguacuucacacagaccgccggacccuggcaccuggggaagcucgagcuggacuucgaccucugcgagggcacgaccguagugguggaugaacacugcgggaaccgcggccccagccuucggacuaccacggucacggguaagaucauccaugaguggugcugcagauccugcacgcugccgcccuuacgguuccgcggggaagacggaugcugguacgggauggagauucggccggugaaggaaaaggaggagaaucuuguaaagagcauggucagcgcuggcucgggggagguggugagccugucccugggccuccugugcaucagcaucaugaucgaagaagucaugcgcucccgguggucgcgcaagaugcugaugaccggcacgcucgccgucuucuuccggaagaucagggggcaguuaaccuggaaugaucugauucgccucuguaucauggugggcgccaacgcguccgaccggaugggaacccgcaccacauaccuugcccugauggccaccuuuaagaugcggccuauguucagcgucggucuccuguuccgccguuuaacguccagagagguccuccuguuaacaaucggguugagccuaguggccuccgucgaacugccgaacagccucgaggaguugggcgugcugcuagcuauggggaucaugauacucacguuacucaccgauuuccagucccaccagcugugggcuacccugcuuagcaugacguucaucaaaacgaccuucucccugcauuacacauggaaaacgauggccaugguccugagcaucgugucguuauucccccugugccuaucaacgaccucacagaagaccaccuggcuccccgugcugcuggggucccugggcugcaagccucucacuauguuccugaucgcagagaacaaaauuugggggaggaagaguuggcccuugaacgaaggcaucauggccgucggcauaguguccaucuugcugagcucccuccugaagaacgacgugccgcuggcggggccccucauagcaggagggaugcugaucgccugcuacgucauuagcgggucgucagccgaccugucccucgagaaggccgccgaggugaguugggaagaagaggcagagcacuccggggccucgcacaacauacugguagagguccaggaugauggaacaaugaagauuaaggacgaggaacgcgacgacacccugaccauucuccugaaggccacccuucucgccguguccggcguguacccuuuaagcaucccggcgacccuguucgucugguacuucuggcagaagaagaagcagagaucagggguacugugggacacacccuccccgcccaagguugaaaaggcgguccucgacgacggcauuuaccgcaucaugcaacgggggcugcucggccgcucccagguagggguggguguuuuccaagagaacgucuuccacaccauguggcacgugaccagaggcgccguccucauguaccaggguaagcgccuagagccaucauggggccggguuaagaaggaccugaucuccuacgggggcggcuggggucucaagggcucuuggaacacgggggaagaaguacaggucauagccguggagcccggaaagaacccgaagaacgugcagacugcccccgggaccuucaagaccccggagggcgaggucggggcgaucgcacuggacuucaagcccggaacguccggcagccccauugugaaccgcgaagggaagauagucggucuguacgggaacggaguagugaccaccagcggcaccuauguauccgccaucgcccaugcgaaggccagccaggaggggccccucccggagacggaggucgaggcguuccggaagcgcaacuugacaaucauggauuuacaucccggaucggguaagacgcggcgcuaccuccccgcgauagugcgagaggccaucaaacgcaagaugcgcacccuuauccuggcaccgacgcggguggucgccagcgagauggcagaggcacucaagggcaugcccauaagguaccagaccacugcuguuaagagugagcacaccgggaaagagaucguggaccugaugugccacgcgacauucaccaugcgucugcucagcccugucagggugcccaauuauaacaugauuaucauggacgaggcccacuucaccgacccuucuucacuggcggcccggggauacaucucaacccgcgugggcaugggggaggccgcggccauuuucaugacggccaccccgcccgggucagucgaagccuucccccaguccaacgcggucauccaggacgaggagcgggacaucccggagcgcucguggaacuccggguacgaguggauuaccgacuuccccggcaagacgguuugguucgucccuagcaucaaggccgggaacgauaucgccaauugccuacgaaagaacggcaagcgagugauccagcucucccggaagacuuucgacaccgaguaccagaagacuaagaacaacgacugggacuaugugguuaccacugacaucagcgagaugggagccaauuuucccgccgaccgcgugaucgacccgcggcggugccuuaaucccgugauccugaaggacggcccugaacgagucauccucgcgggccccaugccgguaaccguggccuccgcaaaccagcgccgggggcgcaucgggcggaaucauaauaaggagggugaucaguacauuuacaugggccaaccacugaacaacgacgaggaucacgcacacuggaccgaggcaaagauguugcuugacaacauaaacacccccgagggcauuauccccgcgcuguucgagccggagcgcgagaagucugccgccaucgacggggaguaucgacugaggggagaagcccgcaagacguuuguagaacuuaugcggcgcggagaccugccuguguggcuauccuacaaggucgccagcgaaggguuccaguacagcgaccggcgcuggugcuuugauggcgagaggaacaaccaaguucucgaggagaacauggacgucgagaucuggacaaaggagggggagagaaagaagcugcgaccccgcuggcuagaugcucggaccuacuccgacccccucgcgcugcgugagaaaaaggaguucgcggccggccggcgcagcgucuccggggaccugauacucgagaucggcaagcucccgcagcaccugacccagcgggcgcaaaaugcccucgacaaccugguuaugcugcacaacagcgagcagggcggucgcgccuaccggcacgccauggaggaacucccagacacgaucgagacccucaugcugcuggcccugauugcgguguugaccggaggggucacccucuuuuuccugucaggcaaagggcugggcaaggccgggaauggccuccuaugcgucauggccuccucugcccugcucuggauggcaaacguggagccucacuggauugcggccagcaucauccuagaguucuucuugaugguccuccugauccccgagccggaucgccagcggacgccccaggauaaccagcuggccuacguggugauccgccuccuguucaugauccugacagucgccgccaaugagaugggucuccucgagaccacgaagaaggaucuggggaucggacacgcggccguggagaaccaccaccacgccgccaugcuggacaucgacuugcaccccgccuccgccuggacucucuacgccguggcgacgaccaucauuacgccuaugaugcggcacaccauagagaauaccaccgcgaauauaagccucaccgcgauugccaaucaggccgccauccuaauggggcuggauaagggcuggcccaucuccaagauggacaucgggguuccgcuccucgcuuugggcuuccucucucagguuaacccccugacccuuacggcggcgguacucaugcugguggcucacuacgccaucauuggcccggggcugcaagccaaggccacccgcgaggcccagaagcguaccgccgccgggaucaugaagaaccccaccaucgacgggaucguugccaucgaccucgaccccguggucuaugacgcgaaguucgagaaacagcucggccagaucauguugcucauucugugcaccucccagauacuguuaaugcggacgaccugggcccuuugugagaguaucaccuuagccacggggccccucuccccauuaugggagggcagccccgggaaguccuggaacacuacuaucgccgugucaauggcgaacaucuuccggggguccuaccuggcaggagccgggcucgccuuuagcuugaugaagucccugggcggcgggcggcgcggcaccggggcccagggcgagacgcuaggggagaaguggaagcggcaacuaaaccagcuuuccaagacagaguucaacaccuacaagcggagcggcaucauggagguggaucggagugaggccaaagagggucucaagcguggagaaacgacuaagcacgccgucagccggggaacagccaagcucagaugguucguggagcggaaucuggugaagcccgaggggaaggucaucgaccugggcugugggcgcgggggcugguccuacuacugcgccgggcucaaaaaggugagcgagguucggggguacacaaagggcgggcccgggcacgaggagccgauccccauggccacauacgggugggaccugcugaagcgauguuccggcaaggaguuuuucuucauacccccugagaagugcgacagcuuccuuggcgacaucggugaguccagcccgaaccccacgaucgaggagggacggaccgugcgcguccugaagaugguggaacccuggcuccggggcaaccaguuuugcaucaaaaucuuaaaccccuacaugccgucugucguagagacccuggagcagaugcaaaggaaacacgggggaauguuagugcgaaaccccuuaagccgcaauuccacccacgagauguacugggucagcugcgggacgggaaacaucguguccgcagugaacaugaccucacgaaugcugcugaacagauuuaccauggcccaccgcaagcccaccuacgagcgggacgucgaucucggcgccgggacacgacacguggccguggagccagagguggccaaccuggacaucaucggccagcggaucgagaacauaaagcacgaacacaaauccacguggcauuacgaugaggacaacccuuacaagacaugggcguaccacggcagcuacgaggugaagcccucagguagcgccucuucgaugguuaacggcgucgugaagcugcucaccaaacccugggacgugauccccauggucacccagaucgcuaugacagacaccaccccauucgggcagcagcgcguguucaaggaaaaggucgauacccggacacccaaggccaagagaggcaccgcucagaucauggaagugacugcccgauggcuguggagcuuccucucccgcaacaagaagccccggauauguacccgggaggaguuuacgcguaaaguucgcaguaacgccgccaucggggccgucuucguggacgagaaucaguggaacuccgcaaaggaggccguugaggacgaccgguucugggaccucguccaccgcgagagagaacugcacaaacaaggcaagugugcaaccugcguauacaacaugaugggcaagcgcgagaagaagcugggagaguuuggcaaagccaaggggagccgcgccaucugguacauguggcucggagcgcgauuccuggaguucgaagcccucggguuuaugaacgaggaccacugguucucccgggagaauagccucucaggcguugagggggaggggcugcacaaacuuggcuacauacuccgcgacauuucgaagauaccaggagggaacauguacgccgaugacacugccgggugggacacccgcauaaccgaggacgaccugcagaacgaggcaaaaaucaccgacaucauggagcccgagcacgcgcuguuggccaaguccauauucaaacuuacguaccagaauaaagucgugcgggugcagaggcccgccaagaacgggaccgucauggaugugaucagccggcgugaccagaggggcucugggcaagugggcacguacggguuaaacaccuucaccaacauggaggcccagcucauccgccagauggagagcgaggagaucuucuccccuaacgagcuggagaccccgaaucuugcggaacggguccuugacuggcucgagaaguauggcguugagcgucugaagcggauggcgauaagcggcgaugacugcguagucaagcccaucgaugaccgcuucgccacggcccucaccgcccugaacgacauggggaagguccggaaggacauaccacagugggaacccagcaaaggcuggaacgauuggcagcaaguuccguuuuguagccaccacuuccaucagcuggucaugaaggacgggcgggagauaguggugcccuguagaaaccaggacgagcucgucggccgagcgcguguuagucagggggcgggcuggucccuccgcgagaccgccugccugggcaagagcuaugcccagauguggcagcuuauguacuuucaucggcgcgaucugaggcuggccgcgaacgcuaucugcuccgccguccccgucgacuggguuccaacuagccgcacgaccuggucaauccacgcacaccaccaguggaugaccaccgaggacaugcucagcguguggaaccgcgucuggaucgaagagaacccguggauggaggacaagacgagagugaguagcugggaggacguuccauacuugggaaagcgcgaagaccaguggugcggcucccugaucgggcuaaccgccagggcgaccugggccaccaacauccagguugccauuaaccaggugcgccgucugaucgguaacgagaacuacagcgacuacaugacguccaugaagcgcuucaagaacgagagcgagccagaaggggcccugugguga

SEQ ID NO: 24713 - RNA, 9879 nt, Artificial Sequence
  derived and/or modified CDS sequence (opt11) from DENV-1__KF289073__SS-prME
agcgucaccaugcuguucaugcucuuacccacugcccucgcauuccaccucaccacacgggguggggagccccacaugaucgugagcaagcaggaaaggggaaagagcuuauuauucaagaccucagccggcgugaauauguguacccuaauugcgauggaccugggagagcugugcgaggacacuaugaccuacaagugucccagaaucaccgaggccgaacccgacgacguagacugcugguguaacgccacugacaccuggguuacuuacgggaccugcucccagaccggcgaacaccgcagggacaagcgguccguggcucucgcaccccacgugggccuggggcuagagacgagaaccgaaacguggaugagcuccgagggcgccuggaagcaaauacaaaaaguugagaccugggcccuccgacacccuggauuuacagugauagcguuauuccuggcgcacgccaucggcacaucuaucacgcaaaagggcaucaucuuuauccuccuaaugcuggugacucccuccauggcuaugcgcugcgucggcaucggcaaccgugauuuuguggaagggcucagcggcgccacguggguggacgucgugcuggagcaugggucuugcgugacgaccauggcgaagaacaagccaacccuggacauagagcuacugaagacggagguaaccaacccugcgguucugcgcaaguugugcaucgaggccaagaucagcaagacuaccacugacucccgaugccccacccagggcgaggcgacucugguagaggagcaggacgccaacuucguaugccgccggaccuucguugaccgaggcugggguaacggcugcgggcuguuuggcaaggguagccugcugacgugcgccaaguuuaaaugcguaacgaaguuagagggcaagauaguccaguacgagaaccugaaguacuccgucaucgugacuguccacacgggagaccaacaucagguagggaacgagacgacugagcacggcaccauagcgaccaucacgccccaggcccccacgagcgagauucaacugaccgacuacggggcccucacccucgacugcuccccccggaccggccuggacuucaacgaaaugguauugcucacgaugaaggagaaauccuggcugguccacaagcagugguucuuggaccucccgcugcccuggaccuccggggcgucuaccagccaagaaaccuggaaucgacaggauuuauuaguuacguucaaaaccgcccacgcgaagaagcaggagguggucguucugggaucacaggagggugccaugcacaccgcauugaccggggccaccgagauacagaccucuggcaccaccacuaucuuugccggccacuuaaaaugccgguugaagauggacaagcugacccucaagggcaugucguacgucaugugcaccgggucuuucaagcuggaaaaagagguggcggagacccagcacggcacggugcugguucaggugaaguacgagggaacagacgcgccuugcaaaauacccaucuccacucaagacgagaaaggagugacucagaacgggcgucugaucacggccaauccgaucgucaccgauaaagagaagcccgugaauaucgagaccgagccccccuucggggaaagcuauaucgugauuggcgccggcgaaaaagcgcucaagcucucaugguucaagaaagggagcucgaucggcaagauguucgaggcaacagcccgcggcgcccgccggauggccauacuuggcgacacagcgugggauuucgggucuauaggaggugucuuuaccuccguggguaagcucgugcaccagguguucggaacugcguacggggugcuguucagcggcgucucauggaccaugaagaucgggauaggggucuuauugacguggcugggccugaacagccgcaguacuagccucucaaugacuugcaucgccguaggaauggucacacuguaccugggggucauggugcaggcagacagcggaugcgugaucaacuggaagggcagggagcucaagugcgguuccggcauauucguuacgaacgagguucacaccuggacagagcaauacaaguuccaggccgacagcccgaaacgguugagugcagcuauuggcaaggcuugggaggaaggggugugcggcauucgcuccgccacccgucuggagaacaucauguggaagcagaucagcaacgaguugaaccauauccuguuagagaacgauaugaaguuuacaguaguggucggagaugccaacgguauauuggcucaggggaagaagaugauccgcccccagcccauggagcacaaauacuccuggaagaguugggguaaggccaagaucaucggcgccgauauccagaacacgaccuucauuaucgacgggccagauaccccagagugccccgaugaucaccgggccuggaauauuugggagguugaggacuacggauucgggaucuucaccaccaauaucuggcugaagcugcgggacuccuauacgcagaugugcgaccaccgccuaaugagcgccgccaucaaggacucgaaggccgugcacgccgacaugggauacuggaucgagagcgagaagaacgagacuuggaaguuggcaagggcgucuuucaucgaagucaaaaccuguaucuggcccaagucucacacccuguggaguaacggcguccucgagagcgaaaugauuaucccgaagauuuacgggggcccuaucucacaacauaacuaccguccgggguauuuuacgcagaccgcggggcccuggcaccuagggaagcuggagcucgauuucgaccuuugcgagggcacuacgguugucguagacgagcacuguggcaaccgcgggccgagccuacggacgacgacggugacggggaagauaauccacgaauggugcugccgguccugcacccugccgccccuccgauucaagggagaggauggcuguugguacgggauggagauccgcccagucaaggaaaaggaggagaaucugguucggagcaugguguccgccggcucgggggaaguggacucauucucccucgggcuacugugcgugaguauuaugaucgaggaggugaugcgcucacgauggagccgcaagauguugaugacugguaccuuagcaguguuucugcuccugauaaugggucaacugacguggaaugaccucauccgguuguguaucaugguaggagccaacgccagugaccgcauggggauggggacgacauaccuugcccucauggcuacuuucaagaugcgucccauguucgccgugggccugcuauucagacgcuugacgagucgggagguguuacugcucacaauugggcuuagucuggucgccucagucgaguuacccaacucuuuagaagagcugggcgacggccucgcgaugggcauuaugaugcuuaaacugcucacggacuuccagagccaccagcuguggaccacgcuguuaucauuaaccuuuaucaagaccacacuaucucucgacuacgccuggaagaccauggccaugguccuguccaucgugagccuuuucccccucugucugucgacgaccucccagaaaaccacauggcugccaguguugcugggcucguucggcuguaagccgcugacuauguuucucaucacggagaacaagauauggggccgaaagagcuggccccugaacgagggcauuauggcugucggcaucgugagcauucuucugucaagccuccugaagaacgaugugccccucgcgggcccccugaucgccggcggaauguugaucgcuugcuacgucaucaguggcuccuccgccgaccucagccuggagaaggccgccgaggucaguugggaggaggaggcggagcacagcggcgcuucccacaauauccugguggaggugcaggacgacggaaccaugaagaucaaagacgaggaacgggacgauacccucaccauacugcugaaagccacacuccuggccgugagcgguguguacccgauguccaucccugcgacucuguuugucugguacuucuggcaaaagaaaaagcaacgcagcggggugcucugggacacccccagcccgccugaaguggaacgggcaguucuggaugacggcaucuaccgcauccugcagcgaggacugcuuggucguagccagguuggcgugggggucuuucaggacggcgucuuucacacgauguggcacguuacccgcggggcuguacugauguaccagggcaagcgccuggagccauccugggcaagcgucaaaaaggaccucaucaguuacggcgggggcuggcgguuccaggggucuuggaacaugggggaggagguucaaguaaucgccguggaaccuggcaagaaucccaagaacgugcaaaccacccccgguacguuuaaaaccccugaaggcgagguuggggcgauagcccuggacuuuaaacccggcaccuccgggucacccauagugaaccgcgagggaaagaucgugggccuguaugggaacggggucgucaccacguccgggaccuacgugucugccauugcccaggccaaagcgucucaggagggcccgcuccccgagaucgaggacgaggucuuccggaagcguaacuuaaccaucauggaccugcaccccggguccggcaaaacccggcgguaccucccggccaucgugcgugaggccaucaagcgcaagcugcggacguuaauucucgcacccacccgcgucgucgcaagugagauggccgaagcucugaagggcaugccgauccgcuaccagacaacggccgugaaaucagagcauacggggcgggaaauaguggaccugaugugccacgcaaccuucacgaugcgacuccugucacccguccgggugccgaacuacaauaugaucaucauggacgaggcucacuuuacggaccccgcgucuaucgcugccaggggcuacaucucuacgaggguggggaugggcgaggccgcggccauuuucaugaccgccacgccgcccggguccgucgaggccuuuccacaguccaacgccgugauucaagacgaggaaagggacauacccgagaggucuuggaauagcggcuacgacuggauaaccgauuuucccggcaagacggugugguucguucccucuauaaaaagugggaacgacaucgcaaacugccugcggaagaacggcaagcggguaauucagcugucccgcaagacguucgacacagaguaucagaagacgaagaacaaugacugggacuacguugucacgaccgauaucagcgagaugggagcuaacuuccgggcggacaggguuaucgacccgcggcggugccucaagcccguuauccucaaagacgggcccgagcgggucauacucgccgggcccaugccagugaccguagcguccgccgcucagcgccggggccgcaucggccggaaccagaacaaggagggagaccaguacguguacaugggccaaccucuaaacaacgaugaggaccacgcccacuggaccgaggccaagaugcugcucgacaacaucaacacccccgaggguaucaucccggcacuguuugagccggagcgcaagaagucggcugccaucgacggcgaguaccgccugcgcggcgaagcccgaaaaaccuuuguggaauugaugcggcggggcgaucuucccgucuggcuguccuacaagguggccagcgaggguuuccaguacuccgaccggcgcugguguuucgacggggaacgcaacaaccaggugcucgaggagaacauggacgucgaaaucuggaccaaggagggcgagcgcaagaagcugcggccccgcuggcuggacgcgaggaccuauucggauccacuggcgcucagggaauuuaaggaguuugccgcugggcggcgaucggugucaggggacuuaauacucgagaucggcaaacuuccacaacaccuuacuuuacgugcccaaaaagcacuagauaaccucgugaugcuacacaacagcgaacaaggcgggaaagccuaucgccaugccauggaggaacugcccgacaccaucgagacacuaaugcucuuggcccugaucgccguccugaccggagguguaacccuguucuucuuauccgguaagggccucggcaaaaccuccauagggcugcuaugcgugauggcauccagcgccuuacuuuggauggcgagcguggagccucacuggaucgcggcgagcaucauccuugaguucuuucucauggugcugcugaucccugagccggaccggcagcgcacuccccaggacaaucaacucgccuacgugguuaucggauugcuguuuaugauccucaccguggcugccaaugagaugggucuacuggagaccaccaagaaggacuugggcaucggccacguggccgccgagaaccaccaccacgccaccaugcuagacgucgaucugcggcccgccuccgcuuggacccuguacgccguagcgaccacgaucaucacuccgaugaugcgccacacgaucgagaacacaacggccaacaucagccugaccgccaucgccaaccaagccgcaauacugaugggccuagacaaggguuggcccauaaguaaaauggacaucggggugccccugcuggcucucggcugcuacucacaagucaauccccuaacccugacggcugcagugcucauguuaguggcgcauuacgccaucauagggccggggcuccaggccaaggccacccgggaggcacagaagcgaaccgcggccgggaucaugaaaaaucccacgguggacgggaucguggccauagauuuagacccugugguguacgacgccaaauucgagaaacagcuggggcagauuaugcuguuaauccugugcaccucccagauccuacucaugcgcacgaccugggcccuuugugagagcauaacucuggcgacagggccccuaacgacacugugggagggcagcccggggaaguucuggaacaccacaaucgcagucagcauggcuaacaucuuccgggguuccuaccuggcgggggccggguuggcuuucagucugaugaagucucugggcgggggccgccgggggaccggcgcacagggcgagacccucggggagaaguggaaacgccagcugaaccaacuaaguaagagcgaguucaacacguacaagagguccgggaucauggagguggaccgcagcgaggcgaaggagggguugaaaaggggcgaaaccacgaaacacgcggucucgcgcgggaccgcgaagcugcggugguucguagaacggaacuuagugaaaccggaagggaaaguaaucgaccuuggguguggccgcggcggaugguccuacuauugcgccggucucaagaagguaaccgaggugaagggguacaccaagggcggcccagggcacgaggagcccaucccgauggccacguauggcuggaaccugguaaagcuccacuccgggaaagacguauucuuuacgccgccugagaaaugcgauacccuccucugcgacaucggugagagcuccccuaacccgaccaucgaggagggcagaacacuccggguucuuaaaauggucgaaccuuggcugcgcggcaaucaguucugcaucaagauccuaaaccccuacaugcccagcgugguggaaacgcucgagcagaugcagcggaaacauggcgggaugcuuguccgcaauccguugucacgaaauucgacccacgagauguauugggugucaugcggcacugguaacaucgugagcgccgucaacaugacaucccgaaugcuccugaaccgguucacuaugacccaccgcaagcccaccuacgaacgcgacguugaucugggugcgggcacacggcacguggcgguugagcccgaaguugccaaccucgacaucaucggacagcgcaucgagaacauaaaaaacgagcacaaaucuacguggcauuacgacgaggacaaucccuacaagacaugggccuaccacggauccuacgaggugaagccgaguggcagcgccucauccauggugaacggcgugguccgacuguugaccaaacccugggacgugaucccgauggugacccagaucgcuaugaccgauacaacucccuucgggcagcagcgggucuuuaaggagaagguggauaccagaacgcccagagcuaagcgggguaccgcccaaaucauggaggugaccgccaaguggcucuggggcuuccuaagccgcaacaagaagccccggaucugcacccgcgaggaguucacacggaagguccgcagcaacgccgccaucggggcugucuucguggacgaaaaucaguggaacuccgccaaggaggccgucgaggacgagcgguuuugggacuuggugcaucgcgagcgggaguugcacaagcagggcaaaugugcaaccugcguauauaauaugaugggcaagcgggagaagaagcugggugaguuuggcaaggcgaagggcagccgggccaucugguauauguggcuaggagcccgcuuccucgaguuugaagcccugggauucaugaacgaggaccacugguuuuccagggagaacagccuguccggcguggagggggagggccuccacaagcugggguacauccugcgcgauauuagcaagauccccggcggcaacauguacgccgacgacaccacgggcugggacacaaggauuacugaggacgaccuacagaacgaggcgaaaauuaccgacaucauggagccagagcacgcguugcuggccacuagcaucuucaagcucacauaucagaacaaaguggugcgcguccaacggcccgccaaauccggcaccguaauggacguuauaucccgccgcgaucaacgggguagcggccagguagggacauacgggcucaacacauuuacgaauauggaggugcagcugauaagacagauggagucagagggcaucuuucucccgucugaguuagaaacccccaaccuggccgagcgggucuuagauuggcuggagaagcacggggucgagaggcuuaagcgaauggcaaucuccggcgaugacuguguggugaagccuacagacgaccgauucgccaccgcccucacggcccugaacgacaugggaaagguccgaaaggacauuccacaaugggaaccuagcaagggauggaacgacuggcaacaggugcccuucugcucccaccacuuccaucagcuuaucaugaaagacggccgcgagauaguggucccgugccggaaccaggacgaacugaugggaagagcgcggguuagccagggcgcgggguggucccuacgcgagaccgccugucuugggaaguccuacgcccagauguggcagcucauguacuuccaccggcgcgaccugcggcuggccgccaacgcuaucuguagcgcuguaccugucgacugggugccgaccucgcgcaccaccuggagcauccaugcccaccaucaauggaugacgaccgaggauaugcucuccguauggaacagagucuggaucgaggagaaccccuggauggaagacaagacacacgugaguuccugggaggacguaccguacuugggcaagcgcgaggaccaguggugcggcagccugaucggccucaccgccagggccaccugggccaccaacauucaagucgcaauuaaccaggugcggcgucugaucgggaacgaaaacuaccuagacuacaugaccuccaugaagcgguucaaaaacgagagcgacccugaaggugccuuaugguga

SEQ ID NO: 24714 - RNA, 9879 nt, Artificial Sequence
  derived and/or modified CDS sequence (opt11) from DENV-1__JQ915072__SS-prME
agcgugaccaugcugcugaugcugcugcccacgguccucaccuuccacuuaaccacccgcggcggggagccgcacaugaucgugagcaagcaggagcggggcaagagccuccuguucaagaccuccgccggggugaacaugugcaccuugauagccauggaccugggugagcucugcgacgacacgaugaccuacaaguguccccgcaucacugagacggagcccgaugacguugauugcuggugcaacgcaacggagaccugggugacuuaugggacgugcagccagacuggcgagcaucggagggacaagcguuccgucgcccuggcgccccacguuggccucgggcucgagacccgcacggaaacguggaugagcagcgagggcgccuggcggcaaauucagaagguggagacgugggcgcugcgccacccaggguucacggugauugcccuguuccucgcccacgccaucggcaccagcaucacgcagaaggggauaauauuuaucuugcugaugcucgucacuccguccauggccaugcgguguguggggauaggcaacagggacuucguggagggacuuagcggcgccaccugggucgacgugguguuagagcacggguccugcgucaccacgauggccaaagacaagcccacccucgacaucgagcugcugaagaccgaggugacaaaccccgccguucuccggaagcugugcauugaggccaagauuagcaacacgacgaccgauucccgcugcccgacccagggcgaggccacgcuggucgaggaacaggacaccaacuucgugugccgccgcacauucguggaccggggcugggggaacgggugcggcuuauucggaaagggaagccucaucacgugugcgaaauuuaagugcgucacgaaacuugagggcaagaucguucaguacgagaaccucaaguacuccgugauagucaccgugcauaccggcgaccagcaccaagucggaaacgagaccacugagcaugguacgauugcgaccaucacaccccaggcuccgacaagcgagauucagcugacggacuacggggcacugacccucgacuguagcccccggaccggccuggauuuuaacgaaauggugcugcucaccaugaaagagaaauccuggcuggugcacaagcagugguuccuggaccucccgcugcccuggacgaccggggcauccacuucacaggagaccuggaaccggcaggaucugcucgucacguucaagacugcacacgccaagaagcaggaagucgugguccuuggcagccaggagggcgccaugcacaccgcgcugacaggggccacggaaauccagaccuccggaaccaccacgauuuucgcggggcaccucaagugccgccugaaaauggacaagcugaccuugaagggcaucucguacgugaugugcaccgguuccuucaagcuggaaaaagagguggcagagacccaacacgguacgguccugguccagguaaaguacgaggguaccgacgcccccugcaagauucccuucagcucccaggacgagaagggggucacccagaacggccggcuggucaccgccaauccgaucgugacggacaaggagaagcccgucaacauagaggccgagccgcccuucggggagagcuacaucguggugggugcgggcgagaaggcacugaaacuuuccugguuuaagaaggggagcuccaucggcaagauguuugaggccaccgcccgcggggcacggagaauggccauccugggcgacaccgccugggacuucgggaguaucggcggcgucuucaccuccguggggaagcucgugcaccagaucuucggcacggccuacgggguccuguucucgggcguguccuggaccaugaagaucgggauuggcauacuguuaaccuggcugggccugaacagccgcagcaccagccucaguaugacgugcaucgccguagggauggucacccuguacuuaggcgugauggugcaggcggacucugggugcgucaucaauuggaagggccgggaacucaagugcggcuccggcaucuucgugaccaacgaggugcauacguggaccgagcaguacaaguuccaggcugacagcccgaagcgccuuagcgcggccaucgguaaggccugggaagaaggggucuguggcauccgauccgcgacgcgccuggaaaacaucauguggaagcagaucagcaacgagcucaaccacauccuguuggagaacgacaugaaguucaccgugguugucggggauguguccgguauccucgcccaggggaagaagacuauccguccccaacccauggagcacaaguacucuuggaaauccuggggcaaggcgaagaucaucggagccgacgugcaaaacacuacguucaucaucgacgggcccaacaccccagaaugccccgacgaccagcgcgcuuggaauaucugggaggucgaagacuauggcuuugggaucuucaccaccaacauauggcuuaagcugcgagacagcuacacacaggugugcgaccaccgccucauguccgcugccauuaaggacagcaaagccgugcacgcggauaugggcuacuggaucgagagcgagaagaacgagacguggaagcuggcgcgggccucauuuaucgaggucaagacguguguguggccuaagucccacacccuuuggagcaacggcguacucgaaucagagaugaucaucccuaagaucuacggcggcccgaucagccagcacaacuaccgucccggguacuucacgcagaccgccgggcccuggcaucuggggaagcuggagcucgacuucgaccugugugagggcaccaccgucgugguggacgagcacugcggccaccggggccccucccugcgcacaacaaccgucacuggcaaaaucauccacgaguggugcugcaggagcugcacgcugccgccccuaagauucaagggggaggacggguguugguaugggauggagauaagacccgugaaggagaaggaggagaaccuggugaaguccaugguuagcgccggcagcggcgagguggauuccuucucccucggucugcugugcauuuccauuaugaucgaggaggugaugcgcagccggugguccagaaagaugcuuaugacaggcacuuuggucguguucuuacuacugacccuugggcagcucaccuggaaugacuugaucagacuguguauaauggucggcgccaaugcgagcgacaacauggggaugggcaccacuuaccuggcccugauggcgaccuuccgcaugcguccaauguucgcugugggccuccucuuccggcgccuuaccucucgggagguacuucugcugaccgucgggcucagccucguggccuccguggagcugccaaacucacuggacgaguuaggcgacgguuuagcgaugggcaucaugauccugaaauuacugaccgacuuccagucccaccaguuaugggcaacgcucuugagcuugacguuugucaagaccacccucagccugcacuaugcguggaaaacgauggccaugaucuuaagcaucguaucccucuugccccugugccuuuccacgaccucacagaagaccaccuggcuccccgugcugcucgguagucuggggugcaagccgcucacgauguuuuugaucaccgagaacaagauuuggggcagaaaauccuggccccugaaugaggggaucauggccgucgggaucgugagcauccugcucagcucacugcugaaaaacgaugugccccucgcggggcccuugaucgcaggcggcaugcucauagccugcuacguaauuagcgggucgagcgcggaccucucccuggagaaggcggccaaggugagcugggaggaggaagccgagcauuccggcgcgagccacaacauccugguggagauccaggacgacgggaccaugaagauaaaggacgaggagcgggacgacacuauuaccauucuccugaaggccacacugcucgcgaucucuggcguuuacccgaugaguauacccgccacccuguucguguggcacuucuggcaaaagaagaagcagcgcuccggaguccugugggauacccccagcccgcccgagguggagaaggccgugcuggacgacggcaucuaccguauucuccagcgcggccugcuggggcggucccaggugggggucgggguguuccaggaggguguguuccacaccauguggcacgucacgcgcggggccgugcucauguaccagggcaagagacuggaacccucuugggccagugugaaaaaggaccugaucagcuacggcgggggcuggcgcuuccaggggucuuggaacaugggugaggaaguccaggugauagccguggagcccgggaagaaccccaagaacguccagaccgcccccggcaccuucaagaccagcgagggcgaggucggggcaauugccuuggacuucaaaccuggcacguccgggagcccuaucgugaaccgggaaggcaagaucgucggccuguacgggaacggcguggugaccaccagcgggaccuacgucucagccaucgcgcaggccaaggcaucgcaggagggccccuuaccggagaucgaggacgagguguucaggaagcggaaccuuacgaucauggaccugcacccgggauccgggaagacccgccgguauuugcccgccaucgugcgcgaagccauuaaacggaagcuccgcacccugguccuggcgccgacccgcgugguugccagcgagauggccgaagcccucaaagggaugcccauccgcuaccagacgaccgcggugaagagugagcacaccgguaaagagaucguggaccuuaugugccacgccaccuucacgaugcgucugcucagccccgugcggguccccaacuacaacaugaucaucauggacgaggcccacuucaccgaucccgccuccaucgccgcucgcggcuacaucagcaccagaguugggaugggcgaggccgccgccaucuucaugaccgccacaccgcccgggucgguggaagcguucccccagagcaacgccgucauccaggacgaggagaaggauaucccugagcgcuccuggaacucgggcuacgacuggaucacagacuuccccggcaagaccgugugguucguuccauccaucaaaagcgggaacgacauagccaacugccugcggaagaacggcaagcgcgucauccagcugucacggaaaaccuuugauaccgaguaucagaaaacgaagaacaacgacugggacuacgucgucacaacggacaucagcgagaugggggccaauuuccgcgccgaccgggugaucgacccgagacggugccucaaaccuguaauccugaaggauggcccugagcgcgucauccuggcggggcccaugcccgucaccguggcuucagccgcccaacggcgcggccgaaucggacgcaaucagaacaaggagggggaccaguacaucuacauggggcagccgcucaacaaugaugaggaccacgcgcacuggaccgaggcgaagaugcugcuggacaauaucaacacucccgaggggaucaucccagcacucuucgagcccgagcgggagaaguccgccgccaucgauggcgaguaccgccugcgcggggaggcgcgcaagaccuucgucgaacugaugcgccgcggcgaucugccgguguggcugucauacaagguggccucagagggcuuccaguacagcgaccgccgguggugcuuugacggggagcgcaacaaucagguacuggaggagaacauggacguggagauauggaccaaggaaggcgaacggaaaaagcuccggccucggugguuagaugcccgcaccuacucggacccccuugcccuccgggaguucaaggaguucgcugcggggcgccggaguguauccggcgaucugauccuugaaauaggcaaauuaccccagcaccugacccagcgugcccagaacgcccucgacaaccuagucaugcugcacaacagcgagcagggcgggaaggccuaccggcacgccauggaggagcugccggacaccaucgagaccaucaugcuucuggcgcugaucgccgugcucacuggaggggugacccuauuuuuccugucagggcgcggguugggcaagacaucaauugggcugcugugugucaccuccagcuccgcccugcuguggauggccagcguggagccccacuggaucgcggccucuauaauccuggaguucuuucucaugguguuacugauccccgagccagaccggcaacgcacgccgcaagacaaccagcucgccuacgucgugaucggccuguuguucaugauccucaccguggccgccaacgaaauggggcugcuggaaaccaccaaaaaggaccucggcaucggccacacggcggccgagaaccaucaucaugccgccaugcuggacgucgaccugcaucccgccagcgcguggacacucuacgccguggccaccacgaucauaacacccaugaugcggcacaccaucgagaacaccaccgccaauaucucccucacggcgaucgcgaaccaggcagcgauccugaugggcuuggacaagggauggccgaucucgaagauggauaucggggugccccugcuggcucucggcugcuacucccagguuaacccccugacacuaacagccgccgugcucauguuaguggcccauuacgcaaucaucgggcccggccugcaagccaaggcgacccgcgaggcacagaagcggacggccgccgggaucaugaagaacccuaccgucgacgguaucguggccauugaccucgaccccgugguuuacgacgcgaaguucgagaagcagcugggccagaucaugcugcucauccugugcaccagccagauacugcucaugcgcaccacgugggcacugugcgaguccaucaccuuagccaccggcccccucaccacgcugugggaggggagccccgguaaguucuggaauacuaccauugccguguccauggcuaacaucuuccggggcucguaccuggcaggcgccgggcucgccuucagccugaugaagucacugggugggagcaggagaggcaccggggcccagggcgagacgcucggcgagaaguggaagcgccagcugaaccagcucuccaagagcgaguucaauaucuacaagcgcagugggaucaucgagguggaccggagcgaggcgaaggagggccucaagcgcggugagaccaccaagcacgcgguuagucggggcacugccaagcugcgcugguucguugaacgaaaucuugugaagcccgaggggaaggucaucgaccugggcugcgggcgcgggggcuggagcuacuauugugccgggcucaaaaagguaaccgaggugaagggcuauacgaagggcgggcccggccacgaggagcccauccccauggccaccuacggguggaaccuggucaagcuccauuccggcaaggauguguuuuucauuccgccugagaaaugugacaccuuguugugcgacaucggcgagagcucccccaacccuaccaucgaggagggccggacgcuacgcguucucaagauggucgaaccgugguugagagggaaccaguucugcaucaaaauccugaaccccuacaugcccucgguggucgagacccuagaacaaaugcagcgcaaacacggcggaaugcucguucggaacccccugucccguaacagcacgcacgagauguacuggguguccugcgggaccggcaacaucguuagugcggucaacaugacuucccggaugcuccugaaucgcuuuacaauggcacaccggaagccgaccuacgagcgcgacguagaccugggggccggaacccggcacguugccgucgagccugagguggccaaccuggacaucaucgggcagcgcaucgagaauauaaagaacgagcacaaaagcacguggcacuaugacgaggacaaccccuacaagaccugggcauaccacggaaguuacgaggucaagcccagcggcagcgccucaagcauggugaauggaguuguccgccugcugaccaaaccgugggacgugauccccauggugacucagaucgccaugacggacacaacccccuucggccagcagagagucuucaaggagaaaguggacacccgaacgcccaaggccaagcgggggacggcccagaucauggaggugaccgcgaaguggcucuggggcuuucugucccgcaacaagaagccgcggaucuguacccgcgaggaguucacacggaagguccgcagcaaugccgcuaucggcgccguauucguggacgagaaccaguggaacuccgcaaaagaggcgguugaggaugagcgguucugggaccuggugcgccgggaacgcgaacuccacaagcaggggaaaugcgccacuugcgucuacaacaugaugggcaagagggagaagaagcugggagaguucggcaaggcuaaggggagccgcgccaucugguacauguggcugggcgcgcgguuccucgaguucgaagcccugggcuucaugaacgaggaccacugguuuucccgagagaacucacuguccggggucgagggcgaggggcuccacaaacuuggcuacauacugcgugacaucagcaaaauccccgggggcaacauguacgccgacgacaccgcuggcugggacaccagaauaacagaggaggaccuccagaacgaggccaaaaucaccgacaucauggagcccgagcacgcguuauuagcaaccuccaucuuuaagcucaccuaucaaaacaagguggugcggguccagaggccggccaagaacgggacggucauggacguaaucucucggcgcgaccagcgaggcuccgggcaggucgguaccuacgggcugaacaccuucaccaauauggaggcucagcuuauccggcagauggagagcgaggggauauuuucccccucggagcucgaaacgcccaaccuggccggaaggguguuggacugguuagaaaaacacgggauugagcgacugcgccggauggcgauauccggcgacgacugugucgucaaaccaauagacgaccgcuucgccaccgcccugacagcccucaacgacauggggaaggugcgaaaggacaucccgcagugggagccaagcaagggauggaacgacuggcaacaggugccguucugcucucaccauuuucaccagcucaucaugaaagacggucgcgagaucgucgugccaugccggaaccaggaugaguuggugggccgcgcgcggguaucccagggcgcgggauggucguuacgcgagaccgcgugccuggguaaguccuacgcccagauguggcagcugauguacuuccaccgucgcgaccucaggcuggccgccaacgcgaucugcagcgccgucccgguggacuggguccccacgucccgcacaaccuggagcauucacgcccaccaccaguggaugaccaccgaggauaugcuguccguguggaaccgcguguggaucgaggaaaacccguggauggaggacaagacccaugugucgucuugggaggaugugcccuaccuaggcaagcgcgaggaccaguggugcgggagcuugaucggacucacggcccgugcgaccugggcaaccaacauccagguggcgaucaaacagguccgcagacucaucgggaaugagaacuaccucgacuacaugacguccaugaagcgguucaagaaugagagcgacccggagggagcccugugguga

SEQ ID NO: 24715 - RNA, 9879 nt, Artificial Sequence
  derived and/or modified CDS sequence (opt11) from DENV-1__JQ915071__SS-prME
agcgugacaaugcugcucaugcugcugcccaccgugcuaacuuuccaucuuaccacacgugggggcgaaccucacaugaucguuagcaagcaggaacgggggaagagccucuuguucaagaccuccgccggcgugaacaugugcacccugaucgccauggaccucggcgagcucugugacgacacaaugacguauaagugcccccgcauaacugagaccgagcccgacgacgucgacugcuggugcaacgcuaccgagaccugggugaccuacgggacgugcagucagaccggcgagcacagacgcgacaagcgguccguagcccuggcgccccaugucggccuggggcucgagacgcguaccgagacuuggaugagcagugagggggccuggcggcagauccagaagguggagaccugggcccuccgccacccgggcuucacagugauugcacuuuuccucgcacacgccaucggcacuaguauuacgcagaagggcaucaucuuuauccugcuaaugcucgucacccccuccauggccaugcggugcgugggaaucggcaaccgcgacuucguggagggguuaucaggcgcgaccuggguugauguggugcuggagcacgggaguugcgucaccacuauggccaaagacaaacccaccuuagacaucgaauuacucaagacagagguuaccaaucccgccgugcuccgaaagcugugcaucgaggccaagaucagcaacacgaccaccgacagccgcugcccgacgcagggggaggcgacgcuggucgaggagcaggacaccaauuucguguguagacgcaccuucguagaucggggcugggguaauggcugcggccuguucgggaaggggagccugaucacgugcgcgaaguuuaagugcgccacgaagcuggagggcaagaucguccaguaugaaaaccucaaguacuccgugaucgugacgguccacaccggagaccagcaccagguugggaacgaaacuacggagcauggaacgaucgccaccaucacuccgcaggccccaacaagcgagauccaacugacggauuauggggcgcugacacuugacuguagcccccggaccggccuagacuucaacgagaugguccugcuuacaaugaaagaaaaauccugguuggugcacaagcaaugguuccuggaccucccgcugcccuggaccacaggggcguccaccagccaggagaccuggaaccggcaggaccugcuaguaacguuuaagaccgcacacgcaaagaagcaagaagucguaguacugggaagucaagaaggcgccaugcacacugcacugacgggggcgacggagauccagaccuccggcacaacgacuaucuucgccgggcaccucaagugcaggcuaaagauggacaaacuaaccuugaagggcaucucuuaugucaugugcaccggguccuucaagcucgagaaggagguugcugagacccagcacggcacgguguugguccaggugaaguaugaagggaccgacgcccccugcaagaucccauucagcucccaggacgagaaggggguaacucagaacggccggcuugucaccgccaacccgaucgugacggacaaggagcgccccgugaacaucgaagcugagccgcccuucggcgagagcuacaucgucgugggcgccggugagaaagcccucaagcuguccugguucaagaaggggaguaguaucggcaagauguucgaggcgaccgcgcgcggggcacgccgcauggccauccugggagacacggccugggacuucgggagcaucggcggugucuucaccuccgucgggaaguuagugcaccaaaucuucggaacggccuacggugugcuguucucuggcgucuccuggacaaugaagaucgggaucggaauccuguuaaccuggcuuggccugaacagccgguccaccagccucucuaugacgugcauagcgguggggauggugaccuuauaccugggcgucauggugcaagccgacagcgguugcguuauaaauuggaagggccgcgaguuaaagugcggguccgggaucuucgugaccaacgaggugcacaccuggaccgagcaguacaaguuucaggccgacagcccgaagcggcuaagcgccgccaucggcaaggcgugggaggaagggguguguggcauccgcuccgccacacgguuggagaacauaauguggaagcaaaucagcaacgaauugaaccauauccuccuggagaacgacaugaaguuuaccguagucgugggggacgucuccggcaucuuggcccaagggaagaaaaccauucgcccccagccuauggagcacaaguacagcuggaaguccuggggcaaggccaagaucauaggcgccgacgugcagaacaccacuuucaucaucgacgggcccaauaccccugagugucccgacgaccagcgggcguggaauauuugggaggucgaggacuacggauucgggaucuucaccaccaacaucugguugaagcugcgugacaguuacacacaggucugcgaccaccgucuuaugagugccgccaucaaggauagcaaggccguacaugcggacaugggcuacuggaucgagagugagaagaacgagacguggaagcuggcucgcgccagcuucaucgaggugaagaccugcgucuggcccaagucccacacccuguggagcaacggggugcuagaguccgagaugaucauacccaagaucuacgguggcccuaucucucagcacaacuaucggccgggguacuucacgcaaacagccggcccguggcacuuagggaagcuggagcucgauuucgaccugugcgagggcaccacuguggucguggacgaacacugcggcaaucgggggccgucccuaaggacaaccaccguuaccgguaagauaauucaugaauggugcugccgcagcugcacguugccaccgcugcgguuuaagggggaagacggaugcugguacggcauggaaauacgccccgucaaggagaaggaggagaaucugguuaaauccauggugagcgccggcagcggcgaggucgacuccuuuagccucggucuacugugcaucuccaucaugaucgaggaggugaugcggucucgcuggucccggaagaugcugaugaccggcacucugguggucuuccugcuccugaccuugggucagcuuacauggaacgaccugauucgccugugcauuauggugggugcaaacgcuagcgacaauauggggaugggcaccacauaucucgcccugauggccaccuuccgcaugcggccgauguucgccguggggcucuuguuccgccggcugacgucccgcgagguguugcuccugaccgugggacucagcuuagucgccaguguggaacugcccaacagcuuggacgaacucggcgacgggcuggcaaugggcaucaugauacugaagcuucugaccgacuuccaaucccaccaacugugggcgacccugcugagccugacguuugugaagacuacccucagccugcauuacgccuggaagaccauggcgaugauucugucgaucguaagccucuugcccuugugcuuaagcacgaccucccagaagaccaccugguugccagugcugcucggaagcuuagguuguaagccguugaccauguuccucaucacggagaacaagaucuggggccggaaguccuggccccugaacgaagggaucauggcggugggcaucguuagcauccugcucagcucccugcuaaagaacgacguccccuuagcagguccccugauugccggcgguaugcugaucgccugcuacgucauuagcgggucuagcgcggaccuuuccuuagagaaggccgcuaaggucagcugggaggaagaggccgagcacuccggcgccagccacaacauccuaguggagauccaggacgacgggaccaugaaaaucaaggacgaagagcgcgacgacaccaucacuauccuccugaaggcaaccuuacucgccauauccggaguguacccuaugagcauccccgccacacuguucgucuggcacuucuggcagaagaagaaacaacgcuccgggguacugugggacacccccagcccgccggagguugagaaggccguccuggacgacggcauuuaucgcauccuccaacggggccuacuggguaggucccaagugggugugggugucuuucaggaaggcgucuuccacaccauguggcacguuacucgaggggccguccucauguaccagggcaagcgccuagagcccucuugggcauccguuaagaaggaccugaucagcuacgggggaggcuggagauuccaaggaucauggaauacgggagaggagguccaggucaucgcuguggagcccgggaagaaucccaagaacguccagaccgccccuggcaccuucaagaccagcgagggcgaggucggggccauugcccucgacuucaagccuggcacguccgguagcccuaucgugaaccgcgagggcaagaucguggggcuguacgggaauggagucgugacgacaagcgggacguacguuagugcgaucgcccaggccaaggccucgcaggagggcccgcugccugagauagaggacgaggucuuccggaagcgcaaccucaccaucauggaccugcaccccggcuccggaaagacccggcgcuaccugccagcgaucgugcgggaagcuaucaagcggaagcucaggacccugguucuggccccgacacgcgucguggccagcgagauggccgaagcgcugaagggcaugcccauacgcuaccaaaccaccgccgugaaguccgagcacaccgggaaggagauagucgaccucaugugccacgccaccuucaccaugcggcugcuaagccccguuaggguccccaacuacaacaugaucaucauggacgaggcccacuucacggacccagccaguaucgcggccaggggcuacaucagcacucgugucgggaugggcgaggcugcggcgaucuucaugacggcgacgccgcccggguccguggaggccuuuccccaaagcaacgcugugauccaggacgaagagaaggacaucccggagcgguccuggaacagcgguuacgacuggaucacugacuucccuggcaaaacggucugguucgugcccuccaucaagagcgggaacgacaucgcaaacugccugcguaagaacggcaaacgggugauacaacuguccaggaagacguuugacaccgaauaccagaagacaaagaacaacgacugggacuacgucgugaccacagacauaagcgagaugggggccaacuuccgggcagaccgcgucauugauccccgucgcugccuuaagccgguuauccuuaaggacggccccgagagagugauccuggcagggcccaugcccgucaccgucgccuccgcggcgcagcggcgcggacgcaucggcagaaaucagaacaaggagggggaccaauacaucuacaugggccagccucugaacaacgacgaagaccacgcacacuggaccgaggcgaagaugcuacucgacaacaucaacaccccugaagggaucauccccgcucucuucgagcccgagcgcgagaaguccgccgccauagacggcgaguaccggcugcgcggugaggcccguaagacguucguggaacugaugcggcgcggugaucucccggucuggcucuccuacaagguggccagcgagggcuuccaguacagcgaccggcgcuggugcuucgacggggagagaaacaaccagguuuuagaggagaauauggacgucgaaauuuggaccaaggagggcgagcgcaagaaacuccgaccccgcuggcuggacgcuagaaccuacucugacccccuggcgcuccgugaguucaaggaguucgcggccgggcggcguucaguguccagcgaccugauccuggagaucgggaaacugccccagcacuuaacucagagggcccagaacgcccuggauaaucucgugaugcuccacaauucagaacagggcggcaaggccuaccgccacgcgauggaggagcugccggacacgaucgagacgaucaugcuacuugcccugaucgcgguccucacgggcggcgugacccuguucuuccuaagcggccggggguuggggaagaccaguaucggcuuacugugcgucacgagcuccagcgcccuccuguggauggcgaacgucgagccccauuggauagcggccuccaucauccuggaguucuuccucauggugcugcugauuccugagccagacaggcagcggaccccucaggacaaucaauuagccuauguugucaucgggcugcuguucaugauccucaccguggcagcgaacgagauggggcuguuagagaccacgaaaaaagacuuagggauuggacacaccgccgcagagaaucaucaccaugccgcuaugcuugacguggacuuacauccagcaucagcguggacccucuacgccguugccaccacgaucaucacuccaaugaugcgccacaccauagagaacacgacggccaacaucucucuuaccgcgaucgccaaccaggccgccauucugaugggccucgacaagggcuggccgaucagcaaaauggauaucggcgugccccuucuggcccucgggugcuacucccaggugaacccgcugacccugaccgcggccguguugaugcugguggcccacuacgccaucaucggaccggggcugcaggcgaaggcuacgcgggaggcccaaaaacgcaccgccgccggcaucaugaagaauccaacuguggacgggaucguagcgaucgaucucgaccccgugguguacgaugcgaaguucgagaaacagcuggggcagaucaugcugcucauucugugcaccagccagaucuuacucaugcggacgaccugggcccugugcgaaucgaucacccuggcuacagguccccucacgacacugugggaggggucgcccgggaaauucuggaauacgaccaucgccguaucaauggccaacaucuuccgcggaagcuaccuggcaggugcgggcuuggcguuuucgcugaugaagucccucggaggcgggcgccggggcacgggugcccaaggcgagacccucggcgaaaaguggaagcgccagcugaaccaacugagcaagucagaguuuaacaccuacaagcggagcgggaucaucgagguagaccgcuccgaggcacgugagggucucaagagaggugagaccaccaagcacgccguaagccggggcaccgcuaagcugcgcugguucgucgagcggaaccuagugaagccggaaggaaaggugaucgauuugggcuguggccgcggagggugguccuacuacugcgcuggacucaagaaggucacagaggugaagggcuacaccaagggcgggccuggccacgaggagcccauccccauggcgaccuacggguggaauuuagugaagcugcacagcggcaaggacgucuucuucauaccgcccgagaagugugacacgcuccugugcgacaucggggaguccagcccgaaucccacgaucgaggagggccgaacccugcgcguguuaaaaauggucgagccguggcuacgggggaaccaguucugcaucaagauccugaacccguacaugcccagugucguggagacccucgagcagaugcagcgcaagcacggcggaaugcuggugcggaacccgcuaagccgcaacuccacgcaugagauguacugggucagcugcgggacuggcaauaucgugucggccgugaacaugacuagccggaugcuccuaaaucgcuuuaccauggcccaucggaagccgacguacgagcgugauguugaccugggggccggcacccggcacguugccguagagccggaggucgcgaaccucgacaucaucggccagcggaucgagaacaucaagaacgagcauaaguccaccuggcauuacgacgaagauaaucccuacaagaccugggccuaccaugggucguacgaggugaagccauccggcagcgccucgucgauggucaacggggugguucgccugcugacgaaaccgugggaugucaucccaauggugacccagaucgccaugacugacaccacgcccuucggccagcaacgggucuucaaggagaagguugauacgcgcacccccaaggcaaagcgggggaccgcgcagaucauggagguuacggccaaguggcucuggggcuuucugagccgcaacaagaagcccaggaucuguacccgcgaggaguucacccgaaagguccgcucgaacgcggccaucggagccguuuucguagacgaaaaccaguggaacagugcgaaggaggccguggaggacgagagguucugggacuuaguccgucgugaacgugagcuccacaagcaagggaaaugcgcgacgugcgucuacaacaugaugggcaagcgggagaagaagcugggggaguuuggcaaggccaaggggucccgagcgaucugguacauguggcugggcgccagauuccucgaauucgaggcucugggcuucaugaacgaagaccacugguucagcagagagaacucccugagcgggguggagggugaagggcuacauaaauugggcuacauucugcgggauaucuccaagaucccagggggcaacauguacgccgacgacacggccggcugggauacccgcaucaccgaagaggaccuccagaacgaggcgaagaucaccgacaucauggagcccgagcacgcccugcuugccacgagcaucuuuaagcucaccuaccagaacaaggucgugcgggugcagcgcccggccaagaaugggaccgucauggacgugaucagccgccgggaccagcgcggcuccggccaaguaggcaccuauggccugaacacauucacaaacauggaggcccagcuuauacgccagauggaaagcgaggggauuuucagccccuccgagcucgagacccccaaccuggcgggccgcguccuggacugguuagagaagcacggaaucgagcggcugcgccggauggccaucagcggugacgauugcgucguaaagcccaucgacgaccgcuuugccaccgccuuaacggcucugaacgacauggggaagguucggaaggacauuccgcagugggagccauccaaaggcuggaacgacuggcagcagguccccuucuguucacaccacuuccaccaacuaaucaugaaggacggccgcgaaaucgucgucccaugccggaaccaggacgagcuggugggaagagcacggguuucacagggcgccgggugguccuugcgggagacugccugccugggcaagucauacgcacaaauguggcagcucauguacuuccaucggcgugaccuccggcuggcugcgaacgccaucugcuccgccgucccgguggacuggguucccaccagccgcaccacuuggagcauccacgcccaccaccaauggaugacgacagaggauauguuaagcgucuggaaccggguguggaucgaggagaaccccuggauggaggacaagacccacgugucuaguugggaggacguccccuaccucggcaagcgcgaggaccaguggugcggcucccugaucggcuugacagcgcgugccacgugggccaccaauauccagguagccaucaaccaggugcggagacuaauugggaacgagaacuaccuggauuacaugaccagcaugaaacgguucaagaacgaauccgacccugagggcgcgcugugguga

SEQ ID NO: 24716 - RNA, 9879 nt, Artificial Sequence
  derived and/or modified CDS sequence (opt11) from DENV-1__JQ915073__SS-prME
uccguaaccaugcugcuuaugcugcugccaacgguacuuaccuuccaccuaaccacccgggguggcgagccacacaugaucgugagcaagcaggagcgggguaagucgcugcuguucaagaccucggccggggucaacaugugcacccucauugccauggaccugggugaguugugcgacgauaccaugacguacaagugcccccguauuaccgagacagagcccgaugacguggacuguuggugcaacgcaacugaaacaugggugacguacggaaccugcuuccagacgggugagcaccggcgcgauaagcggagcguugcacuggcgccgcacgucggccucgggcucgagacccgaacugaaacguggauguccucagaaggagcuuggcggcagauccagaaaguggagaccugggccuugagacaucccggguuuaccgugauugcacuguucuuagcucacgccaucggaacgucuaucacgcagaaggggaucaucuucauccugcucauguugguaacgcccucgauggccaugcggugcguuggcaucggcaaccgagauuucguggaagggcuuuccggcgcgaccugggucgacgugguccuggaacacgguagcugcgucaccacuauggccaaggacaagccaacccucgacaucgagcugcugaagaccgaaguuaccaaccccgccguacuucggaaguuaugcauagaggccaagaucucaaacacgacgaccgacucgcgcuguccgacccaaggcgaggcuacccucgucgaggagcaagacacgaacuucgucugccggaggaccuucguggacagaggcuggggaaacggaugcggcuuguucggaaaggguucacugaucacgugugcgaaguucaagugcguuacgaagcuggaggggaaaaucguacaguaugagaaccuuaaauacagcgugaucgucaccgugcacacuggcgaccagcaccagguaggaaaugaaacuacugagcacggcaccaucgccaccaucacaccccaagcccccaccucugaaauucagcugacggacuauggggcacugacacucgacuguuccccgcgcaccggccucgacuuuaacgaaauggugcuccucacuaugaaggagaaguccuggcuagugcauaaacagugguuccuggaccugccgcuuccauggacgacuggggcuagcacgagccaggaaaccuggaaccggcaggaccugcuagucacuuucaagaccgcgcacgccaaaaagcaagagguggucguguuaggaucacaggagggcgcuaugcacaccgcccugaccggggcuaccgagauacagacuucgggcaccaccacgaucuucgcggggcaucucaaaugucgccugaagauggauaaacuuacccucaaggguaucucguaugugaugugcacagggagcuucaaacuggaaaaggagguggccgagacucaacacggaacggugcuagugcagguaaaguaugaggguaccgaugcccccugcaagaucccuuucuccagccaggacgagaagggagucacccagaacggacggcuggugacggccaacccgaucgugacggacaaggaaaagcccgugaacaucgaggccgagccgcccuuuggggagucguauauagucgugggggccggcgagaaagcccucaagcugagcugguucaaaaagggauccagcauuggcaagauguucgaggcgacagcccgcggggcccggcgcauggcaauucuaggagacaccgccugggacuuuggguccaucggcggcgucuuuaccuccgugggaaaacuagugcaucagaucuuuggcacggccuauggcguccucuucuccggggugucauggaccaugaagauuggcaucgggauccuccucaccuggcugggucugaacuccagaucaaccucccucaguaugacgugcaucgccguagggauggucacccuuuaccugggcgugaugguucaggcggacagcggcuguguaaucaacuggaaggggcgggagcucaaaugcgggucuggcaucuucguuaccaaugaggugcacaccuggacggagcaguauaaguuccaagcugacaguccgaagcgccugucugccgccauuggcaaggccugggaggagggcguaugcggcauccguagcgcuacacgccuggagaauauaauguggaagcagauuucuaaugagcuuaaccauauacugcuggagaacgacaugaaguucaccgugguugucggggacgugagcggcauccucgcccaagggaaaaagaccaucaggccccagcccauggagcacaaguacuccuggaagucauggggaaaggccaagaucaucggcgccgacgugcaaaacaccacguuuaucauagacggccccaacaccccggaguguccugacgaccagcgugccuggaacauuugggaggucgaggacuacggguucgggauuuucacuaccaauauuuggcugaaguuacgugauuccuacacgcaggugugcgaccaccgucucaugagcgcggcaaucaaggauucaaaggccguucacgccgacaugggcuacuggaucgagagcgaaaagaacgagaccuggaaauuggcgagggcuuccuuuaucgaggucaagaccugcguguggccuaagagccacacacucuggagcaauggcguucucgagagcgaaaugaucauuccaaaaaucuacgggggcccgauaucccagcauaauuacagaccggguuacuucacgcagaccgcgggacccuggcaucuggggaaacuggagcuggauuuugaccugugugagggcacuaccgucgugguggacgagcacugcggccaccgggggccgucacugcgcacgaccaccguuacgggcaagaucauccaugaguggugcugccggucaugcaccuugccgccacugcgcuucaagggggaggacggcugcugguacgggauggagauccgaccagugaaagagaaggaggagaaccuggucaagagcauggucuccgccggcagcggcgagguggacuccuucucccucggccugcugugcaucucuauaaugauagaagagguaaugaggagucgguggagccgcaagaugcuaaugacgggcacccuggugguauuccugcuccugacacucgggcagcucaccuggaacgacuugauccggcugugcaucaugguaggugcgaaugcgagcgauaauauggggauggggacaaccuaccucgcccugauggccaccuuccgcaugaggccgauguucgcaguagggcuccucuuuagaagacugacgagccgggaggugcugcuccugaccguugggcugucgcucguugcgagcguggagcugcccaacaguuuggacgagcugggcgaugggcuggcaaugggcaucaugauuuuaaagcucuuaaccgacuuucagucccaccaguuaugggcaacccuccuaucccugacguuugucaaaacaacauugagccugcacuacgccuggaagaccauggccaugauccuguccaucgugagccuccugccgcugugccucucuacaaccagccagaagacgaccuggcuccccgugcuccucggcagucugggguguaaaccacugacaauguuccucauaacggagaacaaaauauggggucguaagucguggccgcucaacgagggaaucauggccguaggaaucguaaguauacugcucagcucucugcugaaaaaugacguacccuuggcggggccacugaucgcaggugggaugcugauugccugcuacgucaucucggggucgagcgcggaccucagccucgagaaggcggccaagguguccugggaggaagaggccgagcacucaggcgcaucccacaauaucuugguggagauccaggacgacggaaccaugaagaucaaagacgaagagcgggacgacaccaucacuauccuccugaaagccacgcuacucgcaaucucgggggucuacccgauguccauaccagccaccuuauuuguguggcauuucuggcagaagaagaagcaaaggagcggcgugcuuugggacacgcccucaccccccgagguugagaaggccgugcuagacgacggaaucuaucggauccuccaacgaggccugcugggccggagccaagugggcgucgggguguuccaggagggcguguuccacaccauguggcacgucacgcgcggagccgucuugauguaccaaggcaaaaggcuggagccuucuugggccagcgucaagaaggacuuaaucuccuacggcgggggcuggcgguuccaggggagcuggaacaccggagaggagguccaggugaucgcgguggagcccgggaagaacccaaaaaacguccaaaccacgccuggcacauucaagaccucagagggcgagguaggagccaucgcccuggacuucaaacccggcaccuccgggagccccauugugaaccgggagggcaaaaucguaggccuguauggaaacggcgucgugaccacgucugggaccuacguaagcgccaucgcccaggccaaggccucccaagagggcccucugccggaaauagaggacgaaguguucagaaaacggaaccuaaccauuauggaccugcauccugggucaggcaaaaccagacgguaccuaccagccaucgugcgggaggccaucaagcggaaacuccggacgcugguccuggccccgacccgggugguggcgagugagauggccgaggcacuuaagggcaugccuauucgcuaccagaccaccgccgugaagucggaacauacggggaaggagauaguugaucugaugugccacgcuaccuucacaaugcgccugcucuccccugugcgggucccuaacuacaacaugaucaucauggacgaggcccacuuuaccgauccggccagcauugccgcccgcggcuauaucaguacgaggguugggaugggugaggcggccgccaucuucaugacggccaccccgcccgggagcgcagaggcguucccccagucgaacgccgugauucaggacgaggagaaggacaucccagaacguucuuggaacuccggauacgacuggaucaccgacuuccccggcaagacagucugguucgugcccagcaucaaguccgggaacgacaucgccaacugccugcggaagaacggcaagcgaguaauccaacugucacguaagacuuucgacacggaguaccagaaaaccaagaacaaugacugggacuacgucgucacgaccgacaucuccgaaaugggugcuaacuuccgcgccgaccgggucaucgauccgaggcguugccuaaagcccgugauccucaaggacgggccugagcgcgugauccuggcaggucccaugccggugacuguggccagcgccgcccagcggagaggacgcaucggccgaaaucagaacaaggaaggagaucaguacauauacaugggucagccgcucaacaacgaugaggaccacgcgcauuggaccgaggccaagaugcugcucgacaacauaaacacgcccgaagggaucauaccggcgcuauucgagcccgaacgggagaaguccgccgccauugacggcgaauaccgccugcgcggggaggcacgcaagacauucguggagcugaugagacgaggcgaucuaccggucuggcugucauacaagguggccuccgagggcuuccaguacucagaccgccggugguguuucgauggggagcgcaacaaccaggugcuugaggaaaauauggacgucgagaucuggacaaaggaaggcgaacggaagaagcuccggccgcgguggcuagacgcacgcacguacagcgacccccuggcccuccgugaguuuaaagaguucgcugcggggcgccgguccgugucgggggaccuuauucuggagaucggcaagcucccccagcaccugacucagcgagcccagaaugcccuggacaaccuugugaugcugcacaacuccgagcagggcgggaaggccuauaggcacgcgauggaggagcugccggacacgauugaaacgaucaugcuucucgcgcuaaucgccguacucaccgggggugucacgcuuuucuuccuaucgggucgcgggcuggggaagacguccauagggcugcugugcgugaccagcucuagcgcccuccuguggauggcauccgucgaaccccacuggauagcagccucaauuaucuuagaauucuuucuuaugguccuucuuauaccagaacccgaccggcagagaaccccacaagauaaccagcucgccuacgugguaauuggcuuacuguucaugauccuuaccguugccgccaaugagaugggguugcuggagacgaccaaaaaagaccucgguauagggcauacagcggcagagaaccaccaccaugcggcgauguuagauguggacuuacacccggcuuccgcauggacacuguacgccgucgccacgaccaucaucaccccgaugaugaggcacaccaucgagaacacgacggccaauaucagccugacggcgaucgcaaaccaagccgccauccugaugggccucgacaaaggguggccgaucuccaagauggacaucgguguuccacugcuggcccucggcugcuauagccagguaaacccucugacccugacggccgcagugcucaugcugguggcccacuacgccaucauagguccgggcuugcaggccaaggcuacacgugaggcacagaagcggaccgccgccggcauuaugaagaacccgacaguggacgggaucguggcaaucgaccucgaucccgucguuuacgacgcaaaguucgagaagcaacugggccagaucaugcugcuaauccugugcacgagccagauccuauuaaugcggaccaccugggcccugugcgaaucuaucacgcuggcuacggggccacuaaccacccugugggagggcucuccgggcaaauuuuggaauaccacuauugccgucagcauggcgaacauauuccggggcuccuaucuggcgggcgccgggcuugcguucucacugaugaagucguugggcggugggcgucgcgguacuggggcccagggggaaacccucggcgagaaguggaagagacaacugaaccagcuuaguaagagcgaguuuaauacguacaagcgcuccggcauuaucgagguggaccgaagcgaagccaaggaaggccucaagaggggggagacaacaaaacaugccguaucacgcggaaccgccaagcugcgcugguucguggagcgcaaccucgugaaaccggagggaaaagugaucgaccuuggcugugggcgcggcgguuggagcuacuacugcgcaggccucaagaaagugaccgaagugaaggguuacacgaaggguggccccggacacgaggagccgaucccgauggccacauauggcuggaacuuggucaagcugcacuccggcaaggacgucuucuucaucccgccggagaagugcgacaccuuauuaugcgauaucggcgaaagcuccccgaaucccaccaucgaggagggcagaacccugcgcgugcucaagaugguugagccguggcugcggggcaaccaguucugcaucaagauacugaacccuuacaugcccagcguaguggagacuuuagagcagaugcagcgcaagcauggagggaugcuggucaggaacccuuuauccagaaauagcacccaugagauguauuggguguccugcggcaccgggaacauuguguccgcggucaacaugaccucgcggaugcugcuaaacagguucacgauggcccaccggaagccuaccuaugagcgugaugucgacuuaggcgccgguacccgccacguggccgucgagccagaggucgccaaccucgauauaaucgggcagcgcaucgagaacaucaagaacgagcacaagagcaccuggcacuaugacgaggauaacccuuacaagacgugggcguaccauggcuccuacgaaguaaaaccaagcgggucagccagcucgaugguuaauggcguuguccgcuugcuuacuaagccgugggacgucauccccauggugacccaaaucgccaugaccgacacuacccccuucgggcagcagcgggucuucaaggaaaaagucgauaccagaaccccgaaggccaagcggggcacggcgcagaucauggaggugaccgcgaaguggcucugggguuuccugucccguaauaagaaaccgcggaucuguaccagagaggaauucaccaggaagguacgcagcaacgccgcaaucggugcuguauuuguggacgaaaaccaguggaacagugcuaaggaggcuguggaagacgagagguucugggaccuuguucgccgugaaagagagcuccacaagcagggcaagugcgcuacgugcguguacaacaugauggggaaacgcgagaagaagcucggcgaauucgggaaggcuaagggcagccgagccauuugguauauguggcugggugcgcgguuucucgaguucgaggcucugggcuucaugaacgaggaccacugguuuucgcgcgagaauagccugagcggcguggaaggggagggccuccacaagcugggauacauccugcgggacauaagcaagauccccggcgggaacauguacgccgacgauaccgcgggaugggacacccgaauuaccgaagaggaccuccaaaacgaggccaagaucacggauaucauggaaccugagcacgcgcugcuggccaccuccaucuucaagcugacauaccaaaauaaagucgugcgaguucagcguccugccaaaaacggcacaguaauggacgucaucucacggagagaccagcgaggcuccggccagguuggcacguacggguuaaacacauucacuaacauggaagcccagcugauacgccagauggaaagcgaggguauuuucucccccucugaacucgagacacccaaucuggcggggcgcguacuagacuggcucgaaaagcacggcaucgaacggcugcgccguauggcgaucuccggggacgacugcguggugaagcccaucgaugaccgcuucgccacggcccugaccgcccucaacgauaugggcaagguccggaaagauauuccgcagugggagccgucgaagggcuggaacgauuggcaacagguacccuuuuguucacaucacuuccaccagcugaucaugaaggacggccgcgaaaucgucgugcccugccggaaucaagacgaacuggugggccgagcccggguuagccagggcgcgggcuggagccuccgcgagacggcgugcuuggggaagagcuacgcccagauguggcagcugauguacuuccacaggcgcgaccuccggcuggccgccaacgcgauuugcagcgcugucccgguggacugggugccuacguccaggacuacguggagcauccacgcccaccaccaauggaugaccaccgaggacaugcuauccgucuggaacaggguuuggauagaggaaaacccauggauggaagacaagacccacgugagcucaugggaggacgugcccuaccucggaaagcgcgaggaccaguggugcggcagccugaucggucugacggcacgggcgaccugggccaccaacauccagguggccaucaaucaggugcgucgguugaucggcaacgagaacuacuuagacuacaugacuucgaugaagcgcuucaagaacgagucugacccggagggggcccugugguaa

SEQ ID NO: 24717 - RNA, 9879 nt, Artificial Sequence
  derived and/or modified CDS sequence (opt11) from DENV-1__JQ915075__SS-prME
agcgugacaaugcuacucaugcugcugcccaccgugcucacauuccaucugacaacucggggcggggagccccacaugaucgugagcaagcaagagcggggcaaaagccuccucuucaagaccuccgccggggugaacauguguacccugaucgccauggaccugggcgaguugugcgacgacaccaugacuuauaagugcccccgcaucacugaaacagagcccgaugacguugacugcuggugcaacgcaaccgagaccugggucaccuaugggacgugcagccagaccggcgagcacagacgcgacaagcgguccguagcccuggcgccccacguaggccuggggcuagagacccgcaccgagacguggaugagcuccgagggcgccuggcggcagauccagaagguugagaccugggccuuacggcaccccggguucacagugauugcucuuuuccucgcccacgccaucggcaccucuaucacacagaagggaauuauuuucaucuuacugaugcucgucacaccauccauggcgaugcggugcgugggcauuggcaaccgcgacuucguggaggggcuuuccggcgcgacgugggucgacguggugcuggagcacggaucuugcgucaccacuauggcgaaggacaagccaacacuagacaucgagcuuuugaagacagagguuacaaaucccgccguccuccggaagcuguguauugaagccaagaucagcaauacgaccaccgauucccgcugccccacccagggcgaagccacgcuggucgaagagcaggauacaaauuucgugugccggaggacuuucguggaccgggggugggggaacggcugcggccuguuugguaaagggucacucauuacgugcgcgaaguucaagugcgccacgaagcuggagggcaagaucguucaguacgagaaccucaaguacagcgugaucgugaccguccauacaggcgaccagcaccaagugggaaaugagacuacagagcauggcacgaucgcaaccaucacaccccaggcccccacuagcgagauccaacuuacagauuacggggcccugacuuuggacuguagcccccggaccggccuggacuucaacgaaaugguccugcuuaccaugaaagagaaguccuggcuggugcacaagcagugguuccuugaccucccacugcccuggacgacaggggcguccacaagccaagagaccuggaaccggcaggaccuguuagugacguuuaagaccgcccacgccaagaaacaggaggucguggugcuuggcagccaggagggcgcgaugcacaccgcacugaccggagccaccgagauccagaccuccggcaccaccacgaucuuugccggacacuuaaaaugccgcuuaaagauggauaaguugaccuuaaagggaauuagcuacgucaugugcaccgggagcuucaaacuggagaaggagguggccgagacccagcacgggacaguucugguccaggugaaguaugagggcaccgacgcacccugcaagaucccguucagcucccaggaugaaaagggggugacccaaaacggccggcugguaaccgccaacccgaucgugacugauaaagaacgccccgugaacaucgaggcggagccgcccuucggcgagagcuacaucgucgugggcgccggcgagaaggcccucaagcugagcugguucaagaaagggagcuccaucggcaagauguucgaagccacagcacgcggggcaaggcgcauggccauucugggcgacaccgcaugggacuucgggagcaucggcggcguguucaccuccgucggaaaacucgugcaccagaucuuuggcacugccuacgggguacuguucagcggcgucuccuggacgaugaagaucgggaucggaauccuacucaccuggcugggccugaacagccggaguacaagccucucgaugacgugcaucgcugugggaaugguuacucuguaccugggcgucauggugcaggcugacagcgggugugugaucaacuggaaaggucgagagcugaagugcggcuccgguaucuuugucaccaacgaggugcacaccuggacugagcaguacaaguuccaggccgauagcccaaaacggcucagcgcagccaucggcaaggcgugggaggagggggugugcggcauccgcucggccacacggcuggagaacaucauguggaagcagauaagcaacgaguuaaaccacauuuuacuggagaacgacaugaaguucacggucguggugggggacgucucgggcaucuuagcccaggggaagaagacgaucaggccgcaacccauggagcacaaguauagcuggaaguccuggggcaaggccaagaucaucggggccgacguacagaacaccacguucauaaucgacggcccgaauacuccggagugccccgacgaccagcgggcguggaacaucugggagguggaagacuacggcuuugggaucuuuaccacgaacauauggcucaagcugcgcgauuccuacacucaggucugcgaccaccgucucauguccgccgccaucaaggacucaaaggcugugcacgcggacaugggcuacuggaucgaguccgagaagaacgagaccuggaagcuggcccgggcaagcuuuaucgaggugaagacuugcgucuggcccaagucccauacccuguggagcaacggcgugcuugaguccgaaaugaucaucccaaagaucuacgggggcccaauaagccagcacaacuaccgacccggguacuuuacucagaccgcgggcccguggcacuuggggaagcuggagcucgacuucgaccugugugagggcaccacgguggucguggacgagcacugcggcaaucgggggccaaguuugcgaacaaccaccgugacaggcaagaucauccacgaguggugcugccgcaguugcacauuaccgccccuucgguucaagggggaggacggguguugguacgggauggagauucgccccgucaaagagaaagaggagaaucuggugaaauccauggugagcgccgggagcggcgaggucgacucauucagccucgggcuucugugcaucagcaucaugaucgaggagguaaugcggagccgcuggucccggaagaugcuuaugaccggcacccuggugguguuccugcuccugacccuggggcagcucacguggaacgaccugauccguuuguguaucauggugggcgcgaacgcuagugacaacauggggaugggcacaaccuacuuggcccugauggccaccuucaggaugcggcccauguucgcagucgggcuccuauuucggcgucugacguccagggagguguugcuccugaccguagggcugagccucguugccuccguggagcugcccaacagcuuagacgagcuuggcgacgggcuggccauggggaucaugauccugaagcuccugaccgacuuucagucccaucagcucugggccacccuccugagccugacguuugugaaaaccacccucucccugcacuacgccuggaagaccauggcgaugauccugagcaucguaagccucuuuccccuaugccuuagcacgaccucccagaagacgacauggcuacccgugcuguugggcucgcucgguugcaagccacugaccauguuccugaucacggaaaacaagauuugggggagaaaguccuggccucucaacgaggggauuauggcagucggcaucgucagcauccugcugaguagccuccugaaaaacgacgugccccuggccgggccgcucaucgccgguggcauguugaucgccuguuacgucaucagcgggucgucggccgaccugaguuuagagaaggccgccaaagugagcugggaagaggaagccgagcacucaggagcgagccacaauauccugguggagauccaggacgacggcacaaugaagaucaaggacgaggagagagacgacacuauaacaauccuacucaaggcaacucugcuagccauauccggcguguaccccaugagcauacccgcgacccucuucgucuggcacuuuuggcagaagaagaagcaacgguccggggugcucugggacacccccagcccgccggagguggagaaggcgguccuggacgacggcaucuaccgcauccugcagcggggccuccuggggcgcucccaggugggagugggggucuuccaggagggaguauuccauaccauguggcacgugacgcgcggggccguccugauguaccagggaaagcgccucgagccgagcugggcguccguuaagaaagaccugaucagcuacggcggcggcuggagauuccagggguccuggaacaccggcgaggaggugcaggucauagccguggagcccgggaagaauccgaagaaugugcaaaccgcacccgggaucuucaagaccucugagggggaagucggggccaucgcccuggacuuuaagcccggcacguccgggaguccgaucgugaaucgagagggcaagaucgugggccuguacgggaacggcgucgugaccaccagcgggacauauguguccgcuaucgcccaggcuaaggcaucccaagagggcccgcugccggagaucgaggacgaggucuuccggaagaggaaccugaccauaauggaccuccauccuggguccggcaagacucgccgcuaccugcccgcgaucgugcgggaggcuauaaagcgcaagcuccggacccucgugcuggccccaacccgugucguagcuagcgagauggcggaggcgcugaaggguaugcccauccgguaccagacgaccgccgugaaguccgagcacaccgggaaagagauugucgaccucaugugccacgccaccuucacgaugcgucugcucagccccgugcgcgugcccaacuauaacaugaucaucauggaugaggcccacuucaccgacccugccucaauugcggcccgggguuacaucagcacacguguggggaugggugaagccgcggccauauuuaugacagcgacgccgcccggguccguggaggccuucccucagagcaaugcagugauccaagacgaggaaaaggacaucccugagcgcuccuggaauagcggcuacgacuggaucaccgacuuccccgguaaaaccgucugguucgugccgucgaucaagagcggaaacgacaucgcgaauugucuccgcaagaacggaaagcgggugauccagcugucccgcaagaccuucgacacggaguaccagaagaccaagaacaacgacugggacuacgucgugaccaccgacaucagcgagaugggggccaacuuccgggcggaccgcgucauugacccccggcgcugccugaagccggugauccuuaaggacgguccagagagagugaucuuagccgggcccaugccugucacgguugccuccgcggcgcagcgccggggccgaaucgggcggaaucagaacaaggagggcgaccaguacaucuacauggggcaaccgcugaacaacgacgaagaccacgcccacuggaccgaggccaagaugcugcuagacaauaucaacacccccgaggggauuauaccagcgcuguuugagccggaacgcgagaaauccgccgcaaucgacggcgaguaccggcuccgcggggaggcccggaagacuuuuguggagcugaugcggcggggcgaccugccggucuggcucuccuacaagguagcgagcgaaggcuuccaguacucggaccggcgcuggugcuucgauggagagcggaacaaccaggugcuggaggagaacauggacguagaaauauggacgaaggagggcgagcgcaagaagcugcggccccgcuggcuugacgcccggacguacuccgacccacuggcccuuagagaauuuaaggaguuugcggcugggcggcgcucgguguccagcgauuuaauccuggagaucggcaagcugccgcaacaccucacccagcgggcccagaaugcccuggauaaccugguuaugcuccauaauagugagcaaggggggaaggccuaccgccaugcgauggaggagcugccggacacgauugagaccaucaugcugcucgcccuaauugccguccuaacugggggggugacccuauuuuuccuaaguggccgggggcuagguaagaccuccaucggcuuacugugcgugaccaguucaagcgcucugcucuggauggcgaaugucgagccucacuggaucgcagccuccauuaucuuagaguucuuccucauggugcuccuuauccccgagcccgaccggcagaggacgccgcaggacaaccaguuggccuacguggucauaggucuccuguucaugauccucaccguggccgcuaacgaaaugggccuccuggaaaccaccaagaaggaucuggggaucggacauacggccgccgagaaccaccaccacgccgcgaugcucgacguggaccugcaccccgcuagcgccuggaccuuguacgccgucgccaccacaaucaucacgcccaugaugcgccacacaaucgagaauaccaccgcuaacauuuccuuaacugcaauggccaaccaggcggcuauccugauggggcuugauaagggcuggcccaucucuaagauggacaucggggugccccuccuggcccugggcuguuacagccagguaaacccccucacccugacagcggccguccuuaugcucguggcacauuaugccaucaucgguccugguuugcaggcgaaagccacccgggaggcccaaaagcgcacggccgccggcauuaugaaaaauccgaccguggacggcaucgucgcgaucgacuuagaccccguuguauacgacgccaaauuugaaaagcagcucggccagaucauguuacugauccucugcaccagccaaauccuacugaugcggacuacgugggcccucugcgaguccauaacccuggccacaggcccccugacuacgcucugggaggggagcccgggcaaguucuggaacaccaccaucgccguauccauggcgaacauauuccgcggaagcuaccuggccggcgcgggccuggcauucagccucaugaaaucccuggggggcggccgccgggguaccggggcacagggcgagacccugggcgaaaaguggaagcgccagcucaaccaguugagcaagucugaguucaacaccuacaaacggagcgggaucaucgagguugaccgcuccgaggcgcgggaaggccuaaaacgcggggagacaaccaaacacgcagugagccgggguacugccaagcuccguugguucgucgagcggaaccuggugaagccggaggggaaagugauagaccugggcuguggccgcgggggauggagcuauuacugugccgggcugaagaaagucacagaggugaagggcuacaccaagggcgggccaggccacgaggaacccaucccgauggccaccuacgguuggaaccucgugaagcugcacagcgguaaggacgucuucuucaucccgccggagaaaugcgacacucugcucugcgauaucggcgaguccagcccuaaccccacuaucgaggagggccggacccugcgcgugcugaagaugguggagcccuggcuccgggggaaucaguucugcauaaaaaucuuaaacccauacaugcccuccgucguggaaacccuggagcaaaugcaaaggaagcacgggggcaugcucgugcguaacccccugagccgcaacagcacgcacgagauguacuggguaagcugcgggacgggcaauaucgugagcgccgugaauaugaccagccggauguuacucaauagguuuaccauggcccaucggaagccgacguacgagcgcgaugucgaccugggggccggaacgcgccacguggcgguggaacccgaggucgcuaaccuggacaucaucggccagcggaucgaaaauaucaagaaugaacacaagagcacauggcacuacgacgaggauaacccguacaagacgugggcauaccacgggaguuacgaagugaagccuagcggcagcgccagcaguauggucaaugguguggugcgccuucugaccaagccgugggacguaaucccgauggucacacagaucgccaugacagacaccacccccuucggccagcagcggguguucaaggaaaaggucgacacgcgcacccccaaagcuaagcgggggacagcgcaaaucauggaggugacagcaaaguggcuguggggcuuccucagucgcaacaagaaaccaagaauuugcacacgggaggaauucacccguaaggugcgauccaacgccgcgaucggugccgucuucguugacgagaaccaguggaacucugccaaggaggccguggaggacgagcgguucugggaucugguucgccgggaacgcgaacugcacaagcaggggaaaugcgcgacgugcgucuacaacaugaugggcaagcgggagaagaagcucggggaguucggcaaggccaaggggucccgcgcgaucugguacauguggcugggcgcccgguucuuagaguucgaagcccucggcuucaugaaugaggaccacugguucagccgcgagaacucccugagcggaguggagggcgaggggcugcacaagcuuggcuacauccugcgagauaucuccaagauccccgggggcaacauguacgcggacgacacugccggcugggacacacguaucaccgaggaggacuugcagaacgaggcgaagaucaccgauauuauggagcccgagcacgcccuccuggccacaagcaucuucaaacugacguaccagaacaagguagugcgggugcagcgcccugccaagaacggaacagucauggauguuaucucccgccgggaccagcggggcagcggccaagugggaacuuacggccucaacaccuucacgaacauggaagcccagcugauaaggcagauggagucggaagguauuuucagccccuccgaacuggagacccccaaccuugcgggucguguccuggacuggcuggaaaagcacgggaucgaacggcuccgcaggauggccauaagcggcgacgauugugugguuaagcccaucgacgaccgauucgcuacggcccuuaccgcgcugaacgacauggggaagguccgaaaggauaucccgcaaugggaacccuccaagggcuggaaugauuggcaacaggucccauucugcagccaccacuuccaccaacucaucaugaaggacggccgcgagauaguuguucccugccggaaucaagacgaguugguugggcgcgcgcgaguaucucaaggcgccggguggucccugcgcgagacagccugccuuggaaaguccuaugcccaaauguggcaacuuauguacuuucacagacgcgaccuacggcucgccgcgaacgcaaucugcuccgcggucccugucgacugggugcccaccucgcgcaccaccugguccauccacgcccaccaucaauggaugacuacggaggauaugcugagcgucuggaaccgcguuuggaucgaggagaacccauggauggaggacaagacccaugugucgagcugggaggacguccccuacuuggggaaacgagaagaucaguggugcggcagucucauuggucugaccgcgcgagccaccugggccacgaacauucaaguugcaaucaaccaaguccgcaggcucaucgggaacgagaacuacuuggacuacaugaccagcaugaagcgguuuaagaacgaguccgacccggagggagcccugugguga

SEQ ID NO: 24718 - RNA, 9879 nt, Artificial Sequence
  derived and/or modified CDS sequence (opt11) from DENV-1__JQ915076__SS-prME
agcgugaccauguugcugaugcuacugcccaccguucugaccuuucaucugacuacccgcggcggagagccccacaugaucgugaguaagcaggagcggggcaaaagucuacuguucaagacuuccgcaggggugaauaugugcacccugaucgcaauggacuuaggcgagcucugcgacgacacuaugaccuacaaaugcccccgcaucacagagaccgaacccgacgaugucgacuguuggugcaacgcgacggagaccugggugaccuacgguacguguagccagaccggggagcaccgacgcgacaagcgguccguggcgcuagcaccccaugucggccugggacucgagaccaggaccgagacguggaugagcucagagggcgcuuggcggcagauccagaaggucgagaccugggcccugcgccaccccggguucaccgugaucgcccuguuucucgcccacgccauugguaccucaaucacgcagaaggggaucaucuucauccugcugaugcucgucacccccuccauggcuaugcgcugcgugggcaucggcaaccgcgauuucguggaggggcugagcggcgcgaccuggguugacgugguucuggaacacggguccugcgucaccacgauggccaaagacaagccgacccucgacaucgagcugcugaagaccgagguuaccaaccccgccgugcuccggaagcucugcaucgaggcaaagaucaguaauacgacgacagauucgcgcugcccgacccagggggaggccaccuuaguugaggagcaggacaccaacuucgugugucggcgcacguuuguggaccggggcuggggaaacgggugcggccucuucggcaaggggagccugaucacgugcgcgaaauuuaagugcgucacgaagcuggagggcaagauuguacaguacgagaaccucaaguacuccgucaucguuacugugcacacgggcgaccaacaccaggucggcaacgagaccaccgagcauggcacgaucgccaccaucacgccccaggcgcccaccagcgagauccagcugacggacuauggggccuugacccucgauugcagcccccggaccggacuggacuucaacgagauggugcugcucacuaugaaggagaagucuuggcugguucacaagcaaugguuccuggacuugccacugcccuggaccaccggugccucgacaagccaggagaccuggaaccggcaggaccugcucgucacguucaagaccgcgcacgccaagaagcaggagguggugguccugggcagccaggagggcgccaugcacaccgcacugaccggagccacggagauccagaccuccggcaccacgacgaucuucgcggggcaccucaaaugccgccugaagauggacaagcugacccucaaaggcaugagcuacgugaugugcacgggcuccuuuaaacuggagaaggaaguggccgagacucagcacgggacgguccugguacaggugaaguacgagggcacagacgcgcccuguaagauccccuucucuucccaggacgagaagggggugacccagaacggucggcuggugaccgcuaauccaaucgugaccgacaaagagaagccggucaacaucgaggccgaaccgcccuucggggagucauacaucguggugggcgcgggggagaaggcccucaagcuguccugguuuaagaagggguccuccaucggaaagauguucgaggccaccgcgcgcggugcgcggcgcauggccauccugggcgacacugccugggauuucggauccaucggaggcgucuuuaccuccguggggaagcugguccaccaaauuuucggcacggccuacgggguccuuuucagcggcguaucguggaccaugaagaucgggaucggcaucuuauugaccuggcugggccugaacagccgcucuaccagccuguccaugacaugcaucgccguugggauggucacccuguaccuaggugugaugguccaggcagacucggggugcgucaucaacuggaagggccgggaacucaagugcggauccggcaucuucgugaccaacgaggugcacaccuggaccgagcaguacaaguuucaggccgacagcccaaagcgccugagcgccgccaucggcaaggccugggaagaagggguaugcggcauucgcuccgcgacgcgccucgagaacaucauguggaagcaaaucagcaacgaacuaaaccacauacugcuggagaaugacaugaaguucaccguuguggucggggacgucagcgggauccucgcccaggggaagaagaccauccggccccaacccauggagcacaaguacagcuggaagucuuggggcaaggccaagaucaucggcgccgacgugcagaacaccacguuuauaauugacgggcccaacaccccugagugccccgacgaccagcgcgcguggaacaucugggagguggaggacuauggcuucgggaucuucaccaccaacaucuggcuuaagcugcgggacagcuacacccaggugugcgaccaccgccucauguccgcggccauuaaggacagcaaggccgugcacgccgacaugggcuauuggauugaguccgagaagaacgagaccuggaagcuggcgcgggccagcuucaucgaggucaagaccugcgucuggcccaagucccacacccuguggagcaacggcgugcucgaguccgagaugaucaucccgaagaucuacgggggcccgaucagccaacacaacuaccgccccggguacuucacgcagaccgccggccccuggcauuuagggaagcuagagcucgacuucgaccugugcgagggaaccaccgucgugguggacgagcacugcggccaccgggggccgucccugcguacaacuacggugaccggaaagaucauccaugaguggugcugccggagcugcacucugccgccccugcgcuucaagggggaggacgggugcugguacgggauggagauccggcccgugaaggaaaaggaggagaauuuaguuaagaguauggucagcgccggcagcggcgagguggacaguuucucccuaggucuacuaugcaucucaaucaugaucgaagaggugaugcgcagcagguggucccggaagaugcucaugacuggcacauuggucguguuccugcuccugacucuggggcagcucaccuggaacgaccugauucggcugugcauaauggucggcgccaacgcgagcgacaacaugggaaugggcacgacguaccucgcgcugauggccaccuuccgcaugcggccgauguucgccgucggccuccuuuucaggcgccugacaucccgggaggugcugcuccucacggucgggcugagccucgucgccaguguugagcuacccaacagccuugacgagcucggcgacgggcuggcgaugggcauaaugauccuuaagcuccugaccgacuuccaaucccaccagcugugggccacauugcugucacugacauucgucaagacuacccucucccugcacuacgccuggaagaccauggcaaugauucuguccaucgugucucuccuaccgcugugccucucuacgaccucccagaagaccaccuggcugcccgugcugcucggcagccuggguugcaagccgcugaccauguuucuaaucacggagaacaagaucuggggucgcaaauccuggccccuuaacgaggggaucauggcggucggcaucguuagcauacugcuaagcucccugcugaagaacgacgugccucucgccgggccccugaucgccggcggcaugcugaucgccugcuauguaaucagcggguccagcgccgaccucucucuggagaaggccgcuaagguaucaugggaggaggaggccgagcacuccggcgcgagccacaauauccugguggagauacaggacgacgggacuaugaagaucaaggacgaggagcgggacgacaccaucaccaucuugcugaaggcaacauuacucgcgaucuccggcgucuacccgaugagcaucccugccacccuguucguguggcacuucuggcagaagaagaagcaacgauccgggguacugugggacacccccagcccgccagagguagagaaggcgguacuggacgacggcaucuaccggauccuccagcguggccugcuggggcggucccaggugggugucggggucuuccaggagggcgucuuccacaccauguggcacgucacgcgcggcgccguuuuaauguaccagggcaagcggcuggagcccagcugggccuccguaaagaaagaccuaaucucuuacggcgggggcuggcgcuuccaaggguccuggaauacgggcgaggagguccagguuauugccguggagccggggaagaacccaaagaacguccaaaccgcccccggcacauucaagacgucugagggagaggugggggccaucgcccuugauuucaagcccgggaccuccgggagccccaucguaaaccgcgaggggaagaucgucggccuguaugggaacgggguggugaccaccagcgggaccuaugucuccgccaucgcucaggcuaagaccagucaggaggguccccugccggagaucgaggaugagguauuccguaaacggaaccucacaauaauggaccugcaccccgggucuggcaaaacacgucgguaccugccagccaucgugcgagaggccaucaagcggaaacuacgcacguuaguccuggcaccgacccgggugguggcuagcgagauggccgaagcccucaaggguaugcccauccgcuaccagaccaccgccgucaaguccgagcauacggggaaggagaucguagaccuuaugugucacgcgaccuucaccaugcgccugcucagcccugugcguguccccaacuacaacaugauuaucauggacgaggcccacuucaccgacccggccuccauagccgcccgcggcuacaucagcacgcgcguggggaugggcgaggcggccgcuaucuucaugaccgccacgccgcccggguccgucgaggccuucccccagagcaacgcggucauccaggacgaggagaaggacauuccggagcgcuccuggaacagcggcuacgacuggaucaccgacuucccaggcaagacggugugguucgugcccuccaucaaaagcggcaacgacaucgccaacugucugcggaagaacgguaagcgcgucauccagcugucacggaagaccuucgacaccgaguaccagaaaaccaagaacaacgacugggacuacguggucaccacagauaucucggagaugggggccaacuuccgcgccgaccgggugauagacccccgccggugccucaagccggugauacugaaggacggcccugagcgcgucauacuggccgggccgaugccagugaccguggcgagcgccgcccagcggcgcgggcggaucggccgcaaccagaacaaagagggggaccaguacgucuacaugggccagccgcuaaauaacgacgaggaccacgcccauuggaccgaggcgaagaugcugcuggacaacaucaacacgccugaagggaucaucccagcccucuucgaacccgagcgggagaaguccgccgcaauagauggcgaguaccgccugcgcggggaggcccgcaaaacauuugucgagcugaugcgccgcggagaccucccgguauggcugucuuacaagguggcgucggagggauuccaguacucggaccggcgauggugcuucgacggagagcgcaacaaucagguccuagaggagaauauggacguggagauuuggacgaaggagggcgagcggaagaagcucagaccccgguggcuggacgcccgcaccuacuccgacccccuggcgcuccgggaguucaaggaguucgccgccgggcgccguagcguguccggggaccugauccuggagaucggcaagcucccccagcaccugacccagcgcgcgcagaacgcccuggacaaccucgugaugcugcacaauagcgagcaggguggaaaggccuaucggcacgccauggaggaguugccggauacgaucgagaccaucaugcuccuggcgcugaucgcuguacucaccgggggcgucacccucuuuuuucuguccgggcgcggccucggaaagacgucaauagggcugcugugcguuaccuccagcuccgccuuacuguggauggccagcgucgagccucacuggaucgccgcgucuauaauccucgaguucuuccucaugguacuguuaauccccgagccggaccggcagcggacuccgcaggacaaccaacucgcguacguggugaucggacugcucuucaugauccuuaccgucgcugccaacgaaauggguuuacuggaaaccaccaagaaggaccugggaaucgggcacaccgccgcagagaaccaccaucacgcugccaugcuggacguggaucuucaccccgccagcgcuuggacccucuacgcagucgccacgacaaucauaacucccaugaugcgucacacgaucgagaauacgaccgccaacauaucccugacagcuaucgccaaccaggcagccaucuuaaugggacucgauaagggcuggccaaucagcaagauggacauuggggucccccugcuggcccucggcugcuacucccaaguuaaccccuuaacccugaccgccgccgugcucaugcugguggcgcacuacgccaucauagggcccggacugcaggcaaaggccacccgcgaggcgcagaagcggaccgccgcagggaucaugaagaaccccacaguggacggcaucguggccaucgacuuagaccccgucgucuacgacgccaaguucgagaagcagcucggacagaucaugcugcucauccugugcacgagccaaauacugcuuaugcgcaccaccugggcgcugugugaguccaucacccuggccacugggccccucaccacccucugggagggcagccccggcaaguucuggaacaccacgaucgccguuuccauggccaacauauuccggggcagcuaucuggccggcgcagggcucgccuucagccugaugaagucccugggaggggggcgcagggggacaggagcccagggggaaaccuuaggggagaaguggaaacggcagcuaaaucagcugagcaagucagaguucaacauuuauaagcgcagcggcaucaucgagguagaccgguccgaggccaaggaggggcucaagcgcggagagaccaccaagcacgcggugucacgggggacggcgaagcugcgcugguucgucgagcggaaccuggucaagccggagggcaaggugaucgaccugggcugcgggcgcggagggugguccuauuacugcgcuggccugaagaaggugaccgaagucaagggguacaccaagggcgggccugggcacgaggagccuauccccauggccaccuacggauggaaccuggugaagcugcacagcgggaaggacguguucuucaucccgcccgaaaaaugcgacacgcuccugugcgacaucggcgaguccagccccaaccccaccaucgaggagggacggacucugcgcgucuuaaagauggucgaaccaugguugcgggguaaucaguucuguaucaagauccugaaccccuauaugcccaguguugucgagacccucgagcagaugcagcgaaagcauggagguauguuagugcggaacccccugagucgcaacuccacccacgaaauguacuggguaagcugcgggaccgggaacauagucagugccguuaacaugaccagccggaugcuccugaaccgcuucaccauggcgcaccggaagccgacauacgagcgcgacguggaccugggcgccggcacacggcacguggccguggagccagaggucgccaaccucgauaucaucggccagcgcaucgagaacaucaagaacgaacacaagucuaccuggcacuacgacgaggacaaccccuacaagaccugggccuaccacggcuccuacgaggugaagccguccgguagcgcgagcuccauggucaauggcgucgugcgccuacugacaaaaccgugggacgucaucccgauggucacccagaucgccaugaccgacacaacgcccuucgggcaacagaggguguucaaggagaaaguggacacccgcacccccaaggccaagaggggcaccgcccagaucauggagguaacggcuaaguggcuaugggguuuccugagccgaaacaagaaaccgcggaucuguacccgcgaggaauucacgagaaaggugcgcuccaacgcggccaucggggcgguguucgucgaugagaaccaguggaacagcgccaaagaggccguagaggaugagcgguuuugggaucuggugcgacgggagagagagcuucacaagcagggcaagugcgcgaccugcguguacaauaugauggguaaacgggagaagaagcugggugaguucgggaaggcuaaaggcucccgcgcgaucugguacauguggcugggugcccgcuucuuggaguucgaagcguugggauucaugaacgaggaccacugguucagccgcgagaacagccuuagcggcguggagggggaagggcuccacaagcugggguacauacugcgggacaucaguaagauccccggcggcaacauguacgccgaugacacggcagggugggacacccgcaucaccgaagaggaucuccagaacgaggccaagaucaccgacaucauggagcccgagcacgcccugcuggcgacgagcauauucaagcugaccuaccagaauaaggugguccgggugcagcgcccggccaagaauggcacagugauggacguaaucucucggcgcgaccagcgcgggagcggccagguaggcaccuauggccugaacacauucaccaacauggaagcccagcugaucagacagauggaguccgagggcaucuucagccccuccgagcucgagaccccuaaccucgccgggagaguccuggauuggcuagagaagcauggcaucgagagacuucgucgaauggccaucagcggggacgacugcguggugaaacccaucgaugaccgcuucgccaccgcgcuuacggcacucaacgacaugggcaaggugagaaaggacaucccacagugggagccuuccaaggguuggaacgacuggcagcagguccccuucugcagccaccacuuccaucagcugaucaugaaggacggacgcgagauagugguucccugccggaaccaggacgagcuggucggccgcgcccgggugagccagggcgccggcuggucccuucgcgagacugcgugucugggcaagucuuacgcccagauguggcagcugauguacuuccaccggcgcgaccugcggcuggccgcaaacgcgaucugcuccgcggugccggucgacugggugccuaccucucgaaccaccuggagcauucacgcccaucaccaguggaugacaacugaggacauguuaagcguguggaaccgagucuggaucgaggagaaccccuggauggaggacaagacccacguguccagcugggaggaugugcccuaccucggcaagcgcgaggaccagugguguggcucccugaucgggcuaacggcacgggccacaugggccacuaacauccaggucgcgaucaaccagguucgccgccugaucggcaaugagaacuaucuagacuacaugaccagcaugaagcgguucaagaacgagagugauccagagggggcccugugguga

SEQ ID NO: 24719 - RNA, 9879 nt, Artificial Sequence
  derived and/or modified CDS sequence (opt11) from DENV-1__KF289072__SS-prME
agugugaccaugcugcucaugcugcuuccuaccgcccuggcuuuccaccugaccacgcgcggcggcgagccucacaugauagugagcaagcaagagcgaggcaagagccuccuguucaaaacaucugcggggguaaacaugugcacccuaauagccauggaccugggcgagcucugcgaggacacgaugaccuauaagugcccccgcaucacugaggccgagcccgaugacguggacugcuggugcaacgccaccgacaccugggugaccuacgggaccuguagccaaaccggcgagcaccguagagauaagcguuccguggcccuggcaccccaugugggccugggauuggaaacacgcaccgagaccuggaugagcuccgagggggcauggaggcagauccagaagguggaaaccugggccuugcgccaccccggguucaccgugaucgcacuauuccuagcgcacgccaucggcaccagcauuacgcaaaaggggauaauuuucauccugcugaugcucgugacgccuagcauggcaaugcggugugucggcauuggcaaccgcgacuucguugaaggccucagcggcgcuacguggguggacgucgugcuggaacacggcuccugcguaaccaccauggcuaagaauaagcccacccucgacauugaacugcuuaagacagaggucaccaaccccgcggugcugcggaagcuuugcaucgaggcaaaaaucagcaacacuaccacggacucucgcugcccuacccagggugaggcaacucuggucgaggaacaggacgccaacuucgucugccggcgcacuuucgucgaucggggauggggaaauggcugcggccucuucgguaaagggagcuuacugacgugcgccaaauucaagugcgugaccaagcucgagggcaagaucguccaauacgagaaccugaaguacuccgugauugugacaguucacacgggcgaucagcaucaggugggcaaugaaacaacugagcacggcaccaucgcuaccaucacgccacaagcgccuacgagcgagauccagcuaaccgacuacggggcccucacccucgacuguagcccgcgcaccggccuggauuucaacgagauggugcuccugacgaugaaagagaagagcugguugguccauaagcagugguuccuagaccugccgcugcccuggacuuccggggccagcaccagccaggagacuuggaaccggcaggaccuccugguuacguucaagaccgcccacgcgaagaaacaggaagucguggugcugggcucccaggagggcgcaaugcacaccgccuugaccggggccacggagauccaaacgaguggcaccaccaccaucuucgcagggcaccugaagugccgucugaagauggauaagcucacccugaagggcguuucguacguaaugugcaccggaagcuucaagcuggagaaagagguggcggaaacccagcacggcacgguccugguccaggugaaguacgaaggcacugacgcacccugcaagaucccaaucagcacccaggacgagaaaggggucacccagaacggccgucucaucacggcuaacccaaucgugaccgacaaggagaaaccugugaacauagagacugagccgcccuuuggcgaguccuacaucguaauaggcgcuggcgagaaggcacugaaguuauccugguucaagaaggggucuaguauaggcaaaauguucgaggcgaccgcucgcggcgccagacgcauggccauccucggcgacacggcgugggacuucgggucgaucggcggaguguucaccuccgucggcaaacuggugcaccagguguucggcaccgccuaugggguucuguuuagcggcgucagcuggaccaugaagaucgggauuggaaucuuacugacguggcugggccucaacagccgguccaccagccugucaaugaccuguaucgcuguggggaugguaacccuguaucucggcgugaugguacaggccgacagcgguugcguuaucaacuggaaggguagggagcugaaaugcggguccggaaucuucgucacaaacgaggugcacaccuggaccgaacaguacaaauuucaggcagacucuccgaagcgauugucagcggccaucggcaaggcaugggaggagggggugugcggcauccgguccgccacccgcuuggagaacaucauguggaagcagaucagcaacgagcugaaccacauccugcucgagaacgacaugaaguucaccgucgugguuggugacgcgaacggcauccugacucaggggaagaagaugauccgaccacagcccauggagcacaaguacuccuggaaguccuggggcaaggcaaagauaaucggggccgauacccagaacacgaccuuuaucaucgacgggccagacacgccugagugccccgacgaccaacgggcauggaacaucugggaagucgaggacuacgguuuugggguguucacgaccaacaucuggcugaagcucagagacuccuauacacaaaugugugaccaccgccugaugagcgccgcgaucaaggacucaaaggcggugcacgccgacaugggcuauuggauugagagcgagaagaacgaaacguggaaguuagcacgggccucguucauugaagucaagaccugcaucuggcccagaagccacacguuaugguccaacggcgugcuugagagcgagaugaucauccccaagaucuacgggggcccgaucucccagcauaacuaccggccggguuacuuuacccagaccgcgggacccuggcaucuagggaagcucgagcuggacuucaaccugugugaggggaccaccguggucguggaugagcacugcgggaacaggggucccagccucagaaccacgaccgugaccggcaagaucauccacgagugguguugccgcucaugcacuuugccgccacuacgguucaagggggaggacggaugcugguacgggauggagauccgccccgugaaggagaaggaggaaaaccucgugcggagcauggugucugccggcagcggcgagguugacucguucucccuggggcugcucuguguaagcauuaugauagaggaggugaugcggucucgguggucgcgcaagaugcugaugacggggacccuggccguuuucuucuuguuaauuauggggcaacugacuuggaacgaccuaauccgacugugcauaauggugggggccaacguguccgauaggaugggaaugggaacgacauaccuggcccuuauggcgacauucaagaugcgccccauguucgccgucggacugcucuuucggcgccuaaccucccgggaggugcugcugcuuacaaucgggcugucacuggucgccagcguggagcucccuaacucccuggaggagcuuggcgacggacucgcgauggguaucaugaugcugaagcugcucacugacuuccaaucacaucagcuguggaccacccuguuaucccugaccuucauaaagacgacgcugagccucgacuacgccuggaagaccauggcuauggugcuauccaucgucagccuguuccccuuaugccuauccaccacgucgcagaagacaaccugguuaccuguacuccugggcuccuuugggugcaagccguugaccauguucuuaauaaccgagaauaagaucuggggccgaaagagcuggccccugaacgaagggauaauggcgguuggcauagucagcauccugcucucaucucugcugaaaaacgacgugccccucgccgggccccugauagccggcgguaugcuuaucgcgugcuacguuaucuccgggucgucagccgaccucagccuggaacgggccgcggaggucucgugggaggaggaagcggagcacucgggcgccucccauaacauccugguggaggugcaggaugacggaacaaugaagauuaaggacgaagagcgcgacgacacccucaccauucugcugaaggccacucuccuggcaguaagcgggguguacccgaugucgauccccgccacgcuguucgugugguacuucuggcagaagaagaagcagcggucggggguccucugggacacccccagcccgcccgaggucgagagagcgguguuggacgacggcauuuaccggauccugcagagaggucuguuggggcguagccaaguaggcguggggguauuccaggacggagucuuucacacaauguggcacgugacacgcggggcggugcugauguaucaaggcaaacgucuggaacccuccugggccucagugaagaaggaccucauaaguuacggcgggggcuggcgcuuccaggggucguggaacacgggcgaagaaguccagguuaucgcuguugagcccgguaagaaccccaagaacguucagaccacccccgguaccuucaaaacaccggagggggccgugggcgcgaucgcguuagacuucaaacccggaaccuccggaagccccaucgucaaucgggagggcaagauaguuggccucuacgggaacggcguugucaccaccuccggaacguacguaagugcgaucgcucaggcaaaggccagccaagaggguccacuccccgagaucgaagacgaaguuuucaagaagagaaaccugaccaucauggaccuacaccccggguccggcaagacccgucgcuacuuaccagcgauaguccgggaggcgaucaagcgcaaguuaaggacccugauacucgcacccacgagggugguggcgagcgaaauggcggaggcacugaagggcaugcccauucgcuaucagaccaccgccgucaaauccgagcacacuggaaaggagaucguggauuuaaugugucacgcuacguuuaccaugcggcuucugucucccgugcgcgucccgaacuacaacaugaucauaauggacgaggcccacuucacugauccggcauccauagccgcgcggggcuauauuagcacccggguggguaugggugaagccgccgcgaucuucaugacggcuacgccacccggguccguggaagcuuucccacaaucgaacgcagugauccaggacgaggaacgggacauaccggagcgcuccuggaacaguggcuacgacuggaucaccgacuuccccggcaagaccgugugguuuguacccaguaucaaauccgguaacgacaucgccaacugccugcguaagaauggcaagcgcguaauucaguuaucccggaagacguuugacaccgaguaccagaagacgaagaacaacgauugggacuacguagugacgacggauaucucagagaugggugcgaacuuccgcgccgaucgggucaucgauccccgccggugccugaagccggugauccugaaggacggccccgaacgcguuauccucgccggcccaaugccagucaccgccgcguccgcggcccaacggcguggcaggaucggccgcaaccaaaacaaggagggggaccaguacaucuacaugggccagccacugaacaaugaugaggaccacgcgcacuggaccgaggccaagaugcugcuggacaacaucaacacccccgaggggaucauccccgcauuguucgaaccggagcgcgagaagucugcugccauugauggcgaguaccgguuacgaggggaggcccggaagacguuugucgagcucaugcgcagaggcgaucugcccguauggcuguccuacaagguagccucggaaggcuuccaguauuccgaccgccgguggugcuucgacggggagcguaacaaccaggugcucgaagagaacauggacguagaaauuuggaccaaggagggcgaacgcaagaaacugcgcccccgguggcuggacgcgcgcaccuacagcgacccccuugcacugagggaauuuaaggaguucgccgccgggcgccggucugugucgggcgaccugauccucgaaaucggcaagcuaccgcagcaccugacccuccgcgcucagaacgcguuggacaaucuggugauguuacacaauagcgagcagggcggaaaggccuaccggcacgcaauggaagagcugcccgacaccaucgagacguuaaugcuccuggcacugaucgcggucuuaaccggaggagugaccuuguucuuccuguccgggaagggccucggcaagacgagcaucgggcuccugugugugauggccuccucaguacuccuguggauggccucuguggagccucacuggaucgccgccagcaucauccuggaguucuucuuaauggugcugcugauacccgagccggaccgccaacggacgccccaggacaaccaacucgcguacgucguuaucggacuccuguucaugauccuaaccguggcggccaacgagauggggcugcuggagaccaccaaaaaggaccucgggauugggcacgucguggcugagaaccaccaccacgcuacgaugcuggacaucgaccuacaccccgcguccgccuggacccucuacgcaguggccaccacaaucauaacaccgaugaugcgccacaccauugagaacaccaccgccaacaucucacugacggcgaucgcuaaccaagccgccauccucaugggcuuagacaagggcuggcccauuuccaagauggacaucgggguaccgcugcuggcccuaggcugcuacucacagguaaacccccugacgcugaccgcggcugugcuaaugcuaguugcccacuacgcgaucaucggaccgggccugcaagcgaaggccacaagggaagcccagaagcgcacugcugcuggcaucaugaagaauccgacuguggacgguauaguggcaaucgaccucgaccccguuguguacgacgccaaguucgaaaagcagcucggccaaauaaugcuccucauccugugcaccucucagauccuguuaaugagaacuacaugggccuuaugcgagagcaucacgcuggcuaccggaccccugaccacucugugggagggcucccccgggagguucuggaacacuaccaucgcggucaguauggcgaacaucuuucgcggcuccuaccuggccggggccggguuggcauucucacugaugaagucccugggagggggacggcgcgggacuggcgcccagggagaaacgcugggugagaaguggaagaggcaguuaaaccagcugagcaagagcgaguucaauacauauaagcguucagguaucauggagguagaucggagcgaggccaaggaagggcucaagcgcggagagaccaccaagcaugccgugucccggggaacggcuaagcugaggugguucguggagcggaauuuggucaaacccgagggcaaggugaucgaccugggcugcgggcgcggcggguggagcuacuacugcgccggcuuaaagaaagugaccgaggucaagggauacaccaagggcggccccgggcacgaggagcccaucccaauggcgacuuacggcuggaauaucgugaagcugcacagcgggcgggacgucuucuucacgccgccagagaagugugacacgcugcuuugugacaucggcgaaucauccccgaacccgacgaucgaggaagggcgcacccuaaggguccugaagaugguggaacccuggcuccgcgggaaccaauucuguauuaaaaucuugaaucccuacaugcccucagugguugagacacuggagcagaugcagcggaagcauggggggaugcuggugcggaauccgcugucccggaacucuacgcacgagauguacugggugucaugcggcaccgguaacauaguuagcgcgguaaauaugaccucccgcaugcugcucaaccgcuuuaccaugacgcaccggaagcccaccuacgaacgcgacguagaccugggcgccgguacccgacacgucgccguugagcccgagaucgccaaccuggacauuaucggucagcgcaucgaaaauaucaagaacgagcacaagagcaccuggcacuacgacgaggauaacccguacaagacgugggcuuaccacggcuccuacgaggucaagccgucggguuccgccucauccauggugaacggcgugguacggcuccugacgaagccaugggacguuauucccauggugacccagauagccaugacagacacgacaccuuucgggcagcaaagggucuucaaagagaagguggauaccaggacgccgcguccuaagcggggcaccgcccaaaucauggaggucaccgccaaguggcuguggggauuccuuagccgcaacaagaagccccggauuuguacccgcgaggaauucacacgaaagguccgcucaaacgcugccaucggggccguguuuguggacgagaaccaguggaacagcgccaaggaggcgguggaagaugagcgguucugggaccuggugcaccgcgagcgggagcugcacaagcagggaaagugcgcgacgugcguguacaacaugaugggcaagcgcgaaaagaagcucggcgaguucgggaaagcgaaggguagccgggccaucugguacauguggcuuggcgcucgcuuccuggaguucgaagcguugggguuuaugaacgaggaccacugguuuucccgggagaacagccugucuggcgucgaaggugaggggcugcauaaguuaggguacauccugcgggacauaagcaaaaucccgggcggcaauauguacgccgaugacaccgccggcugggacacccgaaucacugaggacgaucugcagaacgaggcgaagaucacggauaucauggaacccgaacacgcccucuuagcgaccuccaucuucaaacucaccuaucagaacaagguggugcgcguccaaaggcccgccaagagcgguacggugauggacgugauaagucguagggaccagcgagggagcggccaggucggcacguaugggcugaacaccuucacgaacauggaggugcagcugauucgccagauggagagcgagggcaucuucagcccaucagagcuggagaacagcaaccucgccgaaagagucuuggauuggcuggagaagcacggugucgagcgccucaagagaauggccaucuccggcgacgacugcgucgugaaaccuaccgaugaccgcuucgccacugcccugacagcccugaacgacauggggaagguccggaaggacaucccccagugggagcccucaaagggcuggaacgauuggcagcaggucccauucugcucucaccacuuccaccagcucaucaugaaggacggucgcgagauaguggucccgugccgaaaccaggacgagcugguggggcgcgcucggguuucacaaggagcaggguggagccugagggagacagccugucuggguaaauccuacgcucagauguggcagcugauguacuuccaccggcgcgaccugcgucucgccgccaacgcgaucugcagcgccguccccguggacugggucccgaccucccgaaccacguggagcauccacgcgcaucaccaauggaugaccaccgaggauaugcugucugucuggaaucguguguggaucgaggagaacccuuggauggaagacaaaacccacguaucauccugggaagaugucccguaccuagggaagcgggaagaucagugguguggcagccuaauaggccugacggcucgcgccaccugggcaaccaauauccagguggcgaucaaccaggugcggagauugauugggaacgagaacuauuuggacuacaugaccagcaugaaacgguucaagaaugaaagcgacuccgaaggcgcccucugguga

SEQ ID NO: 24720 - RNA, 9879 nt, Artificial Sequence
  derived and/or modified CDS sequence (opt11) from DENV-1__JQ692085__SS-prME
agcguuacgaugcugcucauguuacugcccacugcacuggccuuccacuugacuaccagagggggggagccccauaugaucguaagcaagcaggaacggggcaagagcuuauuguucaagaccuccgcggggguuaauaugugcacccugaucgccauggaccugggcgagcuuugugaggacacuaugaccuauaaguguccccggaucacagaagccgagccagacgacgucgauugcuggugcaacgccacagacaccugggucacauaugggacguguagccagaccggagaacaccggcgcgacaagcggucgguggcgcuggcgccccacgugggccuuggacucgagacccguacugagacuuggaugucaucggaaggagccuggcggcagauccaaaagguggaaaccugggcccugcgacacccaggauucacggugauugcacuguucuuagcgcaugccaucggcaccagcaucacccaaaaggggauaaucuucauccugcugaugcucgugaccccuucaauggccaugaggugcgucggcaucggcaaucgcgacuucguggagggccucaguggcgccaccugggucgacgucguccuggaacauggguccugcgugacaaccauggccaaaaauaagccgacccucgacaucgagcugcugaagacggaaguaacaaaccccgcgguccuccgaaaacugugcauugaggcgaagaucucuaacaccacgacagacucccgcugcccaacccagggcgaggccaccuugguggaggagcaggacgcuaacuucgugugccgccggaccuucguggacagggguuggggaaauggcugugggcucuucgggaaggguagccugcugacaugugcgaaauucaaaugcgugacaaaacuagaaggcaagaucgugcaguaugagaaccuaaaauacagugugauugugacaguccauacaggugaccagcaccaaguagguaaugaaacgacugagcacggcacgaucgcgaccauaacgccccaggccccgaccucugagauccagcuuacugacuauggggcucucacucuggacuguuccccccggaccgguuuagauuuuaaugagauggugcuccugacgaugaaggagaaguccuggcuggugcacaaacagugguuuuuggaccuuccucugccguggaccucuggugccagcaccagccaagagaccuggaaccgccaggaucuccuggugacguucaagacugcccacgcgaagaagcaggaggucgugguacugggcagucaagagggagccaugcacaccgcguugaccggcgccacggagauucagacgagcggcaccaccacuaucuuugccgggcaccugaagugccgcuuaaagauggauaaacucacccuaaagggcguaucuuacguuaugugcacgggcagcuucaagcuagagaaggagguagcggagacacagcacgggacgguccugguccaggugaaguaugagggcacggacgcccccugcaagauccccauauccacccaggaugaaaaaggggucacccaaaacggccgguuaauaacugcgaauccgaucgugaccgacaaggagaagcccguuaacauagaaaccgagccucccuuuggggaaucguacauugucauaggcgcuggcgaaaaggcacuaaaacugucgugguuuaagaaggggagcuccaucgggaaaauguucgaggccaccgcccgcggagcccggaggauggccauccuuggagacaccgcgugggacuuugggagcauaggaggaguuuucacaaguguaggaaagcugguacaucaaguguucgguaccgcguacggggugcuguucucaggcgugucguggaccaugaagauugggauaggcauccuccugacguggcugggccucaacucccgcucaaccagccuguccaugaccugcauagcggucgggauggugacucucuaccuaggcgucauggugcaggccgacucugggugcgugaucaauuggaaggggagggagcugaaguguggcagugggaucuucgucacaaacgagguacacacuuggaccgaacaguauaaguuccaggcagacagcccaaagcgccugagcgcagcaaucgguaaggcaugggaggagggggugugcggcauacgguccgccacgaggcucgaaaauaucauguggaaacagaucucaaacgaguugaaccacauccugcuagaaaacgacaugaaguucacggugguggucggggaugccaacggcauccucacucaaggaaagaagaugauccggccccagcccauggagcacaaauauagcuggaagaguuggggcaaggcgaaaauaaucggcgccgauacgcaaaacacaaccuucauuaucgacggccccgacacgccggagugccccgacgaccaaagagccuggaauaucugggaggucgaggacuacgguuucgguguauuuacaacaaacaucugguugaagcuccgggauuccuacacccaaaugugcgaucaucgccugaugagcgccgccaucaaggacucaaaagccgugcaugccgacaugggguacuggauagagagcgagaagaacgagacuuggaagcuggcucgggcguccuuuaucgagguaaagacuugcaucuggccccggagccacacccucugguccaauggugugcuggagagcgagaugaucauuccuaagauauacgggggcccgaucucccagcacaacuacaggcccggguacuucacccagacggcgggccccuggcaccucgggaagcucgaacuggacuucaaccugugcgaaggcacgaccguaguaguggacgagcacugcggcaaucgugguccuagcuuacggaccacgacgguaacaggcaagaucauccacgaauggugcugccgcucgugcacccugcccccccuccgguuuaggggggaggacgguugcugguaugguauggagauaagaccagugaaagagaaggaggaaaaccucguccguucgaugguguccgcuggcucgggagaggucgauagcuucagccugggguugcugugcgugagcauuaugaucgaggaagugaugcggagcagguggagccggaaaaugcugaugacgggcacucuugcggucuucuucuuacuaauuauggggcagcugaccuggaacgaccugauacggcuguguauaauggugggcgccaacgucuccgaucggauggguaugggcaccaccuaucuggcccuuauggcgaccuucaagaugcggccgauguuugccguggggcuucuguuccgacgguuaaccagccgugaaguguuauuacuaaccaucggguuauccuugguugcaucaguggagcucccaaacucgcucgaagagcugggcgaugggcuagccaugggaauuaugaugcugaaguugcuaacggauuuccagagccaucagcuguggaccacccugcuauccuuaaccuucaucaagacgacccuuagccuugacuacgcguggaaaaccauggcgaugguucugucgauaguuagccuguuucccuugugccuguccaccacaagccagaaaacgaccuggcuaccagugcuccuuggcuccuuuggcugcaagccguuaacaauguuccucaucaccgagaacaagaucuggggccgaaagucguggcccuugaacgaaggaaucauggcgguugggauuguuuccaucuuacucucuagcuuacugaagaaugacgugccccucgccgguccccugaucgcuggcggcaugcugaucgcaugcuacgugauauccgggagcuccgcggacuugagucuggagcgcgccgcagaggucuccugggaggaagaagcggaacauagcggagcgucccacaacauccuggucgaggugcaggacgacgggacgaugaagauuaaagaugaggaacgagaugacacccucacuauucugcugaaggccaccuuacuggccgugagcgggguuuacccaauguccauucccgcuacgcuguucgucugguacuuuuggcagaagaagaagcagcgcagcggcguccucugggauacgccaaguccuccggagguugagcgggccgugcuagaugacggcaucuaccgcauccuacagcgcggccugcucggacgaagccaggucgggguggggguuuuucaagacgguguuuuccauaccauguggcacguuacaaggggcgcgguucugauguaccagggcaagcgccucgagcccucgugggccagcgucaagaaagacuuaauauccuacggggguggcuggcgguuucaaggcagcuggaacacgggagaggagguccaggucaucgccguggagcccgggaaaaaucccaaaaaugugcagaccacccccggaacauucaaaacaccugagggcgcugugggcgccaucgccuuggacuuuaagcccggcacaucaggaagucccaucguuaaccgcgagggcaagauagugggccuauacgggaauggggucguuacaaccuccggcacauacguaagcgccauugcccaggccaaggcgucgcaggaaggcccgcuacccgagauugaagacgagguguuuaaaaagcgaaacuugaccaucauggaucugcauccagggucaggaaaaacccgucgguaccucccggccaucguccgcgaggccaucaaacgcaaacugcggacacugaucuuggcccccacgcgcguuguugccagcgagauggcggaagcucugaagggaaugcccauacgguaucagaccaccgcagucaagucugaacacaccgguaaagagauuguggaccucaugugccaugccacguucaccaugcgccuccuuagucccgugcgggugccgaauuacaacaugaucaucauggaugaggcacacuucaccgaucccgcgucgaucgccgcccgugguuacaucaguaccagaguagggaugggggaggccgccgcaaucuuuaugacagccacgccccccgggucgguagaggccuuuccgcaaucaaacgcggucauucaagacgaagagcgagacaucccagagagauccuggaacuccgguuaugacuggaucaccgacuuccccggcaagacggugugguucguuccauccaucaagucuggcaacgacaucgccaacugucugcgcaagaacgguaaacgugugauccagcucucgcgcaagacguuugacaccgaauaucaaaagaccaagaacaacgauugggacuacgugguuacaaccgacauaucagagaugggggcgaauuucagggccgaucgggugaucgacccgcggcgcugccucaagcccgucauccuaaaggacggccccgagcggguaauacucgccggucccaugccggugaccgccgcgagcgccgcccagcgccgggggcgcaucgggcggaaucagaacaaggaaggggaucaguacauuuauauggggcaaccccugaacaacgaugaggaccacgcgcauuggacagaggcgaagaugcugcucgacaauaucaacacccccgaggggauuaucccggcgcucuucgaaccugaacgugaaaaaucagcugccaucgauggcgaauaccgccuccgcggggaggcccgcaagacuuucgucgagcucaugcggcggggagaccugccuguuuggcugucauauaagguggcuagcgagggguuccaguacucagaccggagauggugcuuugacggggaacgaaacaaccaggugcuagaggagaacauggacguugagauuuggacaaaggagggcgagcgcaaaaaacugcggccacgcuggcuggacgcgcggaccuacagcgauccccucgcucuccgcgaguucaaggaauucgccgccggacggcguucuguauccggugaccuaauccucgagaucgggaaacugccgcagcaccugacauugcgggcccagaacgcauuagacaaccuggugaugcuucacaauagcgagcaggguggcaaggcauaccgccaugccauggaggagcugccggacaccaucgagacacugauguuauuagcccugauagcuguccuaaccgggggcgucacucuguucuuccuguccgggaaagggcucggcaagaccagcauagggcucuuaugugugauggccuccagcgucuugcuguggauggcaagcguggagccccauuggauagcugccagcauaauacuggaguucuuccucaugguccugcuaauccccgagccggaccggcagcgcacaccccaggacaaucagcucgcuuacguugucaucggccuucucuucaugauucucaccguggccgccaacgagaugggacugcuggaaaccacaaagaaagacuugggaaucgggcacguaguggcugaaaaccaccaccacgccacaauguuagacaucgaccugcacccggcguccgccuggacccuguaugccguggccacaaccauuauaaccccaaugaugcggcacaccaucgaaaauacgaccgccaauauaagucugacggcgauagccaaucaggcggccauccugaugggccucgacaagggguggcccaucucgaagauggacauugggguuccgcugcuugcccucggaugcuacagccaagugaacccucugaccuugaccgcggcugugcugaugcucgucgcacacuacgcgauuaucggcccgggccuccaggcgaaggccacccgugaggcccaaaagcgcacggccgcuggcaucaugaagaaccccaccgucgacggcaucguggcuaucgaccucgaccccgugguguaugacgccaaguuugagaagcagcugggccagaucaugcugcuuauccuauguaccucccagauccuguugaugcggaccacgugggcguuaugcgaaucaaucaccuuggcuaccgggccccuaacaacccugugggagggcuccccuggucguuuuuggaauaccacaaucgcgguuucgauggcuaacaucuuccguggcuccuacuuggccggcgccgggcucgccuucagccugaugaagucccugggcggggggagacgggggaccggcgcccagggagaaacgcuuggagaaaaguggaagcgccagcugaaccagcugucuaagagcgaguucaauaccuacaagcggucuggcauuauggaggucgaucggagugaggcuaaagagggacucaagcggggcgagaccaccaaacacgcagugucccgggggacggcuaagcugcggugguucguggagcgcaaccugguaaaaccagaggggaaggugauugacuugggcuguggccggggaggguggaguuacuacugugcaggccuuaagaaaguuacagaggucaaggguuacaccaagggcgggcccggucaugaggagcccaucccuauggcgacauacggcuggaacaucgugaaacuucacuccgggcgagacguguucuucacgccgccugagaagugcgacacgcugcucugcgacauuggcgaaagcucaccaaauccgaccaucgaggaagggcggacccuccgcguucugaagauggucgagcccuggcuccgcggcaaccaguuuugcaucaaaauccugaauccauacaugcccagcguugucgagacccuagagcagaugcagcggaagcauggcgggaugcugguucggaacccgcugagccgaaacucaacccacgagauguacuggguuucgugcgguacugggaacaucgucagcgccgugaacaugacgucccgcaugcugcucaaccguuucacgaugacucaucggaagcccaccuaugagagggaugucgaucucggcgccgggacacggcaugucgccguggaaccggagaucgcuaaccuugauauaaucgggcaacggauagagaauaucaagaacgaacacaaguccaccuggcacuacgacgaagacaacccuuauaagacaugggcauaccacgguuccuacgaaguuaagccgucaggcagcgcgucguccauggucaaugggguagucaggcucuuaacaaagcccugggaugucauuccgaugguuacccagauagccaugaccgacacuacccccuuuggacagcagcgggucuucaaggagaaaguggacaccagaaccccgcggccaaaacgugggacugcgcagaucauggagguaaccgccaaguggcuguggggguuccuaagccggaacaagaagccccgaauuuguaccagagaggaguucacacgcaagguucggagcaaugcggccgugggcgcaguauucguugacgaaaaccaguggaauagcgcaaaggaggccguggaggacgagcgcuucugggacuuaguacaccgagaaagggagcuccauaagcagggcaagugcgcaacgugugucuacaacaugauggggaagcgggagaaaaagcucggcgaguucgggaaggccaagggcagcagggccaucugguacauguggcucggcgcgagguuccuagaguucgaagcacucggguuuaugaacgaagaucauugguucucgcgcgaaaauucacuguccggcguagagggagaaggccuccauaaguuaggcuacauacugcgcgacauuaguaagaucccuggcggcaacauguacgcggacgacaccgcagggugggacacccgcauaaccgaggaugaccugcaaaaugaggccaagaucaccgacauuauggagcccgagcacgcacuccuggcgaccaguauuuucaagcugaccuaccaaaacaagguagucagggugcagcggcccgcaaagucaggcaccgugauggacguuauuuccagacgggaccaacgcgggagcggccaaguagguacuuacggcuuaaacacauucacaaacauggaggugcagcugauacgacaaauggagucggaagguauuuuuagccccaaugaacucgaaaacuccaaccucgcagagcggguguuagacugguuagagaagcaugggguggagcgucuuaaaaggauggcgaucagcggugaugacugcgucgucaagccgacugaugaccgguucgcgaccgcuuuaaccgcccucaacgauaugggaaagguccgcaaggauaucccccagugggaacccuccaaaggcuggaacgacuggcagcaggucccuuucugcagccaccacuuucaccagcucaucaugaaagacggccgggaaauagugguccccugucgcaaccaggaugaacugguggggcgagcccgcgugucccagggagcgggguggucgcugagggagacagcaugucuggguaaaagcuacgcucagauguggcaacugauguacuuccaccgcagagacuuacgguuagcugcuaaugccaucugcucagccguccccguggauugggugccgacgagccgcaccaccugguccauccaugcacaccaccaguggaugacgacggaggacaugcugucuguuuggaaucggguauggaucgaggaaaaccccuggauggaagacaagacccacgucucgagcugggaagaugugccguaccuagggaaaagggaggaucaaugguguggcucccucauuggccugacggcacgggccaccugggcgacaaauauucagguggcaaucaaccaaguacggcgacucaucgggaacgagaauuauuuggauuacaugacgagcaugaagcgcuucaagaacgagagugacuccgagggagcccugugguga

SEQ ID NO: 24721 - RNA, 9879 nt, Artificial Sequence
  derived and/or modified CDS sequence (opt11) from DENV-1__JQ917404__SS-prME
agcguuaccaugcuucucaugcugcuacccacugcccucgccuuccaccuuaccaccaggggcggggaaccccacaugaucgugagcaaacaggaacggggcaagagccucuuauucaaaaccuccgcgggggugaacaugugcaccuuaaucgccauggaccugggcgagcucugcgaggacaccaugaccuauaaguguccgcggaucaccgaggccgagcccgaugacgucgacugcugguguaaugccaccgacaccugggucaccuacgggaccugcagccaaaccggggagcaccgucgcgacaagcgguccguugccuuggcaccucacguaggccuagggcucgagacucgcaccgagaccuggaugagcuccgagggcgccuggcggcagauccagaagguugagaccugggcccugcgccacccgggguuuacgguaaucgcccucuuccucgcccacgcuaucggcacgagcaucacccagaaggggaucaucuucauauuauuaaugcucguaaccccauccauggccaugcgaugcgucggcauugggaacagggauuucguggagggccuuucgggcgccacguggguggacgucguccuggagcacggguccugcguuaccaccauggcgaagaacaagcccacccucgacauugagcugcucaaaacggaggucaccaaccccgcggugcuacggaagcuaugcaucgaagccaaaauaagcaacacgaccacggacucccggugccccacucaaggugaggccacccugguggaggagcaagacgcgaacuucgugugccggcggaccuucguggaccggggcuggggaaaugggugcggucucuucggcaaggggagccugcugacaugcgccaaguucaagugcguaaccaagcucgaaggcaaaauagugcaguacgaaaacuuaaaauacucugugaucguuaccguccacaccggcgaccagcaucagguggggaaugagacgaccgagcacgguaccaucgcgaccaucacgccgcaagcgcccacgagcgagauucaacugaccgacuacggggcccucacgcuggacugcucgccccggaccggccuagauuucaacgaaaugguccuccugacgaugaaggaaaagagcugguuaguccacaaacaaugguucuuggaccugccguuacccuggaccagcggggcgagcaccucacaggagacuuggaaccgucaggaccuccucguaaccuuuaagacagcccaugcgaaaaagcaggagguaguggugcuuggcucgcaagaaggagcgaugcacacugcgcucaccggggccacagagauccagacuucugggaccacuacgaucuucgcggggcacuugaagugcagacugaagauggauaagcucacccugaaaggcgucucuuacguuaugugcaccgguuccuucaaacuggagaaagagguugcggagacucagcacggcacggugcuaguucaagugaaguacgagggaaccgacgcacccugcaagauccccaucuccacgcaggacgaaaagggggucacccagaacggucggcucaucacagccaacccgaucguuacugacaaggagaagcccgugaacaucgagaccgagcccccuuucggcgaaagcuacaucgucaucggcgccggggagaaggcacugaaacuguccugguucaagaaggggagcuccauaggaaagauguuugaggcaacggcccggggagcccgacgaauggccauucucggcgauacggcgugggacuucgggucaaucggggguguguucacaucaguggggaaacugguucaccagguguucggcacggcauacggggugcuguuuagcggcgucuccuggaccaugaagauugggauaggcauccucuugacguggcuggggcucaacucucgcucuaccagccugaguaugaccugcaucgccguagggaugguuacccuguaccucggcgucaugguucaggccgacagcgggugcguuaucaauuggaagggacgggaacugaagugcggauccgggaucuucgucacgaaugaggugcauacauggaccgaacaguauaaauuucaagccgauucaccgaagaggcucucggcggccaucggcaaagccugggaggaggguguguguggcauucgguccgccacucgccuugagaauauaauguggaagcagaucagcaacgaacugaaccacauccugcucgagaaugauaugaaguucaccgucguggucggggacgccaacggaauacugacacaggggaagaaaaugauucggccccagccuauggaacacaaguacuccuggaagucguggggcaaagcuaagauuauuggcgccgauacccagaacaccacauuuaucauugaugggcccgauacgccggaaugucccgaugaccagcgcgccuggaauaucugggaggucgaggacuacggauucgggguguucaccaccaacaucuggcugaagcuccgagacuccuacacccagaugugcgaccaccgucugaugagcgcggccauaaaggacuccaaggccgugcaugccgacaugggcuauuggaucgagagcgaaaagaacgagacuuggaaacuggcccgggccagcuucaucgaggucaagaccuguaucuggccucgcucacacaccuuguggucaaacggcguucuagagagcgagaugauuaucccgaagauuuacggcggcccuaucucccagcacaauuaucgucccggguacuucacccagacggcgggucccuggcaccuggggaagcuagagcucgacuucaaucugugcgagggcacaaccguggucguggaugagcauuguggcaaccgcggcccaagccuccgcacaacgaccgugaccgguaaaaucauccacgagugguguugccgcuccugcacccugccaccccugcgauuccgcggggaagacggcugcugguacgggauggagauccggccugucaaggagaaagaggaaaaccucguucgcagcaugguguccgccggcagcggcgaggucgacagcuuuagucuggggcugcucuguguguccaucaugaucgaggaggugaugcggucccgcuggagccgcaagaugcugaugacgggcacgcuggccguauuuuuccuacuaauaaugggccagcuaaccuggaacgauuuaauucggcuuugcaucauggugggcgcuaauguguccgaucggauggggaugggaacaacguaucuagcccucauggcgaccuucaagaugagacccauguucgccgucggguugcucuuucgccggcucaccagccgcgaagugcugcugcucaccaucgggcugucgcugguagcgagcguggagcucccaaacucccuggaggaacugggggacgggcucgccaugggcaucaugaugcugaagcugcucacagauuuucaaucgcaccagcuguggacgacccugcucuccuuaaccuucauuaagacgacgcugagccuagacuacgcguggaagacgauggcgauggugcuguccauugucucccucuuccccuugugccuguccaccacgucccaaaagaccaccugguuacccgugcuacugggcuccuucgguugcaagccucugaccauguuccuaaucaccgaaaauaagauauggggccgcaaaucuuggcccuuaaacgaggggauuauggccgugggcaucgucuccauucuucucucaucccuucuaaagaacgacgugccccucgccgggccacugauugccggcggcaugcugauugcgugcuacgugaucuccgggagcuccgcugaucucagccucgagcgcgcggccgaggucucuugggaggaggaagccgagcacucgggcgcgagucacaacauacugguggaggugcaggaugacggaacuaugaagauuaaggacgaagaaagggacgacacccucacaauccugcugaaggccacccuccuggccguuucaggcguguacccaaugucuaucccagccacacucuucgugugguacuucuggcaaaagaagaagcagcgcagcgggguccucugggauacacccucaccgcccgagguggagcgggccguacuugaugaugggaucuaccgcauucugcagcgggggcugcucggccggagccaggucggcgugggugucuuccaggacggcgucuuccacaccauguggcacguuacccgcggggccguguugauguaccagggcaagcggcuggagcccuccugggcuagcgucaagaaagaccucauuuccuacggagggggcuggagauuccagggcagcuggaacacgggggaggagguacaagugaucgcaguagaaccugggaagaauccgaagaacgugcagaccacccccggcacuuucaagacccccgagggcgaggugggugcaaucgcccuggacuucaaacccggcaccuccgggucacccaucgucaaccgcgaggggaagauagugggccuguaugggaacgggguggugaccaccuccgggaccuaugucuccgcgaucgcccaggccaaggccagccaggagggcccacuacccgagaucgaagacgagguguuuaagaagcggaaccugaccaucauggaucugcaccccgguagcggcaagaccaggcguuauuuaccugccaucguccgugaggcgauaaaaagaaagcugcgcacccugauacucgcccccacgcgcgugguugcuagcgagauggccgaagcacugaagggcaugcccaucagguaccagaccaccgccguaaaaucggaacacacaggaaaggagaucguggaccugaugugccacgcgacuuucacaaugcgccuccugagucccgugaggguuccaaacuacaacaugaucaucauggaugaagcccauuucaccgaccccgccuccaucgcugcccguggcuacaucagcacccggguugggaugggcgaggccgccgcgauauuuaugacagcgacgccgcccggguccgucgaggccuucccgcaaagcaacgccgugauacaagacgaagaacgggauauccccgagcgcuccuggaacagcggcuacgacuggauuacugacuuccccggcaagacaguaugguucgugcccuccauaaaaucagggaacgauauugccaauugucugcgcaagaauggcaagcgggucauacagcuuucccgcaaaacguucgacacagaguaccaaaagaccaagaauaacgacugggacuacgugguuaccacggauaucagcgagaugggggccaacuuccgggcggacagagucauagauccgcggcgcugccugaaaccaguaauccucaaggauggcccggaacggguaauccucgccgggccaaugccugugaccgccgccuccgcagcgcagcgccggggccgcaucggccguaaccagaacaaggagggggaccaguacaucuacaugggccagccucugaacaacgacgaggaccacgcccauuggacagaggccaaaaugcugcuugacaauauuaacacccccgaggggaucauucccgcccuguucgagccggagcgcgaaaaguccgcggcgauugauggcgaguaccgccuucgcggggaagcccgcaagacuuucguagaguuaaugcggcgcggcgacuuacccgucuggcuguccuacaaaguggccagcgaaggcuuucaguacuccgaccgacguuggugcuucgacggggagcggaacaaccagguucucgaagagaauauggacgucgagauuuggacacgcgagggcgagcggaagaagcugcgcccccgcugguuggacgcccgcaccuacucugacccucucgcucugcgggaguucaaggaguuugcugccgggcgccggucuguuuccggagaccugauccucgagauugguaagcugccacagcaccugacccucagagcccagaacgcccuugacaaccuggugaugcuccacaacagcgaacagggcgggaaggcguaccggcacgccauggaggaacugccugacaccaucgagacgcugaugcuccuggcgcugaucgccguccuaaccggaggggugacccucuuuuuccuguccgggaaggggcuaggcaagaccagcaucgggcugcuuugcgugauggccuccagcguccugcuguggauggcguccguggagccgcacuggaucgccgccagcaucauacuggaauuuuuccucaugguacugcugaucccggagccugaccgccagcggacgccccaggacaaucaacuugccuacgucgucaucggccugcuguucaugauccucaccguggcagccaacgagaugggccuccuggagaccaccaagaaggacuuaggcaucgggcacgucguggccgaaaaccaucaccacgccacgaugcucgacaucgaucugcaccccgcguccgcguggacccucuaugccguggccaccaccauuaucacgccaaugaugcgccacaccaucgagaacacuaccgccaauaucucccugacggccaucgcgaaccaggccgccauauuaaugggccuagacaagggcuggcccaucagcaagauggacaucggggugccccugcuggcccuaggcugcuauagccaggucaacccccugacccuuaccgccgcaguucucaugcuggucgcucauuacgccauaauuggaccgggacuacaggccaaggcgacacgcgaggcgcagaaacggacugccgcgggaaucaugaaaaaccccacugucgacggcauuguggccaucgaccuagaccccgucguguacgaugcgaaguucgagaagcagcuggggcaaaucaugcugcuuauauuauguaccucacagauccuacugaugcgcaccacgugggcccuaugugaaagcauuacgcuggcuaccgggccacucacgacgcugugggaaggcucccccgggcgguucuggaauaccaccaucgcuguuagcauggccaacaucuuccgcggcuccuacuuagcgggcgcagggcucgccuucagucugaugaagucccucggcggagggcgucgcgggacuggagcgcaaggcgagacguuaggugagaaguggaaacgucagcugaaccagcugagcaaaagcgaguucaacacauacaagcgcuccggcaucauggaaguggacaggagcgaggcgaaagaggggcucaagcgcggagagacgaccaagcacgcggugucccgggggacggcgaaacugcgaugguucguggaacggaaccuggucaagcccgaaggcaagguuaucgaccugggcugcgggcgcggcggauggagcuacuauugcgcgggccuuaagaaggugacagaagucaagggguauaccaagggcggccccggccacgaggagcccaucccgauggcgaccuacggcuggaacauagugaaacuucacagcgggcgcgauguguuuuucacgcccccggagaagugugacacguuacuuugcgacaucggagagucgucacccaacccgaccaucgaagaggggcgcacgcuacggguauugaagaugguggagcccuggcuccgcggcaaccaguucugcaucaaaauccugaacccauacaugccgagcguggucgaaacacuggagcagaugcagcggaagcauggugguaugcucguacgaaacccgcuuucacgaaacagcacucacgaaauguacugggugagcugcggcacagggaacaucgucuccgcugugaacaugacaucccggaugcugcuaaaccgcuucaccauggcccacagaaagcccacuuaugagcgugacguggacuuaggggcaggcacacggcacgucgccguggaacccgagaucgccaaucuggauaucaucgggcaacgcauagagaacaucaaaaacgaacacaagagcacguggcacuacgacgaggacaaccccuacaagaccugggcauaccacggcucauacgaggugaaaccgagcgggucagccagcaguauggugaaugguguaguccggcuauuaacgaagccaugggacgugauucccauggugacccaaaucgccaugaccgacaccacgcccuucgggcagcagcgcgucuucaaagagaagguugacaccaggacuccccgccccaaacggggcacugcccagauaauggaagugacggccaaauggcuguggggcuuccucagccgcaacaagaaaccucggaucuguacccgcgaggaguucacccguaaggucaggagcaacgcggcuaucggggccguuuuuguggaugagaaccaguggaacuccgcgaaggaggcagucgaagacgagcgguucugggaccugguccaccgcgaacgggagcugcacaagcaggggaaaugugcgaccuguguguacaacaugaugggcaaacgggagaagaaacuuggcgaguuugggaaggccaaggggagccgggccaucugguacauguggcugggagccagauuccuggaauuugaggcgcuagguuucaugaacgaggaccauugguucucccgcgagaacagccuguccgggguagaaggggagggacugcacaagcucgguuauauccugcgggacaucagcaagaucccaggcggcaacauguacgccgaugacacagccgggugggacacccgcaucacagaagacgaccugcagaacgaggcuaaaaucaccgacauuauggagcccgaacacgcccucuuggccacgucuauuuucaagcugacguaccagaacaaaguuguuagagugcagcgccccgccaaaagcggcaccgugauggacgugaucucccggcgcgaccagcggggaagcggccagguuggcacauacggccugaacacguuuaccaacauggaggugcagcugauccgucagauggaguccgaaggaaucuucagucccuccgaacuggaaaacuccaaccucgccgaacgugugcuggauuggcuggagaagcacgggguggagcgacucaagcggauggccaucuccggcgacgacugcguggucaagccgaccgaugaucgcuucgccaccgcgcugacggcuuugaacgauauggggaagguccggaaggauauaccccagugggagccaaguaagggcuggaacgacuggcaacaagucccuuucugcucucaucacuuccaccagcucauaaugaaagauggccgcgagaucgucguaccuugccggaaccaggacgagcuggugggccgcgcacgggugagccaaggggccggguggucucugagagagacagcuugccuuggcaaaucauacgcgcagauguggcagcugauguacuuccaucgucgcgaccugagacucgcggccaacgccaucuguagcgcaguacccgugaacugggugcccaccucacggacaaccuggagcauccacgcgcaccaccaauggaugacgaccgaagacaugcuuuccguguggaaccgcgucuggaucgaagagaaucccuggauggaagacaagacgcacgugaguagcugggaggacguaccuuaccuggggaagagagaggaccaguggugugguagccucaucggccugaccgcacgcgccacuugggcuaccaauauccaggucgcgaucaaucaaguucggcgcuuaaucgggaaugagaauuaccuugacuacaugacuuccaugaagcgguucaagaacgagucagaccccgagggggcgcugugguga

SEQ ID NO: 24722 - RNA, 9879 nt, Artificial Sequence
  derived and/or modified CDS sequence (opt11) from DENV-1__GU370048__SS-prME
agcgugacgaugcugcucaugcugaugccaaccgcccuggccuuucacuugaccacccggggcggagaaccacacaugaucgugagcaagcaggagcggggcaagagccugcuguucaagaccagcgcgggggugaacaugugcacccucaucgccauggaccuaggcgagcugugugaggacacgcucaccuacaagugcccccggaucacggaagccgaacccgacgacguagacugcuggugcaacgccacugacacgugggugaccuacgggaccugcagccagaccggagagcaccggcgagacaaacgguccguggcccuggcuccccacgugggcuuggggcucgagacgcgcaccgagaccuggaugagcuccgagggcgccuggaagcagauccagcggguggagacuugggcccugcgccacccuggguucacggugaucgcacuguuccucgcgcacgccaucggcacgagcaucacccagaaggggaucaucuucauccuguuaaugcucgugacgccguccauggcgaugcgcugcguuggcaucggcagccgggacuucguggagggguuguccggggccacguggguggacgucgugcuggaacacgggagcuguguaaccacaauggcgaaggacaaacccacccucgacauugaacugcugaagacggaggucacgaacccagcgguccuccggaaacugugcaucgaggccaagaucucuaacaccaccacggacagcagauguccgacccagggcgaggccacccugguggaagaacaggacgccaacuucgucugccggcgcaccuucguggaccggggcugggggaacgguugcggguuguucggaaaggggagccugaucacgugcgccaaguucaagugcguuaccaagcuugaaggcaagaucguccaguacgagaaucucaaguacagcgugaucguaaccguccacaccggcgaccagcaucagguugggaacgagagcacggagcacgguaccaccgcgaccauaacgccccaggcccccacgaccgagauccagcugaccgacuacggagcacugacccucgauugcucaccccgcacugggcugaauuucaacgagaugguccugcucaccaugaaggagaagucuugguuagugcauaagcagugguuccuggacuugccgcugcccuggacuucaggggccuccaccacgcaagaaaccuggaaccgacaggaccugcuggugacguucaagacggcccacgcuaagaagcaggaaguggugguccuuggcucucaggagggagccaugcacaccgcccugacuggagcuaccgagauccaaaccagcggcaccacaacaaucuucgccggccaccuuaagugccgccugaaaauggacaaauuaacacucaagggcauguccuacgucauguguacggggaguuucaagcuggagaaagaaguggcggagacccagcauggcacugugcuaguccagauuaaguacgagggcacggacgcccccugcaagauccccuucagcacgcaggacgagaagggcguuacccagaacggacgguuaaucaccgccaauccgaucguaacggauaaagagaaacccgucaacauagaggcggagccgcccuucggagagagcuacaucgugaucggcgcgggggagaaggcccucaaguuauccugguucaagaagggaucuuccaucggcaagauguucgaggccacggcccgcggggcccggagaauggcgauucugggcgacaccgcgugggauuucgguagcauuggcgguguguucaccagcguagggaagcucguacaccagaucuucggcacggcguacgggguucucuucucgggggucuccuggacgaugaagaucgggaucggcgugcugcuaaccuggcugggccuuaacagccgcuccacgucccucaguaugaccugcaucgccgugggccuggucacgcuguaucucggggugauggugcaggccgacucggggugcgucauuaacuggaagggccgggaguugaaguguggguccggcaucuucguaaccaacgagguucacaccuggaccgaacaguacaaguuccaggcggacagcccgcgccggcuuucggccgccaucggcaaggccugggaggaaggugucugcgguaucagguccgccacccggcucgagaacaucauguggaagcagaucagcaacgagcugaaucacaucuuacucgagaacgauaugaaguucacgguaguggucggggacguggccggcauccuggcccagggcaagaagaugaucagaccccagcccauggagcauaaguacucguggaaaucguggggcaaggccaagaucaucggcgccgaugugcagaacacgaccuucaucaucgacggucccaacaccccggagugccccgaugaccagcgggcguggaacaucugggaggucgaagacuacggcuuugggaucuuuacgaccaacaucuggcugaagcuccgugacucauacacccaggugugcgaccaucgguuaaugagcgcggccaucaaggacucaaaagccgugcacgccgacaugggcuacuggaucgagagcgagaagaaugagaccuggaaacuugcgcgcgccuccuucaucgaggucaaaaccuguaucuggcccaagagccacaccuuaugguccaacggcgugcuggagagcgagaugauaauccccaagaucuacgggggcccgaucucccagcauaacuaccggcccggguacuucacccagaccgccggccccuggcaucuggggaaacuugagcuggacuucgaucugugcgagggcaccaccgugguaguggaugagcacugcggcaaccgcgggccgagccuccggaccaccacggugacaggaaagaucauccacgagugguguugccgcuccugcacccuuccgccccugcgguuucgcggugaggacgggugcugguacgggauggagauccggcccgucaaggagaaagaggagaaccucgucaagagcaugguguccgcuggcagcggcgaggucgacagcuucucccuggggcugcucugcaucucuaucaugaucgaggaggugaugcgcucccgguggagccgcaagaugcugaucacagggacgcuggccgucuucuuccuccugaucauggggcaggucaccuggaacgaccuaauccgcuugugcaucauggugggcgcgaacgcuuccgaccgaaugggaaugggcaccaccuaccuggcccugauggccacguucaaaaugcgccccauguucgccgugggacuccuguuccggcgccugaccagccgggagguccuccugcugaccaucggacucucccugguggcuucggucgagcuucccaacucccucgaggagcugggcgacgggcuagcgaugggcaucaugauccucaagcugcugaccgacuuccagccccaccagcucugggcuacucugcugagcuugacguucaucaagaccacguucucgcugcacuacgccuggaagaccauggcgauggugcuuagcaucgugucccucuucccccugugccuuagcacuaccucccagaagacgacguggcuaccgguucugcugggcagucucgggugcaaaccccugaccauguuccugaucgccgagaacaagauuuggggacgcaagagcuggccccucaacgaggggauuauggccgugggcaucgugaguaucuugcuguccucgcuccugaaaaacgacgucccccuggccgggccgcucaucgccggaggcaugcuuaucgccuguuacgugaucucgggguccuccgccgaccuguccuuagaaaaagccgccgaggugagcugggaggaggaggccgagcacuccggcgcgagccacaacauccuggucgaggugcaagacgaugggacuaugaagaucaaggacgaagagcgggaugauacucugaccauccuccugaaggccacguuauuagcaguguccggcgucuacccccugagcaucccggcgacacuguuugugugguacuucuggcagaagaagaagcagcgcuccggggugcugugggacacccccucuccucccgaggucgagcgggcggugcuggaugacggcauauacaggaucaugcaacggggccugcuggggcgcucccaggucggcgucgggguguuccaggagaaugucuuccacaccauguggcacgucacccggggggcggugcuuauguaccaagggaagcgccuggagcccaguugggccucggugaagaaggaccugauuagcuacgggggcgguuggcggcuccagggcuccuggaacaccggggaggagguccagguaaucgccguggagcccggcaagaacccuaaaaacguccaaaccgcccccgggacauucaagacgccggagggcgaggugggcgccaucgcgcuggacuuuaagcccgguaccagcggaaguccaaucguaaaucgggaggguaagaucgucggccuguacggcaacgggguggugacuaccagcggcacauacguuuccgcaaucgcccaggccaaggcgagccaggaggggccguugcccgaaaucgaggacgaaguauuccguaagcgcaaccugaccaucauggaccugcacccaggcagcgggaagacccggcgcuaccuccccgccaucgugcgggaggccaucaaacgcaaacugcgcaccuuaauucuagcccccacgcggguaguggcuagcgagauggcggaggcccucaagggaaugccuauccgauaccagaccaccgcggucaagagcgagcauaccggaaaggagaucgucgaccugaugugccacgccacguucaccaugcgacuccuguccccggugcgcguccccaacuacaauaugaucaucauggacgaagcccacuucaccgauccaagcuccaucgcggcacguggguacaucagcacucgcgucggcaugggggaggccgccgccaucuucaugacggcgacuccgcccgggaguguggaggcuuuuccccagucuaacgccgugauacaggacgaagagcgggacauccccgagcgcuccuggaacagcggguaugaguggaucaccgacuuccccggcaaaacugucugguuugugccguccaucaagagcggcaacgacaucgccaacugccuacguaagaacgggaagcgcgugauccagcucaguagaaagacguucgacaccgaguaccagaaaaccaaaaacaaugacugggacuacguugugaccaccgacauaagcgagaugggcgccaacuuccgcgccgaucggguuauagacccccgccgaugccugaagcccgucauucugaaggacggccccgagagagugauccucgccggcccaaugcccgucaccguggccagcgccgcucagcggcgcgggcguauuggccgcaaccacaacaaggagggcgaccaauacauauacauggggcaaccccuuaacaacgacgaggaucaugcccacuggacugaggccaagaugcuccuggacaacaucaauacccccgaggguaucaucccagcccuguuugagcccgagcgcgagaagucugccgcgaucgacggggaauaccgucugcgcggcgaggccaggaagacguucguggagcuuaugaggagaggggaucugcccgucugguugucuuacaagguggccuccgagggcuuccaauacuccgaccgccgguggugcuucgacggcgaacgcaacaaccagguucucgaggagaacauggaugucgaaaucuggaccaaggagggggaacggaagaaacugcgcccccgguggcuggacgcccgcaccuacagcgauccguuagcccugcgggaguucaaggaguucgcggccgggagacggagcguguccggggaccugauccucgaaaucggcaaguuaccccagcaccugacccagcgcgcucagaaugccuuggacaaucuggugaugcugcacaacagcgagcagggcgggcgggcguaccgacacgccauggaggagcuccccgacacaaucgagacccugaugcuguuagcccugaucgccguccugaccggaggaguuacacucuucuuccugucugggcgggggcugggcaagaccagcaucggucugcucugcgugauggccuccagcguccugcucuggauggcguccgucgagccccacuggauugccgcaagcaucauacuggaguucuuucugauggugcuccugauuccggaacccgaccgacagcggacaccgcaggacaaccagcuggccuaugucgugauuggguugcuguucaugauccugacuguggccgccaaugagaugggccuccuggagaccaccaagaaggauuuggggaucggccacgucgccguggagaaccaucaccacgccgcuaugcucgacguggaccugcacccggccuccgccuggacgcuguacgcggucgccacgaccaucaucacccccaugaugcgccacacgaucgagaauaccaccgccaacaucagccuuacggcuauagcgaaccaagccgccauacugauggggcuggacaaggguuggccuauuuccaagauggacauaggcgugccccuccuggcccuaggguguuacagccaggugaacccgcucacgcugaccgccgccguccugaugcucguggcccacuaugccaucaucggccccgggcugcaggccaaggcaacccgagaggcgcagaaacggaccgccgccggcaucaugaagaaccccacggucgacggcaucguggccaucgaucuggaccccgugguguaugacgcgaaguucgagaagcagcucggccagaucaugcugcugauccugugcaccagucagauccugcugaugcguaccacuugggcccucugcgagagcaucacgcuggccaccggcccguugaccacccucugggaggggucgccagguaaguucuggaacacgaccaucgcggucagcauggcaaacaucuuucggggguccuaccuugcgggagccgguuuagcguucagccucaugaagucccuugggggcggucgccgggggaccggggcccagggcgagacccugggcgagaaguggaagcgccaguugaaccagcugucuaagagcgaauucaauaccuacaagcguaguggaaucauggagguggacagaagcgaagcgaaggaggguuugaagcgcggcgagacaacuaagcacgccguguccaggggcaccgccaaacuccggugguucgucgagcgcaaccuggugaagccggaggggaaggugauagacuuaggcugcggccgcgggggguggagcuacuacugcgcagggcugaagaagguuacggaggugaagggauauacuaagggcggccccggccacgaggagccgauccccauggccacuuacggguggaaccucgugaagcugcacuccgguaaggacgucuucuucaucccucccgagaagugugacacccugcucugcgacaucggggagagcucgccgaacccgacgaucgaggaaggucggacgcugcggguacuaaagauggucgagcccuggcuccgcgggaaccaguuuugcauaaaaauccugaaccccuacaugccgagcgugguggagacucuggagcagaugcagcggaagcacggcggcaugcuagugcgcaacccccugucccggaacagcacccacgaaauguacugggucuccugcgggaccgggaauaucguaagcgcgguaaacaugacgucucgcaugcugcucaaccgcuucaccauggcccaccggaagccgacguacgagcgcgacgucgaccugggggccggcacccgucacguggccguggaaccugaggucgccaaccuagacaucaucggccagcgcaucgagaauaucaagcacgaacacaagaguacguggcacuacgaugaggacaauccguacaagaccugggcuuaccacgggagcuaugaagugaagcccucaggcuccgccucguccauggucaaugggguggugaagcuccugacaaagcccugggacguaauccccauggugacccagauagccaugacggacaccaccccguucggccagcagcgaguguucaaggagaaagucgacacccgcacgcccaaggccaagcggggcacggcccagaucauggaggugaccgcgcgcuggcuguggggcuuccucucacggaacaagaagccacgcaucugcacccgggaggaguucacuagaaaggugcgaagcaacgccgccaucggagccgucuucguggacgagaaccaguggaacuccgcaaaggaggccguggaggacgagcgcuuuugggaccuaguccaccgggagagagaacuccacaagcaggguaaaugcgcgaccugcguguauaauaugaugggcaaacgggagaagaagcucggggaauucggcaaggcuaaggggagccgagccaucugguauauguggcugggcgcgcgguuccuggaguucgaggcgcucggcuucaugaaugaggaccacugguucucccgcgaaaauucgcuguccgggguggagggagaagggcugcauaagcugggguauauccuccgggacaucagcaagauacccgggggcaacauguacgcggacgacaccgccggcugggacacccgcaucacggaagacgaccugcagaacgaggccaagaucacugacauaauggagcccgagcaugcgcuccuggcaaaagccaucuucaagcucacauaucagaacaagguagugcgcguccagcgucccgccaagaaugggaccgucauggauguaaucucccgccgggaccagcgcgguagcggccaagugggcacguacggccuaaacaccuucacaaacauggaggcccagcugauacggcagauggaauccgaagggaucuucagccccuccgagcuggagacgccgaaccucgcggagcgcguccuguacuggcuggagaaguacgguguggagcggcucaagaggauggccaucagcggggacgauugcguggucaagcccaucgacgaccgcuucgccacggcacugaccgcgcugaacgacaugggcaaggugcguaaggacaucccccaaugggaacccuccaaggguuggaacgacuggcagcaggucccguucugcagccaccacuuccaccagcucaucaugaaggacggcagagagauugucgugcccugccgaaaucaggacgagcuggugggcagagcgcgcgucucccagggggccggcuggagccugcgggagacugccugccucgggaaguccuaugcccagauguggcagcuaauguacuuccaccgacgggaccugcgcuuagcggcgaacgccauuugcagcgccgugcccguagacuggguucccacuaguagaacgacaugguccauccacgcccaucaccaguggaugacgaccgaggacaugcugagcguguggaaccgcguguggauugaggagaacccuuggauggaggacaagacgcacaucuccucuugggaggacguaccguaccugggcaagcgcgaggaccaguggugcggcucccucaucggccugaccgcgcgagccaccugggccaccaacauccaaguggccauaaaccagguucgcaggcugaucggcaaugaaaacuaccucgacuauaugaccucuaugaaacgcuucaagaacgaguccgauccggagggggcccugugguga

SEQ ID NO: 24723 - RNA, 9879 nt, Artificial Sequence
  derived and/or modified CDS sequence (opt11) from DENV-1__KM403627__SS-prME
aguguuacaaugcuguugaugcugcugcccacugcguuggcguuucaucugaccaccagaggaggggagccccacaugauugugagcaaacaggaacggggaaagagccuccuguucaaaaccagcgcaggggugaacaugugcacccuaaucgccauggaccugggugaacucugcgaagacacgaugacauacaaauguccccggaucacugaggcagagccugacgacguggacugcuggugcaacgcgaccgacaccugggugaccuacgggaccugcagccagaccggcgagcaucggagggacaagcgguccguugcccuugcgccccacguuggauuaggacucgagacgcgcaccgagaccuggauguccuccgaaggggccuggcggcagauucagaagguggagacgugggcucuucgccauccgggguucacggugaucgcccuguuccucgcgcacgccauagggacuagcauuacccaaaaggggaucauauuuauccugcugaugcucguuacccccaguauggcaaugcgguguguuggcaucgguaaccgcgacuucguggagggguugagcggcgcuacguggguggacgucgugcuggaacacggguccugcgugaccaccauggccaagaacaaacccacccucgacaucgaacugcugaagacggaagucaccaaccccgcgguguugcggaaacugugcaucgaggccaagauaucaaacacuacuacggacucacgcugucccacccaaggcgaagcaacgcugguagaggagcaggacgccaacuucgucugccggagaacauucgucgaccggggcugggguaacgguugcggccucuucggcaaagggucacuacucacaugugccaaguucaaaugcgugaccaagcucgagggcaagauaguccaguaugagaaccugaaguacucgguaaucgugaccguacauaccggcgaccaacaccagguggguaacgagacgaccgagcacggcaccaucgccaccaucacgccccaggccccuacuagcgagauucagcugaccgauuacggggcccugacgcuagacuguagcccccggaccggccuggacuucaacgaaauggucuugcugacgaugaaggagaaauccuggcugguccacaaacaaugguuucucgaccuaccacugcccuggaccuccggggccucgacaagccaggagacguggaaccgccaggaucucuuaguaacauucaagaccgcccacgcgaagaagcaggaggucguuguccuggggucccaggagggcgcuaugcauaccgccuugaccggggcaacagagauccagacuucgggcaccaccacaaucuuugcugggcaucugaagugccgccuaaagauggacaagcucacccugaagggcgucucuuaugugaugugcaccgggagcuucaagcuggagaaggagguggcggagacccagcaugguacgguacugguccaggugaaguaugaaggcacagacgccccgugcaagauccccauauccacccaggaugagaaggggguaacacagaacgggagauuaaucacugccaacccgaucgucacagacaaggagaaacccguuaacauugagaccgagccgcccuucggugaaucguacaucgucaucggcgcgggcgagaaagcgcugaaacuuuccugguucaagaagggguccuccaucgguaaaauguuugaggccaccgcgcgcggggcccggcguauggccauccucggagacacggcgugggacuucgggagcaucgggggcguguucaccuccgugggcaagcugguccaucagguguucggcaccgccuacggggugcuauucagcggcgucaguuggaccaugaagaucgggaucgguauccucuuaacgugguugggacucaauucucguuccaccagcuuauccaugaccuguaucgccgugggcaugguuacgcuguaucucggcgucauggugcaggccgacagcgggugcgugauaaacuggaagggccgugagcuaaagugcggguccggaauauucgucaccaacgaggugcacaccuggaccgagcaguacaaguuccaggcagauuccccgaagagacucagcgcggccaucggcaaggccugggaggagggcguaugcgguauccgguccgcuacccgauuggagaauauaauguggaaacaaaucaguaacgaguuaaaccacauacuguuggagaacgacaugaaguuuaccgugguggugggggacgccaauggcauccugacacaggggaaaaagaugauccggccgcagccuauggagcauaaauacuccuggaaauccuggggcaaggcgaagaucaucggggcagauauccagaacaccaccuucaucaucgaugggccagacacgcccgagugccccgacgaccagagggccuggaacaucugggaggucgaggacuacggcuuugggguguuuacgacuaacaucuggcugaagcuacgugacuccuauacccaaaugugcgaccaccgccugaugucugccgcgaucaaagacucuaaggccgugcacgccgacaugggauacuggaucgaaucagaaaagaacgagaccuggaagcuggcccgagcauccuucaucgaggucaagacgugcauuuggccuaggucccacacccucugguccaacggugugcuggagagcgagaugaucauccccaagauuuacgggggcccgauuagccagcacaacuaccggccuggguacuucacccagaccgcgggcccuuggcaucuggggaagcucgagcuggacuucaaccugugugaaggcacgaccguggugguugacgagcauugcggcaaccgcgguccaagccuccggaccaccacagugacagguaagaucauccacgagugguguugccgcuccugcacgcugccgccgcugcgguuucgcggggaagacgggugcugguacgggauggaaauucggcccgucaaagagaaggaagaaaacuugguacgaagcaugguguccgccggcagcggcgaaguagacucguucucccucgguuuacucuguguuucuaucaugaucgaggaggugaugcggucccgcuggagccgcaaaaugcugaugacuggcacgcuggccguguucuuccuacugaucaugggccagcugacguggaaugaccucauccggcuaugcauaauggugggcgcgaacguguccgaccgcaugggcaugggcacuaccuaccuggcguuaauggcgacguucaagaugcggccgauguucgccgucggccugcuauucagacgguuaaccagccgcgagguucugcugcuuaccauuggucugucacuugucgcaaguguggaacuccccaacucccuugaggaacuuggggacgggcucgcaauggggaucaugaugcugaaguuguugaccgacuuccagagccaccaauuguggacgacccugcucucccugaccuucaucaagaccacgcugucucucgacuacgccuggaagaccauggcuaugguucuuaguauagucagccuguuuccucucugccugucaaccaccagccaaaagacgaccuggcugcccguucuacugggcuccuucggguguaagccgcugaccauguuccucaucaccgagaacaagauauggggccgcaagagcuggccacugaaugaggggaucauggccgucggcaucgucuccaucuuguuaagcucccugcugaagaacgacgugccucuggccgggccgcugaucgccggcggaauguugaucgcgugcuacguaaucuccgggagcuccgccgaccucagccuggagcgcgccgccgaagucuccugggaagaggaggcggaacacaguggcgcgucccacaauauccuggucgaaguacaggacgaugggacaaugaagaucaaggacgaagagcgagacgauacucucaccaucuuacugaaggcgacucuacuagcggucagcgggguguacccgauguccauccccgcgacguuguucguaugguacuuuuggcagaagaagaagcagcgcagcggggugcucugggauacgccgucuccgcccgaaguggagcgggccguucuugacgacggcaucuacagaauccuucagagaggccuguuggggcgaucgcaggucggcguaggcguauuccaagacggcgucuuccacaccauguggcaugugacccgcggggcaguccugauguaccaaggcaagaggcuggagcccaguugggccagcgucaagaaagaccucaucuccuacggaggaggcuggcgguuccaggggucuuggaacaccggagaggaggugcaggugauugccgucgaacccgggaagaaccccaagaacgugcagaccacccccggcaccuucaagacccccgagggggaaguaggcgccaucgcccuggauuucaagccugguacguccggaagccccaucgugaaccgugagggcaagaucguggggcuuuacgggaacggaguagucaccaccucagguaccuacgucagcgcaaucgcccaggccaaggcaagccaagaggggccguuaccagagaucgaggacgagguguuuaagaagcggaaccugacgauuauggaccugcauccagggucuggcaaaacccgcagauaccucccggcuauuguccgcgaagcgaucaaacgcaaacugcggacucugaucuuggccccuaccagggucguggcuagcgaaauggcagaggcgcuuaaaggcaugccgauucgguaccagacgaccgccgugaaguccgagcacacugggaaggaaaucguagacuugaugugccacgcaaccuucacgaugcgucuccugagccccgugcggguuccgaauuacaacaugauuauaauggacgaggcucacuucacagauccugccuccaucgcggccaggggcuacauaagcacccguguggggaugggcgaagcagccgcuauuuucaugaccgcgacgccgcccggcuccgucgagucauucccacaguccaacgccgucauccaggacgaggagcgcgacaucccugagcguagcuggaacaguggcuacgacuggaucacugauuuccccggcaaaacggugugguucgugcccagcaucaagagugguaacgacaucgccaacugcuugcguaagaacggcaagcgagugauacagcuuagccgcaagaccuucgacaccgaguaccaaaagacuaagaacaacgacugggacuacgugguuaccaccgacaucuccgaaaugggagccaacuuccgggccgaccgagucaucgacccgagacgaugccugaagccagugauccugaaggacgggcccgagcgggucauccucgcaggucccaugccggugacggcugccagugccgcccaacgaagaggccgcaucggccgcaaccagaauaaggagggcgaccaguacaucuacaugggccaaccccugaacaacgaugaggaccaugcccacuggaccgaggccaagauguugcucgacaacauaaacacgcccgagggaauuauccccgcccuguucgaaccagagcgggagaagucggcugcgauugauggggaguacaggcugcgcggcgaggcccgcaagaccuucguggagcucaugcggcgcggcgaucuacccgucuggcucagcuacaagguggccuccgagggcuuccaguacucagaccgccgcugguguuucgacggggagcggaacaaccaggugcucgaggagaacauggacgucgagaucuggacgaaggagggcgagcgcaaaaagcuccggccacgcuggcuggacgcccggaccuacucugacccccuagcccugcgcgaauucaaggaguucgcggccggacgcagaaguguguccggagaucuaauucucgaaaucggcaagcugccccaacaccugacccugcgagcccaaaacgcccuggacaaccuggugaugcuccacaacuccgagcagggagggaaggcauaucgccaugccauggaggagcugcccgauacuaucgagacgcugaugcuccuggcucugaucgccguacucaccggcggugugaccuuguuuuuucugagcgguaaggggcucgguaagaccuccauuggacugcugugcgugauggccagcucagugcuccucuggauggcgagcgucgagccccacuggauugccgccucuaucauccuggaguuuuuucucauggugcuguuaaucccugagccggacagacagaggacgccccaggauaaccagcucgcuuauguagugaucggucugcuguucaugauccucacaguggccgcgaacgaaauggggcugcuugagaccaccaagaaggaccucggcaucgggcacgucguggccgagaaccaccaucacgcaacgauguuagauaucgaccugcaccccgcaagcgcguggacacucuacgcgguagccacuaccaucaucacuccuaugaugagacacacgauugagaacacuaccgccaacaucucccugaccgccauagccaaccaggccgccauccugaugggccucgacaagggcuggcccaucagcaaaauggauaucggggucccccugcuggcuuuaggcugcuacucccaagugaauccacugacucugaccgcagcugugcuaaugcuuguugcgcacuacgccaucaucgggccgggacuacaggcgaaagccacccgggaggcccagaagcgcacggccgccggaaucaugaagaacccuacgguggacggcaucguagccaucgacuuagacccugucgucuacgaugccaaauucgagaaacagcugggccaaaucauguugcuaaucuuauguaccucccagauccuucucaugcggaccaccugggcgcuuugcgagucaaucacacuggccacggggccccucacgacccugugggaaggaagcccugguaaauucuggaauacgaccaucgcugugaguauggccaauaucuuucgcggcaguuaccuggcuggcgcggggcucgccuucucccuaaugaagucucugggaggaggccggcgugggacgggcgcccagggugaaacccucggggagaaguggaagcggcaacugaaccaguuguccaaguccgaauucaacacguacaagcgcuccggcaucauggaagucgaucgguccgaggcuaaagaggggcucaagcgcggugagacaacgaagcaugccgugagccgggggaccgcgaagcugcgcugguucgucgaacggaaccuggucaagccggagggaaaggugaucgaccugggaugugggcgcggggguugguccuauuauugcgcaggccucaagaagguaacugaggugaagggguauacuaagggcggccccgggcacgaggagcccaucccuauggccaccuacggcuggaacaucgucaagcuacauagcgggcgggacguguucuucacgccgccugagaaaugcgauacccugcucugcgacauaggcgaaaguagccccaaccccacgaucgaggaggggcgcacccuucgaguacugaaaaugguggaacccuggcuccgcggcaaucaauuuugcauaaagauccugaaccccuacaugcccuccguggucgagacccuggagcagaugcaacggaagcauggcggaaugcucgugcgcaauccgcuaagccggaacucuacccaugagauguacuggguaagcuguggcacggggaacauaguuuccgcgguaaauaugaccucacgcaugcugcuuaaucgcuucaccauggcgcaccggaagcccaccuacgagcgcgacguugaccugggcgcgggcaccagacacguugccguggagcccgagaucgccaaccuggacaucaucggacagcgcaucgaaaacauaaagaaugagcacaaguccacuuggcacuacgacgaggauaaccccuacaagacuugggccuaccacggcagcuacgaggugaagccauccgggagcgcguccuccauggucaauggaguagugcgauugcugacaaaaccaugggacguaauccccauggugacgcaaaucgccaugaccgacaccacucccuucggucagcagcgcgucuucaaggagaagguggauacgagaaccccgagacccaagagggguaccgcacagaucauggagguuaccgcuaaguggcuguggggcuuucuaagcaggaauaaaaagccacggauuugcacgcgcgaggaguucacccggaaagugcgcuccaacgcugcgauuggggcuguguucguggacgagaaccaauggaacucugcgaaagaagccgucgaagacgagagguucugggaccugguacaccgcgaacgggagcuccauaagcagggcaagugcgcgacgugcguuuacaacaugauggggaagcgcgaaaagaagcucggggaguucgguaaggcgaagggcucccgcgccaucugguauauguggcugggcgcgagauucuuggaauuugaagcccuugguuucaugaacgaggaccacugguuuagccgggagaacucccugagcggcgucgaaggggagggccuacacaaacucggcuacauucugcgcgacaucuccaagaucccgggaggcaacauguacgccgaugauacugccgggugggacacgcgcaucaccgaagacgaccuucagaacgaggcuaagauuaccgauaucauggagcccgagcacgcucuccuggcaaccagcaucuucaaacugacguaccagaacaagguuguucgcguccagaggcccgcuaaguccggcacagugauggacgugauaagccggcgggaccagcgggggucgggccagguaggcacuuacggccucaacaccuucacgaacauggaggugcagcugauccgccagauggagagugagggaauuuucuccccaagcgaacuggagaacuccaaccucgccgagcgggugcuggacuggcucgagaagcauggggucgagcgccuaaagcguauggcaaucagcggcgacgauugcguugugaaaccuaccgacgaucgcuucgccaccgcccugaccgcccugaacgauaugggcaagguccguaaagacauaccccagugggagccaucgaaaggcuggaacgacuggcaacagguccccuuuugcagccaccacuuccaccagcucauuaugaaggacggcagagagaucguggucccaugccggaaccaggaugaacuggugggccgcgcccggguaucucagggcgcaggcuggucccugagagagacggccugccucggcaaaucguacgcccaaauguggcagcugauguauuuccaucggcgcgaucugcggcucgcggccaacgcaaucuguuccgccgucccggugaacugggugccaaccucucgcacgaccuggaguauacacgcgcaccaccaguggaugaccacugaagacaugcuuagcgucuggaaccgcguguggaucgaggaaaaucccuggauggaagacaagacucacgugucgucaugggaggacguucccuauuuggguaaacgggaggaccaguggugcgggagcuuaauaggucugaccgcgcgcgcaaccugggcgacgaacauacagguggcaaucaaccaggugcggcgucugaucggcaacgagaacuaucucgacuacaugaccagcaugaagcgguuuaagaacgagucugaccccgagggugcgcugugguga

SEQ ID NO: 24724 - RNA, 9879 nt, Artificial Sequence
  derived and/or modified CDS sequence (opt11) from DENV-1__KM403584__SS-prME
agcgugaccaugcugcuaauguuacugcccaccgcccuugccuuccaccugaccacccggggcggagagccccauaugauugugagcaagcaggaacggggcaagagccugcuguucaagaccagugcgggggugaacaugugcacgcugaucgccauggaccugggcgagcucugcgaggacacgaugaccuacaagugcccccggaucaccgaggccgagccugacgacguggauugcuggugcaacgccaccgacaccugggucaccuacgggaccugcagccagaccggggagcaccggagggacaagcggucgguggcccuggcgccccacgugggccuggggcucgagacccgcaccgagaccuggaugagcuccgagggcgccuggcggcaaauacagaagguagagaccugggcccugcgccacccgggguucacggugaucgcgcuguucuuagcgcacgcuaucggcaccagcaucacccagaaggggaucaucuucauccugcugaugcucgugacccccaguauggccaugcggugcgucggcaucgggaaccgggacuucguggagggucugucgggcgccacguggguggacgucgucuuggagcacggguccugcgugacgacgauggccaagaacaagcccacccuggacaucgagcugcuaaagacagaggucaccaaccccgcggugcuucggaaguuaugcaucgaggccaagaucucuaauacuaccacggacuccagguguccaacacagggcgaagccacccugguggaggagcaggaugccaacuucguuugccggcgcaccuucguggaucggggcugggguaacggcugcggcuuauucggaaaagggagccuacugaccugcgcuaaauucaagugcgugacuaaguuagagggcaagaucguccaguacgagaaucugaaguacuccgucauagugaccgugcacaccggcgaccagcaccaaguaggaaacgagacgaccgagcacgguaccauagcgaccaucacgccccaggcccccacgagcgagguccagcugaccgacuauggggcccucacccuggacugcagcccccggacuggccuagacuucaacgagauggugcuccugacaaugaaagagaagucuuggcuggugcacaagcagugguuccucgaucugccgcucccuuggaccucaggggccagcaccagccaagagaccuggaauagacaggacuuacuggucacguuuaagaccgcacacgcgaagaagcaggaggugguuguccuggguucccaggaaggagccaugcauaccgcccucaccggggccacggagauccagaccucaggcaccaccacgaucuuugcagggcaccuaaagugccgccugaagauggauaagcucacccugaaaggcguguccuauguaaugugcacggggagcuucaagcuggaaaaggaggucgcugagacccagcacggcacggugcuggugcaagucaaguacgagggcaccgacgcccccugcaagaucccuaucucgacccaggacgagaagggggugacccagaacggccggcucauuaccgccaacccgauagugacggacaaggagaagcccguuaacaucgagaccgagccgcccuucggggagucuuacaucgugauuggcgccggagagaaggcguugaaacuuuccugguucaagaaggggucuaguaucggcaagauguucgaggccaccgcccgcggggcgcggcgcauggccauccugggcgacacggcuugggacuuuggcagcaucggcgggguguucaccucaguggggaagcugguacaccaaguguucggcacugccuacgggguccuguucagcggcguguccuggaccaugaagaucgggaucggcauccuccugacguggcugggccucaacucucgcuccaccucccuguccaugaccugcaucgccguggggauggucacccuguaccucggcgugauggugcaggccgacagcgggugcguuauaaacuggaagggccgggagcugaaguguggguccggcauuuucguuacgaacgaagugcacacuuggaccgagcaauacaaauuccaggccgacucgcccaagcgccugagcgcggccaucggcaaggccugggaggagggggucugcggcauccgguccgccacccgccuagaaaacauaauguggaagcagaucagcaacgagcugaaccacauccugcuugagaacgacaugaaguucaccgugguggucggggacgccuauggcauccugacgcaggggaagaagaugauacgaccgcagccaauggagcacaaguacucguggaaguccuggggcaaggcgaagauaaucggcgccgacacccagaacaccaccuucauaaucgacgggcccgacacgccggagugccccgacgaccagcgcgccuggaacaucugggagguugaagacuacggcuucgggguguucaccacaaacaucuggcugaagcuccgggacuccuacacccagaugugcgaccaccgccugaugagcgccgcgaucaaggauucgaaagccguucaugcugacaugggcuacuggaucgagagcgagaagaacgaaacguggaagcuggcccgggccuccuucaucgaggugaaaacgugcaucuggccacggucacacacccucugguccaacggagugcuggagagcgaaaugaucaucccuaagaucuacgggggcccgaucucccagcacaacuacaggcccggauacuucacccaaacggcgggccccuggcaccugggaaagcuggagcuggacuucaaccugugcgaggguaccacggucguggucgacgaacacugcggcaaccgcgggccaagucuccggaccacgacggucaccggcaagaucauccacgaguggugcugucgcuccuguacccugccaccacugcgguuccgcggggaggacggcugcugguaugggauggaaauccggcccguaaaggaaaaggaggaaaaccucgugcguagcauggucagugcgggcagcggcgagguggacagcuucucccuggggcugcucuguguuagcauuaugaucgaggagguuaugcgcuccagguggagccgcaagauguuaaugacgggcacccuggccguuuucuuccuccugauuauggggcaacugacguggaacgacuuaauccggcuguguauuaugguuggugccaacguuuccgaccgcaugggaaugggcaccacguaucuggcccucauggcgaccuucaagaugaggcccauguuugccgugggucugcuguucaggcggcucacaagccgcgaggucuugcugcucaccaucgggcugucccugguggccagcguggagcuucccaauucccuggaggaacuuggggacggccucgccauggguaucaugaugcugaagcuccucacggacuuccagucacaccagcuguggaccacgcugcugucuuuaaccuucauuaaaacgacucugagccuagacuacgcauggaagaccauggcaaugguccuguccaucgucagcuuguucccccucugccugucaaccacgagccagaagaccaccuggcugcccguccuccucggcuccuucgggugcaaaccguuaaccauguuccuuaucaccgagaacaagaucugggggcgcaagagcuggccccuuaacgaggguaucauggccgugggcaucguguccaucuuacuuagcagccugcugaagaacgacgugccgcucgccggaccucugaucgcagggggaaugcugaucgcgugcuaugucaucuccgguuccuccgccgaucucucacuggagcgcgccgccgagguguccugggaggaggaggccgaacacagcggugcgucacacaacauccugguggagguccaggacgacgggacgaugaagaucaaggacgaggagcgggacgacacccugaccauccugcugaaggccacccuccuggccgugaguggcguguacccuaugucgauccccgccacacucuuugucugguacuucuggcagaagaagaagcagagaagcggggugcucugggacacccccagcccgcccgaaguggagcgggcuguccuggaugauggcaucuaccgcauccugcagcgaggccuguuggggcgaucacaggugggcguuggcgucuuccaggacggcguguuccacaccauguggcacguuacgcgcggggcgguccucauguaccagggcaagcgccuggagcccucaugggccagcgugaagaaggaccucaucuccuacggcggaggcuggcgguuccaggggagcuggaacacgggggaggaggugcaggucaucgccguggaacccgggaaaaaccccaagaacgugcagaccacccccggcaccuucaagacgccggagggcgagguaggggccaucgcccucgacuucaagcccggcaccucagggagccccauagucaaccgcgagggaaaaaucgugggccuguacgggaacggcgucgugacuaccuccgggacguacgugagcgcgauugcccaggccaaggccagccaggagggcccgcuccccgagauagaggacgaaguuuucaagaagagaaaccugaccaucauggaccuacaccccggguccggcaagaccaggcgguaccucccggccaucgugcgcgaggcuaucaagcgcaagcugcgcaccuugauccucgcccccacgcgcgugguugccagcgagauggccgaggcacugaaggggaugcccauccgguaccagaccaccgccguuaagucugagcacaccgggaaggaaaucguggaccucaugugccacgccacguucaccaugcgccuccugagccccgucagagugccgaauuacaacaugauuaucauggacgaagcacauuucaccgaccccgcaaguauugcggcuaggggcuauaucagcacccgagugggcaugggcgaggccgccgccaucuucaugacggcaacuccacccggauccguugaggccuucccucagucgaaugccguaauccaagaugaagagcgcgacauccccgagcguagcuggaacagcggcuacgauuggaucacagacuucccuggcaagaccgugugguucgucccauccaucaagagcgggaacgacaucgccaacugccugcgcaagaacgggaagcgggugauccagcucucccgcaagacguucgacaccgaguaccagaagacaaagaacaacgacugggacuauguugucaccacggacauaagcgagaugggggcuaacuuccgggcggaucgcgugaucgacccgcggcgaugccugaagcccgugauccugaaagacggcccagagagagugauccucgccgggcccaugccggugaccgccgccucggcggcccagcgccggggacgcaucggccgcaaccagaauaaggagggugaccaguauaucuauaugggccagccccucaacaacgacgaggaccacgcccacuggacggaggccaagaugcugcucgacaauaucaacaccccagaggguaucaucccagcccuguucgagccggaacgggagaaaucugcagccaucgauggcgaauaccgccugcgcggggaggcccgcaagacguuugucgagcuuaugagacgcggcgaccugcccguguggcuauccuacaagguggccagcgagggcuuucaguacagcgaccggcgguggugcuucgacggggaacggaacaaccagguccuggaagagaacauggacguggagauuuggaccaaggagggcgagcgcaaaaagcuccggccccgcuggcuggacgcccggaccuacagcgauccccucgcgcugagagaguucaaggaguuugccgccgggagacgcagcguguccggcgaccugauucuggagaucggcaagcugccgcaacaccugacccuccgggcccagaacgcccucgauaaccuggucaugcuccacaacagcgagcagggcgggaaggcguaccgccacgcuauggaggagcugccggacaccaucgagacgcugaugcuccuggcacugaucgccgugcucaccgggggcgugacacuguucuuccuguccggcaagggcuugggcaaaaccagcaucgggcugcugugcguaauggccuccucggugcugcuguggauggccuccguggagccccacuggauagccgccucuaucauccuggaguucuuccucaugguacugcugauccccgagccugaccgacagcgcaccccgcaggacaaccaauuggccuacguugugaucggucuccuguucaugauccucaccguugcggccaacgagauggggcugcuggagaccaccaagaaagaccuuggcaucgggcaugugguagccgaaaaccaccaucacgccacuaugcuggacauagacuuacaccccgccucagcguggacacucuacgcagucgcgaccaccaucaucacgccgaugaugaggcacaccaucgagaauaccaccgcuaacauaucgcugacagcgaucgcgaaccaggccgccauccugaugggccucgacaagggcuggccuaucuccaagauggauaucgggguucccuuacuggcccucggcugcuacucucaggugaacccccugacccugaccgccgcaguucucaugcugguggcucacuacgcgauuauagggccgggccugcaagccaaggcgacacgcgaagcacaaaagcggacggcggccgggaucaugaaaaaccccaccguggacgguaucgucgccaucgaccucgaccccgugguguacgaugcgaaauucgagaagcagcucggccagaucaugcugcucauccuguguaccucccagauacugcucaugcggaccacgugggccuuaugcgaguccaucacucuggccaccgggccccucaccacgcugugggaggguuccccggggcgcuucuggaacaccacuaucgccgucucuauggcuaacaucuuccggggcuccuaucuugcgggggccgggcuugccuucagccugaugaagucucugggcgggggccgccgggggaccggcgcccagggggagacgcucggugagaaguggaagcgccagcuaaaccagcugagcaagagcgaguucaacaccuacaagcgguccgggauuauggagguggaccgcagcgaggcaaaggaggggaugaagcggggcgagaccaccaagcacgcugugucccgcggcacggccaaacucaggugguuugucgaacgcaaccuggugaaacccgagggcaaggugaucgaccuggggugcggccguggcggguggucuuacuauugcgccggccugaagaaggucaccgaagugaagggguacacaaagggcggccccgggcacgaagagcccaucccgauggccacauauggcuggaacaucguaaagcuccacucaggacgcgacgucuucuucacgccgcccgagaagugugauacgcuuuugugcgauaucggggagagcucccccaacccgaccaucgaagaggggagaacccuccgaguguugaagaugguugagccguggcugcggggaaaccaguuuugcauuaagauacucaaccccuauaugcccagcgucguggagacccuggagcagaugcagcgcaagcacggcgggaugcugguccggaacccucucucccguaacagcacgcacgagauguacugggucuccugcggcaccgggaacaucgugagcgcggugaacaugacaucucgcaugcugcuuaaccgguucaccauggcccacaggaagccaacauaugagcgggacgucgaccucggggccggaacccgccauguggccguagagcccgaaaucgccaaccuggauaucaucggccagcggauagagaacauaaagaacgaacacaagagcaccuggcacuacgacgaggacaacccuuacaaaaccugggcguaccauggcuccuacgaggucaagccgagcggcuccgccucauccauggugaacggugucgugagacuacucacgaagcccugggacgucauccccauggucacucagauagcaaugaccgauaccaccccuuucgggcagcaacggguguucaaggagaagguggacacccgcacgccacggcccaagcggggcaccgcccagauuauggaggucacggcuaaguggcuguggggcuuucucagccggaacaagaagccuaggauuugcacccgggaggaguucacgcgaaaagugcggagcaacgcggccaucggggccguguucgucgacgaaaaccaguggaauucugccaaggaggccguugaggacgaacgcuucugggaccucgugcacagggagcgcgagcugcacaagcaaggcaagugcgccaccugcguuuacaacaugauggggaagagggagaagaagcugggcgaauucgggaaggccaagggcucgcgcgccaucugguauauguggcucggcgcucgguuucuggaauucgaggcgcugggguucaugaacgaggaccacugguucucccgcgagaacagccuguccggcguggagggggagggccugcacaaguuggguuacauccuccgcgauaucucuaagauaccgggcggcaacauguacgccgaugauacggccggcugggacacccggauuaccgaggaugaccugcagaacgaggccaagaucacggacaucauggagccagaacacgcccugcucgcgacguccauauucaaacugaccuaccagaacaaaguuguucgcgugcagcggcccgccaagagcgguaccgugauggaugucaucucccgccgggaccaacgcgggagcggucaaguggguaccuacgggcugaacacguucacuaacauggagguccagcucaucaggcagauggagagugagggaaucuuuagucccagcgagcuggaaaacagcaaccuggccgagagaguccucgacuggcuggagaagcacgggguggagagauuaaagcgcauggccaucaguggcgacgauugcguggucaagccgaccgacgaccgguucgccaccgcacucacggcccuaaacgauauggguaagguccgcaaggacaucccgcagugggagccaucgaagggcuggaacgacuggcagcagguccccuuuugcucccaccacuuccaccagcugaucaugaaggacggccgcgagaucgucgucccuugccgcaaccaggacgagcucgugggccgggcccgcgucucgcagggugccggguggagccugagagaaaccgccugccugggcaaguccuacgcgcaaauguggcagcucauguacuuccaccgccgggaccugcggcuggcggccaaugccaucugcucggcaguccccgugaacugggucccaacaagccgcacgaccuggagcauccacgcacaucaccaguggaugacgaccgaggauaugcucuccguuuggaaccggguguggauugaggaaaacccguggauggaggacaagacacacgucagcuccugggaggaugugccguaucuagggaagcgcgaggaccaauggugcggcagccugaucggccucaccgcccgggccacaugggccaccaacauccaaguggcgaucaaccagguccggcggcuaaucggcaacgagaacuaccuggacuauaugaccuccaugaaaagguucaagaacgagagcgacccugagggcgcccugugguga

SEQ ID NO: 24725 - RNA, 9879 nt, Artificial Sequence
  derived and/or modified CDS sequence (opt11) from DENV-1__KM403633__SS-prME
agcgugacaaugcugcucaugcugcugccuaccgcccucgcguuccaucugaccaccaggggcggggagccccacaugaucgugagcaagcaggagcgggggaaaucgcuucuauucaaaaccuccgcgggggugaauauguguaccuugauugccauggaccugggcgagcucugcgaagacacgaugaccuacaaaugcccgcgcaucacggaggccgaacccgaugauguugacugcuggugcaacgccacugacaccugggugaccuacgggaccugcucccagaccggcgagcaccggcgcgauaagcgguccguggcccuugcuccccacgugggccuugggcucgaaacccgcaccgaaaccuggauguccuccgagggcgcguggcggcagauccagaaaguggaaaccugggcucugcgccacccuggguucacgguaaucgcgcuguuucucgcgcacgccaucgguaccaguauaacccagaaggggaucauauucauuuuacugaugcucgugacacccuccauggccaugaggugcguaggcauaggcaaccgggacuucguggaggggcuaucaggcgcaacauggguggacgucgugcuggagcacggguccugcgugacgacuauggccaagaacaaacccacccucgacaucgaguuacugaaaacggaagucaccaacccggcagugcugcggaagcuguguauagaggcaaaaauuagcaacaccaccacugacucccgcugcccgacccagggugaagcgacccugguggaggaacaggacgccaauuuugucugucgccgcacguuuguggaccgggguugggggaauggcugcggccucuucgguaaggguagccugcugaccugugccaaguucaagugcguaaccaagcucgaaggcaagauugugcaguacgaaaaccugaaguacagcguuauuguuaccguccacaccggcgaccaacaccaggucgggaacgaaacgaccgagcacggcaccaucgcgacgaucacgccccaggccccgacuagcgagauccagcugaccgacuacggggcccucacccuggacugcagcccacgcaccggccuggacuucaacgagauggucuuacuuaccaugcgggagaaguccuggcugguacacaaacagugguuucucgaccugccacugcccuggaccuccggggccagcaccucucaggagacuuggaaccgccaagaccuccuggucacguucaaaaccgcucacgccaaaaagcaggaggucguggugcugggcucccaggagggagccaugcauaccgcgcucaccggggccacugagauccagaccucgggcacuaccacaauauucgccgggcaucugaagugccggcuaaagauggacaaacugacccucaagggggucuccuacgugaugugcacagggagcuucaagcuggagaaggagguggcugagacucagcacggcaccguccugguacaggugaaguacgaggguaccgacgcgcccugcaagauucccauaagcacccaggacgaaaagggggugacccaaaacggccgccucauuacggccaacccuaucgugaccgauaaggagaagcccgugaacauagaaaccgagccucccuucggggagucauauaucgucauaggggcaggcgagaaggcgcugaagcuguccugguucaagaaggggucuuccauagguaagauguuugaagcaacggccagaggggcacggcgcauggccaucuugggcgacacggcgugggacuucggaagcauaggcggcgucuucaccucuguggggaagcugguccaccaaguguucggcacugccuacggggugcuguucucggguguuucuuggaccaugaaaaucgguaucgggauccugcuaacguggcucggacucaacagccggucuaccucacugucaaugaccugcaucgccgucgggauggugacccuguaucucggcgucauggugcaggcugacuccgguugcguuaucaauuggaagggccgggagcugaaguguggguccgguaucuuugucacgaacgaggugcacaccuggaccgaacaauacaaauuccaggcggauagcccgaagagacuaagcgcagcuaucggaaaggcuugggaagagggggugugcggcauacgcuccgcgacgcggcucgagaacaucauguggaagcagaucagcaacgagcugaaccacauccuacucgagaaugacaugaaguucacaguagucgugggggacgccaacgggaucuuaacgcaggggaagaagaugauccgcccccagccuauggagcacaaguacuccuggaagucguggggcaaagcgaagauaaucggggccgacacccagaacaccaccuucaucaucgacgggcccgacacgccggagugucccgaugaccagcgggcuuggaauauuugggaggucgaggacuacggauucgggguguucaccaccaacaucuggcuaaagcuccgcgacagcuacacucagaugugugaccaccggcugaugucggccgcgaucaaggauucaaaggccguacacgccgacaugggcuacuggaucgaaagcgagaagaaugagacguggaaacuugcgcgcgccuccuuuauugaggucaagacuugcaucuggccacggagccacaccuuauggucuaacggugugcuggagagcgagaugaucauccccaagaucuacggagguccgaucucccagcacaauuaccgcccgggguacuuuacacagaccgcgggcccguggcaccucgggaaguuagagcuagacuuuaaccugugcgaggguaccaccguugugguggacgagcacugcgguaaucgcgguccgagccuccgcacgacgaccgugacuggcaagaucauccacgaguggugcugcagaaguugcacccuuccuccccugcgcuuccguggggaagacggcugcugguacggcauggagauccggcccgucaaggagaaggaggagaacuuagugcgaagcaugguguccgccggcagcggcgagguagacagcuucucacuggggcugcucugcguuagcaucaugauugaagaagugaugcgcucccgcuggagccggaaaauguugaugacgggcacccuggcagucuucuuccuucuaauuaugggucagcugaccuggaacgaccucauacgccugugcauaauggugggcgcgaacguuuccgaccggauggggaugggaacgacguaccucgcccucauggcgacguucaagaugcgcccgauguucgcuguagggcugcuguucagacgcuuaacuucccgggaagugcugcuguugaccaucgggcugucccuggucgccuccguagaguugcccaacuccuuggaggaacugggcgacggacuagcaaugggcauaaugaugcugaagcugcucacggacuuccagagccaucaacuguggaccacccuguugucccugaccuucaucaagacuacccugagccucgauuacgcauggaagacgauggcgauggugcucuccaucgucagccuguucccccucugccugucgacuacuagccagaagaccaccuggcugcccguuuuacugggcuccuucggcugcaagccucugacuauguuccugaucacagaaaauaagauauggggucgcaagucuuggccccugaacgaggggauuauggcagugggcaucguguccauccugcugucuagccugcuaaagaacgaugugccacucgcagggccccugaucgccggcggaaugcugaucgcuugcuacgugauuagcggaagcagcgccgaccucagccuugagcgggccgccgaggucucaugggaggaagaggccgagcacagcggggcgagucauaacaucuuaguggaggugcaagacgauggcacgaugaaaaucaaggacgaggaacgcgaugacacccucaccauccuguugaaagccacccucuuggcggucagcggcguguacccgauguccauccccgccacucuuuucgugugguacuucuggcagaagaagaagcagcggucugggguccucugggacacccccagcccgcccgagguggagcgugccgugcuggaugacggcaucuaccguauacuacagcgcggccugcucgggcgcagucagguaggcguuggggucuuucaagacggcgucuuccacaccauguggcacgugacccgcggcgcggugcugauguaccagggcaaacggcuggagccuuccugggccucggucaagaaagaucuuaucuccuacggcgggggcuggagguuucaggguagcuggaacacaggcgaggaagugcaaguuauugcaguugagccagggaaaaaccccaaaaacgugcaaaccacccccggcacuuucaaaacgcccgaaggggaggugggggccaucgccuuagacuucaagccugggaccagcgggagcccgaucgucaaccgcgagggcaaaaucgugggccuguacgggaauggcgucgucacgaccuccgguacguacgugagcgcgaucgcccaggccaaagccagccaagagggcccgcuccccgaaauagaagacgagguguucaagaaacgcaaccugaccauaauggaucugcaccccggguccgguaagacccgccgcuaucucccagccaucguacgcgaagcuaucaagcguaagcucaggacgcugauccucgcacccacccgcguuguagccagcgagauggccgaagcgcuaaagggcaugccuauucgcuaucagaccacugcggucaagucggagcacacaggaaaggagauaguggaccugaugugucacgcuacuuucaccaugcggcugcuuagccccgugcgcgucccaaacuacaacaugaucaucauggaugaggcccacuucaccgaccccgccuccaucgcugcccgaggcuauauaucgacccgcguggggaugggcgaggccgccgccaucuucaugaccgcgaccccgcccgguuccguagaagccuucccgcaaucgaacgccgucauccaggaugaggaacgggacauccccgagcgcaguuggaacagcggauacgacuggaucacggauuuccccggcaagaccgugugguucgugcccuccauaaagagcgguaacgacaucgccaacugcuugcggaagaacggcaagcgcgucauccaacucucccgcaagacauucgauaccgaguaccagaagaccaagaacaaugacugggacuacguggugaccacggacaucucagagaugggcgccaacuuccgcgcggaccgggucaucgauccgcgucgaugccugaagccugugauucugaaagacggcccggagcgggucauccucgcugggcccaugccggugacggccgccuccgcagcucagcgucgcggccgcaucggccguaaccaaaacaaggagggggaccaguacauuuauaugggccagccccugaacaacgacgaggaucacgcacacuggaccgaggcgaagaugcugcucgauaacaucaacaccccggaggggaucaucccugcacuguucgagcccgagcgcgagaagagugcugccauagacggugaauaccggcuacgcggcgaggcccguaagacguucguggagcucaugcgcaggggcgacuuacccgucuggcugucuuacaagguggccagugaggguuuccaguacuccgaccgccgguggugcuucgacggggagcgcaauaaucaggugcucgaggagaacauggauguagagaucuggaccaaggagggugagcggaaaaagcugcggccccgguggcuggacgcccgcacuuacagcgauccacucgcguugcgggaguuuaaggaguucgcggcuggacgccggagcgugucgggggaccugaucuuggaaaucggcaaacugccgcaacaccuuaccuugcgagcgcagaacgccuuagacaaucucgugaugcuccacaauucggagcaaggagggaaagcguaucggcacgccauggaggagcugcccgacaccaucgagacgcugaugcuccuggcguuaaucgccguucuaaccgggggugugacccuguucuucuuauccgggaagggccuaggcaagacaagcauagggcuguugugcgugauggcgucaagcguguuauuauggauggcauccguggagccccacuggaucgccgccucgaucauccuggaguucuucuuaauggucuugcugauucccgagccggaucgccaacggaccccucaggacaaccagcucgcguacgucgugaucgguuuacuguuuaugauccucacagucgcggccaacgagauggggcugcuggaaaccaccaagaaggaccucggcauugggcacgucguggccgagaaucaccaccaugccacgauguuagacaucgacuuacaccccgccagcgcguggaccuuguacgcuguggccaccacuaucaucacgccgaugaugcgccacaccauagaaaacaccaccgccaacaucagccugacagccaucgcuaaccaggccgccauucugaugggccuagacaagggcuggcccaucucuaagauggauaucggcgucccauugcuggcccucggcugcuauagccaggugaacccccugacccugacagccgcggugcuuaugcuggucgcccacuacgccaucauugggccgggucugcaggccaaggcgacccgagaggcccaaaagagaacggcugccgggaucaugaagaacccaacuguggacggcaucguggccauugaccuagaccccgucguguacgacgcgaaguucgagaagcagcugggccagaucaugcugcucauccugugcaccucacaaauccugcucaugcgcaccacgugggcccucugcgagagcaucacccuggccaccgggccacucaccacgcugugggaaggcuccccggggaaguucuggaauaccaccauagccgucucgauggccaacauuuuucgggguagcuaucuagccggugccgggcucgccuucagccugaugaagucgcuuggcgggggccgcagagggacgggugcgcagggagagacacugggggagaaguggaagcgccagcuuaaucagcuuagcaaaagcgaguucaacacauauaagcgauccggcauaauggaggucgaucggucggaggccaaggaagggcucaaacggggagaaacaacaaagcacgcggugucacgugggacggcaaagcugcggugguucguagagcgcaaccuggucaaacccgaggggaaggugaucgaccuuggcugcgggcggggcggguggagcuauuauugcgccggccucaagaaggugaccgaaguaaaaggguacacaaagggcggcccggggcaugaggagcccaucccuauggcuacauacggcuggaauaucgugaagcugcacuccgggcgcgauguuuucuucacgccucccgagaagugugauacucuacugugcgacaucggcgaaagcucuccaaacccgaccauugaggaagggcgaacgcugcgaguucugaaaaugguggagcccuggcuccgagggaaccaguucugcaucaaaauccugaaccccuacaugcccaguguugucgagacgcuggaacagaugcagcgcaagcacggcgggaugcucgugcggaacccgcuguccagaaacaguacucacgagauguauuggguuaguuguggcacggggaacaucgucagcgccguaaacaugacgucccgcaugcugcuaaaccgguucacgauggcccauaggaagcccacguacgagcgggacguggaucuaggggccggcacucgccacgucgcaguagagccggaaaucgccaaucucgacaucauaggacagcgcaucgagaacauaaagaacgaacacaaaagcaccuggcacuaugacgaggacaauccuuacaagaccugggcguaccaugguuccuacgaagugaagccgagcgggucagcuagcuccauggucaauggcguggugcgccuauugacgaagccgugggacguuauccccauggugacacagaucgccaugaccgacaccacgccuuucgggcagcagcggguauucaaggagaaggucgacacccgcaccccgcggcccaaacgcggcacagcccagaucauggagguuaccgccaaguggcuguggggcuuccucagccggaacaagaaaccccgaaucugcacgcgcgaggaguucaccagaaagguccggagcaacgcggcuauuggggccguuuuuguggaugagaaccaauggaacuccgccaaggaggccgucgaggaugagcgcuucugggaccuggugcaccgcgagagagagcugcacaagcagggcaagugcgcgaccugcguguacaacaugauggggaagcgggagaagaaacuuggcgaguucgggaaggccaaggggucccgagcuaucugguacauguggcugggggcccgguuucuggaguucgaggcgcucgguuucaugaacgaagaccacugguucucccgcgaaaacagccugagcggcgucgaaggggaaggccugcacaagcucggauacauacugcgugacaucagcaagaucccgggcggcaacauguacgccgacgacacagcaggcugggacaccaggauaaccgaagacgaccugcaaaacgaagccaagaucacggacauuauggagccagagcacgcccuguuggcaaccagcauuuucaagcuaaccuaucaaaacaagguggugcgcguacagaggccagcgaagucaggcaccgugauggacguaaucucucggagagaccagcgggguagcggccaaguagggaccuacggucuaaacacauuuaccaacauggagguacaauuaauccggcaaauggaguccgaaggcaucuucucuccuuccgagcuggagaacagcaaccucgccgagcgcguucuggauugguuagagaagcauggggucgagcgguuaaaacggauggccauauccggagacgacugcguggucaaaccaaccgacgaccgauucgcaaccgcccugaccgcccugaacgacaugggaaaagugcgaaaggacauaccccagugggagcccagcaagggcuggaacgacuggcagcaaguaccuuucugcagccaccacuuucaccaacuuaucaugaaggacggcagagagauaguagucccaugccgcaaccaggacgagcugguggggagggccagggucagccaaggcgccggguggagcuuacgugagacggccugccucggcaaguccuacgcgcagauguggcaacugauguauuuccaucgcagggaccugcgcuuagcggccaacgccaucugcagcgccgucccagugaauugggugcccaccagucggaccaccuggagcauucacgcucaucaccaauggaugacgacagaggacaugcuguccgucuggaaccgggucuggaucgaggagaaccccuggauggaggauaagacccacguaucauccugggaagacguucccuaccucgggaagcgggaggaucaaugguguggcagccucaucggcuuaacagcccgcgcaacgugggccaccaauauccagguggcgaucaaccaggugcgcagauugaucgggaacgaaaacuaccucgacuacaugaccuccaugaaacgcuuuaagaacgagagcgaccccgagggagccuuaugguaa

SEQ ID NO: 24726 - RNA, 9879 nt, Artificial Sequence
  derived and/or modified CDS sequence (opt11) from DENV-1__KM403592__SS-prME
uccgugaccaugcugcucaugcuguuaccaaccgcccuggcauuccacuuaaccacccggggcggggaaccccacaugaucgugagcaagcaggagcggggcaagagccucuuguucaaaaccagugccggugugaacaugugcacccugaucgccauggaccugggcgaacucugcgaggacacuaugacauacaagugcccucguaucaccgaggcggagcccgacgacguggacugcuggugcaacgccacggacaccugggugaccuaugggaccuguucccagaccggcgagcaucggcgugacaagcgguccguggcccuggcgccccacgugggccuggggcucgagacgcgcaccgagacauggaugaguuccgaaggcgccuggcggcagauccaaaaggucgagaccugggcacugcgccaucccggguucaccgugaucgcccucuuccucgcgcacgccauuggcaccagcauaacccagaaggguaucauauucauccugcuuaugcuaguaacccccuccauggccaugaggugcguaggaaucggcaaccgcgacuuuguggaggggcugagcggcgccacguggguggacguggugcuggagcacggguccugcgugaccacuauggccaagaacaagccgaccuuagacaucgaguuacugaagacggaggucacgaaccccgcgguccuacggaagcugugcauagaggccaagaucagcaauacgaccacggacucccgcugccccacccagggggaggccaccuuaguugaagagcaagacgccaauuucgucuguaggcgcaccuucguggacagaggcugggggaacgggugcggccucuucggcaaaggaagucuucugacgugcgccaaauucaagugugugacuaaacucgaaggaaagaucguccaguaugagaaucugaaauacuccgugauagugacaguacauaccggcgaccaacaccaggugggaaacgagacgaccgaacacggcaccaucgcgacuauaacgccccaggcucccacgagcgagauccagcugaccgacuacggggcccucacccuggacuguagcccccggaccggccuggacuucaacgagaugguccuccugacgaugaaggagaagagcuggcugguccacaagcaaugguuccucgaccugccucugcccuggaccucaggggccagcaccucgcaagagaccuggaaccgccaggaucuccucguuacguucaagacggcccacgcgaagaagcaggaggugguagucuugggaucccaggaaggggccaugcacaccgcgcucaccggggccacggagauucaaaccagcggcacuaccacgaucuucgccgggcaccugaagugccgccugaagauggacaaacucacccugaaaggcguauccuacgugaugugcaccgggucauucaagcuggagaaggagguggcggagacccagcacgggacggugcugguccaggugaaguacgaaggcaccgacgcccccugcaagauacccaucuccacccaggaugagaagggggucgcgcagaacggccggcucaucaccgccaacccgaucgugacggacaaggagaagcccguuaacauugagaccgagccacccuucggggagagcuacaucgucauaggcgcgggcgagaaggcccugaaguuauccugguucaaaaaggggagcuccauuggcaagauguuugaggccaccgcccguggggcccggcggauggcgauccucggugacaccgccugggacuucgggagcaucgguggugucuucacguccgugggcaagcuuguccaccagguguucgggaccgccuauggcgugcuguucagcggcgucuccuggaccaugaagaucgggaucggcauccuccugaccuggcugggccucaacagccgcucgacuagccuguccaugaccugcauugccguagggauggucacguuauacuugggcgucauggugcaggccgauucagggugugucauaaacuggaagggcagggagcugaaaugcggguccggcauauucguuacuaacgaggugcacacuuggaccgagcaauacaaguuccaagcagacaguccgaaacgccugagcgccgccaucggcaaggcgugggaggagggggugugcggcauccgguccgccacucgccucgaaaacaucauguggaagcagaucagcaacgagcugaaccauaucuugcuagagaacgacaugaaguucaccgugguagucggggacgcgaacggcauccugacucaggggaagaagaugauccguccccagcccauggagcacaaguacaguuggaaguccuggggcaaggccaagaucaucggcgccgacacgcagaacaccaccuuuaucaucgacgggccugacacuccggagugccccgacgaccagcgcgccuggaacaucugggaagucgaggacuacggcuucgggguguucacgacgaacaucuggcugaagcuccgggauuccuauacccaaaugugcgaccacagauugaugagcgcggccaucaaggacuccaaggccgugcaugccgacaugggcuacuggauagagagcgagaagaacgagaccuggaaacuggcccgggcgucuuucaucgaggucaagacgugcaucuggcccaggagucauaccuugugguccaacggcgugcuggagagcgagaugaucaucccaaagaucuacgggggcccgaucucgcagcacaacuaucggccugguuacuucacccagaccgccggaccguggcaccuggggaaguuagagcuggacuucaaucucugcgagggcacgacgguagucguggacgagcacugcggcaaucgugggccaagccuccggaccaccacggugaccggcaaaaucauccacgaauggugcugccgcuccuguaccuuaccgccccugcgguuccgcggggaggacggcugcugguaugggauggagauccggcccgucaaggagaaggaggaaaaccucgugcgcucaaugguuuccgcuggcagcggcgagguagacagcuucagccucggguugcucugcguuagcaucaugaucgaggaggugaugcgguccagauggucucgcaagaugcugaugaccggcacgcuggccgucuucuuccuccugaucaugggacagcucaccuggaacgaccucgugagacugugcauuauggugggcgccaacgucucagaccgcauggggaugggcaccacauaucuggcgcugauggccaccuucaagaugcggcccauguucgccguggggcuguuguuccgccgguuaaccagccgcgagguccuguugcuaaccaucggacugucgcugguagccucuguggagcuccccaacagccuggaggaguugggcgacgggcuugccauggggaucaugaugcugaagcugcucaccgauuuccagagccaccagcuguggacuacccugcucucucugacauucaucaagaccacgcucagccuagacuacgcguggaagacaauggccaugguccugaguaucgugagccuauuuccucucugccuguccaccaccagccagaagacgaccuggcugcccguucuccuggggucuuucgggugcaagccguuaaccauguuccucaucaccgagaacaagaucuggggccgaaaaagcuggccccugaacgaggggaucauggccgugggcaucguguccauccugcucuccagccuguuaaagaacgacgugccccucgccgggccucugaucgcgggcggcauguuaaucgccugcuacguaaucuccgggagcuccgccgaccucagccucgagcgcgccgccgagguguccugggaggaggaggcggagcacagcggagccucccacaacauccucguggagguccaggacgacggcacaaugaagaucaaggacgaggagcgggaugauacgcugaccaucuugcugaaggccacccuguuggcaguaaguggcgucuacccaauguccauccccgccacccuguucgucugguacuucuggcagaagaagaagcagcgaagcgggguacucugggacacgcccagcccgcccgagguggagcgcgcgguccuggacgacggcaucuaccgaauccugcagcguggccugcucgggcgcucccagguaggcguugguguguuucaggacggcguguuccauaccauguggcacgugacccggggggcaguccugauguaccagggcaagagauuggaacccuccugggccagcgucaagaaggaccucaucuccuacgguggcggcuggcgguuccagggaaguuggaacaccggggaggagguucaggucauagccguggaacccgggaagaacccuaagaaugugcagacgaugcccggaaccuucaagacgcccgagggugaagucggggccauagcgcuggacuucaaacccggcaccuccgggucucccaucguuaaccgcgagggcaagaucgugggccuguacgggaacggcguaguuacaacgucggggaccuaugugagcgcgauagcccaggccaaggccagccaggagggaccgcuccccgagaucgaagacgaggucuucaagaagcggaaccugaccaucauggaccugcaccccggcuccggcaagacgcgccgguaccucccugcaaucguucgcgaggcgaucaagcgcaagcugcggacccugauccucgccccuacccguguugucgccagcgagauggcggaggcccuaaaaggcaugcccauucgauaccaaacgacggcugugaaauccgaacacaccgggaaggagaucguggaccugaugugccacgccaccuuuaccaugcgccuccugagccccgugcggguaccgaacuacaauaugaucaucauggacgaggcccauuucacggaccccgcguccaucgcagccagaggguacaucagcacccggguggggaugggugaggccgccgcgaucuucaugaccgcuaccccgcccggguccgucgaggcguucccgcaaagcaacgcuguaauccaggacgaggagcgcgacaucccugagcgcuccuggaacagcggcuacgauuggauaacggacuuccccggcaaaaccgugugguucguccccucuaucaagagcgguaacgacaucgccaauugccugcgcaagaauggcaaacgggugauccagcucucccgcaagaccuucgacaccgaguaccagaagacgaaaaacaacgauugggacuacguggucaccaccgacaucucugagaugggggcgaacuuccgggccgaccgcgugaucgacccgcggcgcugccugaagccggucauccugaaggacggccccgaacgggugauccucgccgggccgaugccggugaccgcagccuccgccgcccaacgccggggccgcaucggccgaaaccagaacaaggagggcgaucaguacaucuacaugggacagccccugaacaaugacgaggaccacgcccacuggacggaggccaaaaugcugcucgacaacaucaacacccccgaagggaucauccccgcgcuuuucgagccggagcgugagaaguccgcagccaucgacggcgaguaccgccuccgcggggaggcccgcaagaccuucgucgaguugaugcggcgcggcgaucugcccgugugguuguccuauaagguggccagcgagggauuccaguacuccgaccggcgcugguguuucgacggggagcggaacaaccagguccucgaggagaacauggacguggagauauggaccaaggaaggagagaggaagaagcugcggccacgcugguuggacgcgcguacguacagcgacccccucgcccugcgcgaguuuaaggaguucgccgccgggcggagaagcguguccggcgaccugauccucgagaucggcaaacugccgcagcaucugacccuccgggcccagaacgcgcuggacaaccuggucaugcuccacaacagcgagcagggagggaaggccuaccgccacgccauggaggagcuacccgacaccauugagacccugaugcuccuugcccugaucgcggugcucaccggcggcgugacccuguucuuccuguccgggaagggacucggcaagaccagcaucggucugcuuugugucauggccuccuccgugcuccuguggauggccuccguggagccgcauuggaucgcggccagcaucauccuggaguucuuccucaugguucuacugauccccgaaccggaccgucagcgcacgccccaggacaaucagcuggcuuaugucgugaucgggcuguuguucaugauccucaccgucgccgccaacgagauggggcugcuggagacgaccaagaaagaccugggcaucgggcacgugguggccgagaaccaccaccacgcuacgaugcuggauaucgaucugcacccggcguccgccuggacccucuacgcaguagccacgaccaucaucaccccgaugaugcgacacaccaucgagaacacuaccgccaacaucagccugaccgcgaucgccaaccaggccgcgauacugaugggccucgacaagggcuggccgaucuccaagauggacauagggguuccccugcuggcccucgggugcuacagccaggugaauccccugacccugacggcagccguguugaugcugguugcccacuacgcaaucaucgggccgggcuugcaggccaaggccacccgugaggcccagaagcgcacagccgccgguaucaugaaaaaccccaccgucgauggaaucgucgcgaucgaccucgaccccgugguguacgacgccaaguucgagaagcaacugggccaaaucaugcugcucauccugugcacaucccagaucuuacuaaugcggacuaccugggcucugugcgagagcaucacucuggccacgggcccccucaccacccugugggagggcagucccgggaaguucuggaauaccaccaucgccgucagcauggcgaauaucuuccgcggcuccuaccuggccggcgccggccuggccuucagucugaugaagagccugggcggcggccgccgcgggacaggcgcucaaggcgagacccugggagagaaguggaagcggcagcugaaccagcugagcaaaagcgaguucaauaccuacaagcgcuccggcauuauggaaguggaccggagcgaggcgaaagagggguuaaagcgcggcgagacgaccaagcaugcugucucccgggggaccgccaaauugcgcugguucguagagcggaaccuggugaagcccgagggcaaggugaucgaccuggggugcgggcgcggaggguggagcuauuacugcgccgggcucaagaagguaaccgaggugaagggguauacgaagggcggccccgggcacgaggagcccauaccgauggccaccuauggcuggaacaucgugaagcuacauuccgggcgggacgucuucuucaccccgcccgagaagugcgacacccuucucugcgacauaggcgagagcucccccaauccgacaaucgaggaggggcgcacgcugcgggugcugaagaugguggagccauggcuccgcggcaaccaguucugcaucaagauucuuaaucccuacaugccuagcgucguugagacccuggagcagaugcagaggaagcacggggggaugcucgugcgcaauccgcugucccggaacagcacccacgagauguacugggucuccugcggcaccgggaacauuguuagcgcagugaacaugacuucacgcaugcugcucaaucgcuucaccauggcccaccggaagcccaccuaugagcgcgacguggacuugggcgccggcacucggcacguggccguggagcccgagaucgcgaaccuggauaucaucgggcagcgcauagagaauaucaaaaacgaacacaagagcacuuggcacuacgacgaggauaaucccuacaagaccugggccuaccacggcuccuaugaggucaagccgagcggcucugccagcucgauggugaacggcgucgugcggcuccugaccaagcccugggacgugauccccauggucacccagaucgccaugacggacaccacccccuucggucagcagcgcguguucaaggaaaagguggacacccggacuccgcgacccaagcggggcaccgcccagauuauggaggugaccgcgaaguggcuguggggcuuccucagccgcaauaaaaagccccgcaucugcacccgcgaggaguucaccaggaaggugcgcagcaacgcugcgauaggagcaguguucgucgacgaaaaccaauggaacuccgcaaaggaggcgguggaagacgagcgguucugggaccucgugcacagggagagggagcugcacaaacagggcaaaugcgcaacgugcguauacaacaugauggggaagagagagaagaaguuaggcgaguucgggaaggccaagggcucccgggccaucugguauauguggcugggcgcacgcuucuuagaguucgaggcccucggauucaugaacgaggaccacugguucucccgggagaacucgcugucaggugucgagggggagggccugcacaagcucggguacauacugcgcgacaucagcaagauuccgggcgggaacauguacgccgacgauaccgccgggugggacacgcgcaucacggaggacgaucugcagaacgaggccaaaaucaccgacaucauggagccugaacacgcgcuccuugccaccuccaucuucaaacugaccuaccagaacaagguaguacgggugcagcgccccgcuaagagcggcacggugauggacgugaucucccggcgcgaccaacgggggucgggacagguuggcaccuacggucucaauacauucaccaacauggaggugcaguugauccgccagauggaguccgagggaaucuucucacccuccgagcuagagaacagcaaccucgccgagagaguacuggacuggcucgagaagcaugggguggaacgccucaagcggauggcgaucuccggggacgauugcguggucaagccgacggaugaccgcuucgcgaccgcccugaccgcucugaacgacauggggaaggugcggaaggacaucccccagugggaacccaguaaggguuggaacgauuggcagcaggugcccuucuguucccaccacuuccaucaacucaucaugaaggacggucgcgagauagucgugccuugccguaaccaggaugagcucguggggcgggcccguguaagccagggcgccggguggagccugcgcgaaaccgcgugccucgguaagucguacgcccagauguggcagcugauguacuuccaccggcgcgaucugcggcucgccgccaacgccaucugcuccgcgguucccgugaacuggguccccacuucccgcaccaccuggagcauccaugcacaccaccaguggaugaccaccgaggacaugcuguccguguggaaccgcguguggauagaagagaaccccuggauggaggacaagacgcaugucagcuccugggaagaugugccguaccugggaaagcgggaggaccagugguguggcagccuuaucggacugaccgcccgggccaccugggcgaccaacauccagguagcaauaaaccaaguccggcgccugaucgggaacgaaaacuaccuugacuacaugaccuccaugaagcgauucaagaacgagagcgacccugagggcgcacugugguaa

SEQ ID NO: 24727 - RNA, 9879 nt, Artificial Sequence
  derived and/or modified CDS sequence (opt11) from DENV-1__KM403593__SS-prME
agcgugaccaugcugcucaugcugcugcccaccgcccucgcguuccaccugacgacucggggcggggagccccacaugauugugagcaagcaggagcggggcaagagccuucuguucaagacgagcgcaggggugaacaugugcacccugaucgccauggaccucggggaacucugcgaggacaccaugaccuacaagugcccccguaucaccgaagcggagccugacgacguagacugcuggugcaacgccaccgacaccugggugacuuacgggaccugcagccaaaccggcgagcaccggcgcgacaagcgguccguggcccuggcgccccacgugggccuggggcucgagacgaggaccgagaccuggauguccuccgagggagcuuggcggcaaauccagaagguggagaccugggcccugcgccaccccggguucacggugaucgcgcuguuccucgcucacgcaaucggcaccagcaucacccagaaggggauaaucuuuauccugcugauguuaguuaccccuuccauggcaaugcggugcgucggcauaggcaaucgcgacuucguagaggggcugagcggagccaccuggguggacgugguucuggagcauggguccugcgugaccaccauggccaaaaacaagccaacccucgacaucgagcugcugaagacggaagucacaaaccccgcggugcuucgaaagcugugcaucgaggccaagaucagcaacaccaccacggacucgcgcugccccacccagggcgaggccacauuaguggaggagcaggacgccaacuucgucugccggagaacuuucguggaccggggcugggggaacggcugcggacucuucggcaaggggagccugcugacgugugccaaguucaagugcgucaccaaguuagaagggaagaucguccaauaugagaaccugaaauacagugugaucgugaccguccauaccggugaccagcaccagguggggaacgaaaccaccgagcacgguaccaucgcgacgauaacgccccaggccccaacgagcgagauccagcugaccgacuacggggcccucacccuagacugcagcccccggaccggucuggacuucaacgagaugguccuccugaccaugaaggagaaguccugguuggugcacaagcagugguuccucgaccugccucugcccuggaccuccggggccagcacaagccaggagaccuggaaccggcaagaccuccuggugacguucaagaccgcccacgcgaagaagcaggaggucguggugcugggcagccaagagggugcgaugcacaccgcccucaccggggccacggagauccagaccagcggcaccaccacgaucuucgccgggcaccuaaagugccgcuugaagauggacaagcugacccugaagggcgucuccuacgugauguguacagggagcuucaaacuggaaaaggagguggcugagacacagcacggcacgguccugguccagguaaaguacgagggcacagaugcccccugcaagauccccaucuccacucaggacgagaaaggaguagcccagaacggucggcucauaacugccaacccgaucgugacggacaaggagaagccagugaacaucgagaccgagccgcccuucggcgagagcuacaucgucauaggggcuggcgagaaggcccugaagcugaguugguucaagaaggggagcuccauaggcaaaauguucgaagccaccgccagaggggcacgacgcauggccauccucggcgacaccgcuugggauuucgguagcaucggcggcguguucaccuccgugggaaagcugguccaccagguguucggcaccgccuacggagugcuguucuccggcguguccuggaccaugaaaaucgggauuggcauacuccugacauggcuaggacuaaacagccguuccacgagccuguccaugacuugcaucgcaguggggauggugacucuguaccuuggugucauggugcaagcugacagcgguugcgugaucaacuggaagggccgagagcuuaaaugcggcuccggcauauucgucaccaacgaggugcacacguggaccgagcaauauaaauuccaggcggauagccccaagcgccuauccgccgcuaucggcaaggccugggaggagggggugugcggcaucagguccgccacccgucucgaaaacaucauguggaagcagaucagcaacgagcugaaucacauccuguuagagaacgacaugaaguucaccgucguagugggggaugcgaacgggauccugacccaaggaaagaagaugauccgaccccagccuauggagcacaaguacuccuggaagucguggggcaaggccaagauaaucggcgcggacacacagaacacuaccuucaucaucgacgggccugauaccccggaauguccagacgaccagcgcgccuggaacaucugggaggucgaggacuacggcuucgguguguucacgaccaacaucuggcugaagcuccgggacaguuacacacagaugugcgaccaccgccugaugucugcggccauuaaggacucgaaggccgugcacgccgauaugggcuacuggauagagagcgagaagaacgagacauggaagcuggcccgggcguccuucaucgagguaaagacgugcaucuggccaagaagccacacccucuggucgaauggcgugcuagagucagagaugauuaucccuaagauauacggggguccgauuagccagcauaacuaccgccccggguauuucacucagaccgccggccccuggcacuuggggaagcucgagcuagauuucaaccuuugcgagggcacgacuguggucguggaugaacacugcggcaaccgcgggccgagucuccguacuaccacggugaccggcaagaucauacacgaguggugcugccgcagcuguacccugccgccccugcgcuuucgcggggaagacggcugcugguacggcauggagauccggcccgucaaagagaaggaagagaaccucgugcgcagcaugguguccgccggcagcggcgaggucgacagcuucagccuggggcugcucugcgugagcaucaugaucgaggaggugaugcggucccgcuggagccgcaagaugcugaugacgggcacgcuggccgucuucuuccuauuaaucauggggcaacugaccuggaacgaccucauuagacucugcaucauggugggugccaacgucuccgaccgcauggggaugggcaccaccuaucuggcgcucauggccacguucaagaugcggccgauguucgcagugggccugcuguuucgccggcuuaccagccgcgaggugcugcugcucaccaucgguuugucccugguagccagcguagaguuacccaacucgcuggaggaguugggcgacggccucgccaugggcaucaugaugcucaagcugcucaccgacuuccagagccaccaacuguggacgaccuugcucucauuaaccuucaucaagaccacgcugagccucgacuacgcguggaagaccauggccaugguguugucaauugucucucuguucccgcucugccuguccaccacaagccagaagacgaccugguuacccgugcugcugggcuccuucgggugcaagccccugacaauguuccucaucaccgagaacaagaucuggggccgcaaaagcuggccccugaacgaggggaucauggccgugggcauugucuccauccuguugagcagccugcugaagaacgacgugccgcucgccgggccucugaucgcgggcggcaugcugaucgccugcuacgugaucuccgggagcuccgcugaccucagccuggagagagccgccgaaguuuccugggaagaagaagcggagcacucuggcgccucccacaacauccugguggagguacaggacgacggaaccaugaagaucaaggacgaagaacgggacgauacgcucacuauccugcuaaaggccacucuccuggccguuagcggaguguacccgauguccauccccgccacgcuguuugugugguacuucuggcagaagaaaaagcagcgcagcggggucuugugggauacgcccucgccgcccgagguggagcgggcggugcuggacgacggcaucuacagaauacugcagcggggccugcucgggcgcucccaagucggcgugggaguguuccaggacggcguuuuucauaccauguggcacguaacccgcggcgccguccuuauguaccagggcaagcgccuggagcccucgugggccagugucaagaaggaccucaucuccuauggcgggggcuggcgauuccaggggagcuggaacaccggcgaggagguccagguuaucgccguggagcccgggaagaaucccaagaaugugcagacaacccccggcaccuucaagacccccgagggcgaggugggggcaaucgcccuggacuucaagcccgggacguccgguagccccaucguaaacagggagggcaagaucgugggccuguacgggaacggcgugguaaccaccuccgggaccuacgucagcgccaucgcgcaagccaaggcaagccaggagggcccgcuccccgagaucgaggacgaagucuucaagaagcggaaccugacgaucauggaccuccaccccggguccggcaagacccgccgguacuuaccggcgaucguccgcgaggccaucaaacgcaaguuacggacccugauccucgcccccacacgcgugguggccagcgagauggcggaggcccuuaaggggaugcccauucgguaccagacuacggccgucaaguccgaacacaccgggaaagagaucguagaccugaugugccacgccaccuucacgaugcgccuccugagcccugugcgggucccgaacuacaacaugaucauuauggacgaagcccacuucacggacccggcguccaucgccgcgcgcggcuacaucagcaccagaguggggaugggcgaggccgccgcgaucuucaugaccgccacgccgcccggguccguggaggccuucccgcaaagcaacgccgucauccaggacgaggagcgagacauccccgagcgcucguggaauaguggguaugacuggaucaccgacuuccccggcaagaccgugugguucgugccauccauuaaaagcgggaaugacaucgccaacugccugcgcaagaauggcaagcgggucauccagcucucccgcaagacguucgacacggaauaucaaaagaccaagaacaacgacugggauuacgugguuaccaccgacaucagcgagaugggggcgaacuuccgagccgacagagucaucgacccgcggcgcugccugaaacccgugauccugaaggacggccccgagcggguaauccucgccgggcccaugccugugacggccgcgucggcugcccagaggcggggccgcaucggccgcaaccaaaacaaagagggggaccaauacaucuacaugggccagccccugaacaacgacgaggaccacgcccauuggaccgaggcgaagaugcugcucgacaacaucaacacuccagaggggaucauucccgcucuguucgagccggagcgugagaaaagcgcugccaucgacggggaauaccggcugcgcggggaagcacgcaagaccuucguggagcuaaugcggcgcggcgaccuucccgucuggcugucauacaagguggccagcgagggcuuucaguacuccgaccggcgcuggugcuuugacggggagaggaacaaccaggugcucgaggagaauauggacgucgagaucuggacgaaggagggcgagcgcaagaagcugagaccccgcuggcuggacgcgcggaccuacagcgacccucucgcucugcgcgaguuuaaggaguucgccgcgggacgucgaagcguguccggcgaccugauccucgagauaggcaagcugccgcaacaccugacccuccgggcacagaacgcucuggacaaccuggugauguugcacaacagcgagcagggcggcaaggccuacaggcacgccauggaggagcugcccgacaccauugagacccugaugcuccuggcacugauugcggucuugacagguggggugacccuguuuuuccuguccgggaaaggacucgggaagaccagcaucggucugcugugugugauggcuucgagcguccuccuguggauggccuccguagagccucacuggaucgccgccagcauaauccuggaguucuuccucauggugcugcuuauccccgagccugaccgucaacgcacuccccaggauaaccagcucgcguacgucgugauuggccuacuguucaugauccucacgguggccgccaacgagaugggcuugcuggagaccacgaagaaggaccugggcaucggacacgucguagcggagaaucaccaucacgcgacgaugcuggauaucgaccugcaccccgccuccgcauggacgcucuacgccguagcgaccaccaucauuacuccgaugaugcggcacacgaucgagaacacuaccgccaacaucagucugaccgcgaucgcgaaccaggcagcgauccugaugggccucgacaagggcuggccgaucagcaagauggacauaggggucccccugcuggcccucgguugcuauucacagguaaaccccuuaacgcugacugcugccgugcucaugcuggucgcacacuacgccaucaucgggccgggccugcaggcgaaggccacccgcgaggcccaaaagcgcaccgccgccgggaucaugaaaaaccccacgguugauggcauuguagcgauagaccucgacccgguuguguaugacgccaaguucgagaagcagcugggccagaucaugcuguugaucuuaugcaccucccagauuuuacugaugcgcaccaccugggcccugugcgagagcaucacacuggccaccggcccccucaccacccugugggagggcuccccggggaaguucuggaacacgacgaucgcagugagcauggcgaacaucuuccgcggcuccuaucuggccggagcggggcucgccuucagccucaugaagucccuaggggguggccgucgcgggaccggcgcucagggcgagacccucggggagaaguggaaacggcaguugaaucagcugagcaagagcgaguuuaacaccuacaagcggucuggcaucauggaggucgaucggagcgaggcgaaggaaggucucaagcggggcgagacuaccaaacacgccgugucucgggggacugccaaguugcgcugguucguggagcggaaucuggucaaaccugagggcaagguaaucgaccuuggcugcggucgcggcggguggucuuacuauugugcaggccucaagaaggugacagaggucaagggguacaccaaaggcggucccgggcaugaggaacccaucccgauggcgaccuacggcuggaacauuguaaaacugcacuccgggcgggacgucuucuucacuccgcccgagaagugcgacacccugcucugcgacaucggcgagagcucccccaacccgacgauugaggagggccgaaccuugcgaguccugaagaugguggaacccuggcucagaggcaaccaauucugcaucaagauccugaaccccuacaugcccucgguggucgagacccuggagcagaugcagcggaagcacggcgggaugcucgugcguaauccgcugagucggaacagcacccacgagauguacuggguuuccugcggcacugguaacaucgucagcgcuguaaacaugaccucccgcaugcugcucaaucgcuucaccauggcccaccggaagcccaccuaugagagagacguggaccucggcgccggaacgcggcacgucgccguggagcccgagaucgcgaaccuggacaucaucgggcaacgcaucgagaacaucaagaacgagcacaagagcaccuggcacuacgacgaagacaaccccuacaagacaugggccuaccacggcuccuacgagguaaagccauccggguccgccagcuccauggucaacggcgugguccggcuccucaccaagcccugggacgugauccccauggugacgcagauagccaugaccgacaccacgcccuuuggccaacagcgcguauucaaagaaaaaguggacacccggaccccacgccccaagcggggcaccgcacagaucauggaggucaccgcuaaguggcuguggggcuuccucagccggaacaagaagccccggaucugcacacgggaggaguucacacggaagguccgcagcaaugccgcgauuggggccguguucguggacgagaaccaauggaacucagccaaggaggcggucgaggacgagcgguucugggaucuagugcauagggaaagggagcugcauaagcagggcaagugcgcgaccugcguguacaacaugauggggaagcgcgaaaagaaguugggagaguucgggaaggccaagggcagccgggcuaucugguacauguggcugggggcgcgcuuccuagaguucgaggcccuaggguucaugaacgaggaccauugguuuucccgggaaaacagccuguccggaguggaaggggagggacugcacaaguugggguauauccugcgcgacaucagcaagaucccgggcggcaacauguacgccgacgacaccgccgggugggauacgcguaucaccgaggacgaccugcagaacgaggccaagaucacagauaucauggagccagagcaugcguugcuggccacguccauuuucaagcugacguaccaaaacaagguggugcggguccagcgcccggccaagagcggcacugugauggacgucaucucccggcgggaccagcgggggagcggccaggucggcacauaugggcucaacacuuucaccaacauggaggugcagcuaauucgucagauggaguccgagggcaucuuuagccccuccgagcuggagaacagcaaucucgccgagcggguccucgacuggcucgagaaacauggugucgagcgccuuaagcggauggcgaucucgggcgacgacugcguugugaagccgaccgaugaccgcuucgcgaccgcccugacugcccugaacgauauggggaagguccgcaaggacauuccccagugggagcccagcaaaggcuggaacgauuggcaacaggucccguucugcucccaucacuuccaccagcucaucaugaaagacggacgcgaaaucgugguuccgugccggaaccaagacgagcugguggggcgcgcccgugugagccaaggcgccggguggucgcugcgcgagacggcgugucucggcaaguccuacgcgcagauguggcagcugauguacuuccaccgccgcgaccuacggcucgccgccaacgccaucugcagcgccguccccgugaacuggguccccaccucccgcaccaccuggagcauacaugcccaccaucaguggaugaccacggaggauaugcuauccgucuggaaccgcguguggaucgaggagaaccccuggauggaggauaagacccacgugucauccugggaggacgucccguaccuggggaagcgggaggaccaauggugcggcagccucaucggcuuaaccgcccgcgccaccugggcgacgaacauccagguagccauaaaccaggugcgcaggcucaucgggaaugagaacuaccuagacuacaugaccuccaugaagcgguuuaagaacgagucugaccccgagggcgcccugugguag

SEQ ID NO: 24728 - RNA, 9879 nt, Artificial Sequence
  derived and/or modified CDS sequence (opt11) from DENV-1__KM403603__SS-prME
agugugacaauguuacucaugcugcugcccacggcccucgccuuccacuuaaccacccggggcggggagccccacaugauagucagcaaacaggaaagggguaagagccuccuuuuuaagaccuccgcgggggucaacaugugcacucucaucgccauggaucugggcgagcucugcgaggauacgaugaccuacaagugcccucgaaucaccgaggccgagcccgacgacguugacugcuggugcaacgccaccgacacguggguaaccuacgggaccugcucccagacgggcgagcacagacgagacaagcgauccguagcccucgcuccccacgugggacuggggcuggagacgagaaccgagaccuggaugucuuccgagggagcuuggcgucagauccaaaagguggagaccugggccuugcgacaucccggguucacggucaucgcucuguuccucgcgcacgccaucggcacuagcaucacucaaaagggaaucaucuucauccugcugauguugguuacccccucgauggccaugcggugcguuggcaucggcaaucgcgacuucguggaggggcucucaggcgccaccuggguggaugucgugcuggagcacggguccugcgugacuaccauggccaagaacaaacccacccuugauaucgagcugcugaagacggaagugaccaaccccgcggugcuccggaaacucuguaucgaggcgaagaucuccaacaccaccacggacucccgcugccccacccagggagaagcgacccugguggaggagcaagacgccaauuucgucugccgaaggacguucguagacaggggaugggggaacggcugcggacuauucggaaaggggagccugcugacgugcgccaaauucaagugcgugaccaagcucgagggcaaaaucgugcaguacgagaaucugaaguacagcgugaucgugacgguccacaccggcgaccagcaucaagugggcaacgagacaaccgagcacgguacuauagcgaccaucacgccgcaagcaccgacgagcgagauccagcugacagacuauggggcucucacgcuggacugcucuccuagaacagggcuagacuucaacgagaugguccuccugacuaugaaggaaaaguccugguuggugcacaagcagugguuucucgacuugccacugcccuggaccuccggagccagcaccagccaggagaccuggaaucggcaggacuuguugguuaccuucaaaacagcacacgcgaagaagcaggaggucguagugcugggcagccaagagggcgccaugcacacagcucugaccggggccacggagauccagaccagcggcaccaccacuauauuugcgggucacuuaaagugccgccugaagauggacaaguugacccugaagggggucucguaugugaugugcacagggucuuuuaagcuggagaaggagguggcggagacccagcacggcacgguccuaguccaggugaaauacgaaggcaccgaugcccccugcaagauuccaaucuccacucaggacgaaaaaggggucacccagaacggccggcucaucacggccaacccaaucgucaccgauaaagagaagcccgugaacaucgagacagagccuccuuuuggagaaagcuauaucgucaucggagcuggagagaaggcucucaagcuguccugguucaagaaggggagcaguaucgguaagauguucgaagccaccgcccgcggggcccggcgcauggcgauccuuggagauacggccugggacuucgggagcaucgggggcguguucaccucagucgggaagcuaguccaccaggucuucggcaccgcguacggagugcuguucagugguguguccuggaccaugaagaucggaauaggcaucuugcugacguggcugggucucaauagccgcagcaccagccugaguaugacguguaucgccguugggauggugacccuguaccuuggggucauggugcaggccgacucagggugcguaaucaauuggaagggcagggaacugaaaugugggucuggcauauucgucacgaacgagguacacacauggaccgagcaguauaaguuucaggccgauuccccgaagcgacucagcgcggcaaucggcaaggccugggaagagggggugugcggcauccggagugccaccaggcucgagaauaucauguggaagcagauauccaacgaguuaaaccauaucuugcucgagaacgacaugaaguucacagucguggugggggacgccaacggcaucuugacucaggggaagaagaugauccgaccccagcccauggagcacaaauacucguggaagagcuggggcaaggcgaaaauuaucggggccgacacacagaacaccaccuucaucaucgacggaccggacacgccggaaugccccgacgaccagcgagccuggaauaucugggagguggaggacuacggcuucgggguguucacgaccaauaucugguuaaagcuccgggacuccuacacacagaugugcgaccaccgcuuaaugucugcagcgaucaaggacaguaaggcggugcacgccgacaugggcuauuggauagagucggagaaaaacgagacguggaaacuagcuagggccaguuucaucgaggucaagaccugcauuuggccacgcagccacacucucugguccaacggcgugcuggagagcgagaugauaauccccaagaucuacgggggcccgaucucgcagcacaacuaucggccuggguauuucacccaaacggcaggucccuggcaccuggggaagcucgagcuggauuucaaccugugcgagggcaccacuguggucguggaugaacacugcgggaaccgcgggcccucacugcggaccacaaccguuaccggcaagaucauacaugaguggugcugccgcucgugcacacugccgccccugcgguucaggggggaagacggaugcugguacgggauggagauccgcccugucaaggagaaggaggagaaccugguucggucaaugguguccgccggcagcggcgagguggacucuuucucccuggggcuccucugcgucagcauaaugaucgaggagguuaugcggucccgguggucuagaaagauguuaaugacggggacccuggccguguuuuuccuccugaucaugggacagcugaccuggaacgaccugauccgacuguguauuauggugggggccaacgugucugaccgcauggggaugggcaccacguaucuggcccucauggcgaccuucaagaugcggccgauguucgccgucgggcuguuguucaggagacucacuagccgcgagguacugcuccucaccaucgggcugucccuggucgcuagcguggagcucccuaacucgcuggaggaacugggcgaugggcucgccauggguaucaugaugcucaagcugcucacggauuuucagagccaccagcuguggacuacccuguugucucugaccuucaucaaaaccacccugaguuuggacuacgccuggaagaccauggcuauggugcuguccaucguaucgcuuuucccccucugcuuguccacaacgucacagaagacaaccuggcugcccgucuuacugggcucguucggcuguaaaccgcugaccauguuucucaucaccgagaacaagaucuggggccgcaagaguuggccccugaacgaagggaucauggccguggguauugucucaauauugcucagcagccugcugaagaacgacgugccccucgccgggcccuuaaucgcuggagguaugcugaucgcgugcuacgugauauccgggagcuccgccgaccuuagccuggagcgcgccgcggaggucaguugggaggaggaagcggaacacagcggagccucccacaacauccuuguggaggugcaggacgacgggacaaugaaaauaaaggacgaggagcgggacgacacccuaacgauccugcugaaggccacccuccuggcggucucuggaguauacccaaugucaauccccgccacgcuguucgugugguacuuuuggcagaagaaaaaacagcgcucgggggucuugugggacacuccauccccucccgagguggagcgggcugugcuggacgacggcaucuaccgcauucugcagcggggauuacucggacgcagccaggucgggguggggguguuccaggacgguguguuccacaccauguggcacgugacccggggggcgguucugauguaccaagguaagcgccucgaaccauccugggccagcgucaagaaggacuuaaucucuuauggcggggguuggagguuccaagggagcuggaauacgggugaagagguccagguuaucgccguggagcccgggaaaaaccccaagaacgugcagaccacacccggcacauucaaaacacccgagggcgaggugggcgccaucgcccuggacuucaagccuggcaccagcggaagccccauugugaaucgcgagggcaagaucgucggccuguaugggaacggcguggucaccaccuccggaacguacgucagugcgaucgcccaggccaaggccagccaagagggcccguuacccgagaucgaggacgagguguucaagaaacggaaccugaccaucauggaccugcaccccgggagcggcaagacccgucgcuaccuccccgccaucguucgcgaggccaucaagcgcaaacugcggacacugauccucgcccccacgagaguuguggccagcgagauggccgaggcgcucaagggcaugccgauucgguaccagacaaccgcggucaaauccgagcauaccgggaaagagaucguggaccugaugugucacgcuacguucaccaugcgucugcugagccccgugcgggucccgaacuacaacaugauuaucauggacgaggcccacuucacagacccagccaguaucgcagcccgcggguacaucagcaccagaguaggcaugggcgaggccgccgcgauuuucaugacggcgacgccgcccggaaguguggaggccuucccgcagagcaacgccgucauccaggacgaggagcgcgacaucccugagcgcucuuggaacagcggcuacgacuggauuacugacuucccuggcaagaccgugugguucguccccuccauaaagagcgggaacgacaucgccaauugcuugcguaagaacgggaagcgggucauccaacucucgcgcaagacguucgacaccgaguaccaaaagaccaaaaacaacgacugggacuacgugguuaccacggacauaagcgagaugggggccaacuucagagcggaccgcgugaucgacccccggcgcugccugaagcccgugauccugaaggacggcccggagcgggucauucucgccgggcccaugccgguaaccgccgccuccgcggcgcagcgaaggggccgcaucggccgcaaucaaaacaaggagggcgaccaguacaucuacaugggccaaccucugaacaacgaugaagaucacgcucacuggaccgaagccaaaaugcugcucgacaauaucaacaccccugaggggauaauaccugcacuguuugagccggaacgcgagaaguccgcggccaucgacggcgaguaccgauuacgcggggaggcccgcaagaccuucguagagcuaaugcggagaggcgacuuacccguauggcugaguuacaagguggccagcgagggcuuccaguauuccgaccgucgcugguguuucgacggggagcggaauaaccaagugcucgaggaaaacauggacguugaaaucuggacuaaggagggagagagaaagaaguugcggccccgcuggcuggacgcacggacuuacagcgacccgcuagcguugagagaguucaaagaauucgccgcgggacggcgcaguguguccggggaccugauccuugagauaggcaagcugccacagcaccugacgcugcgggcccagaacgccuuagacaacuuggugaugcuccacaacagcgaacaaggcgggaaggcguaccgccacgccauggaggagcugcccgacaccaucgagacgcucaugcuccuggcguugaucgccguccucacugggggcguuacccuauucuuccuguccgggaaaggccucggaaagaccucgauuggacuauuaugcgugauggcguccagcgugcucuuguggauggccuccgucgagccccauuggaucgccgccuccaucauacuggaguucuuccucaugguguugcuaauacccgagccggauagacagcgcaccccccaagacaaccagcuggccuacgucgucaucggccugcuguucaugauucucacuguggcggccaacgagaugggauugcuggagaccaccaagaaggaccucggcauagggcacgucguggccgagaaccaccaucacgccacgaugcuggacaucgaucuccacccugcuuccgcguggacccuguacgcuguggccaccaccaucauuacgccaaugaugaggcacaccaucgagaacacuaccgcaaauaucagccuaacggccauagcgaaccaggccgcgauccuaaugggcuuggauaagggcuggcccaucuccaaaauggauaucggcguccccuuacuagcauuaggcuguuacagccaagugaauccccugacccugaccgcugcgguucuaaugcuugucgcgcacuacgccaucauagggccgggccugcaggccaaggcgacccgcgaggcccagaagcgcacggcggccgggaucaugaagaacccgaccguugacggcaucguggcaauagaucucgaccccgugguauacgacgcgaaauucgaaaaacagcugggccagaucaugcugcucauccucugcaccucucaaauccuccuuaugcggaccacuugggcccugugcgaaagcaucaccuuagccacaggaccacucacuacgcugugggagggguccccugggaaguucuggaacacaaccauagccgugagcauggcgaauauuuuccgcggcuccuacuuggcuggcgccgguuuagcauucagccugaugaagacacugggcgguggccggagggggacuggcgcccagggcgaaacucucggggaaaaguggaagcgccagcugaaccagcuguccaagagcgaguucaacaccuauaagcgcagcggcaucauggaagucgaccgguccgaagccaaggaggggcucaaaagaggcgagaccacgaagcacgcggugagccggggcacagccaagcugcggugguucgucgagcggaaucuggucaagcccgaaggaaaggucaucgaccugggaugugggcgcggcgggugguccuacuacugcgcgggacucaagaaggucaccgagguuaagggguacaccaaggggggcccugggcaugaggagcccaucccgauggccaccuauggauggaauaucgugaaacugcacagcgggcgggauguguucuucacgccgccggagaagugcgacacucugcucugcgacauuggggaauccucccccaacccuacgaucgaagagggucgcacccuccggguccugaaaaugguggagcccugguuacgcggcaaccaguucuguauaaagauccugaacccuuacaugcccuccgugguggagacccuagagcaaaugcagcgcaagcacggcgggaugcuugugaggaacccgcugagcagaaauuccacccacgaaauguacugggugagcugcggcacaggaaacauugucuccgcggugaacaugacgucccgaaugcugcuuaaccgauucacgauggcgcacagaaagccaaccuaugaacgcgauguggauuuaggcgccggcacccggcauguugccguggagcccgagauagccaaccuggacauuaucggucagcgaaucgagaacaucaagaacgagcauaaaucaaccuggcacuacgacgaggacaauccauacaagaccugggcguaccacggcagcuacgaggugaaaccguccgggagcgccucgagcauggucaacggggugguccggcuccugaccaagcccugggacgugauccccauggugacacaaaucgccaugacagacacgacgcccuucgggcaacagcgcgucuucaaggagaagguggauacccggaccccgcggccuaagcgggggacugcacagauaauggaagugacagccaaguggcuguggggguuccucucccgcaacaaaaagccccguaucugcacccgcgaggaguucacuagaaaaguccgaucgaacgcggcaaucggggccguguucguggacgagaaccaguggaacagcgcuaaggaagccgucgaggacgaaagguucugggaccugguccaccgcgaacgggagcugcacaagcaaggaaaaugcgcgacgugcguguauaacaugauggggaagcgcgagaaaaaacucggugaguucgggaaggcuaagggaucucgggccaucugguacauguggcucggggcccgcuuucuggaguuugaagccuugggguucaugaacgaggaucacugguuuucccgggagaacucccugagcggcgucgagggagaggggcuccacaagcucggguacaucuugcgugacauuuccaaaauuccggggggcaacauguacgccgacgacaccgcggggugggauacacgcaucaccgaggacgaccugcagaaugaggccaagauuacggacauuauggagcccgagcaugcacuguuggcuacauccauauucaagcugaccuaucagaacaagguugugagagugcaacgcccggccaagucaggcaccgugauggacguaaucagccggcgggaucagcguggcuccggccaggucgguacuuacgggcucaauaccuucaccaacauggaaguucagcugauucggcagauggagagcgagggcauauucucaccuagcgaauuggagaacuccaaucucgcggagaggguguuggacuggcuggagaagcacgggguugaacgcuugaagaggauggccaucuccggggacgauugcguagugaagccgaccgaugacagguucgcaacugcgcugaccgcccugaacgauaugggcaagguaaggaaagacauaccucagugggagcccuccaaaggcuggaaugacuggcagcaggucccguucugcagccaccacuuucaucaguuaaucaugaaagacgggcgugaaaucguagucccaugcagaaaccaggacgagcugguggggcgcgcccgggugagccagggagccggguggagccugcgcgaaaccgccugccucggcaagaguuacgcgcagauguggcaguugauguacuuccaccguagggaccugcggcucgccgcuaaugccaucuguuccgcagucccagugaacugggugcccaccucaagaacuaccuggagcauccaugcgcaccaccaauggaugacgacggaggacaugcugagcgucuggaaccgcguguggaucgaagagaaucccuggauggaagacaagacccaugucuccagcugggaggacgucccauaccugggaaaacgggaagaccaguggugcggcucccucaucggccugaccgcccgugcgaccugggccaccaacauucaaguggcgauaaaccagguccggagacugaucgguaacgagaacuaccucgacuauaugaccagcaugaaacgcuucaagaacgaaucugaccccgagggcgcccucugguga

SEQ ID NO: 24729 - RNA, 9879 nt, Artificial Sequence
  derived and/or modified CDS sequence (opt11) from DENV-1__KM403585__SS-prME
agcgugaccaugcuguuaauguugcuacccaccgcccucgccuuccaccugaccacccgggguggagagccccacaugauagucagcaagcaggaaaggggcaaguccuuacuuuucaagaccuccgcggggguaaacaugugcacccugaucgccauggaccugggcgaauugugcgaggauacgaugacuuacaagugccccagaaucaccgaggccgagcccgacgacguagacuguuggugcaaugcgacugacacuugggugaccuacggcaccuguagccagaccggcgagcaccggcgggacaagcgcuccguggcacuggcgccccacgucggccugggguuggagacacgcaccgagacauggaugagcuccgaaggugccuggcggcagauccagaaggucgagaccugggcccugcgccacccaggguuuacggugaucgccuuauuucucgcgcacgccaucggcaccagcauaacgcagaagggcauuauuuucauucugcuaaugcucguaacucccuccauggcuaugagaugcguaggcaucggcaaccgcgacuucguugaggggcuuagcggggcaacguggguagacgucguguuggagcacggauccugcguuaccaccauggccaagaacaagccaacacuggacaucgaguugcugaagacggaaguuaccaacccugcuguacuacggaagcuuugcaucgaggccaaaaucaguaacacaaccacggacucacgcugccccacccagggcgaggccacccugguggaggagcaggacgcaaacuucgucugccggcggacguucguggaccggggcugggggaacggcugcgggcucuucggcaaaggaucccugcugacuugugccaaguucaagugcgugaccaagcucgagggcagaaucguccaguacgagaaccugaaguacuccguuauugucaccgugcacacuggcgaucagcaucagguggggaacgagacgaccgagcacggcaccaucgccaccaucacgccccaggcccccacaagugaggugcagcuaaccgacuacggggccuuaacucuggacugcucgccccgaaccggucuggacuucaaugaaaugguucuucugaccaugaaggagaaguccugguuggugcauaagcagugguuccucgacuugcccuuaccuuggaccuccggggcgucgaccagccaggaaaccuggaaccgccaagaccucuugguaacguucaagaccgcccacgcgaagaagcaagagguugugguccugggcucccaggagggggccaugcacacagcccucaccggggccacggaaauccagaccagcggaaccacuacuauuuucgccggccaccugaagugccggcugaagauggacaaacucacccugaagggugugucguaugugaugugcacagggagcuuuaagcuugagaaagaggucgcggagacccagcauggcacgguccuagugcaggucaaguacgaggguacggacgcucccugcaagauccccaucuccacgcaggacgagaagggggugacccagaacggucgccucaucacggccaacccuauaguuaccgauaaagagaagcccgucaacaucgaaaccgagccgcccuucggagagaguuacaucgugaucggcgccggcgagaaggcacugaagcuguccugguucaagaaggguagcuccaucggcaagauguucgaagccaccgcccguggggcccgccgaauggccaucuuaggcgacacggcgugggacuucggaagcaucggcggcguauucaccagugucgggaagcuugugcaccagguguuuggcaccgccuaugggguccuguuuagcggcgugagcuggaccaugaagaucgggaucggcaucuuacuuacguggcugggccucaacagccgauccacgagccuguccaugaccugcaucgccguggggauggucacccuuuaccugggaguuauggugcaggcagacagcgggugcgucauuaacuggaagggucgagagcugaagugcggguccggcaucuuugugacgaacgaggugcauaccuggacggaacaguauaaguuccaggccgacaguccuaagcgucugagcgcggcaauugguaaggccugggaggagggggucugcggcauccgcuccgcgacucggcuagagaacaucauguggaagcagaucagcaacgagcugaaucacauccugcucgagaacgacaugaaguuuacuguggucguaggagacgcauacgggauucucacgcagggaaagaaaaugauacgcccccagcccauggagcauaaguacuccuggaagucuuggggcaaggccaagaucauuggcgccgacacgcaaaacaccaccuucauaaucgacgggcccgacacgccggagugcccugaugaccagcgggccuggaacaucugggagguagaggacuauggauucggaguguucaccaccaacaucugguuaaaguuacgggacuccuauacccagaugugcgaccaccggcugaugucagccgcaauuaaagauucuaaggcgguccaugccgacaugggcuauuggaucgagagcgagaaaaaugagacguggaaacuggcccgcgccagcuucaucgaggucaagacauguaucuggccgcggagccauacccucugguccaacggcgugcuugagucugagaugaucauccccaagaucuacgggggcccgauuucccagcacaacuaucgccccgguuacuuuacccaaacggccggccccuggcaccuggggaagcucgagcuggacuucaaccuaugcgagggcacuaccgucguuguggacgagcacugcggcaaccggggaccgagucuccgcacgacuaccgucacaggcaaaaucauccacgaguggugcugccgcucaugcacccuaccgccccugcgcuucagaggggaagacggcugcugguacgggauggagauccgcccagugaaggagaaagaagaaaacuuggugcggagcaugguauccgccggcagcggcgagguggacagcuucucccugggucugcucugcguuagcauaaugaucgaggaggucaugcgcucccgcuggucacggaagaugcugaugacgggcacccucgcuguguucuuucuccugaucauggggcaacucaccuggaacgaccucauccgucucuguaucauggugggcgcaaacgucuccgaccggaugggaaugggcaccacguaccuggcacugauggcgaccuucaagaugcguccgauguucgccgugggguugcuguuccgccgccucaccagccgggagguccugcugcucaccaucggucugucgcuggucgccagcguggagcuccccaacagccuggaggagcugggcgaugggcuagccauggggauuaugaugcugaagcugcuaacggacuuucagagccaucagcuguggaccacgcuguuaucccucaccuucaucaagacgacucugagccucgauuacgccuggaagaccauggcgaugguccugagcaucgucagccucuuuccacucugccugucgaccacuagccagaagacaacguggcugcccguguuacuggguagcuucggcugcaagccucugaccauguuccugaucaccgagaauaagaucuggggacgcaagaguuggccccugaacgaagggaucauggccgucggaaucguguccauccugcucuccagccugcugaagaacgacguuccccucgcugggccccugaucgcuggcggcaugcugaucgcguguuacgucaucuccgggagcuccgccgaccucagccuggagcgggccgccgaggugucaugggaagaagaggccgagcacagcggugcgagucacaacauccugguggagguccaggacgacgggacgaugaagauuaaggacgaggagagagacgauacccuuaccauacugcugaaggcuacccuccuggccguuucaggcguguacccgauguccauccccgccacacuguucgucugguacuucuggcagaagaaaaagcagcggagcggugugcucugggacaccccgucgccgcccgagguggagcgggccguucuggacgacgguaucuaccggaucuugcagagaggccuguuagggcggagccaagugggcgugggcgucuuccaggauggcguguuccacaccauguggcacgugacccgcggggccguccugauguaccaaggcaagcggcuggagcccagcugggccucugugaagaaggaccucauuuccuacggcgggggcuggcguuuccaagggagcuggaacacgggcgaggagguccaggucaucgcaguggagccggggaagaaccccaagaacgugcaaaccacccccggcacguucaagacccccgagggcgaggucggggccaucgccuuagacuucaagcccggcacuucggggagcccgaucgugaaccgggagggaaagauugugggccuguacgggaauggcguugucaccacuuccgggacguacguuagcgcaaucgcccaagccaaagcuagccaggagggaccacuccccgagaucgaggacgaggucuucaaaaaacgcaaucugaccauuauggaccuccaucccgguagcgguaagacgcggcgcuaccucccugcuaucgugcgggaggccaucaagcggaaacugcgcacccugauucucgccccaacgcggguggucgcuucagaaauggccgaagcccuaaaggguaugcccauccgcuaucagaccaccgcugugaaauccgaacauaccgguaaagagaucgucgaccugaugugucacgccacguucaccaugcgacuccucucuccugugcgcgugccgaacuacaacaugaucauaauggacgaggcccacuucaccgaccccgccuccaucgcggcccguggguacaucagcacccgaguaggcaugggcgaggccgcugccauauucaugacggcgacgccgcccggguccgucgaggccuucccacagagcaacgcgguaauccaggacgaggagcgcgauaucccugagagauccuggaauagcgguuaugacuggaucaccgacuuccccggcaaaaccgugugguucguccccuccaucaaaucggggaacgacaucgcuaacugcuuacggaagaacggcaagcgugugauccagcucuccaggaagacguucgacaccgaguaccagaagaccaagaacaacgacugggacuauguggugaccacggacaucagcgagaugggcgccaacuuccgcgcggaccgggugaucgacccgcgccggugccugaaaccagucauucuuaaggauggucccgaacgcgugauccuggcaggacccaugccugugaccgccgcauccgcggcccagaggcgcggccgcaucggacggaaccagaauaaagagggggaccaguauaucuacauggggcagccccugaauaaugaugaggaccacgcgcauuggacagaggccaagaugcugcucgacaacauuaacacucccgaggggaucauccccgcucuguucgagccggagcgcgagaaguccgcggccauugacggggaguaccggcuacgcggggaggcccggaaaacguucgucgagcucaugcgccggggcgaccuacccguguggcuguccuacaaggucgccucagagggcuuucaguacagugaucgccgguggugcuucgacggggagcgcaauaaccagguauuggaggagaacauggacguggagaucuggaccaaagagggcgagcggaagaagcugcgcccacguuggcuggacgcccgaacuuacagcgacccccuggcgcugcgggaguucaaggaauucgccgccgggcguagaagcguguccggcgaccugauccuugaaauugggaagcuuccgcaacaccugacgcuucgcgcccagaaugcccuggacaaccuggucaugcuccauaacagcgagcagggcgggaaggcuuaccggcacgccauggaggaguuacccgacaccaucgaaacgcugaugcuccuggcccugaucgcugugcucaccgggggggugacccuguucuuccuauccggcaaaggacucgguaagaccagcaucgggcugcugugcgucauggcguccagcgugcuccuguggauggcaaguguugaaccccacuggauagccgccagcaucauacuggaguucuuccucaugguccugcugaucccggagccugacagacagcggacaccccaggacaaccagcuggccuacguggugaucggccugcuguucaugauccucacugucgcggccaaugagauggggcugcuggagaccaccaagaaggaccucggcauugggcacgucguggccgagaaccaucaccaugccacgaugcuggacaucgaucugcaccccgcuuccgcguggacgcuauacgccgucgcuacaacgaucaucacgccuaugaugcggcacaccaucgagaacaccaccgccaacaucagccugacggccaucgcgaaccaggccgccauucugaugggccucgacaagggcuggcccauuucgaagauggacaucggugugcccuugcucgccuuaggcugcuacagccaggugaacccccugacacuaaccgccgcgguucuaaugcuuguggcccacuacgccaucauuggaccaggccugcaggccaaggcgacccgcgaggcccagaagcggacggcagccgggauuaugaagaacccaaccguagacggcaucgucgcuaucgaccucgaccccguuguguacgacgcgaaguuugagaagcagcuuggacagaucaugcuacucauccuguguacgucccagauccugcugaugcggaccacuugggcccugugugagaguauaacccuggccaccgggccucucaccacgcugugggaggguuccccggggcgguucuggaacaccaccaucgccguuagcauggcgaacaucuuucgcggauccuaucuggcgggcgcagguuuagcauucagccugaugaagucccugggcgggggcaggcgcgguacuggcgcccaaggcgagacgcucggcgagaaguggaaacggcagcugaaccagcugagcaagagcgaauucaacacuuacaagcgcagcggcaucguggagguugaccguagcgaggcuaaggaggggaugaagcgcggcgaaaccaccaaacaugcggucucccgggggacggcuaagcuccguugguucguggagcggaaucuugugaagcccgagggcaaagucaucgaccuggggugcgggcgcggcggguggagcuauuacugcgccggccuuaagaaggugaccgaagugaagggguacaccaaaggaggccccgggcacgaggagcccauaccgauggccacguauggcuggaacauugucaagcuccacuccgggcgggacguguucuuuacgccgcccgaaaagugugacacccuccugugcgacaucggcgagucgucacccaacccaaccaucgaagaggggcgcacccuccgcgugcugaagauggucgagcccuggcugcgcggcaaucaguucuguauaaagauccucaaccccuacaugcccagcguaguggagacgcuagagcagaugcagaggaagcacggugggaugcugguucggaacccucucucccgcaacagcacgcacgagauguacugggugucuugcggcaccgggaacaucguguccgcggucaauaugaccucccgcaugcuacugaaccgcuucacaauggcccaccggaagcccacguacgagcgcgacguggaccucggcgccggcacccggcacguggccgucgagccggagaucgccaaucuggacauuaucggacaacgcaucgagaacaucaaaaaugagcacaaauccaccuggcacuacgaugaggacaaccccuacaagaccugggcguaccacggcuccuacgagguuaagccgucgggguccgccagcuccauggucaacggcguggugagacugcucacgaagcccugggacgucauuccgauggugacccagauugccaugacugacaccacgccguuugggcagcagaggguguucaaggagaaagucgacacgcgcacaccucgaccgaagcggggcacagcccagaucauggaggugacggccaaguggcucuggggcuuccugucccgcaacaagaagccccgcaucuguacccgcgaggaguucacccggaaaguacgcucaaacgccgccaucggcgccgucuucguggaugaaaaucaguggaacuccgccaaggaggccguggaggacgagcgguucugggaucucguccaccgcgagcgcgagcugcacaagcaaggcaagugcgcgacguguguguacaacaugaugggcaaacgcgaaaagaagcugggggaguuugggaaagccaaaggcagccgggccauaugguacauguggcucggcgcccgcuuccucgaguucgaggcgcugggguuuaugaacgaggaccacugguucucccgcgagaacucacucuccggaguggagggggagggccugcauaaacuuggguacaucuuacgggacaucagcaagaucccuggagggaacauguacgccgaugacacggcugggugggauacacgcauaaccgaggaugacuugcaaaacgaggccaagaucaccgacaucauggaaccggagcacgcccuacuggcuacauccaucuucaagcugacauaucagaauaaggucgugcggguacagcggcccgccaagagcggcaccgucauggacguuaucagccggcgcgaucagcggggaagcggccaggugggcacuuacgggcugaacacguucaccaacauggagguccagcucauccgucaaauggaguccgagggcauuuucagccccagcgagcuggagaauagcaacuuggcugaaagggugcucgacuggcuggagaagcaugggguggagcgccugaagcgcauggccauauccggggacgacugcguggucaagcccaccgacgaccgcuucgcaaccgcgcucacagcgcugaacgacauggggaaggugcggaaagacaucccacagugggagcccucgaagggcuggaacgacuggcagcaggucccauuuugcucacaccacuuucaccaauuaaucaugaaagaugguagagagaucgugguaccaugcaggaaccaggacgagcucgucgggcgcgcaagagugagccaaggcgccggcuggucucugagagaaaccgccugccucggaaaguccuacgcgcagauguggcaguuaauguauuuccacagacgcgaccuucgccuggcggccaaugccaucuguucagccgugcccgucaacugggugcccaccucuagaaccaccuggagcauccacgcgcaccaccaauggaugacgaccgaagauaugcucuccguguggaacagagucuggauagaagagaaccccuggauggaggauaagacgcaugugagcucuugggaggauguaccguaccuggggaaacgggaggaccaguggugcggcagccugaucggccucacagcacgggcuacaugggccacuaacauccaggucgcaaucaaccaagugaggcgucugaucggcaacgagaauuaccuggacuacaugaccuccaugaagcgguucaagaaugagagcgaccccgagggcgcacucugguga

SEQ ID NO: 24730 - RNA, 9879 nt, Artificial Sequence
  derived and/or modified CDS sequence (opt11) from DENV-1__KM403595__SS-prME
uccgugaccaugcugcucaugcugcuacccaccgcccucgccuuccaucugaccacccggggaggggagccccacaugaucgugucgaaacaggagcggggaaagagccuccuguucaaaaccuccgcgggggugaauaugugcacucugaucgcuauggaccugggagaguuaugugaggacacgaugaccuauaaaugcccccggaucacugaggccgagccugacgacguggacugcuggugcaacgccaccgacacgugggucaccuacggaaccugcagccaaaccggcgaacaccggcgcgaccggcgcuccguugcccuggcuccccacgugggccugggccucgagacgcggaccgagacguggaugagcagugagggcgccuggcgucagauucagcgggucgaaaccugggcccuaagacacccgggguucacggugaucgcucuguuccucgcacacgcgaucggaaccagcauuacccaaaaggggaucauauucauccugcugaugcucgugacccccuccauggccaugcggugcgucggaaucggaaaccgcgauuucguggaggggcugagcggggccacguggguggaugucgugcuggagcacggguccugcgugacaacuauggccaagaacaagccgacccucgacaucgagcuucugaagacggaggugaccaaccccgcgguuuuacggaaguuaugcauugaggccaagaucagcaacaccacgacggacucucgcugccccacccagggcgaggccacccuggucgaggagcaggaugcaaacuucgucugccgccgcacuuucguggaccggggcugggggaacgguuguggcuuguucggcaagggcagcuuacuaacgugcgccaaguucaagugcgugacuaaacuggaggggaagaucguccaguacgagaaccucaaguacuccguuauagugaccguccacaccggugaccagcaucagguaggcaacgagacgacugagcacgggaccaucgccaccaucacgccccaggccccgacaagcgaaauccagcugaccgacuacggggcccuuaccuuagauugcagcccucgcacgggccuggacuucaacgagaugguccugcugacgaugaaagagaaauccuggcugguccacaagcagugguucuuagaccugccccugccuuggaccaguggagccucgaccagccaggagaccuggaaccggcaggaccuccuggugacguuuaagaccgcucacgcgaagaaacaggaggucguggugcugggcucccaggagggcgccaugcacaccgcucuaacaggggccacggagauccagacgagcggcaccaccaccaucuucgccgggcaucugaaaugccgccuaaagauggacaagcugaccuuaaagggagucuccuacgugaugugcaccgggucuuucaagcuggagaaggaaguggcggagacgcaacaugggacgguccucguacaaguuaaguaugagggcacggacgcgcccugcaagauccccauuuccacgcaggaugagaagggggucacacagaacggccggcucaucaccgccaacccgauugugacagacaaggaaaagcccguaaacaucgagaucgagccgccguucggcgagucuuacaucguuaucggcgccggcgagaaggcgcugaaacuguccugguuuaaaaaggggucuagcaucgguaagauguucgaggccaccgcacgcggggcucgccggauggccaucuuaggcgacaccgcuugggauuucgguagcauaggcggaguguucacguccgucgggaaacugguacaccaaguguucggcaccgcuuacggggucuuguucagcggugucuccuggacgaugaagaucgggaucggcauccuccugaccuggcugggccucaacagccgcucgacgucgcuguccaugacgugcaucgcaguggggaugguaacccuguaccucggagucauggugcaggccgacucggggugcguuaucaacuggaagggccgggaguuaaagugcgggagcggcaucuucgucaccaaugaggugcacacuuggaccgaacaguacaaguuccaagccgauagccccaagcgccugucugcugccaucggcaaggccugggaagagggugugugcggcauccgguccgcuacucgccucgagaacaucauguggaagcagaucagcaacgagcugaaccacaucuuauuggaaaacgacaugaaauucaccgucguggugggggacgccaacgguauccugacccagggcaaaaagaugauccggccccagcccauggaacacaaguacucguggaaguccugggggaaggccaagauaaucggcgccgacacgcagaacaccacuuuuaucaucgaugggcccgauaccccggagugucccgacgaucagagagcauggaacaucugggaaguggaggacuauggguucgggguauuuacgaccaacaucuggcuuaagcuccgggacuccuacacacagaugugcgaccacagguugaugucggccgcgaucaaggacuccaaggccgugcacgcagacaugggcuacuggaucgaguccgagaagaacgagaccuggaagcucgcccgcgccuccuucaucgaggugaagacgugcaucuggccccgcagccacacucucugguccaacggcgugcuggagagcgagaugaucauccccaagaucuacgggggcccgaucucccagcacaacuaucggcccggguacuucacccagaccgccggccccuggcaccuagggaagcucgagcuggacuucaaccugugcgagggcacgaccgugguugucgaugagcacugugggaaccgugggccgagccuucggaccaccacggugaccggcaagaucauccaugaauggugcugcagguccugcacccugccacccuugcgauucagaggggaagacggcugcugguacgggauggagauccggccagucaaagagaaggaggaaaaccucgugagaagcauggugucagccggcagcggcgagguugacuccuucucccuggggcugcucugcguaagcauuaugauagaggaggugaugcguucccgguggagccgcaagaugcugaugaccgguacuuuagccaucuuuuuccuccugauaauggggcaguuaaccuggaacgaccucauccggcugugcaucauggugggcgccaacgugucagaucgcauggggaugggcaccaccuaccuggccuugauggcuacguucaagaugcguccgauguucgccguggggcugcuuuuccgccggcucaccagucgcgagguccugcuacucaccaucgggcugucccugguggccagcgucgaacuccccaauucccuugaggaguugggagacgggcucgcuaugggcaucaugaugcugaagcugcucacugacuuccaaucacaccagcuguggacgacacugcugucccuuaccuucaucaagacaacgcuaagucuggacuacgccuggaagaccauggcgaugguucuguccaucgugagccuauuuccgcucugccugucaaccaccagucagaagacuaccuggcugcccgucuugcugggcuccuucgggugcaagccgcugaccauguuccucaucaccgaaaacaagauauggggccgaaagagcuggccccuaaacgaggguauuauggccguggggaucguguccauccuguuaagcagccugcugaagaacgacgucccccucgccgggccccuuaucgcuggcggcaugcugauugcgugcuacgugauuuccgggagcuccgccgaucucagucuagagagagccgcagagguguccugggaagaggaagccgagcacagcggcgcgucccacaauauccuggucgagguucaggacgacgggacaaugaagaucaaggacgaggagcgggaugacacacuuaccauauugcugaaggccacccuccuggcagugagcggagucuauccaauguccaucccggccacccuguucgugugguacuucuggcagaagaaaaagcagcguagcggggugcucugggacacgccgagcccgccugaggucgaacgggccgugcuggacgacggcaucuaccgcauucuccaacggggccuacuugggaggagccaggucggcgucgguguauuccaggacggcguguuccacacaauguggcacgucacccgcggggcgguacugauguaccagggcaagcggcuggagccguccugggccagcgugaagaaggaccucaucuccuacggcgguggcuggcgcuuccaggggucauggaacaccggcgaggaaguccaggugauagcuguggagcccgggaagaacccgaagaacguccagacgaccccuggaaccuucaagacucccgagggagaagugggggccauagcucuggacuucaaacccggaacgucugggagcccgaucguuaaccgcgagggcaaaaucgucggccuguacgggaacggcguggugaccaccuccgggaccuacgucuccgcgauagcccaggccaaagccagccaggaaggcccgcuccccgagaucgaggacgagguguucaagaagcggaaccucacaauuauggaccugcaucccgggucaggcaaaacccgacgguaccucccggccaucguccgggaagcgaucaagaggaagcugcggacgcugauccucgcccccaccagaguuguggcuagcgagauggccgaggcgcuaaaggggaugcccauucgguaccagacgacagccgugaaguccgaacacaccgggaaggaaaucguugaccugaugugccacgccaccuucacgaugcgccuccugagccccgugagagugccaaacuauaacaugaucaucauggaugaggcccacuuuaccgacccugccaguaucgccgcccgcggcuacauuagcaccagaguggggaugggcgaggcugccgccaucuucaugaccgcuacgccgcccggguccguggaggccuucccgcaaagcaacgccgugauccaagacgaggagcgcgacauccccgagcgcaguuggaauagcggcuacgacuggaucaccgacuuucccggcaagacggucugguucguacccuccaucaaaucagggaacgacaucgccaauugucugcgcaagaauggcaaacgagucauccagcucucccggaagaccuucgacacagaguaccagaagaccaagaacaacgacugggauuauguggugaccacugacaucagcgaaaugggugccaacuuuagggcggaccgcguaaucgacccgcggcgcugucugaagcccgugauccuuaaggacggcccugaacgggugauccucgccgggcccaugccggucaccgcagcgagugcggcccagcgccgcggucggaucggccgcaaccagaacaaagagggugaccaauacaucuacaugggccagccccugaacaaugacgaagaucaugcccacuggaccgaggccaaaaugcugcuugacaacaucaauacccccgaagggaucauccccgcccuguuugaaccggagcgggagaaguccgcggcgauagauggcgaguauaggcugcgcggagaggcacgcaaaaccuucguggagcuaaugcggcgcggcgaccugccgguguggcuguccuacaaaguugccagcgagggcuuccaguacuccgaccggcgcuggugcuuugacggagagcggaacaaccaggugcucgaggagaauauggacgucgagaucuggacgaaggagggcgagcgcaaaaagcugagaccccgguggcuggacgcccguacuuauucggacccacucgcgcugcgcgaguucaaggaguuugccgccgggcggagaucaguguccggcgaucugaucuuagagaucggcaagcugccgcagcaccugacacuccgggcccaaaacgcccuggauaacuuagugaugcuccacaauagcgaacagggagggaaagccuaucgccacgccauggaggagcugccugacacgauugagacgcugaugcugcuggcccugaucgcuguccugaccgguggggucacccucuucuuccuguccgguaaaggucucgguaagaccagcaucgggcugcuguguguuauggcguccagcgugcuccuguggauggccuccgucgagccccacuggauugccgccagcaucauccuagaguuuuucuugaugguccuguugauccccgagccagaccgucagcgcacgccccaagacaaccagcucgccuauguugucaucggccuacuuuucaugauacucacgguggcugccaacgagaugggucuccuggagaccaccaagaaggaccucggaaucgggcacguagucgccgagaaucaucaccaugccaccauguuagacaucgaccugcacccggccucugcguggacuuuguacgccguugccaccacuaucaucacuccgaugaugcgccacacuauugagaacaccacugccaauaucagccugacagccaucgcgaaccaagccgccauccugaugggccuagauaagggcuggcccauauccaagauggacaucggcgugccccugcuggcucuuggaugcuacagccaagucaacccccugacccugacugcagcagugcucaugcugguggcucacuacgccaucaucgggccgggcuuacaggccaaggcuacccgggaagcccagaagcgaaccgcagcugggaucaugaagaaccccacggucgacggcauugucgccauagaccucgacccaguggucuacgacgcgaaauucgaaaagcaacucggccaaaucaugcuacucauccugugcaccucgcagauccugcucaugcggaccacaugggcccugugcgagagcaucacguuagccaccgggccccucaccacccugugggagggcuccccggggaaauucuggaauacgacgaucgccgugagcauggcuaacauuuuucgcggcuccuaucucgcuggcgccgggcuugcguucagccugaugaagucucuaggcggcggccggcgcgggacgggcgcccagggcgaaacucucggggagaaguggaaacgacaacugaaccaacuaagcaagucagaguucaacacauacaagcgcuccggaaucauggaaguggaucggagcgaggcuaaggagggguuaaagcggggugagacuaccaaacacgcggucucgcggggaacggcaaagcuccgcugguucguggagcggaaccugguuaagccugagggcaaaguuaucgaccugggcugcgggcguggcgguuggagcuacuacugcgcaggccucaagaaggugacggaggugaagggguacacaaagggcgggccggggcacgaggagcccaucccgauggccaccuacggcuggaacaucgugaaguugcacucagggcgugacguguuuuucacuccacccgagaagugcgacacccugcucugcgacauaggcgagaguagcccgaauccuacgauagaggaggggcgcacucuacgcgugcucaagaugguagagccguggcuccgcggcaaccaguucugcaucaaaauccugaaccccuacaugccgucaguuguggagacccuggagcaaaugcagcggaagcauggcggcaugcucguccgcaacccgcugucccgcaacagcacccacgagauguacuggguguccugcggcacggggaacaucgugucugcggugaacaugaccucccggaugcuacucaaccguuuuaccauggcccaccggaagccgacguacgagcgcgauguggaccucggcgccggcacucggcacguggccguagagccggaaacggcaaaccuggacauaauugggcagcggaucgagaauauaaagaacgagcacaagagcacguggcacuacgaugaggacaaccccuacaagaccugggcauaccauggaaguuacgaagugaagcccucggggucagccagcuccauggugaacggcguggugaggcucuuaacgaaaccgugggacgucauccccauggucacccagaucgccaugaccgacacaacgcccuucggucagcaacggguguuuaaggagaagguugauacucggaccccacgccccaaacgugggaccgcucagauaauggaggugacggccaaguggcugugggguuuccucagucgcaacaagaaaccccggauaugcacccgagaagaauuuaccagaaaggugaggagcaacgcggccaucggcgccguauucguggacgagaaccaguggaacucugccaaggaggccguggaggacgaacgguucugggaccuggugcaucgcgagcgggagcugcacaagcagggcaagugcgcuaccugcguguacaauaugauggggaagcgugaaaagaagcucggagaguuugggaaggccaagggcagccgggccauuugguacauguggcugggagcccgcuuuuuggaguucgaggcguuaggguucaugaaugaggaccacugguucucccgcgagaacagccuguccggcguggagggggaaggccugcacaagcucggguacauccugcgggacaucucgaaaaucccgggcggcaacauguacgccgacgacacggccgggugggacaccaggaucacugaggacgaccugcagaacgaggcuaagaucaccgacaucauggagcccgagcacgcccucuuagcaacguccaucuucaagcugaccuaccaaaacaaggucgugcgggugcagcggccugcuaaguccggcaccgucauggaugugauaucccgaagagaccagcgggggagcggucagguggggaccuacggguugaauacguuuacuaacauggagguccagcucauccgccaaauggaguccgagggaaucuuuagcccuuccgaacuggagaacagcaauuuggcagagcggguacuggacuggcuggagaagcacgggguggaaaggcucaagagaauggccaucuccggcgacgauugcgucguuaagccgaccgacgaccgcuucgccaccgcccugacggcccugaacgacauggggaaagugcguaaagauauaccccagugggagcccagcaagggcuggaacgacuggcaacagguucccuucuguucccaccacuuccaccagcucauuaugaaggacggcagggaaauagugguuccaugccggaaucaggacgaacuggucgggcgcgcccgggugucucaaggcgcgggguggucgcugcgcgagaccgccugucucggcaaaucauacgcgcagauguggcagcuaauguauuuccacagacgcgaccugcgacucgccgcgaacgccaucugcucggcagugcccgucaauugggugccaaccucuagaacaaccuggagcauccaugcgcaccaucaguggaugacgaccgaggacaugcugucgguuuggaaccgcgucuggaucgaggaaaaccccuggauggaggacaagacucacgucaguucgugggaggacgugccguaccuggggaagagggaggaccaauggugcgguucucucauuggccuaaccgcgcgcgccacgugggcgacuaacauacaggucgcaaucaaucaaguucggcgcuuaaucgguaacgagaacuaucucgauuauaugaccuccaugaaacgguuuaagaacgaaagcgaccccgagggcgcccuaugguga

SEQ ID NO: 24731 - RNA, 9879 nt, Artificial Sequence
  derived and/or modified CDS sequence (opt11) from DENV-1__KM403604__SS-prME
agcgugacuaugcuucugaugcuguugcccacagcccuggcuuuccaccugaccacccgcgggggugagccccacaugaucgucucuaagcaggaacgggguaagagccugcuguucaagacgucagcggggguuaauaugugcacccuuaucgcuauggaccugggcgaguugugcgaggacacgaugaccuacaagugcccucggauuaccgaggccgagcccgacgacguggauugcuggugcaaugccaccgacaccugggugacauaugggacaugcagccaaacaggggagcaucggcgggauaagcgguccgucgcccuggcgccccacguaggccuggggcucgagacccgcaccgaaaccuggaugucauccgagggcgcauggcggcaaauacagaagguggagaccugggcccugcgccaucccggguucacggugaucgcgcuguuccucgcacacgccauuggcacaagcaucacccaaaaagggaucauauucauacuguuaaugcucgugacaccguccauggccaugcggugcgucgguaucggcaaucgcgacuucguggaggggcuuagcggcgccacguggguggaugucgugcuggagcaugggucgugcgugacgaccauggccaagaacaagccuacccuugacaucgagcugcugaaaacggaaguaaccaaccccgcgguucuucguaagcugugcaucgaggccaaaauuagcaauacgaccaccgauucaaggugucccacacagggcgaggccacuuuaguggaggaacaggaugccaacuuugucugcaggcgcaccuucguggaucggggcuggggcaauggcuguggccuguuuggcaaggggucccugcucacgugugcaaaauucaagugcgucaccaaguuagaggguaagauuguacaauacgagaaucuaaaguacuccgugaucgugaccguccacaccggcgaucagcaccagguggggaacgagacgacugagcagggcacgaucgcgaccauuacgccccaggcgcccacgagcgaaauccagcugaccgacuacggggcacucacccuugauugcagcccccgcaccggucuagacuucaacgagaugguccuccugacgaugaaagagaaauccuggcuggugcacaagcaaugguucuuagaucugccgcuacccuggacaagcggggcaagcaccagccaagagaccuggaaucggcaagaccuccuggugacguuuaagacagcccacgcgaagaaacaagaggucguuguccuaggcucccaggagggcgccaugcauaccgcgcuuaccggugcaacagagauucagaccagcggcaccaccacuauuuuugccgggcaccugaagugccgccugaagauggacaagcucacccuaaagggagucuccuacgugauguguaccgggagcuuuaaacuggagaaggaggucgcugagacucagcacggaacggucuugguucaagugaaauaugagggcaccgacgcaccgugcaagauuccaauuuccacccaggacgagaagggggugacccaaaacgggcggcuuaucaccgccaacccgaucgugaccgacaaggagaagccaguuaacaucgagacugagccgcccuucggggaaagcuacaucgucaucggcgcgggcgagaaggcccugaagcugucuugguucaagaaggguuccaguauaggcaagauguucgaggccacugcccgcggggcccgucgaauggccauacucggggacacggcgugggacuucgggagcaucggcggcguguucaccucaguggggaaguuagugcaucaaguuuucggcaccgcuuacggaguguuauucagcgguguguccuggaccaugaagaucgggauuggcauauugcugaccuggcugggucucaauagccgcuccaccucucuaagcaugacaugcaucgcggucggaauggugaccuuauaucucggcguaauggugcaggccgacagcgggugcgugaucaacuggaagggccgggagcuaaaguguggcuccggcaucuucgucacgaacgaggugcacaccuggaccgagcaguacaaauuccaggccgacagccccaagcggcugagugcggccaucggaaaggccugggaggagggggugugcggcaucagauccgccacucgccuagagaacauaauguggaagcaaauaagcaacgagcugaaucacauucuguuggagaacgacaugaaguuuaccguagucgugggggacgccaacggcauccuuacccaggggaagaagaugauacggccccagccuauggagcacaaauacucauggaagucauggggaaaggcgaagaucauaggcgccgacacccagaacaccacguuuaucauugacggucccgacacgccggagugcccagacgaccagcgcgcguggaacaucugggaggucgaggacuauggcuucgggguuuucaccaccaauauuuggcugaaacuucgggacuccuauacccagaugugcgaccaccgccugaugucggccgcaaucaaggacuccaaggccgugcacgccgauaugggguacuggaucgagagcgagaagaacgagacguggaagcuagcccgggcaucuuucaucgaggucaaaaccugcaucuggccccgcucccacacccuuuggucuaacggcgugcuggagucagagaugaucaucccaaagaucuacggcggcccgaucucccaacacaauuaccggcccggguacuucacccagacagcuggccccuggcaccugggaaaguuggaguuagacuuuaaccugugcgagggcaccaccguggucguggacgagcauuguggcaauagagggcccucucuccggaccacgaccguaaccggcaaaauaauccacgaaugguguugccgcucgugcacccucccgccccugcgguuccgaggggaggacggcugcugguacggaauggagaucagacccgucaaggagaaggaggaaaacuuggugcggagcaugguuuccgccgggagcggcgaaguugacagcuucucccugggacuguuaugcguaagcaucaugaucgaggaagucaugcggucccgcuggucucgcaagaugcugaugacgggaacgcuggcagucuucuuccuccugaucauggggcagcugacuuggaacgacuugauccggcuguguaucauggugggcgcgaacgugagugaccgcauggguaugggcacaacguacuuagcccucauggcgacauucaagaugcggcccauguucgccgucgggcugcuguuucgucggcuuacuagcagggagguucugcuguugacgaucggguugucacugguagccagcguggagcuccccaacuccuuggaggaauuaggcgacggucucgccaugggaaucaugaugcugaagcuccucacggauuuccagucucaccaacuguggacgacccuccucucucugaccuucaucaagacgacacugagccucgacuacgcauggaagaccauggcgaugguacugucgaucgucaguuuguucccacucugucuaucgacuaccagccaaaagacuaccuggcugccuguucuccugggcaguuucggcugcaagccacugacuauguuccuaauuaccgagaacaagaucuggggccgaaagaguuggccccugaacgaagggaucauggccgugggcaucgucuccauccuacucucaagccugcugaagaacgacgugccccucgccggacccuuaauagcuggcggcaugcugauagcgugcuacgugaucucagggagcuccgccgaccucagccuggagcgugcugccgagguuuccugggaggaggaggcugagcacucgggcgcgucgcacaacauccugguagagguacaagacgacgggacaaugaaaauuaaggacgaggaaagagaugacacccucaccauccugcugaaggccacccuccuggcagucagcggcguguacccgauguccaucccagcaacgcuguucgugugguacuucuggcagaaaaagaagcagcgcucgggugucuugugggauaccccgaguccacccgagguggaacgggcggugcuagaugacggcaucuaccgcauccugcaacggggccuccucggccgcagccaggucggcguggggguguuccaagacggcgucuuccauaccauguggcacgugacccguggggcggugcugauguaccaaggcaagcgucuagagcccagcugggcuucagucaagaaagaccucauauccuacggcggaggguggcguuuccaggggagcuggaacaccggcgaagaaguccaggugaucgcgguggaacccgggaagaaccccaaaaacgugcagaccacacccggcaccuuuaaaacgcccgaaggugaagucggggcaaucgcccuggacuuuaagcccggcaccucuggcagccccaucgucaaccgcgaggggaagaucguaggucuguacgggaacggcgugguaaccaccuccggcacguacgugucugcgaucgcccaggcgaaggcuucacaggaggguccgcucccagagaucgaggacgagguguuuaagaagaggaaccugaccaucauggaccuacaccccgguucuggcaaaacccgccgguaccucccggcaauaguacgcgaggcuauuaagcgcaagcugcggacccuuaucuuagcccccacgcgcgugguggccagcgagauggccgaagcgcugaaggguaugcccauccgguaccagaccacugccgucaaauccgagcauaccgggaaagagaucguggaucugaugugccacgcaacuuucaccaugcgccuccucagccccgugagggucccgaacuacaacaugauuauaauggacgaggcccauuuuaccgaccccgccucgaucgcggcccgcggcuacaucuccaccagaguggggaugggcgaggcggccgccaucuucaugacggcgacaccucccggcuccguggaggccuuuccgcagagcaacgccguaauccaagacgaggagcgggacauucccgagcgguccuggaacuccggguaugacuggaucaccgacuuccccggcaagaccguuugguucgucccguccaucaagagcgggaacgacaucgccaacugccugcgcaagaacggcaagcgggucauccagcucucccgcaagaccuuugacaccgaguaccagaagaccaaaaacaacgauugggacuauguugucaccacggauaucagcgagaugggggcaaacuuccgggcggaccgcgugaucgacccgcggcgcugccugaaaccugugauccuaaaggacggccccgagcggguuauccucgccgggccuaugccgguuaccgccgccucggcggcucagcggcggggccgaaucggccgcaaccaaaauaaggagggcgaucaauacaucuacaugggccagccucugaacaacgaugaggaucacgcccacuggaccgaggcaaagaugcugcucgacaauauaaauaccccggaggggaucauaccagcucuguucgagccggagcgggagaaguccgcugcgaucgacggcgaguaccgccugagaggggaagccaggaagacguucguggagcucaugaggcgcggcgaccuccccguauggcuguccuacaaaguugcaagcgaaggguuccaguacuccgaucggcgcuggugcuucgacggggagcguaacaaccaggugcucgaggagaauauggaugucgagaucuggaccaaggagggagagaggaagaaacugcgcccccgcuggcuggacgcgaggaccuacucggauccccuugcgcugcgcgaguucaaggaguucgccgccgggcggcgcagcgucuccggcgacuugauacuugaaaucggaaagcugccacagcaucugacucuacgggcccagaacgcccuagacaaccuggugaugcuccacaacuccgagcagggcgggaaggcauaccgccacgccauggaggagcugccagauacuaucgagacgcugaugcuacuggcccuuaucgccguccucaccgggggcgugaccuuguucuuccugagcgggaagggcuuagguaagacgagcaucggucugcugugcgugauggcgaguagcguccuccuguggauggccagcguggagccgcacuggaucgccgccagcaucauacuggaguucuuccuaauggugcuccugauccccgagccggaccgccagaggacgccccaggacaaccagcucgccuacgugguuaucggccugcuauucaugaucuuaacgguagcagccaacgagauggggcuucuggagaccaccaagaaggaccuaggcaucgggcacgucguagcggagaaccaccaccacgccacgaugcuggacaucgaccuccacccugcuuccgcuuggacucucuaugcuguggcuaccacgaucaucacaccaaugaugcggcacacuauugagaacaccaccgccaacaucagucugacggcgaucgcgaaucaggccgccauccugaugggcuuagacaagggcuggccgaucucaaagauggacauuggggugccgcuguuagcccuaggcugcuacagccaggugaauccucugacccugaccgccgcgguuuuaaugcucgucgcccauuacgccauuauugggccgggccugcaggccaaggcgacacgcgaggcgcagaagcgcacggccgcagguauaaugaagaacccuacaguagacggcauuguagccaucgacuuagacccgguuguguacgacgcgaaguucgaaaagcaauugggccagauuaugcuucucauccugugcacuucacaaauccugcuaaugcggacuacgugggcacugugcgagagcauuacccucgccaccgggccacuuaccacccugugggagggcaguccugggaaguucuggaacaccacaaucgcaguguccauggccaacauauuccgaggauccuaccuggcgggcgccgggcucgccuucagucugaugaagucccugggcgggggacggagaggaaccggcgcccagggcgagacguuaggggagaaguggaagcgacaauugaaccaacugucgaagucugaguucaacacuuacaagcgcuccgguaucauggaggucgaccggagcgaggcuaaggagggucucaagcgcggcgagaccacgaagcacgcagucucccggggaaccgccaagcugcgcugguuuguggaacggaaccuaguuaagcccgaggguaaagugaucgaccuggggugcgggcgcgguggguggucuuacuacugugccggccucaagaaggugaccgaagugaagggcuacacgaagggcggccccgggcacgaggagccaaucccgauggccaccuacggauggaacaucguuaagcugcauuccgggcgggauguguucuucacaccgcccgagaagugugacacguugcuuugcgacauuggugagucgagcccgaacccgacaaucgaggaggggcgcaccuuaaggguacugaagaugguggagcccuggcugcgcggcaaucaauucuguauaaaaauccucaaccccuacaugccuagcgugguugagacccuagaacagaugcagcggaagcaugggggcaugcucgugcggaacccgcuguccagaaauucgacgcacgaaauguacugggugucaugcggcacagggaacaucgugucggcaguuaacaugaccucccgcauguugcucaaucgcuucaccauggcucaccggaagccuacguaugagcgcgacguggaucugggugccggcacccggcaugucgcuguugagccugagaucgccaaucuggacaucaucggacagcgcaucgagaacauuaagaaugagcacaaaagcaccuggcacuacgaugaggacaaucccuauaagacuugggcguaccacggcuccuacgaagugaaaccuagcggcuccgccagcucaaugguaaacggagugguccgucuccugacgaagcccugggacguaauacccauggugacccagauagcaaugacagauacuacuccauucggccagcagcgcgucuucaaggagaagguggacacccggacccccaggccuaagcggggcacugcccagaucauggaggugacggccaaauggcuuuggggcuucuugucaaggaauaagaagcccaggauaugcacucgcgaggaauuuacccggaaggucagaucuaacgcggcuauaggggcuguuuucguggacgagaaccaauggaacuccgccaaagaggccgucgaggaugagcgguuuugggaccugguucaucgcgagcgagagcuccacaagcagggcaagugcgcgaccugcguguacaacaugauggggaagcgagagaaaaagcuaggcgaguuuggcaaggccaaaggcagccgggccauaugguacauguggcugggcgcccgcuuccuggaguucgaggcgcucggguucaugaacgaagaccacugguucucucgggagaacagucuuuccggggucgagggggagggccugcacaagcucggauacauccugcgcgacauuagcaagauuccagggggcaacauguacgccgaugacacggccgggugggacacgcgcauaacugaggacgaccugcagaacgaggcuaagaucacugacaucauggaaccggagcacgcccuccuggcgacauccauuuucaaacugaccuaccaaaacaagguggugcggguccagcguccggccaagagcggcacugugauggacgugaucagccgacgagaccagcgggggagcggccaggucgggacguacgggcucaacacguucaccaauauggaggugcagcugauccgccagauggaguccgaaggaaucuucucgccauccgagcuggagaacucuaaccuagccgagcgggugcuugacuggcuggagaagcacggggucgagcgccucaaacgcauggcuauauccggcgacgacugcguaguaaagccgaccgacgaccgcuucgcgacggcgcuuauugcccugaacgacauggggaagguccggaaggauaucccccagugggaaccgaguaagggcuggaacgacuggcagcagguccccuuuugcucccaucauuuccaccagcucauaaugaaggauggucgagaaauuguggucccuugccggaaccaggacgagcuggugggcagagcccgggugagccaaggcgccggguggagccuccgcgagacggcuugccucggcaaguccuacgcgcagauguggcaguugauguacuuccaucggcgagacuuacggcucgccgccaaugccauaugcagcgccguccccgugaacugggugccaacaucccguacaaccuggagcauccaugcacaccaccaauggaugaccacggaagauaugcuguccgucuggaacaggguguggauagaggaaaaccccuggauggaggauaagacucacguuucguccugggaggacgucccguaucuggggaagcgggaggaccaaugguguggcagucucaucggccugaccgcccgcgccacuugggccacgaauauccagguggcgauuaaccaggugcggagacugaucgguaaugaaaauuaccucgacuacaugaccucaaugaagagauucaagaaugagucugaucccgagggugccuuaugguag

SEQ ID NO: 24732 - RNA, 9879 nt, Artificial Sequence
  derived and/or modified CDS sequence (opt11) from DENV-1__KM403588__SS-prME
agcgugacaaugcugcucaugcugcugccaaccgcccucgcuuuccaccugaccaccagaggaggggaaccccacaugaucguuagcaagcaggagcggggcaaaagccugcuguucaagaccagcgccggugugaacaugugcacccugauagcaauggaccucggcgaguugugcgaggacaccaugacuuacaaguguccccggauaaccgaggcugaacccgacgauguggauugcuggugcaacgccacggacacgugggugaccuacgguacgugcucucagaccggcgagcaucggcgagacaagcgauccguagcccuggccccacacguaggccuggggcucgagacccgcaccgagaccuggauguccuccgagggggccuggcgccagauccagaagguggagacgugggcccuccgccaucccggguucacagugaucgcucuguuucucgcgcacgccaucggcaccucaaucacccagaaggggaucaucuucauccugcugaugcuggugacccccuccauggcuaugcggugcgucgggaucggcaaccgcgacuucguagagggguuaagcggagcuacauggguggaugucguucuagagcacggcucuugcgugaccaccauggccaaaaauaaacccacccuagauaucgaacugcucaagacggaggucaccaaccccgcaguccuccggaagcugugcauagaggccaagauuagcaacaccaccacggacucccgcugcccaacccagggcgaggccacccugguggaagagcaggacgccaacuucguaugccggcgcaccuucguugaccgcggcuggggcaacggcugcggccucuucggcaaggggagccuguuaacgugcgccaaguucaaaugcgugacgaaacucgagggcaagaucguccaguacgagaaccugaaauacucuguaaucgucaccgugcacacuggcgaccaacaccaaguggggaacgagacgaccgaacacggcaccaucgcgacgaucacgccccaagcccccacgagcgagauccaacugaccgacuacggcgcgcucacccuggacugcagcccgcggaccgggcuggauuucaaugagaugguccuucuaacgaugaaagagaaguccuggcuggugcacaagcagugguuccuggaccugccacugcccuggaccucuggagccucgaccagccaggagacauggaaccggcaagaccuccuggugacguuuaagaccgcccacgcgaagaagcaggaggucguggugcugggcucccaagaaggcgccaugcauaccgcccuaaccggggcgacggagauccagaccuccggcaccaccacgauauucgccgggcaucugaagugucgccugaaaaugggcaagcucacccugaagggcguuuccuacgugaugugcaccggcagcuucaagcuggagaaggagguggcggaaacccagcacgggacggucuugguccagguaaaguacgaagggaccgacgcccccugcaagauccccaucuccacccaggacgagaagggcgucacccagaacgggcgccucaucacggccaauccgaucgugacugacaaggagaagcccgugaacaucgaaaccgagccgcccuucggcgagucguacaucgucaucggcgcaggggaaaaggccuuaaagcuguccugguuuaagaagggcagcucuaucgggaagauguucgaggcgaccgcccgcggcgcccggagaauggccauccucggagacaucgcgugggacuucgguucgaucggcgggguauucaccuccgugggcaagcucguccaccaaguguucgggacagccuacggugugcuuuuuagcggggucuccuggaccaugaagaucgguauagguaucuuacugacauggcuagggcugaacagccgcuccacgagccuguccaugaccugcaucgccguggguauggugacccuguaccucggggucauggugcaggcagacagcggcugcgugauaaacuggaaggggagggagcugaaguguggcuccggcaucuucgucaccaacgaagugcacacguggaccgagcaguacaaguuccaggcagacagcccgaagcgucugagcgcggcaaucggaaaggccugggaggagggcgucuguggcauacgguccgccacgcgccucgagaacaucauguggaagcaaaucagcaacgagcugaaccacaucuuacucgagaacgauaugaaguucaccgucguugugggcgacgccaaugggauucugacucaggguaaaaagaugauacggccccagccuauggagcacaaguacaguuggaaguccuggggcaaggccaagaucaucggggccgacacgcagaacacaaccuucaucaucgacggccccgacacuccagagugccccgacgaccagcgcgcguggaauauuugggaggucgaggacuauggguucggcguguucacgaccaauaucuggcugaagcuccgagauuccuauacgcagaugugcgaccaccgccugaugagcgccgcgauccgggacucaaaagccgugcacgccgacaugggcuauuggaucgagagcgagaagaacgagaccuggaaacuagccagggccuccuucaucgagguuaagacguguauuuggccccggagccacacucucugguccaacggggugcucgaguccgagaugaucaucccgaagaucuauggcgggccuauuucccagcacaacuaccgcccaggcuacuucacccagaccgcugggcccuggcaccugggcaagcuagagcuagacuucaaccugugcgagggcacgaccguugucguggacgagcacugcgguaaccgggguccgagcuugcgcacaaccacggugacagggaagauuauucacgaguggugcugccgguccugcacccugccgccccugcgcuuccggggggaggacggaugcugguacgguauggagauccggcccgucaaggaaaaggaggaaaaccucgugcggucgaugguguccgcgggcuccggggaggucgacagcuucagccugggccugcucugcgugagcaucaugaucgaagaggucaugcgcuccagauggucucguaagaugcugaugacagggacguuggccgucuucuuucuccugaucaugggccagcuuaccuggaacgaccucauccgccuaugcaucauggugggagccaacgugucagaccggaugggcauggggaccaccuaccuggcacucauggcgacguucaaaaugcgcccgauguucgccgucggacugcuguuccggcguuugaccagcagagagguauugcuguugacuauaggccugucccuggucgccagcguggaacuccccaacucccuggaggaguugggggauggccucgcaaugggaaucaugaugcugaagcugcucaccgauuuccagagccaccaacucuggacgacgcugcucagucugaccuucaucaagaccacgcugagccucgauuacgccuggaagaccauggcgaugguucucuccaucgucagccuguuuccccucugccuguccaccacuucacagaaaacgaccugguuacccguacuucugggguccuucggcugcaaaccgcugaccauguuucucauuacugagaacaagaucuggggucgcaagagcuggccccuuaacgagggcaucauggcgguugggaucguguccauccugcucagcagcuugcugaagaacgacgugccccuagccggcccccuaaucgccggcgggaugcugauagcgugcuacgugaucuccgguagcuccgccgaucuaagccuggagcgagccgcagaggucuccugggaggaggaggccgagcacagcggggccucccauaacauccugguagaggugcaggacgacggcaccaugaagaucaaggacgaggaacgcgacgauacguuaaccauccuucucaaagccacccuccuggcggucagcggcguguaccccauguccauccccgccacccuguucgugugguacuucuggcagaagaagaagcagaggucuggcguccucugggacaccccuagcccacccgagguggagcgcgccgugcuggacgacggcauauaccggauccugcagcgggggcuccucggccggagucagguuggcgugggcguguuccaggacggcgucuuccacaccauguggcacgugacccgcggcgcugugcugauguaucagggcaagagacuagagcccucuugggccagcgucaagaaggaccucaucuccuacgguggcggauggcgguuccagggcagcuggaacacgggggaggagguccaggucaucgccgucgagccaggcaagaaucccaaaaauguucagacgacaccgggcaccuucaagacccccgagggagaggugggcgcuauagcccuggacuucaaacccgguacguccgguagccccaucgucaaccgggagggcaagaucguggggcuguacggcaacgguguggucaccacguccggcaccuacgugagcgcgaucgcccaggccaaggccagucaggaggggccgcucccggagaucgaggacgagguguucaagaagcgcaaccugacgaucauggaccugcacccuggcuccgguaagacccgucguuaccucccggcuaucguccgagaagcgaucaaacggaagcugcgaacccugauucucgcccccacccgggugguggccagcgagauggcagaggcacugaaagggaugcccauucgcuaucagacgaccgccgucaaguccgagcacaccggcaaggagaucguggaccugaugugccaugccaccuucacgaugcgacuccucagccccguccgcgucccgaacuacaacaugaucaucauggacgaggcacacuucacagaucccgccaguauagcggcccggggguacaucagcacccgcgugggcaugggagaggccgccgccaucuucaugacggcgacgccgcccggaucugucgaggccuucccgcagagcaacgcgguuauccaggaugaggagcgggacaucccagagcgcuccuggaacucaggcuacgacuggaucacggauuuccccggcaagaccgugugguucguucccaguaucaaaagcggcaacgacaucgccaauugccugcguaagaauggaaagcgcgucauccagcucucccggaagaccuuugacacggaauaccagaagaccaagaacaacgacugggacuauguggugaccaccgauaucucugagaugggcgccaacuuccgcgcggaccgggucaucgacccgcgccggugucuaaagcccgugauccugaaggacgggcccgagagagucauccucgccgggcccaugccgguggcagccgccuccgcggcccagcggcgcggccgcaucgggcguaaccagaacaaggagggcgaccaauacauuuacaugggucaaccccugaacaaugacgaggaccacgcccacuggacggaggcaaagauguuauuggacaacauaaacacccccgagggcaucaucccggcccuguucgagccggagcgcgaaaagagugccgccaucgacggggaauacaggcugcgcggcgaggcccggaagaccuucguggagcucaugcgccggggugaccugcccgucuggcuguccuacaagguggccagcgaaggguuccaguacagugacagacggugguguuuugacggcgagcgcaauaaccaagugcucgaggaaaacauggacgucgagaucuggaccaaagagggggagcggaagaaacugcgcccccgguggcuggacgcgcgcacguacagcgaccccuuagcccuucgggaauucaaggaguucgcggccggccgccggagcgucuccggcgacuuaauccucgagaucgggaagcugccgcagcacuuaacccuccgcgcccagaacgcacuggacaaccuggugaugcuccacaacagcgagcagggcgggaaggcauaccggcaugcaauggaggaacugcccgacacgaucgaaacccugaugcuccuggcccugauagcgguccucaccgguggggugacgcuguuuuucuuaucuggaaagggcuuagggaagaccagcaucggucugcugugcguaauggccuccagcguccuccuguggauggcuuccguggagccccacuggaucgccgccagcaucauccuggaguucuuccucaugguucugcucauccccgagcccgaccgccagcggacuccccaggacaaccagcuggcauacgucgugaucggguuacuguucaugauccugaccguggccgcuaacgagaugggccugcuagagacgaccaagaaggaccucgggauaggccacgugguggccgagaaccaccaccacgccaccaugcuggacaucgacuuacaccccgcguccgccuggacccucuaugccguugcaacgacgaucaucaccccuaugaugcgccacaccauagagaacacgaccgccaacaucucucugacggcgaucgccaaccaggccgccauacugaugggccucgacaagggguggcccaucuccaagauggacauaggcguaccccugcuggcccucggauguuacagccaggugaacccccugacccugacggcggccguccucaugcuggucgcccacuacgccaucaucggcccagggcugcaggccaaggcuacaagagaagcccagaaacgaacugccgccggcaucaugaagaaccccaccguagacggcaucguggccaucgaucuugaucccgucguguacgacgcgaaguucgaaaagcagcuggggcagauaaugcuguugauccugugcacgucccagauccugcucaugcgcaccaccugggcucugugcgaaucuauuacccuggccacgggcccacucaccacccugugggaggggaguccaggcaaguucuggaacaccacgauugccgugagcauggcgaacaucuuccggggcuccuaccucgccggggccggccucgccuucagcuugaugaagucccucgggggcgggcgccgggggaccggcgcccaaggagagacgcucggcgagaaguggaagcgccaauugaaccagcucagcaagagcgaguucaacaccuacaagcgguccgggaucauggagguggaccgcagcgaagcgaaagagggccucaagcggggggagacgaccaaacaugccguaucccgcgggacagccaagcugcggugguuuguggagcgcaaccuggucaagcccgagggcaaagugaucgauuuggggugcggccgcgggggcuggagcuacuacugcgccgggcucaagaaggugaccgaggugaagggauacacgaagggcgggcccggccacgaggagcccaucccgauggcgaccuauggguggaacaucgugaagcugcauuccggccgcgacguuuucuucacgccgcccgagaagugcgacacccuguugugcgacaucggcgagucuuccccaaacccgacgauagaggagggccggacguugaggguccugaaaaugguggagcccuggcuuaggggcaaccaguucugcaucaagauucugaaccccuacaugcccagcguggucgaaacccuggagcagaugcagcgcaagcacgggggcaugcuggugagaaacccacugucccgcaacucuacacacgagauguacugggugucaugcgguaccggcaacaucgucagcgcggugaacaugacgucccgcaugcuguuaaaccgguucaccauggcacaucgaaagccgaccuacgagcgggacguagacuuaggcgcuggcacccgccacgucgcgguggagcccgagaucgcgaacuuggacaucauuggccagcggauagagaacauaaagaaugagcacaagagcacuuggcacuacgacgaggacaaccccuauaagacgugggccuaccacggguccuaugaggugaagccgagcggcuccgccuccucaauggucaacggugucguccgcuugcugaccaagccaugggaugugauccccauggugacccaaaucgcuaugacggacaccacccccuucggccagcagcgagucuucaaggagaagguggacacgcgcaccccgcggcccaagcgcggaaccgcccaaaucauggaggugaccgcgaaguggcuguggggguuucucagccggaacaagaagccccggaucugcacccgggaggaguucacgcgcaaagugcggagcaaugccgcaauuggcgccguguucguggacgagaaccaguggaacuccgccaaggaggcgguggaggacgagcgcuucugggaccuggugcaucgcgaacgcgagcuucacaaacaggggaagugcgcgacgugcguauacaacaugauggguaagcgggaaaagaagcucggugaguuuggcaaggcuaagggcucccgcgccauuugguacauguggcugggugcgcgguuccuagaguucgaggcccucggcuuuaugaacgaggaccacugguucucccgcgaaaacagccuguccggggucgagggagaggggcuacacaagcucggguacaucuugcgcgacaucagcaagauuccgggcgggaacauguacgccgaugacacugccggcugggauacccggaucaccgaggacgaccugcagaacgaggccaagaucaccgacaucauggagcccgagcacgcacuccuggcgaccuccaucuucaagcuaaccuaccaaaacaagguugugcguguccagcggcccgcuaagagcgggaccgugauggacguaauaucgcgccgggaccagcgcggcucgggccagguagggaccuacggccuuaacaccuucacaaacauggagguucagcugauccggcagauggaauccgaggggaucuucagccccuccgagcuggaaaauagcaaucucgccgagcgcgugcuggauuggcuggagaagcauggcgucgagcggcucaagcgcauggcgauauccggggacgacuguguggugaaaccgacggaugaucgguucgcgaccgcccugacugcccugaacgacauggggaagguccgcaaggacaucccccagugggaaccgucgaaaggcuggaacgacuggcagcagguccccuucugcucccaccacuuccaccagcucaucaugaaggacgggcgcgagaucguggucccaugccgcaaccaggacgaacuggugggccgggcacgcguaagccagggggccggcuggagcuuacgggagacagcuugccucgggaaguccuacgcccagauguggcagcuuauguacuuccaccgccgggaccugcgccucgccgccaacgccauuugcucggcaguccccgugaacuggguccccacguccaggaccaccuggagcauccacgcccaccaccaguggaugacaacugaggauauguugucggucuggaaucggguguggaucgaggagaaucccuggauggaagacaagacgcacgugagcuccugggaggacgucccguaucucggaaagcgcgaagaccaguggugcggcagccuaaucggucugacggcccgggcaaccugggcaacgaacauccaggucgccaucaaccaagugcgccggcugaucggcaacgagaacuaccucgacuacaugacguccaugaagagauucaagaacgaguccgaccccgagggggcacugugguga

SEQ ID NO: 24733 - RNA, 9879 nt, Artificial Sequence
  derived and/or modified CDS sequence (opt11) from DENV-1__KM403605__SS-prME
agcgugaccaugcuucucaugcugcuucccacggcccucgcuuuccaccugacgacccgcggcggggagccccauaugaucgugaguaaacaggagcgcggcaagagccucuuguucaagacaucugcggggguaaacaugugcacccuuauugccauggauuuaggagagcucugcgaggacaccaugacuuacaagugcccgcggaucaccgaggcggagccggaugacguggacugcuggugcaacgccaccgacacgugggugaccuacgggaccugcucccagaccggcgagcacagacgcgacaagcgguccguggcucuggcgccccacgugggccuggggcucgagacgcgcaccgagaccuggaugucgucugagggcgccuggcggcagauucagaaggucgagaccugggcgcugcgccacccgggcuucacggugaucgcucucuuucuugcgcacgccauuggcaccagcauuacccaaaaagggaucaucuucauacugcugaugcuugugacuccaaguauggccaugcguugcgucggcauugggaaccgcgacuuuguggagggacuuucgggcgcuacguggguggacgucgugcuggagcacgggagcugcgugaccaccauggcuaagaacaagcccacccucgacaucgagcucuuaaagacggaagucaccaaccccgccgugcugaggaagcugugcaucgaggccaaaauaucgaacaccaccacggauagccgcugccccacccagggcgaagccaccuuggucgaggaacaagacgccaacuucgucugccggcguaccuucguggaccggggcuggggcaacggcuguggacucuucggaaaggggagccugcugacgugcgcuaaguucaagugcgugaccaagcucgagggcaagaucguucaguacgagaaccuaaaguacagcguaauugugaccguccauaccggugaccagcaucagguagggaacgagacgaccgagcacggaaccauugcgaccauuacgccccaagcacccacuagcgaaauccagcugaccgacuacggagcccucacccuggacugcagcccucggaccggccuggacuucaaugagaugguuuugcuuacaaugaaagagaagagcuggcuggugcacaagcaaugguuccucgaccugccguugcccuggaccuccggggcgagcaccagccaagagaccuggaacagacaggaccuacuagugacguuuaagaccgcccaugccaaaaagcaggaggucgucguccuggguucccaggagggcgcaaugcacaccgcccucaccggggcgaccgagauccaaaccagcgguacgaccacgauuuucgccgggcaccugaagugccgucugaagauggacaaacuaacccugaagggcguuaguuacgugauguguaccggaagcuuuaagcuggagaaagagguggcggagacgcagcacggcacuguccuggugcaggugaaauaugagggcaccgacgccccuugcaagauacccauuagcauccaagacgagaaaggggucacucaaaacggaagacucaucaccgccaacccgaucguaacggacaaagagaaaccagugaacaucgagacugaaccaccauucggggaaucauauaucgugauaggggcuggcgaaaaggcgcugaagcugaguugguucaagaagggguccuccaucggcaagauguucgaagcgaccgccagaggggcccgucgcauggcaauccuaggcgacaccgcgugggacuucggcagcaucggcggaguuuucacgucaguagggaagcugguccaccaaguauucggaaccgcguaugggguccuguuuagcggcgucucauggacuaugaagaucgggaucggcauccuccugaccuggcugggccucaauagccgcuccacgagccugaguaugaccuguaucgccguugggauggugacccuguaccucggcgucaugguacaggcagacagcgggugcguaaucaacuggaaaggacgggagcugaagugcggcuccgggaucuucgucaccaacgaggugcacacauggaccgagcaguauaaguuccaagccgacagcccgaagcgccugagcgcggccaucggcaaggccugggaggaggggguguguggcauucgauccgcaacccgccucgagaacauaauguggaagcagauuaguaacgagcuuaaccacauccuacuugagaaugacaugaaguucacugucguggugggggacgccaacgggauccuaacccaggggaagaaaaugaucaggccccagcccauggagcacaaguacuccuggaaguccuggggcaaggcgaaaauuaucggcgccgacacgcagaacaccaccuucauuaucgacgggcccgacacuccagagugccccgaugaucagcgcgccuggaacaucugggaggucgaggauuacggguucgguguguucacgaccaauaucuggcuaaagcuccgggacuccuacacccagaugugcgaccaccggcuaaugagcgccgccauaaaagacuccaaggccguccacgccgauaugggcuacuggaucgagagcgagaagaacgagaccuggaagcuggcacgggcauccuucaucgagguaaagacgugcaucuggccgcgcagccacacucucugguccaacggcguguuggagagcgagaugaucauccccaaaaucuacgguggcccuaucucccaacacaauuaccggcccggguacuuuacccagaccgcaggccccuggcaccuggggaaguuagaacuggacuucaaccugugugagggcaccaccguggucguggaugagcacuguggaaaccgggggccgagucuucggaccacgaccgugaccggaaagauuauccacgaauggugcugccgcuccugcacccugccgccccugagauuccggggagaagaugguugcugguacggaauggagauccggcccguaaaggagaaggaggaaaaccucguucguagcaugguguccgccggcagcggcgaggucgacagcuucucccugggacugcuaugcgugagcaucaugauagaagaggucaugcgcuccagauggagccgcaagaugcugaugaccggcacuuuggcugucuuuuuccuccugauuauggggcaguugaccuggaacgaccucauccggcugugcauuauggugggcgccaauguuuccgaccgcauggggauggguaccacauaccuggcccucauggcgacguucaagaugcggccuauguucgccgucggcuuauuguuucgcaggcucaccagccgugagguucugcuucuaacaauuggccugucccugguggcgucaguggagcucccgaacucgcuggaggagcugggcgaugggcucgccauggguauaaugaugcuuaagcugcucaccgacuuccaaucacaccaacuguggacuacucugcucucccugacuuucaucaaaacuacgcugagccucgacuaugcguggaagaccauggcgauggugcugucaaucgucucccuauucccccucugccugagcacuacaagccaaaagacgaccugguuacccgugcucuuaggcuccuucggaugcaagccguugacuauguuucucaucacggagaacaagaucuggggccgcaagagcuggccacugaacgaggggauuauggccgucggcauuguguccauccugcugagcucgcugcugaagaacgacgugcccuuagccgggccgcugaucgcaggcgguaugcugaucgccugcuacgugaucuccgggaguuccgccgaccugagccuggagcgcgccgcggaggucuccugggaggaggaggccgaacauucgggcgccagucacaacauccucguggaggugcaggacgaugggaccaugaagauaaaggacgaggagcgggacgacaccuuaacuauccugcugaaggccacgcuccuggccgucagcggcguguacccgauguccauucccgccacccuguucgugugguauuuuuggcagaagaagaagcagaggucugguguccucugggauacgcccagcccgccagagguggagcgggccgugcuggacgacggcauuuaccggauccugcaacggggcuuacucgggcgcagccaaguggguguggggguguuccaggacggcgucuuucacaccauguggcacgugaccaggggggcggugcuaauguaccaaggcaagcgccuggaacccuccugggccagcgucaaaaaggaccucaucucauacggcggaggcuggcgguuucagggguccuggaacacaggcgaggaggugcaggugaucgcugucgagccaggcaagaacccuaagaaugugcagacgacccccggcaccuucaagacccccgagggggaggugggggccaucgcccuggauuucaagcccggcacgagugggagccccaucgugaaucgcgagggcaagaucgugggauuauacgggaauggggucguuacuacaaguggaaccuacguuuccgcgaucgcccaggccaaggcaagccaggaagguccgcuccccgaaaucgaggacgaaguuuucaagaagcggaacuuaacaaucauggaccuucacccggggucaggcaagaccagacgguaccucccggccaucgugcgcgaggcgaucaagcgcaaacugcggacccucauccuagcccccaccagagugguggccagcgagauggccgaagcgcugaaaggcaugcccauccgguaucagacgaccgcagucaaguccgagcacaccggaaaggaaaucguggaccugaugugccacgccacauucacuaugcgccuccugucgccgguacgcguaccgaacuauaacaugauaaucauggacgaggcccacuucacggaccccgccagcaucgcugcgcgcggcuacaucagcacccggguagggaugggagaggcugccgccauuuucaugaccgcaacaccgccggggagcguggaggcuuucccucaaucgaacgccgucauccaggacgaggagcgcgacaucccggagagguccuggaacagcggcuacgacuggaucaccgauuucccuggcaagacuguuugguucgugccauccaucaaaucugggaaugacaucgccaacugccuucgcaagaacggcaagcgggucauccagcucagccgcaagaccuucgacacggaguaccagaagaccaaaaacaaugacugggacuacgucgugacgaccgacaucagcgagaugggcgccaacuuccgggccgaccgcgucauugacccgcggcgcugccugaagcccgugauauuaaaggacggcccugagcgugucauccucgccgggcccaugccggugacagcagccuccgcugcccagcgccggggccguauaggcagaaaucaaaacaaggagggcgaccaguacauuuacaugggccagccucugaauaacgaugaagaccacgcccacuggaccgaggccaagaugcuuuuggauaacaucaacacccccgaggggauaauccccgcccuguucgagccggagcgggagaaguccgcggccaucgacggcgaguaucgccugcgcggggaagcccgcaaaacuuucgucgagcucaugcggcgcggcgaucugcccguauggcuguccuacaagguugccagcgagggguuccaguacagcgaccggcgauggugcuucgacggggagcgaaacaaccaagugcucgaggagaacauggacguugagauauggacgaaggagggugagcgcaaaaagcugcggccccgcuggcuggacgcccggaccuacucagacccccucgcacuucgcgaguuuaaggaauucgcugccggucggaggagcguuuccggcgaccugauccuugagauagguaagcugccgcagcaccugacccuccgggcucagaaugcucuggacaaccuggugaugcuccauaacagcgagcagggcgggaaggcguacaggcacgccauggaggagcugcccgacaccaucgagacccugaugcuccuggcccugaucgccguacuaaccgguggggugacccuguucuuccugucugggaaggggcucggcaagaccagcauugggcugcugugcgugauggcguccagcguuuugcuauggauggcauccguggagccccauuggaucgccgccagcaucauacuggaguucuuucucauggugcuguuaaucccugagccggaccggcagcgcacuccccaggacaaccagcucgccuacgucgugaucggccuacuguucaugauccucacgguggcggccaacgagaugggccugcuggagaccaccaagaaagaccucggcaucgggcaugucguggccgagaaccaccaccaugccaccaugcuggacaucgauuuacaccccgcaucagcguggacccucuacgccguggccacuaccaucaucacuccaaugaugcggcacacuaucgagaauaccaccgcuaauauuagccugacugcgauagcuaaccaggcagcaauccucauggggcucgacaagggcuggcccaucucgaagauggacauaggagucccccugcuggcccucggcuguuauagccaagucaacccccugacgcugaccgccgcgguguugaugcuggucgcccacuacgcaauuaucgggccgggccugcaggcgaaagcgacucgagaggcccagaagcgcacggccgcggguaucaugaagaauccuacagucgauggcauuguggccaucgaccucgaucccgucguguacgacgcuaaguucgagaagcaacugggccagaucaugcuccugauccugugcacaucccagauccugcucaugcgcaccaccugggcccugugcgaaagcaucacacuggccaccgggccccugacgacguugugggaggggaguccugggaaauuuuggaacacgaccauagcuguuucaauggccaacaucuuccgcggcuccuaccuggcgggggccggacucgccuucagccugaugaagacucugggcggcggucggcgcgggaccggcgcgcagggggaaacgcucggggagaaguggaagcggcaacugaaccagcuauccaagagcgaguucaacacuuacaagcgcagcggcaucauggaggucgaccggucugaagccaaagaagggcucaaacgcggcgagaccaccaagcaugcggugagccgggggacggcuaagcuucgcugguuuguggagcggaaccuggucaaacccgaaggcaaggugauagaccugggcugcgggaggggcggguggucauacuacugugccggccugaagaaggugaccgaagucaagggauacacuaaaggcggccccgggcacgaggagcccaucccgauggccacguacggcuggaacauaguuaagcugcauagcgggagggacguguucuucaccccacccgagaagugcgacacgcugcucugcgacaucggcgaauccagccccaacccgaccauugaggaggggcgcacccugcggguccucaagaugguggaacccuggcuucgcggcaaccaguucuguaucaagauccugaaccccuauaugcccagcguggucgagaccuuggagcaaaugcaacggaagcacggcgggaugcucgugcgcaacccgcugagccggaacuccacgcacgagauguacugggucucaugugggaccgggaauaucgucuccgccgugaacaugaccagccgcaugcugcucaaucguuuuaccauggcgcauaggaagccuacguaugagcgugacguggaccugggcgccggcacucggcacguugccguggaaccugaaaucgcaaacuuagacaucaucgggcagaggauugagaacauaaaaaacgagcauaaauccacguggcacuacgaugaagacaaccccuacaaaaccugggcguaccacgguagcuacgaggugaagccguccgggagcgccuccagcauggucaacggcgugguacgccugcugacgaagcccugggacgugaucccuauggugacucagaucgccaugacagacaccacgcccuucgggcaacagcgcgucuuuaaggagaagguggacacccggaccccgcgccccaagagggggaccgcccagaucauggaggugacggcuaaauggcugugggguuuccucucccguaacaagaagcccagaaucugcacgcgcgaagaguucacccggaaaguccgcagcaaugcagccaucggagccguguucguggaugagaaccaguggaauucugccaaggaggccguagaggacgagcgguuuugggaccuagugcaccgcgagcgcgagcugcacaagcagggcaaaugcgcaaccuguguguacaacaugauggggaaacgcgagaagaaacucggcgaguucgggaaggcgaagggcucccgggccaucugguauauguggcugggcgcccgcuuccuggaguuugaggcacucggauuuaugaacgaggaccacugguucagccgggaaaacucgcugucuggcgucgagggggagggccugcacaaacucggguauauccugcgggacaucucaaagaucccgggaggcaacauguacgcugacgauacugccgggugggauacucgcauaaccgaggacgauuugcaaaaugaggcaaagaucaccgacauuauggaaccugagcacgcccuccuggcuacgagcaucuucaagcuaaccuaccagaacaagguagugcggguccaacgccccgccaagaguggcacagugauggacgugauuagccgccgcgaccagcgcggguccggccaggucgggacuuacgggcucaacacguucaccaacauggaggugcagcugauccgccagauggaaagcgagggcaucuuuuccccguccgagcuugagaauucuaaccucgccgagcgggugcuagacuggcuggagaagcacgguguagagcgccucaagcggauggccauaagcggcgacgacugcgaggugaagccgaccgacgacagguucgccaccgcccugacggcccugaacgacauggggaagguacgaaaggauaucccgcagugggagcccucuaagggcuggaaugacuggcagcagguccccuucugcagccaccauuuccaccaacucauaaugaaggacgggcgcgaaaucgucgucccgugccgcaaucaggacgaacuaguagggcgggcccggguuucccagggagccggguggagccuucgcgagacggccugccucggcaagagcuacgcgcagauguggcaguuaauguacuuccacagacgggaccugcggcuggccgcaaacgccaucugcucagcuguucccgugaacugggugcccaccagccgcaccaccuggaguauccacgcgcaccaccaguggaugacgaccgaggacaugcugucgguguggaaccgcgucuggaucgaggaaaaccccuggauggaagacaaaacccacguguccuccugggaggacgugccguaccuagggaagcgggaggaucagugguguggcucccucauuggccuuaccgcccgggccacgugggccaccaacauccagguagcgaucaaccaggugcgccggcugaucggaaaugagaacuauuuggacuacaugaccagcaugaagcgguucaagaaugaguccgaccccgagggcgcccuuugguga

SEQ ID NO: 24734 - RNA, 9879 nt, Artificial Sequence
  derived and/or modified CDS sequence (opt11) from DENV-1__KM403606__SS-prME
agcgugaccaugcucuuaaugcugcugccuaccgcccuggccuuccaucugacuacccguggcggagagccccacaugaucguauccaagcaggagcggggaaagagccuccucuucaagaccuccgcggggguaaacauguguacccugaucgcgauggacuugggagagcucugcgaagacaccaugacuuauaaaugcccccggaucacggaggccgagcccgacgacguggacuguuggugcaaugccaccgauacguggguaaccuacgggaccugcagccagaccggcgagcaccggcgcgacaaacgguccguggcccuugcgccucauguaggcuuaggcuuagagacgcgcaccgagaccuggaugagcagcgagggcgcguggcggcaaauacagaaggucgagacuugggcucugaggcaccccggguucacggugaucgcccuguuccuagcacacgccaucggcaccaguaucacgcagaaggggauaaucuucaucuugcugaugcucgugacccccuccauggcaaugcggugcgugggcaucggcaaucgugacuuuguggaggggcugucaggcgccacguggguagacgucguguuagaacacggguccugcgugaccaccauggccaagaacaagccaacccucgacaucgaguugcugaagacggaggucacaaacccagccgugcuccggaagcugugcaucgaggccaagaucagcaacaccacuacagauucccgcugccccacccagggcgaggccacccugguugaagagcaggaugccaauuucgugugccggaggacguucgucgaccggggcugggggaacggcugcggucuguucggcaaagggagucugcugaccugcgccaaguucaagugcgugaccaagcucgagggcaagaucgugcaguaugaaaaccugaaguacagcgucaucgugacagugcauaccggggaccaacaccaagugggcaacgagacgacagagcacggcaccauagcgaccaucacgccgcaggcccccacgcuggagauccaguugacggacuauggagcccugacccuggacugcagcccccgcaccggacucgacuucaacgagaugguacugcuuacgaugaaggaaaaauccuggcucguucauaagcagugguuccuggaucugccgcuccccuggaccagcggggccuccaccagccaagaaaccuggaacaggcaggaccugcuggugaccuuuaagaccgcccaugcgaagaaacaggagguugucguucucgguagccaggagggcgcgaugcacacggcacucaccggggccacagagauccagacguccggcacuacgacuaucuucgccggacaccuuaagugccggcuuaagauggacaagcugacucuuaagggcgucucguacgugaugugcaccgggagcuucaaacuagagaaggagguggcggagacccaacacggaacaguccuuguccagguaaaguaugaggggacugacgcuccaugcaagauccccauaucgacccaggacgagaagggggucacgcagaacggccgucugauuacagccaauccuaucgugacagacaaggagaagccaguaaacauagaaaccgagccgcccuucggggagagcuacaucgucaucggcgccggcgagaaggcccugaaguuaucgugguucaagaaggggucgucuaucggcaagauguuugaggccaccgcacguggugcccggcgcauggcgauacugggcgacacggccugggacuucggguccaucggaggugucuuuaccagcguggggaagcuaguccaucagguguucgguacggcguacgggguacuuuucuccggugucagcuggacaaugaaaauuggaaucggcauccugcugacgugguugggucugaauucccgcaguaccucccucucaaugacgugcaucgccgugggcauggugacccuguaccuuggcgucauggugcaagcggacuccgggugcgugaucaacuggaaggguagggaguuaaagugcggguccgguaucuucgugacgaaugaagugcacaccuggacugagcaguacaaguuccaagcagacuccccgaagcgccucucagcggccauagguaaggcuugggaagaggggguguguggcauccggagcgccacccgccuggagaacaucauguggaagcagaucucgaacgagcugaaccauaucuugcuagagaacgacaugaaauucacggucgugguaggagaugccaacgguauucuaacgcaaggaaagaagaugauccggccccagcccauggagcacaaauacagcuggaaguccuggggcaaggcgaagaucauaggcgccgacacccagaacaccaccuuuaucauugaugggcccgacacuccggaaugcccggacgaccaacgcgccuggaacauuugggaggucgaggacuacggcuucgguguguuuacgaccaacauauggcuaaagcugcgggauagcuacacccaaaugugcgaccaccgccugaugagcgcagcuaucaaggacagcaaggccguccacgccgacaugggguauuggaucgagagcgagaagaaugagaccuggaagcucgcacgagccagcuuuaucgagguaaagaccugcaucuggccccgcucccacacacuguggagcaacggcguauuggagagugagaugauuauucccaagaucuaugggggcccuaucagccagcauaacuaucggccgggguacuucacccagacagcgggcccguggcacuuaggcaagcucgagcuggacuucaaccugugugaggggacgacagugguaguggacgagcacugcggaaaccgcgguccgucccugcggaccacgacugugacuggaaagaucauccacgaaugguguugccgaagcugcacccugccgccccuuagauucagaggugaggauggcugcugguaugggauggagauacggccggucaaggagaaagaggaaaaccuggugcgcucaauggugagcgccggcuccggcgagguagacuccuucucacuggggcuccugugcguguccaucaugauugaggaggugaugcggagccgguggagccguaagaugcugaugaccgguacccucgccgucuucuuccugcugaucauggggcaguugacuuggaacgaccucauacggcucugcauaaugguaggcgccaacgugucagaccgcauggggaugggcacuacguaccucgcccugauggccaccuucaaaaugcgaccuauguucgccgucggucuccucuuccgccgguuaaccucgagagaggugcugcuccucaccauugggcugagccuggucgccucuguggaacuaccuaacucucuagaggaguugggcgacgggcuggcgauggggaucaugaugcuuaagcugcuaaccgacuuccaaucccaccaacuguggaccacccuuuugucgcugacguucaucaagacaacgcucucccuggauuacgccuggaaaaccauggcgaugguguugagcaucgugucccucuucccccugugccugagcaccacgagucagaagacgaccuggcuccccguguuacucggcagcuucgggugcaagccacucaccauguuccugaucaccgagaacaaaaucuggggaagaaaauccuggccccugaacgaggggaucauggccguuggcaucgucagcauccuccuguccagcuugcucaagaacgacgugccccuggcugggccucugauagccgguggcaugcucaucgcgugcuacgugaucagcggaaguagcgcugaucugagccuggaacgcgccgcggaagucagcugggaggaggaggcugagcauuccggcgccagccacaauauccucguugaggugcaggacgacgggacuaugaagaucaaggacgaggagcgggacgauacccugacgaucuugcugaaggcgacccuguuggccgucucaggcguguacccaaugucaaucccggccacucuuuucgugugguacuuuuggcaaaagaagaagcaacgcuccgggguccugugggacacacccagcccgcccgagguagagcgggccgugcuggacgacggcaucuaccggauucuccaacgggggcucuuagggcgaucccaggucggcguggguguguuucaagacggcguuuuucacaccauguggcacgugacacgcggggcugugcucauguaccaaggcaagcgccucgaacccuccugggccuccgugaaaaaggaccuaaucucauacggcgggggcuggagguuccagggguccuggaacacgggcgaagaaguccaggugaucgccgucgagcccgggaaaaaccccaaaaacguacaaaccacgcccggcacguucaagaccccggagggcgaagugggggccauugcccuggauuucaagcccggcaccagcgggucccccaucgucaauagagagggcaagauaguggggcucuauggaaacggcgucgucacaaccagcgguacguaugugucugcgauagcccaggcgaaggccucccaggagggcccccugcccgagaucgaggacgagguguucaaaaagcggaacuugacaauaauggaccuccaccccggaagcgguaagacacgccgguaccugccggccauuguccgugaggcgauaaagcgaaagcugcggacccugauacuggcccccacacgcgugguggcaagcgagauggccgaagcguuaaagggcaugcccauucgguaucagacuaccgccgucaagucugagcacaccgggaaggagaucguggaccucaugugccacgccacguucacgaugcgccugcuuucccccgugcgggucccgaacuauaauaugaucaucauggaugaggcccauuucaccgaccccgccagcaucgcugcccgcggcuacaucuccacccgggucggcaugggcgaggcagcagcaaucuuuaugacggcgacgccucccgggucaguggaggcguuuccacaguccaaugccgucauacaggacgaggagcgcgacauuccggagcgaagcuggaacuccggcuacgacuggaucacugacuuccccggcaagaccguaugguucguaccgagcaucaaauccgguaacgacaucgcgaauuguuugagaaagaacggcaagcgggucauccagcugucgcgcaagacauuugauaccgaguaccaaaagacgaaaaacaacgacugggacuauguagugaccacggacaucuccgagaugggagccaauuuccgagcugaccgggucaucgacccaagacgcugccugaaaccugugauccugaaggacggcccugaacgggucauccuggccgggcccaugccgguuaccgcugcuagcgcggcccagcgccggggccgcauaggucgcaaccagaacaaggagggggaucaauacaucuacaugggccagccgcucaauaacgacgaggaccacgcccacuggacggaggccaagaugcuccuagauaacauaaauacacccgagggcaucauccccgcccuauucgaaccggagcgggagaaauccgccgcgaucgacggagaguaccgguugcgaggggaggccagaaagacguucguggaacugaugcggcgcggagaccugccggucuggcucagcuacaagguggccucggagggcuuccaguauagcgaccggcguugguguuucgacggcgagcggaacaaccaggucuuagaggagaacauggacgucgagaucuggaccaaagagggugagcgcaagaagcugaggccccgcuggcucgaugcuaggaccuacuccgaccccuuagcgcugcgcgaauucaaagaauucgccgccgggcggcgaucggugucgggcgauuuaauccuggagauaggcaagcugccgcagcacuuaacguugagggcgcagaacgcucuggacaaccucguuaugcugcacaacuccgagcaggguggaaaggcguacagacaugccauggaggagcugcccgauacgaucgagacgcucaugcuuuuagcuuugauagccgucuugaccggaggcgucacccuauucuuccucagcggcaagggccuaggcaagaccucuaucgggcugcucugcguaauggcgagcuccguccuguuauggauggccaguguggagccccacuggauagccgcaaguaucauccucgaguucuuccucaugguguuacuaauccccgagccggaucggcagcgcacgccccaggacaaucagcuugcuuacgucgugaucggccuccucuuuaugauccugaccgucgcggccaaugaaauggggcugcucgagaccaccaaaaaggaucuugguaucggccacgucguggccgaaaaccaucaccacgccacgaugcuggacaucgaccuucaccccgcaagcgcguggacccuguacgccguggccaccacuaucauaacgccgaugaugcggcacaccauugagaacaccacagccaacauaucccucacggccaucgcgaaucaggcggcgaucuuaaugggcuuagacaagggcuggcccauaagcaaaauggacaucggggucccacugcucgcccugggcuguuacagccagguuaacccccugacgcucacugcugcgguguugaugcugguggcccacuacgccaucaucgggccgggucuccaggcgaaggcgacccgcgaggcccaaaaacgcacggccgcugguaucaugaagaaccccaccguggauggcauuguggccaucgaucuggaccccgucguguacgaugcgaaguuugaaaaacagcugggccagaucauguuacugauccuguguaccagccagauucucuuaaugaggaccaccugggcccugugcgagucgaucacccucgcgacagggccucugacaacucugugggagggcucgccggggaaguuuuggaacaccaccauugccguguccauggcuaacaucuuccgcggaagcuaccucgcgggcgcaggacuugccuucucccugaugaaaacuuuaggcggcggccgccgcgggaccggcgcccagggcgaaacacugggugagaaguggaagcggcagcugaaccagcuaagcaagucagaguucaacaccuacaaacguagcggcaucauggaagucgacagaucugaggccaaggaggggcugaagcgcggcgagaccacuaagcacgcugugucccgggggacggccaagcugcgcugguucguggagcggaaccuugucaaacccgaagggaagguaaucgaccucggcugcgggagagggggaugguccuacuacugcgcaggcuugaagaaagugaccgaagucaagggguacaccaaaggcgggcccgggcacgaggagcccauaccgauggccacguacggguggaacauuguuaaacugcacuccgggcgggacguguucuucacuccuccggagaagugcgacacccuccugugcgacaucggagagagcucccccaauccgacgauagaggaggggaggacccugcguguucuuaagaugguggagccgugguuacgcggcaaccaguucuguaucaaaauccucaaccccuauaugcccagcguggucgagacccuugagcaaaugcagcggaagcacggcgguaugcuuguucgcaacccgcugucucggaacagcacccacgaaauguacugggucuccuguggcaccgggaacauuguaagcgcggugaacaugacgucacgaaugcuccugaaucgguucacgauggcccaccggaagcccaccuacgagagagauguggaccugggcgccggcaccaggcaugucgccguggagccagaaaucgcgaaucucgauaucaucggccagcgcaucgagaacaucaagaaugaacacaaaucgaccuggcacuaugaugaggacaauccauacaagacgugggcuuaucauggcuccuacgaagugaagccgagcggguccgcaagcucaaugguuaacggugugguccggcuucugaccaagcccugggacgugaucccgauggugacacagauagccaugaccgacacgacgccguucgggcaacagagagucuuuaaggagaaaguugacacacgaacuccgcgccccaagcgggguacggcccaaaucauggaggugaccgccaaauggcucuggggguuccugagucggaacaagaagccccggauuugcacccgugaagaauucaccaggaagguccgcucaaacgcggccaucggggccguguuuguugaugaaaaccaguggaacagcgcaaaggaggcggucgaagacgagcgguuuugggaccuuguucacagagagcgugagcuccacaagcagggcaaaugcgcgacgugcgucuauaacaugaugggaaagcgcgagaagaagcugggcgaguucgggaaggccaagggcagccgggccauuugguacauguggcuaggcgcccgcuuccucgaguucgaggcgcuaggguuuaugaacgaggaccacugguucagucgggagaacagccugaguggagucgagggugaaggccuccacaaauuaggguacauucugagggacaucagcaagauaccgggcggcaacauguacgccgacgacaccgcugggugggacacccgcauuacagaggaugaccuccagaacgaagccaagaucacggacaucauggagcccgagcacgcguuacuagcaacauccauuuucaaacucaccuaccagaacaagguggugcgcguccaaagacccgcaaagaguggaaccgugauggacgugaucucccggcgagaccagcgggggucuggccaaguaggcacguacgggcugaauacauuuacuaacauggagguucagcugauccggcaaauggaauccgagggcauauucagcccgucggaacucgagaacagcaaccuggccgagcgagugcuagacuggcucgagaagcacggggucgagaggcuuaagcggauggcaaucucuggcgaugauuguguugugaagccgaccgacgaccgauucgcgaccgcccucaccgcacucaacgacauggggaagguucggaaggacaucccccaaugggagcccagcaaaggcuggaacgauuggcagcagguccccuucuguagucaccauuuccaccagcugauuaugaaagacggacgggagaucguggugccaugucggaaccaggacgagcugguggggcgggcgcgagugucucagggggcaggguggucccuccgcgagaccgcgugucuuggcaagagcuaugcucagauguggcagcugauguauuuccacaggcgcgaccugcggcucgccgccaacgccauauguagcgccguccccgugaacugggugcccaccuccagaaccaccuggucuauacaugcgcaccaccaguggaugaccaccgaagacaugcuuuccgucuggaaucgcguguggaucgaggaaaaccccuggauggaagacaagacacacgugaguuccugggaggacgucccguaucucgggaagagagaagaccaguggugcggcagccugauuggcuugacugcccgcgccacgugggcuaccaacauccagguggcgaucaaccaggugcggcgcuuaaucgggaacgagaacuauuuagacuacaugaccuccaugaagcgguucaagaacgaaucagacccagagggcgcucugugguga

SEQ ID NO: 24735 - RNA, 9879 nt, Artificial Sequence
  derived and/or modified CDS sequence (opt11) from DENV-1__KM403591__SS-prME
ucggugaccaugcuguuaauguuguuaccgaccgcgcucgccuuucaccugacgacccggggcggggaaccccacaugaucguaagcaagcaggaacggggcaaaagccugcuguucaagaccuccgcggggguuaacaugugcaccuugaucgccauggaccuaggagagcucugcgaagauacgaugaccuacaagugcccccgcaucaccgaggccgaacccgacgacguggauugcuggugcaacgccaccgacacgugggugaccuacgggaccugcagccagaccggcgaacaccggcgcgacaaacgguccguggcccuggcgccucaugugggucuggggcucgagacccggacggagaccuggaugagcuccgagggugccuggcggcagauccagaagguggagaccugggcccuccgccauccaggguuuacggugaucgcccuguuccuugcccacgccaucggaacaucuaucacgcagaagggaauaauuuucauucuacugaugcuugugacgcccuccauggccaugcggugugucggaauuggcaaccgcgacuucguggaggggcugagcggugccaccuggguggacgucgugcuggagcacggguccugcgugaccacgauggccaagaacaagcccacccucgacaucgagcuguugaaaacggaggucaccaacccggcgguguuacgaaagcugugcauugaggccaagaucagcaacacaaccaccgacagucgcugucccacccaaggugaggcgacccuaguggaggaacaagaugcgaacuucgucugccggcguaccuucguagaucggggcugggggaacggcugcggccucuucggcaaggggagccugcugacuugcgccaaguuuaagugugugaccaagcucgagggcaagaucgugcaguacgagaaccugaaguacuccgugaucgugaccguccacaccggcgaccaacaccagguggggaacgagacgacagagcauggcaccaucgcgaccaucacgccccaggcccccacgagcgagauccagcugacugauuacggggcucucacgcuggacugcagcccccggaccggccuggacuucaacgaaaugguccuccugaccaugaaggagaaguccuggcuggugcauaagcagugguuccucgaccugccgcugcccuggaccuccggcgcuagcaccagccaggagaccuggaaccggcaggaccucuuagugacguuuaagaccgcccacgcuaagaagcaggaggucgugguccugggcagucaagagggcgccaugcacacugcucucacaggggcaacggagauccagaccuccggcaccaccacgaucuucgccgggcaccugaagugccgucugaagaugggcaagcucacccugaagggggucuccuacgugaugugcaccggaagcuucaagcuugagaaggagguggcggagacccagcacgguacgguccugguccaggucaaguacgaggguaccgacgccccgugcaagauccccaucuccacccaggacgaaaaaggcgucacccaaaacgggagacucauuacggcgaacccgaucgugaccgacaaggaaaagcccgugaacaucgaaaccgagccgccguuuggggaaagcuauaucgucauuggagccggggagaaggcgcugaagcuguccugguuuaagaagggcuccaguaucggaaagauguucgaggccacugcccgaggcgcacggcgcauggcaauccuuggagacaccgcgugggauuucggcucaauaggcggcgucuucaccuccgugggcaaauugguacaccagguguuugggaccgccuauggcgugcuguucucagggguaucguggaccaugaaaaucggcaucgguauacuucugacgugguuaggacucaacagccgcucgaccagccugaguaugaccuguaucgccgugggcauggugacacuguaccucggagucaugguacaggccgacagcggcugcgugaucaacuggaaggggcgggagcucaaguguggcuccgggauuuucgucacgaacgaggugcauaccuggaccgagcaguacaaguuccaggccgauagccccaagcgucuaucggcggccaucggaaaggcuugggaagagggcgugugugggaucagguccgccacccgccucgagaacaucauguggaaacagauuagcaaugaguugaaccacauccugcucgagaacgacaugaaguucaccgucguggugggcgacgccaacgguauacugacucagggcaagaagaugauucggccccagcccauggaacacaaguacuccuggaagucguggggcaaggcaaagauaaucggggccgacacucagaacacaaccuucaucauagacggacccgacacgccagagugccccgaugaucagcgcgccuggaacaucugggaggucgaagacuacggcuucggaguguucaccaccaacaucugguuaaagcucagggauuccuacacccagaugugugaccaucgccugaugucggccgcgauuaaggacucuaaagccgugcacgccgauaugggcuacuggauagagagcgaaaagaacgagaccuggaaacuggcgcgggcauccuucaucgaggugaagacuugcaucuggccccgcagccauacccucugguccaacgguguucuugagagcgagaugaucauccccaagaucuacggcgggccgaucucccagcacaacuauaggccaggcuacuucacccagacugcugggcccuggcacuuaggcaagcucgagcuugacuucaaccucugugaggguaccaccguggugguggacgagcacugugggaaccgcgggccuagccucagaaccacgacugugacaggaaaaaucauccacgaauggugcugccgcuccuguacccugccgccacuuagguuucgcggcgaggacgggugcugguacggaauggagauccggcccguaaaggagaaggaggagaaccuuguacgcucuaugguguccgccggcagcggggaggucgacagcuucuccuugggccugcucugugugucgaucaugauagaggagguuaugcggucccgcuggagccgaaagaugcugaugacgggcacccuggccgucuucuuccuccugaucauggggcagcugaccuggaacgacuugauccggcuguguaucauggugggggccaacgucucggaccgcauggguaugggaacgacuuaccuggcacucauggcgaccuucaagaugcggccgauguucgcuguagggcuguuguucaggcggcucaccagccgagaggugcugcuucucaccaucggccugucccuggucgcauccgucgaguuacccaacucccuggaagaacugggggacggccucgccauggguaucaugaugcugaagcugcucacggacuuucagagccaccaacuguggaccacccuccuauccuugaccuucaucaaaacgacucugagccucgacuacgcauggaagacuauggccaugguguuauccauagucuccuuauucccucucugccuuuccaccacgagccagaaaaccaccuggcugcccguccuccucggauccuucgggugcaaaccgcugaccauguuucucaucacugagaacaagaucugggggcggaaaagcuggccccuaaacgagggcaucauggcagucggcaucgucagcauacugcucagcucuuuacugaagaacgacguaccgcuggcuggccccuuaauugccggugggaugcucauugcuugcuacgugauuuccggcagcuccgccgaccucagccucgaacgcgccgccgaggucuccugggaggaggaagccgagcacagcggggcgucccacaacauacuggucgaagugcaggacgacggcacgaugaagaucaaggacgaggagcgggacgacaccuuaaccauccugcugaaggcgacccucuuagcggucagcggaguguacccgauguccauccccgccacguuguuuguaugguacuucuggcagaagaagaagcagaggagcggcguucucugggacacgccgagcccgcccgagguggagcgggccguacuggacgacggcaucuaccgcauccugcaacggggucugcucggccgaagccaggucggggugggcgucuuccaagacgggguuuuccauacgauguggcaugugacccggggcgcggugcugauguaccagggaaagaggcuggagcccuccugggccucggucaagaaggaucucauauccuacggcggcggcuggcgguuccagggcucauggaacacgggggaggagguacaggucaucgccgucgagcccggcaagaaccccaagaacgugcagaccacccccgggaccuucaagacgccagaaggugaggugggcgccaucgcccuggacuucaagccugguaccuccgggagccccaucgucaaccgcgagggcaagaucgugggguuguacggcaacggggucgucaccaccuccggcacguacguuucagccaucgcacaagcgaaggccagccaggaggggccgcuccccgaaauugaggacgagguguuuaagaagcggaaccuaaccauuauggaucuccaccccggcucuggcaaaaccaaacgcuaccucccugccaucguucgggaggcgauaaagcgcaaacugcggaccuuaauccuggccccuacacggguuguugccagcgagauggccgaggcauugaaggggaugcccaucagguaccagaccaccgccgucaaguccgagcauaccggcaaagagaucguugaccugaugugccacgcuacauucacuaugcgguugcugagccccgugcgcgucccaaacuauaacaugauuaucauggaugaggcccacuucaccgaccccgccuccaucgcggcucggggauauauaagcacacgagugggcaugggggaggccgccgccauauucaugacagcgaccccacccggcuccguggaggccuucccccagaguaaugccgugauccaggaugaggagcgggacauccccgagcgcucauggaauagcggcuacgacuggaucaccgacuuuccagguaagaccgugugguucguaccuuccauuaagucuggcaacgacaucgcgaacugccucaggaagaaugggaagcgcgucauccagcuguccagaaagacguucgacacagaguaccaaaagaccaagaacaaugacugggauuacgugguaaccacggauauaagcgagaugggcgccaauuuccgggccgaccgggucaucgacccgcgucggugccugaagccuguuauucugaaggacgggcccgagcgcguuauccucgccgggcccaugccugugacugcagcguccgcagcccagcggcgcggccgcaucgguagaaaccagaacaaagagggcgaccaguauaucuacaugggacagccccucaacaacgaugaggaccacgcccacuggaccgaggccaagauguuacuagacaacaucaacacccccgaggguaucauccccgcccuguucgagccggaacgcgagaaguccgcggcgaucgacggcgaguaccgucugcguggcgaggcccggaagacguucguggagcuaaugcgccggggcgaccugcccgucuggcuguccuacaagguggccagcgagggguuccaauauuccgacaggcgcuggugcuuugauggugaaaggaacaaccagguacucgaggagaacauggacgucgaaaucuggaccaaggagggggagcggaagaaguugcguccccgguggcuggacgcacgcacuuacagcgacccccucgcgcugcgggaguucaaggaguucgccgcaggccgucguagcguguccggcgaccugauccucgagaucgggaagcugccgcaacaccugaccuuacgugcccagaacgcccuugacaaccuggugauguuacauaacagcgagcagggggggaaggcguaccggcacgcuauggaggagcugcccgacaccaucgagacgcugaugcuccucgcccugaucgcuguccuuaccggcggugugacccuguucuuucugucugguaagggccucggcaagaccagcaucggacugcuuugcgugauggcguccagcguccuccuguggauggcauccguggagccccauuggaucgcagcuagcaucauccucgaguucuuuuugauggugcugcugauccccgagccggaccgccagagaacgccccaggacaaccagcucgccuacgucgugauaggccugcuguuuaugauccucaccgucgccgcgaacgagauggggcuacuggagacuaccaagaaagacuuagggauaggccacgucgucgccgagaaccaccaccaugccacgaugcuagacauugaccugcaccccgccuccgcguggacacucuaugccguggccaccaccaucaucacccccaugaugcgccacaccaucgagaacaccaccgccaacauaucucugaccgcuaucgccaaccaggccgccauauuaaugggccucgacaagggguggccgaucaguaagauggauauaggcgucccccugcuggcucucgggugcuauagccaggugaacccccugacgcuuaccgcggcggugcucaugcuggucgcccauuacgccauaaucggcccggggcuccaagccaaggcgacgcgggaggcccagaagcggacggccgccggaaucaugaagaaccccacgguggauggcaucguggccaucgaccucgacccugucguguacgaugcgaaauucgagaagcaacuggggcagaucaugcugcucauccugugcaccucucagaucuugcucaugaggaccacgugggcguuaugcgagucuaucacccuggcuaccggcccccucaccacgcugugggagggguccccaggaaaauucuggaacaccacuaucgcaguuagcauggccaacaucuuccggggcuccuaccuggcgggagccggccucgcuuucagccucaugaagucccucgggggcggucgccgggggaccggugcgcagggggagacccuaggcgagaaguggaagcggcaguuaaaccagcugagcaaaagcgaauucaacaccuacaagcgcuccgggaucauggaggucgacagaagcgaggcaaaagagggcuuaaagcgcggggagaccacuaaacacgcgguguccaggggcacggcaaaacugagaugguucguggaacgaaaucuggucaagcccgaggguaaagugaucgaccuggggugcggcagggguggcuggagcuacuacugcgccgggcucaagaaggugaccgaagugaagggcuauacaaagggagggcccggccacgaggagcccauuccgauggccaccuauggguggaacauugugaagcugcacuccggccgggauguguucuucacgccgcccgagaagugcgacacucuccucugcgacauuggggagagcucucccaauccgaccaucgaggagggacggacccugcgcguccugaagaugguggaaccguggcuccgaggcaaccaguucugcauaaagauucuuaacccuuauaugcccuccguggucgagacacuggagcagaugcagaggaagcacgggggcauguugguccggaacccacuaucucgcaacagcacgcacgagauguacugggucuccugcggcaccggcaacaucgucagcgcggugaauaugacgucccggaugcugcucaaccgcuucaccauggcccaccgcaagcccacuuacgagagggacguggaccugggugccggcacccgccauguagccguagaacccgagaucgccaaccuugacaucaucggccagcggaucgaaaacauuaagaacgagcauaagagcaccuggcauuacgacgaggacaacccuuacaagaccugggcguaccacgggagcuaugaagugaaaccgagcggcucagcaucauccauggucaacgggguugucaggcuccugacgaaacccugggacguaauccccauggugacccagaucgccaugaccgacaccacgcccuuuggccagcagcgcgucuucaaagagaaagucgauacucgcaccccgcggccgaagcgcgguaccgcacaaaucauggaagugacggccaaauggcuguggggguuccugucucggaacaagaagccccgcaucugcacacgggaggaguucacccgaaagguccggagcaacgcggcaaucggcgccguguucguggacgagaaccaguggaacuccgcgaaggaagcggucgaggaugaacgauucugggaccuggugcaccgggagcgcgagcuucauaaacaggggaagugcgcgaccugcguguacaacaugaugggcaagcgggaaaagaagcuaggagaguucgggaaggcaaagggcucacgugcuauuugguacauguggcuuggggcccgguuccuggaauucgaggcgcuggguuucaugaacgaggaccacugguucucacgcgagaacagccuauccggggucgagggcgaaggacugcacaagcucggcuacauccugcgggacaucaguaagaucccgggcggaaacauguacgccgacgauacggccggcugggauaccaggauuaccgaggaugaccugcagaacgaggccaagaucacggacauaauggagcccgagcacgcauuauuggcuacguccaucuucaaacugacauaccagaacaaggucguacgcguccagagacccgccaagagcgggaccgugauggacgugaucuccaggcgggaccagcgcggcagcggccagguagggaccuacggucucaacacguucaccaacauggaggugcaguugauccggcagauggaguccgagggcaucuucagccccagcgagcuggagaacagcaaccucgccgagcgugugcuggacuggcuggagaagcacggcgucgagcggcugaaaaggauggcaaucucuggggacgacugcguggugaagccgacagacgauagauucgccaccgcgcuaacggcauugaacgacaugggcaagguacguaaggacaucccccagugggagcccagcaagggauggaacgacuggcagcagguccccuuuugcucccaccauuuccaucaauuaaucaugaaggacgggcgcgagaucgugguaccgugccgcaaccaggacgagcugguaggccgugcccgcgugagccagggcgcuggcuggagccuaagagagaccgcgugccucgggaaauccuacgcgcaaauguggcagcugauguacuuucaccgccgggaccuucgcuuagccgccaacgcaaucuguagcgcgguccccgugaacugggugcccaccucccggaccaccuggagcauccacgcgcaucaucaguggaugaccacagaggacaugcugucggucuggaaccgcguguggaucgaggagaacccuuggauggaggacaagacccacgugagcaguugggaagacgucccauaccuggguaagcgcgaggaccaguggugcggcagccuuaucgggcuaaccgcgcgggcgacgugggccaccaacauccagguggcaaucaaccaggugcgccggcucaucggcaacgagaacuaccucgacuacaugacguccaugaagcgauucaaaaaugagagcgaccccgaaggggcccugugguag

SEQ ID NO: 24736 - RNA, 9879 nt, Artificial Sequence
  derived and/or modified CDS sequence (opt11) from DENV-1__KM403607__SS-prME
ucggugacuaugcugcucaugcugcuuccuaccgcgcuggccuuccaucugaccacacguggcggggagccccacaugaucguuagcaagcaagagcgaggcaagagccuccuguucaagaccagcgcgggggugaacauguguacccuuaucgccauggacuugggcgaacucugcgaagacacgaugacauacaagugcccccggaucacggaggcugagccugacgacguggacugcuggugcaacgccaccgauaccuggguuaccuacggaaccugcagccagaccggagaacaccggcgggacaagagauccguggcccuggcgccgcacgugggccugggucucgagacgcgcaccgagacauggaugucuucagagggcgcguggcggcaaauucagaagguggaaaccugggcccugcggcaccccggguucacggugaucgcucuguuccucgcgcacgccauuggcacaaguauuacccagaagggaaucaucuuuauucugcugauguugguaacccccuccauggccaugcguugcgugggcaucgguaaucgcgauuuuguggagggucugagcggcgcaacguggguggaugucgugcuggagcacggguccugcguaaccaccauggccaagaacaagccaacccucgacaucgagcugcucaaaacggaggugaccaaccccgcgguacuccggaagcuguguaucgaggccaagaucagcaacaccaccacggacucccgcugcccaacccagggagaagcgacccugguggaggagcaagacgcuaacuucguaugccggcgaaccuucguggaccggggcugggggaacggcugcggcuuauucggcaaggggucccuucugacuugcgccaaguucaagugcgugacuaagcuggagggaaagaucguccaguaugagaaccugaaauacuccgugaucguaaccguccauaccggcgaccagcaccaagugggcaacgagacgaccgagcacgggaccaucgcgaccauaacgccccaggcccccaccagcgagauccagcucacggacuacggggcccucacccuggacugcagcccgagaaccggucucgacuucaacgagauggugcugcuuacaaugaaggagaagucuuggcuggugcacaagcagugguuccuugaccugccgcucccguggaccucaggggccagcaccagccaggaaaccuggaaccggcaggaccuacugguaacguucaagaccgcccacgcgaagaagcaggaggucguggugcuggggucccaggagggugccaugcacacggcauugaccggggccacagagauacaaaccagcgggaccaccacgaucuucgccgggcaucuaaagugccgccugaagauggacaagcuaacccuaaagggcgucuccuacgugaugugcaccggcagcuuuaagcuggagaaggagguggcggagacccagcacggcaccguccugguccaggugaaguacgagggcacggacgcccccugcaagauccccaucuccauccaggacgagaagggcgucacccagaacggccgucuaaucacggccaauccgaucgugacggacaaggaaaaaccagugaacaucgaaaccgagccgcccuuuggggagagcuacauugucaucggcgccggcgagaaggcgcugaagcuguccugguucaaaaaggggagcuccaucggcaagauguucgaggccaccgcccgcggggcccggcgcauggcuauccugggcgacaccgcgugggacuucgguucgauaggcggcguguucacguccguggggaagcuuguccaccagguauucggcaccgcuuacgggguauuguucaguggcgucucguggacuaugaaaaucgggauugguauccuucugaccuggcugggccucaacagccgcuccacgagccuuuccaugaccugcauagccguggggaugguaacccuguaucuaggcgucauggugcaagcagauagcgguugcgugaucaacuggaaaggccgggagcugaagugcggguccggcaucuuugugaccaacgaggugcacacguggacagaacaguacaaauuccaggcagacagcccgaagcgccugucagcggccaucggcaaagccugggaggaaggggugugcggcauccgguccgccacacggcuugagaacaucauguggaagcagaucagcaacgagcugaaucacauccugcucgagaacgacaugaaguucacggucguagucggggacgccaacggcauccugacccaggggaaaaaaaugauccgcccacagcccauggagcacaaauacuccuggaaguccuggggcaaggcgaagaucaucggcgccgacacgcaaaacaccaccuucaucauagacgggcccgacaccccugagugccccgaugaccagcgcgcauggaacauuugggagguugaggacuacggcuucgggguguucacgacaaacaucuggcugaagcuuagggacaguuauacccagaugugcgaccaccgccucaugagcgccgcaaucaaggacuccaaggccguacacgccgacaugggcuauuggauagagagcgagaaaaacgagacuuggaaacucgcccgggccucguucaucgaggucaagacgugcaucuggccucguagccacacccucugguccaacggcguacuggagagcgaaaugaucauuccaaagaucuacgggggcccgaucucgcagcacaacuacagacccggguacuucacccagaccgcaggcccguggcaccuggggaagcuugagcuggacuucaaccuaugugaaggcacgacuguggucguggacgagcauugcggcaaccgcgggccgagcuugcggacuaccacggugacugguaaaaucauccacgaguggugcugccgcucuugcaccuuaccuccccugcgguuucggggggaggacgggugcugguacgggauggagauccguccugucaaagagaaagaggagaacuuggugcgcagcaugguguccgccggaagcggcgaggucgacagcuucucguuggggcugcucugcguaagcaucaugaucgaggaggugaugagaagcagauggagccgcaagauguuaaugaccggcacgcuggccgucuucuuucuucugaucauggggcaguugaccuggaacgaucuaauccgguuaugcaucauggugggcgccaacguguccgaccgcauggggaugggcaccaccuaccuggcgcucauggcgacguucaagaugcggccgauguuugcugucggucuguuauuccgccgacuuaccagucgcgaggugcuguuacucaccaucggguugucccugguugccaguguagagcuccccaauucccuggaggagcugggcgacggucuggcuaugggaaucaugauguuaaaacuacucaccgacuuccagagccaccaacuguggacgacccugcucuccuugaccuucaucaagaccacgcugagccucgauuaugccuggaagacgauggcgaugguacuguccaucgucucgcuuuuuccgcucugccuguccaccaccagccagaagacgacauggcuaccaguguuacugggcuccuucggguguaaaccgcugacaauguuccucaucacggagaacaagauuuggggccgcaagucguggcccuuaaacgagggcauaauggccgugggcaucguauccauauugcucucgagccugcugaagaacgacguaccccucgccgggccacugaucgccggcgguaugcugauagcgugcuacgugaucucgggcucgucugccgaccucagcuuggagcgcgcggcggaagucuccugggaggaagaggccgagcacagcggugcgucccacaauauccugguggaggugcaggacgaugggaccaugaaaauuaaagacgaagagcgggacgacacgcucaccauacuguuaaaggccacgcuccuggccgucagcggugucuacccuaugucgauccccgccacccuguucguuugguauuucuggcagaagaagaagcagaggagcgggguccucugggacacgccgagcccgccggagguggagcgggccgugcuggacgacggcaucuaccgcauccuucagagaggacugcuugggcgcagccaggucggcguuggcguguuccaggauggcgucuuucacaccauguggcacgugacucggggugcggugcugauguaccagggcaagcgccuggagccguccugggcguccguuaagaaggaucucauuuccuacggcgguggauggagguuucaggggagcuggaacaccggcgaggagguccaggugaucgccgucgaacccgggaagaaccccaagaacgugcagacuacccccggcaccuucaagacucccgagggugaagugggugcaauagcccuggauuucaaaccggguacguccgggagccccaucgucaaccgcgaaggcaaaaucgugggccuauauggcaacggcguggucacaaccagcgggacuuaugugagcgcgauagcccaggccaaggccagccaggagggcccgcuccccgagauagaggacgagguguucaaaaaacggaaccugacgaucauggaccugcauccaggaagcggcaaaacccgacgguaccucccggccaucguccgcgaggcgaucaaaaggaagcuuaggacacugauccucgcacccacccgagugguggccagcgagauggcagaggcgcuaaaaggcaugcccauccgauaccagacgaccgcugucaaguccgagcacaccgggaaggagaucguugaccugaugugccacgcgacuuucacgaugcgccuccucagccccgugcgcguaccgaacuacaacaugaucaucauggacgaagcccacuuuaccgauccagccagcaucgcggccaggggcuacaucagcacccguguagggaugggcgaggcagccgccaucuuuaugaccgcgacgccgccuggguccguagaagccuucccgcagagcaacgccgucauccaggacgaggagcgcgauauccccgaacggucguggaacagcggcuaugacuggaucacugacuuccccggcaagaccguaugguucgugccaagcaucaagagcgggaacgacaucgccaacugccugcgcaaaaacgggaaacggguaauccagcucucccgcaagacguucgacacggaauaccagaagaccaagaacaaugacugggacuacgucgugaccaccgauaucucggagaugggcgccaacuuccgcgcggaccguguaaucgauccgcggagaugccugaagccugugauucugaaggacggccccgagagggucauacucgcggggccgaugccuguuacagcagccuccgccgcccagcgccggggccgcaucggccgcaaccagaauaaggagggcgaucaguacaucuacaugggccagccccugaacaacgacgaggaccacgcucacuggaccgaggccaagaugcuucucgacaauaucaacacccccgaagggaucauacccgcguuauucgagccggagcgggagaaguccgcggccaucgacggcgaguauaggcugcgaggggaggcccgcaagaccuucguagagcucaugcggcgcggggaucugcccgucuggcuuucguacaagguugccagcgagggauuccaguacuccgacagacgcuggugcuucgacggggagcggaacaaccaggugcucgaggagaacauggaugucgagaucuggacgaaggagggggagcgaaagaaacugcggccccgcuggcuggacgcccggaccuacagcgacccccuugcgcugcgcgaguucaaagaguucgccgccgggcggcgcagcgugucgggcgaucugauacucgaaaucggcaaacugccucagcacuugacacugcgugcccagaaugcccuggacaaccuugugaugcuucacaacagcgaacagggcgggaaggccuaccgccacgccauggaggagcugcccgauaccaucgaaacccugaugcuccuggcccuuaucgccguacucaccggcggugugacccuauuuuuucugucugggaaagggcucgggaaaaccagcaucggguuacucugugugauggcguccagcguccuccuguggauggccaguguggagccccauuggaucgccgcgaguaucaucuuggaguuuuuccucaugguucuuuuaauccccgagccugacagacagcgcaccccccaagacaaccagcuugcuuacgucgugauaggccuucuguuuaugaucuuaacgguugcggccaacgagauggggcugcuggaaaccaccaagaaggaccucgggaucggucacgucguugccgagaaccaccaccacgccaccaugcuggacaucgaccugcaccccgcaucagcguggacgcucuacgccguagcgaccacgauaaucaccccgaugaugcggcacacgaucgaaaacaccaccgcgaacaucagccucacugccaucgcgaaccaggccgcuauccugaugggccucgacaagggcuggccaaucuccaagauggacaucggcgucccacugcuggcccuaggcugcuacagccaggugaauccccugacgcugaccgccgccgugcucaugcuggucgcccacuacgccaucaucgggccgggguuacaggcgaaggcaacucgcgaggcccagaagcgcaccgccgccggcauaaugaaaaaccccacgguggacggcaucguggcgauagaccuugauccugugguguacgacgcuaaguucgaaaaacaguugggccagauaaugcugcucauccugugcaccucccagauccuguuaaugcguaccaccugggcccugugcgagucaaucacgcuggccacggggccccucaccacacugugggaggguuccccggggaaguucuggaacaccaccaucgccgugucuauggccaacaucuuccgaggauccuaccuggcgggagcagggcucgccuucagccugaugaagaccuugggcgggggccggagagguacgggcgcccagggugaaacgcucggggagaaguggaagcggcagcugaaccagcuuucgaagagcgaguucaauacguacaagcguagcggcaucauggagguagaccgaagcgaggccaaggaggggcucaaacguggugagaccaccaagcacgcugugucacggggcacggcuaagcuuagaugguucguggaacggaaccugguuaagccugagggaaaggucaucgaccugggcugcgggcgcggcgggugguccuauuauugugccggucucaagaaggugaccgagguuaagggguacacuaagggcggccccgggcacgaggaaccgaucccuauggccaccuacggcuggaacauugugaagcugcacagcggacgggacguguucuuuacgccgccagagaagugugauacgcugcuuugcgauaucggcgaaaguaguccuaacccgaccaucgaggaggggcgcacccugcggguccucaaaaugguugagcccugguugagagggaaucaauucugcauaaagauccugaaccccuacaugcccuccgucgucgagacgcucgagcagaugcagcggaagcacggcggcaugcucgugaggaacccucugagucggaacuccacacaugaaauguacuggguguccugcggcaccgggaacauugucuccgcugucaacaugaccagccgcauguuacucaaccgcuuuaccauggcccaccguaaaccgacauacgagcgcgacguggacuugggcgccggcacccgccacgucgccguggaacccgaaaucgccaaccuggacauuaucgggcagcgcauugagaacaucaagaacgagcacaaguccacguggcacuacgacgaggacaaccccuacaagaccugggcguaucacggaagcuacgaggugaagccuuccgggagcgccuccaguauggucaacggcgugguccggcuccugacaaagccaugggacgugaucccaauggugacccagauagccaugaccgacacgacgcccuuugggcaacagaggguuuucaaggagaaggucgacacccggacgccgcgccccaaacgggggaccgcccagauuauggaggugacggcaaaguggcucuggggauucuuaucgcgcaacaagaagccccggaucugcacccgagaggaguucacccguaaagugaggagcaacgcggccaucggggccguguucguggacgagaaccaguggaacagugccaaggaggccgucgaggacgagcguuucugggaccucgugcacagggagcgugagcugcacaagcaaggcaaaugcgcuaccugcgucuacaacaugauggggaagcgcgagaaaaagcucggcgaguucgggaaggccaaggggucgcgcgcgaucugguacauguggcuaggcgcccgcuucuuagaauucgaggcgcucggguucaugaacgaggaucacugguucucuagagagaacagucugucgggugucgagggugagggccugcauaagcucggguacauccugcgcgauaucuccaagaucccgggcggcaacauguaugcagacgacacagccggaugggacacccgcaucaccgaggaugaccugcaaaacgaggccaaaaucaccgauauaauggagccugagcacgcgcuccuggcuacguccaucuucaagcugaccuaccagaacaaggugguucguguccagcggcccgccaaguccggcaccgugauggacguaaucucucggagagaccaaaggggguccggccaggucggcaccuacgggcucaacacguucaccaacauggaaguacaguugauccggcaaauggaaagcgagggaaucuucucccccagcgagcuggaaaacuccaaccucgcugagcggguccuggacuggcuugaaaagcauggggucgaacgccucaagcggauggcgaucaguggcgacgauugcguugugaagccgaccgacgaccgguucgcgaccgcgcugacggcccugaaugacauggguaagguacggaaagacaucccccaaugggagccgagcaagggcuggaacgacuggcagcaggucccuuucugcucgcaccauuuccaccaacucaucaugaaggacggccgcgagaucguugucccgugucggaaucaggacgaacugguggggcgcgccagagugucccaaggggccgguuggagccugcgcgagacggccugccucggaaaaagcuaugcgcagauguggcagcucauguacuuccaccggcgcgaucugcggcucgcggccaaugccaucugcuccgccguccccgugaacugggugccaaccagccguacuacauggucaauccacgcgcaucaccaauggaugacgaccgaggacaugcugagcgucuggaaccgcguauggaucgaggagaaccccuggauggaagacaaaacgcacguguccagcugggaggacgucccguaccuggggaagcgagaagaucagugguguggcucccucaucgggcugacagcccgugccacgugggccaccaauauccagguggcuaucaaccagguuaggcgccugaucgggaacgagaacuaccucgacuacaugaccagcaugaagcgguucaagaacgaguccgacccagaaggugccuuaugguga

SEQ ID NO: 24737 - RNA, 9879 nt, Artificial Sequence
  derived and/or modified CDS sequence (opt11) from DENV-1__KM403581__SS-prME
ucaguuacgaugcuucucaugcugcuaccaacugcgcucgccuuccaucugacuacccguggcggggagccucacaugauugugucuaaacaagagagaggcaagagccuacuguucaagaccagugcaggggugaacaugugcacccugaucgccauggacuugggcgagcucugcgaggacacaaugacuuacaaauguccccgaauuaccgaagcggagcccgacgacguggacuguuggugcaacgcgacugacaccugggucaccuaugggaccugcagccaaacgggugaacaucggcgagaccggcggucuguggccuuggcaccacacgucggccuggggcucgagacgagaaccgaaaccuggaugagcagcgaaggagccuggcgacagauucagcgggucgaaacaugggcccugcgccacccuggguucacgguaauugcccuguuccucgcgcacgcuaucgguacgucuauaacccagaaggggaucauauucauccugcugaugcucguuacccccuccauggcgaugcggugcgucggcaucggcaaucgggauuucguggaagggcuguccggcgcgacguggguggauguuguacucgagcacgggagcugcguaaccaccauggcuaagaacaaaccaacccucgauaucgagcuucugaaaaccgaggugacuaaccccgcagugcuccggaagcuuuguauugaggcuaaaaucuccaacacgaccacugacucucgcugccccacccaaggcgaggcaacccuuguugaggagcaggacgcuaacuuuguuugccggcggaccuucgucgauagaggguggggcaacggcugcggacuguucgggaaaggcucccuucugacuugcgcgaaauucaagugcguuaccaagcucgaaggcaagaucguccaauaugagaauuugaaguacuccgugauugugaccgugcacacgggcgaucagcaccagguggggaacgagacgaccgagcacggcacgaucgcaaccauuacuccccaggcuccuacuagcgagauccaacugacagacuauggagcccucacccuugacugcagcccucggaccggccuggauuucaacgagaugguccuccugacgaugaaggagaaaucguggcugguacacaagcaaugguuccucgaccugccgcugccauggacuuccggggcaucgaccucucaagagaccuggaaccgacaagaccuccucgugacguuuaagaccgcucacgccaagaagcaggagguagugguauuaggcucccaagagggcgccaugcacacggcccucaccggggccacagagauacaaacgagcgguaccacuacaauauucgccgggcaucugaaaugccgccugaaaauggauaagcucacacucaagggcgucuccuacguuaugugcacuggcucauucaaguuagaaaaggagguggcagagacccaacacggcacgguccuaguacaaguuaaguacgagggcacagacgcucccugcaagauacccauaaguacccaagacgaaaaggggguuacccaaaacggucggcucauaacggccaacccuaucgugaccgacaaggagaagcccgugaacaucgagacugagccuccauucggugaaagcuacaucgucaucggagccggugagaaggcacugaagcuguccugguuuaaaaagggaucauccaucgggaagauguucgaggccaccgcucgcggcgcgcgccggauggccauccucggggacacugcgugggacuucgggucaauaggcggcguguucaccucgguugggaagcugguccaucagguauucggcaccgccuacggagugcuuuucagcggagucuccuggacgaugaagaucgggaucggcauccuccugacguggcugggccugaauagucgcucuaccuccuuauccaugacuuguaucgccguggggauggugacccuguaucucggcguaauggugcaggccgacucgggguguguaauaaacuggaagggccgcgagcugaagugugggucgggcauuuucgucacgaaugaggugcacaccuggacggaacaauacaaguuccaggccgauucgccgaagaggcucucagcggccaucggcaaggccugggaagaggggguaugcgggauccgguccgccacccgacucgagaacauuauguggaaacagaucucaaacgaacuaaaccacauacugcucgaaaacgauaugaaguucacaguuguggugggggaugccaacgguauccugacucaggggaagaagaugauccggccccagcccauggagcacaaguacuccuggaaguccuggggcaaggcgaagauaauaggcgcggacacacagaacaccaccuucaucaucgaugguccggacacgccggagugccccgaugaccagcgcgccuggaacaucugggaggucgaggacuacggcuuugggguuuuuaccaccaacaucugguugaagcuacgggacuccuacacacagcugugugaucaccggcugaugagcgcagcuauuaaggauaguaaggccguucacgcggacaugggcuacuggaucgagucagagaagaacgagacauggaaacucgcccgagcguccuucaucgaggucaagaccuguaucuggccgcgcagccacacccuaugguccaacggcguguuggaaagcgagaugaucauccccaagauauacggggggccgaucucccaacauaacuaucggccgggauacuuuacccagacugcgggccccuggcaccucgggaagcuggagcuagacuucaaucucugcgagggcacuaccguugugguggacgagcacugcggcaaccgcgggccaucacugcggacuacgacggugaccggaaaaaucauucacgaguggugcugccgcuccuguacccugccucccuuacgguuccgcggggaggacggauguugguacgggauggagauccggccgguuaaggagaaagaggagaaccuggugaggucaaugguguccgccggcagcggcgagguugacagcuucuccuugggguuacugugugugagcaucaugaucgaggaggugaugcguuccagauggagucgcaaaaugcugaugacgggcacauuagccaucuucuuccugcugaucauggggcaguuaacuuggaacgacuuaauucgucugugcauaauggucggcgcaaacguguccgaccgcauggggaugggcaccaccuacuuagcccugauggcgacauucaagaugcggccaauguucgccguggggcuccucuuuagacggcuuaccucacgcgagguucuacuccuaaccaucgggcugagucucguggccagcgucgagcugcccaacuccuuagaggaacucggcgauggauuagccaugggaaucaugaugcugaagcucuuaacggacuuucaaagccaccaacuguggaccacccuccugucucugaccuuuauuaaaacgacccucagccuggacuacgcuuggaagaccauggccauggugcugagcaucguuagccucuuuccccuaugcuuguccaccacuagccagaaaacgaccuggcuucccguauugcuaggcucuuucgggugcaaaccgcucaccauguuccugaucaccgagaauaagauuuggggccggaagucguggccuuugaacgaggggaucauggccgucgggaucguaucgauccuccugagcagccugcucaaaaaugaugucccccuggcagggccauuaaucgcaggcggaaugcuuaucgcgugcuaugugauuuccggguccucggccgaccugucgcuggagcgcgccgccgagguaucuugggaagaggaggccgagcauagcggcgccagccacaacauccuggucgaggugcaggacgacggaacgaugaagaucaaggacgaggagagggacgacacucucacaauccugcucaaagccacacugcuggccgugagcggcgucuacccgaugucuaucccugccacccucuucgucugguacuucuggcagaaaaagaagcagcgcagcggcguccugugggacacacccuccccgcccgaggucgagcgugcaguguuggacgacggcaucuaccgcauccugcaacggggccuccuggguagaucccaagugggcguuggaguuuuucaggacggcguguuccacaccauguggcacguaacuaggggugcggugcugauguaccagggcaagcguuuagagcccuccugggccucagugaagaaggaccuaaucuccuacggagggggcuggcgguuccaggguucauggaauacgggugaggagguccaggugaucgcggucgagcccggcaagaacccuaagaacguacaaaccaccccgggcacuuucaaaacgccagagggagaggucggggccaucgcacuggauuucaagcccggcaccucugggaguccgauagugaaccgcgaagggaagauaguuggccuauacgggaacggagugguaacgaccucgggcacguacgugagugcgaucgcccaggccaaggccagccaggagggcccccugcccgagauagaggacgaagucuucaagaagcggaaccugaccauaauggaccuccacccgggcuccggcaagacccggcgcuaccucccggccauaguccgggaagcaaucaagcgcaagcugagaacccuaauccuggccccgacgcgcgucguggccucugagauggcggaggcgcugaagggcaugccuauaagauaccagacgaccgcgguuaaguccgagcauaccgggaaggagaucgucgaccucaugugucaugccacguucaccaugcgccugcugagcccugugagagugccuaacuacaacaugauuaucauggacgaggcccacuucaccgacccagccucaauagcggcccgcggguacaucucgacccgggucgggaugggcgaagccgccgccaucuucaugacagccaccccgcccggguccguggaagccuuuccacagucuaacgcaguuauccaggaugaggaacgcgacauuccugagcgguccuggaacuccggauaugauuggaucacggacuuccccggcaagacggucugguucgugccauccaucaagagcgggaacgauaucgccaauugucuuagaaagaacggaaaacgugugauccaacugucccgcaagacuuucgacaccgaguaucaaaagaccaagaacaaugauugggacuacgucguaaccacggacaucagcgaaaugggugccaacuuucgagcggauaggguaaucgacccccgacgcugucugaaaccagucauacugaaagacggucccgagcgggugauccuggccgggccuaugcccgugaccgcugccuccgcggcgcagcgccgcggccggaucggccgcaaccaaaauaaagagggggaccaguacaucuauaugggccagccacugaacaacgacgaggaccacgcccacuggaccgaggccaagaugcuccuggauaacaucaauacccccgaggggauaauacccgcccuauucgagcccgagcgagagaagucugcggccaucgacggcgaguaccgucuccgcggggaggccaggaaaaccuuuguggagcuuaugagacggggcgaccuccccguauggcugagcuauaaagucgcuuccgaaggcuuccaauacucggaccggcguuggugcuucgauggugaacggaacaaccaaguguuagaagagaacauggacguggaaaucuggaccaaggagggagagaggaagaaacugaggccucgcuggcucgacgccagaaccuacucggacccccuggcucugcgggaauucaaggaguucgccgccgggcggagaagcguguccggcgaccugauacuggagaucgggaagcugccgcagcaccuaacucuacgggcgcagaacgcacuggacaaccuagucaugcugcacaauucagaacaaggcgggaaggcguacaggcacgccauggaggagcugcccgauacgaucgagacucucaugcuacuggcacucauagccgugcugaccggugguguuaccuuauucuuccucuccgggaagggucuagggaagaccagcaucgggcugcucugcguuauggcguccucuguccuguuauggauggccuccgucgagccucacuggaucgccgccagcauuauacucgaguucuuccugaugguucuccugauccccgagccggacagacagcguacgccccaggauaaccagcuagccuacguggucauuggccuacucuuuaugauucugaccgucgcugccaacgagaugggucuguuagagaccaccaagaaggaccuggguauuggacacguugucgccgaaaaccaccaccacgccacaaugcuggauaucgaccuccaucccgccuccgcguggacccuguacgcuguggccaccaccauuaucacgccuaugaugaggcauacgauugagaacaccaccgcaaacaucagccugacggcuaucgcgaaccaagccgccauccucaugggccuggauaagggcuggccaaucuccaagauggacaucggugugccccugcuggcacuggguugcuauucgcagguaaacccacugacccuaaccgcagcgguccugaugcugguugcccacuacgccaucauagggccaggccuccaagccaaggcgacccgggaggcacagaaacgaacagccgcagggaucaugaagaaucccaccguugacggcaucguggcaauagaccucgacccuguggucuacgaugcgaaauuugagaagcaguugggucaaauuaugcuacugaucuuguguaccucccagauccuccugaugcggacgacuugggcccugugugagagcauaacccucgcgacagggccuuugaccacguugugggaggggucgccugggaaauucuggaacacgaccaucgccgugagcauggccaacaucuuccgcggcucauaccucgcgggcgccgggcucgccuucucauugaugaagagccucggcgggggucggcgcgggaccggcgcccaaggugagaccuugggugagaaguggaagagacagcugaaucagcuaagcaagagcgaguucaacaccuacaagagauccggcaucauggagguugaccguagcgaagccaaggaagggcugaaacguggcgaaacaaccaagcacgcggucagucgcgguacggcaaagcugcgcugguucguggagcguaacuuggugaaaccagagggcaaggugaucgaucucggcugcgggcgcggaggguggagcuacuacugcgccggccugaagaaggugacugaggugaagggguacacgaagggcgggcccgggcacgaggagcccauaccgauggccaccuacggcuggaacauugucaagcuccacuccgggcgggacguguucuuuacgccgcccgagaagugcgacacgcuccugugcgacaucggcgagagcagucccaacccgaccauagaggaggggaggacccugcgaguacucaagauggucgaacccuggcugcgcgguaaccaguucuguaucaaaauccugaaucccuauaugcccagcgugguggagacccuagagcagaugcaacguaagcacggcgggaugcuuguccguaauccgcugucgcgcaacucaacgcacgagauguacugggucuccugcggcacugggaacaucguaagcgcgguuaacaugacgucucggaugcugcugaaccgcuuuaccauggcccacagaaagcccacauacgagcgcgacguugaccugggagccgggacaagacacguggcugucgagcccgaaauagcuaaccucgacaucaucgggcaacgcaucgaaaacaucaagaacgagcauaagucgaccuggcauuaugacgaagauaaccccuacaagacaugggcguaucacggcaguuacgagguuaagccgucugguagugccagcaguaugguaaacggcgucguucggcugcuaacuaagccuugggacgucauucccauggugacgcaaauagcgaugaccgacaccacacccuucgggcagcaacgcguuuucaaagagaaggucgacaccaggacuccccgccccaagcgcggcaccgcccaaaucauggagguaacggcuaaauggcucuggggcuucuugaguaggaacaagaagccucggaucuguacccgcgaggaguucacccggaaggugcgcucgaaugcagcgaucggggccgucuuuguggacgagaaucaguggaacagugccaaggaggccguggaggacgagcgguuuugggaccugguccauagggagcgggagcuacacaagcagggcaagugugcgacuuguguguauaacaugauggggaaacgugagaagaagcugggugaguucgggaaggccaagggcuccagagcuaucugguacauguggcugggcgcucgcuuccucgaauuugaggcacucggguucaugaacgaagaccacugguucucccgugagaauagccuguccggcguugagggggaaggucuacacaaauugggauacauccugcgagacauuagcaaaaucccaggcggaaacauguacgccgacgacacggccgguugggacacacgcaucacggaggaugaucuccagaacgaggccaagaucaccgacaucauggagcccgagcaugcauugcuggcgacuagcaucuuuaagcucaccuaucaaaacaagguuguucgcgugcagcgccccgccaagagcggcaccguaauggacgugauaucccggcgcgaccagcggggcagcggccaggucggcaccuacggguugaacacguucaccaacauggagguacagcugauacgccagauggagagugagggcauuuucagccccuccgaacucgagaacagcaacuuggccgaacgggugcucgacuggcuagaaaagcaugggguggagcgccugaaacggauggccaucuccggcgacgacugcgucgugaagcccacugacgaccgcuuugccaccgcacuaacggcccucaacgacauggggaaggugcggaaggacauuccacagugggaacccagcaaagguuggaacgauuggcagcaggucccauucuguagccaccacuuccaccagcugaucaugaaggacggacgcgaaaucguggugccgugccggaaucaggacgaauuggucgggcgcgcccgggugagccagggugccgguuggagccuccgcgagacugcaugccugggaaaguccuacgcgcagauguggcaacugauguauuuccaccgacgcgaccuacgacuggcagcaaaugcaauuugcagcgccgugccagucaacuggguaccaacaucaaggaccaccuggagcauccaugcgcaccaucaguggaugacgaccgaggacaugcucuccguguggaaucgcgucuggaucgaggaaaacccuuggauggaggacaagacucacgugagcuccugggaagacgugccguaccuugggaaaagggaggaccaguggugugguagccugaucggcuuaaccgcccgcgccacgugggccaccaacauccagguggcgauuaaccaggugcggaggcucauagggaaugagaauuaccucgacuacaugaccuccaugaagcgguucaagaacgagagcgaccccgagggcgcccugugguga

SEQ ID NO: 24738 - RNA, 9879 nt, Artificial Sequence
  derived and/or modified CDS sequence (opt11) from DENV-1__KM403597__SS-prME
agcgugacaaugcugcuuaugcugcugcccacagcccucgccuuccaucugaccacccgcggcggcgaaccccacaugaucgugagcaaacaggagcggggcaagagccuccuauucaagaccuccgcggggguaaacaugugcacccucaucgccauggaccugggcgaguugugcgaggauacaaugaccuacaagugcccucggaucaccgaggcugagccugaugacguggacugcuggugcaacgccaccgacacauggguuaccuacgggaccuguagccagaccggcgagcaccggagggaccggcgcagcguggcgcuggcgccccacguuggucugggguuagagacgcggaccgaaaccuggaugagcuccgagggcgcuuggcgccagauccagcgggucgagacaugggcgcugcgccacccuggguuuacgguaaucgcccuguuccucgcgcacgccaucggcaccucgauuacccaaaaggggaucaucuucauuuuacugaugcucguaacccccuccauggcuaugcggugcgugggcauaggcaaccgcgacuucguggaggggcugagcggcgccaccuggguggacgucgugcuggagcacgguucuugcgugacaacaauggcuaaaaacaaaccaacccucgauaucgagcugcugaagacggaggucaccaaccccgcgguccuccgaaagcuaugcaucgaagccaagauaagcaacacaacaaccgacucgcggugcccaacccagggcgaggccaccuuaguagaggaacaggaugccaauuucgucugccggcgcaccuucguggaccgcggguggggcaaugggugcggucucuucggcaaggggagccugcuuacgugcgcaaaguucaaaugugugacuaagcucgagggcaagaucguccaguaugagaaccugaaguacucugugauagugaccgugcauaccggcgaucagcaccagguagggaacgaaacgaccgagcaugguaccauugcgaccaucacaccccaagcgcccacuagcgagauccagcugaccgacuacggggccuugacgcuggacugcagcccgcggaccgggcuggacuucaacgagaugguccucuugacgaugaaagagaaguccuggcugguacauaagcagugguuucuggaccugccacugcccuggaccucaggugccagcaccagccaagaaaccuggaaucggcaagaccuccuugucacguuuaagacugcccacgcgaagaaacaggaggucguggugcuggggucccaggagggugcaaugcacacagcacugaccggagccacggagauccagaccagcggcacgaccacaaucuucgccgggcacuugaaguguagacugaaaauggacaaauuaacccuaaagggcgucagcuacgugaugugcaccgggagcuucaaguuagaaaaggaaguggcggagacccagcacgggaccguucugguacagguuaaguacgagggcacagacgcccccugcaagauccccaucuccacucaggacgagaagggugucacccagaacggccggcucaucaccgcuaacccgaucgugaccgacaaagagaagccaguaaacaucgaaacagagccacccuucggggaaucguauaucgucauaggcgccggagagaaggcccugaagcugagcugguucaaaaaggggucauccaucggcaagauguucgaagccaccgcccgcggcgcucgacguauggccauccugggcgacacggcaugggacuucgggagcaucggcggcguguucacuucgguugggaagcugguccaccagguguucggcaccgccuacggggugcuguucagcggcgucuccuggaccaugaagaucgggaucgggaucuugcugacguggcugggacuuaauagccgcuccaccagccugagcaugaccugcauagcgguaggcaugguuacccuguaccucggcguuauggugcaagccgauagcggcugcgugaucaacuggaagggccgggaguuaaagugcgggucaggcauauucguuacgaacgagguccacacuuggaccgagcaguacaaguuccaagccgauagcccgaagcgccugucagcggccaucggcaaggccugggaggaagguguguguggcauccggucggcgacccgccucgaaaacaucauguggaagcagaucucuaacgagcucaaucacauccugcuggaaaacgacaugaaguucaccgucguggugggggacgcaaaugggauccugacgcaagguaagaagaugauccgcccacagcccauggagcacaaguacucuuggaaaagcuggggcaaggcgaagauaauaggggccgacacccagaacacuacauucaucaucgacgguccggacacgccggagugcccagacgaccagcgagccuggaauaucugggagguggaggacuacggcuucggcguguuuaccacuaacaucuggcugaagcugcgagacuccuacacacagaugugugaccaccgccuaaugagcgccgcgaucaaggauaguaaggccguccacgccgacaugggcuacuggaucgagagugagaagaaugagacguggaaguuagcccgggcguccuucaucgaggucaaaaccugcaucuggccccgcucucacacccucugguccaacggcguucuggagagcgagaugaucauccccaagaucuacgggggaccgaucucccagcacaacuaccggcccggguauuucacgcaaacagcgggccccuggcaccucgggaaacucgagcucgauuucaaucugugcgagggcacuaccgugguggucgacgagcacugcggaaaccgcggcccgagcuugcggaccacgaccguuaccggcaagaucauccacgaguggugcugcagaucguguacacugccgccccugcgguuccgcggggaggacggcugcugguacgggauggagauccggcccgucaaggagaaagaggagaaccucguuaggagcaugguguccgccggcucaggcgaggucgauagcuucucccucgggcugcucugcgugucgauuaugauugaggaggugaugcggucucgauggagccgcaaaaugcugaugacggggacccuggcgaucuucuuccuuuuaaucauggggcagcugaccuggaacgaucucauccgguugugcauaauggucggcgcuaacguguccgaccgcaugggaaugggcaccacguaucuggccuugauggcgacauucaaaaugcggccgauguuugccguggggcugcuguuccgccgacucaccagccgcgaggugcugcuacucacaauagggcuuucccugguagccagcguggaacuccccaacucccuggaggagcugggcgaugggcuagccaugggcauuaugaugcugaagcugcucacggacuuccagucccaccagcuguggaccacauuacuaucucugaccuuuauuaaaacgacucuuagccucgauuacgccuggaagacuauggcuauggugcuguccaucgugagucuguucccccucugccugagcacgacgagccaaaagaccaccugguugcccgugcucuuaggcuccuucggguguaagccguugacaauguuucugauaaccgagaacaaaauauggggcagaaagagcuggccauugaacgaggggaucauggccgugggcauuguauccaucuugcucaguagccugcugaagaaugacgugccacuagccgggccccugaucgccggcgggaugcuaauagcgugcuaugucauaagcgguagcagugccgaccugagcuuagagcgcgccgcggagguuucaugggaggaggaggccgagcauucgggcgccagucacaauauccugguagagguccaggaugacggcacgaugaagaucaaggacgaagagagagacgacacccucaccaucuugcugaaggccacccuccuggccgugagcggcguuuauccaauguccaucccagcuacgcuauucguaugguauuucuggcagaagaagaagcaacgcucagggguucugugggacaccccgagucccccggaggucgagagagcuguccuggacgauggcauuuaccgcauccugcagcggggacugcuggggcgaucucaggugggugucggcguguuccaggacgguguguuccacaccauguggcacgucacccgaggggcuguguuaauguaccagggcaagcgccuagagccgaguugggcgagcgugaagaaggaucucauaucguacggcggcggcuggcgguuccaggguagcuggaacacgggcgaggaaguccaggugauugccguggagcccgguaagaauccgaagaacguccagaccacccccgggacguucaagacgcccgaaggcgaggugggggcaaucgcccuggacuuuaagcccggcaccucuggaagcccgaucgucaaccgcgagggcaagaucgucggccuuuaugguaauggcguuguuaccaccucggggacguacgucagugcgauagcccaggccaaggcaucacaggagggcccgcugccugagauagaggaugaaguguuuaagaagcguaaccuuaccauaauggaccugcauccuggauccggcaagacucgccgcuaccucccggccaucgugcgagaggcgaucaagcgcaagcugcggacccugauccuugccccgacgcgcguaguugccucugagauggcagaggcgcugaaaggcaugcccauccgguaccagaccacagcugugaaguccgagcacacggggaaggaaaucguggaccugaucugucaugcgaccuucaccaugcgccugcuguccccagugcggguaccgaacuacaacaugaucaucauggacgaggcucacuuuaccgaucccgccaguaucgccgcccgcggcuacauaaguacccgagucgggaugggcgaggccgccgccauauucaugacagcaacgccgccaggguccguggaagccuucccgcagucuaacgcggugauucaagaugaggaacgcgauauccccgagaggaguuggaacucugguuacgacuggaucaccgacuucccgggaaagaccgucugguucgucccauccaucaagagcggcaacgacauagcaaacugccugcggaagaacggcaagcggguaauccagcucucccgcaagacguucgacacugaguaccagaagaccaaaaauaacgauugggacuacgucgucacaacggacauuagugagaugggggcuaacuuccgggcggaccgcgugaucgacccacgucgcugccugaaacccguuauccugaaagacgggccugagcguguuauccucgccgggccuaugccugucacggccgccuccgcggcacagcgucgcggccggauuggccgcaaccagaacaaggaaggugaccaguacaucuacaugggccagccucuuaauaacgacgaggaccacgcccacuggaccgaggccaaaaugcugcucgacaacaucaacaccccugaggguaucauccccgcccuguuugagccagagagggagaaguccgcggccaucgacggcgaauauagacugagaggggaagccaggaagacguucguggagcucaugcgacgcggugaccugcccgugugguuauccuacaaaguagccagcgagggcuuccaguacucggaucggcgcuggugcuucgacggggaacguaauaaccaggugcucgaggagaauauggacguggagauuuggaccaaggagggcgagcgcaaaaaguuacggccccgcuggcuggacgccaggacauacagcgaccccuuagcgcugcgcgaguucaaggaguucgcugcagggcggcguucagucuccggggaccuaauccucgaaaucggcaagcugccgcaacaccugacccuccgggcgcaaaacgcccuggauaaccuuguaaugcuccauaacagcgagcagggcggaaaggcguauagacacgccauggaggaacuccccgauaccaucgagacgcugaugcuccucgcccugauugccguccucaccggagggguaacccuguucuuccuguccgggaagggccucggcaagaccagcaucggacuccugugcgugauggcguccagcgugcucuuauggauggcguccguugagccccauuggauugcugcgagcaucaucuuggaguucuuccucauggugcugcuaauuccagagccggaccggcagaggacuccacaggacaaccagcucgccuacguaguaaucggucugcuguuuaugauauuaaccguggcggcuaaugaaaugggacugcuggaaaccaccaaaaaggaccuaggcaucgggcacgugguggcugagaaccaucaccacgccacuaugcuggauauugacuugcaccccgccuccgcguggacccuuuacgccguggcgacaaccaucaucacgccgaugaugcgacacacuauugagaacaccaccgccaacauuucauugacggccaucgcgaaccaggccgccauacugaugggguuagacaagggcuggcccauaaguaagauggacauuggggugccccugcuggcauugggcugcuauagccaggucaacccccucacucugaccgcagccguguuaaugcuugucgcccacuacgccaucauuggcccaggccugcaggccaaagcgacccgggaggcacaaaagcgcacggccgccggcauaaugaagaaucccaccgucgacggcauuguggcgaucgacuuggaccccguugucuacgacgccaaguucgaaaagcaauuggggcaaauuaugcuucucauccuaugcaccucccaaauacugcucaugaggaccacgugggcucucugugagagcauaacgcuggcgaccgggccucucacaacucucugggaggguuccccggggaaguucuggaacaccacuaucgccgugagcauggccaauaucuuucgcggcuccuaccuggcgggggccggccuggccuucagccugaugaagucccugggcgggggaaggagggggaccggcgcucagggcgaaacucucggggagaaguggaaacgucagcugaaccagcugaguaagucagaguucaacaccuacaagcgcaguggcauaauggagguagaucguagcgaggcaaaagaggggcugaagcgcggcgagacaaccaagcaugcggucucccgggggacugccaaacuucgcugguucguggagcggaaccuggugaagcccgagggaaaggucauugaccugggcugugggcguggaggguggagcuauuacugcgcggggcugaagaaggugaccgaggugaagggauacaccaagggcggccccgggcacgaggagcccaucccaauggcgaccuacggcuggaauauugucaagcugcauuccggacgggaugucuuuuucacgccacccgagaagugugacacgcuacucugcgacauaggcgagucuucccccaauccgacaauugaggaggggcguaccuugcgggugcugaaaaugguggaacccuggcuccguggcaaucaauucugcauuaagauucuuaaccccuacaugccgagugucguagaaacccuggaacagaugcagcgaaagcacggcgguaugcucguccgcaacccguuaucccgcaacagcacacacgagauguacuggguauccugcggaaccgguaauaucgugagcgcggucaacaugaccuccaggaugcuguuaaaccgcuucaccauggcccaccggaagcccacguacgagcgcgacgucgaucugggcgccgggaccaggcacguggccguugagcccgagaucgccaaucuggacaucaucgggcaacgcaucgagaacaucaagaacgaacacaaaaguaccuggcacuacgacgaggacaacccuuacaaaacgugggcguaccacggcagcuacgaggugaaaccgucaggauccgccagcucaauggugaauggcguaguacggcuccugaccaagcccugggacgucauacccauggugacccagaucgccaugaccgacaccacaccguucgggcagcagcgcguauucaaagaaaaaguagacacccggaccccgaggcccaagagggggacggcccagaucauggaagucacggccaaauggcuguggggcuuccucucucgcaacaagaagccgcguaucugcacccgcgaggaguucaccaggaagguuaggucuaacgcggccaucggcgccguauucguagaugagaaccaguggaacuccgccaaggaggcagucgaagacgagcgguucugggaucuuguucaucgcgagcgggaguuacacaagcaggggaagugcgcuacguguguguacaacaugauggggaaacgugaaaagaaauugggugaguucgguaaggccaagggaucccgggccauaugguacauguggcugggcgccagguuccuggaguucgaagcccucgguuucaugaaugaggaucacugguucucccgagagaacagccuguccgggguggagggggagggacugcauaagcucggguauauucucagagacauaagcaagaucccgggaggcaacauguacgccgaugacacagccggcugggacacccgcaucacugaagacgaucuucagaacgaagccaagaucacagauaucauggaaccggagcacgcgcucuuagcgacguccaucuucaagcugaccuaccaaaacaagguuguucggguucagcguccagccaagucgggcaccgucauggacguaaucucccggagggaucagcggggcagcggccaggugggcaccuacgggcucaauacuuucaccaacauggagguccaacuuauccgccagauggagagugagggcaucuuuagccccuccgagcuggaaaacagcaaccucgccgagcgggugcuggacugguuagagaagcaugggguggaacgccucaagcggauggccauaucuggugacgacugcgucgugaagccgaccgacgaccgcuuugccacugcacugacggccuuaaacgauauggggaaggugcggaaggacaucccccagugggagcccucgaagggcuggaacgacuggcagcagguccccuucugcucccaucacuuccaccaguuaauaaugaaagacggacgcgagauuguagugccuugccggaaccaggacgagcugguggggcgcgcgcgagugagccagggcgccggguggagcuugcgcgagaccgccugccucggcaaauccuaugcgcagauguggcaguugauguacuuccaccggcgcgaccugcgacuggccgcaaacgccaucugcuccgccgugcccgucaacuggguacccaccucccggaccaccuggagcauucacgcgcaccaccaguggaugacgacggaggacaugcuuuccguguggaaccguguauggauugaggagaaucccuggauggaggauaagacccacgugaguucuugggaggaugugccguacuuagguaagcgggaggaccaguggugcggcagcuuaaucggccugaccgcacgugccacgugggccaccaacauucaggucgcgaucaaccaggugcgccgccugauagggaacgagaauuaccucgacuauaugaccuccaugaagcgguucaagaacgaaucggaccccgagggcgcccugugguga

SEQ ID NO: 24739 - RNA, 9879 nt, Artificial Sequence
  derived and/or modified CDS sequence (opt11) from DENV-1__KM403610__SS-prME
agcgugaccaugcugcucaugcugcugcccacggcucuagccuuccaccugacuacccgcggaggggagccucacaugaucgugucaaagcaggagcggggaaagucucuccuguucaaaaccuccgcgggggugaauaugugcacccuuauagcuauggaccugggcgagcucugugaggacacgaugaccuacaagugcccccgcaucaccgaagccgagcccgacgacgucgacugcuggugcaacgccaccgacaccuggguaacuuaugggaccugcucgcagacuggcgagcaccggcgcgauaagagauccguggcgcuggcgccccaugugggccugggccucgaaacucguaccgagaccuggaugagcuccgagggcgccuggcgucagauucagaaggucgagaccugggcgcuacgccacccgggauucacggugaucgcccuguuccucgcgcacgcuauaggcaccagcaucacccagaaggguaucauuuuuauccugcugaugcucgugacccccuccauggccaugagaugcgucggaauagguaaccgcgacuuuguggagggguugagcggcgcaacuuggguggacguggucuuggagcacggguccugcgugaccacuauggcuaagaauaagcccacccucgauauagagcuccugaaaacggaggugaccaaccccgcgguacuccggaaacugugcaucgaggccaagaucagcaacaccaccacugacucccguugccccacccagggcgaggccaccuuaguggaggagcaggacgccaacuucgucugccggcgcaccuucguggaccgcggcugggggaauggcugcggccucuucggcaaggggagccugcugacgugcgccaaauucaaaugcgugaccaagcucgagggcaaaaucguccaauacgagaaccugaaguacuccgugaucgucaccauccacaccggggaccaacaccaggucgggaacgaaacuaccgagcacggcaccaucgcgaccaucacgccgcaagcccccacaagugagauccagcugaccgacuauggggcccucacccuggacugcagcccccgcaccggucuggacuuuaacgaaaugguacuucugacgaugaaggaaaagagcuggcugguccacaagcagugguuccucgaccucccguugcccuggaccuccggagccagcaccagccaggagaccuggaaucggcaggaccucuuggugacuuuuaagaccgcccacgcgaaaaagcaggagguuguugugcugggcucccaggagggcgccaugcacacggcccucaccggagccaccgagauccagaccagcggcaccacgacaaucuucgcagggcaccugaagugccgccugaaaauggacaagcucacccugaagggcguguccuaugugaugugcacagggagcuuuaagcuggagaaagaaguggcagagacccagcacggaacaguccugguccaagugaaguacgagggcaccgacgcuccgugcaagauccccaucuccacccaggacgagaagggcgugacucagaacggacggcucaucacggcgaacccgaucguaacggacaaggaaaagccggugaauaucgagaccgagccgccauucggggagagcuacaucgugaucggcgccggcgagaaagcgcugaaacuguccugguucaaaaaggggagcuccaucggcaagauguucgaggccaccgcccgcggggcccggcguauggccaucuuaggcgauacggcuugggacuucgggagcaucggcggagucuucaccuccgugggcaagcuggugcaccaggucuucggcaccgccuacgguguacuguucagcggcgucuccuggaccaugaagaucgggaucggcauucuccugacguggcugggcuugaacagccgcuccaccagccuguccaugaccuguaucgccgucgggauggugacccuguaucuaggcgugaugguccaggccgacagcgggugcgugaucaacuggaagggacgugaacucaaaugcgguuccggaauuuucguaaccaacgagguccacaccuggaccgagcaguacaaguuccaggccgacagcccgaagcgccugagcgcggccaucggcaaggcaugggaggagggggugugcggcauccggagugccacacgccucgagaacauaauguggaaacagaucucguccgagcugaaucacauccuguuggagaacgacaugaaguucaccguggucgucggggacgccaacgggauacugacacagggcaaaaagaugauccggccacagcccauggagcacaaguacagcuggaaguccuggggaaaggcgaagaucauaggcgccgauacccaaaacaccaccuuuaucauagacggacccgauacgccggagugccccgacgaccagcgcgcauggaacaucugggagguggaagacuacggcuucgggguuuuuacaaccaacaucuggcugaagcuccgggacucuuacacccagaugugcgaccaucgccugaugucugcugcgaucaaggacagcaaggccguucacgccgacaugggcuauuggauugaguccgagaagaacgagacguggaagcuggccagggccuccuucauagagguaaagaccugcauuuggccacgcucccacacccucuggagcaacggcguucuggagagcgagaugaucauacccaagaucuacgggggcccgauaagucagcacaacuaccgacccggcuacuucacccagacggcgggcccauggcaccugggcaagcucgagcuggacuucaaccugugcgagggcaccacagugguggucgacgagcacugcggcaaccgagggccgucccuucggaccacaaccgugacaggcaagaucauccacgaguggugcugccgaagcugcacccuuccgccgcugcgguuccgcggggaggacggcugcugguacgggauggagauccggcccgugaaggagaaggaagagaaccucguccgcuccauggugagugccggcagcggcgagguggacaguuucucccuggggcuuuuaugcguauccaucaugaucgaggaggucaugagaagccgaugguccaagaagaugcugaugacgggcacccuugccguguucuuccuccugaucauggggcagcugaccuggaacgacuuaauacgucugugcaucauggucggcgcuaacguaagcgaucggauggggaugggcacgacguaccucgcccucauggccaccuucaagaugaggccgauguucgccguggggcuuuuauuccgacgacuuaccucccgggagguccuacugcucaccauuggccucagccugguggccagugucgagcucccgaacucauuagaagaguuaggcgacggacucgcgaugggcauuaugauguugaagcugcucaccgacuuucagucgcaccaguuauggaccaccuugcucucccugaccuucaucaagacgacacugagccucgacuacgccuggaaaacgauggcuauggugcugucuaucgugagccuuuucccccucugccuuagcaccacgucccagaagacuaccuggcugcccguuuuguuaggguccuucggguguaagccgcugaccauguuccucauaacugagaacaagaucuggggccgcaaguccuggccccugaacgaggggaucauggccgugggcaucguaagcauccuguugagcucccuguuaaagaacgacguaccauuggccgggccccugaucgcuggcgguaugcugaucgccuguuacguaaucagcgggucaagcgccgaccucucccuggagcgggccgccgaggucagcugggaggaggaggccgagcacucuggagcgagccacaacauccuaguggaagugcaggacgacgguacgaugaagaucaaagacgaggagcgcgacgauacccucaccauccugcugaaagcuaccuuacuggccguguccggcgucuacccgaugagcauccccgccacacuguucgugugguacuuuuggcagaagaagaagcagcgguccggggugcucugggacacccccagcccgcccgaaguugagcgcgccguucuggaugacggcaucuaccggauccugcagagagggcugcucggucgaucccaggugggcgucgggguguuccaggacggcguguuccacaccauguggcaugucacccgcggugcggugcuuauguaccaggggaagcgacuggagcccagcugggccuccgugaagaaggaccuuauuagcuacggugggggcuggagauuccagggguccuggaacacgggcgaggaaguacaggugaucgccgucgaacccgggaagaaccccaagaacguccagaccaccccuggcaccuucaagacgcccgagggggaggugggggccaucgcccuggacuucaagccagggaccagcgggagccccauaguuaaucgugagggcaagauugucggucuauaugggaauggcguggugaccaccagcgggacuuacgucagcgcgaucgcgcaggccaaagcaucccaagagggcccgcuccccgaaaucgaagacgagguguuuaagaagagaaaucugaccaucauggaccugcaccccgggagcggcaagacacgccgcuaccucccggccauugugcgggaagccaucaagcgcaaacugcggacccugauacucgcccccacgcguguuguugccuccgagauggccgaggcgcuaaagggcaugcccauacgcuaccagaccacggccgucaaguccgagcacacgggcaaggaaaucguagaccugaugugccacgccacauucaccaugcggcuccuguccccggugcgcgugccgaacuacaacaugauuauaauggacgaggcgcacuucaccgauccagcuucaaucgcggcccggggcuacaucuccaccagggucggcaugggugaggccgccgccauuuucaugacggcuacgccgcccgggagcguggaggccuucccgcagaguaacgccgugauccaggacgaggaacgagauaucccggagcgcagcuggaacuccggcuaugacuggaucaccgauuucccuggcaagaccgucugguucgugcccagcauaaagucagggaacgacaucgccaacugccugcggaagaaugguaagcgcgugauccagcucucucggaagacguucgacaccgaguaccagaagacgaagaacaacgacugggauuacguugugaccacggauaucagcgagaugggugccaacuuucgcgcugaccgggugaucgacccacgccggugccuaaagcccgucauccugaaagacggccccgagcgcgugauccucgccgggccuaugccggucaccgccgcaagcgcggcccagcggcgcgggcggaucggccgcaaccaaaacaaagagggagaccaguacaucuacauggggcaaccccugaacaacgacgaggaccaugcgcacuggaccgaggccaaaaugcugcuggacaacaucaacacccccgagggaaucauacccgcccuauucgagccggagcgugagaaguccgcggccaucgacggugaguacaggcuucgcggagaagcccggaagacuuuuguggaacucaugaggcggggcgaccugccugucuggcuaagcuacaaggucgccuccgagggcuuccaguacagcgaccgccgguggugcuuugacggggaacgcaacaaccaggugcucgaggagaacauggacguggagaucuggaccaaagagggcgagcggaagaagcugcggccacgguggcuggacgcccgcaccuacucagauccgcucgcgcuucgggaguucaaggaguucgccgcagggcgccggagugucucuggcgaccugauccucgagaucggaaagcugccgcaacaccugacccucagggcccagaacgcccuggauaaccuggugaugcuccacaacuccgagcagggagguaaggcguaucggcacgccauggaggagcugccugacaccaucgagacgcucaugcuccuggcccugaucgccguucucaccggaggggucacgcuguuuuuccugagcgggaagggguugggcaagacaucgauugggcuacugugcgugauggcgucuuccgugcuccuguggauggccagcgucgagccucauuggaucgcugccuccaucauccuggaguucuuccucauggugcugcugaucccggaaccggaccgccagcgcacgccccaggacaaccagcucgccuaugugguuauaggcuuacuguucaugauucucaccguggcggccaacgagauggggcugcuggaaaccacaaagaaggaccucggaaucggccacguagucgcagagaaccaccaccaugccacgaugcuggacaucgaccugcaccccgccagcgcguggacgcucuaugccguugcuaccaccauuaucacgccgaugaugcgccacaccauagagaauacuacugccaacaucucauugaccgccaucgcgaaccaagccgccaucuuaaugggccucgacaagggguggcccaucucgaaaauggacauagggguaccccuacuggcccucggcugcuacucacaggucaauccacugacccuuaccgccgcggugcucaugcugguggcccacuacgcgaucaucgggccgggccugcaagccaaggcgacgcgggaggcccagaagcgcacggccgccgguaucaugaaaaaccccacggucgaugggaucguggccaucgaucucgaccccguagucuacgacgcgaaguucgaaaagcaacugggccagaucaugcugcucauccugugcacuagccagauccuccucaugcgcaccacaugggcccugugugaguccaucacgcuugccaccgggccccucaccacacugugggagggcagcccggguaaguucuggaacacgacuaucgccguguccauggccaacaucuuccgggguagcuacuuggcgggcgccgggcucgcuuucucccugaugaagucccugggcgggggccgccgagguacaggcgcccagggcgagacgcucggcgagaaguggaagcgccagcugaaccagcugagcaaauccgaguucaacacguacaagaggagcggcaucauggagguggaccgguccgaagccaaggagggcuuaaagcggggcgagaccaccaagcacgcggucagccgcgggacggccaagcugcggugguuuguggagcggaaccuggugaagcccgaaggcaaggucaucgaccuagguugcggacggggcgguugguccuacuacugcgcgggccucaagaaggugaccgaagugaagggguauaccaagggcggcccagggcacgaggagcccauaccgauggcaaccuauggcuggaacauugucaagcugcacagcggccgcgacguuuucuucacgccgccggagaagugcgacacacugcucugugacauuggcgaguccagccccaacccgaccauagaggaggggcgaacccugcgcguucucaagaugguugagcccuggcuccggggcaaccaguucuguaucaagauccugaaccccuacaugcccuccgucguagagacacuggaacagaugcagcgaaagcacggcggcauguugguucggaacccgcuaagccgcaacaguacgcaugagauguauugggucagcugcgguacagggaacauuguguccgccgucaauaugaccucgcggaugcugcucaaccgcuucaccauggcucaccgcaagcccacguacgagcgggacguggaccugggugccggcaccagacauguggcggucgaacccgagaucgccaaucuggacaucaucgggcagcggaucgagaacaucaagaaugagcacaaguccaccuggcacuacgacgaggacaaccccuacaaaaccugggcguaucacggcucuuacgaggugaagccguccggguccgccuccaguauggugaacggcgucgugcgccuccucacgaagcccugggacgucauccccauggucacgcaaaucgcgaugacagacaccacgcccuucgggcagcagcggguguucaaagagaaggucgauacccgcaccccacggcccaagcgcggcaccgcccagaucauggaggugacggcuaaguggcuguggggcuuccucucccggaacaagaagccccgcaucugcacccgggaggaguuuaccagaaaggugcgguccaacgcggccauaggggcagucuucguggacgagaaccaguggaacagcgccaaggaggccguagaggacgagcgcuucugggaccugguccaccgugagcgugagcugcauaaacagggcaagugcgcgaccugcguguauaacaugauggggaagcgggagaagaagcucggcgaguucgggaaggcuaagggcucccgcgccauaugguacauguggcugggcgcccgguuccuggaguucgaggcgcucggguucaugaacgaggaccacugguucagccgcgagaacucccugagcgguguggagggggagggccugcacaagcuaggguacauccuaagagacaucuccaagaucccgggcggcaacauguaugccgaugacacggccgguugggacacccgcaucaccgaggaugaccugcagaacgaggccaaaauaaccgacaucauggagcccgagcacgcccugcuggcgaccuccaucuucaagcugacauaccagaacaaagucgugcgcgugcagcggccugccaaguccggcaccguaauggaugugaucagcagacgcgaccaacgcggguccggccaggugggcaccuacgggcucaacacguucaccaacauggaaguccaacugauacggcagauggaaagcgagggcaucuuccugccauccgagcucgagaacucaaaccuugccgagcgcguguuggauuggcucgagaagcacgggguggagcggcuuaagcgcauggccaucuccggcgacgacugcguggugaagccgaccgaugaccgguuugccaccgcgcucacggcccucaacgacauggggaagguacggaaggacaucccccagugggagcccuccaagggcuggaacgacuggcagcaggucccguucugcagccaccacuuccaccaacugaucaugaaggacggucgggaaaucguggugccgugccgcaaucaggacgagcuagucgggcgggcccgcgugagccagggcgccggguggucucuccgggagaccgccugccugggcaagucuuacgcgcaaauguggcagcugauguauuuccaucgccgggaccucagacuggccgccaacgccaucugcagcgccgugcccguaaauuggguuccuaccucccggaccaccuggagcauccacgcgcaccaccaguggaugacgaccgaggacaugcuguccguauggaaucgcgucuggaucgaggagaaccccuggauggaggacaagacccaugugagcucaugggaagacgugccguaucucgggaagcgcgaagaccaguggugcggcagcuugauaggccugaccgcccgggcaacgugggccaccaacauccaggucgcgaucaaccaggugcgucgacucaucgggaacgagaacuaccuagacuacaugacuuccaugaagcgcuucaagaacgagagcgaccccgagggcgccuuaugguga

SEQ ID NO: 24740 - RNA, 9879 nt, Artificial Sequence
  derived and/or modified CDS sequence (opt11) from DENV-1__KM403596__SS-prME
agcgugaccauguugcucaugcugcuaccgaccgcccucgcauuucaccugaccacccgcggcggggagccacacaugaucgugagcaagcaggagcggggaaagagccuccuguucaagacaagcgcgggggugaacaugugcacgcuuauagccauggaccugggcgagcucugcgaggacaccaugacauacaagugcccccggauaaccgaggccgagcccgacgaugucgacugcuggugcaaugccaccgauaccugggugaccuacgggaccugcagccaaacuggcgagcaccggagggaucggagaucgguggcccuggcuccgcacguaggucugggccuugagacgcggaccgagaccuggaugagcucagagggcgcguggagacagauccagcgggucgagaccugggcccugcgccaccccggguucaccgugaucgcauuguuccucgcgcaugcaaucggcaccucuaucacccagaagggaaucaucuucauccuacugaugcucgugaccccuuccauggcgaugcggugcgucggcaucggcaacagagacuucguugaaggacugagcggcgcgacguggguggacgucgugcuggagcacgguuccugcgugaccaccauggccaagaacaaaccaacccucgacaucgagcugcugaagacggaggucaccaacccagcggugcuccggaagcuuugcaucgaggccaagaucagcaacaccaccacugauucgcgcugccccacgcaaggcgaggccacccucguggaagagcaagacgccaacuucgucugucggcgcacauucguagaccggggcugggggaacgguuguggucucuucggcaagggaagccuacucacgugcgcuaaguucaagugcgucaccaaguuagagggcaagauuguccaguacgagaaccugaaguauagcgugaucguuacgguccacaccggcgaccagcaucagguggggaacgaaacgaccgagcacgguaccaucgccaccaucacgccccaggcccccacgagcgagauucagcugaccgacuacggggcccucucccuugauugcagcccccgcaccggccuugacuucaacgagaugguccucuuaaccaugaaagagaaguccuggcugguucacaagcagugguuccuggacuuaccgcugcccuggacaagcggggccagcaccucccaggagaccuggaaccggcaagacuuguuagugaccuucaagacggcccaugcgaagaagcaggaagucgugguguugggcucucaagagggugccaugcacaccgcccucaccggggccacggaaauacagacuuccggcaccaccaccaucuucgccgggcaccugaagugccgccucaagauggacaaacucacgcuuaagggcguuagcuaugugaugugcaccggcagcuucaagcuggaaaaggaaguagcggagacccagcauggcacuguuuugguccaaguuaaguacgaaggaacagaugcccccuguaagauuccgaucagcacacaagacgaaaagggggucacccagaauggccggcucaucaccgccaacccgaucguaacugauaaggaaaagcccguaaacaucgagaucgagccgcccuucggggaauccuauaucgucaucggggccggcgagaaggcccugaaauuaagcugguucaagaagggguccuccauugguaagauguucgaagccaccgccaggggggcccgccggauggccauccucggagacaccgcgugggacuucggcuccaucggcggcguguucaccagcguggguaagcuuguccaccagguuuucggcaccgcuuauggggugcuguucuccggcgucagcuggaccaugaagaucgggaucggaauccuccugaccuggcugggccucaauucacgcagcaccucccuauccaugacguguauugcuguggggaugguuacccuguaccucggcgucauggugcaggcggacuccgggugcgugauaaacuggaaaggccgagagcugaaaugugggagcgguaucuucgucaccaacgaggugcauaccuggacugagcaguauaaguuccaggcugacagcccaaagcgucugucagcggccaucggcaaggccugggaagaggggguaugcggcauccggucggccacccgccuggagaauauaauguggaagcagaucuccaacgagcugaaccacauacugcucgagaaugauaugaaguuuaccgucguugugggggacgccaacggcauccucacccaggggaagaaaaugauccggccccagcccauggagcauaaguacucuuggaaauccuggggcaaggcgaagauuauaggcgccgacacucagaacacaaccuucaucauagacgggcccgacacgccggagugcccggaugaccaaagagccuggaauauuugggaggucgaggacuacggcuucgggguguucacuacgaauaucuggcugaaguugcgggacucguacacccagaugugcgaccaccgccugaugucggccgccaucaaggauucaaaggcugugcacgccgacaugggguauuggaucgaaucggagaaaaaugagaccuggaaguuagcccgggccagcuucaucgaggucaagaccugcaucuggccacgcucccauacgcucuggaguaacggcguguuggaguccgagaugauuaucccgaagauuuacgggggcccgaucagccagcauaacuaucgacccgguuauuucacacaaacagcgggccccuggcaucuagggaagcuggagcuggacuucaaccugugcgaggguacgacgguggucguggaugagcacugcggcaaccgcgggccuucgcuccggacuacgacggucacgggcaaaauuauccacgaguggugcugccgcagcugcacccugccgccgcugcgguucagaggggaggacgggugcugguacgggauggagauccggccugucaaggagaaggaggaaaaccucgugcgcaguaugguaagcgccggcagcggugaggucgacuccuucagccugggguugcucugcguguccaucaugaucgaggaggucaugcggagccgguggucccgcaaaaugcugaugaccggcacucuggccaucuucuuccuccugauaaugggccagcucaccuggaacgaccucauccggcugugcaucauggucggcgccaacgugagcgaccgcauggggaugggcacaaccuaccuggcacucauggcgacguucaagaugcggccgauguucgccgugggacugcuguuccgcaggcucacgucccgggaagucuugcuccucaccauagggcugagccugguggccucuguugaguuacccaacagucuggaggagcucggcgacgggcuagccaugggaaucaugauguugaagcugcucacagacuuccagucccaccagcuguggaccacacugcucagucugaccuucauaaagaccacccugucccucgacuaugccuggaagacgauggcgaugguauugagcaucgugucucuguucccacucuguuugagcaccacgucacagaagaccacgugguuaccuguccuccugggcagcuucggguguaagccccuaaccauguuccucauaaccgagaacaagaucuggggccgaaagagcuggccacugaacgaggggaucauggccgugggcaucgugagcauccugcuuucuagccuguuaaagaacgaugucccccucgcagggccccugaucgccggaggcaugcugaucgcgugcuacgugaucucaggguccagcgccgaccucuccuuggagcgggccgcagaggugagcugggaggaggaggcugaacacuccggugcgagccacaacauacuggucgaggugcaggacgacgggaccaugaagauaaaggacgaggagcgggaugauacccucacgauccuacugaaagccaccuugcucgccguauccggagucuacccgaugagcauuccagccacgcuguucgugugguacuucuggcagaagaaaaagcagcguuccggugugcucugggauacgcccucuccgccggagguagagcgggccgugcuugaugacgguauuuaccggauccuacagcgggggcugcucgggcgcucgcagguuggcgucggaguguuccaggacggcguguuccauaccauguggcaugucacccgcggggcgguguugauguaccaagguaagcgccuggagcccagcugggccuccgugaagaaggaccugaucaguuacggaggggguuggcgguuccaggguagcuggaacaccggcgaggaggugcaggugaucgccguggagccagggaagaaccccaaaaacguacaaaccacuccaggcacauucaaaacgcccgagggcgaggugggggcaaucgcccuggacuucaagcccgggaccagcggguccccgaucgugaaccgcgagggaaagaucgucggccuguacgggaacggcguggugacgacgagcgggaccuacguaagcgccaucgcccaggccaaggccucccaagaaggcccgcuccccgagaucgaggaugagguguuuaagaaacggaaucugacaaucauggaccugcacccggguagcggcaagacgcgucgcuaccucccugccaucgugcgggaagccaucaagagaaagcugcggacgcugauuuuggcccccacccgagucguggccuccgaaauggcagaggcgcugaaagggaugcccauccguuaccagacaacggcugucaagagcgagcacaccgggaaagagaucguagaucugaugugccaugccaccuucacgaugcgccuccugucgccagugagaguaccgaauuacaauaugauuauaauggacgaggcccauuucacggauccugcaagcaucgcugcccggggcuacaucagcaccagggucgggaugggcgaggccgcugccauuuuuaugaccgcuacgccgcccgggagcguggaggcuuucccgcaguccaacgccgugauccaggacgaagagcgcgacauccccgagcggagcuggaacuccggcuacgauuggaucacggacuuccccgggaagaccgucugguucgugcccagcauaaagucgggaaaugacaucgccaacugccuccgcaagaacggcaagcgggugauacagcuaagccguaagaccuucgacacagaguaccagaagacgaagaacaaugacugggauuacgucgugaccaccgacaucuccgagaugggggcaaacuuccgggcggaccgcgugaucgacccacggcgcugucugaagcccgucauccugaaagacggccccgagcgggugauacucgccgggcccaugccggucacugccgccagcgccgcccagcgccguggccggauuggacggaaccagaacaaagaaggggaucaguacaucuacaugggucagccccugaacaacgacgaggaccacgcucacuggacggaggccaaaaugcugcuggacaauaucaacaccccagaggggauaauuccugcucuguucgagccggagagagagaagagugcggccaucgauggagaguaccgcuuacgcggggaggcacgcaagaccuucguggagcucaugcggcgcggcgaccugcccgucuggcucagcuauaaagucgcuuccgagggcuuccaauauucggaccgucgcuggugcuucgacggggagcggaacaaccaaguccucgaggagaacauggacguggagaucuggaccaaggagggcgaacgcaaaaaguuacgccccagauggcuggacgcccggaccuacagcgauccacucgcguugcgcgaguucaaggaauucgccgccgggcggcgcucgguuagcggcgaccugauccuagagaucggaaagcugccacagcacuugacccuucgggcgcaaaacgcccuggacaaccugguaaugcuccacaacuccgagcaagggggcaaggcguaucgucacgccauggaggagcuacccgacacaauagagacuuugaugcuccuggcccugaucgccgugcucacugggggcgucacgcuguuuuuucuauccgggaagggccucggcaagacuagcaucggccuguugugcgugauggcgucuuccgugcuccuguggauggccagcgucgaaccucacuggaucgccgccuccaucauccucgaauucuuccucauggugcuacugauccccgagccggaccggcagcgaacaccucaggacaaccagcucgcguacguggucaucggccuauuguucaugauccuaaccguggccgccaacgaaaugggguuguuagaaacgaccaaaaaggaccucgguaucgggcacguggucgccgaaaaccaccaccacgccaccaugcuggauauagaccugcacccggccagcgcguggacacucuacgccguggccacgaccaucaucaccccgaugaugcgccacaccaucgagaacacgaccgccaacaucucccugacugccaucgcuaaccaagccgcgauccugaugggucucgacaagggcuggcccaucagcaagauggacaucgguguccccuugcuggcucuagguugcuacucccaagucaacccccugacccugacggcugcgguccucaugcugguugcccacuacgccaucaucgggccggggcugcaagccaaggcgacccgagaggcccagaagaggaccgccgccgggauaaugaagaaucccacggucgacggcaucguggccaucgaccucgacccagucgucuaugacgcaaaguucgagaagcaguugggccagaucaugcugcucauucuauguacuagccagauccugcucaugcguaccaccugggcccugugcgaguccaucacucuggccacggggccccucaccacccugugggaaggcagcccggggaaguucuggaacaccacgaucgccguguccauggccaacaucuuccgcgguagcuauuuagcgggcgcggggcucgccuucucccugaugaagucccugggcgggggccggcgcgggacgggcgcccaaggcgagacuuugggcgaaaaguggaagcggcaacucaaccagcugagcaaguccgaauucaacaccuacaagcgauccggcauuauggagguggaccgguccgaagccaaggaggggcucaagaggggcgagacgaccaaacaugcggucuccagagggaccgccaagcugcgcugguucguagagaggaaccuggugaagcccgagggcaaggucauagaccuggggugcggccgcggcggguggaguuacuacugcgcgggccucaaaaaggugaccgaggucaagggcuacacgaaaggcggcccggggcacgaggagcccaucccgauggcuaccuacgguuggaacaucgucaaguugcacagcgggagggacguuuucuucacgccgccagagaaaugcgacaccuuacucugcgauaucggugaguccagccccaacccgacgaucgaggaagggcggacgcugcgagugcugaagauggucgagcccuggcuucgcgguaaccaauuuugcaucaagauccugaacccuuacaugcccuccgugguggagacccuggagcagaugcagcggaagcacggagguaugcugguccguaacccgcugagccgcaauuccacccaugagauguacugggucagcugcgggacagggaauaucguguccgcaguaaacaugacuucucgcaugcugcucaaccgcuucacuauggcccaucggaagcccacuuacgagcgcgacguugaccucggcgccggaacccggcacgucgcagucgagcccgagacugccaaccucgacaucaucgggcagcgcaucgagaacaucaaaaacgaacacaaguccaccuggcacuacgaugaggacaaccccuacaagacuugggcguaccacgguucguacgaggugaagccguccgggagugccuccagcauggugaacgggguugugcggcuccugaccaaacccugggacgucaucccaauggugacgcagaucgccaugaccgacacgacccccuucgggcagcagcgcguauucaaggagaaagucgacacgcggaccccccgccccaagcggggcacagcccagaucauggagguaaccgccaaguggcuauggggcuuucucagccgaaacaagaaaccccggaucugcacacgcgaggaguucacgcggaagguacgcucaaacgccgccauaggugccguuuucguagacgaaaaccaguggaacagugccaaggaagccguggaagacgagcgauucugggaucuuguccacagagagcgggagcugcacaagcaggggaagugugcgaccugcguguacaauaugaugggaaagcgcgagaagaagcugggcgaguuugggaaggccaaagguucccgggccaucugguauauguggcugggggcccguuucuuggaguucgaggcgcucggauucaugaacgaggaccacugguucagccgcgagaacucgcugagcgguguggagggugagggccugcacaaacucggguacauacugcgggacauauccaaaaucccagggggcaauauguaugccgacgacaccgccgguugggacacgcgcaucaccgaggaugaccuccaaaacgaggccaaaaucaccgacaucauggagcccgagcacgcacuccuggccaccaguauauucaaacugacguaucagaacaagguggugcgggugcagcgcccagcuaaguccggcaccgucauggacgugaucagccggcgcgaucagcgggguucaggccaggugggcaccuaugggcucaacaccuucaccaacauggaaguccagcugauaaggcaaauggaaagcgaggggaucuuuucccccagcgaacuggaaaacucuaaucucgcggaacgggugcucgacuggcuggagaagcacgggguggagcgccucaaaagaauggccauaagcggugacgacugcgucgugaagccuaccgacgaccgcuucgccaccgcguugacagcccugaacgacauggggaaggugcggaaagacaucccccagugggagccuuccaagggcuggaacgacuggcagcagguccccuuuugcagucaucauuuccaccagcucaucaugaaggacggucgcgagauuguggugccgugucggaaccaggacgagcucguaggccgcgcccgcgugagccagggcgcaggguggucccugcgcgagacugcgugccucggaaagagcuaugcgcagauguggcagcugauguacuuccaccgccgugacuugagacucgccgccaacgccaucugcuccgccgugccagucaauugggugcccaccagccggaccaccuggucuauccacgcacaccaccaguggaugaccacugaggauaugcucagcguguggaaccgcguuuggaucgaggagaaccccuggauggaggacaagacucacgugucaagcugggaggaugugccguaccuggguaagcgugaggaccaguggugcggcucguuaaucggccugaccgcccgcgcgaccugggccacgaauauccaggucgcuaucaaccaaguucgacgucugauagggaacgagaacuaucucgacuacaugaccagcaugaagagguuuaagaacgaaucugacccggagggcgcccugugguaa

SEQ ID NO: 24741 - RNA, 9879 nt, Artificial Sequence
  derived and/or modified CDS sequence (opt11) from DENV-1__KM403616__SS-prME
agcguuacuaugcuacucaugcugcugcccaccgcccucgccuuccaccuuacuacccgaggaggggagccccacaugaucgugagcaagcaggagcguggcaagucucuccuuuucaagaccucugccggggugaacaugugcacccucaucgccauggaccugggcgagcucugcgaggauacgaugaccuacaagugcccucggaucaccgaggccgagcccgacgacguagacuguuggugcaaugccaccgacaccugggugaccuacggcacuugcucacagaccggcgagcaccggcgcgacaagcggagugucgcccucgcuccucacgugggccugggacucgagacccgcacugagaccuggaugagcuccgaaggggccuggcggcagauccagaaggucgagacgugggcacuucgccacccuggguucacggugaucgcccuguuucucgcccacgccaucggaaccagcaucacccagaaggggaucauuuucauacugcugaugcucgugacccccuccauggcuaugcgcugcgugggcaucggcaaccgcgacuucguggaggggcugagcggcgccacgugggucgacgucgugcuagagcacggguccugcgugaccaccauggccaagaacaagcccacucucgacauugagcugcugaagacugagguaacgaaccccgcgguucuccgcaagcugugcaucgaggcuaaaauaagcaauaccaccacggacucccgcugccccacccagggggaggcuacccugguugaggagcaggacgccaacuucgucugccggcgaacuuucguggaccggggcugggggaacggcugcggucucuuugguaaagggagccugcugacgugcgcgaaguucaagugcgugaccaaguuagaagggaagaucguccaauacgagaacuuaaaguauuccgugguggucaccgugcacaccggugaucagcaccaagucgggaaugagacgaccgagcacggcaccauagcuaccaucacgccccaggcccccacgucagagauucaacugaccgauuacggggcccucacccuggacugcucgccacggaccggccuggacuucaacgagauggugcuccugacgaugaaggagaaguccuggcugguucacaagcaaugguucuuagaccucccgcugccguggaccuccggagccucaaccagccaggaaaccuggaaucgccaggaccuccuggucacguucaagaccgcccacgcgaagaagcaagagguggugguacucggcucccaggagggcgccaugcauaccgcccuuaccggggcgacggagauccagaccucuggcacaaccacuaucuucgccggacaccugaaaugccgccugaagauggacaaacucacucugaaaggcgucuccuaugugaugugcaccggcagcuuuaaauuggagaaggaagucgcggagacacagcauggcacggugcuggugcaggucaaauacgaaggcaccgacgcccccugcaagaucccgauuuccacgcaggacgaaaagggcgugacccagaacggccggcucauuacggcuaacccgauagugacagacaaggagaagccggucaacaucgaaaccgagccacccuuuggggagagcuacauugugaucggggcuggcgagaaggcgcucaaauuauccugguucaagaaagguucgucaaucggaaagauguucgaagccaccgcccgcggggcacggcgcauggccaucuuaggcgacacggcgugggacuucggcagcaucggcgguguauucacuagcgucgguaagcuggugcaccagguuuuuggcaccgccuauggggucuuguuuagcggcguguccuggaccaugaaaaucgggaucgggauccuccugaccuggcucggccucaacagcaggaguaccucacuguccaugaccugcaucgcuguggggauggucacuuuguaccucggcgugauggugcaggcagauucggguugcguaauuaauuggaagggccgggaguuaaaaugcggcuccggcaucuuugugacaaacgaagugcacacauggaccgagcaguacaaguuccaggccgacaguccgaagcgccugagcgcggccaucggcaaggccugggaagaaggggucugcgggauaagguccgccacccgccucgagaacaucauguggaagcagaucagcaaugaacugaaucacauccugcucgagaacgacaugaaguucaccgugguggucggggaugccaacggcauccugacacaggggaagaaaaugauccggccacagcccauggaacacaaguacuccuggaaguccuggggcaaggcuaaaaucaucggggccgacacccagaacaccaccuucaucaucgacgggcccgacacgcccgagugcccggacgaccagcgagccuggaacauaugggagguggaggacuacggcuuugggguguucaccaccaauauuuggcuuaagcucagggacuccuacacacagaugugcgaccaucgcuugaugagcgccgcgaucaaggacuccaaagccguccacgccgauauggguuacuggaucgaaagcgaaaagaacgagacguggaagcuggcccgagcuuccuucaucgaggugaagaccugcaucuggccccgcagccacacccucugguccaacggcgugcuggaguccgagaugaucauccccaagaucuaugggggcccaauaucgcaacacaacuaccggccaggguauuucacccagacagcgggccccuggcaccuggggaagcucgagcuggacuucaaccugugcgagggcaccacuguagugguggacgagcacugcggcaaccgcgguccgagccuucggaccacgaccgucacuggcaagauuauccacgaauggugcugccgcuccuguacccugccgccguugcgguuucgaggggaagacggcugcugguacgggauggagauacggccugugaaggagaaggaggagaaccucgugagguccauggucuccgcgggcagcggugaaguggacagcuucagccuggggcuacugugugugagcaucaugaucgaagaggucaugcgcucccgcuggagccggaagaugcucaugacgggcacacuggccgccuucuuucucuuaauaauggggcagcugacguggaaugaccucaucaggcugugcaucauggugggcgccaacguguccgaccgcaugggaauggguacgacguaccuggcacucauggccaccuucaagaugcggccaauguucgccgucggccuacuguuucgccggcucacaagccgcgaggugcugcugcucaccaucgggcugagcuuaguagcgucgguggagcucccaaacucccuggaagaacucggagacgggcucgccaugggcaucaugaugcugaaacugcucacugauuuucaaagccaucagcuuuggacaacccuguugucccugaccuucaucaaaacgacgcucagccuggacuacgcguggaagaccauggccauggugcuguccaucgucagccuauucccccucugccuuucuacgacgagccagaagaccaccugguuacccguguugcugggcuccuucgggugcaagccgcugaccauguuccucaucaccgagaacaagauuuggggcagaaagagcuggcccuugaaugagggaaucauggccgugggaaucgucuccauucugcugucgagccugcuuaagaacgacgugccccucgccgggccccucaucgccggcggcaugcugaucgccugcuacgugaucagcggaagcuccgcggaccucucgcuggaacgcgccgcugaggucucaugggaggaggaggccgagcacagcggugccucgcacaauauauugguagaggugcaggacgauggcacgaugaaaauuaaggacgaggagcgggacgacacccucacaauccugcugaaggccacccugcucgccgucagcggcguguauccgauguccauccccgccacccuauucgugugguacuucuggcagaagaagaagcagcgcagcgggguucucugggacacccccuccccgccagagguggagcgggcagugcuggacgacggcauauaccgcauccugcagcggggccugcucgggcgcagccaggucggggugggaguguuucaggacggcgucuuccauaccauguggcacgugacccgcggggccgugcugauguaccagggcaagcggcuggagccuucuugggccagcgucaagaaggaucucauauccuacggcggaggcuggcgguuccaggggagcuggaacacaggcgaagaaguccagguaaucgcgguggagcccgggaagaaccccaaaaaugugcagaccacccccggcaccuucaagacgcccgagggcgaggugggcgccauugcgcuggacuuuaaaccagggaccagcgguagccccaucgucaaccgcgaggggaagaucgugggccuguacgggaacggcguugucaccacauccggcacuuaugugagcgccaucgcccaggccaaggccagccaggagggcccgcucccagagaucgaggaugaaguguucaagaagcggaaccucacgauaauggacuuacacccgggguccgguaagacccgcagguacuuaccagcgauuguucgcgaggccaucaagcggaagcugaggaccuuaauccucgcgcccacgcgcguaguggcaagcgagauggcggaggcgcugaagggcaugcccaucagguaccaaaccaccgcaguaaaguccgagcacaccggcaaggagaucguggaccugaugugccacgcaaccuucacuaugcgccuacugagccccgugagaguaccgaauuacaacaugauaaucauggacgaagcccacuucaccgacccagcguccaucgccgcccgcggcuacaucaguacgagagugggaaugggugaggccgccgcgaucuucaugacggccacuccgcccgggagcguggaagccuucccacagucaaacgcugucauccaagaugaggagcgcgauauccccgaacgguccuggaacagcggcuaugacuggaucaccgacuuccccgguaagacggugugguuuguaccuuccaucaagucuggcaaugacaucgccaacugccugcgcaaaaacggcaagcggguuauccaacucagccgcaaaaccuucgacaccgaguaucagaagaccaagaacaacgacugggauuacguagugaccacggacauuagcgagaugggugcgaacuuccgggccgaccgcgucauagacccgcggcgcugccugaaacccgugauucugaaggauggacccgaacgggucauccuugccggacccaugccggucaccgcagcguccgcugcccagcgccggggccgcaucggucgcaaucagaacaaggagggugaccaguacaucuacaugggccagccccugaacaaugaugaggaccaugcccacuggaccgaggccaagaugcugcucgacaacaucaacacccccgaagggaucauucccgcccuguucgaaccggagcgggagaaguccgcagcgaucgacggcgaguaccgucugcgcggggaggcccgcaagaccuuuguggagcucaugcggcgcggcgaccugcccgucuggcuauccuacaagguggccagcgagggcuuucaguacucugaccggcgcugguguuucgacggggagcggaacaaccaggugcucgaagagaacauggacguugagaucuggaccaaagagggcgagcgcaagaaacuuaggccucgcuggcuagacgcgcggaccuacagcgacccgcucgcccugcgcgaguucaaagaguuugccgccgggaggcgcagcguguccggcgaccugauccucgagauuggcaagcugccgcagcaucugaccuuaagagcgcagaacgcgcuggauaaucuugucaugcuccacaauagcgagcagggcgggaaggccuaucgucacgccauggaggagcugccggacaccaucgagacgcugaugcuccuggcccugaucgcgguacucaccgggggcgugacacuauucuuccugaguggcaagggcuuaggcaagaccagcaucgggcugcugugcgucauggccucgagcguccuucuguggauggccucaguagagccccacuggaucgcggcgagcaucaucuuagaguucuuccucauggugcugcugauccccgagccggaccggcagcgcacgccccaggacaaccagcuggcauacguagugaucggucugcuguucaugauucucaccguagccgccaacgagauggggcugcuagagacgaccaagaaggaccucggcaucggccacgucguggccgagaaccaccaccacgcuacaaugcuagacauugaccuccacccggcguccgcauggacucucuacgccguggccacaacuaucaucacgccgaugaugcggcacacaaucgagaacaccaccgccaacauaagccuuacggcgaucgccaaucaggccgcuauccucaugggccucgacaagggcuggcccaucuccaagauggacaucgguguuccccuucuggcccuuggcugcuauagucaaguaaacccccugacccugacagcagccgugcucaugcuggucgcucauuacgccaucaucggucccggccugcaggccaaggccacccgcgaggcgcagaaacgaacugccgccgggaucaugaagaaccccaccguggacggcaucguggcgaucgaucuagauccuguggucuacgacgccaaguuugagaagcaguuaggccagauaaugcugcuaauccuguguacgucccagauacuauugaugcggaccacgugggcacuaugugaaucgaucacacuggcgaccggcccccugaccacucugugggagggguccccggggaaauucuggaacaccaccaucgccguguccauggcgaacaucuuccgcgguuccuaccuggcgggugcggggcucgccuucagucuaaugaaaucgcugggcgggggccggcgcgggaccggcgcacagggcgagacgcugggcgaaaaguggaagcggcaacugaaccaguugagcaaaagcgaguucaauaccuacaagcgcuccggcaucauggaggucgaccggagcgaggcaaaggagggucucaagcgaggcgaaaccacgaaacacgccgugucccgggggacugccaagcugcggugguucguggagcggaaccuggucaaacccgagggcaagguaaucgaccugggcugcgggcguggcgguuggagcuacuauugcgccggucugaagaaaguuaccgaggucaagggguacacaaagggcggccccgggcaugaggagcccauuccgauggcaacuuacggcuggaacauagucaagcugcauucugguagggacguguucuucacuccgccggagaagugcgacacgcugcucugugacaucggugaaucaucccccaacccgacuauagaggaagggcgcacccugcgaguccugaagaugguggagcccuggcugcgcggcaaccaguucugcauaaagauccugaaccccuauaugccuagcguggucgagacucuggaacagaugcagcggaagcacggcggcaugcucgugcgcaacccacugucccgcaacagcacgcaugaaauguacugggugucuugcggcaccgggaacaucgucagcgccgugaacaugacuagccgcaugcugcuuaaccgcuucaccauggcccaccggaagccgacguacgagcgggacguugaccugggcgcaggcacccggcacgucgccguggagcccgaaaucgcgaaccuggacaucaucgggcagcgcauagagaacaucaagaacgagcacaagagcacauggcacuaugacgaggacaaccccuacaaaaccugggcguaccacggcuccuacgagguaaagcccagcggguccgccagcuccauggucaacggcgugguccggcuccugaccaagcccugggacgugaucccgaugguuacccaaauugcaaugaccgacacgacgccuuucggacaacagcgcguguucaaggagaagguggacacccggaccccgcgccccaaacggggcaccgcccagaucauggagguaacagccaaguggcuguggggcuuccucucccgcaacaagaagccccgaaucugcacgcgcgaggaguucacccggaagguccgcagcaacgccgccaucggagccguguucguggacgagaaccaguggaacagcgccaaggaggcugucgaggacgagcgguucugggaccugguucaccgugaacgggagcuucauaagcaaggcaagugugcaaccugcguguacaacaugauggguaagcgcgagaagaagcucggcgaguucgggaaggcgaagggcagccgggccaucugguauaugugguuaggcgcucgcuuccuugaguucgaggcccuaggguucaugaacgaggaccacugguucucccgggagaacucucugucaggugucgaaggggagggccugcauaagcucggguauauacugcgcgacaucagcaagaucccgggcggcaacauguacgccgacgacaccgccgggugggauacccgcaucaccgaggacgaucugcagaaugaagccaagaucaccgauaucauggagcccgagcaugcguugcuggccacguccaucuucaagcugaccuaccagaacaaaguggugcggguccagcgcccggccaaaagcggcacgguaauggacguaaucucccggcgagaucagcgggggucgggccaggucggcacauacgggcucaacacguucaccaacauggagguucagcuuauucggcagauggaguccgagggcaucuucagcccuuccgaacuugagaauagcaaucucgcagagcgggugcuggacuggcuggagaagcacggggucgagcggcucaagaggauggcuauuuccggagaugacugcgugguaaaaccaaccgacgaucgcuucgcgaccgcccucacggcccuaaacgacauggguaagguccggaaggacaucccccaaugggaaccaagcaaaggcuggaaugacuggcagcagguccccuucugcucacaccacuuccaccagcucaucaugaaggacggccgcgagauugugguccccugccggaaccaggacgagcugguagggagagcgcgcgugagccaaggcgccggguggucucuccgcgagaccgccugccucggcaaguccuacgcccagauguggcagcugauguacuuccaccggcgcgacuugcggcucgccgccaacgccaucugcagcgcgguacccgugaauuggguucccaccucccgcaccaccuggagcauccaugcccaccaccaguggaugaccacggaggacaugcugucggucuggaaucgcguguggauugaagagaaccccuggauggaggacaagacccaugugagcucgugggaagacgucccguaccuggggaagcgggaggaccagugguguggcagccuuaucggacucaccgcccgcgccacgugggcgaccaacauacaaguggcuaucaaucaggugcggcgccugaucgggaacgagaacuacuuagacuacaugacguccaugaaaagauucaagaacgaaucggaccccgagggcgcccugugguga

SEQ ID NO: 24742 - RNA, 9879 nt, Artificial Sequence
  derived and/or modified CDS sequence (opt11) from DENV-1__KM403617__SS-prME
agcgugaccaugcuucucaugcugcugccaacggcgcucgcauuucacuuaacuacccggggcggggagccucacaugaucgugaguaagcaggagagagguaagagcuugcuguuuaaaacauccgccggcguaaacaugugcacccugauugccauggaccugggggagcuaugcgaggacacgaugaccuacaagugcccgcgcauuaccgaggcggagccagaugacguggacuguuggugcaaugcaaccgauaccuggguuacauauggcacuugcucgcagaccggcgagcacagaagagauaagagguccguggcccuggcgccgcaugugggucuaggccuugagacucgcacugagacguggaugucuuccgagggagccuggcggcagauacaaaaggucgagacgugggcucuuagacaucccggguuuacagugauagcgcuguuucucgcccacgcaaucggcaccagcauuacccagaagggcauaaucuucauacugcugaugcucgugacccccucuauggcuaugcggugcgucggcaucggcaauagggacuucgucgaggggcugucuggugccacuugggucgacguggugcuggaacauggcagcuguguaaccaccauggcuaagaacaaacccacccucgauauugagcugcugaagacggaagucacaaauccagcgguacuucggaagcugugcaucgaggcuaagaucagcaacaccacaacggacucccgcugccccacccaaggugaggcaaccuugguggaggagcaagacgccaauuucguaugccggcgaacguuuguugaccggggguggggaaacggcugcggccucuuuggcaaggggaguuuacugacaugcgccaaguuuaagugcgugaccaaguuagaaggaaagaucguccaauacgagaaucuaaaguacucugugguggucacggugcauaccggcgaccagcaccaagucggcaacgagacgacggaacacggcacaaucgcgacaaucacgccccaggcaccuacgagcgagauccagcuaacagacuauggagcccucaccuuggacugcagcccgcggaccggacuagacuucaacgagaugguguuacugacgaugaaagagaaaagcugguugguacauaagcaaugguuucucgaccugccgcugcccuggacauccggggccaguacuagccaggagaccuggaacaggcaggaccuccucgucacguucaaaaccgcacacgccaagaaacaggaaguggugguucuggguucacaggagggcgccaugcacacagcacucaccggggccaccgagauucaaacuucaggcaccaccacgaucuucgccgggcauuugaagugccgcuuaaagauggauaagcucacgcugaagggcguuucuuaugugaugugcaccgggagcuucaagcuggagaaagaggucgcugagacgcaacacggcacggugcugguacaaguuaaguaugaaggaaccgacgcccccugcaagaucccaaucuccacccaggacgagaagggggugacccagaacggucggcucaucacagccaacccgauugugaccgacaaggaaaagcccgugaacauugaaaccgagccgcccuucggugagagcuauaucgucaucggcgccggcgaaaaagcgcugaaacugaguugguucaagaaggggucgucgauagggaagauguucgaagcgacggcccggggagcgcguagaauggcuauucuaggcgacacugcuugggauuucggauccaucggcggugucuucacauccguugggaaacugguacaccagguguuuggcaccgccuacgguguccuguucuccggcgugucguggacuaugaagaucgggauuggcauacuccugaccugguuagggcucaacucccgauccaccagccuguccaugacaugcaucgccguaggcaugguuacucuguaccugggaguaauggugcaggccgacagugggugcgucauaaauuggaagggccgggagcugaaaugcggguccggcaucuuugugaccaacgaaguucacacuuggaccgagcaauauaaguuccaggccgauagccccaaaagguuaagcgcggccauuggaaaggccugggaggagggcguuuguggaauccggucugccacccgcuuagagaacaucauguggaagcagaucagcaacgagcugaaccauauauugcucgaaaaugauaugaaguuuacggugguggucggagacgccaaugggauucugacccaggguaaaaagaugauccggccccagcccauggagcacaaguacuccuggaagucuuggggcaaagcgaaaaucauuggcgccgacacccagaacaccacguucauaaucgaugguccugacacgccggagugcccugacgaccagcgcgccuggaacaucugggagguggaagacuauggcuuugggguguucaccaccaauaucuggcugaaacucagagauucguacacccagaugugugaucacaggcugaugagcgcggcgaucaaggacuccaaagccguccacgccgacaugggcuauuggauagaaagcgagaagaacgaaacauggaaacuggcgcgggcuagcuucaucgagguuaagaccugcauauggccccgcucacauacccucuggucgaauggcguacucgaauccgaaaugaucauacccaagauauaugguggcccaaucagccagcacaacuauagaccagguuacuucacccagacggcgggccccuggcacuuggggaagcucgagcuggacuuuaauuuaugugagggcacaacugucguggucgacgaacacugcggaaaccgcggucccagcuugagaaccaccaccguaaccgguaagaucauacacgagugguguugccgcuccugcacccugccgccgcugcgauucagaggggaagacgguugcugguacgggauggagauucggccugugaaggagaaagaagaaaaccucguaaggagcaugguguccgccggaagcggggagguggauagcuucucccugggguuacucugugucaguauaaugauagaagaagugaugagaucucgcuggagccggaagaugcugaugacuggaacccuggccgucuucuuccuauuaauaaugggccagcugaccuggaaugaccuuauaagacucugcaucaugguaggcgcuaacgucuccgaucgcauggggaugggcaccacuuaccuggccuugauggccaccuuuaaaaugcggcccauguuugcugucgggcugcuguuccgccgacucaccucgcgcgagguacuacuccucacgaucggguuaagccuggucgcuucgguggagcuucccaacucgcuagaggagcugggcgacggccuugcuauggggaucaugauguuaaagcuacuaacggauuuccagagucaucaguuguggaccacgcuacucucauugaccuucaucaagacgacccugucucucgacuaugccuggaagacuauggcaaugguacuguccaucgugagccuguuuccccucugcuuaaguaccacgagccagaagaccacguggcucccaguacuccugggcuccuucgggugcaagccgcugacuauguuucugaucacugagaacaaaaucuggggccgcaagaguuggccccugaacgaagggaucauggcugucggaaucgugucuauccugcugaguagccuguugaagaacgacgucccccucgcuggcccccugaucgccggcggcaugcugaucgcgugcuacgucauuucagggagcuccgccgaucuaaguuuagagcgggccgcagaggucucuugggaggaagaggccgagcacucaggugcgucccacaauauccucguugaaguccaggaugacgggacgaugaaaaucaaggacgaggaaagggacgacacucugaccauacugcugaaggcgacccuccuggccgucucaggcguguacccaauguccauccccgccacgcuguucguaugguacuucuggcagaagaagaagcagcgaucgggcguacucugggauaccccgagcccucccgaggucgagcgggccguguuggaugacggcauuuaccgcauauuacagagaggccuucucgggcgcagccaaguaggcgugggcgucuuccaggacgguguguuccauaccauguggcacguuacccguggcgcaguccugauguaccaggggaagcgccuggagccuuccugggccagcguuaaaaaggaccucaucucuuacggagggggcuggcgguuccaaggguccuggaauacaggggaggaggugcaggucauugccguggaacccgggaagaaccccaagaaugugcagacgaccccagggaccuucaaaacccccgagggagaggucggggccaucgccuuggacuucaagcccggaaccucggggucuccuaucgugaacagagagggcaagaucgugggacuguacggaaacggugucguuaccaccuccgggacauaugugucugcgaucgcccaggccaaagcaagccaagaaggcccgcucccugagaucgaggacgaggucuuuaagaagcgcaaucugaccaucauggaccuucaucccggcucgggcaagacccgcagguauuuaccugcaauagugagagaggcuauuaaacgcaaacugcggacccugauccuggccccaacucggguggucgccucggagauggcggaggcguuaaaggggaugcccaucagguaucaaacuacggccgugaagucugagcauacagggaaggagaucguggaccugaugugccacgccacguuuaccaugagacuucugagcccaguccgagugccgaauuacaacaugaucaucauggacgaggcccacuuuaccgaccccgccucuaucgcggcacgagguuacauaucgaccagggugggaaugggugaggccgcggccaucuucaugacggcgaccccgcccggcucugucgaggcuuucccccaaagcaacgccgugauccaggacgaggagcgggacauaccagagcgauccuggaacagcggguacgacuggaucacagacuuucccggcaaaaccguaugguucguaccgucgauaaagagcgggaacgacauugccaauugccugcgcaagaacggcaaacgggugauccagcuaucccgcaaaaccuucgacacugaguaccaaaagaccaaaaacaacgacugggacuauguggucacuacagacaucagcgagaugggggcgaacuuuagagcggaccgaguuauagacccgcggcgcugccuaaagccugucauccucaaggacggaccagagcggguaauauuggccgggcccaugccugugaccgcggccuccgcggcccagagacggggccggaucggccgcaaccagaauaaagagggagaucaauacauauacauggggcagccccugaacaaugacgaggaccaugcccacuggacggaggcgaagaugcuacucgauaauauaaauacaccugaggguaucauucccgcccuguucgaaccggagcgggagaaaagcgcggcuaucgacggggaguaucgcuugcgcggggaagcccgcaaaacguuugucgaacucaugcggcguggggaccugccugucuggcuguccuacaagguggcuuccgagggcuuccaguacuccgaccggcgcuggugcuucgacggcgaacgaaacaaccagguccuugaagaaaauauggacguggaaauuuggaccaaggagggcgaacgcaagaagcuacgcccucgcuggcuggacgcacggacauacucggacccccucgcucugcgagaguucaaagaguucgcggcugggcggcgcaguguguccggcgaucugauacucgagaucggcaagcuaccgcaacaccucacccucagggcccagaacgcacuggacaaccuugucaugcuccauaacagcgaacaaggcgggaaggccuaccgccaugccauggaagaacugcccgauacuaucgagacgcugaugcuucuagcccugauagccgugcucaccggaggggugacccuguucuuccuguccgguaaaggacucggcaaaaccucuaucgggcugcugugcgucauggcguccagcgugcuccuguggauggcuucugucgagccacacuggauugcggccagcauuauccuggaguucuuucucaugguccuccugauuccagagccagaccggcagaggacgccgcaagacaaccaguuggccuacgugguaaucgggcuucuauucaugauucuaacgguagccgccaacgagaugggguugcuggagaccaccaagaaagacuugggaauuggccacguggucgccgagaaccaccaccacgccacgaugcuggacaucgacuugcaccccgcuuccgcguggaccuuauaugcuguagcuaccaccaucaucacgccgaugaugcggcacaccaucgagaacacuaccgccaacaucucccugaccgcuauagcgaaccaagccgccauauugaugggccucgacaaggguuggcccauaagcaagauggacauaggagugccccugcuagcccucggcugcuacagucagguuaacccguuaacccugaccgccgcggucuuaaugcugguugcacacuaugccaucaucgggcccgggcugcaagccaaggcgacccgggaagcccagaagcgcacugccgcggggaucaugaagaaucccacuguggaugguaucguggccauugaucuggacccaguggucuacgaugcaaaauuugaaaaacaacugggccagauaaugcuucugauucugugcaccagccagauccuguugaugaggacuacaugggcccugugugagagcaucacuuuagccaccggcccgcucacuacgcugugggagggcucaccgggaaaguucuggaacacaaccauagcuguguccauggccaacaucuuccgcggcuccuaccuggccggcgcuggacuugccuucagcuuaaugaaaagucugggagggggccggagagggacgggggcccagggcgagacgcugggagagaaauggaagaggcagcuuaaucaguuaagcaagagcgaguucaacacauacaaacgguccggcaucauggaaguugaccggagugaggccaaggaggggcugaagcgcggcgaaaccacuaagcaugcugucagucgugggacggccaagcugcgcugguuuguugagcgaaaucuggucaaacccgaggggaaagugauagacuugggcugcgggcggggcgguuggagcuauuacugugccggauuaaagaaggugaccgagguuaagggauacaccaaaggcggccccgggcacgaggagccgauaccgauggccaccuacggguggaacaucgucaagcugcacuccgggagggacguuuucuucacgccacccgagaagugugacacgcugcucugugacaucggagagaguucccccaacccgacuaucgaggaggggcgcacauugcggguacugaagaugguggagcccuggcuucgcggcaaccaauucugcaucaagauccuuaauccauacaugccuagugucgucgagacccucgagcagaugcaacggaagcacggcgggaugcucgugagaaacccgcugucccggaacucaacgcacgagauguauugggucuccuguggcaccgggaacaucgugagcgcgguaaauaugacgagcaggaugcugcugaaucgauucaccauggcccaccgcaagcccacguacgagagggacguggaccugggcgccggcaccaggcacguugccguagagcccgagauagccaaccucgacaucauuggucagcgcaucgaaaacaucaagaacgagcacaagucgaccuggcacuacgacgaggacaaccccuauaaaaccugggcguaccauggcuccuacgaggucaagcccucaggauccgccagcagcauggucaacgguguggugcgacuccugaccaagcccugggauguaauccccaugguaacacagauugcaaugaccgauaccacaccguucgggcagcagcgcguguucaaggagaagguggacacccggacaccacgccccaaacgggguaccgcacaaaucauggaagucacggcaaaaugguuaugggguuuccucagccgcaauaagaaaccccggauuugcacccgagaggaguuuacccggaagguacguaguaaugccgccauuggcgccguguucgucgacgagaaccaguggaacagcgccaaggaggcagucgaggaugagcgguucugggaccuagugcauagggagcgggaacugcacaagcagggaaagugugcgaccugcgucuacaauaugaugggcaagcgcgaaaagaagcucggagaguucgggaaggcuaagggcagccgcgccaucugguacauguggcugggcgcgcgcuuuuuggaguuugaggcucucggguucaugaacgaagaccauugguucucacgggaaaacagccugucggguguugagggggaaggacuucacaaacucggguacauccucagggacaucagcaagauuccgggcggcaacauguaugccgaugauacugccgguugggauacccggaucacugaggacgaucugcagaacgaggccaaaaucaccgacauaauggagcccgaacacgccuugcuggcgacauccauauucaaacugacauaccagaacaaggugguccgggugcagcgccccgcuaagagcggcaccgucauggacgucaucuccaggcgcgaucagcgggguagcggccaagugggcacauacggauuaaacacguucaccaacauggaagugcaacugauaagacagauggaguccgaaggcauuuucucgcccuccgagcuagagaauagcaaccucgccgagcgggucuuggauuggcucgagaagcacggcguggagagguuaaagcggauggccaucuccggcgacgacugcgugguaaagccaacggacgaccgcuucgccaccgcgcuaacggcccugaaugacauggggaaagugagaaaggacaucccccaaugggagcccagcaagggcuggaaugacuggcagcaggucccguuuugcucccaucacuuucaccagcuuaucaugaaagacggcagagagaucgucgugccguguagaaaccaggacgagcugguggguagggcccgggucagucagggcgcuggguggagccuccgagagaccgcaugccucggcaaaagcuaugcucaaauguggcagcugauguacuuccaucgccgggaccugcggcucgcugccaacgccauuugcagcgccgugcccguaaacugggugccgaccuccagaacaaccuggucaauacacgcucaccaucaguggaugacuaccgaggacaugcuguccguguggaaccgcguguggauugaagagaauccauggauggaggacaagacucauguaagcagcugggaggacgugccguaccuagggaagcgggaagaccaguggugcgguagccucauuggccugaccgcgagagccaccugggccaccaauauccagguggcuaucaaucaggugcgacgccugaucggcaacgagaacuaucucgacuacaugaccuccaugaagcgguucaagaacgagucggaucccgagggggcccugugguaa

SEQ ID NO: 24743 - RNA, 9879 nt, Artificial Sequence
  derived and/or modified CDS sequence (opt11) from DENV-1__KM403635__SS-prME
ucagucacaaugcugcucaugcugcuacccacggcccucgccuuccaccugaccacccguggcggggagccccacaugaucguaagcaagcaggagcggggcaagaguuuauuauucaagaccucugcuggggugaacaugugcacccugaucgccauggaccugggcgaacucugcgaggacacgaugaccuacaagugccccaggauaaccgaggccgaaccggacgacguggacuguuggugcaacgcuacagacaccugggugacguacgggaccuguagccagaccggcgagcaccggcgcgacaagagguccguggcgcuggcgccccauguaggccuggggcucgagacccgcaccgagacauggaugagcuccgagggcgcauggcggcagauccagaaaguggaaaccugggcccugcggcaccccggcuuuacggugaucgcccuguucuuagcucacgcuaucggaaccagcaucacccagaagggaaucaucuucauccuucuaaugcucgucacccccuccauggccaugcggugcgucggaaucggcaaccgggacuucguggaaggucugagcggcgccacguggguggacgucguucuggagcacggguccugugugaccaccauggccaagaacaaacccacccucgacaucgaacuguugaagaccgaagucaccaaccccgcgguguugcgaaagcugugcauugaggccaagaucagcaacaccaccacggauucgcgcugcccgacccaaggcgaggccacccugguggaggagcaggaugccaacuucguuugcaggcguaccuucguggaccgcggcugggggaacggcugcggccucuuuggcaaggggagccugcugacgugugccaaguucaagugcgugaccaagcuagagggcaagaucguccaguacgagaacuugaaguacucaguuaucgucaccguccacaccggcgaccagcaccagguagggaacgaaacgaccgagcacggcaccaucgcuaccaucacgccccaggcccccacguccgagauccagcugaccgacuacggggccuuaacccuggauugcaguccgcggaccggccuggacuucaacgaaaugguccuacugacuaugaaggagaaguccuggcuggugcacaaacagugguuccucgaccugccguugcccuggaccaguggggccuccgccucgcaggagaccuggaaccggcaggaccuccugguuaccuucaagacggcgcacgccaagaagcaggaggucguggugcuaggcucccaggagggagcgaugcacaccgcgcucaccggcgcgaccgagauccaaacgagcggcacaaccaccaucuucgcgggccaccuuaagugccgccugaagauggacaagcucacgcugaagggcgucuccuacgugaugugcaccgggagcuucaagcuggagaaggagguggccgagacccagcacgguaccguccugguccaagugaaguacgagggcacggacgcccccugcaagauucccaucuccacccaggacgagaagggagucacccagaacggccggcucaucaccgccaacccgaucgucacggacaaggagaagcccgugaauaucgagaccgagccgcccuucggggagagcuauaucgucaucggcgcgggcgagaaggcccugaagcuguccugguucaaaaaggggagcucuaucggcaagauguucgaagccacggcccgcggggcccggcgcauggcgauuuuaggcgacacagccugggauuucggguccaucggaggcguguuuacuuccguggggaaacuuguccaccaaguguucggcaccgccuacggggugcuguucucaggcgucuccuggacuaugaagauugggauagguauccuuuugaccuggcugggccucaacagccgcuccacgagccuuuccaugaccuguaucgccgucgggauggugacucuguaccucggcgucauggugcaagccgacagcgggugcgugaucaacuggaagggccgcgagcugaaauguggguccggcaucuucgucaccaacgaggugcauaccuggaccgagcaguacaaguuccaggcggacagcccgaagcgccugagcgccgccaucggcaaggccugggaagaggggguaugcgguauccgguccgccaccagauuagagaacaucauguggaaacagaucagcaacgaacucaaccauauccugcuugagaacgacaugaaguucaccgucguagugggggacgcgaaugguauccugacccaagggaagaagaugauccggccccagcccauggagcauaaguacuccuggaaguccugggguaaagcgaagaucaucggcgcggacacgcagaacaccaccuucaucauagacgggcccgacacuccggagugcccugacgaccagcgcgccuggaacauuugggaggucgaagacuacggcuucgguguguucacgaccaacaucuggcugaagcuccgggacagcuacacccagaugugcgaucaccgccugaugagcgcggccaucaaggauucuaaagcagugcacgcagacaugggcuacuggaucgagagcgagaagaaugagacuuggaagcuugcucgggcguccuucauugaagucaagacguguauuuggccacgaagccacacccuuugguccaacggggugcuggagagcgagaugauuauucccaagauuuacgggggaccgauaucccaacacaacuacagaccaggguauuucacgcaaaccgcuggccccuggcaccuagggaaguuggaacuggacuucaaccugugcgagggcacgaccguagucguggacgagcacugcggcaaccgcgggccguccuuacggaccaccacuguuaccggcaagaucauccacgaaugguguugccgcuccugcaccuugccgccccugcgguuccgcggggaggauggcugcugguacgguauggagauccgcccggucaaggagaaggaggagaacuuggugcgcucaauggugucugccggcucgggcgaagucgacucauuuucccuggggcuguugugcgugucgaucaugaucgaggaagugaugcggucucgcuggagucgcaaaaugcugaugaccggcacgcuggcagucuucuuucuccuuaucauggggcagcugaccuggaacgaccucauucgacugugcaucaugguaggcgccaacguguccgauaggauggggaugggcacaacuuaccuggcacucauggccacguucaagaugcguccgauguucgccgucggucuacuguuccggcggcucaccagccgcgaagugcuccuuuugaccaucgggcugucccugguggccagcguugagcuccccaacucccuggaggagcugggcgacgggcucgcaaugggcaucaugaugcugaaacugcucaccgacuuccagagccaccagcuguggacgaccuuauugucccugaccuucaucaagaccacgcucagccucgacuacgcguggaagaccauggcgauggugcugucuaucguaagccuguuccccuugugccuguccaccacaagccaaaagacgacuugguugcccgugcuccugggcuccuucgguugcaagccucugaccauguuccucaucaccgagaacaagaucuggggccgcaagagcuggccacugaacgaggggaucauggccgugggcaucgucagcauccugcucagcucuuugcugaagaacgacguaccccucgccgggccccugaucgcgggcggcaugcugaucgccuguuacgugaucuccgggucguccgcggaccucagccuggagcgcgcugccgaagucuccugggaggaggaggcggagcacagcggugcuucacacaauauccugguggagguccaggacgauggcaccaugaaaaucaaggacgaggagcgggaugacacacucaccauccugcugaaggccacccuccuggcgguaagcggaguguauccaauguccauccccgccacccuguuugugugguauuucuggcagaagaagaagcagcgcagcgguguccucugggacacgcccucaccgcccgaaguggagcgggcgguccuggacgacgguaucuaccgcauccugcagcggggccugcucggaagaucccaggucggcgugggcguauuucaggacggcgucuuccacacuauguggcacgugacccgcggggccgugcugauguaccagggcaagcgacucgagcccucgugggccagcgucaagaaggaccugaucuccuacggggggggcuggcgguuccaggguagcuggaacaccggcgaagagguccagguaaucgccguugagcccgggaagaaccccaagaacguacagacgacucccggcaccuucaagacccccgagggcgaggucggcgccaucgcccuggacuuuaagcccggcacgagcgguagccccauagucaaucgcgagggcaagaucgugggccuguacgggaacggcguagucaccaccuccgggaccuaugugagcgccaucgcacaggcaaaggcuagccaggagggcccacucccagagauugaggacgaaguguucaaaaagcguaaucugacuaucauggaucugcaccccgggucaggcaagacccgccgguaccuuccggcgaucguccgggaggccaucaaacgcaagcugaggacacugauccuagcccccacccgcgugguagccagcgaaauggcagaggcccugaagggcaugcccauccgguaucagacgaccgccgugaagagugaacacaccgggaaagagauaguggaccugaugugccacgccacauuuacgaugcgucuccugagucccgugcggguccccaacuacaacaugaucaucauggacgaagcgcacuucaccgaucccgcguccaucgccgcccgcggcuauaucagcacacggguggggaugggcgaggccgccgcgaucuuuaugaccgccaccccgcccgguucgguggaggccuucccucaaagcaacgccguaauccaggacgaagagcgcgacauccccgagcggaguuggaacaguggcuaugacuggaucacggacuuccccggaaagaccgugugguucgugcccagcauuaagagcgggaacgacaucgccaauugccugcgcaagaacggcaagcgggucauccaacuuucucgcaagaccuucgacacggaguaccagaagaccaagaacaacgacugggacuacgucgugaccacggacaucagcgaaaugggcgccaacuuucgggcggaccgcgucaucgacccgcggcgcugucugaaaccugugauccugaaggacggccccgaacgggucauccucgccgggccuaugccggugacagccgcaucagccgcccagcgacgggggagaaucggccgcaaccagaacaaagagggggaccaguacaucuacaugggccaaccccucaacaacgacgaggaccacgcccacuggaccgaggccaagaugcugcucgauaauaucaacacccccgaggggaucauccccgcccuguucgagccggagagagaaaaguccgccgccaucgacggcgaguaccgcuuacgcggggaggccaggaagaccuuuguggagcucaugagacguggcgaccugcccgucuggcuguccuacaagguugccagcgagggcuuccaguacucagaccggcgcuggugcuucgacggggagcggaauaaccaggugcuagaggagaacauggacgucgaaaucuggacgaaggagggagagcgcaagaaacugcggccccgcugguuggaugcacggaccuacagcgacccccucgccuugcgcgaguucaaagaguucgcugcagggcggcgcagcgugucuggcgaucugauccucgagaucggcaagcucccgcaacaccugacccuccgggcacagaaugcgcuggacaaccuggugauguuacacaacagcgagcagggcggaaaagccuaccgccacgcaauggaggagcugcccgacaccaucgagacccuuaugcuucuggcccuaaucgcgguccucaccggcggcguaaccuuauucuuucucuccgggaaggggcucggcaaaacgagcauagggcugcugugcgugauggccuccaguguccuucuguggauggccucuguggagccccacuggaucgcugccagcaucaucuuagaguucuuucucauggugcugcugaucccugagccggaccggcagcggacgccccaggacaaccagcucgcguacgucgugaucggccugcuguucaugauccucacgguggccgccaacgaaaugggucugcuggaaaccaccaaaaaggaccucggcauagggcaugucguggccgagaaucaccaccaugccaccaugcuggacaucgaccugcaccccgccucggccuggacgcucuacgccguggccaccaccaucauuaccccgaugaugcggcacacaauugaaaacaccaccgccaacauuucgcugaccgcgaucgccaaccaggccgccauauuaaugggauuggacaagggcuggccuaucuccaagauggacauagggguccccuugcuggcccucggcugcuacagccaggugaacccccugacgcugaccgcagcugugcuaaugcugguugcccacuacgcgaucaucgggccggggcugcaggccaaggccacuagggaagcccagaagcgcaccgcagccggcaucaugaagaaccccacggucgacgggaucgucgcaauugaucucgaccccgucguguacgacgccaaguucgaaaagcagcugggccaaaucaugcugcucauccugugcaccagccagauccugcucaugcgaaccaccugggcccugugcgagagcaucacgcuggcuaccgggccccucaccacacugugggagggcuccccggggaaguucuggaacacgaccauagcagugagcauggcgaacaucuucaggggcuccuaucucgccggcgccgggcuggccuucagccugaugaagucccugggcgggggcagacgggggacgggcgcccagggcgagacccucggggagaaguggaagcggcagcugaaccagcugagcaagagcgaguucaacacguacaagagauccggaaucauggaggucgaccgaagcgaggcgaaagagggucucaagcgcggcgagaccaccaagcacgccguuucccgggggaccgccaagcugcgcugguucguggagcgaaacuuggucaagccagagggcaaggugauagaucugggcugcgggcgcggaggguggagcuacuacugcgccggauugaagaaggugacggaagucaaaggcuacaccaagggcggccccgggcaugaggagccuaucccgauggcgacuuacgguuggaacauagugaaacugcacuccgggagggacguguucuucacgccgccugaaaagugcgacacccugcucugugacaucggcgagagcucccccaaccccacgaucgaggaggggagaaccuuacgagucuugaagauggucgagcccugguuacggggcaaccaauucugcaucaaaauccugaacccguacaugcccagcgucgucgagacccucgagcagaugcagcggaagcacggagggaugcugguccgcaacccgcucucccggaacagcacacacgagauguacugggugagcugcggcacggggaacauugucagcgccgugaacaugaccucccgcaugcuguugaaccgcuucaccauggcccaucggaagcccaccuaugaacgcgacguggaccugggcgccggcacgcggcaugucgccguggagcccgagaucgcaaaccuggacauaaucgggcagcgcauugagaauaucaagaacgaacauaagagcaccuggcacuacgacgaagauaaccccuauaaaacgugggccuaccacggcuccuacgagguuaagccgucgggguccgccagcuccaugguaaacggcgucguccgucucuugaccaagcccugggaugugauucccauggugacgcagauugccaugaccgacacuacacccuuugggcagcagcgcguauucaaagaaaagguagacacgagaaccccgcgccccaagcggggcacggcccagaucauggagguaaccgcgaagugguugugggguuuccugagccguaacaaaaaaccccggaucugcacgagggaggaguucacccggaagguccgcucuaacgcugccauuggggccguguucguagaugagaaccaguggaacucagcuaaagaagcggucgaggacgagcgguucugggaccuggugcaucgcgagcgggagcuccacaagcagggcaagugugcgaccugcguguacaacaugaugggaaagcgugaaaagaagcucggugaauucgggaaggccaaaggcagcagagcaaucugguacauguggcucggugcccgguuuuuggaauuugaggcccucggcuuuaugaacgaggaucacugguuuucgcgggagaauagccuguccggagucgagggcgagggccuacacaagcucggguacauccugcgagacaucagcaaaauuccuggaggcaacauguacgccgacgacacggccgggugggacacgcgcaucaccgaggacgaccuccagaacgaggccaagaucaccgacauaauggagcccgaacacgcgcuccuggccaccuccaucuucaagcugacguaccagaacaagguggugcggguccagcgacccgccaagagcggcaccgugauggacgucaucucccggcgcgaccagcgggggagcggccaagucgguaccuaugggcucaacacuuucacuaauauggaggugcagcugaucaggcagauggaguccgagggcaucuuuagccccuccgaacuggaaaacagcaaccucgccgagcgcgugcuggacuggcuggagaaacacgggguggaacgacucaagagaauggccaucuccggcgacgauugcguggugaagccgaccgacgaccgcuucgcgaccgcccugaccgcccugaacgacauggggaagguccggaaggacaucccacagugggaacccagcaagggcuggaacgacuggcaacaagucccguucugcucccaccauuuccaccagcucaucaugaaagacggacgcgaaauagugguaccgugccggaaccaggacgagcugguggggcgcgcccgcguuagccagggagcaggguggagccugagagagacugcgugucucggcaaguccuacgcccagauguggcagcugauguacuuccaccggcgcgaccuucgacucgccgccaacgcaaucuguagcgcgguucccgugaacuggguuccgacgucccgcaccaccuggaguauccacgcccaccaccaguggaugaccacggaggacaugcuguccgucuggaaccgcguguggaucgaggagaaccccuggauggaggacaagacgcacguuuccuccugggaagacguccccuacuuggggaagcgggaggaccaguggugcggcagccucaucggccuaacagcccgagcaaccugggcgacgaacauccaaguggccaucaaucaggugcgucgccuggucgggaacgagaacuaccuagacuacaugaccagcaugaagagauucaaaaacgagagcgauccugagggcgcacuuugguga

SEQ ID NO: 24744 - RNA, 9879 nt, Artificial Sequence
  derived and/or modified CDS sequence (opt11) from DENV-1__KM403621__SS-prME
agcguaaccaugcugcuaaugcugcugcccacagcucucgcuuuccaccugaccacgcgggguggagagccccacaugaucgugagcaagcaagagcgaggcaaaagccuucuauucaagacauccgcgggggugaacaugugcacgcugaucgccauggaccugggagaguuaugugaggauacuaugacauacaaguguccccguauuaccgaggccgaacccgacgauguugacugcuggugcaacgccaccgauaccugggugacauacggaacaugcagccagaccggcgagcauagacgcgacaagcgguccguggcccuggcaccccacguggggcuggggcucgagaccaggaccgagacuuggaugucguccgagggcgcauggcgacagauacagaagguggagacgugggcucugcgccacccgggauucacgguuaucgccuuauuccucgcgcacgccaucggcaccucaaucacccagaagggcauaaucuucauccugcucaugcucgugacccccuccauggcuaugcggugcguuggcaucggcaacagagacuucguggaggggcugucaggcgccacgugggucgacgucgugcucgagcacggguccugcguuaccaccauggccaagaauaagcccacucucgacaucgaacuacugaagacagagguaaccaacccagcagugcugagaaagcuguguaucgaagccaagaucagcaacaccaccacggauucccgcugccccacccagggcgaggccacucucguggaggagcaagacgccaacuucgucugccggcgcaccuucguggacagaggcugggggaacggcugcggcuuauucggaaaagggagcuugcugacgugugccaaguucaagugcgucaccaagcuugaagggaaaaucgugcaguacgagaaccugaaauacagcgugauagugaccguccacaccggcgaccagcaucagguuggcaacgagacgacggagcaugguaccaucgccaccaucacaccccaagcacccacuucagaaauccagcugaccgauuauggggcccucacacuagacugcucucccaggaccggguuggacuuuaacgagaugguccuuuugacaaugaaggagaaguccuggcuggugcacaaacagugguuuuuggaccugccgcuacccuggacaucgggggccucaacgucacaggagacguggaaccggcaggacuuacuggugacguucaagaccgcccacgcgaagaaacaggagguuguggugcuggggucccaggagggggccaugcacaccgcccucaccggggcgacggagauacaaaccucaggaaccacaacgaucuucgccgggcaccugaagugccggcugaagauggauaagcucacccugaagggcguauccuaugucaugugcacuggaagcuucaaguuggagaaagagguggcggaaacgcagcacggcacgguucugguccaggugaaguacgagggcaccgacgcccccugcaagaucccgaucuccacucaggacgagaaggggguaacccaaaacggcagacucaucacggccaacccaaucgugaccgacaaagagaagcccgucaacaucgagaccgagccgcccuucggggagucauacauugucauuggcgccggcgagaaggcccugaaacuauccugguucaagaagggcagcucgaucggcaagauguucgaggccaccgcccgcggagcucggcgcauggccauacucggcgauacggcaugggacuucgguagcaucggaggcguguucacguccguugggaagcugguccaccaaguguucggcaccgccuauggggugcuguucuccggcguuucguggaccaugaagaucgggauaggaauccuccugacguggcugggacucaauucccgcuccaccagcuuauccaugaccugcauagccguggggauggucaccuuguacuuaggagucaugguucaggccgacagcgggugcgugaucaacuggaagggccgggagcucaaaugcggguccgggaucuuugucacgaacgaggugcacacuuggacggagcaguacaaguuccaggccgacagcccaaagcgacuuagcgcugcgaucgggaaggcaugggaggaggggguguguggcaucagauccgcuaccaggcucgagaacauaauguggaagcagaucuccaacgaacucaaccacauucugcuggagaacgacaugaaguucaccguuguuguuggggacgccaauggcauccucacgcaggggaagaaaaugaucagaccgcaacccauggaacacaaauauuccuggaaguccuggggcaaggcaaaaauaauaggggccgacacccagaacaccacauucauaaucgacggaccagacacgccagagugccccgacgaccagcgcgcauggaacaucugggaagucgaggauuauggcuucggggucuucaccacaaacaucuggcugaagcuccgggacaguuauacccaaaugugugaccacagauuaaugagcgccgcgaucaaggacuccaaggccgugcacgcugacaugggguacuggauugaaagcgaaaagaacgagacguggaaacuagcccgggccucguucaucgagguuaagaccugcauauggccccgcagccacacccucuggucgaacggcgugcuggagucugagaugaucauacccaaaaucuauggggggccgauaucacagcacaacuaccggcccggguacuucacccaaacugcgggcccauggcaccuggggaaguuagagcucgacuucaaccugugcgaggggaccaccguggucguggaugagcacugugguaaccgcgggccgucgcuccgaaccacgaccguuaccggaaagauaauucaugaguggugcugccgcucguguacccugccgccacugcgguuucgcggggaggacggcugcugguaugggauggagauuaggcccgucaaagaaaaggaggaaaaccucgugcgcagcaugguguccgccggaagcggcgaggucgacucauucucccuggggcugcuaugcguaagcaucaugaucgaagaggugaugcggucccgcuggucccguaagaugcuuaugacuggcacccuggccgucuucuuucuccugaucaugggccagcugacauggaacgaccucauccggcugugcaucauggucggcgccaauguauccgaccggauggggaugggcaccacuuaccucgccuuaauggcuaccuucaagaugcgaccuauguucgcagucgggcugcucuucagacgguuaaccagccgcgagguauuacuguuaaccaucggucuaucccuggucgcuucaguggagcugcccaacagcuuagaagaacuaggcgacgggcucgccaugggcauaaugaugcugaaacuguugacugacuuccagucccaccaguuauggaccacccugcuaagccuuacguucaucaagacgaccuuaagccucgacuaugcuuggaaaacgauggcaaugguccuguccaucguaagcuuauucccgcuuugccuguccaccacgagccagaagaccacguggcugccgguacuccuuggcuccuucggcuguaagccucuuaccauguuucuaaucaccgagaacaagaucuggggccgcaagaguuggccauugaacgaaggcaucauggccguggguaucgugucuauacuccugagcagccugcugaaaaacgacgugccccucgccgggccccuuaucgccggaggcauguuaaucgcgugcuacguuaucuccgggagcuccgcggaucugucauuagagcgcgccgcggaggucucaugggaggaggaggcugagcauagcggggcgucgcacaacauucuuguggagguucaagacgacggaacuaugaagaucaaggaugaagagcgcgaugacacacucaccauccugcugaaggccacccuccuugccguauccgguguguauccgaugagcauacccgcaacgcuguucgugugguacuucuggcagaagaagaagcagcgcagcgggguccucugggacaccccuagcccaccggaaguggagcgggcaguccuggacgacgggaucuaccgcauccugcagcggggauugcucgggcgcucgcaagucggcguugggguuuuucaagacggcgucuuucacaccauguggcacgugacccgcggggccgugcugauguaccagggcaaacgccuggaaccguccugggccucgguaaagaaggaccuuaucuccuacggcggaggcuggcgguuccaggggagcuggaacacgggcgaagaggugcagguaauugcagucgagcccgggaagaaccccaagaacgugcagaccaccccuggcaccuuuaagacgcccgagggcgaggugggugcuauugcccuggacuucaagcccggcacuuccggaagcccgaucgucaaccgcgaagggaagauaguaggccuguacgggaacggcguggucacuaccagugggacguauguuagcgcaaucgcccaggcuaaggccagccaggagggcccguugccugagaucgaagaugagguuuucaagaagcggaaccugaccaucauggaccuccaucccgggucggggaaaaccaggcgguaucuacccgcgauaguccgcgaagcuaucaagcgcaaguuacggacucugauccucgcccccacgcgcguggucgccucggagauggccgaagcgcugaaggguaugccaauacgguaccaaacgaccgccgucaaguccgaacacacugggaaagagaucgucgaccugaugugccaugcgacauucaccaugcgacuccugagccccgugcgcguuccaaacuacaacaugauaaucauggacgaggcccacuucaccgaccccgcgucuaucgccgcccgugguuacaucagcaccaggguugggaugggggaggcagccgcgauuuucaugacggcgacgccgccugguuccgucgagagcuucccgcagucuaacgccgucauacaggacgaggaaagagacaucccagagagaagcuggaacuccggguacgauuggauuacagacuuucccggaaagaccgugugguucgugcccuccaucaaguccgguaacgacauagccaacugccugcgcaaaaacggcaaacgggucauccaguugucccgcaagacguuugacaccgaguaccaaaagacgaagaacaacgacugggacuacguggugaccaccgacaucagugagaugggggcuaacuuccgugccgaccgcguuaucgacccgcggaggugccugaagccugugaucuuaaaggauggaccugagcgugucauccucgcagggccaaugccugugaccgccgccucagccgcgcagcgccggggccgcaucggcagaaaccagaacaaggagggggaccaauacaucuacaugggccagccccucaauaacgacgaggaccaugcccauuggaccgaggcgaagauguuauuggacaacaucaacacccccgaggggaucauccccgcccuguucgagccugagcgggagaaguccgccgcgauagacggggaguaucgccugagaggcgaagcccgcaagacguuuguggagcuuaugcggagaggcgaccugccaguauggcugucuuauaagguggccuccgaagguuuucaguacuccgacaggcgcuggugcuucgacggggagcggaacaaucagguccuggaggagaacauggacgucgagauauggacaaaggagggcgagaggaagaaguuacggcccagauggcuggacgcccguaccuacagcgacccucucgcguugcgcgaguucaaggaguucgcggccgggcggagaucugugagcggugaccugauccuagaaauuggcaagcugccgcagcauuugacucuccgggcccaaaacgcacuggacaacuugguuaugcuccacaacuccgagcagggcggaaaggccuaccgucacgcgauggaagaguuacccgauacuauugagacgcuaaugcuccuggcccugaucgcuguccucaccgggggagugacccuguucuuccucuccgggaagggccucgguaagaccucaauuggccugcugugugucauggccagcuccguccuccuguggauggccagcgucgagccccacuggauagcagccuccauuauucuggaguucuuccuuauggugcugcugauccccgagccggaucggcagcgcaccccccaggacaaucagcucgcauacguugucauuggccuccuguucaugauccucaccguggcugcgaacgagauggggcuauuggagaccaccaagaaggacuugggcaucggacacgucguagccgaaaaccaccaccaugccacgaugcuggacauagacuugcaucccgccagcgccuggacucucuacgcagucgccacgacaaucaucacgccgaugaugcggcacaccaucgaaaauaccaccgccaacaucucccuaacggcaaucgccaaucaggcggcgauccugauggggcuagauaagggcuggccgaucagcaaaauggacaucggggucccccuccuggcccucggcugcuauucccaggugaacccccucacccugaccgccgccgugcucaugcucgucgcgcacuaugccaucauuggcccggggcugcaggcuaaagccacccgcgaagcacagaagaggaccgccgccgggaucaugaagaacccgacaguggauggcaucguggcgaucgaucucgaccccgugguuuaugacgcgaaguucgagaagcagcugggccagaucaugcuguugauccuauguacaagccagauccuacucaugcggaccaccugggcacugugcgaguccaucacguuagccacagggcccuugaccacgcugugggaagggagcccggggaaguucuggaauaccacuaucgccguguccauggcgaacaucuuccggggcagcuaccuggccggcgcgggguuggccuuuagucugaugaaaucccuaggcggaggccggcgagggaccggcgcccagggcgagacucucggggagaaguggaagcgacagcugaaccaacugagcaaguccgaguuuaacacuuacaaacguagcggcaucauggaagucgacagauccgaggccaaggaagggcucaagcgcggggagaccaccaaacacgcagugucccgggguacggccaaacuccgaugguucguggagcggaaccugguuaagcccgagggaaagguaaucgaccuuggaugcgggaggggcgguuggucauacuacugugccggacucaagaaagugaccgaggucaagggguacacgaaggggggaccggggcacgaggagccuauccccauggccaccuacggguggaacaucgugaagcugcacagcgggcgggauguguucuuuacgccgcccgagaagugugacacgcuguugugcgacaucggcgagucuagccccaacccgacuaucgaggagggcagaacgcugcgggugcugaagaugguggagcccugguuaaggggcaaccaauucugcaucaaaauccugaaccccuacaugccuuccgugguggagacccucgagcagaugcagaggaagcacggcgggaugcucguuaggaacccgcuuucacguaacuccacgcacgagauguacuggguaagcugcggcacuggcaacauugucagugccgugaacaugaccagccgcaugcugcucaaucguuucacaauggcgcaccggaagcccacguacgaaagggacguugaccugggagccggcaccaggcaugucgccguggagcccgagauugccaaccuggacaucaucgggcagcgcaucgagaacaucaagaacgagcauaagaguaccuggcacuaugaugaggauaaccccuacaagaccugggccuaccauggcagcuacgaggugaagccguccggaagcgcguccuccauggucaauggggugguucgccugcugacaaagccgugggacgugauccccaugguuacucaaaucgccaugaccgauaccacgccauuugggcaacagcgcgucuucaaggagaagguggacacccggaccccuaggccaaagagaggcaccgcccagaucauggaggugacggcaaaauggcuguggggcuuccucagccggaacaagaagccccggaucugcacccgugaagaauucacccggaagguccgguccaacgcugcgaucggugccgucuuugucgacgagaaucaguggaauucugccaaggaggccguggaagacgaacgguucugggaccuggugcacagagagcgggagcugcacaaacagggaaagugcgcgaccugcguguacaacaugauggggaaacgcgagaagaagcucggcgaguucggaaaggcgaagggcagccgggcaaucugguacaugugguugggugcccgcuuccuggaguuugaggcccucggauucaugaacgaagaccacugguucagccgggagaacuccuuaaguggcguagagggggagggccugcacaaacucggguacauacugcgcgacaucaguaaaaucccgggcggaaacauguacgcggacgacacugccgggugggauacucgcaucaccgaggacgaccugcagaaugaggccaaaaucacggacauuauggagcccgagcacgcccucuuagccaccagcauuuucaagcucaccuaccagaacaaagugguacggguacaacgccccgcgaaguccgguaccgugauggacgugaucucgagacgcgaccagcggggauccggucaggucggcaccuaugggcucaacacauucacgaacauggagguacaguuaauccgccaaauggagagcgagggcauuuucagucccagcgagcuggaaaacagcaaccucgccgaacgggucuuagacuggcucgagaaacacggggucgagcgccuuaagagaauggccaucagcggcgacgacugcgugguuaaaccuaccgacgaccgcuuugccaccgcacugacggcgcuuaaugacaugggcaaggucaggaaagacaucccccagugggagccauccaagggcuggaacgacuggcagcagguacccuucugcucacaccacuuccaccagcucaucaugaaggacggccgcgagaucgugguaccgugccggaaucaagacgagcuuguggggcgcgccagagugagucaaggggcgggguggucccugcgcgagaccgcuugccucggcaagaguuacgcgcagauguggcagcugauguacuuccaccgccgcgacuugagacuagccgccaaugcgaucugcuccgcugucccagugaacugggucccgaccagccgcaccaccugguccauucacgcgcaccaccaauggaugacgaccgaagacaugcugagcgucuggaaucggguauggaucgaagagaaccccuggauggaagacaagacccacguuuccagcugggaagacguccccuaccuuggcaagcgggaggaccaguggugcgguucccuaauuggacugaccgcucgcgccacgugggccaccaacauacagguggccaucaaucagguacggcgccugaucgggaacgagaacuaccucgacuacaugacuagcaugaagcgguucaagaacgagagcgacccugagggcgcccugugguga

SEQ ID NO: 24745 - RNA, 9879 nt, Artificial Sequence
  derived and/or modified CDS sequence (opt11) from DENV-1__KM403623__SS-prME
agcgugacaaugcuacucaugcugcugcccaccgcccucgccuuccaccugacaacccggggcggggagccccacaugauagugagcaagcaggagcguggcaagagccuccucuucaagaccuccgcgggggugaauaugugcacccugaucgccauggaccugggcgaguugugugaggacacuaugaccuacaagugcccccggaucaccgaggccgagcccgacgauguggacugcuggugcaacgccaccgauaccugggugaccuaugggaccugcagccagaccggugagcaccggcgcgacaagcgguccguggcucuggccccccacgugggccugggccucgagacccgcacugagaccuggaugagcuccgagggagccuggcggcagauccagaaaguggagaccugggcccugcgccaccccggguucacggugaucgccuuuuuccuggcgcacgccaucggcaccagcauuacccagaaggggaucaucuuuaucuugcugaugcucgugaccccauccauggccaugaggugcgucggcaucggcaaccgcgauuucguggaggggcucagcggcgccacguggguggacgucgugcuggagcacggguccugcgugaccaccauggccaagaacaagcccacccuggauaucgagcuccugaagacggaaguaaccaaccccgcggugcugcggaagcucugcaucgaggccaagauaucgaacaccaccacugacuccagaugucccacccagggugaggccacccugguugaggagcaagacgcaaacuucgucugccggcgcaccuucguggaccggggaugggggaacggaugcgggcuguucggaaaggggagccuccugacgugcgcuaaguucaagugcgugaccaagcuggaaggcaagaucguccaguacgagaaccucaaguacagugugaucgugaccguccacaccggcgaucagcaucagguggggaacgagacgaccgagcacggcacgaucgcgaccauaacgccccaggccccgacgagcgagauccaguuaaccgacuacggggccuuaacccuagauugcagcccccggaccggcuuggacuuuaaugagaugguacugcucaccaugaaggagaaguccuggcuggugcacaagcagugguuccuggaucucccgcugcccuggaccuccggggccagcaccagccaggagaccuggaaccggcaggaccugcucguaacguuuaagaccgcccacgccaagaagcaggagguuguggugcugggcucccaggagggcgccaugcacacagcccugaccggggccacggagauccagacgagcggcaccacaaccaucuucgccgggcaccucaagugccgccuuaaaauggacaagcugacccucaagggcgucuccuaugugaugugcaccgggagcuucaagcuggagaaagagguggcggagacccagcacggcacgguccuuguccaggugaaguacgaggggaccgacgcccccugcaagaucccgaucuccacccaggacgagaagggggucacccagaaugggcgccugauuacggcaaacccgaucgugaccgacaaagagaagcccgucaacaucgagacggaaccgcccuucggcgagagcuauaucgucauaggugccggcgagaaggcgcucaagcucuccugguucaagaaggggagcuccauugggaagauguuugaggccaccgcccgcggggcucggcgcauggccauccugggcgacacggcgugggacuucggcagcauaggcggcguguucaccuccguggggaagcucguccaccaggucuuuggcacggccuacgggguucuguucagcggcguguccuggaccaugaagaucgggaucggcauccuacugacguggcugggccugaacagccgcuccaccagccucuccaugaccugcaucgccguggggauggugacccuguaccugggugucauggugcaggccgacagcgggugcgugaucaacuggaagggccgagagcucaaaugcggguccggaaucuuugucacgaacgaaguccacacuuggaccgagcaguacaaguuccaggccgacagcccgaagcgccugagcgcggccaucggcaaagccugggaggaagggguguguggcauccggagugccacccgacuggagaacauaauguggaagcaaaucagcaacgagcucaaccauauccugcuugagaacgacaugaaguucaccguuguggugggugacgccaacggcauucucacgcaggggaaaaagaugauccggccccagccuauggagcacaaauacuccuggaaguccuggggcaaggcgaagauuaucggcgccgacacucagaacaccaccuucaucaucgacgggccggacacgccggagugccccgacgaccagcgcgccuggaacaucugggaggucgaggacuacggcuucggaguguuuaccaccaauaucuggcugaagcugcgggacuccuacacccagaugugcgaccaccgccucaugagcgcugcaaucaaggacuccaaggccgugcacgccgacaugggcuauuggaucgagagcgaaaagaacgagacguggaagcuggcccgggccuccuucaucgaggucaagaccugcauauggccccgaagccacaccuugugguccaacggcgugcucgaguccgagaugaucauccccaaaaucuacgggggcccgaucucccagcacaacuaccggcccggguacuucacccagacggcgggccccuggcaccuagggaagcuggagcucgauuucaaucuaugcgagggcaccaccgugguuguggacgagcacugcggcaaccgcgggccgagccugcggaccacgaccgugaccgguaagaucauccacgaauggugcugccgcucuugcaccuugcccccccugcgguuccgcggggaggacggcugcugguaugggauggagauccggcccgucaaggagaaggaggagaaccugguacgcagcaugguguccgccggcagcggcgaggucgacagcuucucccuagggcugcugugcguaagcaucaugaucgaggagguuaugagaucccgcuggucccgcaagaugcucaugaccggcacccuggccguauucuuccugcucaucaugggccaguugaccuggaacgaccugaucagacucugcauuauggugggcgccaauguguccgaccgcauggggaugggcaccacguaccuggcccugauggcgaccuucaagaugcggccgauguuugccgugggucuccuguuccgacggcuaaccagcagggagguccuccugcucaccaucgggcucucgcuggucgcuagcguggagcugccuaacucccuagaggagcugggcgacggccuggccaugggcauuaugaugcucaagcugcugaccgacuuccagagccaccagcucuggaccacccugcugagucucaccuucaucaagacgacccugagccuggacuacgccuggaagaccauggcgaugguccuaucuaucgucucucuguucccccugugccucucaaccacgagccagaagacgaccuggcugcccgugcugcucggguccuucgggugcaagccguugaccauguuccugaucaccgagaacaagaucuggggccgcaagagcuggccucucaacgaaggcaucauggccguggguaucgucuccauucugcugagcagcuugcugaagaacgaugugccccuggccgggccucucaucgcuggcgguaugcugaucgccuguuacgugauauccgggagcuccgccgaccugagccucgaaagagccgccgaggucuccugggaggaagaggcggaacacagcggcgcgucgcacaacauccugguggaggugcaggacgacgggacgaugaagaucaaggacgaggagcgggacgauacccuuaccauccuccugaaggccacucugcuugccgugucaggcguguacccgaugucaauacccgccacgcuuuucgugugguacuuuuggcagaaaaagaaacaacgaagcgggguccugugggacacucccucgccgcccgagguggagcgggccgugcucgacgacggcaucuacagaauccuccagcggggccuccuggggcgcagccaggucggcgugggcguguuccaggacggcgucuuccacacgauguggcacgugacacgcggcgccgugcuuauguaccagggcaagcgccuggagcccuccugggccagcgucaagaaggaccugaucuccuacggcgggggcuggagguuccagggcagcuggaacacgggagaggaaguccaggugaucgccguagagcccgggaagaaccccaagaacguacagaccaccccaggcaccuucaagacgccagagggcgaggugggggccaucgcccucgacuucaagccgggcaccuccgggucacccaucguaaaucgcgagggcaagaucguuggccuguacgggaacggcgugguaaccaccuccgggacguacgugagcgcgauugcccaggccaaggccagccaggaaggcccacugcccgaaaucgaggacgagguguucaagaaacggaaccucacaaucauggaccugcaccccgguuccgguaagacccgccguuaccugccggccaucguccgcgaagcgaucaagcgcaagcuccggaccuuaauccucgcacccacgagggugguggccagcgagauggccgaggcccucaagggcaugcccauucgguaccagaccaccgcggucaagagcgagcacaccgggaaagagauuguggacuuaaugugccacgccacguucaccaugcgccuguuaucgcccgugcgggucccgaacuacaacaugauuaucauggacgaggcccacuucaccgaccccgccuccaucgccgcccgcggcuacaucagcacccggguggggaugggagaggcggccgccaucuuuaugaccgcgacaccccccggguccguggaguccuucccgcaguccaacgcagucauccaagacgaagagcgcgauauacccgaacgcagcuggaacuccggcuaugacuggaucaccgacuuccccggcaagaccgucugguucgugcccagcauuaaguccgggaacgacaucgccaauugucugcgcaaaaacggcaagcgggucauacagcugagccgcaaaacguucgauaccgaguaccagaaaaccaagaacaacgacugggacuacgugguaacgacggacaucucagagaugggggccaacuuccgggccgaccgcgucaucgauccacggcgcugccucaagccuguuauccugaaggacgguccagagcgggucauccuggccgggcccaugccggugaccgccgcgagcgccgcgcagcgccggggccgcaucggccgaaaccagaauaaggagggggaccaauacaucuauaugggccagccccucaacaacgacgaggaccacgcccacuggaccgaagccaagaugcugcuggacaauaucaacacgcccgaagggaucauucccgcccucuucgagccggagcgggagaaguccgccgcgaucgacggcgaguacagacugcgcggggaggcgcgcaagacguucguggagcugaugcggcgcggcgaccugcccguuuggcugagcuacaagguggcuuccgagggcuuccaguacucagaccggagauggugcuucgacggggagcggaacaaccaggugcuggaggagaacauggacgucgagaucuggaccaaggagggcgagaggaagaagcuccggccccgcuggcuggacgcacggacauacuccgacccccuggcccuccgcgaguucaaggaauucgccgccgggaggcgcagcgugagcggcgaccugauccucgagauuggcaaguugccccagcaccugacgcugcgggcccagaacgcccuugacaaccuggugaugcugcacaacuccgagcagggcgggaaggccuaccgccacgcgauggaggaacucccugauaccaucgagacgcugauguuacucgcccugaucgcaguccugacggggggcgucacccuuuuuuuccugagcgggaaaggccugggcaaaacauccauagggcuccugugcgugauggccagcuccguccugcucuggauggcgaguguagaaccccacuggaucgccgccagcaucauccuagaguuuuuccugauggugcuacugauccccgagccggaccggcagcgcacuccccaggacaaucagcuggccuacgucgugaucggccuccuguucaugauccugaccguggccgcuaacgagauggggcuccuggagaccaccaagaaggaccugggaaucgggcacgucguggcggagaaccaccaccacgccacgaugcucgacaucgaccugcaucccgccucugccuggacccuguacgcgguggccaccaccaucaucacgccaaugaugagacacaccaucgagaacaccaccgccaacaucucccucacagccauugccaaccaggcagccauccugaugggacuggacaagggcuggccaaucucuaagauggacaucgguguccccuuguuagcccugggcugcuauucucaggugaauccccucacccugaccgccgccgugcugaugcucgucgcgcacuacgccauaaucgggccgggccugcaggccaaggccacccgcgaggcgcagaagagaacggccgccgggaucaugaagaaccccaccguggacggaaucguggccauagaccuggaccccgucguguacgacgccaaguucgagaaacaguuagggcaaaucaugcuguugauccucugcaccucacagauccuguuaaugcguaccacgugggcgcucugcgaauccaucacccuggccaccgggccucugaccacgcucugggagggcagcccggguaaguucuggaacacuaccaucgccgugaguauggccaacaucuuucgcggcagcuaccuggccggcgcggggcuggcauucucacucaugaagucacugggcgggggccggcgcgguaccggagcucagggcgagacgcugggggagaaguggaagcggcagcugaaccagcugagcaagucggaguucaacaccuacaagcgaucgggcaucauggaggucgaccggagugaggccaaggaggggcugaagcgcggcgagaccaccaagcacgccgugagccgggggacggcgaagcuccgcugguucguggagcggaaccugguuaagccagagggcaaggugaucgacuugggcugcgggcgcggcgggugguccuauuacugcgccggccugaaaaaggugaccgaggucaagggguacacuaagggcggccccgggcacgaggagcccaucccgauggccaccuacggcuggaacaucgugaagcuccacagcggacgggacguauucuucacgccgcccgagaagugcgauacauuacugugugauaucggcgaguccagucccaacccgaccaucgaggagggacgcacccucaggguccuuaagaugguggagcccuggcugcguggcaaccaguucuguaucaaaauccucaacccguacaugcccuccgugguugagaccuuggagcagaugcagcggaagcacggcgggaugcugguucgcaauccgcucagccggaacucgacgcacgagauguacugggugucgugcggcaccgggaacaucgucuccgccgugaacaugacgagccgcaugcugcugaaccgcuuuaccauggcccaccggaaacccacguacgagcgcgacguggaccuaggcgccgguacccgacacgucgcaguggagcccgagaucgccaaucucgacaucaucggacagcgcaucgagaacaucaagaacgagcacaaauccaccuggcacuacgacgaggacaaccccuauaagacaugggcauaccacggcuccuacgaagugaagccguccgggagcgcguccagcauggucaacggcgugguccgucugcucacuaagcccugggacgucauccccauggugacucaaaucgccaugaccgacaccacgcccuucgggcagcagcgcgucuucaaggagaagguggacacccggacgccacgccccaagcggggcaccgcccagaucauggaggugacggccaaauggcuguggggcuuccugagccgcaacaagaagccccggaucugcacccgcgaggaguuuacucggaagguccgcuccaacgccgcgaucggugccguuuucguggaugagaaccaguggaacagcgccaaggaagccgucgaggaugagagguucugggaccucgugcaccgcgaacgggaguugcacaagcagggcaagugcgcgacuugcguguacaacaugauggggaagcgcgagaagaagcucggcgaguucgggaaagcgaagggcucccgggccaucugguacauguggcucggcgcccgcuuucuggaguucgaggcccuuggguucaugaacgaggaccacugguucucgcgggagaacucgcugucggguguagagggggagggccugcacaagcucggguauauacuccgcgacaucagcaagauuccaggcggcaacauguacgcggacgauacggccgggugggacacgcggaucaccgaggacgaccugcagaacgaagccaagaucaccgacaucauggagcccgagcacgcacugcucgcuacgagcaucuucaagcugaccuaccagaacaaaguaguacggguccagcgccccgcgaaguccggcacggugauggacgugaucucuagacgcgaccagcggggcuccggccaggucggcaccuacgggcuaaacacguucaccaacauggaggugcagcucauccgccagauggaaagcgagggcaucuucuccccaucugagcuggagaacagcaaccuggccgagcgcgugcucgacuggcuggagaagcacggggucgagagacugaagcgaauggccaucagcggcgacgacugcgugguaaagccuacagacgaccgcuucgccaccgcccucacggcgcugaacgacauggggaagguccggaaggacaucccccagugggaacccaguaagggauggaacgacuggcaacaggucccuuucugcagccaccacuuccaccagcugaucaugaaggacggccgcgagaucguggucccgugccggaaccaggacgagcucguggggcgcgcccgagugagccagggcgccggguggucccugagagagaccgccugccugggcaaauccuacgcccagauguggcagcucauguacuuccaccggcgcgaucugcgguuagcugcaaacgccaucugcuccgccguccccgugaacuggguccccaccagccgcaccacuugguccauccaugcccaccaccaguggaugacgaccgaggauaugcucucugucuggaaccgcguguggauugaggagaaccccuggauggaggacaagacccacgugucuagcugggaagacgucccguaucuggggaaacgggaggaccaguggugcggcucccuuaucggccucacugcgcgcgccacaugggccaccaacauccagguggccaucaaccaggugcgccgccugaucgggaacgagaacuaccuggacuacaugaccucgaugaagcgguuuaagaacgagucugaccccgagggcgcgcucugguga

SEQ ID NO: 24746 - RNA, 9879 nt, Artificial Sequence
  derived and/or modified CDS sequence (opt11) from DENV-1__KM403575__SS-prME
agcgugaccaugcuguugaugcuacugcccaccgcccucgccuuccaucugaccaccaggggcggggaaccccacaugauagugagcaaacaggagagggguaaaucgcuccucuuuaagacguccgcaggggugaacaugugcacacugaucgccauggaccugggcgaguuaugcgaagauacuaugaccuacaagugccccagaaucaccgaggccgagccggacgauguggacugcuggugcaacgcaaccgacacaugggugaccuaugggaccugcagccaaaccggcgagcaccgacgcgacaagcgguccgucgcccuggcgccccaugugggcuuaggucucgaaacucgcaccgaaaccuggaugagcuccgagggcgcuuggcggcagauccagaagguggaaaccugggcgcugcgccacccuggguucacgguuauugcacuuuuccucgcucacgcuauugggacaagcaucacucagaaggggaucaucuucauccugcugaugcucgugacccccuccauggccaugcggugugucgguaucggcaaccgcgacuucguggaggggcugagcggcgccacguggguggacgucgugcuugagcacggaucaugcgugaccaccauggccaagaacaagcccacauuggauaucgagcugcugaagacggaaguuaccaaccccgcgguccuccggaagcugugcauugaggcgaagaucucuaauaccaccacggauucccguugccccacgcagggcgaggccacucugguggaagaacaagacgccaacuucguuugcagacgcacguucgucgaccggggcugggguaauggcugcggacucuucgguaaggggagccuccuaaccugcgccaaguucaagugcgugaccaagcucgaagggaagaucguccaguacgagaaccucaaguacuccguaaucgugaccguccacaccggugaccagcaccaaguggggaacgagacgaccgagcacggaaccaucgcgaccauaacgccccaggccccgacgagcgaaauucaguugaccgacuacggcgcccucacccuggacugcagcccccguaccgguuuggauuucaacgagaugguccuuuuaacaaugaaagaaaaguccuggcucgugcacaagcaaugguuccuagaccuaccgcugcccuggacuuccggggccagcacuagccaggagaccuggaacagacaggaccuccugguaacuuucaaaacggcccacgcaaagaagcaagaagucguggugcugggaucccaggagggcgccaugcacacagcccucaccggugccacagaaauccagaccagcggcaccaccacgauuuucgcaggccaccugaagugccgccuaaagauggacaaguuaacgcugaaaggcgucucguacguuauguguaccgggagcuucaaacuggagaaggagguggcagaaacccaacacgggaccgugcugguccaggucaaguaugaagggacggacgcccccugcaaaauccccaucuccacccaggacgaaaagggcguuacccagaacggacggcucaucacggccaauccuaucgugaccgacaaggaaaagccuguuaacauugagaccgagccucccuucggggagagcuacaucgucauaggagccggcgagaaggcccugaagcuguccugguucaaaaaggggucguccauuggcaaaauguucgaggccaccgccagaggggcccggcgcauggcaauauuaggcgacacggcgugggacuucgggucaaucggcggcguguucaccucaguggggaagcuaguccaccagguauucggcaccgcuuaugguguccuguucagcggcgucuccuggaccaugaagauagguauuggcauauuguugacguggcugggccucaauagccgcuccaccucacuguccaugaccuguaucgccgugggaauggugaccuuguaccucggugucaugguccaggcagacagcgggugugugaucaacuggaaggggcgagaacuaaagugcggguccggcaucuucgucacuaacgaggugcacaccuggacugagcaauacaaauuucaagccgauagcccgaaacgccuaagcgcggcuaucggcaaggcaugggaggagggcguguguggaauccgguccgccacuagacucgagaacauaauguggaaacagauuagcaacgaacugaaccacaucuuacucgagaaugauaugaaguucaccgucguagugggggaugcaaacggcauccucacgcagggcaaaaagaugauuagaccacagcccauggagcacaaguacuccuggaaaagcuggggaaaggcgaagauuaucggagccgauacccagaacacgaccuuuaucauugacggcccggacacgccagagugccccgacgaucagcgcgcguggaauauuugggagguggaggacuacggcuucgggguguucaccacaaacauauggcugaagcucagagauucuuacacccagaugugcgaccaucgccugaugucagccgcaauuaaagacucuaaagccgugcacgccgacaugggcuacuggaucgaaagugagaaaaaugagacguggaaguuggccagggccuccuucauagaggucaagacauguaucuggcccaggagccacaccuugugguccaacgggguucuugagagcgaaaugaucauccccaagaucuacggcggcccgauaucccaacauaauuacagacccggguacuucacccagaccgcuggcccuuggcaccuggggaaacucgagcuggacuucaaucugugcgagggcaccaccguggucguggacgagcacugcggcaaucgcgguccgucacuccggaccaccacugugacugggaagaucauucacgaguggugcugccgcucuugcacccugccgccccuucguuuccggggagaggauggcugcugguauggaauggagauaagaccggucaaggaaaaggaagagaaccuagugcgcaguaugguuuccgccggcagcggcgaggucgacagcuucucauuaggccuucucugugugagcauuaugaucgaggaagugaugcggagcagauggucuagaaagaugcugaugacgggcacccuagcagucuucuuccuucugaucauggggcagcugaccuggaacgaucucaucaggcugugcauaauggugggugccaacgugucugaccgcaugggaaugggcacaaccuaucuggcacugauggcgaccuucaagaugcggccgauguucgccgucggucugcuguuccgucggcucaccagucgcgaaguucugcuguugacgaucgggcugagccugguggccagcguggaacuccccaacucccuggaagaacugggcgacgggcuagcaauggguaucaugaugcugaagcuccucacggacuuccaaagccaccagcuguggaccacucugcucucccugaccuuuaucaagacgacccugucgcuggacuacgccuggaagacaauggcgauggugcugagcaucgucaguuuguucccccucugccuguccaccacgucccagaagaccaccuggcugcccguguuguugggcuccuucgggugcaagccuuuaacuauguuccucauaacugaaaauaagaucuggggacgcaagagcuggccccuuaacgaggggaucauggccgugggaaucgugaguaucuugcucaguagccugcugaagaaugaugugccccucgcgggucccuugauugccggcggaaugcuuaucgcguguuacgugauauccggcagcuccgcugaccugagccuggagcgagccgccgaagucuccugggaagaagaggccgagcacagcggcgcgucucacaacauccugguggaagugcaggaugauggaacgaugaagaucaaggacgaggagcgggacgauacccucaccauucugcucaaggccacucuauuggccguuagugggguguauccgauguccaucccagcgacgcuuuucgucugguacuucuggcagaagaaaaagcagcgcagcggaguccucugggacacccccagcccgcccgaggucgaaagggccgugcuugacgacgggaucuaccggauccugcagcggggccugcucgggagaucgcaggucggugugggugucuuccaagacgggguuuuccacacgauguggcauguuacgcgcggugcggugcugauguaccaaggcaaacgcuuagaacccuccugggccagcguuaaaaaggacuugauuucuuauggugggggcuggagguuucaagggaguuggaacacgggcgaggaggugcagguaaucgccgucgaacccgggaagaauccgaaaaacguacagacaacaccuggcacguucaagacgcccgagggcgaggugggagccauagcccuggacuuuaagcccggcaccuccggaucuccaaucgucaaucgcgagggaaagaucguaggccuauacgggaacggugucguuaccaccucugguacguacgugagcgcgaucgcccaagccaaggccagccaagagggcccgcuaccugagaucgaagacgaaguauucaagaaaagaaaccucacgaucauggaccuacaccccgguuccggcaagacccgucgguaccuacccgccaucguccgagaggcgauuaaacgcaaacuacguacguugaucuuggccccgacgcgggugguggccagcgagauggccgaggcacugaaaggcaugcccauccgguaccagacuaccgccguaaaauccgagcacacggggaaggagauuguugaccugaugugccacgcgacguucaccaugagacuccugagccccgugagagucccgaacuauaacaugaucauaauggacgaggcccacuucaccgacccugccuccaucgccgcccgcggauacaucagcacgcgcgugggaaugggcgaggccgccgcaaucuucaugacggcgaccccgcccgggaguguggaggcuuuuccgcaguccaacgccgucauacaggacgaggagcgagacauacccgagcgaaguuggaacucggguuacgacuggaucaccgacuuccccggcaagaccgugugguucgugcccuccaucaagagcgggaaugacaucgccaacugccugcgaaagaaugggaagcggguaauccaacucaguaggaagacguucgacacggaguaccagaagaccaagaacaacgacugggacuacgugguuacgacggacaucagcgagaugggagccaacuucagagccgaccgcgugauagacccgaggcgcugccugaaaccugugauacugaaggacggucccgagcgggucauuuuagccgggcccaugcccgugacggcagcauccgcggcccagcgccggggccggaucggccgcaaccagaacaaggagggugaccaauacaucuauaugggccagccccucaacaacgacgaagaccaugcccacuggacggaggcuaagauguuacucgauaacauaaacacccccgaggggauaauccccgcccucuucgaaccggagcgggagaaaagcgccgccauugacggcgaguaccgccugcgcggagaggcccgcaaaacguucgucgagcugaugcgccgcggcgaccugccugucuggcugucauacaagguggccagcgagggcuuccaguacucggaccggcgcuggugcuucgauggcgagagaaacaaucaagugcuagaggagaacauggacguagagaucuggaccaaggaaggcgagcgcaagaagcugcgccccaggugguuggacgcgcggacauacagcgacccacucgcacugcgcgaguucaaagaguucgcggccgggagacguuccgucuccggcgaccugauuuuagaaaucggcaaauugccgcaacaccugacccucagagcacaaaacgcccucgacaaccugguaaugcugcacaauagcgagcagggcgggaaggcauaccgacacgcgauggaggagcugcccgacaccaucgaaacguugaugcuccuggcccugaucgcgguccucacaggcggugugacccuguucuucuugucggggaagggccucggaaagaccaguauugggcugcugugcguuauggccuccagcguccugcuguggauggccuccguggaaccgcauuggaucgccgccucuaucaucuuagaguucuuccucauggugcuguuaaucccggagccggauagacaacggacgccccaagacaaucagcucgccuaugucgugaucggccuguuguucaugauucuaaccguggcugccaacgagauggggcuucuggaaaccaccaagaaggaccucggcaucgggcacgucguggccgagaaccaccaccacgccacgaugcuggacauugaccugcaccccgcauccgcauggacauuauacgcuguggcaaccaccauuaucacccccaugaugcggcacacuaucgagaacaccaccgccaacauuucgcugacggcgaucgcuaaucaggccgcaaucuuaaugggccucgacaagggcuggccaaucuccaagauggacauuggggucccccugcuggcccucggcuguuacagccaggugaacccuuuaacccuaacugccgcggugcucaugcugguggcccauuacgcuaucaucgggccgggccugcaagccaaagcgacccgggaggcucagaaacgcacggccgccgggaucaugaagaaccccacgguggacggcaucgucgccaucgaucuugacccggucguguacgacgcgaaguucgagaagcaguuaggucagauuauguuguuaauccugugcaccucccagauucugcucaugagaaccacgugggcgcugugcgagagcaucacgcuggcgacugggccccucacuacguugugggaggggagcccggggaaguucuggaacaccacuaucgcaguguccauggcaaacaucuuccgcgguuccuaccuggcaggcgccgggcucgccuucagccuuaugaagucguuaggcgggggccggcgagggaccggcgcccaaggcgagacgcucggggagaaauggaagcgccagcugaaccaguuaagcaagagcgaguucaacacauacaagagaucggguaucauggagguugacagaagcgaggcuaaggaagggcucaaacguggcgagaccacaaagcacgcaguguccagagggacggccaagcugcgcugguucguggaacggaaccuggugaagcccgagggcaaggugaucgaccuggggugcgggcgcgggggcuggagcuacuacugcgccggccucaaaaaggugaccgaggugaagggguacacgaaaggcggccccggucacgaggagccaaucccgauggccaccuacggcuggaauaucgucaagcugcauuccggccgagacguguucuucacgccgcccgaaaagugcgacacucuucucugcgacaucggcgaaagcucccccaacccaaccaucgaagaagggcgcacccugcgugucuugaagauggucgagccauggcuccguggcaaccaguuuugcaucaagauccuuaacccuuacaugcccagcguggucgagaccuuggagcagaugcagcgaaaacacggcgggauguuaguccgcaauccacugucccggaacagcacacacgagauguacuggguguccugcgguacagguaacauagucuccgccgucaacaugaccucccgcaugcugcucaaucguuucaccauggcccaccggaaacccacguaugagcgcgacguggauuugggcgcggggacucggcacguugccguugagccagaaaucgccaaccuggauaucaucgggcagcgcaucgaaaacaucaaaaaugagcacaaaagcaccuggcacuacgaugaggauaaccccuacaaaacuugggccuaccacggcucuuacgaagucaagccuucagguuccgcuuccuccaugguuaacggagugguccgguugcugacaaagcccugggauguaaucccgauggugacccagaucgccaugacagacaccacgcccuucggccagcagagggucuucaaggaaaagguggacacgcggaccccgcgcccgaagaggggcacagcccagauuauggaggugacggccaagugguuguggggcuuccucucucggaacaagaaaccccggauaugcacuagggaggaguucacccggaagguaaggagcaaugccgccauuggagccguguuuguggacgagaaccaguggaacucugccaaggaggccgucgaggacgaacgguucugggaccucgugcauagagaacgggaacugcacaagcagggaaagugcgcgaccugcguuuauaacaugauggggaagcgggagaagaagcuaggugaguuugggaaggccaagggaagccgggcaauuugguauauguggcugggggcacgcuuccuggaguucgaagcauugggguucaugaacgaggaccauugguuuucucgggaaaacagccugucgggagucgagggggagggccuccacaagcucggguacauucugcgcgacaucagcaaaauccccggcggaaauauguaugccgaugauacggccgguugggacacccgcauaaccgaagaugacuuacagaacgaggcgaaaauaaccgacaucauggagccggagcaugccuuguuagcuacgucuauuuucaagcugaccuaccaaaacaagguuguccgcguccagcggcccgccaagagcggcaccguaauggacgugauuucccgacgcgaccagcggggaagcggccaggucgguacguacgggcugaacaccuucaccaacauggagguucaacugauccgucagauggaauccgaagggauuuucagcccuucugagcuggagaacuccaaccuggccgagcgcguacuggacuggcucgaaaaacacggcguugaacgccucaagcgaauggcaaucucaggcgacgacugcguggugaagccgaccgacgaccgcuuugccaccgcucuuacugcucucaacgacaugggaaaggucaggaaagacaucccucagugggagccgagcaagggcuggaacgacuggcaacagguccccuuuugcucccaccacuuucaccagcucaucaugaaggacggccgcgagaucguggucccgugccggaaccaggacgaauuaguggggcgcgcuagagugucccagggagccggcuggagccugagggaaaccgccugccucgggaaguccuacgcgcagauguggcagcugauguacuuccaccgccgcgaccugcggcucgccgccaaugccaucugcagcgccgugccggugaacuggguucccacaucacgcacgaccuggagcauccacgcgcaccaccaguggaugacgacugaagacaugcucuccgucuggaaccgcguuuggauagaggaaaacccuuggauggaggacaagacgcaugugagcuccugggaggauguccccuaccugggcaaacgagaggaccaguggugcggcagccucaucggccucaccgcccgcgcuacuugggccaccaauauccagguagcuaucaaucaggugcggcgccugauugggaaugaaaacuaucucgacuacaugaccuccaugaagcgguucaagaacgagagcgaccccgagggugcccugugguga

SEQ ID NO: 24747 - RNA, 9879 nt, Artificial Sequence
  derived and/or modified CDS sequence (opt11) from DENV-1__KM403586__SS-prME
agcguaaccaugcugcucaugcugcuccccacggcauuggcauuccaccugaccacaagaggcggggagccccacaugaucgugagcaagcaggagcggggcaaaucucuccucuucaagaccuccgcgggggugaauauguguacccugauugccauggacuuaggcgagcugugcgaggacacgaugacguacaaaugcccccggauuacugaggccgagcccgacgacguagacuguuggugcaacgccacagauaccuggguuacauacgggaccugcucacagaccggcgagcaccggcgcgacaagcguuccguagccuuggcgccgcaugugggccuaggccucgagacccgcaccgagaccuggauguccuccgagggcgccuggcggcaaauucagaaagucgagaccugggcucuccgccaccccggguucacggugaucgcguucuuccuggcgcacgccaucggcaccagcauaacccagaaagggauuaucuucauccuccugauguuggugaccccuuccauggcuaugcggugugugggaaucgggaaccgcgacuucguggaggggcucuccggcgccacguggguugacgucgugcuggagcacggguccugcgugaccacaauggccaagaacaagcccacccuggacaucgagcuccugaagacggaggucaccaaccccgcggugcugcggaagcugugcauugaggccaagauaagcaacaccaccacggacagucgcugccccacccagggcgaggcgacccugguggaggagcaggacgcgaacuucgucugccggcgcaccuucguggaccggggcuggggcaauggcugugggcuguucgguaaggggagccuccugacgugugccaaguucaaaugcguuaccaagcuggagggcaaaaucguccaguaugagaaccucaaguauagugugaucguuaccguccacaccggcgaccagcaucaaguggguaacgagacgacggagcacggcacgauagcgaccauaacgccccaggcccccacaucugagguccagcugaccgauuacggggcgcugacccucgacugcagcccccggaccgggcuggacuucaacgagaugguucugcucacgaugaaggagaaguccuggcuggugcacaagcagugguuccuggaccucccgcugcccuggacauccggggccagcaccucucaggagaccuggaaccggcaggaccuccucguaacguucaagaccgcccacgcgaagaagcaggaaguggugguccugggcucccaggagggcgccaugcacaccgcccucaccggggcuacugagauccagaccagcggcaccacgacgaucuuugccgggcaccucaagugccgcuuaaagauggauaagcugacgcucaagggcguguccuaugugaugugcacggggagcuucaagcuggagaaggaggucgcagagacccagcacggcacagugcuggugcaggucaaguacgaggguaccgacgcccccugcaagauacccaucucgacccaggacgagaagggggugacccaaaacggccggcugauaacggccaacccgaucgugaccgacaaggagaaacccgucaacaucgagaccgagccgcccuucggggaaucauacauugugaucggcgccggugagaaagcgcucaaacucucuugguucaagaagggcagcuccaucgguaagauguucgaggccaccgcccgcggggcccggcgcauggccauccuuggcgacacggcgugggacuucgguagcaucggcgguguuuucacguccgucggcaagcucgugcaccagguuuucggcaccgccuacgggguccuguucagcggagugaguuggaccaugaagaucgggaucggcauccuacucacgugguuaggucuaaacagucgcuccacuagccucuccaugaccugcaucgccguggggauggucacgcucuaccugggcgugaugguacaggccgacagcgggugcguuaucaacuggaagggccgggagcucaagugcgguuccggcaucuucgugacgaaugaagugcacacauggaccgagcaguacaaguuccaggccgacagcccaaagagacugagcgcggccaucgguaaggcgugggaggagggggucugcggcauccgguccgcaacccggcuggagaacauuauguggaagcagauaagcaacgagcucaaccacauccugcucgaaaacgacaugaaguucaccguggugguuggggaugccuacgguauccucacacaggggaagaagaugauacgcccccaacccauggagcacaaguacucguggaagucauggggcaaggcuaagaucaucggcgccgacacccagaacacaaccuuuaucaucgacggacccgacacgccggagugcccagacgaccaacgcgcuuggaacaucugggagguagaggacuacggcuucgggguauuuacaaccaacauauggcuuaaguuacgggacuccuacacccagaugugcgaccaucgucucaugagcgccgcaauuaaagacaguaaggccguccacgccgacaugggcuacuggauugagagcgagaagaacgagacguggaagcuggcccgggccuccuuuaucgaagugaagacaugcaucuggccccgcagccacacccuguggucaaacggcgugcucgaaagcgagaugauaauccccaagaucuacgggggcccgaucagucagcacaacuaccggcccggguacuucacccaaacggcgggccccuggcaccuggggaaguuggagcucgacuucaaucugugcgagggcaccacggucgugguggacgaacacugcggcaaccgcgggccuagccugcggaccaccacagucaccgggaagaucauccacgaguggugcugccgauccugcacccugccaccccugcgguuccgcggggaggaugggugcugguacgguauggagauacggcccgugaaggagaaggaggagaaccuggugcgcagcauggucuccgcggggagcggcgaggucgacagcuucuccuuagguuugcuuuguguaucaaucaugaucgaggaggucaugcggucccgcugguccagaaagaugcucaugacggggacuuuagccguuuucuuccugcucauuauggggcagcugaccuggaacgaccugauccggcucuguauuaugguuggcgccaaugucuccgaccgcauggggaugggcaccacguaccuugcccugauggcgacauucaagaugcggccgauguuugccgugggccuccuguucagacggcugacaucgcgcgaaguccuccuguuaaccaucgggcucucccugguggccucgguggagcugcccaacucccucgaagagcugggcgacgggcucgccaugggcaucaugaugcucaagcugcugacggacuuccagagccaccagcucuggaccacccugcugucccuaaccuucauuaagacgacccugagccuggacuacgccuggaagaccauggcgaugguccucuccaucgugagccuguucccgcugugucucuccacuacuucccagaaaaccaccuggcuucccgugcugcuugguuccuuuggcugcaagccgcugaccauguucuugauuaccgagaacaagauauggggccguaaaagcuggccccucaaugaggggauuauggccguaggcaucgugucuauucugcucagcucacugcugaagaacgacguaccccuggcagggccccucaucgcuggcggcaugcugaucgcgugcuacgucaucagcgggagcuccgccgaccugagccucgagcgagccgccgaaguguccugggaggaggaagccgagcacagcggcgcgagccacaacauccugguggagguccaggacgacgggacgaugaagaucaaagacgaggagcgggacgacacacugacuauacuccugaaggccaccuugcucgccgugagcggcguguacccgauguccauccccgccacauuauucgucugguauuucuggcaaaagaagaagcagaggagcggcguccugugggacacccccagcccgccagagguggagagggccguucucgacgauggcaucuaccggauccugcagcggggccugcugggccgcagccaggugggcguggggguauuccaggacggaguguuccacaccauguggcacgugacccgcggggcgguucuaauguaccagggcaagcgccuagagcccuccugggccucggugaagaaggaccugaucucuuacggcgggggauggcgauuccaggggucguggaacacgggcgaggaggugcaagucauagcagucgagcccgggaagaaccccaaaaacguccagacgacccccggcacauucaagacgcccgagggcgaggucggggccaucgcccuagacuucaagcccggcaccuccgggagccccaucgugaaccgcgagggcaaaaucgugggccuguacggaaacggugucgugaccacauccgggacguacgucagcgcgaucgcccaggccaaggccagccaggaaggaccgcuccccgagaucgaggacgaggucuuuaaaaagcggaaccucaccaucauggaccugcacccuggguccggcaaaacccgccgguaccugccggcaaucgugcgcgaggcgaucaagcgcaagcuccgcacccugauucuggcuccaacgcgcguggucgccagcgagauggccgaggccuuaaaaggcaugcccaucagauaccagaccacggccguuaaguccgagcacacggggaaggagaucguggaccugaugugccacgccacguucaccaugcgccugcucagcccaguccgggugccgaacuacaacaugaucaucauggacgaagcccacuucaccgaccccgccuccaucgcggcacggggcuacaucagcacucggguggggaugggagaggccgccgccaucuucaugacugcgacgccgcccggguccgucgaggccuucccgcagagcaacgccgugauccaagaugaggagcgcgacauccccgagcgcuccuggaacucuggguacgacuggaucacagacuuccccgguaagaccguaugguucguccccuccaucaagagcgggaacgacauagcuaacugccuaagaaagaacggcaagcguguaauccaacugucccgcaagacguuugacaccgaguaccagaagaccaagaacaacgacugggacuacguggucacaacggacaucagcgagaugggggccaauuuccgggcggaccgcgugauagacccgagacgcugccucaagcccgucauccuaaaggacggcccagagcgggugaucuuggccgggcccaugccggugaccgccgccuccgcggcacagcgccggggccgcaucggccgcaaccagaacaaggagggagaucaguacaucuacaugggccagccccucaauaaugacgaggaccacgcccacuggacagaggccaagaugcuacuugauaacaucaacacccccgaggggauaauucccgcccucuucgagccagagcgggagaaguccgcggccaucgacggagaguaccgcuuacguggggaggcccgaaagacguuugucgagcugaugcgucgcggcgaccucccaguguggcuguccuacaaaguugccagcgagggcuuccaguacuccgaccggcgcuggugcuucgacggugagcggaacaaccaagucuuagaggagaacauggacguggagaucuggaccaaagagggggagcgcaagaaacuacggccgcgcugguuagaugcacggacguauagcgacccccuggcgcuacgcgaguucaaggaauucgcagcuggacggcgcagcgugaguggggaccugauccuggagaucgguaagcuaccgcagcaccugacccugcgggcccagaaugcccucgacaacuuggucaugcugcacaacagcgagcagggcgggaaagcguaccgccacgccauggaggaguuacccgacacuaucgagacgcugaugcugcuggcccugauagcagugcugaccgggggcgucacccuuuucuuccuuuccgggaagggccugggcaaaaccagcaucgggcuccugugcgucauggcgagcagcgucuuacucuggauggcuuccguggagccacacuggaucgccgccagcaucauccuggaguucuuccugaugguccuccugauacccgagccggaccggcagcggacgccccaagacaaccagcuggccuacguggugaucgggcugcuguucaugauccugacugucgcagccaacgagaugggccuccuggagacgaccaagaaggacuuaggcaucgggcacgugguggccgagaaccaccaccacgccacuaugcucgauaucgaccugcaccccgccuccgcguggaccuuauacgccguagcuaccaccaucauuacgccuaugaugcggcacaccaucgagaacaccacagccaauaucucacucacggccaucgcuaaccaggccgccauccugaugggcuuggacaagggcuggcccaucaguaagauggacaucggggugccccuccuggcccugggcugcuauagccaggugaacccccucacccugaccgccgcgguacugaugcucguugcccauuacgccaucauagggccggguuugcaggcaaaggcgacgcgcgaggcccagaagcguacugccgccgggaucaugaagaaccccacuguagacgguaucguggccaucgaccuggaccccguuguuuacgaugcgaaguucgagaagcagcucggccaaaucauguugcugauucucugcaccucccagauccugcugaugcggacuaccugggcccucugugagagcaucacccuggccacugggccacugaccacacucugggagggcaguccugggcgcuuuuggaacacaaccaucgccgucagcauggccaacaucuuccguggcuccuaccuggcgggagcaggguuagccuucucccucaugaaaucccuggguggggggcgccgggggaccggcgcccagggcgagacguuaggggagaaguggaaacgccaacucaaccaguuaagcaagagcgaguuuaacacuuacaagcgguccgguaucauggagguggaccgcagcgaggccaaagaggggaugaaacgaggcgagaccaccaagcaugcggugucccgcgggacggccaagcugcggugguuugucgagcgcaaccucgugaagcccgagggcaaagugaucgaccugggcugcgggcggggcggguggagcuacuauugcgcaggccugaagaaggucaccgaagugaagggguacaccaagggcggccccgggcacgaggagccuaucccgauggcgaccuacggcuggaacaucguaaagcuacacucagggcgcgaugucuuuuucacgccgcccgagaagugcgacacauuacugugcgacaucggcgagucauccccuaacccgaccaucgaggagggacgcacccugcgcgugcucaaaaugguggaacccuggcugcgaggcaaccaauucugcaucaagauccugaaccccuacaugcccagcgucguggagacucucgagcagaugcagcgcaagcacggcgggaugcuggugagaaacccacugucucgaaacagcacucaugagauguauugggucuccugcgguaccgggaauaucgugucggcggugaacaugacuucccguaugcucuuaaaccgguuuaccauggcccaucgcaagcccacguacgaacgggacgucgacuugggcgccggcacucgccauguagccguggagcccgagaucgccaaccucgacaucauagggcagcggaucgagaacaucaagaacgagcacaagagcaccuggcacuacgacgaggacaaccccuacaagacgugggcguaccacggcuccuacgaggucaagccgagcggcuccgcgagcucgauggugaacggcgucguccgccugcugacgaagcccugggaugugaucccuauggucacacagaucgccaugacggacaccacgcccuucggacagcagcggguguucaaagagaagguggacacccgcaccccgcggcccaagcggggcaccgcccagaucauggaagucacggccaaauggcucuggggcuuccugagccggaacaagaagccccguaucuguacccgggaggaguucacccgcaaggugcggagcaacgcggccaucggggcuguguucgucgacgagaaccaauggaacucggcgaaagaggcaguugaggacgagagauuuugggaccugguccaccgcgagcgagagcuccacaagcagggcaaaugugcuaccugcgucuacaacaugauggggaaaagggagaagaagcugggcgaguucgggaaggccaaggguagccgcgccaucugguauauguggcucggcgcccgguuccucgaguucgaggcuuugggguuuaugaacgaggaccacugguuuucccgcgagaacagcuuguccgggguggaaggggagggccuacacaagcugggguacauccugcgcgacaucagcaagaucccgggcggcaacauguaugcggacgacacggcgggcugggacacccggauuaccgaagaugaccuccagaacgaagccaagaucaccgacaucauggagcccgagcacgcucugcucgccacgucuaucuucaagcucaccuaccagaacaagguaguccgugugcagcggcccgccaagagcggcaccgugauggauguaaucuccagaagggaccagcgcgggagcggucaagugggcaccuacgggcugaauaccuucacgaacauggaggugcagcugauccgucagauggaguccgagggcauuuucagccccuccgagcucgagaacagcaaccuggccgagcgcguccuugacuggcucgagaagcacgguguggagcggcugaagcgcauggccaucuccggagacgauugcguggucaagccgaccgacgaccgauucgcgaccgcgcuaaccgcccuaaaugacauggggaaggugcgcaaggacaucccccagugggagcccucuaaaggguggaacgauuggcaacaggucccauucugcucgcaccacuuccaucaacuaaucaugaaagacggccgggaaaucguaguuccgugccgcaaucaggacgaacugguggggcgggccagggucagccagggcgccggguggagccuccgggagaccgccugucugggcaaauccuacgcccagauguggcagcugauguacuuccaucgccgggaccuccgccuggcugccaacgccaucugcucggccguccccgugaauuggguccccaccucccgcacaacauggagcauccacgcccaccaucaguggaugacgaccgaggauaugcuguccguguggaacagaguguggauagaggagaaccccuggauggaggacaagacucauguuaguuccugggaggacgugccguaccuggggaagcgcgaggaccaguggugcggcagccucaucggccugacugcccgcgccacgugggccaccaacauacagguggcgaucaaccagguccgucggcucaucgggaacgagaacuaccuggacuacaugaccuccaugaagcgcuucaagaacgagagcgaccccgaaggcgcucugugguag

SEQ ID NO: 24748 - RNA, 9879 nt, Artificial Sequence
  derived and/or modified CDS sequence (opt11) from DENV-1__KM403602__SS-prME
aguguuaccaugcuuuugaugcugcugcccacagcguuggcuuuccaucucacuacacguggcggugagccacacaugaucgugucgaagcaagagcgcgggaagucgcuuuuguucaagaccuccgcggguguuaacaugugcacccugaucgccauggaccuuggcgagcuaugcgaggacacgaugaccuauaagugcccccggaucacggaagcugaacccgaugacgucgacuguuggugcaacgccaccgacaccuggguaaccuaugggacaugcagccagacgggcgagcaucggcgagacaagcgauccguggcccuggcgccucacgugggccuggggcucgagacucguaccgagaccuggaugucaucagagggugccuggcggcagauucagaagguggaaaccugggcccugcgccauccgggguucacgguuauugcccuauuccucgcgcacgccaucggaaccagcauaacccaaaaagggaucauuuuuauccugcugaugcucgugacgccaucaauggcaaugcggugugucggaauaggcaacagagacuucguggagggacugagcggcgcgacguggguggacgucgugcuagagcacgggucgugcgucaccacgauggcuaagaacaagcccacccuggacauugagcuguugaaaaccgaggugaccaaucccgcagugcuccggaagcucugcauagaggcuaagaucucaaacaccaccacggauucccggugcccgacccagggcgaggccacccugguggaagaacaggacgccaauuucgucugccgcagaacauucguggaucggggcugggggaacggcugcggccucuucgggaaagggagcuugcucacgugugccaaauucaagugcgucacgaagcucgaagggaagauuguccaguacgagaaccugaaguacagugugaucgucaccguucacacaggcgaccagcaccaggucggcaaugagacgaccgagcacggaacaaucgcgaccaucacaccacaggcccccacguccgaaauacagcuuacagacuacggggcaaucacgcucgacuguagcccucgcaccggccuggacuucaacgaaaugguguuauugaccaugaaggagaaauccuggcuagugcacaagcaaugguuucucgaccucccgcuucccuggaccuccggggccucaacaagccaggagaccuggaaucggcaggacuugcuugugacguucaaaaccgcccacgcgaagaagcaggagguugucgugcuggguucccaggaaggcgcuaugcacaccgcccugacgggggccacggagauccagaccucgggcaccacuacgauuuucgccggccaucucaagugccgacugaagauggacaaacugacgcucaagggcgucuccuacgugauguguaccggaucguucaagcucgagaaagaaguggcagaaacucagcacggcacuguccucguccaggugaaguacgaggggaccgacgccccgugcaaaaucccgaucuccacucaggacgagaagggaguaacacagaaugggcggcugaucacggccaacccaauuguaaccgacaaagagaagcccgucaacaucgaaaccgaaccgccuuucggggagagcuacauugucauuggcgccggugaaaaggcucucaagcuguccugguucaaaaaggggucgucuauaggcaagauguuugaggccaccgcucgcggggcuagacgcauggcaauacucggggauaccgcgugggacuuugggagcaucggcgggguguuuaccuccguggggaaacucguccaccagguauuuggcacagcuuaugggguccuguucucuggcgucaguuggaccaugaagaucgggauaggcaucuuacucacguggcugggauugaauucccgcagcaccagucuguccaugaccugcauagcgguugggauggugacccuguaccugggggucauggugcaggccgacagcgguugcguuaucaacuggaagggcagagagcuaaagugcgguuccgguaucuucgugacaaacgaagugcacaccuggaccgagcaguauaaauuucaagccgacucuccgaaacguuugagcgcagcuauaggaaaggccugggaggagggggugugcggaauacggucugcuaccaggcuggagaacaucauguggaagcaaaucucgagcgagcucaaccauauucugcuggagaaugacaugaaguucaccguggugguuggggacgccaaugggauacucacgcagggcaagaagaugauuaggccgcagcccauggaacacaaguauagcuggaaguccuggggcaaggccaagauaaucggagccgacacccaaaacaccacauucaucauagacgggcccgacacgccggagugccccgacgaccagcgcgcguggaauaucugggaagucgaggacuacgguuucggcguguucaccaccaacauauggcugaagcugcgggacucguacacccagaugugcgaccaccgccucaugagugccgcgauaaaggacagcaaagccgugcacgccgacaugggcuacuggauugagucugagaagaacgaaacguggaagcuggcccgggcaaguuucauagagguaaaaaccugcaucuggccucgcucccacacacuuuggagcaacggcguacucgagucagaaaugauaauacccaaaauuuacggggguccaaucucccaacauaacuaccgucccggguacuucacccagacggcuggucccuggcaccucgggaagcuggagcucgacuucaaucugugcgagggcaccaccguggucguggacgagcacugcggcaaucgcgguccuucccuucggacgacuaccgugaccggcaaaaucauacaugaauggugcugccgcagcugcacccugccgccguugcgguuccgcggagaggacgguuguugguaugggauggagauucgacccgucaaggaaaaggaagagaacuuagugcguuccaugguuuccgcgggaucuggggaagucgacuccuucucacuggggcuguuaugcgugagcauaaugaucgaggaggugaugcggucgcgcugguccaagaagaugcugaugaccggcacccucgccgucuucuuucugcucaucaugggccagcuaaccuggaaugaccucauacgauuaugcauaauggugggcgcaaacgugucggaccggauggggaugggaaccacguaccuggcacugauggcgacauucaaaaugcgccccauguucgcugucgggcuccuguuucggcggcuuacgucccgggagguucuccuccugaccaucggccucucgcuagucgcuuccguggagcuccccaacucgcuagaggaacuuggcgacggucuggcgaugggcaucaugaugcuaaagcugcuuacggauuuucagucccaucagcucuggaccacacugcucagccucaccuucauaaaaacgacccugucuuuggacuacgccuggaagaccauggccauggugcuuagcauuguaucgcuguucccccugugccucagcacgacgucgcaaaagaccacgugguugccagugcucuuaggguccuucggcuguaagccguugaccauguuucuuauaaccgagaauaagaucuggggccgcaagagcuggccccucaacgaggggaucauggccguaggcaucgucagcauccuguugucuucacugcugaagaaugaugugccccuggccgggcccuugaucgccggaggcaugcugauugcgugcuacgugauaagcggguccucugcagaucugucacucgagcgggccgcugaagucucaugggaggaggaagccgaacauuccggcgcgagccacaacaucuugguggaagugcaagaugacgggacgaugaagaucaaggaugaggaaagagacgacacgcugacgauccuccugaaggccacccugcucgcaguuuccggcguguacccgauguccaucccugcuacucuuuucgugugguacuucuggcagaagaagaaacagagauccgggguccugugggacacccccagcccgcccgagguagaacgagccguccucgacgacggcaucuaucggauccugcaacgcggccugcuagggcggucucaagucgguguaggcguuuuccaggacggcgucuuccacacaauguggcacguuacccgcggagcugugcucauguaccagggcaagcgccucgagcccucgugggccuccgucaagaaagaccugaucagcuacggcgggggcuggcgguuccaggguuccuggaacacgggagaggagguccaagugaucgccgucgaaccggggaagaaccccaagaacgugcagaccacucccggcaccuuuaagacaccugaaggcgaggucggggcuaucgcucucgacuucaagcccggcaccuccgggucccccauagucaaccgugaggggaagaucgugggacuguaugggaacggaguagucaccaccucagggacuuacgugagcgcgaucgcucaggccaaggccucacaggagggcccucugcccgagaucgaggacgagguuuucaagaaacgcaaccugacgauuauggaccugcaccccggguccggcaagacgcggcgcuaccucccggccaucguccgggaagccauaaagcgcaaacugcgcacgcugauccuugcgcccacgcgcgugguggccuccgagauggccgaagcgcucaagggcaugcccauccgguaccagaccaccgcagucaagucagagcauacaggcaaagagauaguggaucugaugugccacgccacguucaccaugcgacugcucuccccagugcgcgugccgaauuacaauaugauuaucauggacgaggcacacuuuaccgaccccgccuccaucgccgcccgcggguacaucuccacccgcguggggaugggcgaagccgccgccaucuuuaugacugcgacgccccccggaucaguggaggccuucccgcagucaaacgccguuauccaggacgaggagcgggacaucccggagcgcucguggaauuccggcuacgacuggauuaccgacuuccccggcaagacaguaugguucgugccuagcaucaaauccgggaacgauauugccaacugccugcggaagaacggcaagcgcguaauacagcugagccguaagacguuugacaccgaauaccagaagaccaagaauaaugacugggacuauguggugacuacggacauuuccgagaugggggccaacuuccgggccgacagagucauagacccgagaagaugucucaagcccguaaucuugaaagacggccccgagagggucauacuggccggucccaugccuguuacggcggcaucagcugcccaacgccgcggccgcaucggucgcaaccagaacaaggagggcgaccaguacaucuacaugggccagccccugaauaacgacgaggaccacgcucacuggacagaagccaagaugcugcucgauaauaucaacacccccgaagggaucauccccgcauuauucgagccggaacgcgaaaaauccgcggccaucgacggggaauaccggcugcguggagaggcucgaaaaaccuucgucgagcugaugcgccggggugacuugcccgucuggcuuucguacaaggucgccucagagggcuuccaguauagcgauaggcgguggugcuucgacggggaacgcaauaaucagguguuagaggaaaauauggacguugagaucuggaccaaagaaggggaacggaagaaauuacgcccccgcugguuggaugcccgcacuuauagcgaccccuuggcccuccgugaauuuaaggaguucgcagccggacgccggagcgugagcggcgaccugauccuugagaucggcaaacuaccgcaacaucugacccugcgcgcccagaacgcucucgacaaccugguaauguuacacaacuccgagcagggagguaaggcguauaggcacgccauggaggagcugcccgacacuaucgagacacuaaugcugcucgccuuaaucgcuguucugaccggaggcguuacgcucuucuuucugucggggaaaggccuggguaagaccuccaucggucuccugugcguaauggcaagcaguguccucuuauggauggcgagcguggagccucacuggauugcggccaguaucauccuggaguuuuuccugaugguacuccugaucccagaaccggaccgccagcguaccccccaggacaaccagcuugccuaugucgugauuggccuccuguuuaugauucugaccgucgcggccaacgaaauggggcuccuggagaccaccaaaaaggaucucggcaucgggcacguaguggccgagaaccaucaccacgcuaccaugcucgacauugaccugcacccggccucggccuggacccuguaugccguggcuacaaccaucauaacuccgaugaugcgccacaccaucgagaauaccaccgccaauaucucccucacggccaucgcgaaccaggcagccauucucaugggccucgauaaggguuggcccaucagcaagauggacaucggggucccccuccuggcauuaggcugcuacagucaggugaauccccucacucucacagcagcgguacugauguuggucgcccacuacgcgauaaucggucccggccugcaggccaaggcgacccgggaggcccagaagcgcacggccgccgguauaaugaagaacccaaccguggacggcaucguggccaucgaccuagacccugucguuuacgacgcuaaauucgagaagcagcucgggcagaucaugcugcugauccucugcaccucccagaucuugcugaugcgcacuacgugggcacucugugagucaaucacccuggccaccggcccacugacgacccucugggagggcagcccggggaaguuuuggaacaccaccaucgccgucagcauggccaacaucuuccguggaaguuaccuugcaggcgccggacuggcuuucucccucaugaagucgcuaggcggcggccgccgcgggaccggcgcgcagggcgagacccugggggagaaguggaagcgccagcuuaaucagcuuagcaaguccgaguucaacacguacaagagaagcgggaucauggaggucgaccgcagcgaagcaaaagagggcuugaagcggggugagaccaccaaacaugcggucucccgcggaacggccaagcuccggugguucguggagagaaaucuggucaagcccgaggguaaggugaucgauuuaggcugcgggcggggcggcugguccuacuauugcgccggucucaaaaaggugaccgaggugaagggguacaccaaggggggcccugggcaugaggagcccaucccgauggcaaccuacggcuggaacaucgucaagcuucauucggggagagauguuuucuucaccccgccagaaaaaugcgacacguuacugugcgacaucggcgaauccagcccuaacccgaccaucgaggaggggagaacgcugcgcguccugaagaugguggagccaugguuacggggcaaccaguucugcaucaaaauacugaacccuuacaugcccuccguuguagagacacucgagcaaaugcaacgcaagcauggggguauguugguucggaacccccuaucacgcaauuccacgcaugagauguauugggugucgugcggaaccgggaacaucgucuccgcugucaacaugaccagcagaaugcuucugaaucgcuucaccauggcccaccgcaagcccaccuaugagcgagacguggaccucggggccggaacccgacacgucgccguggagcccgagaucgccaaccuggauaucauuggacagcggaucgagaacaucaagaacgaacauaaaagcaccuggcacuaugacgaggauaaccccuauaagacuugggcauaucacggcucauacgaggugaagccguccgggucggccuccagcauggucaauggcgucguucgccugcuaacgaagccuugggacgugauccccaugguuacgcagaucgccaugacugauacaacgccguucgggcagcaacgggucuucaaagagaagguagacacgcgcacgccgagacccaagcguggcaccgcccagaucauggaggugacggccaaauggcuguggggcuuccucagccggaacaagaagccccgcauuugcacccgggaggaguuuacucgcaagguucgcuccaaugcggcaaucggugccguguucguagacgagaaccaauggaacucugccaaagaagccgucgaagacgagcgauucugggaccuugugcaucgggagcgggagcugcacaaacagggcaagugcgccaccugcguguacaauaugaugggaaagcgggagaaaaaacuaggcgaauucgggaaggcgaaaggcucccgggccauaugguacauguggcucggagcccgguuccuagaguucgaggcgcugggguuuaugaacgaggaccacugguuuucccgcgaaaauucucucagcggcguagaaggggagggccugcacaaacugggcuacauccuccgggacaucagcaagauaccgggcggcaacauguacgcagaugacacugccgguugggacacccgcauuaccgaggacgaccugcagaaugaggcaaagaucacagacauaauggagcccgagcacgcgcugcucgcuacgagcaucuucaagcugaccuaccagaacaagguggugcgcguccagcggcccgcaaaguccggcaccgugauggacgucaucagccgccgggaucagcgcggguccggucagguugggaccuacgggcuaaacacguuuaccaacauggagguucagcucauacggcagauggagagcgaggggaucuucucccccagcgagcuggagaacucuaaccuugccgagcgcgugcuggacuggcuggagaagcacgggguggagcgacugaagaggauggcuauaucaggcgaugacugcgugguuaagccaaccgacgaccgguucgccaccgcgcucacggcccugaacgacaugggaaagguccgcaaagauaucccacagugggaacccuccaaggguuggaacgacuggcaacagguccccuucugcucucaccacuuccaucagcugaucaugaaggacggucgggagaucgucgucccgugccgcaaucaggacgaguuaguggggagggcgcgcgugagccagggcgcuggguggagccugcgggagacugccugccucgggaaaucguaugcgcagauguggcagcucauguacuuccauaggcgggaucugcgacuggccgcgaaugccaucugcucggccguacccguuaacugggugcccaccagccggacgacuugguccauacacgcgcaccaucaguggaugacgaccgaggacaugcucagcgucuggaaucgcguguggaucgaagagaaccccuggauggaggacaagacccauguguccagcugggaggacgucccguacuuggggaaacgcgaggaccaauggugcgguucccugaucggccucaccgcacgggccacuugggcaaccaacauccagguggcgaucaaccaggugcgucggcuuaucggaaacgaaaauuauuuagacuauaugaccagcaugaagcgcuuuaagaacgagucggaccccgaaggcgcccuuugguga

SEQ ID NO: 24749 - RNA, 9879 nt, Artificial Sequence
  derived and/or modified CDS sequence (opt11) from DENV-1__KM403582__SS-prME
agcgugaccaugcugcuuaugcuuuuacccaccgcccuggccuuccaucugacaacgcgggguggcgagccgcacaugaucguaagcaagcaagagcguggcaagagccuccuauucaaaaccuccgccggggugaacaugugcacccugaucgccauggaccugggcgagcucugcgaagauacuaugaccuacaagugcccccggaucaccgaagccgagccugacgauguggacugcuggugcaaugccaccgacacaugggugacuuacgggacaugcucccagaccggcgagcaccggcgagaccgaagguccguagcccuggcgccccacgugggccuggggcucgagacccggacugagacguggaugagcucggagggcgcguggagacagauccagcggguggagaccugggcccugcgccaccccggguucaccguuaucgcccuguuccucgcgcacgccaucggcacaucuaucacccagaaggggauuauauucaucuugcugaugcugguuacccccuccauggcuaugcgcugcguuggcaucggcaaccgcgacuucguggaggggcuaagcggcgcuacguggguggaugucguucuggagcacggguccugcgugacuacgauggccaaaaauaagcccacccucgacaucgaacugcugaagaccgaggucaccaaccccgcggugcuccggaagcugugcaucgaggccaagaucucaaauacuacuacggacucccgcugccccacccagggcgaggccaccuuaguggaagagcaagacgccaacuucgucugccggcgcaccuuuguggacagggggugggggaacggcuguggccuguuugggaaggggagccuuuugacuugcgccaaguucaagugcgugaccaagcucgagggcaagaucguacaauacgagaaccugaaguacuccgugaucgugaccguccacacaggcgaccaacaccaaguggggaacgaaaccacugagcauggcacuauagcuaccaucacgccccaagccccgacaucugagauccaguuaacugacuacggggcccucacccuggacugcagcccacggacaggccuggacuucaacgagauggugcuccugacgaugaaggagaagagcuggcuggugcacaagcaaugguuucucgaccugccgcugccuuggaccaguggggccucaaccucccaggagaccuggaaucggcaggacuugcuggugacauucaagaccgcgcacgcgaagaagcaggaggugguggugcugggcucccaagaaggcgcuaugcacaccgcccucaccggggccacggagauccagaccagcggaacgaccacgauuuuugccgggcacuuaaagugccgccugaaaauggacaagcucacccugaagggugucagcuacgugaugugcaccggcagcuuuaaacuagaaaaggagguggcggagacccagcacggcacgguccugguccagguuaaguaugagggaacggacgcgcccugcaagauccccaucucuacccaggaugagaagggggucacccagaacgguagguuaaucacggcgaaccccauuguuaccgacaaggagaagccugugaacauagagaccgagccgcccuucggggaguccuacaucgucaucggcgccggcgagaaagcgcugaagcuguccugguucaagaagggcagcucaaucggcaagauguucgaagccaccgcgcgaggugcacggcggauggccauccucggcgacacggcgugggauuucggaaguaucggggguguuuucaccuccgucggcaagcuaguccaucaaguguucggcaccgcguacggggugcuguucagcggcguauccuggacuaugaagauagggauagguaucuuacugacguggcugggacuuaacuccagguccacuagccuuuccaugaccugcaucgccguggggauggugacccucuaccucggcgucauggugcaagccgacagcgggugcgugauaaacuggaagggucgggagcucaagugcggguccggaaucuucgucacuaacgaggugcacaccuggacggagcaguacaaauuccaggcggacucuccuaagcggcugagcgcggcaaucggcaaagccugggaagaaggggugugcggcauccgcuccaccacccgccucgagaacauuauguggaagcagauuaguaaugaacugaaccacauucugcucgagaacgacaugaaguuuaccgucgugguaggugacgcaaacggcauccugacacaggggaagaagaugauccggccccagcccauggagcacaaguacuccuggaaauccugggguaaggccaagaucauuggcgcggacacccagaacacgacguucaucaucgacggacccgauaccccggaguguccagacgaccaacgcgccuggaacaucugggaagucgaagauuacggcuucgggguguucaccaccaacauuugguugaagcuccgggacuccuacacgcaaaugugcgaccaccgccugaugagcgccgccaucaaggacuccaaagccgugcaugccgacaugggcuacuggaucgagagcgagaagaacgaaaccuggaagcuggcucgagccuccuucaucgaggucaagacgugcaucuggccucgcagccacacccucugguccaacggcguacuggagagcgagauggugauacccaaaaucuacgggggcccgaucucccagcauaacuaucggccgggcuacuucacgcagaccgcgggcccauggcacuuggggaagcucgaguuagacuucaaccugugugagggcaccaccgucgugguggacgaacacugcggcaaccgcgggccgagccuccggacgaccacagucaccggcaagaucauccacgaauggugcugccgcuccugcacgcuucccccacugcgguucagaggggaggacggcugcugguacgggauggagauccggccugugaaggagaaggaagagaaccucguacgcagcauggucuccgcgggcagcggugaaguagauagcuucagucuggggcugcuaugcgugagcaucaugaucgaggagguaaugcgcucccgguggagccgcaagaugcugaugacgggcacccuagccaucuucuucuuacuuaucaugggccaguuaaccuggaacgaccucauccggcuguguauuauggucggcgcaaacguguccgaccgcauggggaugggaacuacguaccuugccuugauggccaccuucaagaugcggccgauguuugcggucggacuccuguuccgccgucucaccagccgcgagguccugcugcucacgaucgggcugucacuggucgccuccguggagcucccgaacucccuugaggagcuaggcgacggccucgccaugggcaucaugaugcugaagcuccucaccgacuuccagagccaccaguuguggacuacacugcucucccugacguucaucaagacuacccugucgcucgacuacgccuggaagacuauggcaaugguauuaucaaucgucagccuguucccucugugccuguccacgacuagccagaaaaccaccuggcugccggugcuccucggauccuuuggaugcaaaccgcucaccauguuccucaucaccgagaacaaaaucuggggccgcaagucuuggccccugaaugaagggauaauggcugugggcaucguuuccaucuugcuuucuagccugcugaaaaacgacgugccucuugcugggccccugaucgccggcggcaugcugaucgccuguuacgugauuagugguagcuccgcugaccucagccuggaaagagccgcugaaguguccugggaggaggaggccgagcacucgggcgccucccacaacauacuggucgaggugcaggaugaugggaccaugaagaucaaggacgaggaacgugacgauacccucacuauccugcucaaggcgacgcuccucgccgucagcggcguguacccgaugucgauccccgccaccuuguucgugugguauuucuggcagaagaagaagcagcgcagcgggguccucugggauacccccagcccgccagagguagagcgggccgugcuagacgacggaaucuaccgcauccuccagcgaggccuucuagggcgcagccagguagggguggggguguuccaggauggcgucuuccacacaauguggcacgugacgcgcggggccgugcugauguaccaggguaagcgccucgagccguccugggcaagcgucaaaaaagaccugaucuccuauggcgggggcuggcguuuccaggggucuuggaacacuggcgaggagguccaaguuauugcggucgagccugggaagaacccaaaaaacgugcagaccacccccggcacguucaaaacgccagagggcgaggugggggccauagcccuugacuuuaagcccgggaccuccggaucaccaaucgucaaccgcgagggcaagaucgugggccucuacgguaacggcguuguaaccacuuccgggaccuacguguccgccaucgcgcaggccaaggccagccaggagggcccgcuccccgagauugaggacgagguguucaagaagaggaaccuaacgauuauggaccugcaccccgggaguggcaagacucgccgcuauuuaccggccaucguccgggaggcaauuaagcgcaagcugcggacgcugauacucgcgcccacccgcgugguggccagcgaaauggcagaagcucugaagggcaugcccauccgguaccaaaccacggcggucaagagugagcacacggguaaagagauuguugaccucaugugccacgccacauucaccaugaggcuccugagccccgugcggguaccgaacuauaacaugauuaucauggacgaagcacauuucaccgaccccgccaguaucgccgcgagaggcuacaucagcacacguguggggaugggcgaggcugcagccaucuucaugacggccacgccgccgggcuccguagaggcguucccgcagagcaacgcugucauacaggacgaggagcgcgacauccccgagcgguccuggaacagcggcuaugacuggaucacugacuuccccggcaagacggugugguucgugccguccauaaagucagggaaugacauugccaacugccuccgcaagaacgggaagcgggucauccagcucucccgcaaaaccuucgacaccgaguaccagaagacuaagaacaacgacugggacuacgugguaacgacugauaucagcgaaaugggggcuaauuucagggccgaccgcgucauugacccgcggagaugccugaagcccgugauccugaaggacggccccgagcggguuauccucgcgggccccaugcccgucaccgccgccucagcugcgcagcgcagaggccggaucggccgaaaucaaaacaaggagggggaccaguacaucuacaugggucagccccugaacaaugacgaagaucaugcccauuggaccgaggcgaagaugcugcucgacaauauuaacacaccagaggggauaauccccgcccuguucgagccggaacgcgagaagucugccgcgaucgacggugaguaccgucugcgcggugaggcccgaaagacauucguugaacucaugagacgcggcgaccugcccguauggcuguccuacaaggucgccagcgagggcuuccaguacuccgaccggcgcuggugcuucgacggggagcggaacaaccaggugcuugaggagaacauggacgucgagauuuggacgaaggagggcgagagaaagaagcugcggccccgcuggcuggacgcccggaccuacuccgacccccucgcccugagggaguuuaaggaguucgcggccgggcggcgcagcguguccggggaucugauucucgaaaucggaaaacucccacagcaccugacccuccgggcccagaacgcccuggacaaccuggugaugcuccacaacagugagcagggagggaaggccuaucgccacgcgauggaggagcuucccgacacgaucgagacucugaugcugcuggcccugauugccguccucaccggcggcgugacccuguucuuuuuaagugggaagggucuuggcaagaccucgaucggucugcugugcgugauggccuccagcgucuuauuauggauggcgagcguggaaccccacuggauugcugccagcaucauccuagaguucuuuuugauggugcugcugauccccgagccggaccgucagcguacgccucaggacaaucaguuggccuaugucgugaucggccugcuuuucaugauccucacgguggccgcgaacgagauggggcugcuggagaccacgaagaaggaccucgggaucgggcacgucguggccgagaaccaccaccacgccaccauguuggacaucgaccugcaccccgcauccgccuggacccucuacgccgucgcuaccaccauaaucaccccgaugaugcgccacaccaucgagaacaccaccgcuaacaucagccugaccgccaucgccaaccaggcggcgauccugaugggucuagacaagggauggcccaucuccaagauggacauugggguccccuuacuggcccucggcugcuacucgcagguuaacccccugacccugacugccgcugugcucaugcugguggcgcauuacgcaaucaucgggccgggccuccaggccaaggccacgcgggaggcgcagaaacgcaccgccgccggaaucaugaaaaaucccaccguugacggcaucguggccauagaccucgaccccgucguguacgacgccaaguucgaaaagcagcugggccagaucaugcugcuaauacugugcacgagucagauucuccucaugcggaccaccugggcgcuaugcgaguccaucacgcuggccaccgggccccuaacaacacugugggagggauccccggggaaguucuggaacacuaccaucgcugugagcauggccaauaucuuuagggguuccuacuuggccggcgccgggcucgccuucagcuugaugaagucccugggcgggggccggcgggggacgggcgcccaaggagagacgcucggggagaaauggaagcgacagcugaaccaguugucgaagucggaguucaacaccuacaagaggucaggcaucauggaggucgaccggucggaagccaaggagggucucaagaggggcgagaccaccaagcacgcagucucccgggggaccgcgaagcugcgcugguucguugaacggaaccuugucaagcccgagggcaagguaaucgaccugggaugcggccgcgguggguggagcuacuacugugccggcuuaaagaaggugacggagguaaaaggauacacgaagggaggccccgggcacgaggagcccauccccauggcuaccuacggguggaauaucguuaagcugcacuccggacgggacguguucuucacuccacccgagaagugcgacacccugcucugugacaucggagaaagcucccccaauccuaccaucgaggaggggcgcacccugcggguccugaagaugguggagcccugguugcgcggcaaccaguucugcaucaaaauacugaaucccuacaugcccagcguggucgagacgcuggagcagaugcagcggaagcacggcgggaugcucguccggaacccguugagccgcaacagcacccacgagauguacugggucuccugcggcaccggaaacaucguuagcgccgugaacaugaccucccggaugcugcucaaccgcuucaccauggcccaccggaagcccacuuacgagcgcgacguggaccugggcgccggcacacgucacgucgcggucgaacccgagacggccaaccuggauaucauaggccagagaaucgagaauaucaaaaacgagcauaagaguacauggcacuacgacgaagacaaucccuacaagaccugggcguaccacggcucuuaugaggugaagccgagcggcuccgcgucguccauggugaacggcgucguccgguuauugacuaaacccugggacgugauccccauggugacccaaaucgccaugaccgacacaaccccguucgggcaacagcgagucuucaaagagaaggucgacacccggacgccgcggccgaagcgcggcacagcccaaaucauggaagucacggcgaaguggcuguggggauuccucucgcgcaacaagaaaccccggaucugcacccgcgaggaguucacgcggaagguccgcucgaacgccgcgaucggagccgucuuuguagacgagaaccaguggaacuccgcgaaggaggccgucgaggacgagcgguucugggaccuggugcacagggagcgggagcugcacaaacaggguaagugcgcgaccugcguguacaacaugaugggaaaacgugagaagaagcucggggaauucgggaaggcuaagggcagccgggccaucugguacauguggcugggcgcccgcuuccuggaguucgaagcccucggcuucaugaacgaagaccacugguucucccgcgagaacagccugucuggcguagagggggaaggccuucacaaacucggguacauuuuacgggacaucaguaaaaucccgggcgguaauauguacgcagacgauaccgccggcugggacacccggaucacggaggaugaucugcagaacgaggccaaaaucacugacauaauggagcccgagcacgcccuccuggccaccuccaucuuuaagcugaccuaccagaacaagguggugcggguacagcgccccgccaagagcggcacggugauggacgugauaucacggagggaccagcgggggagcggacaagugggcaccuacgggcuaaacaccuucaccaacauggaggugcaauuaauccgacagauggaguccgagggcauauucagcccauccgagcuggagaacaguaaccucgcggagcgggucuuggacuggcuggaaaaacacggggucgagcgccucaagcggauggccaucuccggagaugacugcguugugaagccaaccgacgaccgcuuugcuaccgcccugaccgcacuaaacgacauggggaagguccggaaggauauaccccagugggagcccagcaagggcuggaacgacuggcagcagguccccuucugcagccaccacuuccaccaacucauuaugaaggacggacgcgagaucguggucccgugccggaaccaggaugaacugguggguagagcccgggugagccaaggcgcgggguggucacugcgcgagaccgcgugucucggcaaguccuacgcccagauguggcaacugauguacuuucacaggcgcgaccugcgccucgcggcuaacgccaucugcagcgcagugcccgugaacugggugccuacuucccggacgaccuggagcauacacgcccaccaccaguggaugaccacugaggacaugcuguccguguggaaucgcguguggaucgaggagaaucccuggauggaggacaagacgcacgucagcuccugggaggacgugccguaccuggggaagcgggaggaccaauggugcggcagccucaucggucugaccgcacgcgccaccugggcgaccaacauucagguggccauuaaccaagugcggcgccugaucgggaaugagaacuaccucgacuacaugacaucaaugaagcgguucaagaacgagucugaccccgagggcgcgcuaugguga

SEQ ID NO: 24750 - RNA, 9879 nt, Artificial Sequence
  derived and/or modified CDS sequence (opt11) from DENV-1__KM403577__SS-prME
agcgugaccaugcugcucaugcuccugcccaccgcccucgccuuccaucugaccacccggggaggggagccccacaugaucgucagcaagcaggagcgcggcaagucacuccucuucaagaccuccgcgggggugaacaugugcacccugauagccauggaccuuggggagcucugcgaggauacgaugaccuauaagugcccccggauuaccgaggccgagcccgacgacguagauugcugguguaacgccacugacaccugggugaccuacgggacuugcucucaaaccggcgagcaucgacgugauaagcgcuccguugccuuagcgccccacgugggccuggggcucgagacgcgcaccgagaccuggaugucuucagagggugccuggagacagauccagaaggucgagaccugggcgcugcgccaccccgguuucacggugauagccuucuuccuggcgcaugcuauagggaccagcaucacccagaagggcauaaucuucauccuucugaugcuggugacccccuccauggccaugcggugcgucgggaucggaaaccgcgacuucguggaggggcucagcggcgccaccuggguggacgucgugcuggagcacggguccugugugaccaccauggccaaaaacaaacccaccuuagacaucgagcuucugaagacggaggugacuaauccugccguucuucggaagcuaugcaucgaggcgaaaaucagcaacacuaccacggacucccgcugccccacccagggcgaggccacccugguggaggagcaggacgccaacuucgucugccggcgcaccuucguggaccggggcugggggaacggcugcgggcuuuucggcaaggggagcuuacugacgugcgccaaauucaagugcgugaccaagcuggagggcaaaaucguccaguacgaaaaccucaaguacagcgugauugugacaguccacaccggggaccagcaucaggucgggaacgagacgaccgagcacggcaccaucgcgaccauuacaccccaagcccccacgagcgaaauacagcugaccgacuacggggcacugacccucgacugcucuccgcggaccggauuggacuucaacgaaauggugcuacuuacgaugaaggagaaguccuggcugguccacaagcagugguuccuggaccucccgcugcccuggaccucaggggcuagcacuucgcaggagaccuggaaccggcaggaccuguuggugacguucaagaccgcucacgcgaaaaagcaggagguaguggugcuggguucccaagagggcgcaaugcacacagcccugaccggggccacggagauacaaaccagcggcaccaccaccauauucgcagggcaccucaagugccgcuuaaagauggacaagcugacccucaagggagucagcuaugugaugugcaccgggagcuucaagcuggagaaagaaguggcggagacccagcacggaacgguguugguccaagugaaguacgagggcaccgacgcgccgugcaagauacccauuagcacucaagacgagaaggggguaacccagaacggccggcugaucacagcgaaccccaucguaaccgacaaggagaagcccgugaacauugagaccgagccgccuuucggggagagcuacaucguaaucggcgccggugagaaggcgcugaagcugucgugguucaagaaggggaguuccaucgguaagauguucgaagcgacugcacgcggggcacggcgcauggccaucuugggcgacacggcaugggauuuugguagcaucggcgggguguucaccuccgucggcaaauuaguccaccaaguguucggcaccgccuacgggguacuguucaguggugucucguggacaaugaagaucgggaucggcauccugcucacguggcugggguugaacucgcgcucgacuagccucaguaugaccugcauagcaguuggcauggugacguuauaccuuggugugauggugcaggccgacucggggugcgugaucaauuggaagggccgggagcucaagugcggguccggcaucuuugucacgaacgaggugcauaccuggaccgagcaguacaaguuccaagcagauagcccgaagcgcuugucugcggccaucgggaaagccugggaggagggagugugcggcauccgguccgcaacacgccuggagaacaucauguggaagcagaucucaaacgaguugaaucacauacugcucgaaaacgauaugaaguucaccgucguggugggggacgccaacggcauccugacucagggcaagaagaugauucggccccagcccauggagcacaaauacuccuggaagaguuggggcaaggcgaaaaucaucggugccgauacccagaauaccaccuucaucaucgaugggccugacaccccggagugccccgacgaucaacgcgcauggaacauaugggaggucgaggacuauggcuucggaguguucacgacgaacaucuggcugaagcuccgggacuccuauacccagaugugcgaccaccgucucaugagugcagcgaucaaggacuccaaggcggugcaugccgauaugggcuacuggaucgaaucggaaaagaacgagacguggaaguuggcgagggccucguuuauagaaguaaagacaugcaucuggccccgcagccacacucuguggaguaacggcgugcucgagucagagaugaucauacccaagaucuacgggggcccaauaucccagcacaacuaccggccuggguacuucacacagacggcgggcccguggcaccugggaaaacuugagcucgacuuuaacuuaugcgagggcaccacgguggucgucgacgagcacugcggcaaccgggggccgagccugcgcaccacaaccguuaccggcaagauuauccacgaaugguguugccgcuccuguacacugccgccucugagauuucgcggagaagacggcuguugguacgggauggagauccggccggucaaggagaaggaggagaaccuggucagaagcaugguuuccgccggcagcggcgaaguugacagcuucucucuagggcuucugugcgugucgaucaugauugaagagguuaugcgcagucgauggucucgcaagaugcuuaugacgggcacccuggccguuuucuuucugcucaucauggggcagcugaccuggaacgaccugauccggcuaugcaucauggugggugcaaacguguccgaccgcaugggcaugggcaccacguaccuugcgcugauggcuaccuucaagaugcggccgauguucgccgucggcuugcuauuucgccguuugaccagccgcgaagugcucuugcugaccauugggcucucccuggucgcgagcguggagcugccuaauucccucgaggaacugggcgaugggcuggccaugggaauuaugaugcucaagcugcucaccgacuuccaaagccaucagcucuggaccacccugcugucccucacuuucauuaagacgacccugucccuugacuacgccuggaagaccauggcgauggugcuauccauaguaagccuauucccccugugucucuccacaacgagccaaaagacuacauggcuacccguccugcucgguuccuucgggugcaaaccacuuaccauguuccuaaucaccgaaaacaagaucuggggccgcaagucauggccacucaaugaggggaucauggccgugggcaucgucuccauucugcugagcagccuacugaagaacgaugugccccuggccgggccgcucaucgccggcgggaugcuaaucgcguguuacgugaucuccgggagcagcgccgaccugagucuagaacgcgcagcggagguuaguugggaggaggaggccgagcacagcggcgcgucccauaacauccugguggaagugcaggacgacgggacgaugaaaaucaaggacgaggaacgugacgacacucugaccauccucuuaaaagccacauugcucgcagucagcggcguguacccgauguccauccccgcuacgcuguucguaugguacuuuuggcagaagaagaagcagcggucggggguccucugggacacgcccaguccacccgagguugaacgagccgugcucgacgauggcauauaccgcauccugcagcggggauuacuagggagaagccaagucggcgucgggguguuucaggacggcguauuccacacgauguggcaugugacucgcggggcuguguuaauguaccaagggaagcgccuggaaccauccugggccagcgucaagaaagaccugaucaguuacggcgggggcuggcgguuucaagggagcuggaauacuggcgaggagguccaggugaucgccgucgagcccgggaagaaccccaagaacguacagaccacccccggcaccuucaaaacgcccgagggagaggugggggccaucgcccucgauuucaagcccgguacguccgggagccccaucgugaaccgcgaaggcaagaucgugggccuguacgggaacggcgugguaaccaccuccgggacguaugugagcgcgaucgcgcaggccaaagccagccaggagggcccgcugccugagaucgaggacgagguguuuaagaagcggaauuugaccaucauggaucugcaccccgggucuggaaagacccgccgguaccugccggccaucguccgcgaggcaauuaagcgcaagcuccgaaccuuaauccucgcuccaacgcgcgucguugcuucagaaauggcggaggcauuaaagggcaugccuaucagguaccagaccaccgccgucaaguccgagcacaccgggaaagagaucguagaucugaugugccacgccacguucaccaugcgccugcuaagccccgugcgaguuccgaacuauaacaugauaaucauggaugaggcccauuucaccgaccccgccuccaucgcggcgcgcggcuacaucagcacacggguggguaugggggaagcggccgccauauucaugacggcgacgccacccgguucaguugaagccuucccgcagagcaaugccgucauccaggaugaagaacgagacauucccgagcgguccuggaacagcggcuacgacuggauaacggacuuccccggcaagacaguaugguucgugcccuccauuaagucggggaacgacaucgccaacugccugcgcaagaacggcaagcgagucauccaacugucacgcaagacauucgacacggaguaccagaagaccaagaauaacgacugggauuacguugugacuacggacauuagcgaaaugggggccaauuuccgagcagaccgcgugaucgacccacggcgcugccucaagcccgugauucugaaggacggccccgaacggguuauauuagcaggccccaugccggugaccgcggccucugcugcccagaggcggggccgcaucggccgcaaccagaacaaggagggggaucaguacaucuacaugggccaaccacucaauaaugacgaggaccacgcccacuggaccgaggccaagaugcuucuggacaacaucaacacgcccgaggggaucauccccgccuuguuugagccugagcgggagaaguccgcggccaucgacggcgaguaccgacugcgcggggaggcccgcaagacauucgucgagcugaugcggaggggcgaucuccccgucuggcucuccuacaagguggccagcgaggguuuucaguacuccgaccgaagguggugcuucgacggggagaggaauaaucagguguuggaggagaacauggacgucgagaucuggaccaaggaaggcgagaggaagaagcuccggccccgcuggcuagaugcccggacauacagcgacccguuagcgcuccgcgaguucaaagaguucgccgcugggcggcgaagcgugaguggcgaucugauccuggaaaucggaaaguuaccgcagcaccugacacugcgggcccagaacgcccucgacaaccuggugaugcugcacaauucugagcagggugggaaagcguacagacaugccauggaggaacuccccgacaccaucgagacucuaaugcugcucgcucugaucgccguccucacagggggcgucacccucuucuuccuguccggaaagggacugggcaagaccagcaucggccuccugugcguuauggcguccucaguccuguuauggauggcauccguggaaccccauuggaucgcugccagcauaaucuuggaguucuuccuaauggugcuacugauccccgagccagaccggcagcgcacgccccaggacaaccagcuggcuuacgucgugauuggcuuacuguuuaugauccugaccguggcggcgaaugagaugggcuuacuggaaaccaccaaaaaggaccucggaaucgggcaugucguugccgagaaccaccaccacgccacgaugcucgacaucgaccugcaccccgccagcgcguggacccuguacgcaguggccaccaccauaaucacgccaaugaugcggcauaccaucgaaaacaccaccgccaauaucagccugacggccaucgcgaaccaggcagccauacugaugggacuggauaagggcuggccuaucuccaagauggacaucggggucccccuacuggcccuuggcugcuacagccaggucaacccccucacccugaccgccgcggugcugaugcucgucgcccacuacgccaucauagggcccggucugcaggccaaagcgacgcgcgaagcccaaaagcgcacggccgccgguauuaugaagaaccccacaguggacggcaucguggccaucgaccuggaccccgucguguacgacgcuaaguucgagaagcagcucggccagaucaugcuucuuauccucugcaccucccagauacuguuaaugcgcacgacgugggcucugugcgagagcaucacccuagccaccggaccccugacuacgcucugggagggcuccccggggaaguucuggaacaccaccauugcagugagcauggcuaauaucuuccgaggaucauaccuggcgggagccggguuagccuucagccucaugaaaagccuaggagggggccggcgcggcaccggagcacagggugagacgcugggggagaaguggaagcggcagcucaaccagcugaguaagagcgaguuuaacaccuacaagaggucuggcaucauggaggucgaccggagcgaggccaaggaggggcugaagcgaggcgagacaaccaagcaugcggugucgcgggggacggccaaguugcgcugguucguagagcggaaccucgugaaaccagagggcaaagugaucgaccuggggugcgggcgcggcggguggagcuacuacugcgcgggccuaaagaaggugaccgaagucaagggguacacaaagggcggccccgggcacgaggaacccaucccgauggccaccuacgguuggaauaucgucaagcuccacuccgggcgggauguguucuucaccccuccugagaagugcgauacgcugcugugcgacaucggcgaaagcuccccaaacccgaccaucgaggaggggaggacgcuccgggucuugaagaugguggagcccuggcugcgcggcaaucaauucugcaucaagauccuuaacccauacaugcccagugugguugagacccuggagcagaugcagaggaaacacggcggcaugcuggugcgcaacccguugucccggaacagcacgcacgagauguacugggugucguguggcaccgggaauaucgucucagccgugaauaugaccucccgcaugcuguuaaaccgcuucaccauggcccaccggaagccaaccuacgagcgcgacguggaucucggcgccgguacccgccacgucgccguggagcccgagaucgccaaucuggacaucauagggcagcggaucgagaacaucaagaaugagcauaagagcacuuggcauuacgacgaggauaacccuuacaaaacaugggccuaucacggcuccuacgaagugaagccgagcggguccgccagcuccaugguuaauggcguaguucggcugcuuacaaagcccugggacgucaucccgauggugacccaaaucgccaugaccgacaccacgcccuucggccagcagcgcgucuucaaggagaagguggacacuagaaccccgcgucccaagcggggaaccgcccagaucauggaggugacugccaaguggcuguggggcuuccugagccgcaacaaaaagccccggaucugcacccgcgaggaguuuacucguaagguccgaagcaacgcggccauuggugccguguucgucgacgagaaccaguggaauagugcaaaggaggccguagaagacgaacgguucugggaccuggugcaccgcgagagggagcugcacaagcaagguaagugcgcgaccugcguuuacaacaugauggggaagagggagaagaagcugggugaguuugggaaagccaaaggcagccgagcuaucugguacauguggcucggugccagauuccuggaguucgaggcacuggguuucaugaaugaggaucacugguuuucccgagaaaacagccucuccggggucgagggggaaggacugcacaaacugggguacauccuacgcgacauaagcaagaucccgggcggcaacauguacgccgacgacaccgccgggugggauacccggauuacugaagacgaccugcagaacgaggccaagaucaccgacaucauggagccggagcacgcccuguuggcgacuuccauauucaaacuuaccuaccagaacaagguggugcguguccagcgcccugccaagaguggcaccgugauggacgucauauccaggcgcgaccagcggggcucuggucaggucggaacauacgggcugaacacauucaccaauauggaggugcaguuaaucaggcagauggaguccgagggaaucuucucucccuccgagcucgagaauagcaaccuggccgagcggguccucgacuggcuggaaaagcacggugucgagcgccugaagcguauggcuaucucaggcgaugacugcguagucaagccaaccgacgaccgcuucgccacagcccugacggcccuuaaugacaugggaaagguccggaaagacaucccucagugggagcccagcaagggguggaaugacuggcaacagguccccuucugcucccaccacuuccaccagcugaucaugaaggacggcagagagaucguggucccgugccggaaccaggacgaacugguggggcgcgcccgcgugagccaaggugccggguggucacugcgcgaaaccgcgugccugggcaaguccuacgcccagauguggcaacuaauguauuuccaccgacgcgacuugcggcuggccgccaacgcuauuugcagcgccguccccguuaacugggugcccaccucccgcacuacguggagcauccacgcucaccaccaguggaugacuaccgaggacaugcucuccguuuggaaucgcguguggaucgaggagaaccccuggauggaggacaagacccacguguccuccugggaggacgucccuuaccuggggaagcgggaggaccaaugguguggcucgcugaucggucucaccgcccgcgccacaugggcgacuaacauucagguggcgauaaaccaggugcgucgccugaucgggaaugagaacuaucuggacuauaugacuuccaugaagcgguucaagaaugagagcgauccagagggugccuuaugguga

SEQ ID NO: 24751 - RNA, 9879 nt, Artificial Sequence
  derived and/or modified CDS sequence (opt11) from DENV-1__KM403631__SS-prME
agcgugaccauguuacucaugcugcugccgaccgcccucgccuuccaccugaccacccggggcggggagccgcacaugaucgugagcaagcaggagcggggcaagagccuccuguucaaaacauccgcgggggugaacauguguacccugauugccauggaucugggcgagcucugcgaggacacgaugaccuauaagugcccucggaucaccgaggcugagccagacgacguggacugcuggugcaacgccaccgacaccugggucaccuacgggacauguagccagaccggcgagcaccgaagagacaagcgguccguggcacuggcgccccacgugggccuggggcucgagacacgcacagagaccuggaugagcucggaaggagccuggcggcagauccagaaggucgagaccugggcccugcgccaccccggguucacggugaucgcucuguuccucgcucacgccauaggcaccagcaucacccagaaggggaucaucuucauccuguugauguuagugaccccguccauggccaugcggugcgugggcaucggcaaccgcgacuuuguggaggggcucagcggcgccacguggguggacgucgugcuggagcacggguccugugugaccaccauggccaagaacaagcccacccucgacaucgagcuacugaagacggaaguaaccaaccccgcgguauuacggaaguugugcaucgaggccaagauuagcaacacaacuacugacucccgcugccccacccaaggcgaggccacccugguggaggagcaggacgccaauuucgucugccggcgcaccuucguggaccgggggugggggaacggcuguggccucuuugguaaggggucgcugcugacgugcgccaaauuuaagugcguuaccaagcucgaggguaagauaguccaguacgagaaccugaaguacuccgugaucgucaccguccacaccggcgaccagcaccaaguggggaacgagacgaccgaacauggcaccauugcgaccauuacgccccaggccccgacgagcgagauucaguugaccgacuacggagcccucacccuggacugcaguccccgcaccggcuuggacuucaaugagaugguccuccugacgaugaaggaaaaguccuggcuggugcacaagcagugguuucucgaccugccguuacccuggaccuccggggccucuaccagccaggagacguggaacagacaggaccucuuagugacguucaaaaccgcccacgcgaagaaacaggaggucguaguacugggcagccaagaaggcgccaugcacaccgcucucaccggggccacggaaauccagacgucggguacgaccacgaucuucgccgggcaccugaagugucgccugaaaauggacaaacucacccugaagggcgugucuuacgugaugugcaccgggaguuucaaguuagagaaggaaguggcggagacccagcacggcaccguccugguccaggugaaguacgagggcaccgacgcgcccugcaagauccccaucuccacccaggacgagaagggggucacccagaacggaaggcugaucacggccaacccgaucgugacagacaaagaaaagcccaucaacaucgagaccgagccgcccuucggggagagcuacauugugaucggcgccggcgagaaggcgcugaagcugagcugguucaagaaagggagcucaaucggcaagauguucgaggccaccgcccgcggggcccggcgcauggcuauacucggcgacacggcgugggacuucgggagcauaggcggcgucuucaccaguguaggcaagcuggugcaccaggucuucgggaccgcguacggggugcuguucaguggcguguccuggacuaugaaaaucgggaucggcauccuccugacguggcuaggucucaacagccgcaguaccagccuguccaugaccugcaucgcgguagggauggugacccuguaccucggugugaugguccaagcugacagcgggugcgugaucaauuggaagggccgggagcugaagugcgggagcgggaucuuugugacgaacgagguccauaccuggacggagcaguacaaguuucaggcggacagcccgaagcgccucagcgcagccaucggcaaggccugggaggaaggcgugugcggcauccgguccgccacucgcuuagaaaacaucauguggaagcagaucucgaacgaacugaaccacaucuugcucgaaaacgauaugaaguuuaccguugucgugggggaugccaacggcauccugacgcaggggaagaagaugauucggccccaaccaauggaacacaaguacuccuggaaguccuggggcaaagcuaagaucaucggcgcugauacccagaauacgaccuuuaucauagacgggcccgacacgccggagugccccgacgaccagcgggccuggaacaucugggagguggaagauuacggcuucggcgucuucaccaccaacaucuggcugaaauuacgugauuccuacacccaaaugugcgaucacagauugaugucggccgcgauaaaagacuccaaggccgugcacgcugacaugggcuauuggaucgagagcgagaagaacgagacguggaagcuggcccgggcauccuucaucgaaguuaagacaugcaucuggccgcgcagccacacccucugguccaauggugugcuggagucugagaugaucaucccgaagaucuacgggggaccaaucucccagcauaacuaucggcccggcuacuucacccagacggcgggccccuggcaccuggggaagcucgagcuggacuucaaccugugcgagggcaccaccguggugguugacgagcacugcggcaaccgcgggccuagccuccggacuacaacagugaccggcaagaucauccacgaauggugcugccgguccugcacccugccgccccugcgguuccgcggggaggacggaugcugguacgggauggagauacggcccguaaaggaaaaggaagagaaccucguccgcagcauggugucugccggcagcggugagguagacagcuucucccuggggcugcucugcgucagcauaaugauugaggaggugaugcggucgcgcuggagcagaaagaugcugaugacggggacccuggccguguucuuccuccucaucauggggcagcugacauggaacgaccucauccggcugugcaucauggucggcgccaacguguccgacagaauggggaugggcaccacguaucuggcauuaauggcaaccuucaagaugcggccgauguucgccguggggcugcuguuccgccggcucaccagccgcgagguccugcuccucacgaucgggcucucccugguggcgagcguagagcuccccaacucccuggaagagcugggcgacgggcucgcaaugggcaucaugaugcugaagcugcuaaccgacuuucagagccaccagcuguggaccacccugcucucccugaccuucaucaagacgacucugucgcucgacuacgccuggaaaaccauggcgaugguucugucgauugugagccuguucccccucugucugucgacaacaagccagaagacuacguggcugcccguucuccugggcuccuucgggugcaagccguuaacuauguuucucaucacggaaaauaagaucuggggccgcaagaguuggccccugaacgaagggaucauggccgugggcaucguguccauccugcuguccucgcuacuuaagaacgacgucccgcucgcagggccccugaucgccggcgggauguuaaucgcuugcuacgugaucuccggaagcuccgccgaccucagccuugagcgcgccgccgagguguccugggaggaagaagccgagcacagcggcgcaucccacaauauccuggucgaggugcaggacgacgggacgaugaagaucaaggacgaagagagggacgauacccuaaccauccugcugaaggccacccucuuggccgugagcggcgucuacccuauguccauccccgcgacgcuguucgucugguacuucuggcagaagaagaagcagcguaguggggugcucugggacacccccucaccgcccgaggucgagcgggccgugcuggacgacggcaucuauagaauccuucagcgcggccugcuaggacgcucgcaagugggcgucggaguguuccaggaugguguuuuccauaccauguggcacgucacccggggggcggugcugauguaccagggcaaacgccuggaaccauccugggccagcgugaaaaaggaccucaucuccuauggcgggggauggcgguuccaggggucauggaacacgggcgaggagguccaggugaucgccguggagcccgggaagaaccccaagaacguccagaccacgcccggcaccuucaagacgcccgagggcgagguuggugccauugcgcuggacuucaaacccggcaccagcgggagcccuaucgugaaccgcgagggcaagauugucggcuuauaugggaauggcguggugaccaccucugggacguacgucagcgcgaucgcccaggcgaaggccucgcaggagggccccuuacccgagaucgaggacgagguguucaagaagcggaaccugaccaucauggaccugcaccccgggucggggaagacccgccguuaccuccccgccauugugcgcgaggcgaucaagcgcaagcugcggacccugauccucgccccuacccgugucguggccucugagauggccgaggcgcugaagggcaugcccauacgcuaccagaccaccgcagugaagagcgagcacaccgggaaggagaucgucgaucugaugugccaugccacguuuaccaugcgccuccugagccccgugcggguaccaaauuauaacaugaucaucauggacgaggcccacuuuaccgaccccgccuccauugcggcccgcggcuauauuuccacacgggugggaaugggcgaggccgcagccaucuucaugaccgcaacgccgccaggguccguggaggccuuuccucaaagcaacgcugugauccaggaugaagagcgcgacaucccugagcgguccuggaacagcggcuacgacuggaucacggacuuccccggcaagaccgucugguucguccccuccaucaagagcgggaacgacaucgccaacugccugcgcaaaaacggcaaacggguuauccaguugucccgcaagacguucgacacggaguaccagaagacuaagaauaacgacugggacuacguugucacuacggacaucagcgagaugggggccaacuuucgggcggaccgcguuaucgacccacggcgcugccugaagcccgucauccugaaggacggccccgagcgggugaucuuagccgggcccaugccagucaccgccgccagcgcggcucagcgccggggcaggauaggccguaaccagaacaaggagggggaccaguacaucuacaugggccagccccugaacaaugacgaggaccacgcccacuggaccgaagccaagaugcugcucgacaacaucaacacccccgaggggaucauccccgcgcuguucgaaccggagcgggagaaguccgcggccaucgauggcgaguaccgccugcgcggggaggcucgcaaaacguuuguggaacugaugcgucgcggcgaucugcccguguggcuguccuauaaggucgccagcgagggcuuccaguauucggaccggcgcuggugcuucgauggggaacgaaacaaucaaguccuagaagagaacauggacgucgagaucuggaccaaggagggugaacgcaagaaguuacguccccgcuggcuggacgcccggaccuauuccgacccccucgcacugcgcgaguucaaggaauucgccgccgggcgacgcagcguuaguggcgaccugauccucgagaucgguaagcugccgcagcacuugacccuccgggcacagaacgcccuggacaauuuagucaugcuccacaacagcgagcagggcggcaaggcauaccgccaugccauggaggagcugcccgacaccauagagacgcugaugcuccuggcccugauagccgugcucaccgggggcgucacccuguuuuuccugagugggaagggacucggcaaaacaucgaucggucuccugugcgugauggcguccagcgugcuacuguggauggccucggucgaaccccacuggauugccgccagcauaauacuggaguuuuuccucauggugcuucugaucccggagccagacagacagcgcaccccacaggacaaccagcucgccuacgugguaaucggccuccuguucaugauccuaaccguggcggccaaugagauggggcuguuggagacaaccaagaaggaccuuggcaucgggcacguugucgccgagaaccaccaccacgcgacgaugcuggacaucgaucugcaccccgcuuccgcguggacccucuacgcgguggcuacgacgauuaucaccccgaugaugagacacacaaucgagaacacuacggccaacaucucacugaccgccauagcgaaucaggccgccauuuugaugggccucgacaaaggcuggcccauauccaaaauggauaucggggugccccuguuggcccucgggugcuauagccaggucaacccacugaccuuaaccgccgcggugcucaugcuggucgcccacuacgccauuaucgggccgggccugcaggcaaaggcgacccgcgaggcccagaagcggaccgccgccgguaucaugaagaacccuaccgucgacggcaucguggcgaucgaccucgaccccgucguauacgacgcgaaguucgagaagcagcucggccagaucaugcugcucauccugugcaccucccagauccugcucaugcguaccacaugggcccugugcgaguccaucacccuggccaccgggccccucacuacucucugggagggguccccggggaaguucuggaacaccaccauagccguuagcauggccaauaucuuccgcggcuccuaccuagcgggcgccggguuagccuucagucugaugaagagucugggcggggggagacgcgggacaggugcucagggcgaaacgcucggggagaaguggaagcgacaacugaaccaacugagcaaaagcgaguucaacacguauaagcgcuccggaauaauggaaguggaccggagcgaggccaaggaaggguugaagcgaggcgagaccaccaagcacgcggucucccgggggaccgccaagcugcgcugguucguggagcggaaccuggugaagcccgagggcaaggucaucgaccugggcugcgggcgcggcggauggagcuacuacugugcuggccuaaaaaaggugaccgaggugaagggguacaccaagggcggccccggccaugaggagcccaucccgauggccaccuacggcuggaacaucgucaagcuacauuccgggcgggacguguucuucaccccuccagagaagugcgacacgcugcuaugcgacaucggcgaaagcucucccaacccgaccaucgaggaggggcgcacccugcgcgugcugaagauggucgagcccuggcuccgcggcaaucaauucugcauuaagaucuugaaccccuacaugcccagcgugguagagacacuggagcagaugcagcggaagcauggcgggaugcuuguucgcaacccgcugucccggaacagcacgcacgagauguacugggugaguugcgguaccgggaacaucgugagcgccgucaacaugaccucccgcaugcuacucaaccgcuucaccauggcccaccggaagcccacuuacgagcgcgacguggaccugggcgccgguacccggcacguggcgguggaaccggaaauugccaaccuggauaucaucgggcaacgcaucgagaacaucaagaacgagcauaaaagcaccuggcacuacgaugaggacaaccccuacaagaccugggcguaccacgguucauacgaggucaagccgagcgggucugccagcuccaugguuaacggagucgugcggcuccugacgaaacccugggacgucauuccgauggucacccagauagccaugaccgacaccacgcccuucgggcagcagcgcguuuucaaggagaagguggacacccggaccccgcgccccaagcggggcaccgcacagaucauggaggugacagccaaguggcuuuggggcuuucuuagccgcaacaagaagccccggauauguacucgcgaggaauucacacggaaggugcgcucuaaugcggccaucggagccgucuucguggacgagaaucaauggaauuccgccaaggaggccguggaagacgaacgguucugggaucugguccaccgcgagagagagcugcacaaacagggcaagugcgcuaccugcguguacaacaugauggggaagcgcgagaagaagcucggcgaguucgggaaggccaagggcagccgggccaucugguacauguggcugggcgcccgcuuccuggaguuugaggcgcucggguuuaugaacgaggaucacugguucucccgggagaauagccuguccgggguggagggggaaggccugcacaaacucggguauauccugcgcgacaucucgaagaucccgggcgggaacauguacgccgaugacacggccgguugggacacccgcaucaccgaggaugacuuacagaacgaagccaagaucacagacaucauggagcccgagcacgcccuccuagcgaccuccauauucaagcugaccuaucagaauaaggucguucguguacagaggccugccaagagcggcaccgucauggaugugaucucccggcgcgaccagcgggggucaggucaggugggcaccuacggcuugaacacguuuaccaacauggagguccagcugaucagacagauggaauccgagggcaucuucagucccuccgagcuggagaacagcaaccucgccgaacgggugcuagacuggcuggagaagcacgggguggagcgccucaagaggauggccaucucaggcgacgacugcguggucaagccgaccgacgaccgcuucgccaccgcgcugacggccuuaaacgacauggguaaggugcggaaggacauuccccagugggaacccucaaagggcuggaacgacuggcagcaaguccccuucugcagccaucacuuucaccagcugaucaugaaagauggucgcgagaucguggugccgugccggaaccaggacgagcuggucgggcgcgcccgagugagccagggcgccggguggucccugcgcgagaccgccugccugggcaaauccuacgcgcaaauguggcagcugauguacuuucauaggcgcgaucuccggcucgccgcaaacgcaaucugcagcgcuguccccgucaacugggugcccacuucccgcaccaccuggagcauccacgcgcaccaccaguggaugacuaccgaggauauguuauccguguggaaccgcguguggaucgaggagaauccauggauggaggacaaaacccacguuagcaguugggaggacgugccuuacuuggggaagcgggaggaucaguggugcggcagccuuaucggccugaccgcucgcgccacgugggcuaccaacauccagguagcgaucaaccaggugcggcgucugaucgggaaugagaacuaucucgauuauaugaccuccaugaagcgcuucaagaacgagagcgaccccgaaggcgcccuaugguga

SEQ ID NO: 24752 - RNA, 9879 nt, Artificial Sequence
  derived and/or modified CDS sequence (opt11) from DENV-1__KM403632__SS-prME
agcgucaccaugcuucugaugcugcugccaaccgcccucgccuuccaccuaaccacucguggcggugaaccccacaugaucguuucaaagcaggaacgggguaagucucuccuauucaagaccuccgcgggggugaacaugugcaccuuaaucgccauggacuugggcgagcucugugaggacacuaugaccuacaagugccccaggauaaccgaggccgagcccgacgacguggauugcuggugcaacgccaccgacaccugggugacauacgggaccugcucgcagacaggcgagcaccgccgcgacaagcgguccguggcccuggcgccccacgugggauugggguuagagacccgaaccgaaaccuggaugagcagcgagggcgccuggaggcaaauacaaaagguagagacuugggcccucagacacccgggguucacggugaucgccuuguuccucgcgcacgcuaucggcaccagcaucacccagaagggaaucaucuucauacugcugaugcucgugacccccuccauggccaugcggugcgucggcaucggcaaccgcgacuucguggaggggcugucgggagccacauggguggacgucgugcuggagcacgggucaugcgugaccaccauggcgaagaacaagccuacccucgacauagagcuguugaaaacggaggucaccaaccccgcgguccuccggaagcugugcaucgaggccaagaucagcaacacuacaacggacucccgcugcccuacccagggcgaggccacacucguggaagagcaggaugcaaacuucgucugccggcgcaccuucguggaccggggcugggggaacggcugcggccuguucggcaaggggucucugcugacgugcgcaaaguuccgcugcgugacaaagcucgaagggaagaucguccaguacgaaaaccugaaguacuccgugauugugacuguccacaccggcgaccaacaccagguggggaacgagacgacugagcacggcaccaucgcuaccaucacgccgcaggcccccacgagugaaauacaacucaccgacuacggggcccucaccuuggauugcucgccccggaccggccuugacuucaacgagaugguccuccugaccaugaaggaaaaguccuggcuggugcacaagcagugguuucucgaccuaccgcugccuuggaccuccggugccagcaccagccaggaaaccuggaaccgccaagaccuccuugugacguucaaaaccgcccacgcgaagaagcaggaggucguggugcuuggcucgcaggagggcgcaaugcacaccgcccucacuggggccacggagauacagaccagcgguacaaccacaaucuucgccgggcaucugaagugccggcugaagauggauaagcucacccugaagggcguguccuacgugaugugcaccggcagcuuuaagcuggaaaaggagguggcggagacccagcacggcacgguccuaguccaaguuaaguaugagggcacugacgcccccuguaagauucccaucuccacacaggacgagaagggggucacccagaauggccgccucaucacggccaacccgauagugaccgacaaagagaagcccguuaauaucgagaccgaaccgcccuucggggagagcuacauagucaucggcgccggcgagaaggcucugaaacuguccugguucaaaaaggggagcuccauaggcaagauguucgaggccaccgcccgcggggcucgccgcauggcgauccucggugauacggcaugggacuucgggucaaucggaggcguguucacguccguugggaaacugguccaccagguguuuggcaccgccuacggcgugcuguucaguggggucuccuggaccaugaagaucgggaucggcauccuccugacgugguugggucucaacagccggucaacuagccuguccaugaccugcauagccguggggauggugacccuguaccucggcgucauggugcaggcugacagcgguugcgugauuaacuggaagggccgcgaacugaagugcgggucgggcauuuucgugacgaacgaagugcacaccuggacugagcaguauaaauuucaggccgauagccccaaacggcucucggcggccauaggcaaggcaugggaggagggcgugugcggcaucagaucggccacccggcucgaaaacaucauguggaagcagaucagcaacgaguuaaaccacaucuuacuagaaaacgacaugaaguuuacggucgucguaggggaugccaacggcauccugacucaggggaagaagaugauacguccccagcccauggagcacaaguacuccuggaaguccugggggaaggccaaaauaauuggcgcagacacccagaacacaaccuucaucaucgaugggcccgauacgccggagugccccgaugaccagcgggccuggaacauuugggagguugaggacuacggcuucggaguguucaccacaaacaucuggcugaaacucagagacuccuacacccagaugugcgaccaccggcugaugagcgcggcgaucaaggacucuaaggcggugcacgccgacaugggcuauuggaucgagagugagaagaacgagacguggaaguuggccagggcgucguucaucgaggucaagaccugcaucuggccccggagccacacucucugguccaacggcgugcuggagucagagaugauaauucccaagaucuacgggggcccgaucucccagcauaauuaccgccccggguacuucacccagacagcaggccccuggcaccuggggaagcucgagcuggacuucaaccuaugugagggcacuaccguggucguagacgagcacugcggcaaucggggucccagcuugcgcaccacgaccgugacuggcaagauuauccacgaguggugcugccgauccugcacgcugccgccccugagauuccgcggggaggacgggugcugguaugggauggagauccgccccgucaaagagaaggaggaaaaccuggugcggagcaugguguccgccggcagcggcgaggucgacucauuuucccuagggcugcucugcgugucgaucaugaucgaagaggugaugcgcucucgcuggucucgaaagaugcuuaugacggggacacuggcggucuucuuccuccugaucauggggcaguugacguggaaugaccucauccguuuauguaucaugguuggagccaacguguccgaccggauggggaugggaacgacguacuuagcccuaauggcgacauucaagaugcgcccgauguucgccgucgggcugcuguucagacgccucaccagcagagaggugcugcugcuaacaaucgggcugagccugguagccagcguugagcugccuaacucccuggaggagcugggcgacggucucgccauggguaucaugaugcugaagcugcucacggacuuccagagucaucagcuguggacgaccuuacugagucugaccuucauaaagacgacccugagccucgauuaugccuggaagacuauggcaauggugcuguccauugucagccuauucccccucugccuguccaccacgagccagaaaacaaccuggcuccccgugcuccuggguuccuucggauguaaaccgcugaccauguuccucaucaccgagaacaagauauggggccgcaaaaguuggccccugaacgaggggaucauggccgugggcaucgucuccauccugcucagcucguuacuuaaaaacgacguucccuuggccgggccccugaucgcaggcggcaugcugaucgcgugcuacgugauuuccgggucauccgccgaccucuccuuagaacgggccgccgaggucucaugggaggaagaggccgagcacagcggcgcgagucacaacauacugguggagguacaagacgacggaacgaugaagaucaaagacgaggagcgcgacgacacgcucaccauccugcugaaggccacccuccuggccgucagcggcguguauccgauguccauacccgccacucuguucgugugguacuucuggcagaaaaagaagcagcggucuggaguccucugggacacccccagcccgcccgagguggagcgcgccgugcucgacgacggcaucuaccggauccugcagcgcggcuuacucgggcggagccaagucggcgugggaguguuccaggacggagucuuccacaccauguggcacguaacccgaggggcagugcugauguaccaaggcaaacggcuggagcccuccugggccucggucaagaaggaccuuaucuccuacggcgggggcuggcgcuuccagggguccuggaauaccggcgaggagguccaggugaucgcggucgagccagggaagaaccccaagaacgugcaaaccacgcccggcacauucaagacgccugagggcgagguuggcgccaucgcccuugacuucaagcccggcaccuccggguccccaaucguuaaucgggagggcaagaucgugggacuguauggaaacggaguggucacgaccuccgggacauacgucagcgccauugcccaggcuaaagccagccaggagggcccguuaccggagaucgaggacgaaguuuucaagaagcguaaccugaccauaauggacuuacauccgggauccggaaaaacccggcgauaccuccccgcgauugucagagaggccaucaagcggaagcugcgcacccugauucuugcccccacccgggugguugccagcgaaauggccgaggcgcugaaggguaugccuauccguuaccagaccaccgccgucaaguccgaacacacugggaaggagaucguggacuuaaugugccacgccacguucaccaugcgguuacugagcccuguucgcgucccgaacuacaacaugaucaucauggacgaggcccacuucaccgaucccgccaguaucgcggcccgagguuacauaagcacccguguggggaugggggaggccgccgcgaucuucaugacggcgacaccgcccggguccguggaggcauucccccaaagcaacgccgucauacaggacgaagagagagauauccccgagagguccuggaacucgggcuacgacuggauuacagacuucccuggcaagacggugugguucgugcccuccauaaagucagguaacgacaucgccaacugccuacguaagaacggcaagcgcgucauccagcucucccggaaaacguucgacaccgaguaccagaaaacgaagaacaacgauugggacuacguggugacgacggacaucucugaaaugggggcuaacuuccgcgcggauagggugaucgacccgcgccggugucugaaacccgugauccugaaggacggccccgagcgagucauccucgccgggcccaugccaguuaccgccgcauccgcggcucagcgacggggucgcaucggccggaaccaaaacaaggagggcgaccaguauaucuacaugggccagccccucaacaaugacgaggaccacgcucauuggaccgaggccaagaugcugcucgauaacaucaauacacccgaggggauaauccccgcccuguucgagccggagcgcgagaaguccgcggcuaucgauggcgaguaccggcugcgcggcgaggcccggaaaacguucguggagcucaugcgcagaggcgaccugcccgucuggcuguccuacaaaguggccagugagggcuuccaguacuccgaccgcagguggugcuucgauggcgagcggaauaaccaggugcucgaggagaacauggacgucgagaucuggaccaaggaaggcgagcguaagaagcugagaccccggugguuagacgcccgcaccuacagcgacccccucgcacugcgagaguucaaggaauucgcugcagggcgcaggagcgugucaggggaucugauccucgagaucggcaagcuuccgcagcaccuaacccuucgcgcgcagaaugcauuagacaaccuggugauguugcacaacagcgagcaaggcgggaaggcguaccggcacgccauggaggagcugcccgacacuaucgagacucugauguuacucgcccugaucgccguccucacagggggcgugacucuguucuuccuaagugggaaaggacuugggaaaaccaguaucgggcuccugugcgucauggcguccaguguccuccuguggauggccuccguugagccccacuggaucgcugccuccaucauccuggaguucuuccuaauggugcugcugauccccgagccggaccgccagcggacuccccaagacaaccaauuagccuacguugugaucggcuugcuuuucaugauccucaccguggcugccaacgagaugggauuauuagagaccaccaaaaaggaccucggcaucgggcacgucguggccgaaaaccaccaccacgccaccaugcuggacaucgaucugcacccagccuccgcuuggacccucuaugccgucgccacuaccaucaucacgccgaugaugcgucacacuauugagaacacuacugcuaacaucagccucacagccaucgcgaaccaggccgcuauccugauggggcucgacaaggguuggcccaucuccaagauggacaucggggugccccuguuagcccucggcugcuacagccaggugaauccccugacacugaccgcagcggugcuuaugcuggucgcccacuacgccaucaucgggccaggccugcaggcgaaggcgacccgcgaagcccagaagcggacggcggccgggauaaugaaaaaucccaccguggacggcauuguagccauagaccucgaccccgucguguacgacgcgaaguucgagaagcagcucggccagaucaugcuccucauccugugcacgucccagauccugcucaugcgcaccacgugggcccugugugagagcauuacccuggcgaccggcccacugaccacgcugugggagggcuccccgggaaaguucuggaacaccaccaucgccgugucaauggccaacaucuuccguggcuccuaccuagcgggagccgggcucgccuucagccugaugaagucccugggagggggccgcagggggaccggcgcccaaggagagacgcucggggagaaguggaagagacagcugaaccagcugagcaagagcgaguucaacaccuacaaaaggucuggcaucauggagguagaucggagcgaggccaaggagggucucaaaagaggcgaaaccaccaagcacgcaguguccagggggacggccaagcugcguugguucguagagcggaaucuugucaaacccgagggcaagguaaucgaccuuggaugugggcggggaggguggagcuacuacugcgccggcuugaaaaaggugaccgaggucaagggguacacgaagggcggccccgggcaugaggagcccauuccgauggccaccuauggcuggaacauagugaaguuacacuccgggcgcgacguauuuuucacgccgcccgagaagugcgauacguuacucugcgacaucggcgagaguuccccaaacccgacaauagaggaggggcggacccugcgcguccugaagaugguggaacccuggcuccggggcaaucaguucugcaucaaaauccugaacccuuacaugcccucgguagucgaaaccuuggagcagaugcagcgcaagcauggcgggaugcuggugcgcaacccgcugucacgcaacagcacccacgagauguacuggguguccugcgggaccgggaacaucgucagcgccgugaacaugaccagucgaaugcuguuaaaccguuucaccauggcccaccgcaagcccacguacgagcgggacguggaccugggcgccgguacucgccacguugcuguagagcccgagauugccaaucuagacauuaucggccagagaaucgagaacaucaagaacgagcacaagagcaccuggcacuaugacgaggacaaccccuacaagaccugggcauaucacggcucguacgaggugaagccgagcggguccgccagcuccauggucaacggcgugguccgcuugcucacgaaacccugggaugugauccccaugguuacccagaucgccaugacugacaccacgcccuucgggcagcagcgggucuucaaggagaagguagacacucgaaccccgagacccaagcgcggcaccgcucaaaucauggaggugacagccaaguggcuguggggcuuucuaagccggaacaaaaaaccucggaucugcacuagggaggaguucacccgcaagguccggagcaaugcggccaucggcgccguuuuuguggacgagaaucaguggaacuccgcuaaggaggccgucgaagacgagcgcuuuugggaccuggugcaccgggaacgcgagcugcacaagcaaggaaagugcgcgacuugcguguacaauaugaugggaaaacgcgagaagaaacucggcgaguucgggaaggcuaagggcucgcgcgccaucugguacauguggcugggagcccgcuuccuggaauuugaggcgcucggguucaugaaugaagaucacugguucucccgcgagaacagcuuguccggcgucgagggggagggccuacacaagcucggguacauccugcgcgacaucagcaagaucccgggcgguaacauguacgccgaugacacggccgggugggacacccggaucaccgaggaugaccugcagaacgaggcgaagaucaccgacaucauggaaccagaacacgcccuacuggcgaccuccaucuucaagcugacauaucagaacaaggucguucgcguccagcggcccgccaagucaggcacggugauggacguaauaucccgcagagaccagcgcgggagcggccagguaggcacuuaugggcucaacacguucacuaacauggaggugcagcucauacggcaaauggaguccgaaggcauauucucgcccuccgagcuggagaauagcaaccuagccgagcgcguccucgauuggcuugagaagcacggggucgagcgguuaaaacgcauggcgaucuccggcgacgacugugucgucaagccgacagacgaucgguuugccacggcccugacggcacugaaugacauggggaagguccguaaggauaucccacagugggagcccagcaagggcuggaacgauuggcagcagguccccuucugcucgcaccauuuucaccagcucauaaugaaggacggccgggagaucguugucccgugccgcaaucaggacgaacuaguagggcgagcccgcgugucgcagggcgcagguuggagccuucgggagacggccugccucggcaagucauacgcccagauguggcagcuaauguacuuccacaggcgagaccuucgacucgccgccaacgccaucuguagugccguccccgucaacugggugcccaccucccgcaccaccuggagcauccacgcacaccaccaauggaugacgacugaggauaugcuauccgucuggaaccggguguggauagaggaaaaccccuggauggaggauaagacgcacgugucuaguugggaggacgucccguaccuggggaagcgcgaggaucagugguguggcagucucauaggccugaccgcgcgggccacgugggccaccaacauccaggucgcgaucaaccaggugcgcagacucauugguaacgagaacuaucucgauuacaugaccuccaugaagcgcuucaagaacgaaagcgaccccgagggagcccugugguga

SEQ ID NO: 24753 - RNA, 9879 nt, Artificial Sequence
  derived and/or modified CDS sequence (opt11) from DENV-1__KM403583__SS-prME
agcgugaccaugcugcucaugcuguugcccaccgcccuggccuuccaccugaccaccaggggcggggaaccccacaugauagugucuaagcaagagcggggcaagagccuccuauucaagaccagugcgggggugaacaugugcacucucaucgccauggaccugggcgagcucugcgaggacacgaugaccuacaagugcccccggaucacugaggccgaacccgacgacguggacugcuggugcaacgccaccgacaccuggguuaccuacgggaccugcagucagaccggcgagcaccggcgcgaccgucgauccguggcccuggcgccccacguuggccucgggcucgagacccggaccgagaccuggaugucguccgagggcgccuggcgccagauucagcgagucgagaccugggcccugcgccaccccggguucacggugaucgcccuguuucucgcgcaugccaucggcaccagcauuacccagaaggggaucaucuucauacugcugaugcucguuacccccucuauggccaugcggugugugggcaucggcaaccgcgauuucgucgaggggcugagcggcgcaacguggguagacgucgugcuggagcacgggagcugcguaaccaccauggccaagaacaagcccacccuagacaucgagcugcugaagacagaggucaccaacccugcgguacuccggaagcuauguaucgaggccaagaucagcaacaccaccacggacucccgcugcccuacccagggcgaggccacacugguggaggagcaggaugccaacuucgucugccggcgcacuuucguggacaggggcugggggaauggaugcggccucuucgguaaggggagccuguuaacgugcgccaaguucaagugugugaccaagcucgaaggcaagaucguccaguaugagaaccugaaguacagcgugaucgugaccguacacaccggagaccaacaccagguagggaaugagacgaccgaacauggcacgaucgcgaccaucacgccccaggcucccacgagcgagauccagcugaccgacuacggugcucucacucuggacugcagcccgcggaccggccuggacuucaacgagaugguccuacugacgaugaaagagaaauccuggcuuguacacaagcagugguuucucgaccugccgcugcccuggaccuccggggccagcacgagccaggagaccuggaaccggcaggacuugcuggugacguucaagaccgcacacgcgaaaaagcaagaaguaguggugcugggcucccaggagggcgccaugcacaccgcacucacgggggccacggagauccaaaccagcggcaccaccacaaucuucgccgggcaccugaaaugccgccugaagauggacaagcucacccugaagggagucuccuacgugaugugcaccgggagcuuuaagcuggagaaggagguggcggaaacccagcacggcacgguccugguccaggugaaguacgaaggcaccgaugcccccugcaagauccccauauccacccaagacgagaagggggucacccagaacggccgccugaucacggcgaacccgauugucacagacaaggagaagcccgugaacaucgagaccgagccgcccuucggggagagcuauauugucauaggugccggcgagaaggcguugaagcugaguugguucaagaaagggagcucgauagguaagauguucgaggccacagcccgcggggcccgccggauggcaauccucggcgacacggcgugggacuucgggagcaucggcggcguguucaccuccguggggaaacugguccaccagguguucggcaccgccuacgggguguuauuuaguggcgucuccuggaccaugaaaaucgggaucggcauccuccugacguggcugggccucaacagccgcuccacaagccugagcaugaccugcauagccgucgggauggugacccuguaccucggcgucauggugcaggccgacagcggaugcgugaucaacuggaagggacgggaacugaagugcgggaguggcaucuuugucacgaacgaggugcacaccuggaccgaacaguacaaguuccaggccgacagcccgaagcgccugagcgcggccaucgggaaggcgugggaggaaggggugugcggcauccgguccgcgacccgccucgagaauaucauguggaagcagaucagcaacgagcugaaccacauccugcucgagaacgacaugaaguucaccgucguggugggggacgccaacggcaucuugacccaggggaagaaaaugauccggccccagccuauggagcacaaguacaguuggaaguccuggggcaaggcuaagauuaucggcgcggacacccagaacacuaccuucaucaucgacgggcccgauacuccagagugccccgacgaccagagggccuggaauaucugggagguggaggacuacggcuucgggguuuucaccaccaacaucuggcugaagcuccgggacuccuacacacagaugugcgaccauaggcugaugucggccgcgaucaaggacuccaaggcggugcacgccgacaugggcuacuggaucgagagcgagaagaacgagacguggaagcucgccagagccuccuucaucgaggugaagaccugcaucuggccccgcagccacacccucugguccaauggcgugcuugagagcgagaugaucauccccaagaucuacggaggcccgaucucccagcacaacuaccggcccggauauuucacucaaacggcgggcccuuggcaccuugggaagcucgagcuggauuuuaaccugugugagggcaccaccguaguagucgaugagcacuguggcaaccgcgggccgagccuccggaccacgaccgugacgggcaagauaauccacgaguggugcugcagauccugcacgcugccgccccuucgguuccgcggggaggacggcugcugguacgggauggagauccggcccgucaaggagaaggaggagaaccucgugcgcagcaugguguccgccggcagcggggaggucgacagcuucucccuugggcugcucugcgugagcaucaugaucgaggaggugaugcgcucccgauggagccguaagaugcugaugacgggcacccuugcuaucuucuucuuguuaaucaugggucagcugaccuggaacgaccucauccgucuguguauuauggucggcgccaacguguccgaccggauggggaugggcaccaccuaccuggcccucauggcgaccuucaagaugcggccgauguucgccgugggccugcuguuccgccgguuaaccucucgcgagguacugcugcucaccaucgggcugucccugguggcauccgucgagcuccccaacucccuggaggaguuaggcgacgggcucgccaugggcauaaugaugcugaaacuguuaacggacuuccaaagccaccagcucuggaccacccugcucucgcugacauucaucaagacgacccugagccucgacuaugccuggaagaccauggcgauggugcuguccaucgugagccucuucccccucugcuuaaguacgacgagccagaagacgacuuggcugcccguccuccugggcucauucggcugcaaaccguugaccauguuccucaucaccgagaauaagaucuggggccgcaagaguuggccccugaacgaggguaucauggccgucggcaucguguccauccugcucagcagccugcugaagaacgauguccccuuagccgggccacuaauagccggcggcaugcugaucgcgugcuacgugaucuccgggagcagcgccgaccucagccuggagcgcgccgccgaaguguccugggaggaagaggccgagcauagcggcgcgucccacaacauacuggucgaggugcaggaugacgguacgaugaagaucaaggacgaggagcgggacgacacccucacuauacugcugaaagccacccuccuggccgugucaggcgucuacccgauguccauacccgccacacuguucgucugguauuucuggcagaagaagaagcagcgcucgggggugcuuugggacacccccagcccgcccgaggucgagcgggccgugcuggacgacggcaucuaccgcauacuucagcggggccugcucgggcgcagucaggugggagucgggguguuccaggacggcguguuccacaccauguggcacgucacccgcggggcggugcugauguaccagggcaagcgccuggagcccuccugggccagugugaagaaggaccucaucucuuacggagggggcuggcgguuccaggggagcuggaacacgggcgaggagguccaggugaucgcgguggagcccgggaagaaccccaagaacguccagacaaccccuggcaccuuuaaaacgcccgagggcgaggugggggcuauagcccuggacuucaagcccgguaccuccgggagucccaucgugaaccgcgagggcaagaucguaggccuauaugggaacggcguggugaccaccuccggcacauaugucucugcgaucgcucaggcaaaggccagccaggagggcccgcuccccgagaucgaggacgagguguucaaaaaacggaaccugaccaucauggaccugcaucccggauccggcaagacaagacgcuaccucccggcuaucguacgggaagcaaucaagcgcaagcugcgcacucugauucucgcgccaacucgcgucguggccagcgaaauggccgaggcgcugaagggcaugcccauccgguaccaaaccacagccgugaagagugagcauaccgggaaggagauugucgaccugaugugccacgccacguucaccaugcgccuacugagcccggugcgagucccgaacuacaacaugauaaucauggacgaggcccacuuuaccgaccccgccuccaucgcggcccggggcuacaucagcacccgggucgggaugggggaggccgccgccaucuucaugacggcgacaccgcccgggucgguggaggcguucccgcaaagcaacgccgugauccaggacgaggagcgcgacauccccgagcgguccuggaacagcggcuacgacuggaucaccgacuuccccggcaagaccgucugguuuguccccuccaucaagucugggaaugacaucgccaauugccugcggaagaacggcaagcgggugauccagcuuucccgcaagacguucgacaccgaguaucagaagacaaagaacaacgacugggacuacguagugaccacggacaucagcgagaugggggcaaacuuccgggcggaccgcgugauugacccucggcgcugucugaaaccugucauucugaaggacggccccgagagagugauucuagcagggcccaugccggucacggccgccuccgcagcccagaggcgcggccggaucggacgcaaccagaacaaggagggggaccaguacaucuacaugggccagccucuaaacaacgaugaggaccacgcucacuggacugaggccaagaugcuccuagacaacaucaacacccccgaggggaucauccccgcccuguuugaaccggagcgggagaaguccgcggccaucgacggcgaguaccgccugcgcggcgaggcucgcaagacguuuguggagcucaugcggcgcggcgaccugcccguguggcuuuccuauaagguugccagugagggcuuccaguacuccgaucggcgcuggugcuucgacggggagcguaacaaccagguguuggaggagaacauggacguggagaucuggaccaaggagggcgagaggaagaaacugcggcccagauggcuggacgcccggacauacagcgacccccuugcccuaagggaguuuaaggaauucgcggccggacggcgcagcgucuccggcgacuuaauccuggagaucggcaaauugccgcaacaccugacccuccgggcccagaacgcccuggacaaccuggugaugcuccacaauagcgagcagggcgggaaggcguaccgucacgccauggaggagcugcccgacaccaucgagacgcugaugcuccuugcccugauagccgugcucaccgggggcgucacccuguucuuccuguccgggaagggccucggcaagaccucaaucgggcugcugugcguaauggcguccagcgugcuccuguggauggccuccguggagccccacuggaucgccgccagcauaauccucgaguucuuccucauggugcugcuaauccccgagccggaccggcagcgcacgccccaagauaaccagcucgccuacguggucauuggccugcucuucaugauccucaccguggcggcaaaugagauggggcuucuggagaccaccaaaaaagaccuaggcaucgggcauguggucgccgagaaccaccaccaugcuacgaugcuggacaucgaccugcacccggccagcgcguggacccucuacgccguggccaccacaauaaucacgccgaugaugcgccauaccaucgagaacaccaccgccaacaucagccugacagccaucgcgaaccaggccgccauccucaugggccucgacaagggcuggcccaucuccaagauggacaucggugugccccugcuggcccucggcuguuacagccagguuaacccccugacgcuuaccgccgcgguacucaugcugguagcccacuacgccaucaucgggccgggccugcaggccaaggcgacccgggaggcccagaagcgcacggccgccgggaucaugaagaaccccaccgucgacggcauaguggccaucgaucucgaccccguggucuacgacgcgaaguucgagaagcagcugggccagaucauguuacucauccucugcacuucccagaucuuguugaugcggaccacgugggcccugugcgagagcaucacccuagccaccgggccccugaccacgcugugggagggcucccccgggaaguucuggaacaccaccaucgccgugagcauggcuaacaucuuccgcggcuccuaccuggcgggugccggacucgccuucagccugaugaagucccugggcgggggccggcgugggaccggcgcccagggcgagacgcucggggagaaguggaagcggcagcugaaccagcugagcaagagcgaguucaacacguacaaacgcuccggcauaauggagguggaccggagcgaggccaaggaggggcucaagcgcggagaaaccaccaagcacgcagucucccgggguaccgccaagcugaggugguucgucgagcgaaaccugguuaagcccgagggcaaggucaucgaucugggcugcgggcguggcggguggagcuacuacugcgccggccucaagaaggugaccgaggugaagggguacaccaaggguggccccgggcacgaggaaccgaucccgauggccaccuacggcuggaacaucgucaagcugcacuccgggcgagacguguucuucacgccgccggaaaagugcgacacgcugcucugcgacaucggcgaaagcucccccaacccuaccaucgaggaggggcggacccugcggguucugaagauggucgagcccuggcuccgcggcaaccaguucugcaucaagauccugaaccccuacaugcccagcgugguggagacccuggaacaaaugcagcggaagcauggcgggaugcucguacgcaacccgcugucccgcaacagcacucacgagauguacuggguguccugcggcaccggaaacaucgugagcgcggucaacaugaccucccggauguugcucaaccgcuucaccauggcccaccguaagccgacguaugagcgcgacgucgaccugggcgccggaacccggcacguggccguggaacccgagaucgcgaaccuggauaucaucgggcagcgcauugaaaacaucaagaaugagcacaagagcaccuggcacuacgacgaggacaaccccuauaagaccugggcguaccauggcucuuacgaagugaagcccaguggguccgccagcaguauggugaacggcgucgugcggcuccugacgaagcccugggacgucauucccaugguuacccagaucgcuaugaccgacaccacgccuuucgggcaacagcgcguguucaaagagaagguagacacccggaccccgcgccccaaaagaggaaccgcucaaaucauggagguaacggccaaguggcuguggggcuuccucucacgcaacaagaagccaagaaucugcacccgcgaagaguucaccagaaagguacgcagcaacgcagccauaggggccgucuucguggacgagaaccaguggaacuccgccaaggaggcuguggaggacgagcgguucugggauuuaguccaccgcgagcgggaguugcacaagcagggcaagugcgcgacgugcguguacaacaugauggggaagcgcgagaagaagcucggcgaguucgggaaggcaaagggcagccgggccaucugguacauguggcucggcgcccgcuuccuggaguucgaggcgcucggguucaugaacgaggaccacugguucucccgggagaauagccuguccggcguggaaggcgagggacugcauaagcucggguacauccugcgggacauaagcaagaucccgggcggcaacauguacgccgacgacacggccgggugggacaccaggaucaccgaggacgaccugcagaacgaagccaagaucaccgacaucauggaacccgagcacgcccuccuugcuacguccaucuucaagcugaccuaccagaauaaagucguacggguccaacgccccgccaagagcggcaccgugauggacgugaucucacgucgcgaccagcggggaagcggccaagugggcaccuacgggcuuaacacguucaccaacauggagguccaguuaauucgccagauggaauccgagggcaucuucagccccuccgagcuugagaacagcaaccucgcggagcgggugcuugacuggcuggagaagcacgguguggagcgccuuaagcggauggccaucucgggcgacgacugcguggucaagccgacugaugaccgcuucgccaccgcgcugacggcccugaacgauauggggaagguccggaaggacaucccccagugggagcccagcaagggcuggaacgacuggcagcagguccccuucugcucccaucacuuucaccagcucaucaugaaggacggucgcgagaucgugguaccgugccggaaccaagacgagcuggucgggcgcgcccgggugagccagggcgcuggguggagccugcgcgagaccgccugccucggcaaguccuacgcgcagauguggcagcugauguacuuccaucggcgcgaucugcgccucgccgccaaugccaucugcuccgccguccccgucaacugggugcccaccucccggaccaccuggagcauccacgcgcaccaccaguggaugacgaccgaggacaugcugucagucuggaaccgcgucuggaucgaggagaaucccuggauggaggacaagacccacgugaguaguugggaggacgugccuuaccuggggaagcgggaggaucaguggugcgguucguuaaucggcuuaacugccagggccacgugggccaccaacauacaggucgcgaucaaccaggugcggcgccugaucgggaacgagaacuaccucgacuacaugaccuccaugaagcguuucaagaaugagagcgaccccgagggcgccuuaugguga

SEQ ID NO: 24754 - RNA, 9879 nt, Artificial Sequence
  derived and/or modified CDS sequence (opt11) from DENV-1__KM403579__SS-prME
agcgugacgaugcuacucaugcuccugcccacggcccuagccuuccaccugaccacccguggcggggagccccacaugauaguguccaagcaggaacgggguaagucccuccuauuuaagaccucggcgggggugaacaugugcacccucaucgcgauggacuuaggcgaguugugugaggacacgaugaccuacaagugcccacgcauaacugaagccgaaccggacgacguggauuguuggugcaaugccaccgacaccugggugacuuacgguacguguagccagaccggcgaacaccggcgcgacaagcguuccguagcccuggcgccccacgugggccugggccuggaaacgcgcaccgagacuuggaugucguccgagggggccuggcggcagauucagaaaguagaaaccugggcacuacgccauccuggguuuacagugaucgcuuuguucuuggcgcacgccaucggcaccucuauuacccagaaggggauuaucuuuauacuucuaaugcuagugaccccauccauggccaugcguugcgucgguaucggaaaccgcgacuucgucgaggggcucagcggcgccacguggguggaugucguguuagagcacggcuccugcgugacaacuauggcuaagaacaaacccacccucgacaucgagcugcuuaagacggagguaacgaaccccgcgguacugcggaagcucugcaucgaggccaagaucucaaacacuaccacggacuccagauguccgacccaaggggaggcuacauuggucgaggagcaggacgccaacuucgucugcagacguaccuucguagaccgggggugggguaacggcuguggacucuucggcaaggggagcuuguuaacuugcgcgaaguucaagugcgucaccaagcucgagggcaaaaucguacaauacgagaaucucaaguacuccgugauuguuaccgugcauacgggagaccaacaucaggucgguaacgaaacgacagagcacggcacgauugcuacaaucacgccccaagccccuacaagcgagauccagcucacagacuacggggcacucaccuuggacugcagcccacggaccggacuggauuucaacgagaugguccuccugacgaugaaggaaaaauccuggcuggugcacaagcagugguuccucgaccuaccgcugccuuggacuuccggugcgucgaccagccaggaaaccuggaaccggcaggaccuccuggugacguucaagaccgcacacgcaaagaagcaggagguaguggugcugggaucccaggaaggugccaugcacacugcgcucaccggggccacggagauccaaacaagcgggacaacaaccaucuucgcagggcaccugaagugccgcuugaagauggacaaauugacccucaagggagucaguuacgugaugugcaccggcagcuucaagcuggaaaaagaagucgcggagacccagcacggcacgguccuuguccaggugaaauaugagggcacagacgcccccuguaagauccccaucuccacucaggacgagaagggggucacccagaacgggaggcucaucacugccaaccccaucgugaccgacaaggagaaaccuguaaauauagaaaccgagccgccuuuuggagagucuuacauaguaaucggcgccggcgaaaaagcgcuaaagcuauccugguuuaagaaggggucaucuaucgggaaaauguucgaagcgacugcccgcggcgcucgucgcauggccauccucggcgauacggccugggacuucgggagcaucgguggcguguucaccucgguggggaagcugguccaccaaguauuuggcaccgcguacggggugcuauucucgggcguuagcuggaccaugaagauugggauaggcauccuccucaccuggcuaggccucaacagccgcuccaccagccuguccaugaccugcaucgccguugggauggugacccuuuacuuaggcguaaugguccaggcggauagcgggugcgucauaaacuggaagggccgggaacucaaauguggguccggcaucuucgucacaaacgaggugcauaccuggaccgagcaguauaaguuccaggccgacucgccgaagcgccuaagcgcggccaucgguaaggcuugggaggagggggugugugguauucgauccgccacgcgccuugagaacaucauguggaagcagaucagcaaugagcugaaccacauacugcucgagaacgacaugaaguuuacagucgucgugggcgaugcgaacggcauacugacucaggggaagaagaugauccggccccagccuauggagcacaaguacagcuggaaaaguuggggcaaggcgaagaucaucggggccgauauccagaacacuaccuucauaauugacgggcccgauacaccggagugccccgaugaucaacgugcauggaacaucugggaggucgaggauuacggcuucgggguuuuuacaaccaacaucuggcugaaacucagagauucauacacucaaaugugcgaucaccgacugaugucagccgcgaucaaagacagcaaggccguucacgcagacaugggcuacuggaucgaaagcgagaagaacgaaacauggaagcuggcccgcgcuucuuuuaucgaagucaagacguguaucuggccuaggucucacacgcuuuggagcaauggcgugcuggagagcgagaugaucaucccgaagaucuacggaggcccuaucucacagcacaacuaccggccuggguacuucacgcaaaccgcggggccguggcaccuaggaaagcucgaauuggacuucaaccugugcgaagguacuaccguugucguggacgagcauugcggcaacagagggccgucgcuccggaccacaacagucacgggcaaaaucauccacgaguggugcugucgcuccugcacccuuccgccccugcguuuucgcggggaggaugguuguugguacggaauggagauacggccagucaaggagaaggaagagaaccucguccgcagcaugguguccgccgggagcggcgaggucgacucuuucagccugggguuacucugugugagcaucaugauugaagaagugaugcguucccggugguccagaaaaaugcugaugaccggcaccuuagccgucuucuuucugcugaucauggggcagcucacuuggaacgaccucauacgccugugcaucauggugggggcuaacguaucugaccgcauggguauggggacuacguaccuggcacucauggcaaccuucaaaaugcggcccauguuugccgucggucuguuauuucgacggcuuacuagcagagaggugcuguugcucacgaucggccugagccugguugcuagcguagagcuacccaauagucuugaggaauuaggggacggccucgccaugggcaucaugaugcugaagcugcucaccgauuuucagagccaucagcuauggacgacuuugcucucccugaccuucaucaagaccacauugucccuugacuacgccuggaagaccauggcaauggugcuguccaucguuucacucuucccccucugccuguccacgaccucgcagaagacgaccuggcugcccguucuccugggcuccuucgggugcaaaccucugaccauguuccucaucaccgagaacaagaucuggggucgcaaguccuggccacugaaugaggggauuauggccgugggcauagucuccauccugcucagcagcuuauuaaagaaugacgugccacucgcagggccgcugauugccggcggcaugcugaucgccugcuauguuaucuccggaagcuccgcagaccucagccuggaaagggccgccgaagucucuugggaagaggaagccgagcacagcggagcuucccauaacauucugguugagguccaggaugacgggaccaugaagauaaaggaugaggagcgcgacgacacgcucaccauucugcugaaggccacccuccuggccgucucuggcguguacccgaugucuaucccagccacccuguucgugugguacuuuuggcagaagaagaagcaacgcagcggcguacugugggacacgccuucuccgcccgagguggaaagagcugugcuggacgauggcauuuaccgaauccugcagcgagggcugcucgggcgcagccaggucggcgugggaguauuucaggacggcgucuuucacaccauguggcacgugacaagaggggcggugcuaauguaccagggcaagcgccuagagcccuccugggccucaguuaagaaagaccucaucuccuacgguggaggcuggcguuuccagggcaguuggaacacgggcgaggagguacaggugaucgcggucgagcccggcaaaaaccccaagaaugugcagacgacgcccggcacuuucaagacccccgagggcgagguaggggcgaucgcacuggacuucaagccuggcacguccgggagccccaucguaaaccgcgagggcaagauaguagggcuguaugggaacggugucgucaccaccuccgguaccuacgugagcgccaucgcccaggcuaaagccagccaggagggcccacuccccgagaucgaggacgagguguuuaaaaagcggaaccugaccauaauggacuuacaucccgggaguggcaaaacccgccgguaccucccggcgaucgugcgcgaagcgaucaagcgcaagcugcggacccuaauccucgccccaacucgcgugguugccagcgagauggccgaggcacucaaggguaugcccauacgauaccagacgaccgccguaaagagugaacacaccggaaaagagaucguggaucugaugugucacgccacauucacgaugcguuugcugaguccgguccgcgucccgaacuacaacaugauuaucauggaugaggcgcacuucaccgaucccgcuuccaucgcugcgcguggauacaucucaaccagggugggaaugggcgaggccgccgccaucuucaugacugcuacgccgcccggguccguugaggcauucccucagagcaacgccgucauccaagaugaggagcgagauauuccggagcguucguggaacagcggcuaugacuggaucacagauuucccaggcaaaaccgucugguuuguccccaguauuaagucagguaacgacaucgccaacugucugaggaagaacggcaagcggguuauccagcucucucgaaagaccuucgacacagaguaccagaagaccaagaacaacgauugggacuauguugugacgaccgacauuucggaaaugggggccaacuucagagcggaucgcgucauugacccucgucgcugccugaagcccguaauccugaaagacggccccgagcgggucauccucgcgggucccaugccgguaacagcggccucggcggcccagcgccggggccgcaucggccggaaccagaacaaggagggagaccaguacaucuauauggggcagccucugaacaaugacgaggaccaugcccacuggaccgaggccaaaaugcuucucgacaacaucaacacgcccgaagggaucauucccgcgcuguuugagccggagcgagagaaguccgcagccaucgacggggaauaccgccuucgcggggaggcgcgaaaaacuuucguggaauuaaugcgccgcggagaccuucccgucuggcuguccuauaagguugccagcgagggcuuucaguacucagaucguagguggugcuuugacggggagcguaacaaucaggugcucgaagagaauauggacgucgagaucuggacgaaggagggcgagagaaagaaacuucggccgcgguggcucgacgcccggaccuacucagauccacucgcguuacgcgaguucaaggaguucgccgccggucgacgaucaguuuccggcgaccugauuuuagaaaucggcaagcugccgcagcaccugaccuuacgggcccagaacgcacuugacaacuuagugaugcuccacaauucggagcaaggagggaaagcguaccgccacgcaauggaagaacucccggacaccaucgagacccucauguugcucgcccucauugccguacucacagggggaguaacacucuucuuccugagcgggaagggcuuagguaagaccagcauugggcuccugugcgucauggcgucuucaguucuccucuggauggcaucaguggagccccacuggaucgccgccucgaucauccucgaauuuuuccugauggugcugcugauccccgagccggaccgacagcgaacuccccaagacaaccagcuagccuacgucgugaucgguuugcuguuuaugauccuuacggucgcggcgaacgagauggggcugcuugagaccacuaagaaggaccuuggcaucggucaugucguggccgagaaccaucaccaugccacuauguuggauaucgaccugcaccccgcuuccgcguggaccuuguacgccguagcaaccaccaucaucacccccaugaugagacacacgaucgagaacaccaccgccaacaucagccugacagccaucgcgaaccaggcugccauccugauggggcucgauaaaggcuggccuaucuccaaaauggauaucggugucccccuguuggcccucggaugcuauagccagguaaacccccugacucuaacggcugcggugcucauguuagucgcccacuacgccaucauagggccgggccugcaggccaaggccacacgcgaagcgcagaaacgcaccgcggcagggauuaugaagaaccccacgguggauggcaucguggcgaucgauuuagaucccguuguguacgacgcgaaguucgagaagcagcuuggacagaucaugcugcuuauccuguguaccucccaaauccugcucaugcggaccaccugggcacugugcgagagcaucacccucgccaccgggccgcucacaacccuaugggaaggcuccccagggaaguucuggaacacgacgaucgccgucucgauggccaacaucuuucgcggcucuuaucuugcaggcgccgggcucgcguucucucucaugaaaucccugggcgggggccgcagaggaacaggcgcccagggagagaccuugggagagaaauggaagcgacaacuaaaccagcuuagcaagucggaguucaacaccuacaagcgcuccggcaucauggaggucgacaggucagaagccaaggaggggcucaagaggggagaaaccacaaagcacgcugugucccggggcaccgcuaagcuacgcugguucguggaacggaaucuggucaagcccgaggguaaggugaucgaccugggcuguggacguggcggguggagcuacuacugcgcgggccucaaaaaggugacggaggucaagggguacaccaagggaggccccggucaugaggaacccauaccgauggcaaccuacggcuggaacaucguuaaauuacauucagggagggacgucuucuuuacgccgccagaaaagugcgacaccuugcucugcgacaucggggagucgucccccaacccuacgaucgaggaagggcgcaccuugcggguccugaaaaugguagagcccuggcuccgcggcaaccaguuuugcaucaagauucugaaccccuacaugcccagcguggucgagacacuggaacagaugcagcgaaaacaugguggaaugcugguuaggaauccguuaucccgcaacucgacgcacgagauguacugggugagcugcgguacggggaacaucgucucugccgugaacaugacuucgcgcauguuacucaaccgcuucacgauggcacaccggaaacccacuuaugaacgcgauguggaccuuggcgcaggcacgcggcacgucgccguggagcccgagaucgcgaaccuugacauuaucgggcagcgcaucgaaaacauuaagaaugagcacaagaguaccuggcacuacgaugaggacaaccccuacaagacuugggcguaccacggguccuacgaggugaagccgucgggcuccgccagcuccaugguuaacggcgugguccggcucuuaacuaagccaugggaugucauuccuauggugacucagaucgccaugacggacaccacccccuucggacagcagcgcgucuuuaaagagaaaguagacacucgcacaccgcgccccaaacggggcaccgcucagauaauggaagugaccgccaaauggcuguggggcuuccugagccgcaacaagaagccccgcaucuguacgcgggaggaguucacacgcaaagugcgaucaaaugcagccauaggggccguuuuuguggaugaaaaccaauggaacucugcuaaggaggccgucgaggacgaacgcuucugggaccuggugcaucgcgaacgggagcugcauaagcaaggcaaaugcgccacaugcguguacaauaugauggguaaacgcgaaaagaagcucggugaguucgggaaggccaagggcucgcgggccauuugguacauguggcucggagcccgcuuccuggaguuugaggcccucggguuuaugaacgaggaccacugguuuuccagggagaauagccugagcggugucgagggggagggccuacauaagcuaggauacauuuugcgcgauauaucgaagaucccgggaggaaacauguacgccgacgacacggcuggcugggauacacguauaacugaggacgaccugcaaaacgaggccaaaaucacagauaucauggagccugagcacgcucuacuagcgacaaguaucuucaaacuuaccuaccagaauaaggugguacgcguucagcggccugccaaguccgggacggugauggacgugaucagucgacgggaccaacgcgggagcggccaagucggcacguacggacucaacacguuuacgaacauggaggugcagcucauccgacagauggaguccgaaggcaucuucagccccagugaacuggggaacagcaaccuggccgagcgggugcuggacugguuggaaaaacacggcgucgagcgguugaagcgcauggcaaucagcggggacgacugcguggucaagccgacugaugaucgcuucgccaccgcacugacugcccugaaugacaugggcaagguuaggaaggacauuccccagugggaaccaucuaagggcuggaacgauuggcagcaggucccuuucugcagccaccacuuucaccaguugaucaugaaggacgggagggaaauugugguccccugccgcaaccaggaugagcuagucggccgagcccgagugucgcagggcgcuggcuggagccuucgagaaacggcaugccucgggaaguccuacgcgcaaauguggcagcuuauguacuuucacagacgcgauuuacgguuggccgccaacgcuaucugcagcgccgucccugucaacugggugcccaccucgcgcaccaccuggagcauccacgcgcaccaccaauggaugacaacggaggacauguuauccgucuggaaccgcgucuggaucgaggagaacccauggauggaggacaaaacacacgugucaaguugggaggacgucccguaccugggcaagcgggaggaccaauggugcggcagucuuaucggccugacugcacgagcaaccugggccacgaauauccaaguggcgaucaaccaggugcguaagcuaaucgguaacgagaacuauuuagacuacaugacuuccaugaaacguuucaaaaacgaaagcgacccagagggggccuugugguga

SEQ ID NO: 24755 - RNA, 9879 nt, Artificial Sequence
  derived and/or modified CDS sequence (opt11) from DENV-1__HM469968__SS-prME
ucggugaccaugcugcucaugcuuaugcccacggcacuggccuuccaccucaccacccgggguggggagccccacaugaucgucagcaagcaggaacgaggcaagucucuguuauucaagaccagcgccggggugaauaugugcacgcucauugccauggaccugggagaguuaugcgaggacaccaugaccuacaagugcccccgcauuaccgaggccgaacccgacgacguggacuguuggugcaacgccaccgacacgugggugaccuacgggaccugcagccagaccggugagcaccggcgcgacaagcguuccguggcccucgcgccccacgugggccuggggcuggagacgcgcaccgagaccuggaugagcuccgagggcgccuggaagcagauccagcgggucgagaccugggcccugcgacaccccggguucacgguuauagcccuguuucuggcgcacgccaucggcaccagcauaacccagaaggggauuaucuucauccuccugaugcuggugacccccagcauggccaugcggugugucggcaucggcagcagggacuucguggagggacucuccggagccacguggguagacgucgugcuggagcacgggagcugcgugaccaccauggccaaagacaagccuaccuuggacaucgaacuccugaagacggaggucacgaaccccgcggugcugcggaagcucugcaucgaggcaaagaucuccaacaccacgacggacagccgcugcccgacccagggcgaggcgacccugguggaagaacaggaugccaacuucgucugccggcgcaccuucguugaccgcggcugggggaacggcugugggcuguucgggaaggggucccucaucacuugugcuaaguuuaaaugcguuaccaagcuggaggggaagaucguccaguacgagaaccugaaguacagcgugaucgugaccguccacaccggagaccagcaccagguggggaacgaaucuacggagcacggaaccacugccaccaucacuccccaggcccccacgaccgagauccagcucacggacuacggggcccugacccuggacuguagccccagaacgggccucgacuucaaugaaaugguccugcugaccaugaaggagaagucauggcuagugcacaagcagugguuccuggaccugccccucccuuggacuagcggggccucaaccucccaagagacguggaaccggcaggaccugcuggugaccuucaagaccgcucaugccaaaaagcaggaggucguggugcucggcagccaggagggcgcuaugcacaccgcccugaccggggccacggagauccaaaccuccgggaccacgaccauauucgcagggcaccugaagugccgccucaagauggacaagcugacucucaagggcaugagcuacgucaugugcaccggguccuucaaacucgagaaggagguugcggaaacgcagcacggcaccgugcugguccagaucaaguacgagggcacggacgcccccugcaagaucccguuuagcacccaggacgagaaaggggugacgcagaauggccgacugauaacagccaacccgaucgugaccgacaaggagaagcccgucaauaucgaggccgaaccacccuuuggugagagcuacauugugauaggggccggcgagaaggcccugaagcucaguugguuuaagaaggggucaagcaucggcaagauguucgaggcaaccgcccgcggggcccggcgcauggcaauccugggagacacggccugggacuucgguuccauaggcggugucuucaccagcgucgguaagcugguacaccagaucuucggcaccgccuacggcgugcuguucagcggcguaagcuggaccaugaagaucgggaucggcgcccugcugacauggcuaggccugaacucccgguccaccucccugagcaugaccugcaucgcuguggggcucguuacgcuuuaccugggcguaauggugcaggcggacagcgggugcgugauuaacuggaaaggccgggagcucaagugcgggagcggcaucuucgucacgaacgaggugcacaccuggacagagcaguacaaauuccaggccgacagccccaagcgccucuccgccgccauugguaaggccugggaggagggggugugcggcauacgguccgccacccgccuggagaacaucauguggaagcagaucuccaaugagcucaaccauauccugcuggaaaacgacaugaaguucaccgucgugguuggggacgucgccggaauccucgcucaggggaaaaagaugauccggccccaacccauggaguacaaguacagcuggaagucauggggcaaggccaagaucaucggcgcggacgugcagaauacgacuuucaucaucgacgggcccaacaccccggagugcccggaugaccagagagcauggaacaucugggaaguggaggacuauggcuucgggaucuucaccacgaacaucuggcuuaagcugcgggacagcuauacccaggucugcgaccaccgccucaugucugccgccaucaaggacagcaaggccgugcacgccgauaugggcuauuggaucgaauccgaaaagaaugagaccuggaaauuggcccgggccuccuuuauugaggugaagaccugcauauggcccaagucccacacgcuguggagcaacggcgucuuagaaagcgagaugaucauccccaagauauacggcggaccgaucagccagcacaacuaccgccccggguacuucacccagaccgcgggcccuuggcaccuggggaaacuggagcucgacuucgaccugugcgagggcacaacggugguuguugacgagcacuguggcaaccgggggccgucccugcggaccaccaccguuacggggaagaucauacacgaguggugcugccggaguugcacccuuccuccccuaagauucagaggggaagaugguugcugguacgggauggaaauccgccccgugaaagagaaggaggagaaccuggucaaauccauggugucggcaggaucuggcgagguggacuccuuuagcuugggguuacugugcaucagcauuaugaucgaggaggucaugagaagccgcuggagccggaagaugcucaugaccggcacccucgcgguguuuuuccugcuaaucauggggcaacugacguggaacgauuugauacgccucuguaucaugguaggcgcaaacgccuccgaccguauggggaugggcaccaccuaccuggcccugauggccaccuuuaaaaugcggccgauguucgcggucggauuacuguuccgucggcugacgagccgcgaggugcuccugcugaccaucgggcucagucugguggcgagugucgagcuccccaacagucucgaggaacugggcgacgggcuggccaugggcauuaugauccuaaagcugcuuaccgacuuccagucccaccagcucugggccacccugcugagccucacguuuaucaagaccacauucucacugcacuacgcguggaaaaccauggcaaugguucugagcaucguuucccucuucccccugugccugagcaccaccucccagaagaccaccuggcuccccguccuguugggcagccucgguugcaagccgcugacgauguuccugaucgccgagaauaagaucuggggccggaaauccuggccccucaacgaggguaucauggccgugggcaucgucagcauccugcugucgucccuccugaagaacgacgugccccuggccgggccgcucaucgcaggcggcaugcugauugcuugcuacgugaucucuggguccagcgccgaccugucccuagaaaaggccgcagaggucagcugggaggaggaggcggagcacuccggcgccagccacaacauccugguggaggugcaggacgacgggaccaugaagaucaaggacgaggagcgcgacgacacccugacaauccuccugaaggcaacccugcuugccguauccggcguguacccgcugagcauccccgccacgcuguucgugugguauuuuuggcagaagaagaagcagagauccgggguccucugggacacccccagcccgcccgagguggagcgcgcggugcuggacgacggcauuuaccggaucaugcagcgcggauugcugggccggagccaggucggcguagggguguuccaggaaaacgucuuucacaccauguggcacguaaccagaggcgcaguucucauguaccaaggaaagcggcuggagcccagcugggccuccgucaaaaaggaccucaucagcuacgguggcggguggcgacuccagggcuccuggaacacuggugaggaaguccaggugaucgcuguugagcccggcaagaacccgaagaacgugcagaccgccccugggaccuucaagacccccgagggugaggugggcgcgaucgcccucgacuucaagcccgggacgagcggcagccccaucgucaaccgggagggaaagauagugggccuguacggcaacgggguggucaccaccagcggcaccuacgugagcgccauagcacaggcgaaggccagucaggaggggccacuccccgagaucgaggaugagguguuccgaaaacggaacuuaacgaucauggaccugcaccccggcagcgggaagacucgccgguaccucccagccaucguccgcgaagccaucaagcggaaacugaggacucugauccucgccccuacgcgcgugguggcguccgaaauggccgaagcccugaagggcaugcccaucagguaucagacgaccgccguuaagagcgagcauaccggcaaagaaaucguggaucugaugugccacgcaaccuucacgaugcgccuacugucccccgugcgggucccaaacuacaauaugaucaucauggacgaggcgcauuucaccgaccccagcucgaucgccgcccgcggguacaucucuacccgggugggcaugggagaggccgccgcaaucuucaugaccgcaacgccgcccggcucgguggaggccuucccgcaaagcaacgccgucauccaggacgaagaacgggacauuccagaacgguccuggaacagcggguacgaguggaucaccgacuuccccggcaagaccgugugguuugugcccuccaucaagagcgguaacgauaucgcgaacugccugagaaagaaugggaagcgagucauacaacucucccgcaagacauucgacacggaguaccagaaaaccaagaacaacgacugggacuacguaguuaccaccgacaucagcgagaugggcgcaaacuuccgggccgaccgcguuaucgacccgcgacguugccugaagcccgugaucuuaaaggaugggccagagcgggugauccucgcgggccccaugccagucacaguggccucagcggcucagcgccgggggcgaaucggcaggaaccacaacaaggaaggggaucaguacaucuacaugggacagccccugaacaacgacgaagaccacgcccacuggaccgaggccaagaugcugcuagacaacaucaacacccccgagggcaucauuccugcccuguucgagccggagcgugagaagucagcggccaucgacggggaguaccgccuucggggcgaggcacgcaagaccuuugucgagcuuaugcggagaggggaccugcccgugugguugaguuacaaaguggccuccgagggcuuucaguacagcgaccggcgcuggugcuucgacggcgagcggaacaaccaaguccucgaggagaacauggacguggagaucuggacgaaggagggggagcgcaagaaguugaggccccgcugguuggacgcccggaccuacuccgacccucuggcgcugcgcgaguucaaggaguucgccgccggaagacgcagcguguccggggaccugauucucgaaauaggcaagcugccgcagcaccugacccagcgggcacagaacgcgcucgacaaccuggucaugcuucacaacagcgaacagggcgggcgcgccuaccggcacgccauggaagaacugccggacacgaucgagacauugauguuguuggcgcuaaucgccgugcugaccggaggcguaacccuguucuuccuguccggccgcggacugggcaagaccagcaucggacugcugugcgucauggcauccagcguacuucucuggauggccuccguggagccccauuggaucgccgcgagcaucauccuggaguucuuccugaugguccuccugaucccugagccggaccggcagcgcacgccccaggacaaccagcuggccuacguggugaucgggcucuuguucaugauccucacagucgcggccaaugagaugggccuacuggagaccacuaagaaggaccuggguauuggacauguggcgguggaaaaccaccaccacgccgccaugcucgacgucgaccugcaccccgcguccgccuggacccuguacgccguggccacgaccaucaucaccccgaugaugcggcacaccaucgagaacacgacugcgaacaucagccucacugcgaucgccaaucaggccgcuaucuugauggggcuggacaagggcuggcccauuucuaagauggacaucggcgugccucuccuggcucugggguguuacagccaagucaacccuuugacccuuacagccgccgugcugaugcucguugcccacuacgccauaaucgggccgggguuacaagcaaaggccacccgcgaagcccagaagcgcaccgccgccggcaucaugaagaaccccaccgucgaugguaucguggcgaucgaccuggaccccguggucuacgacgccaaguucgagaagcagcucggccaaauaaugcugcugauccucugcacgucccagauacugcugaugaggaccacgugggcacuaugcgagagcauaacccuggccacgggcccccugaccacccucugggaggggucaccgggcaaguucuggaacacaacaauugccgugagcauggcgaacaucuuccgcggguccuaucuggccggcgcaggucuggccuucagccucaugaagucucuugggggcgggcggcgcgggaccggcgcgcagggugaaacacugggcgagaaguggaagcggcagcucaaccagcucuccaagucggaguucaauaccuacaagcgcuccggcaucauggaaguggacagauccgaggccaaggagggccugaagcgcggggagaccaccaaacacgcgguuucccggggaaccgccaaacuccgcugguucguggagcggaaccuggugaagcccgaggggaaggucaucgaucugggcugcggccgcgggggcuggagcuacuacugcgccgggcugaagaaggugaccgaggugaaaggcuacacuaaaggcggccccggccacgaggagcccauaccgauggcgaccuacggguggaaccucgucaagcugcacucgggcaaggacguuuucuuuaucccaccagagaagugcgacaccuuguugugcgacaucggggagagcuccccaaacccgacgauagaggagggucggacacuccgcgugcugaagauggucgaacccugguugcgggggaaccaauucugcaucaagauccugaaucccuacaugcccagcguuguggagacccuggagcaaaugcagcggaaguacggcggcaugcucguccgcaacccgcugucccgcaacagcacccacgaaauguacuggguguccugcgggaccgggaacaucgugagcgcgguaaacaugaccagccggaugcugcucaaccgguuuacaauggcccaccgcaagcccaccuacgagcgggacguggaccugggagccgguacccgccacguggcgguggaacccgagguugcgaaccuagacauuaucggccagcggaucgagaacauaaagcacgagcacaagucaacauggcacuacgacgaggacaacccguacaagacgugggccuaccacggguccuacgaggugaagccgagcggcuccgccagcagcauggucaacggcguggucaagcuccugaccaagcccugggacguaauccccauggugacccaaaucgcuaugacugauacgacccccuucgggcagcagcgcgucuucaaggagaagguggacacgagaacuccgaaggccaagcgcgggacggcgcagaucauggaggugaccgcccggugguuauggggcuuccugagucguaacaagaagccccggaucugcacccgcgaggaguucacccggaagguccggagcaaugcggccauaggcgcgguguucguggaugagaaccaguggaacagugcgaaggaggccgucgaggaugagcgguucugggauuuagugcaucgugagagagaguugcacaagcaggggaaaugcgccacgugcgucuacaacaugaugggcaagcgcgagaagaagcucggggaguucggcaaggccaaggggagccgugcgaucugguacauguggcugggcgcccgcuuccuggaguucgaggcccucgguuucaugaaugaggaccacugguucucccgagagaacagccuguccggggucgagggcgaggggcugcauaagcucgguuacaucuuacgcgacaucucuaaaaucccagggggcaacauguacgccgacgacaccgccggcugggacacccggauuacugaggacgaucugcagaacgaggcgaagaucacggacaucauggagccagagcacgcccuccuggccaaggccaucuucaagcugacuuaccagaacaagguggugcgcguccagcgccccgccaagaacggcaccgucauggacgugauaucaagacgcgaccagagaggcagcggccagguggggaccuacgggcucaacacguucaccaauauggaggcccagcugauccgccagauggaguccgaggggaucuuucugcccuccgagcucgagacccccaaccuggccgagagaguucuggacuggcucgagaaguauggcguggagagacugaagcggauggcgaucuccggugaugacugugucgugaagccgaucgaugaccgcuucgccaccgcccugacggcgcucaacgauauggggaaagugagaaaggacaucccccagugggagcccagcaagggcuggaacgacuggcagcagguccccuucugcucccaccauuuccaccagcugauuaugaaggacggcagggagaucgugguuccgugccggaaccaggacgagcuggucgggcgggcccgggugagccagggggcgggcuggucccuccgggaaacggcaugccuggguaagaguuacgcucagauguggcaacugauguacuuccaccggcgcgaccuccgucuggccgccaacgcaaucugcagcgcagugcccgucgacugggugcccaccagccgcacuacauggagcauccacgcgcaccaccaguggaugaccacugaggauaugcuguccguuuggaaccgggucuggaucgaggagaaccccuggauggaggacaagacccacaucagcucgugggaggacgugccguaccucgguaaacgcgaggaccaguggugcgggagccugaucggcuugacagcccgcgcuaccugggccaccaauauucagguggccaucaaccagguucggcgccucauaggcaacgagaauuacuuagacuacaugaccuccaugaagcgguuuaagaacgagagcgacccggagggggcgcugugguga

SEQ ID NO: 24756 - RNA, 9879 nt, Artificial Sequence
  derived and/or modified CDS sequence (opt11) from DENV-1__KC172834__SS-prME
agugugaccaugcugcugaugcugaugcccacagcccuggccuuucaucucaccacucgcggcggggagccacacaugaucgucagcaagcaggagcgaggcaaaagucugcuguucaagaccuccgcaggggucaacaugugcacccucaucgccauggaccugggcgagcugugcgaagauacgaugaccuauaagugcccccguaucaccgaagccgagccggaugacguggacugcuggugcaacgccacugacaccugggucaccuaugggacaugcucucaggccggcgagcaccggcgggacaaacgcuccguggcccuugcgccgcacguuggccuaggucuggagacccggacggagacuuggaugagcuccgagggcgccuggaaacaaauacaacggguggagaccugggcccuccgccaccccgguuucacggugaucgcucuguuccuggcucacgcaaucggcacuaguaucacgcagaagggaauuauuuucauccuacugaugcugguuacacccuccauggccaugcggugcgucggcaucggcagccgcgacuuuguugaggggcucuccggugcuaccuggguggacgucgugcucgaacacgggagcugugugacgaccauggcgaaggacaagccgacguuggacauagagcucuuaaagaccgaagucacgaaccccgccgugcuucggaagcucugcauagaggccaagaucuccaacaccaccacggacagccgcugcccuacgcagggcgaggccacccugguagaggagcaagacgccaacuucgucugucggcgcacauucguggaccgaggcugggggaacggcugcgggcuguucggcaaagggucccuccugacuugcgcgaaguucaagugcgucacgaagcuggagggcaagaucguccaauacgagaaccucaaguacaguguuaucgugacgguucacaccggcgaccagcaccaggucgguaacgaguccaccgagcacggcacuacagccaccaucacgccccaggcccccaccacggagauccaguugacagacuacggcgcauugacccucgacugcagcccacgcaccggccuggacuucaaugagaugguacugcucaccaugaaagaaaaguccuggcugguacacaagcagugguucuuggaccucccacucccuuggaccagcggcgccagcaccucccaggagaccuggaaccggcaggaccuccucgugacguucaagaccgcgcacgccaagaagcaggaggugguggugcucggcucccaggagggcgcaaugcacaccgcacugaccggggccacggaaauucagaccuccggcaccaccaccaucuucgcggggcaccucaagugccgccugaagauggacaagcugacucucaagggcaugaguuacgucaugugcaccgggucauucaaacuugagaaggagguugccgaaacucagcacgggacugugcugguacagaucaaguacgaaggaaccgaugcccccugcaagauacccuuuagcacccaagaugagaagggggugacccagaacggccggcucaucacggccaacccgaucgugaccgacaaggagaagcccgucaauaucgaggcggagccgcccuucggggaguccuauaucgugaucggcgccggagagaaggcccucaagcugagcugguuuaagaaggggucgagcaucgggaaaauguucgaggcgaccgcucgcggggcgcgccgcauggcuauccugggugacaccgccugggauuucggguccauuggcggcguguuuaccagcgucggcaaacucguacaccaaaucuucgguacugccuaugggguacucuuuuccggcgucagcuggaccaugaagaucgggaucggcguccuccucaccuggcugggccugaauucucgcucaaccucccuaagcaugaccugcauagcagugggguuagucacacuguaccuuggcgugaugguccaggcggacuccgggugcgucaucaacuggaagggccgugaauuaaagugugggucuggaauauucgugaccaacgaggugcacacguggaccgagcaguacaaguuccaggccgacagccccaaaagacuuuccgcagcuaucgggaaggcuugggaagaaggggucugugguauccggucggcaacccgccucgagaauauaauguggaagcagaucuccaaugagcuaaaccacauccuucuggagaacgacaugaaguuuaccguggugguuggggauguggccggcauccuggcccaagggaagaagaugauccggccccagcccauggaguacaaguacagcuggaaguccuggggcaaggccaagaucauuggcgcagacgugcagaauagcacguuuaucaucgacgggcccaacacgccggaaugccccgacgaccagcgcgcauggaauaucugggaggucgaggacuacggcuucgggaucuucacgaccaacaucuggcugaagcuccgggauuccuacacacaggugugugaccacagacugaugagcgccgccaucaaagacucgaaggcaguacacgcggacaugggcuacuggaucgagagcgagaagaacgagacuuggaagcuggccagagccuccuucauugaggucaaaaccugcauuuggcccaagagucacacccuuugguccaacggagugcucgagagcgagaugaucauccccaagaucuacgggggcccgaucucgcagcacaacuaccgccccggguacuucacccagacagccggccccuggcaccuggggaagcucgagcucgacuuugaccugugcgagggcaccacuguggucguggacgaacauugcggcaaucggggcccgucucuccgaaccacgacaguaaccggaaagaucauccacgagugguguugucggucuugcacccugccgccccugcgcuuccgcggggaggacggauguugguacgggauggagauccgcccagucaaggagaaagaagagaaccucgugaaauccauggugagcgccggcuccggcgaggucgacucuuucucccugggacugcuaugcaucucuaucaugaucgaagaaguuaugcgaagucgcuggucacggaagauguugaugacggguacccuggcgguguucuuccuccugauaauggggcaguugaccuggaacgauuuaauccgcuugugcaucauggucggcgccaacgccucugaccgcauggggauggguaccacguacuuggcguuaauggccaccuuuaagaugcgaccgauguuugcugugggacugcuauuccggagguuaaccagccgugaaguccuacuguugacgauugggcugucccuggucgccagcguggagcuccccaauucccuugaggaacugggagaugggcucgccaugggcaucaugauacucaagcucuugacggacuuccaaagccaccagcugugggccacucugcucucccugaccuucaucaaaaccacuuuuucucugcacuacgcguggaagaccauggccauggugcucuccaucgugagccuguucccgcugugucucuccaccaccagccagaagacuaccuggcugccuguacuacucggguccuuagggugcaagccgcucaccauguuccugauagccgaaaauaagaucuggggccgaaagagcuggccguuaaaugaggggauaauggccgucggcaucgugucaauccugcucuccagccugcugaagaaugacgugccuuuagccgggccccugauagcggguggaaugcugauugccugcuacgugaucagcgggagcagcgccgaucucagccuggagaaggccgccgaaguaucgugggaagaagaggcggagcacagcggcgcgagucacaauauccugguugaaguccaggacgacgggaccaugaagauuaaggaugaggagcgcgacgauacccucaccauccuccugaaggccacccugcuggccgugagcggcguguacccgcuguccaucccugcgacccucuucgucugguacuuuuggcagaagaaaaagcagcggagcggggugcucugggauacgcccagcccgccugagguggagcgcgcgguccuggacgaugggaucuaccggaucaugcaacgcggccuccucgggaggagucaggucggcguggggguuuuucaggagaauguuuuccacacgauguggcacgugacucgaggcgccgugcucauguaccaggggaagcgacuggagcccaguugggccuccguuaaaaaggaccucauuuccuacggcggaggguggcgcuuccagggaagcuggaacaccggggaggaggugcaggucaucgccgucgagcccggcaagaaccccaagaacgugcagacagcccccggcacauucaagaccccugagggcgaagucggugcuaucgcguuagauuucaagcccggaacuuccggcagccccaucguaaaccgggaggggaagaucgugggcuuguacggaaauggggucgugaccaccagcgguacuuacguuucugccauugcucaggcuaaggccagccaggagggaccucucccugaaaucgaggacgaggucuuccguaagcgcaaccugaccaucauggaccugcacccaggcuccgggaagacccgacgguaccucccggccaucgugcgcgaggccauuaagagaaaacuccguacgcugauccucgcaccuacccgcguggucgcgagcgagauggccgaggcccuaaagggcaugccgauccgguaccaaaccaccgccgucaagucagaacacacagggaaggaaaucguggaccuaaugugccacgccaccuucaccaugcgccuccugagcccuguaagaguaccgaauuacaacaugauuauuauggacgaggcgcacuucacggaccccuccagcaucgccgcccguggguacauuuccacgcgugugggcaugggggaggccgccgcgauuuucaugacagcaacgccgccuggcagcauggaggccuucccucaguccaacgccgucauccaggacgaggaacgcgacaucccugagcggucguggaaccuggggcacgaguggaucacagacuuccccggcaagacggugugguucguccccuccaucaaggcgggcaacgauauugcuaacugccuucgcaaaaauggcaagagagucauccagcugucccgcaaaaccuucgacacugaguaccagaagaccaagaauaaugacugggacuaugugguuacuaccgacaucagcgagaugggagccaacuuucgggccgaccgcgucaucgacccccggaggugccucaagcccgugauccucaaggacgggcccgagcgggugauacucgccggcccuaugccggucaccguggcgucagcggcccaacgccgggggcgcaucggccggaaccacaacaaggagggcgaccaguacaucuacauggggcagccccugaacaacgaugaggaccacgcgcacuggaccgaggccaagaugcuccuggacaauaucaacacgccggagggcaucauccccgcucuguuugagccggagcgagagaaaucugccgccaucgacggcgaguaucgccuccggggcgaggcgcgcaagaccuucgucgagcugaugcggcggggggaccugcccguguggcucuccuacaaaguggccagcgagggguuucaguacucagaccggcgcuggugcuucgacggcgagcggaacaaccagguccuagaggagaacauggacguggagauauggaccaaagaaggggagcgcaagaagcugcggccacgcuggcucgaugcgagaaccuacagcgacccccuggcgcugcgcgaguucaaggaguuugccgcuggccggagauccguaagcggggaucuaauccuggagaucggcaagcugccgcagcaccuaacgcagcgggcgcagaacgcgcuggauaaccuggucauccugcacaacuccgagcaaggggggcgcgccuaccggcacgccauggaggaacugcccgacaccaucgaaacucugaugcuucuggcccuaaucgcgguguuaacuggcggggugacgcuguucuuccucagcgguaaggggcucggcaaaaccucuaucgggcugcugugcgucauggccucuaguguccuccuauggauggccaguguggagccccacuggaucgccgcuuccauaauacuggaguucuuccucaugguccugcugauccccgagccggacaggcagcggacgccccaggacaaccagcucgccuacguggugaucggguugcuguucaugauccucaccgucgccgccaacgagaugggccugcuagagaccacgaagaaggaccucgguauuggucacguagccgucgagaaccaccaucaugccgcgaugcuggacguggaccugcacccagccagcgcguggacucucuacgccguggcuaccacaaucauuacgccgaugaugcgccacaccauagagaacaccacugcuaacaucuccuugacggccaucgccaaccaggccgccauccugaugggacucgacaagggcuggccgaucucgaagauggacaucggcguaccccuacuggccuuagggugcuacucccaggucaauccccuuacccugaccgcugcugugcucauguuaguggcucacuacgcgaucaucggacccgguuuacaggccaaggccacccgcgaagcccagaagaggacagccgcgggcauaaugaagaaccccaccauagacggaaucgucgcgaucgaccucgaccccguaguuuaugaugccaaguucgagaaacagcugggccagaucauguuauuaauccugugcaccucccagauccugcucaugcgcacuacgugggcccugugcgagucaauaacccuggccacuggcccccucacgacgcugugggaggggucgccgggcaaauucuggaacaccacuaucgcggucuccauggccaacaucuuuagggggaguuaccuggccggugccggccucgcguucucccugaugaagucccucgggggggggcgucgggggacuggggcccagggggagacacucggcgagaaauggaagagacagcugaaccagcucagcaaaucagaguucaacaccuacaagcggucugguaucauggagguggaccgcuccgaggcaaaggagggccucaagcgcggggagaccacuaagcacgccgugagccgcggcacggccaaacugcggugguucgucgagcgcaaccuggugaaaccagaagggaaggugaucgaccuggggugcggccgaggcggcuggucguacuauugcgcgggccucaaaaaggucaccgaggugaagggcuacaccaaaggaggccccggucacgaggagcccauaccgauggccaccuacggguggaaccucguaaagcugcacagcggcaaggacgucuucuucgugccuccggagaagugcgacacgcuccugugcgacaucggggagaguagcccuaauccuacaaucgaggagggccgcacucugcgggugcucaaaaugguagagcccuggcugcgcgggaaccaguucugcaucaagauccugaaccccuacaugcccuccguggucgagacccuugagcagaugcagaggaagcacggcggaaugcugguccgcaacccgcugagccggaauucgacucaugagauguacugggugagcugcggaaccgguaacaucgugucagcugucaacaugaccagccgcaugcuucugaaccguuuuaccauggcccaccgcaagcccacauacgaacgcgacgucgaccugggggccggcacgcggcacguggcaguggagcccgagguggcaaaccucgacauaaucggccagcgcauagaaaacaucaagcacgagcacaaauccacauggcacuacgaugaggacaaccccuacaagacaugggcauaccauggguccuacgagguaaaaccauccggcagcgccucaagcauggucaauggggucgucaagcugcucaccaagcccugggacgugauccccauggugacgcagaucgcaaugaccgacacgacccccuuuggccagcaacgggucuucaaggagaaaguagacacaagaaccccuaaggcaaagcgggguaccgcccaaaucauggaggugacggcccgcugguuauggggcuuucucucccggaacaagaaaccccgcaucugcacgcgcgaggaguuuacccgcaagguccgcuccaacgccgcgaucggcgcaguguucguggacgagaaucaguggaacagcgcuaaggaggccgucgaggacgaccgcuucugggaccuggugcaccgggaacgcgagcuccacaagcaggggaagugcgcgacaugcguguacaacaugaugggcaagcgggagaagaagcugggggaguuuggaaaggcgaaggggucacgcgccaucugguauauguggcugggcgcgcgguuccucgaguucgaggcgcugggcuucaugaacgaggaccacugguucagccgcgagaauucccugagugggguugagggcgaggggcuccacaagcugggcuacauucuaagggauaucuccaagauccccgggggcaacauguacgccgaugacaccgcgggcugggacacccgaaucacggaggacgaccugcagaacgaagccaagauuaccgacauaauggagccggagcacgcccugcuggccaagagcaucuucaagcuaaccuaccagaacaaggucgugcggguccagcgccccgcgaagaacgggacaguaauggacgugauauccaggagggaccagcgcggcagcgggcaggucggcaccuacggccugaacacuuucaccaauauggaggcgcagcucauccgccagauggagagcgagggaauauuuagccccaaugagcucgagacgcccaaccuugccgagcgcgugcuagacuggcuagagaaguacggcguggaaaggcugaagcgcauggccauuuccggggacgacugcgucgugaaaccaaucgaugaccgguucgccaccgcgcuuaccgcgcucaacgacauggggaaagugcgcaaggacaucccccagugggagcccucgaagggguggaacgacuggcaacagguccccuuuugcucccaccacuuccaccaauugaucaugaaggauggcagggagaucgucgugccgugucgcaaccaggacgaguuagucggaagagcccgcguaagccagggggccggauggggacuucgggagaccgccugccuuggcaagucuuacgcgcagauguggcagcugauguacuuccaucgccgcgaccuccgccuggcugcgaaugccaucugcagugccguuccagucgacugggugcccacaagucggaccaccugguccauccaugcgcaccaucaguggaugaccacagaagacaugcugagcguauggaaccguguuuggaucgaggagaaccccuggauggaggacaaaacccggaucucgucgugggaggacgugccguaccucgggaagcgcgaagaccagugguguggcuccuugaucggccugaccgcccgcgccaccugggcuacgaauauccaggucgccaucaaccagguccggagguuaaucgggaaugagaacuacagcgacuacaugaccaguaugaagcgguucaagaaugagucugagcccgagggcgcauuaugguga

SEQ ID NO: 24757 - RNA, 9879 nt, Artificial Sequence
  derived and/or modified CDS sequence (opt11) from DENV-1__KJ933413__SS-prME
ucggugaccauguuguuaaugcuacugcccacagcucucgccuuucaccugaccacccggggcggggagccccacaugauuguguccaagcaagagcggggaaaaagccuccuauuuaagaccagcacgggggugaauaugugcacucuuauugcgauggaucugggcgagcugugcgaggacaccaugaccuauaagugcccccguauuacggagacggagccagaugacguggacugcugguguaacgcaaccgaaaccugggugaccuacgggaccuguagccagacgggagagcaccggcgcgacaaacggucgguggcacuggcgccccacguuggccuggggcuagagacgcguacagagacauggaugagcucagagggagcauggcggcaaauccaaaagguggagaccugggcgcugcgacaccccggguucaccgugaucgcacuguuccuagcccacgcgauugggaccagcauuacacagaaggggaucauauucauacugcugaugcucgugacgcccuccauggccaugcggugcgucggaaucggcaaccgcgacuucgucgagggcuuaagcggagcgaccugggucgacgucgugcuggagcacgguucuugcgugaccacgauggcgaaagacaagcccacccuggacauugagcugcugaagacggaggucacuaaccccgcugugcugcggaagcugugcauugaggccaagaucagcaauacuacaaccgauuccagaugccccacccagggcgaggcuacgcugguagaggagcaagacacgaacuucgucugucgacgcacccucguggaccggggcuggggcaacggcuguggccuauucgguaagggaucgcugaucacgugcgccaaguucaaaugugugacgaagcucgaagguaaaauuguacaguacgagaaccugaaauacuccgugaucgugacugugcacaccggcgaccagcaccagguggggaacgagacgaccgagcacggcacaacagccacuaucacgccccaagccccuacuucagagauccagcugaccgacuauggagcacucaccuuggacugcagcccccgcaccggccuggacuuuaacgagaugguccuccugacgaugaaggagaagucuugguuagugcacaagcagugguuccucgaccuaccgcuucccuggacauccggugcgagcacgagccaggagaccuggaaucgucaggaccuccuggugacguucaaaaccgcgcaugccaagaaacaagaggucguggugcuaggcucccaggaaggcgccaugcacacugccuuaacgggggcuacggagauccagacuagcggcaccaccacaaucuucgccggccaccugaagugccgcuugaagauggauaagcucacccugaagggcguauccuacgugauguguacuggcucauuuaagcuggaaaaagagguggccgagacgcaacacggcacuguccugguccaggugaaguacgagggcaccgacgcccccuguaagauccccuucaccagucaggacgaaaagggcguaacccagaacggcaggcuaaucacggccaacccuaucgugaccgacaaggagaaaccggugaacaucgaggccgagccgcccuucggugagaguuaucuggucguaggagccggcgagaaggcccugaagcucucaugguucaagaaagggucauccaucgguaagauguuugaagccaccgcgcgcggggcccggcggauggccauccugggcgacaccgccugggacuucgguagcauagguggcguauucacguccguagggaagcucauccaccagaucuucggcaccgccuacgggguccuguucagcggcguauccuggaccaugaagaucggcauaggcauccuucugacguggcucgggcugaacaguagguccacaucucuuuccaugacgugcauugcggucgggauggugacccucuaccugggcguuaugguccaggccgacagcgggugcgugauuaacuggaagggccgggagcugaagugcgggagcggcaucuucgugaccaacgaaguccacacguggacggagcaguacaaguuccaggcggacagccccaagcgacucucagccgccauuggaaaagcgugggaggaaggggugugugguauacgauccguuacccgacucgagaacauaauguggaaacagaucagcaacgaacugaaccacauccuccuggagaacgacaugaaguucaccgucguggugggggaugucaaugggaucuuggcacaggguaagaagaugauucggccucagcccauggagcauaaauacuccuggaaauccugggguaaggccaaagugaucggcgccgacgugcaaaacuccacuuucaucaucgaugggccgaacacgccggaaugccccgaugaccagcgcgccuggaacaucugggaggucgaggauuauggcuucgggauuuucaccacaaacauuuggcucaagcugcgagacagcuacacacaaguaugcgaccaccggcuaauguccgcagccaucaaagacagcaaggccguacacgcugacaugggguacuggauugaguccgagaagaacgaaacguggaagcuaacccgggcgucuuuuaucgaagucaaaaccuguguguggccgaagucgcauacucuguggagcaacggcgugcuggaguccgagaugauuauacccaagauauacgggggcccgauuagccagcacaacuacagacccggcuacuucacgcaaacugcagggccuuggcaucucgggaaguuagagcuagacuucggacucugcgaaggcacgacugucguuguagacgagcauugcgggaaccgggguccgucccugcgaacuaccaccgucaccgggaagaucauacacgaaugguguugucgaagcugcacgcugccuccacuaagguucaagggcgaagacgggugcugguacggcauggagauccggccggugaaggagaaggaggagaaucuggugaaguccauggugagcgcugguagcggggaaguugacuccuucagccugggucuccuuugcaucaguauaaugauugaggaggugaugcguagccgguggucccgcaagaugcugaugaccgguacccucgcugucuuucugcugcuuaucaugggacagcugacuuggaaugaucucauccgucucugcauuauggugggggccaacgcgucugacaagaugggcaugggcacgaccuaccuggcucuuauggccacauuccgcaugcgcccgauguuugcagucggucuucuguuccgacgccugaccucccgggaagugcuccugcuuacuguggggcucucacuggucgccuccguagagcugccgaacagccuggaggagcugggggacgggcuggccaugggcaucaugaugcucaaguuacugaccgauuuucagucccaccagcucugggccgcauuacugagccuaaccuucgugaaaacuacguucucuuuacacuacgccuggaaaaccauggcuaugauccugucgaucgugucccucuucccccuaugccugagcacaaccucacagaagacuacauggcucccgguccuguuagguagccucgguugcaagccacugacgauguucuuaaucacugagaaccggauuugggggcggaaauccuggccccucaacgagggcaucauggccgugggaaucgucagcauccuguugagcucccuccucaaaaacgaugugccccuggcgggcccccucauugccggcgggauguuaauagcauguuaugugaucagcggcuccagcgcggaccuguccuuagagaaggccgccgagguuagcugggaggaggaggccgaacacucgggcgcuucacauaacauccugguggaagugcaggaugacggcacaaugaagaucaaggacgaggagcgugacgauacgcugaccauucuccugaaggcgacccugcucgccaucuccggggucuacccgaugagcaucccggccacccuguucgucugguacuuuuggcagaagaagaagcaacgguccggcgugcugugggacacgcccucuccgccugaggucgagcgcgccguacuggacgacggcaucuaccgcauccuccagagaggccugcugggcaagucgcaggucggagucggcgucuuccaggaaggcguguuccacacaauguggcacgugacccggggcgccguucucauguaccagggcaaaagacuggagcccuccugggcuuccguuaagaaggaccugaucagcuacggcggcggauggcgguuccaaggcuccuggaacacgggggaggagguccagguaaucgccguggagccggggaagaaccccaagaacguccagacggcacccggcacuuuuaaaacccccgagggggaggugggcgcuauugcacucgacuucaagcccgggaccucaggcuccccaaucgugaauagggagggcaaaaucgucggucuguauggcaacggggugguuacgacuagcgguacguacguaucugcuauagcccaggccaaggcaucccaggaggggccauuaccugagauugaagaugaaguguuccggaagcgcaaccuuaccauuauggaccugcaucccggaagcggcaagacgagacgcuaccugccggccaucgugcgggaggcaaucaagcgcaagcuccggaccuugguccuggccccuacccgcgugguggcaagugagauggcagaggcgcucaaggggaugccgauccgauaucagaccacagccgugaaaucugagcacaccggcaaggaaaucguagaccuaaugugucaugccaccuucaccaugagacugcucucucccgugcgggucccuaacuacaauaugaucauuauggacgaggcucauuucacggacccugccucaaucgcggcucggggcuacauuucaacccgugugggcaugggggaggccgcggccaucuucaugaccgcgacacccccgggaagcauggaggccuucccacagucuaacgccgccauccaggacgaggaacgggauaucccagagagauccuggaacucgggcuaugauuggaucacggacuuccccggcaagaccgugugguuuguccccagcaucaagucgggaaacgacauagccaauugcuugcggaagaacgggaaacgcguaguucagcugagccggaaaaccuuugacacggaguaccagaagacgaagaauaacgacugggacuaugucgugaccaccgacaucagcgagaugggcgcgaacuuuagggccgaccgggucaucgacccgaggcgaugucucaagcccguuauccuuaaagauggaccggagagagugauccuggccggcccgaugccgguuaccgucgcuuccgcggcccaacggcgcggacgcauuggcagaaaccagaauaaggagggcgaccaguacauauacaugggacagcccuugaauaaugacgaagaccacgcccauuggacggaggcuaagauguugcuggacaacaucaacacgccagaggguauaaucccagcccucuucgaaccagaacgggagaaaagugcggccaucgacggggaauaucgccugcgcggcgaggcccggaagacguucguagagcugaugcgcagaggcgaccuccccgucuggcugagcuacaaggucgcuuccgagggguuccaguauagcgacagacgguggugcuucgacggggagcggaacaaucaagugcuggaggagaacauggacgucgagaucuggaccaaagagggggagcggaagaaacugcguccccgguggcuagacgcgcgaacguacagcgacccccuggcacucagagaguuuaaggaguucgccgccggccgcagauccgucagcggcgacuugauccuggagaucgggaagcucccgcaacaccugacccagcgcgcccagaacgcccuugauaaccucgugaugcuucauaacuccgaacagggcgggaaggcguaccggcacgccauggaggaacugccagacacgauugagacgcucaugcugcuggcccucaucgcgguccucaccggcggcgugacauuguucuucuuaagcggcagagggcugggaaagaccuccaucggguuauuaugcgugauggcaagcagcgcccuacucuggauggccagugucgaaccccauuggaucgccgccuccaucauacucgaguucuuucugauggugcugcuaauccccgaaccggaccggcagaggacgccccaagauaaccagcucgcguacguggucaucgggcuucucuucaugauccugacuguugccgccaaugaaaugggcuuacuggaaacgaccaagaaagaccuggguauaggacacguggccgccgagagccaccaucacgcggcaaugcuggauguagaccuccaccccgcauccgccuggacccuguacgcuguugcgaccacggugauaacgccgaugaugcggcauacgauagagaacaccacggccaauauuucccugaccgccaucgcuaaccaggccgcgauccucaugggcuuagacaaaggguggcccauauccaaaauggacauuggcguaccccuguuggcccugggcugcuacagccagguaaaccccuuaacgcucaccgccgccguccugaugcugguagcgcacuaugcgauuaucggcccugggcuccaggcuaaggcgacacgcgaggcccagaagcggaccgcggcggggauaaugaagaaccccacgguggacggcaucguggccaucgaccuggaccccguuguguacgacgccaaguucgaaaagcaguuaggucaaaucaugcuucugauacugugcaccucgcagauccuuuugaugcgcacgaccugggcauuaugcgaguccaucacccucgcuacuggaccccuaacgacccugugggaggggagcccaggaaaguucuggaacaccaccaucgccgugagcauggccaacaucuuccgggguucguaccucgccggcgcaggccucgcguucucgcucaugaagucccucgggggcgggcggcgcggcacgggcgcccagggugaaacccugggggagaaguggaagaggcaguugaaccagcucuccaagagcgaguucaacaccuacaagcgcucaggaaucauagagguggaccgguccgaggcuaaagaaggcuugaagcgcggggagaccacgaagcacgccgugucccggggcaccgccaagcugagaugguucguagagcggaaccucgucaaacccgagggcaaggugaucgaccucgggugcgggcgcggcggcuggagcuacuacugcgcugggcugaaaaagguuaccgaaguuaagggcuacacgaagggcgggcccggccacgaggagcccaucccgauggccacguacggguggaaccuagugaaacuccacaguggcaaggacguauucuucaccccgcccgagaagugcgacacgcugcugugugauaucggggagagcucccccaacccgacgaucgaggaaggccggacccucagaguccugaagauggucgagccguggcuucgagguaaucaguucugcaucaaggugcugaaccccuacaugccgagcgucguggaaacgcuggagcagaugcaaagaaagcacgggggcaugcucgugaggaacccgcucagucgcaacagcacacacgagauguacugggucucgugugggaccgggaacaucgugagcgccgucaauaugaccucccgaaugcugcuuaaccgcuuuacgauggcacaucggaagcccacauaugagcgcgacgucgaccugggcgcggggacccgccacguggccgucgaaccggagguggcuaaccuagauaucaucggccaacggaucgagaacaucaagaacgagcacaagucuacauggcacuaugaugaagacaacccguacaagacgugggccuaucacgggagcuacgaggugaagccaaguggcuccgcauccagcauggucaacggaguugugaggcuccucaccaagccaugggaugucauccccauggugacccagauagcaaugacugacacgacaccguucggccagcaacgcguguucaaggagaaggucgacacucggacaccgaaggccaagcggggcacggcccagauaauggaagugacugcccguuggcuguggggguuucucucccggaauaagaaaccccggaucugcacgcgggaggaguuuaccaagaaggugcgcagcaacgccgcaaucggagccguguucguggacgaaaaccaguggaacucagcaaaagaggcaguugaggacgagcguuucugggauuugguucacagagagcgcgagcugcacaagcaagggaagugcgccacgugcguguacaacaugaugggcaagcgugagaagaagcugggggaguuuggcaaagccaagggcagccgggccauaugguacauguggcucggggcccgcuuccuggaguuugaggcucuuggcuuuaugaacgaagaccacugguucuccagagagaacagccucuccgggguggagggcgagggccuucauaaacuaggcuacauacuccgcgauaucagcaagaucccuggugguaacauguacgcggaugacacagcagguugggacacccgcaucacugaggacgaccuccaaaacgaggcuaagaucacggauaucauggagccggagcacgcgcugcucgcaaccuccaucuuuaagcugaccuaucagaacaaggucguccgcgugcagcggcccgcgaaaaacgggaccguaauggacgugaucucgcgccgcgaccagaggggcucgggccagguggggacguacggccugaacaccuucaccaacauggaggcucagcucauacgccaaauggagagugaggguaucuucuugccaagugagcuggaaaccccuaaucucgccgagcgggucuuggacugguuggagaaguacggcauugagcgccucaagcgaauggccaucucgggcgaugacugcguggugaagccgaucgacgaucgcuuugccacggcgcugaccgcacucaacgauaugggcaaggucagaaaggacaucccccagugggagccgagcaagggcuggaacgacuggcagcaaguacccuucugcucccaccacuuccaccagcucaucaugaaggacgggcgcgaaaucguggucccgugccggaaccaggacgagcuggugggcagggccagggugagucagggggccggcuggagccugcgcgagaccgccugccucggcaaaucuuacgcgcagauguggcagcugauguacuuccaccggcgggaccugagacuugccgcgaacgccaucugcagugcgguccccguagacuggguccccaccagccgcacgaccugguccauccacgcacaccaccaguggaugaccaccgaggacaugcugagcgucuggaaucggguguggaucgaagagaaccccuggauggaggauaagacccacguguccuccugggaggacgucccuuauuugggaaaacgcgaggaccaguggugugggucucucauugggcugacagcccgggcaaccugggccaccaacauacaaguugcgauaaaccaggugcgccgacugauagguaacgagaauuaccuggacuacaugacgaguaugaaacgguucaagaacgaguccgacccggagggggcacugugguga

SEQ ID NO: 24758 - RNA, 9879 nt, Artificial Sequence
  derived and/or modified CDS sequence (opt11) from DENV-1__KU666942__SS-prME
ucagucacgaugcugcuuauguuaaugcccacugcccucgcuuuccaccucaccacucgggguggggaaccccacaugauugugucuaagcaagagcgggggaagagccugcuguucaagaccucagccggagugaacaugugcacccucaucgccauggaccucggggagcucugcgaagacaccaugacuuacaagugcccacggaucacagaggccgagcccgacgauguagacugcugguguaacgcgaccgacaccugggugaccuacgggaccugcagccagacgggcgagcaccggcgcgacaagcggaguguggcacucgcaccgcacguggguuuagggcuggagacgcgcaccgaaaccuggaugucguccgagggcgcuuggaagcagauccagcggguagagaccugggcccuacggcacccgggcuuuacggugauugcccuguuccuagcgcacgccaucggcaccagcaucacccagaaggggaucaucuucauccuccugaugcuggugacccccuccauggccaugagauguguuggcauaggcucgagggacuucguggagggacucuccggcgccacguggguagauguggugcuggagcacgggucuugcguuaccaccauggccaaggacaagcccacccuggacauagaacuccugaagacggaagugaccaacccagccauccugcggaagcucugcaucgaggcaaaaaucuccaacaccacgacggacucgagaugcccgacccagggagaggccaccuuggucgaagagcaggacgcaaacuucgugugccggcgcaccuuugucgaccgggggugggggaaugguugcgggcuguuuggcaaggggucccucauuacaugugccaaauucaagugcgugaccaaguuggagggcaagaucguacaauaugagaaccuaaaauauucaguaaucgugaccgugcacacuggggaccagcaccaggucgggaacgaguccacggagcacggcaccacggcgaccauaacgccucaggcucccacgacagagauccaguugaccgacuacggggcccucacucuggacugcagcccucgcaccggucuagacuucaacgagauggugcugcugaccaugaaggagaagucuuggcucguccacaagcagugguuccuggaccugccucuccccuggaccagcggggcgucgaccucccaggagacguggaaccgacaggaccugcuggugaccuucaagaccgcccacgcgaagaagcaggagguggucgugcuuggaucucaagagggcgcuaugcacaccgcccugacuggggccaccgagauccagacguccggcaccaccaccaucuucgccggucaucugaaaugccgucucaaaauggacaagcuuacacugaagggcaugagcuacguuaugugcaccgggagcuuuaagcucgagaaagagguggcggaaacgcagcacgguaccgugcuggugcagaucaaguacgagggcaccgacgcucccugcaagauccccuuuaguacccaggacgagaaaggagucacacagaacggcaggcucaucacggccaacccgauagugaccgacaaggaaaagccugugaauauugaggccgagccccccuucggggaguccuauauugugauuggcgcgggggagaaggcccugaagcucaguugguucaagaaaggcuccaguaucgggaaaauguucgaggccacagcgagaggggcucggagaauggcgaucuuaggcgacacagccugggacuucggcucgaucggcggcguguucacuagcguggggaagcuggugcaucagauuuucggcaccgcauacgggguacuguucuccggagugaguuggacaaugaagaucgggaucggcgucuugcugacguggcuaggccuaaacucacgcagcaccucccugagcaugaccugcauagccgugggucucgugacccuauaccucggcguaauggugcaggccgacuccgguugcgugaucaacuggaagggccgggagcucaagugcgggucaggcaucuuugucacgaacgaagugcacacguggaccgagcaguacaaguuccaggcggauuccccgaaacgucucucuaccgccaucgggaaggccugggaagagggcguaugcgguauucggagugccacccgccuugaaaauaucauguggaagcagaucuccaacgagcucaaccacauccugcuggagaauggcaugaaguucacgguggucgugggcgacguugcgggaauccucgcgcagggcaagaagaugauucggccccaacccauggagcauaaguacagcuggaaguccuggggcaaagccaagaucaucggagccgacguacagaauaccaccuuuaucaucgacggccccaauacuccagagugcccagacgaccagcgcgccuggaauaucugggagguggaggacuacggcuucggcaucuucacgaccaauaucuggcugaagcugcgcgauagcuacacccaggucugugaccaccgccucauguccgcagccaucaaggauagcaaggccgugcacgcagacaugggcuacuggaucgagucggagaagaaugagaccuggaagcuggcacgagcguccuucaucgaggugaagacauguaucuggcccaaaucccauacccuguggagcaaugggguucucgaguccgagaugaucauuccaaagaucuacggcgggccuauuagccagcacaacuaccgccccgguuacuucacacaaacggcuggucccuggcaccugggcaaacuggaacuagauuucgaccuuugugagggcacgaccguggucgucgacgagcauugugggaaccggggaccguccuuacgcaccaccacaguaaccgggaaaaucauccacgagugguguugccggagcugcaccuugccgccacuacgauaucggggcgaggacgggugcugguacggcauggagauuagacccgugaaggagaaggaggaaaaccuggucaaguccauggucagcgccggcagcggggaagucgacagcuucagcuuagggcuacucugcauaaguaucaugaucgaggaggucaugcgaucccgcuggucccguaagauguugaugaccgguacgcuugccguuuucuuucugcucaucauggggcaacugaccuggaacgaccuaaucagacuuugcaucauggugggagccaacgcgagcgaccggaugggcaugggaaccacauaccuggccuuaauggccacauucaaaaugagaccuauguucgccgucggguuauuguuucgucgccugaccucgcgggagguguuauugcucacaaucggccucagucugguggcgucaauggaacugcccaauagccucgaggagcugggggacggguuggccaugggcauuaugauccucaaguuauugaccgacuuccagucccaucagcucugggcuacccuguuaagccucaccuucauaaagaccacguucaguuuacacuacgcguggaagaccauagcaaugguccugucgauugugucccucuucccacucugccugagcaccaccucccagaagaccacuuggcucccuguccugcuggguagcuugggcugcaaaccgcugaccauguuccugaucgccgagaacaagaucuggggccggaaguccuggccauugaacgagggcaucauggccguagggaucgugagcauccugcugagcucucuccugaagaacgacguuccgcuagccggccccuuaaucgccggagguauguuaauugccuguuacgugaucagcggcucuagcgcggaucugaguuuagagaaggccgccgaggugagcugggaggaggaagccgagcacuccggggccagccacaacauccuggucgaggugcaggacgacggcacaaugaagaucaaggacgaggagcgcgacgacacccugaccauccuacugaaagcaacgcuccuggcgguguccggggucuacccguuaucgauucccgcaacucuguucgugugguauuuuuggcaaaaaaagaagcaacguuccggcguguuaugggacacccccucgccgccugagguugagcgggcugugcucgacgacggaaucuauagaauaaugcaacgcgggcugcuuggacggucccaggugggggucggaguguuccaggagaacguguuucauaccauguggcacgugacgcgcggggccguacucauguaucagggcaagcggcuagagcccagcugggcguccgugaaaaaggaucugaucagcuacggcgggggcuggcgguuacaggggucguggaacaccggggaggaggugcagguuaucgccguagaacccgggaaaaaccccaagaacguccaaacugcaccgggcaccuuuaagacgcccgagggcgaagugggggccaucgcucuggacuucaagcccggcaccagcggguccccuaucgugaaccgggagggcaagaucgucggccuguacgggaacggcguggucaccacgucugggacguacgucagcgcgaucgcccaggccaaggccagccaggagggcccacuuccugagaucgaggacgaggucuuucgcaagcgcaaccugaccauaauggaccugcaucccgggagcggcaaaacccgccgguaccucccggcuaucgugcgugaggcuaucaaacggaaguuacggacacugauccuagcccccacgagggucgucgccucggaaauggcagaggcgcugaagggcaugcccauacguuaccagacgaccgccgucaagagcgaacacacggggaaggaaauagucgaucugaugugccacgccacguuuaccaugcgcuuauuaagucccgugcgcgugccaaauuacaacaugauuaucauggacgaggcacacuucacugacccuagcuccaucgcggcgcguggcuacauuuccacacggguggggaugggagaggcugccgccaucuuuaugacggccacgccgccaggguccgucgaggcguuuccgcagagcaacgcagucauccaagacgaggagagggacauccccgagcgcuccuggaauagcggcuacgaauggaucaccgauuuucccggcaagacugucugguucgucccguccaucaaguccgggaacgacaucgccaacugccugaggaagaacgguaaacgggucauccagcucucccgcaagaccuuugacacugaauaccaaaaaaccaagaacaacgacugggauuaugucgugaccacggacaucagcgagaugggggcgaauuuccgggcggaccgcgugaucgacccccgccgcugccugaagcccgucauacugaaagacggccccgagcgggugauccucgccgggccuaugccggucaccguggccuccgccgcccagcgucggggccgcauagggcguaaucacaacaaggagggggaccaguacaucuauaugggucagccccugaauaacgacgaggaccacgcgcacuggacagaggcgaagaugcugcuugauaacaucaacaccccagaaggcauuauccccgcccuguucgagccggagcgcgagaagagcgccgccaucgacggcgaguaccgucugcgcggggaagcgcgcaagacguucguagaacucaugcggcgcggcgaccugcccguuuggcugaguuacaagguugccucagagggcuuccaguacagcgaccggagauggugcuucgacggggagagaaacaaccaggugcuggaggagaauauggaugucgaaaucuggaccaaggagggcgagcggaagaaacugcggccccgcuggcuggacgcccggacauacagugaccccuuggcccugcgcgaguucaaggaguucgcggcgggucgccgcagcguuuccggcgaccugauccuggagaucgggaaacugccgcagcaccucacucaacgggcccagaacgccuuagauaaucuggugaugcugcacaacagcgagcagggcggucgagccuaccggcacgcaauggaggaauugcccgacacgaucgagacccugaugcugcucgcccugaucgccguccugacaggcggcgugacauuguucuuccuguccgggaagggccucggcaaaacuucuaucggccuccucugcguuauggcguccagcgcccuucucuggauggcguccgucgagccccacuggauagcagcaagcaucauucuggaguucuuccugauggugcuccugauccccgagccagacagacagcggacgccccaagacaaccagcuggcauacgugguaauaggccuccuguucaugauucugacgguggccgccaaugagaugggguugcuggaaaccacuaagaaagacuuaggcaucggacauguagccguagagaaccaccaccacgccgcaaugcuggacguagacuugcauccggcguccgccuggacgcuauacgcaguagccaccaccaucaucaccccuaugaugcgccauacgaucgagaacaccaccgccaacaucagucucacggcaaucgcgaaccaggcggccauuuugaugggccuggacaagggcuggcccaucuccaagauggauauaggggugccccuacuggcgcugggaugcuacagucaggugaauccucucacgcugaccgcagcagugcugaugcucguggcccacuaugccaucaucggaccagggcugcaagccaaagcaacccgggaggcccagaagcgcacagccgccgggaucaugaagaaccccacgguggauggcauuguagcgaucgaccucgacccagucguguaugacgcuaaauuugaaaagcagcucggccagaucaugcugcugaucuugugcacaucccaaauacugcugaugcguaccaccugggcccugugcgaaagcaucacgcuggcaaccggaccccucacaacccucugggaagguuccccggggaaguucuggaacacgaccaucgccgugucaauggccaacaucuuccggggcuccuaccuugcaggcgccggucuggccuucagccucaugaagucccugggcgggggacgccgggggaccggcgcacagggagagacccuaggggagaaguggaagcgccagcucaaucagcuguccaagucugaguucaacacguacaagcgguccggcaucauggagguugaucgcagcgaagccaaggaggggcugaagcgaggcgagaccaccaagcaugccguguccagagguaccgccaaguugcgaugguucguagaacgcaaucuggugaagccggagggcaaggugaucgaccucgggugcgggcgcggcggauggagcuacuacugcgccggacugaaaaagguuacggaggucaagggguacaccaagggcggccccggucacgaggagcccgucccgauggcaaccuacggcuggaaccucgugaagcuacauuccgggaaggacguuuucuucaucccgccggagaagugcgacacucugcucugugauaucggcgagagcaguccuaacccgacuaucgaggagggccguacccugcgggugcugaagaugguggagcccugguugaggggcaaccaguucuguaucaaaauccuaaacccuuacaugcccagcgucguagagacgcuggagcagaugcagcgaaagcacggcgggauguuaguacgcaauccccugucucgcaauagcacccacgagauguauugggucuccugcggcacggggaacaucgucagcgcgauuaacaugacgucccgcaugcugcucaaucgauuuaccauggcccaccgcaagcccaccuacgagcgcgacguggacuuaggcgccggcacaagacacgucgccguugagcccgagguggccaacuuggacaucaucgggcagcgcaucgaaaacauaaagugcgaacacaaaagcacauggcacuacgacgaagacaacccuuacaaaacuugggcauaucacgguucuuacgaggucaaaccgagcggcuccgccagcucuauggugaacggaguggucaagcuccuaaccaagcccugggacgugauucccauggucacccagaucgccaugacggacaccacccccuucgggcagcagaggguguucaaggagaaaguggacacccgcaccccgaaggccaaacggggcaccgcucagauaauggaggucaccgcgcgcuggcuguggggcuuccucucgcgaaauaagaaacccagaaucugcacccgagaagaauucacgcggaagguacggagcaacgccgccauuggcgccguguucgucgacgaaaaccaguggaacucugcgaaggaagcaguugaggacgagagguucugggaccucgugcaccgggagcgcgagcugcacaaacaaggcaaaugcgcaaccugcgucuauaauaugauggggaagcgggagaagaagcucggggaauucgguaaagcgaagggcagcagagccaucugguacaugugguugggugcgcgcuuccuggaguuugaggcccuugguuucaugaacgaggaccacugguucuccagggagaacagccuguccggcguggagggggagggccuacacaaacucggguacauccugagagacaucagcaagaucucgggcggcaacauguacgcugacgacaccgcagggugggacacccgcaucacggaggaugaccuucagaacgaagccaagaucaccgagaucauggagcccgaacaugcccagcucgccaaggccaucuucaaguugaccuaccagaacaaggucguccgcgugcagaggccggccaagaacggaaccgugauggaugucaucagccgccgggaccaacgcgguucugggcagguaggcacuuacgggcugaacaccuucacuaauauggaggcccagcuaauccggcagauggagagcgaaggcaucuucucccccagcgagcuggagacgcccaaucuugcagagcgugugcucgacuggcuggagaaguacggcguagagcggcugaagcgcauggccaucagcggggaugacuguguagugaagcccauagacgaucguuuugccacggcccucacggcccugaacgacauggggaaaguccgcaaggacaucccccagugggagcccagcaagggcuggaacgacuggcagcagguccccuucugcucacaccauuuccaccagcugaucaugaaggacggccgggagaucgugguccccugccgcaaccaggacgaguuaguugggcgggcacgcgugagccagggcgccgguuggucccugcgggagaccgccugccuuggcaagagcuacgcccagauguggcagcuuauguacuuccaccgacgggaccuaagacuggcggccaacgcaauaugcuccgccgucccgguugauugggugcccaccucccggacgaccuggaguauacaugcccaccaccaguggaugaccaccgaggacauguuauccgucuggaaccgcguuuggauugaggagaauccguggaugaaggacaagacucauaucagcagcugggaggacgugccauaccugggaaagagggaagaccaguggugcggcagccugaucggccucacggcacgcgccaccugggccacgaauauccaggucgcgaucaaccaaguacgccggcugaucgggaacgaaaacuaccucgacuacaugacuagcaugaagcgcuucaaaaacgaaagcgaccccgagggcgcacucugguga

SEQ ID NO: 24759 - RNA, 9879 nt, Artificial Sequence
  derived and/or modified CDS sequence (opt11) from DENV-1__KU666939__SS-prME
agcgugaccaugcugcucaugcugaugcccaccgcccuggccuuccaucugacaacgcgcggcggggagccacauaugauagugagcaagcaggagcgggguaagucccugcuguucaagaccagcgcgggagugaauaugugcacccucaucgccauggaccuuggugagcugugugaagacaccaugacguacaaguguccccggaucaccgaagccgaacccgacgacgucgacugcuggugcaaugccaccgacacgugggugaccuacgggaccugcagccaaaccggcgagcaccggagagacaagcguucuguggcgcucgcgccccacgucggccuggggcuggaaacgcgcaccgagaccuggaugagcuccgagggggccuggaagcagauacagcgagucgagacuuggguucuccgccaccccggguuuacggugaucgcacuuuuucucgcccaugcaaucggaaccuccauuacucagaaggggauuaucuucauucuccugaugcuugucacgccaucuauggcgaugcggugcgucgguaucggcagccgggacuuuguugagggucuuuccggcgccacgugggucgauguggugcuggaacauggcagcugcgugaccaccauggccaaggauaagcccaccuuggacaucgagcuacugaagacggagguuacaaaucccgccguacugagaaaguuauguaucgaggcaaagaucaguaacaccaccacggacagccgcugcccaacccagggcgaagcgacccuggucgaggagcaggacgccaacuucgugugccggcgcaccuucguggaucguggcugggggaacggcugcgggcuguucggcaaggggucgcugauaacaugcgccaaguucaaguguguuaccaagcuggaaggcaagauaguucaguacgagaacuugaaauacucagugaucguaaccguucacaccggugaccaacaucaggucgggaacgaaagcacggaacacggaaccacagccaccaucacgccccaggcgcccaccaccgagauccaacucacagacuacggggcccugacguuagacugccuuccccgcacgggccuugacuucaacgagauggugcuguugaccaugaaagaaaaguccuggcuagugcacaaacaaugguuccuggaccucccucugccuuggaccuccggagccagcaccucgcaggaaacguggaaucgucaggaccugcucgugaccuucaagaccgcccaugccaagaagcaagaagugguggugcugggcagucaggagggcgcgaugcauaccgccuugacaggggcaacugagauccagaccucaggcaccacgaccaucuucgcagggcauuugaagugccgccugaagauggacaagcugacgcucaaggggauguccuacgugaugugcacagggucguucaagcuugaaaaggagguagccgagacgcaacauggcaccguccuggugcagaucaaguacgaggggaccgacgcgcccugcaagauaccuuucucgacccaagacgaaaagggggugacgcagaacggccgucuaaucaccgcgaauccgaucgucaccgacaaggaaaaacccgucaacaucgaggccgagccgcccuucggggagagcuacauagugaucggcgccggcgagaaggcgcucaagcugagcugguucaagaaggggagcuccaucgggaaaauguucgaggccacggcccgcggggcccggcgcauggcaauccugggugauacggccugggacuuugggagcaucggaggaguguucaccuccguagggaagcucgugcaccagaucuucggcaccgccuacggcgugcuauucagcgguguguccuggaccaugaagaucgggaucggcgugcuguuaacguggcuaggacuaaacagccguuccaccagccucucuaugaccugcaucgcugucgggcuggucacccuuuaccucggcgugaugguccaggccgacucggggugcgugaucaacuggaagggccgggagcugaagugcggguccggcaucuucguuacgaacgagguucacaccuggaccgagcaguacaaauuccaagcggacagcccgaaacgccugagcgcggccaucgggaaggcgugggaggaggggguuugcggcauccgguccgccacccgccucgaaaacaucauguggaagcagaucagcaacgaacugaaccauauccugcucgagaacgacaugaaguucaccguggucgucggggauguagcaggcauccuggcgcaagguaagaagaugauccguccucagcccauggagcacaaguacuccuggaaguccugggggaaggccaaaauuaucggugccgacguccagaacacgaccuuuaucaucgacgggcccaauaccccggagugccccgacgaccagcgcgccuggaacaucugggaaguagaggauuacgguuucgggauauucacuacgaauaucuggcugaagcuccgggacagcuauacucaggugugcgaucacagguugaugagugccgccaucaaagacaguaaggccguccacgccgauaugggcuacuggaucgagagcgaaaagaacgagaccuggaaacuggcccgggcguccuucauugaagugaagaccugcauuuggcccaaaucccauacgcucugguccaauggaguauuagagagcgagaugaucauccccaagaucuacggggggccgauaucccagcacaacuaccggcccggguauuucacacagaccgccggccccuggcacuuggguaaguuggaguuagacuucgaucugugcgagggcaccacugucgugguggacgagcauugcggcaaccggggcccgucacuccgcaccaccaccguaacgggcaagauaauccaugaguggugcugccguaguugcacccuuccgccccugagguuccgcggggaggacggaugcugguacggcauggagauccgccccguuaaggagaaggaggaaaaccucgucaagagcauggucucugcaggcagcggcgaaguagacagcuucucacugggacugcucugcaucagcauuaugaucgaggaggugaugcggucacgguggagccggaagaugcugaugaccggaacccuagccgucuucuuccuccugauuaugggccagcugacguggaacgaccucauccgccuuugcaucauggugggcgccaacgcgagcgaccgcaugggcauggggaccaccuaccuggcccucauggccacguuuaagaugcgcccgauguucgcggucggccuguuauuccgccggcucacuagccgcgagguucuccuguugaccaucggguugucccuuguugccagcguagagcuccccaacucccuggaggagcugggggacggguuggcgaugggcaucaugauuuuaaagcuucucaccgacuuccagagccaccaguugugggccacccuuuugucccuaacguucaucaagaccaccuucagccugcacuacgccuggaaaaccauggcgauggugcucuccaucgugagccugaucccccugugucucuccacgaccagccagaagaccaccuggcugccgguccugcucggcagcuuagggugcaagccgcuaacgauguuccucaucgcggagaauaagaucuggggucgcaagagcuggccgcugaacgaagggauuauggccgugggcauaguuuccauccuauuaagcagccuacugaagaacgacgucccccuagccgggccucuaaucgccggcggcaugcugauugccuguuaugugaucagcggaagcuccgcggaccucuugcuggagaaagcggccgaggugucaugggaggaggaggccgagcacuccggggccagccacaacauccucgucgaagugcaggacgacgggacgaugaagaucaaggacgaggagcgcgacgacacccugaccaucuuacucaaggcaacccugcuugcuauauccggcgucuauccgcucagcauuccggccacccuauuugucugguacuucuggcagaaaaagaagcaacgguccgggguguugugggacacgccaagcccacccgagguggagcgcgccgugcuggacgacgggaucuacagaaucaugcagcgcggccuccuggggcggucccagguaggcguggggguauuucaagagaacguguuucacaccauguggcacgugacacgcggcgcuguccugauguaucaggggaaacgccucgaacccucaugggcguccguaaagaaggaucuaaucagcuacggcggcggguggcgccugcagggcuccuggaacaccggggaggaagugcaggucaucgccguggagcccggcaagaacccaaagaacgugcagaccgcucccgggaccuucaagacacccgagggugaggucggcgccaucgcccucgauuucaagccggggacgagcggaucccccauagugaacagagaggggaaaaucgugggccuguauggaaauggagucgugacuaccaguggcaccuacgugagugcaauagcucaggcaaaggccucacaggaggggccgcuucccgagaucgaggacgaggucuuccgcaagcgaaaucucacgaucauggacuugcacccgggcagcgggaagacacgccgguaucugccagcuauagugcgugaggccauaaagcggaagcuucgaacucuaaucuuagcacccacccgcguggucgccuccgagauggcugaggcgcucaagggaaugcccauccgguaccagacuacagcugucaagagcgagcacaccggaaaggagauuguggaucugaugugucacgccaccuucacgaugcgccugcucucccccguucgagugccgaacuacaacaugaucaucauggacgaggcccacuucaccgacccauccucaaucgccgcucgcggauacauaagcacccguguggggaugggggaggccgccgcaauauucaugaccgcgaccccgcccggcuccgucgaggcguucccccaaagcaacgccgugauacaggacgaagaacgcgacauccccgaacgguccuggaacucaggguaugaguggauaaccgacuucccgggaaagaccgugugguucguccccucgaucaagagcggcaacgacauugccaacugccugcgcaagaacgggaagcgugugauccagcuaucccgcaagaccuuugacacggaguaucagaagaccaagaacaacgacugggacuacguggucacaaccgauauuagcgagaugggggccaacuuccgggcggaccgcgucaucgacccccggcgcugccuuaagcccgugauccugaaagacggccccgagcgggucauccuggccggccccaugccgguaaccgucgccagcgcagcacagcgcagagggagaauaggccggaaccacaacaaggagggugaccaguacaucuauaugggccagccccucaacaaugacgaagaccacgcgcacuggaccgaggcuaagaugcuguuggacaacaucaacaccccggagggcaucaucccagcccucuucgagccggagcgcgagaaguccgccgccaucgacggggaguaccgccugagaggcgaggcgcgcaagaccuucguugagcugaugcggcgcggugaccuccccguguggcuguccuacaagguugccagcgagggguuucaguacuccgaccggagguggugcuuugacggugaacggaacaaccaggugcuugaggagaauauggacguggagauuuggacgaaggagggggagcgcaaaaagcuccgacccagguggcuggacgcccguacguacagcgacccccuggcccuccgcgaguucaaggaguucgccgcgggccgucgcucugucucaggggaccugauccuggagaucggcaaguuaccgcaacaucugacccagcgggcccagaacgcccuggauaaccucgucauguuacacaacagcgagcaagggggacgggccuacaggcacgcaauggaggagcugcccgacacgaucgagacacucaugcugcuggcucucauugcugugcucaccgggggggucacccuguucuuccucuccggacgcgggcugggcaagaccagcaucgggcugcucugcgugauggcuuccagcgugcugcuguggauggcguccgucgagccacacuggaucgcggccagcaucauuuuggaguucuuucugauggugcugcugauccccgagccggaccgacagcgcacgccccaggacaaucagcuagccuacguggucaucggguuacuuuucaugauacugacaguggcagccaacgagaugggccuacucgaaacgaccaaaaaggaccuaggcaucggccacguggcaguggaaaaccaccaccacgcuacuauguuggacguggaccuccaucccgccuccgccuggacgcuguaugccguagcgacaacuaucaucaccccgaugaugcggcacacgauagagaacacaaccgccaacaucagucuaacugccaucgccaaccaggcggcgauccucaugggccuggacaagggcuggcccaucuccaagauggacaucggcgucccccuguuggcacuggggugcuacagccaagugaacccgcugacgcuaaccgccgccgugcugaugcuggucgcgcacuacgccauaaucggcccgggucuccaagccaaggccacccgcgaagcucagaagcgcaccgcggccggcauaaugaagaauccaaccguggacgggauaguggccaucgaccuggauccagucguguacgacgccaaguucgaaaagcagcugggccagaucaugcuccugauccuaugcaccucccagauccuacugaugcggaccaccugggcccugugcgagagcaucacgcuugcgacggguccccugaccacccugugggagggguccccggggaaguucuggaacacgaccauagcagugagcauggccaacaucuuccgcggguccuaccucgccggcgccgggcuggcguucagcuuaaugaagagucucgggggcgggcggcgcgggaccggggcccagggcgagacccugggcgagaaauggaagcggcaauugaaccagcucagcaaaucggaauuuaacacguacaagcgcucugguaucauggagguugaucguagcgaggcaaaggagggccugaaacggggggagaccaccaagcaugccguaucccggggcaccgcaaagcugcgcugguucguggagagaaaccuggucaagccagaggggaaggugauagaccucggcugcggcaggggcggcuggagcuauuacugugccggacucaaaaagguuacggaggugaaaggcuacaccaagggcgggcccggccacgaggaaccgaucccgauggccaccuaugguuggaaccuaguuaaacuuuauucuggaaaggacguguucuucauccccccugagaagugugacacccugcuuugcgauaucggggaaagcucccccaacccgacgaucgaagagggucggacccuccgugugcugaagaugguggaacccuggcuucgggguaaucaguucugcaucaagauccucaacccauacaugccaucaguagucgaaacgcuggagcagaugcagcgcaagcaugggggcaugcugguacggaacccgcuaucacgcaacagcacccacgagauguacuggguguccugcgggaccggcaacauagucagcgccgugaacaugacgucccggaugcugcugaaccgcuuuacgauggcccaccgcaaacccaccuaugagcgggacguggaucucggggcgggcacccgccacgucgcaguggaacccgaaguggccaaccuggauaucaucggccagcggaucgagaauaucaagcaugagcacaaguccacguggcacuaugaugaggacaaucccuacaagaccugggcuuaccacggguccuacgaggucaagccgucuggcucagccagcuccauggugaacggggucguaaagcugcucacuaagcccugggacgugauaccgauggugacgcagauugcgaugacggauacuacccccuucggccaacagcgcgucuucaaggagaaggucgauacccggacgccgaaggcgaaacgcgguaccgcucagauaauggagguaaccgcccgguggcuguggggguuccuuucgcgcaacaagaagccacggauuugcacccgugaggaguuuacgcgaaaggugcgcagcaaugccgcgaucggcgccguguucauugacgagaaccaguggaacagcgcaaaggaggccgucgaggacgagagguucugggaccucguccaccgcgagcgggagcuccacaagcagggcaagugcgcgaccugugucuacaacaugauggguaagcgcgagaagaagcugggggaguucggcaaggccaaggggagucgggccaucugguauauguggcugggcgcccgcuuucuggaguucgaagcgcugggauucaugaacgaggaucacugguucucccgggaaaauagccucucuggggucgagggcgaggggcuacacaaacugggauacauccuccgcgauauuagcaagaucccgggaggaaacauguacgcggacgacacggccggcugggacacucguaucacggaggacgaccugcagaacgaagccaaaaucaccgauaucauggagccggagcacgcccuguuggccaaggcgauuuuuaaguuaaccuaccagaacaagguagugcgcguacaacgcccagcgaagaacgggaccgugauggacgugaucagccggcgcgaccagcggggcucuggucaggucgggacguacggucugaacacauuuaccaacauggaggcccagcugauccgacagauggaguccgaggggaucuuuucaccuucggagcuggagaccccaaaccuugcugagaggguuuuagacuggcuggguaaauacgggguggaaaggcugaagcggauggccauuagcggcgacgacugcguagugaaaccgaucgacgaccgcuuugcaacagcgcugaccgcccugaacgauauggggaaaguacggaaagacaucccgcagugggagcccuccaagggcuggaacgacuggcaacaggucccuuucugcagccaccacuuccaccagcugaucaugaaggacggccgugagaucguggugccgugccggaaccaggacgagcuagucgggcgcgcccggguaucccaaggggccggguggagccugcgcgagacugcuuguuuaggcaaauccuaugcccagauguggcaacucauguacuuccaccggcgcgacuugaggcucgccgcgaacgcgaucuguuccgccgugcccgucgacugggugcccaccucuagaacaaccugguccauccacgcccaccaucaguggaugaccaccgaggacaugcucucgguguggaaccguguauggaucgaggagaaccccuggauggaggacaagacacacaucaguaguugggaggacguuccguacuuagggaagcgcgaggaccaguggugcggcucacuaauaggccucacagcccgcgccaccugggcgaccaauauacagguggccaucaaccagguccggcgccugaucgggaacgaaaacuaccuggacuacaugaccagcaugaagcgguucaagaacgaguccgaccccgagggcgcccucugguga

SEQ ID NO: 24760 - RNA, 9879 nt, Artificial Sequence
  derived and/or modified CDS sequence (opt11) from DENV-1__KU666940__SS-prME
ucagucaccauguugcucauguugacccccacggcccuggccuuccacuuaacaacccgggguggggagccccacaugauuguuagcaagcaggagcgugggaagagccugcuauucaagaccagcgccggaguuaacaugugcacccucaucgccauggaccuuggcgagcugugcgaagauacaaugacauauaagugcccgcggaucaccgaggcagagcccgaugacguggacugcuggugcaacgcgacggauacaugggugaccuacgggaccuguucgcagacgggcgaacaccgacgcgacaaacgaucuguggccuuagccccccacgucggcuuagggcuggagacgcggaccgagaccuggaugagcuccgagggggccuggaagcagauccaacgggucgaaaccugggcuuuacgccaccccggcuucaccgugaucgcccuuuuccuggcucacgccaucggcaccagcauaacccagaaggggaucauauucauucugcugaugcuggugacgccuucgauggcaaugcgauguguuggcaucggaagccgcgacuucguggaggggcuauccggggccaccugggucgacguagugcucgagcacgguucuugcgugaccacaauggccaaggacaaacccacgcuagauaucgaguugcugaagaccgagguaaccaaccccgccguucugagaaagcuuuguauagaggccaagaucuccaacaccacgaccgacagccgcugcccgacacagggcgaggccaccuugguugaggagcaggacgccaacuucguuugcaggcgcacguucguugaucggggcugggggaacggcuguggauuguucggcaagggguccuugauuacgugcgcaaaauuuaagugcgugacaaaacucgagggcaagaucguccaguacgagaauuugaaauacagcguaaucguuacgguccacacgggugaccagcaccaaguggggaaugagaguaccgagcacggcaccaccgcgacaaucacgccucaagcucccaccaccgagauccaguugacugacuacggugccuuaacgcuagacuguucuccccggaccggccucgacuucaacgaaaugguccuccugacaaugaaggagaaaucuuggcucgugcacaagcagugguucuuggaccugccccugcccuggacgucaggggcgucgaccucccaagagacuuggaauaggcaagauuugcuggucaccuucaagacggcccacgcuaagaagcaggaggucguggugcucgggagccaagagggagcgaugcacacggccuugaccggggccaccgagauccaaacuuccggcacgacaaccaucuucgccggacaccugaagugucgucucaagauggacaaguugacccugaagggcaugagcuacgugauguguacgggguccuucaagcuagagaaggagguugcagagacccagcacggcacgguccucguccagaucaaauacgaggguacugacgcccccugcaagauucccuucagcacgcaggacgaaaagggugugacccagaacggccggcugaucacugcgaacccaauuguaaccgauaaggagaagccagucaacaucgaagcugagccgccguucggggaauccuacaucgugaucggagcuggcgagaaggcgcugaagcucagcugguucaagaaagggagcagcaucgguaagauguuugaggccacggcccgcggggcuagaagaauggcaauacugggagauaccgcuugggacuucgggucuaucggcggcguuuucaccagugucgguaagcugguacaccagaucuuuggcaccgcuuauggggugcuguucuccggcgugaguuggacgaugaaaauagggaucggcguccugcucaccuggcuaggccucaacucccgcucgacgucccugucgaugaccuguauugccguugggcucguuacgcuauaucugggcgugauggugcaagccgacucaggauguguaauuaacuggaaaggccgggagcugaagugcggaucuggaauuuucgugacuaaugaaguucacacuuggacugagcaguacaaguuccaggcggauaguccaaagcgccugucggccgccaucggcaaggccugggaggaaggggucugugggauccggucugcuacuagacuggagaacaucauguggaagcagauuuccaacgaguugaaccacauccugcuggagaacgacaugaaguucacgguggugguaggggacguggcgggcauccucgcccaagggaagaaaaugauccggccccagcccauggagcacaaguacuccuggaaguccuggggcaaagccaaaauuaucggcgccgacgugcagaacacuaccuucauaaucgauggacccaacaccccugaaugcccagacgaccagcgcgcguggaacaucugggagguagaagacuacggauucgggaucuucaccaccaauaucuggcugaaacugcgggacagcuacacccaggugugcgaucaccggcucauguccgcggccaucaaggacuccaaggccgugcacgcugacaugggcuacuggauagagucggagaagaacgagaccuggaagcucgcgcgcgccuccuucaucgaagucaagacaugcaucuggccuaagagccauacucucuggagcaacggcgugcucgaguccgaaaugauaauccccaagaucuacggugggccgauuucucaacacaacuacaggcccggguacuucacccagacugccggucccuggcauuuagggaaacuggagcuggacuucgaccuuugugaaggcacgaccguggucguggaugagcauugcggaaaccgggggccaucccugcggacgaccacaguaaccggcaaaaucauccacgaguggugcugccggucaugcacccucccgccucuccgcuaucgaggcgaggacgggugcugguaugggauggagauccgccccgugaaagaaaaggaggagaaccuggucaaaucgauggugagcgccggaagcggagaggucgacuccuuuagccuuggacugcuguguaucucuaucaugaucgaagaaguuaugcggagccgcuggucacggaagauguuaaugacaggcacgcuggcgguguucuuccugcuuaucaugggacaacugaccuggaacgaccucauucgucugugcaucaugguuggagccaacgcaagcgaccgcauggggaugggcaccacauaucuggcccuaauggcgacguucaagaugcggcccauguucgcggugggccuccuuuuuaggcggcugacuagcagggaaguuuuacugcugaccaucggguuaucgcuggucgccuccguggagcugccgaauagccucgaggagcugggagacggccuagccaugggaauuaugauccucaaacuucugaccgacuuccagucccaucaauugugggccacgcuuuugucccuuacuuucaucaagaccaccuucagccugcacuacgcauggaagacgaucgcgaugguccugagcauaguuucacucuucccccugugccuauccacgaccagucagaaaaccacauggcucccgguacuucugggcucgcucggauguaagccguugaccauguuccugaucgccgagaauaagaucuggggcagaaagucauggccgcuuaacgaaggaauaauggcgguuggcauagugucuauccugcugagcucccuccugaagaaugacgugccccuagcggggccccucaucgcuggcggcaugcucauugcgugcuacgucaucagcggguccagcgccgaucuuucccuagagaaagccgcagaggugucgugggaggaggaagccgagcacuccggcgccucacacaauauccuggucgaaguccaggacgacgggaccaugaagauaaaggaugaggagcgcgaugacacauugacaauccuccuuaaggccacacugcucgcuguuuccggcgucuacccgcuaucgaucccagcaacccuguucgucugguauuuuuggcaaaagaagaagcagagauccggggugcucugggacacgcccagcccgcccgagguagagcgcgccguccuggacgacggcaucuaccggaucaugcagcgcggacugcugggucggucccaagugggcguagggguguuucaggaaaacguguuccacaccauguggcacguaacgcgcggcgcaguucugauguaccaagggaagcggcuagaacccucuugggccucggucaagaaggaccuaaucucauaugguggcggguggcgccuccagggcucauggaacaccggggaggaggugcagguaaucgccguugagcccggaaagaaccccaaaaacgugcagaccgcuccagguaccuuuaaaacgcccgagggggagguuggggccauagcgcuggauuucaagcccggaaccagcggcuccccaaucguaaaccgugaagggaagaucgucgguuuauacggcaauggugucguaaccaccucagggacguacgugagcgcgauagcccaggcuaaggcgucacaagaagggccccucccugagauagaagacgaagucuuccgcaagcggaaccugacaaucauggaccugcaccccgggagcggaaaaacgcgccgauaccucccugccaucguucgcgaggccauaaaacguaagcuccgcacccugauccucgccccgacgcgagucgucgccuccgagauggccgaggcgcugaagggcaugcccauucgguaucagaccacggccgucaaaucggagcacaccggcaaggaaaucguggaccuuaugugccacgccacguuuacgaugcgccuccugucccccgugcguguaccgaacuacaacaugauaauuauggaugaggcccacuucaccgauccaucauccauugcggcccguggguacauaaguacccggguuggcaugggggaggcagcugcgaucuuuaugacggcgacgccgcccggcagcgucgaagcguucccgcagucuaacgccgugauccaggacgaagaacgcgauauucccgagcgguccuggaacagcggcuaugaguggauuaccgacuuuccugguaagaccgugugguucguccccaguaucaaguccggaaacgauauagccaacugccugcgcaagaacgggaagcgagugauccagcugucccgcaagaccuucgacaccgaguaccagaagaccaagaauaacgauugggacuacguggucaccacggacauaagugagaugggcgcaaacuuccgggccgaccgggugaucgacccgcggagaugccugaagcccguaauucugaaggauggucccgagcgggucauacucgcaggccccaugccggugaccguggcauccgccgcucagcgucgggggcgcauuggccggaaccacaacaaggagggcgaccaguacaucuacauggggcaaccccugaacaaugacgaggaccacgcucacuggaccgaagcaaagaugcugcuggacaacauuaacacuccggagggcauaaucccagcccuguucgagccggagcgggaaaaauccgccgcgaucgacggggaguaccgccuacggggcgaggcacgcaagacauuugucgaacugaugcgucgcggggaccugcccguguggcugucauacaaagucgccagcgaaggcuuccaguacagcgauaggcgcuggugcuucgauggugaacgaaauaaucaagugcucgaagaaaacauggauguggagaucuggacuaaggagggggagcguaagaaguugcggccccgcuggcuagacgcccguacguacuccgacccccuggcccugcgcgaguucaaagaguuugcugcaggccggcguagcgucuccggggacuugauacucgagauaggcaaacucccgcagcaccuaacacagcgggcacaaaacgcucuggacaaccuggugaugcugcacaacucagaacagggggggagagcauaccgacaugccauggaggaauugcccgacacgauugaaacauugaugcugcucgcccugaucgccgugcugaccggcggcgucaccuuguucuuucuguccggaaagggucugggcaagaccucuauaggccuccugugcguaauggccucaagcgugcuuuuguggauggcgagugucgaaccucacuggauagcugccucaauuauauuagaguucuuccugauggugcuucugauccccgaaccggaccgccagcgaacgccccaagacaaccagcuggccuaugucguuaucgggcuccuguucaugauccugaccguagccgcgaacgaaauggggcuccuggagaccaccaaaaaggaucuggggaucggccacgucgccgucgagaaccaccaccacgcugccaugcuggaugucgaccugcacccugccuccgcguggacgcuguaugccguggccaccacuauuaucacgccgaugaugagacacacgauagagaauaccaccgccaacaucucgcuaacugcuaucgcuaaccaggccgcgauucuaauggggcuggacaaaggcuggccgaucuccaaaauggacaucggcgucccucuccuggcccuugggugcuacagccaggugaacccacuaacacugacugcagccguguugaugcucgucgcccacuacgccaucaucgggccgggacuucaggcgaaggcgaccagggaagcccagaaacgcaccgcagccggcaucaugaagaacccgacuguggacgggaucguggccaucgaccuggaccccguuguguacgacgcgaaguucgaaaagcagcucggucagauaaugcugcugauccucugcacgucacagauccugcuaaugaggaccacgugggcccugugugagaguaucacucuggcgaccggaccauuaacaacccuuugggaggguagcccgggcaaguucuggaauacgaccaucgcagugagcauggcaaauauauuccguggauccuaccuggcgggggccggucuggccuucucucucaugaagucccuugggggcgggcgccgggguacaggggcccagggcgagacccugggcgaaaaguggaagcgccagcucaaucagcuuagcaagagcgaguucaacaccuauaagcgcagcggcauaauggaggucgaccgcagcgaggcaaaagaagggcugaagcggggagagacaaccaagcacgccgugucccgcggcaccgcuaaacugcggugguuuguugagcgcaaucucgucaagcccgaggggaaggucaucgaccuggggugcggccgugggggcugguccuauuacugcgccggacugaagaaggugacggagguuaagggcuacacuaaggggggcccaggccacgaggagcccgucccaauggcuaccuacggguggaaccucgugaagcuucacucgggcaaagacgucuuuuucaucccuccggagaagugcgauacccugcucugcgacaucggcgagagcucccccaacccgacgaucgaggagggaaggacgcugcggguacuaaaaaugguugaaccguggcuccgcgggaaccaguucugcauuaaaauccuuaauccguauaugccgagcguuguugagacucuggagcaaaugcagcguaaacacggcggcaugcucgugcgcaacccgcugucgcguaauagcacccaugaaauguacugggucuccugcggcaccggaaauaucguguccgcgaucaauaugacgucccgcaugcugcucaaccgauucaccauggcccaucggaagccuacauaugagcgcgacguggaucugggcgccggcacccgacacgucgccguagagcccgaggucgcgaaccuggauauaauuggccaacgcaucgagaacaucaagugcgagcacaagagcacguggcacuacgacgaggacaaucccuacaaaacuugggccuaccacgggucauaugaaguaaagccgucuggaagugccucaagcauggugaaugggguugugaagcuuuugacuaagccaugggacgugauccccaugguaacccaaauagccaugacggauacgacccccuucgggcagcagcggguguucaaggagaagguggacacccggaccccgaaggccaagcguggaaccgcucagauuauggagguuacugcccgcuggcuuuggggcuuccucucccggaacaagaagccgcgcaucuguacccgcgaagaauucacgaggaaggugcggucaaacgccgccauuggggccguguucgucgacgagaaucaauggaauucugcgaaggaagcaguggaggacgagcgauucugggaccuaguccaccgcgagcgcgaacuccacaagcaggguaaaugcgcaacguguguuuacaacaugaugggcaagcgcgagaagaaguugggggaguucggcaaggcaaaggggagccgcgccaucugguauauguggcucggcgcgcgguuccucgaguucgaggcccugggauucaugaacgaggaccacugguucucgcgcgaaaacagcuuaagugggguggagggcgagggccugcacaaauugggauacauccuucgggacauaagcaagauaucuggcgggaacauguacgcggacgacaccgcugguugggacacccgcaucacggaagacgaccugcaaaacgaagccaagaucaccgagaucauggagccggaacacgcgcagcucgccaaggcgauauucaagcuaaccuaccagaacaaggugguccgcgugcagcgcccggccaagaaugggaccguaauggacgucaucagccgccgagaucagcggggcagcggccagguggggacguaugggcugaacaccuuuaccaacauggaagcccagcucauccggcaaauggagagcgaggggaucuucucucccagcgagcuggagacccccaaccuggcggagcgcgugcuggacuggcuggagaaauacggcguagagcggcugaaacgcauggccaucuccggggacgacugcguggugaagccaaucgaugaccgguuugccacugcgcucaccgcccuuaacgacaugggcaagguccgcaaagacaucccucagugggaacccucuaagggauggaaugacuggcagcagguccccuucugcucccaccacuuccaccagcuaaucaugaaggacggccgggagaucgugguucccugccgcaaucaggaugagcucgugggccgugcgcgcgugucacagggggcuggguggagccugcgggagaccgcgugccuugguaaguccuacgcucaaauguggcaguugauguacuuccaucgccgggaccugcgccuggccgcaaacgcuauauguagcgccguccccguagauugggugcccaccucccgcacgaccuggucgauccacgcccaucaccaguggaugaccaccgaagacauguugucugucuggaacagggucuggaucgaagaaaacccguggaugaaggacaagacacauaucagcucgugggaagacguucccuaccuagguaaacgugaggaccaguggugcgggagccugauagggcucaccgcacgcgcgacgugggccaccaacauccagguagcaaucaaucagguucgccggcugaucgguaaugaaaacuaccucgacuauaugacgagcaugaaacgcuucaagaacgagagcgacccagagggggcacuaugguga

SEQ ID NO: 24761 - RNA, 9879 nt, Artificial Sequence
  derived and/or modified CDS sequence (opt11) from DENV-1__KU666941__SS-prME
agcgugaccaugcugcucaugcugaugcccaccgcccuggccuuccaucucacgaccagaggcggggagccccacaugaucgucagcaagcaggagcggggcaaaagccuccuguucaagacaagcgcugggguuaacauguguacucucauugccauggaccugggcgagcugugcgaggacacgaugaccuacaagugcccccgcaucaccgaggccgagcccgaugacgucgacugcuggugcaacgccaccgauacgugggugaccuauggcaccugcagccagacaggcgaacaccggcgcgacaagcggucuguggcccuugcuccacacguaggccuggggcuggagacucgcacugagaccuggaugagcuccgagggcgccuggaagcagauccaacggguggagaccugggcccuccgccaccccgguuuuacggugaucgcgcuguuccuggcgcacgccauaggcaccaguaucacccagaaggggaucaucuuuauccuucugaugcugguuaccccgaguauggccaugcggugugucggcaucggcucacgcgauuucguggaggggcucuccggugcgacguggguggacgucgugcuggagcacgggucuugcgugacaaccauggcgaaggacaagcccaccuuggacaucgagcuucugaagacggaggucaccaaccccgcggugcugcggaagcugugcaucggcgcgaagaucuccaauaccaccacggacagccgaugccccacccagggugaagcuaccuugguggaggagcaggacgccaauuucgucugccggcgcacguucguggaccggggguggggcaacgggugcggucuguucggcaagggcucccucaucacgugcgccaaguucaagugcgugaccaagcuggaaggcaagaucguccaguacgagaaccugaaguacagcgugaucgugacgguccacacgggggaccagcaccaggugggaaacgaauccaccgaacacgggaccacggcgacgaucacgccccaggcucccacgaccgagauccagcucaccgacuacggcgcucugacacuagacugcucgccucgcacggggcucgacuucaacgagaugguccuguugaccaugaaggagaagaguuggcucguccacaagcagugguuucuggaccugccgcuccccuggaccagcggagcaagcaccucucaggagacguggaaccgucaggaccugcuggugaccuucaagacggcccaugcgaagaaacaggaggucguggugcucgguagccaggagggugccaugcacaccgcccugaccggcgccaccgagauccagaccucuggcaccacgaccauauucgccggccaccugaagugccggcucaagauggacaaguugacccugaaggguaugagcuacgucaugugcaccggcagcuucaagcuggagaaggagguggcggaaacgcagcacggcaccgugcugguccagaucaaguacgaggggacggacgcccccugcaaaauccccuucagcacccaggacgagaagggcguaacgcagaacgggcggcugaucaccgccaacccgaucguuacggacaaggagaaacccgucaacaucgaggccgagccgcccuuuggcgaguccuacaucgugauuggcgcgggggagaaggcccugaaacuuagcugguucaagaaaggcuccagcaucgggaaaauguucgaggccacggcccgcggcgcccguagaauggcgauccuuggggauacggccugggacuucggcuccaucggcgggguuuuuaccagcgucggcaagcuggugcaccaaaucuuuggaaccgccuacggcguccucuucuccggugugagcuggaccaugaagauaggaaucggcguccuguuaacauggcucggccucaauucccgcagcaccuccuuguccaugaccugcauugccgugggccuaguuaccuuauacuuaggugugaugguucaagcggacuccgggugcgucaucaacuggaaggggagagagcucaagugcggcagcggcaucuucguuacaaacgaggugcacaccuggaccgagcaguauaaguuccaggcggacagcccgaagcgccugucagccgccauugggaaggccugggaggagggcgucugcgggaucagaagcgccacccgccuggagaacauuauguggaagcagaucucuaaugagcucaaccacauccuauuagaaaacgacaugaaguuuaccgugguggugggcgacguggcagggauccucgcccagggcaagaagaugauccguccacagcccauggagcacaaguacaguuggaaguccugggguaaggccaagaucaucggggccgacgugcagaacacgaccuucaucaucgacggucccaacacuccggagugccccgacgaccagcgcgcguggaacaucugggaggucgaggauuacggguucggcaucuucaccacuaacauauggcugaagcuccgggacagcuacacccaagugugugaccaccgccucauguccgccgccaucaaggacagcaaggccgugcacgcugauaugggcuacuggaucgaauccgaaaagaacgaaaccuggaagcuggcgcgggccagcuuuauagaggucaaaacuugcaucuggcccaagucccauacgcuuuggucaaauggggugcucgagucugagaugaucauccccaaaaucuacggcgguccgaucucacagcacaauuaucgccccggguacuuuacccagaccgccgggcccuggcaucuggguaagcuggagcuugacuucgaccugugugagggcaccacggugguuguggacgagcacugcgggaaccggggaccaucccugcgcacuacaaccgugacugggaagauuauccaugaguggugcugccggagcugcacccugccgcccuugcgcuaccggggcgaggacggguguugguauggcauggaaaucagaccggucaaggagaaggaggagaaccuggugaaguccauggugucagccggcagcggggaaguugacaguuucagccucggccugcugugcaucuccaucaugauugaggaggugaugcggagccguuggucgcggaagaugcucaugacaggcacccuagccguguucuuccuguuaaucaugggccagcugacguggaacgaccuaauucgccucuguaucauggucggagcuaaugccucagaccgcaugggcaugggcaccacauaccuggcccugauggccaccuucaagaugcguccgauguuugccguggggcuuuuguuccggcggcugacuucacgcgaggugcuccuccugaccaucggccucagccuggucgccucuguggagcugcccaacagcuuagaggagcugggugacggccuggccaugggcauaaugauccucaagcuacugaccgacuuucaaucucaucagcucugggccacauuacugagccucacuuucaucaagacgaccuucucccugcacuacgcauggaagacgaucgcgauggucuuaagcaucgugucccucuucccucugugcuuaagcacgaccucccagaagaccaccuggcugcccgugcuguuagggucccucggcugcaagccacugacgauguuccuaaucgccgagaacaagaucugggggcggaaguccuggccacucaacgagggcauuauggcggucgggaucgugucgauacugcuguccucccuccugaaaaaugacgugccucuggccggcccccuuaucgccggcgggaugcucaucgcgugcuacgucaucagcggauccagcgccgaccugucccucgagaaggccgccgagguaagcugggaagaggaggccgagcacucuggggcgagccacaacauccuggucgagguccaggacgacggcaccaugaagaucaaggacgaggagcgugacgacaccuuaaccauccuccugaaggccacucugcucgccguguccgggguguacccgcuaucuauccccgccacgcucuucgucugguacuucuggcagaaaaagaagcagagguccggaguccucugggacacccccagcccgcccgaggucgagcgcgccguccuggacgacggcaucuaccggauaaugcagagggggcugcugggccggucccagguggggguuggcgucuuccaggagaacguguuccauacuauguggcacguuacacgcggggcgguacucauguaccaagggaagcggcucgaacccagcugggccuccgugaagaaggaccugaucagcuacggcgggggcuggcgucuccaaggguccuggaacacgggugaggaagugcaagucaucgccguugagccuggcaagaaccccaaaaacgugcagacugcccccggaaccuucaagaccccugaaggugaggugggggccaucgcgcuagacuucaagccaggcacgagugggucgcccaucgugaaucgggagggcaagaucguuggccuguacgggaauggcgucgugaccaccagcgggaccuaugugagcgcuauugcccaggccaaggcgucacaggagggcccuuuaccugaaaucgaggacgaagucuuccgcaagcggaaccugaccaucauggaccugcaccccgggagcggcaagacccgccgguaucucccggccaucgugcgcgaggccaucaaacguaaacugcgcaccuugauccucgcccccacgcgcguggucgccagcgagauggcggaggcccuaaagggcaugcccauccgguaccaaacgaccgccgucaagagcgagcacaccggcaaggagaucguggaccugaugugccacgccacguucacgaugaggcuacugucccccguuagagugccgaacuacaauaugaucaucauggacgaggcacacuucaccgauccaagcuccaucgcggccagaggcuacaucagcacgaggguggggaugggcgaggcagcggccaucuucaugaccgcgacgccgcccggcucggucgaggccuucccgcagagcaaugccgugauccaggacgaggagcgcgacauccccgagcgguccuggaacagcggcuacgaguggaucaccgacuuccccgguaagaccgugugguucguacccuccauuaagagcgggaacgauaucgccaacugucugagaaagaacggcaagcgggugauccagcucucccgcaagacauucgacacugaguaccagaagaccaaaaacaaugacugggacuacguggucaccaccgacaucagcgagaugggggccaacuuccgggccgaccgggugauugacccgcggcgcugccugaagcccgugauuuugaaagacggcccggagcgggucauccucgccgggcccaugccggugacgguugccuccgcagcgcagcgucggggccgcaucggccggaaucacaacaaggagggggaccaauacauauacaugggccagccccugaacaacgacgaggaccacgcccacuggaccgaagccaaaaugcugcucgacaacauuaacacacccgaaggcaucauccccgcccuauucgagccggagcgagagaagucggccgcgaucgacggcgaguaucgccugcgcggggaagcccgcaagaccuucguugagcuaaugcggcgcggcgaccugcccguguggcugaguuacaaggucgccagcgagggcuuccaguacagcgaccggcgcuggugcuucgacggggagcggaacaaccaggugcucgaggagaacauggacguggagauuuggacaaaggagggcgagcgcaagaaguuaagaccccgcuggcuggacgcacggacuuacuccgacccccucgcgcugcgcgaguucaaggaguucgcggcugggcgccgcagcgucuccggcgaccugauucucgagauaggcaaacugccgcaacaccucacccagcgggcccaaaacgcuuuggacaaucuugugaugcugcacaacagcgagcagggcgggcgggcguaccggcacgccauggaggagcuccccgacaccaucgaaacccugaugcuguuagcccuaaucgccguccugacugggggagucacccucuuuuuccuguccgggaagggccugggcaagacaagcaucgggcuccugugcgugauggcauccagcguacugcucuggauggcauccgucgagccucauuggaucgccgccagcauuauccuugaauucuuccugauggucuugcugauccccgagccggaccgccagcggacgccccaggauaaccagcuggccuacguggucaucggccuccuguucaugauccugacgguggcggcgaacgaaauggggcuccuggagaccaccaagaaggacuugggcaucgggcacguggcgguugagaaccaccaucacgccgccaugcucgacguagaccuccaccccgccagcgcguggaccuuauacgccguggccacaaccaucaucaccccgaugaugcgccacaccaucgagaacacgacugcaaacaucucucugacugccaucgcaaaucaagccgccauccugaugggcuuggacaaaggcuggcccaucuccaagauggacaucggggucccccuccuggcccugggcugcuacagccagguuaacccccucacccuuacggcggccgugcuaaugcucgucgcccacuacgccaucaucgggccgggcuuacaggccaaggcgacgcgugaggcucagaagcgcaccgccgccgggaucaugaagaacccaacuguggacggcaucguggccaucgaccuggaccccgucguguacgacgcgaaauucgaaaaacaguuaggccagaucaugcugcugauacugugcacaucccagauccugcugaugcggaccaccugggcucucugcgaaagcaucacccuggcuaccgggccccugaccacgcuaugggagggcuccccgggcaaguucuggaauaccacgaucgccgugaguauggccaacaucuuccggggcuccuaccuggcgggcgccgggcuggccuucucucucaugaagucccugggcggcggccgcagagggaccggcgcccagggcgaaacccugggggagaaguggaaaaggcagcucaaucagcuguccaagucagaguucaacaccuauaagagauccggaaucauggaggucgaucgcagcgaggcgaaggaggggcugaagcggggcgagacgacaaagcacgccgucucccgcgggaccgccaaguugcggugguucguagaacggaaccuggucaagcccgaaggcaaggucaucgaccucggcugcggacggggcggguggagcuacuacugcgccggccugaaaaaggugaccgaggucaagggguacacgaaaggugggccagggcacgaggagcccgugccgauggcgaccuacggcuggaaccucgugaagcugcacuccgggaaggacgucuucuucaucccgcccgagaagugugacacgcugcucugugacaucggcgaaagcucccccaacccgaccaucgaggagggccgcacgcugcgcguccugaagaugguggagcccugguugaggggcaaccaguucugcauaaagauccugaaccccuacaugccuagcgugguggagacccuggagcagaugcagagaaaacacggggguaugcucgugcgcaacccucugucacggaauaguacccaugagauguacuggguauccugcggaacugggaacaucgugagcgcgaucaacaugaccucccgcaugcugcuuaaccgguucacgauggcacaccgcaagcccaccuacgagcgcgacguggaccugggcgccggcacccggcaugucgccguggagcccgagguggcaaaccuggacaucaucgggcagcgcaucgagaauauuaagugcgagcacaagaguaccuggcacuacgacgaggacaauccguacaaaacuugggccuaucacggcuccuacgaggucaagccgagcggguccgccuccucaauggugaacggcgucguaaagcucuugacaaagcccugggacgugauacccauggucacccaaaucgccaugacggacacgacccccuuugggcaacagcggguguucaaagagaaaguggacacccguacacccaaggccaagcggggaacggcccagauuauggaagucaccgcacgcuggcuguggggcuuccucucccggaauaagaagccacgaaucugcacccgagaggaguucacccgcaaagugcggagcaaugccgccaucggggccguguucgucgacgagaaccaguggaacuccgcgaaggaggccguggaggacgagcgcuucugggaucugguccaccgggagagagagcugcacaagcagggcaagugcgccacgugcgucuauaauaugauggggaagcgggagaagaaacucggugaguucgggaaggccaagggcagccgcgccaucugguauauguggcugggcgcccgguuccuggaguucgaggcccucggguucaugaacgaggaccacugguucucgcgcgagaacucgcuaaguggcguggagggugagggacugcacaagcucggguacauccugcgggacauuagcaagaucuccggcggcaacauguacgccgacgacaccgccgggugggacacacgcaucaccgaggaugaccugcagaacgaggcaaagaucacggagauaauggagcccgagcacgcacagcuagccaaggccaucuucaagcugaccuaucagaacaaggugguccgggugcagcgcccagcgaagaacggcaccgucauggacgugauuagccgccgggaccagcgcggguccggccaggugggcacuuacgggcugaacacguuuacaaacauggaggcccagcucauccggcaaauggagagcgagggaauuuuuucccccagcgaacuggagaccccaaaccuggcggagcgcgugcucgacuggcucgagaaguacggggucgagcgauugaagagaauggcaaucuccggggacgacugcguuguuaagcccaucgacgaccgguucgccaccgcccucacggcccugaacgauaugggaaagguccgcaaggacauuccacagugggagcccucaaagggcuggaacgacuggcagcagguccccuucugcucccaccacuuccaccagcugaucaugaaagacggacgggagaucgugguccccugcagaaaucaggacgaguuagucgggcgggcgcgcgugagccagggcgcuggauggagccuccgugagaccgccugccugggcaaguccuacgcucagauguggcaguugauguacuuccaccgcagagaccugcgccuggcggccaacgccaucugcagcgccguccccguggacugggugcccaccucccggacaaccuggagcauccacgcccaccaccaguggaugaccaccgaagacaugcuauccguauggaaccgcguguggaucgaagagaaccccuggaugaaagacaagacccacaucucguccugggaagacgugcccuaccuggggaagcgggaggaccagugguguggcagccugauuggccucacggcacgcgccaccugggcaaccaauauccaggucgccaucaaucaggugcgccgguuaauagggaaugaaaacuaccuggacuacaugaccuccaugaaacgcuuuaagaacgagagcgacccggaaggugcccucugguga

SEQ ID NO: 24762 - RNA, 9879 nt, Artificial Sequence
  derived and/or modified CDS sequence (opt11) from DENV-1__KC172835__SS-prME
ucuguaaccauguugcugauguugaugccuaccgcccuggcguuccaccucaccacccgcggcggggagccgcacaugauagugagcaagcaggagcgggguaagagcuuacuguucaagacgagcgcggggguuaacaugugcaccuuaaucgccauggacuugggcgagcugugugaagacaccaugaccuacaagugcccccgcaucaccgaagccgagcccgacgacguggacugcuggugcaacgcaaccgacacuugggucaccuacgggaccugcagccaaaccggcgagcaccgucgcgacaagcgguccguugcacuugcgccccacgugggcuuaggucuggagacccgcaccgagacuuggaugagcuccgaaggcgcguggaagcagauccaacgggucgagaccugggccuuacgccaccccggguuuacggugaucgcccuguuccuggcgcacgccauaggcaccagcauuacccagaaggggaucaucuucauccuccugaugcuaguuacucccagcauggcaaugcggugugucggcaucggcucacgcgauuucguagaggggcucuccggcgccacguggguggacgucguacuggagcacgguuccugcgugacuacuauggcgaaggacaagcccacccuggauaucgagcuccucaagaccgaagugaccaaccccgcgguucugagaaagcucugcauugaggccaagaucagcaacaccaccacggauagccgcuguccgacgcaaggcgaggccacccuagucgaggagcaggacgccaacuucgucugucgccgcacauucguggauagaggcuggggaaacggcugcgggcuguucggcaaggggucgcucaucacgugcgccaaguucaaaugcgugacuaagcucgagggaaagauuguccaguacgagaaccugaaguacagcguuauagugacgguccauaccggcgaccagcaccaaguaggcaacgaguccacggagcacggcaccacugcgaccaucacgccacaagcgccaacgaccgagauccagcucaccgacuacggugcccucacccuggacugcagcccacgcacaggccucgacuucaacgagaugguacugcugaccaugaaagagaagaguuggcucgugcauaaacagugguuccucgaccugccguugccuuggacaagcggggccucuaccucccaagaaacguggaaccggcaggaccuccuagugaccuuuaagaccgcccacgcgaagaagcaagagguggugguucucggcagccaggagggcgccaugcauaccgcccugacgggcgccaccgagauacaaacaucuggcaccaccaccaucuucgcggggcacuuaaaaugccgccucaagauggacaagcugacccugaaaggaaugagcuaugucaugugcacggguuccuucaaacucgagaaggagguggcugagacacagcauggcaccguccugguccagaucaaguacgaaggaacggacgcuccuugcaaaauccccuucagcacucaggaugaaaaaggggucacgcagaauggcaggcugaucacagccaaccccaucgucacagauaaggaaaagccggucaauaucgaggcggagccgcccuucggggaguccuacaucgugaucggcgcgggggagaaggcacugaagcucagcugguuuaagaagggguccagcaucgggaagauguucgaggccaccgcacgcggggcccggcgcauggccauccugggcgacacggccugggacuucggaagcaucggcggcguguuuacaagugucgggaaacuuguucaccaaaucuucggcacugccuacgguguucuguucuccggcguuagcuggaccaugaagaucgggaucggcgugcuguugacguggcuaggacuuaacagucgcuccaccucucugucgaugacaugcaucgccguggggcuggugacccuguaucuuggcgugauggugcaggcugacuccgggugugucgugaacuggaaaggucgggagcucaagugcgggaguggcaucuucgugacgaacgaaguccacacauggaccgaacaguacaaguuccaggccgacucuccgaagaggcuguccgcagccaucggcaaggccugggaggagggggugugugggauccggucugccacgcgccuggagaacguuauguggaagcagaucuccaaugagcuaaaccacauacuguuagagaacgacaugaaguuuaccgucgucgugggugacguggcuggcauccuagcccaggggaagaaaaugaucagaccucagccaauggaguacaaguacagcuggaagaguuggggcaaagccaagaucaucggcgccgacgugcagaacaccaccuucauaauagacgggcccaacaccccggagugccccgacgaucagcgcgcguggaacaucugggagguggaggacuacggcuucgggaucuucacaaccaacaucugguuacgguugcgcgacagcuacacccaggucugugaccaccggcucauguccgccgccaucaaagacagcaaggccgugcacgccgauaugggcuacuggaucgaguccgagaagaacgaaaccuggaagcuggcgcgagccuccuucauugaggugaagaccugcaucuggcccaagagucacacccuguggagcaacggcguccucgaguccgaaaugaucauccccaagauauacgggggaccaaucucccagcauaacuaccggcccggcuacuucacucagaccgccggccccuggcaccuagggaagcucgaacucgauuucgaccuaugugagggcaccacgguggugguugacgaacacugcggcaaccguggcccguccuuacggacgaccaccgugacgggcaagaccauacacgaguggugcugucgcagcugcacccugccgccccuccgguuccgcggggaggacggcugcugguacgggauggagaucagacccgugaaggagaaggaggagaaccuggucaaauccaugguaagcgccggcagcggcgagguggacuccuucagccucggucuucuuugcaucagcauuaugaucgaggaagucaugcgcagccgguggucccgcaagaugcucaugaccggcacgcuggccguguucuuuuuacugauuaucggccagcugaccuggaacgaccugauccgccucagcaucauggugggggcgaacgccuccgacaagauggggaugggaacgacauacuuagcccugauggccaccuucaagaugcggccgauguuugccgucggccuccuguuccgccggcugaccucucgugagguucuccugcugaccauagggcucucacuggucgcgagcguggagcugcccaacucccucgaagaacucggcgacgggcuggccaugggcaucaugauccuaaagcugcugaccgauuuccaaccgcaccagcugugggccacgcugcugagccucacauuuaucaagaccaccuuuucucugcacuacgccuggaaaacgauggcaauggugcugagcaucgucucacucuucccccugugccugucaacaacuucccagaagaccacguggcucccagugcuccuggguagcuuagggugcaagccauuaacgauguuccugaucaccgagaacaaaauauggggccgcaagagcuggccccucaacgagggaaucauggcagugggcauaguuagcauccugcugaguucccucuugaagaacgacgugccccuggcggggccgcucaucgccggcggcaugcugaucgccugcuacgugaucagcggguccuccgcggaccugucgcucgagaaggccgccgagguaagcugggaggaggaggccgagcacuccggcgcuagccacaacauccucguggagguucaggaugacggcaccaugaagaucaaggacgaggaacgggacgacacccugacgauccuucugaaggcgacccugcucgccgucuccggcguuuauccccugagcaucccagccacccuguucgugugguacuuuuggcagaagaagaagcagcguagugggguacucugggacacacccagcccuccggagguggagcgugcugcccuggaugacggcaucuaccggaucaugcagcgcggccuauugggccggucccaagugggggucggcguguuccaggaaaacguguuccacacgauguggcacgucacucgcggcgccgugcugauguaccaagggaagagacuggagcccagcugggccuccgugaagaaggaccugaucucauacggcggcggcuggcgucuccagggauccuggaacaccggggaggagguccaggugaucgcaguggagcccggcaagaacccgaagaacguccagaccgccccugggacguuuaaaaccccggagggggaagucggugcaaucgcacuggacuucaaacccgggaccucuggguccccuaucgucaacagagaggggaaaaucguuggccuguacggcaacggcgucgugacaacgagcggcaccuacgucagugccaucgcccaggccaaagccucccaggagggcccccuccccgaaaucgaggacgagguguuccgaaagcggaaccugacuaucauggaucuacaccccggcagcgguaagacccgccgguauuuaccagccaucgugcgcgaggccaucaagcggaagcugcggacgcuuauccucgcucccacccgcgucguggccucugagauggccgaggcccugaaggguaugccgauaagauaccagaccaccgccguuaagucagagcacacgggcaaagagaucgucgaccugaugugccacgcgaccuuuaccaugcgacuccuauccccggugcgggugcccaacuacaacaugaucauaauggacgaagcacacuuuaccgaccccagcucgaucgcagcgcgaggguacaucagcacgcggguaggcaugggcgaggccgcggcaaucuuuaugaccgccacuccgcccggcuccguggaggccuucccccagagcaacgcagugauccaggacgaggaacgcgacauccccgaacggagcuggaacucgggcuacgaguggauaaccgacuuccccggcaagacggucugguucgugcccuccaucaagagcggcaacgacaucgccaacugucugcguaagaacggcaagagaguaauucagcucucccgcaaaaccuucgacaccgaguaccagaagaccaagaacaacgacugggacuaugucgugacgaccgauaucucggagaugggagcgaacuuccgggccgaccgugugaucgaccccagacgcugccugaagcccguaauccucaaggacggucccgagagagugaucuuggccggcccaaugccagucaccguugccuccgccgcgcagcgccgggggcgcaucggccgaaaucacaacaaggaaggcgaccaguacaucuacauggggcaaccccugaacaacgacgaggaccacgcgcacuggaccgaggcgaagaugcuucucgacaauaucaacacccccgaaggcaucauccccgcccuguucgagcccgagcgggagaagucggccgcgaucgacggggaguaccgccuucggggcgaggcccgcaaaaccuucgucgagcucaugcggcgcggugaccuucccgucuggcugaguuacaaaguugcauccgagggcuuccaguacagcgacagacgcuggugcuucgacggcgaacggaacaaccaagugcucgaggagaacauggacgucgagaucuggaccaaagagggggagcgcaagaaacugcggccacgcuggcuggacgcccggaccuacucggacccgcucgccuugcgcgaguucaaggaguucgccgccggccggcgcaguguguccggggaccugaucuuagagaucggcaaguugccccagcaccuuacgcagagggcccagaacgcccucgacaaccuagucaugcugcacaacagugagcagggugggcgcgccuaccggcacgcgauggaggaguugccggacaccauagagacacugaugcugcuggccuugaucgccguccugaccggcggggugacacuguucuuccuguccggccgcggccugggcaaaacaagcauaggucuccuguguguaauggccuccagcguccuguuauggauggcguccguggagccucacuggauugcagccagcaucauccuggaguucuuccugaugguguugcucauuccugagcccgaccgucaacggacgccccaagauaaccagcuggccuaugucgugaucgggcuccuguuuaugauccuaaccguggccgccaaugagaugggauuacuugagacaacgaagaaagaccucggcaucggccacgucgccgacgagaaccaccaccaugccgccaugcucgacguggaccugcacccggccuccgcguggacccuguacgccguggcgaccacgaucauuacgcccaugaugcggcacaccaucgagaacaccaccgccaacaucagccucacggccauagcgaaccaagcugccauucugauggggcuggacaaaggcuggcccaucuccaagauggauaucggcgucccccuacuggcccuugguugcuacagccaggugaauccucucaccuuaaccgcggccguacugaugcugguggcccauuacgccauuaucggucccgggcugcaggccaaggcaacccgcgaggcccaaaagcgcacggcagccgggaucaugaagaacccuaccguggacgggaucguggccauagacuuagacccagucguguacgacgcgaaauucgagaagcagcucggccagaucaugcugcugauccucugcacuucacaaauccugcugaugcggaccacgugggcccuuugugagaguauuacccuggcuaccggcccgcugaccacgcucugggaggggucccccggcaaauucuggaacacuacaauagccguaucaauggccaacaucuuccgcgggaguuaccuggcgggugcuggccuggccuucagccucaugaagucacucgggggcgggcgacgcgggaccggggcgcagggcgagacgcucggcgagaaguggaagcggcagcucaaccaguuguccaagagcgaguucaacaccuacaagcgcuccgggaucauggaagucgaccgcagcgaggcgaaggagggucugaagcgcggggaaaccacgaagcacgccgugagccggggaacggccaaacuccggugguucguggagaggaaccuggucaagccagaggggaaggugauagaccugggauguggccgcgggggcugguccuauuacugcgccggucugaagaaagugaccgaaguaaagggcuacaccaaaggagggcccggccacgaggaaccgauucccauggcuaccuaugguuggaaucucguuaagcugcauuccggcaaggacguguucuuuauaccgccggaaaagugcgacacucuucuuugcgacaucggcgagucuuccccgaacccuaccaucgaggagggccguacccugcgcgugcugaagaugguagagcccuggcuucgggguaaccaguucugcaucaagauccugaaccccuauaugccgagcgugguugagacacuggagcaaaugcagcggaagcacggaggcaugcucgugcggaacccccugucccgcaacucgacccacgagauguacuggguauccugcgggacgggcaacaucgugagcgcgguaaacaugacgucccggaugcugcucaaccgcuuuaccauggugcaccguaagccaacuuacgagcgggacgucgaccugggggcaggcacgcgccacguggccguugagcccgaggucgccaaucuggacaucauaggccagcggaucgagaacauaaaacacgagcacaagagcaccuggcacuacgacgaagauaaucccuacaagaccugggccuaccaugggucguacgaggugaagccaagcggcuccgcgagcagcauggucaacggaguagugaaacuccugacgaagcccugggaugucaucccgauggugacgcagaucgccaugacagacacuacgccguucggccagcagcggguauuuaaggagaaaguugacacuagaacccccaaggccaagcgcgggaccgcccagaucauggaggucaccgcacgguggcuguggggcuuccucagucgcaacaagaagccccggaucugcacgagggaggaguucacccggaaagugcgcucaaaugcggccaucggcgccgucuucaucgacgagaaucaguggaacuccgccaaggaggcgguggaggacgagagguucugggaccuugugcaccgcgaacgagaacuacacaagcaggguaaaugcgcaaccugcguauacaacaugaugggcaagcgcgagaagaagcucggggaguucggcaaggccaaagggagccgggcaaucugguacauguggcugggcgcgcgcuuccuggaguucgaggcgcucggguucaugaaugaggaucacugguucagccgggaaaauagccuaagcgggguggagggagaggggcugcauaagcucggcuauauccucagggacauuucaaagauccccggcgggaacauguaugcggacgacacagccgggugggacacgcggaucaccgaggaugaccugcagaacgaggccaaaaucaccgacaucauggaguccgagcacgcccuccuggcgaagucuaucuuuaaacugacuuaccagaauaaaguugugcgcgugcaacgcccagcgaagaacggcacaguuauggacgucaucucucggcgugaucagcgggguucuggccaggugggcaccuacggccucaacaccuucacgaauauggaagcccaacugauccgccagauggagucugaggggauuuucagccccuccgaacuggagacgcccaaccuggcugaacgggcccuagauuggcuggagaagcacggcguggagagguuaaagcggauggcgaucagcggggacgacugcgucguaaagccgauagacgaccgcuuugcgaccgcccugaccgcccugaacgacaugggcaagguuaggaaggacaucccccagugggaaccgucaaaggguuggaacgacuggcagcagguccccuuuuguucgcaccauuuucaccaacuaauuaugaaggacggacgcgagaucgugguuccgugccggaaccaggaugagcugguugggagggcccgcgugagccagggggcgggguggagucuucgcgagaccgcuugccucggcaagagcuacgcccagauguggcagcugauguacuuccaccggagggaccugaggcucgccgccaacgcuauaugcucagcgguaccagucgauugggucccgacgagucgcacaaccugguccauucaugcgcaucaccaguggaugaccacggaggauaugcugagugucuggaacagagucuggaucgaggagaaccccuggauggaggauaaaacccacauuuccaguugggaggaugucccauaucugggcaagagggaggaccaguggugcggaucccugaucggccugacggcgcgugccaccugggcuaccaacauucagguggcuaucagccagguccggcgccucaucggcaacgagaacuaccucgacuacaugacaucuaugaagcgguucaagaacgagagcgaccccgagggggcccuaugguga

SEQ ID NO: 24763 - RNA, 9879 nt, Artificial Sequence
  derived and/or modified CDS sequence (opt11) from DENV-1__EU848545__SS-prME
agcgugacgaugcuccugaugcuguuacccacagcccuagccuuucacuugacaacaagaggaggggagccacacaugaucgugagcaagcaggagaggggcaagagccugcucuucaaaaccagcgccgggguaaauaugugcacgauaaucgcaauggacuugggcgaguugugcgaggacacgaugaccuacaagugcccaaggauaacgaaagcagagcccgacgacguggacugcugguguaaugccaccgauacgugggugaccuacggaaccugcagccggaccggcgagcaccgccgggauaagcgaaguguugcccuagcgccccaugugggacuggggcuggagacccgugcagagacauggaugagcuccgagggcgcauggaagcagauccagaaggucgaaaccugggcccuacgccacccgggguucaccguaaucgcgcuguuucuugcccaugcgaucggaacuagcaucacccaaaaggguaucaucuucauccuccugaugcugguuacccccuccauggccaugcgcugcgugggcaucggaaaccgagacuucguugagggucuaaguggcgcgacguggguggauguagugcucgagcacggguccugugugacgaccauggcgaaggacaaacccacccuagacauugagcuccugaagaccgaggucacgaaacccgcgguacugaggaaguuguguauagaggccaagauaagcaacacaaccaccgacucucgcugcccgacgcagggcgaggccacacugguggaagagcaggacgccaauuucgucugccggcgcaccuucguggaccggggcuggggaaacggcugcggccuauucggaaagggaucccucauuacuugcgcgaaguucaagugcguuacaaaacuugaggggaagaucguccaguacgagaaucugaaguauuccgucaucgugaccguccacaccggcgaccaacaccaggucgggaacgagacuacugagcacggcaccauagcuaccaucaccccacaggcacccacaagcgaaauacaguugaccgacuacggggcacugacccuggacugcucuccccgcaccggccucgacuucaaugagauggucuuacugaccaugaaggaaaaguccuggcucgugcacaagcagugguuccuggaccugccgcuccccuggaccuccggggccucgaccccgcaggagaccuggaaccgagaagacuuauuggugacauuuaagacugcgcacgccaagaagcaagaaguggucgugcucggaagccaggagggcgccaugcauaccgcccugacaggagccaccgagauucagacguccggcaccacgaaaaucuucgccgggcaucugaaguguagacucaagaugaauaagcugacuuugaaaggcaugucuuacguuauguguacgggguccuucaagcucgaaaaggagguggccgagacccagcacggcaccgugcugguccaagugaaguaugagggcaccgacgcacccugcaagaucccauuuagcacgcaggacgagaaaggagugacucagaauggccggcugauaaccgccaacccaaucgucaccgacaaggagaaaccgguuaauauugaggcggagcccccauucggggagagcuacaucguggucggcgccggggagaaggcccugaagcucagcugguuuaagaagggcaguagcaucggcaagaugcuggaagccacggcgcgcggugcacggcgcauggccauccugggcgauaccgccugggacuuuggcuccauaggcggaguauucaccucgguggggaaacucguacaccagauauuuggcacggccuacggggugcuguucucgggcgugagcuggacgaugaaaaucgggauagggauccugcuuacuugguugggccuaaauucaagaagcgccucccucagcaugaccugcaucgcggucgggauggugacccuguaccuaggcgucauggugcaggccgacuccgggugcguuaucaacuggaagggccgagaacucaagugugggagcggcaucuuugugacgaacgaaguucacaccuggaccgagcaguauaaauuccaggccgauucccccaaaagauuaagcgcagccauuggaaaggcgugggaggaggggguuuguggcauccggagcgccaccaggcuggagaauaucauguggaaacaaaucucgaacgaguuaaaccacaucuuacuugagaacgacaugaaguucacgguuguugugggggaugugucaggaauucuuacccagggacguaagaugaucggcccccaacccauggaacacaaguacucuuggaaguccugggguaaggccaagaucaucggggccgacguucagaacaccaccuucaucauagacggcccuaacacccccgaaugcccagacgaccagcgggcguggaacauuugggaaguggaagacuauggguucggcaucuuuacaaccaacauuuggcucaagcugagagacuccuacacccaggugugugacccccgcuugaugagcgcugccaucaaggacaguaaagcgguccacgccgacauggguuacuggauagaaucugagaaaaacgagaccuggaagcuggcgcgggcauccuucaucgaggugaaaacgugcguguggccuaagucgcacacgcugugguccaacggggugcucgagagcgagaugaucaucccuaagaucuacggcgggccgaucucccagcauaacuaccggccgggguacagcacccagaccgccggucccuggcaucucggcaagcuugagcuugacuucgaucugugcgagggcacgaccguuguggucgacgagcacugcgggaaucgggggccgagcuugcguacaaccacugugaccgggaagaucauacaugaguggugcugcaggaguugcacucugcccccucuccgcuucaagggcgaagaugggugcugguacggcauggagauccggcccgugaaagacaaggaggaaaacuugguuaaauccuuggugagcgccgggucuggugagguggacucauucucacuggggcuucuaugcauuucgaucaugaucgaggagguaaugcgcucgcgauggucgcguaagaugcugaugaccgggacacuagccguguuccuccuuuugaucauggggcagcugacguggaacgauuuaauucggcuuuguaucauggugggggcgaacgccagcgaucgcauggggaugggaaccacauaccuugcccuuauggccacauucaagaugcgcccuauguucgcagucggccuccuguuccggcgccuaaccucccgggagguacugcucuugacuauugggcugagccucguugcgaguguggaacugccaaauuccuuagaggaacucggcgacgggcuugccaugggcaucaugauucugaagcuccugaccgacuuccagucacaccagcugugggcagcccugcucagccugacguucauuaaaacuacguucucgcugcacuacgcguggaaaaccguagcuaugguccugagcaucgugucccuauucccgcuuugccugagcacaacuucccaaaaaacgaccugguuaccggugcuauuaggcagccuuggaugcaagccgcucacuauguuucuaaucgccgagaauaagauuuggggacgcaaauccuggccccugaacgagggcaucauggccgucgggaucgucagcauccuccugaguagcuuacucaaaaacgacgucccguuagcggguccccucaucgcggggggaaugcuaauugcuugcuacgugaucagcgggucgucggccgaccugucacuagagaaagccgccgaaaucaguugggaggaggaggcagagcacuccggagccucacauaacauccucguggaggugcaggacgacgguaccaugaagaucaaggacgaggagcgcgacgacacccugacgauacugcucaaggccacgcugcuggccguuuccgggguuuaccccaucagcaucccggccacccucuucgugugguacuuuuggcaaaaaaaaaagcagcgcuccggcguccugugggauacuccgagcccgcccgagguggaacgggcgguccuggacgacggcaucuaccgcaucuugcagcgggggcuccugggcaggucccaggucggcgugggcguguuccaggagggggucuuucacaccauguggcacguuaccaggggcgccguucucauguaucaaggcaagcgccuugagccuucaugggccucugucaaaaaggaucugaucuccuacggcggcggguggcgguuccaaggcuccuggaacacgggggaagagguccaggugaucgcugucgagccgggcaagaaucccaaaaacgugcagaccgcgcccggcaccuucaaaacccccgagggggaggugggcgcgaucgccuuggacuuuaagcccggaacuucgggcucccccaucgugaaccgcgaggggaagaucgucggccucuacggcaacgggguggucaccacuucggggaccuacgugagcgccauugcucaggcuaaggccagucaggaggggccccuaccagagaucgaagacgaaguguuucggaagcggaacuuaacgaucauggaccuccacccuggcagcggcaagacccggcgcuaccuacccgcaaucguccgggaagccauuaagcguaagcuccggacguugauacuggccccuaccagagugguggcauccgaaauggccgaggcccugaaggggaugccgauccgcuaucagacgaccgccguaaagucagagcacacaggcagagagauuguggaucucaugugucacgcgacguucacgaugcgccugcuguccccggugagaguacccaacuacaacaugaucaucauggacgaggcucauuuuacggaccccgccagcaucgccgcccgcggguacaucuccacccgggugggcaugggugaggccgcggcgaucuucaugaccgcgacaccgcccgguagcguggaggccuucccccaguccaaugcggucauccaagaugaggagcgcgacauucccgaacggagcuggaacuccgguuaugacuggaucaccgacuucccgggcaagacggugugguucgucccgagcaucaagucggguaaugacauugccaacugccugcgcaagaacgggaagcgggucauucagcugagccgcaaaacguucgacaccgaguaucagaaaaccaagaacaacgacugggacuacgugguuaccacagacauuuccgagaugggagcuaacuuccgggcagaccgcgugauagacccccgucggugccugaagccugugauccugaaggacggaccggagcgagugauucuggcaggcccgaugcccguuacuguggcuagcgcggcucagcgccguggccgcaucgggaggaaccagaacaaggagggcgaccaguauaucuacauggggcagccccuuaacaaugacgaggaccacgcccacuggacagaagccaagauguuacuggacaacaucaacaccccugagggaauaauacccgcucuauucgagcccgagcgugggaagucggcagcaauugacggcgaguaccgccuccgaggcgaagcccgcaagaccuucguugaacugaugcggcgcggggaccucccuguuuggcuauccuacaaaguggcuuccgagggcuuccaguacagcgaccgcaaguggugcuuugacggggagcgcaacaaccaagucuuggaggagaacauggacguagaaaucuggacgaaagagggcgagaggaagaaacuuaggccgcgguggcucgacgcgcgcaccuauagcgacccgcaggcucugcgugaguucaaggaauucgccgccggccgacggucggugucgggggaucugauccucgaaaucggcaagcuaccacagcaucugacccagcgggcacagaaugccuuggacaaucuggucaugcugcacaacagugagcagggaggaaaagcguaccggcaugccauggaggaauuaccugauacaaucgagacguuaaugcuauuggcacugaucgcuguuuugaccgggggcgugacguuguucuuucuaagcggcagggggcuugggaaaaccaguaucgggcucuuguguguuauggccaguuccgugcugcucuggguggcuucugucgagccacauuggauagcagccagcauuauccuagaguucuuccugauggugcuccuaauacccgaacccgaucggcagcguacaccgcaggauaaccaguuagcguacguagucaucggacuccucuuuaugaucuugacgguugccgccaacgagauggggcuccuggagaccaccaaaaaggaccuggguauaggucacguugccguugaaaaucaccaccacgccaccauguuagauguggacuugcggcccgcgagugccuggacacuguacgccguugccaccacgaucauaacuccuaugaugcgccacacgaucgagaacaccaccgcgaacaucuccuugacugcgaucgcaaaccaggccgccauucugaugggccuggacaagggcuggccgaucucgaaaauggacaucggcgucccccuccuggcgcuggguugcuacucccaggugaacccacugacgcugaucgcggccgugcugaugcucguugcccauuacgcaaucauugggcccggauuacaggcgaaggccacccgcgaggcccagaagcgcaccgcagcagggaucaugaagaaccccacgguugacgggauugucgcgaucgaccuggacccggucguguacgacgccaaguucgagaagcagcucggccagaucaugcuacugauccucugcacgagccaaauccugcuaaugcgcaccaccugggcccucugcgagaguauuacccuggccacggggccgcugaccacucuuugggagggcagccccgggaaguuuuggaacaccacuauugcaguguccauggcgaauaucuuucgggggagcuaucuggccggcgcggggcuggccuucuccuugaugaaaucccugggcggaggacgccgagguacuggggcgcagggcgagacccugggggagaaguggaagcgccaauugaaccaguuaucuaaauccgaauucaacaccuauaagcguagcggcauaauggaggucgaccgcuccgaggcuaaagaggggcugaagcgcggugagacgaccaagcacgccgucagccgcggcacggcuaagcucagaugguucguagagcgcaaucuggugaaacccgaaggcaaggugauugaccugggcugcgguagggguggauggucauacuacugcgcgggacuaaagaaagugaccgagguaaagggguauacgaagggcggcccgggccacgaagagcccaucccaauggccaccuacggcuggaacuuggugaagcuccacagcgggaaggacguguuuuucacacccccagagaaaugcgacacccuccucugcgacaucggggaaucuagccccaacccuacgaucgaggaaggcagaacccugagaguucugaagaugguagagccuuggcucagaggaaaucaguucugcaucaagauccugaacccauacaugccauccgugguggagacccuggagcagaugcagaggaagcauggcgggaugcucguucgcaacccgcugucgcggaacaguacccacgagauguacugggucagcugcggaacaggcaacaucguauccgccgugaacaugaccucgcgcaugcugcucaaccgauucaccauggcccaccgcaagcccacguacgagagagacguagaccugggggccgguaccaggcaugucgccguggagcccgaggucgcgaaccuggacauaaucggucaacguaucgagaacaucaaaaacgagcauaaguccacuuggcacuacgacgaggacaaccccuacaagacgugggcauaucauggcagcuacgaggugaagcccuccgggucugccuccagcauggugaacggcgucguucgccuccugacaaagcccugggaugugauuccgauggucacccagaucgccaugacggacaccacucccuucggccagcaaaggguguucaaggagaagguggacacccggacgccgaaggcaaagcgcggcacugcucaaaucauggaggucaccgccagauggcuuuggggcuuccucagccgcaacaagaagccccggauuuguacucgggaagaguucacgcggaaggugagauccaacgcggcaaucggggcgguguucguggacgagaaccaauggaacagcgccaaggaggcggucgaggacgagcgcuucugggaucugguccaucgggagcgggagcugcacaagcagggaaagugcgcgacgugcgucuacaacaugaugggaaagcgugagaaaaagcucggcgaguucggaaaagcuaaagggagucgggcgauaugguauauguggcugggcgcacgcuuccuggaguucgaggcccucggguuuaugaaugaagaccacugguucucacgggagaacucccuauccggcguugagggggagggccugcacaagcugggguacauccugcgcgacaucucgaagauccccgggggaaacauguacgcugaugacacugccgggugggacacccggaucacggaggaugaccuucagaacgaggcaaagaucaccgacaucauggaaccggaacacgcacuucuugcaacuagcaucuucaagcuaacauaucagaacaaagugguccgcgugcaacgcccugccaaaaacggcacggucauggacguaaucucccggagggaccagcggggaucgggacagguggguaccuaugggcucaacacauuuaccaacauggagguucagcugauccggcagauggaauccgagggcaucuucucaccgucugagcuagagacgcccaaccuagccgagaggguucuggacuggcuggagaagcacggcguggagcgccugaagcggauggccauaucgggcgacgacugcgugguaaagccaaccgacgaccgauucgcuaccgcccugacugcccucaaugacaugggcaaggugcggaaggacaucccccaaugggagccguccaagggguggaacgacuggcagcaaguccccuuuugcagccaccauuuucaucagcucauaaugaaggacggccgugagaucgugguacccugccggaaccaggacgagcuuguggggcgagcccgggucucucaaggcgcaggguggucccugcgcgagacggccugucugggcaagagcuaugcccaaauguggcagcuuauguauuuccaccggcgcgacuuacgucucgccgcgaacgccaucuguucugcuguuccgaucgacugggucccgaccagccgcaccaccuggaguauacacgcccaccaucaguggaugacgaccgaggacaugcugucaguguggaaccggguguggaucgaggaaaaucccuggauggaggauaaaacccacguguccuccugggaggacguccccuaccuuggcaagcgggaagaucaguggugcgggagcuugauuggccugaccgcccgcgcgacgugggcgacuaacauccagguagcgaucaaucaggugcggcgcuuaauugggaacgagaacuaccuggacuacaugaccuccaugaaaagauucaaaaacgaguccgaccuggaaggcgcccucugguga

SEQ ID NO: 24764 - RNA, 9879 nt, Artificial Sequence
  derived and/or modified CDS sequence (opt11) from DENV-1__KR024708__SS-prME
ucggugaccaugcugcucaugcuauuacccacggcccucgcuuuccauuugacgacccgaggcggggaaccgcacaugaucguuagcaagcaagagcguggcaagucguuacuguuuaagaccagugccggugugaacaugugcacacuaaucgcaauggauuugggcgagcucugcgaggauacgaugaccuacaagugcccccgcauuaccgaggccgaaccagacgacgucgacuguuggugcaacgccaccgacaccugggucaccuacgguacguguucccagacaggcgagcaccggcgcgacaaacgcuccguggcucuggcgccacacgugggacuggggcucgagacccgcaccgaaacguggaugagcuccgagggcgccuggaaacagauccagaagguggagacaugggcacugcggcaccccggguucacgguaaucgcucuuuuccucgcgcacgccaucggcaccucgauuacacaaaagggcaucauuuucauucugcugauguuggugacccccuccauggccaugcgcugcgucggcaucggcaaccgcgacuucguugagggccugagcggcgcgacguggguugaugucgugcuggagcaugguuccugcguaaccaccauggcgaagaacaagcccacacuagacaucgagcuguugaagacggagguaacgaauccagcgguucugcgcaagcuuugcaucgaggccaagauaucaaacaccacuacugacucccgguguccaacgcaaggcgaagccacccugguggaggaacaggaugcuaacuucgugugccgacggaccuuugucgaccgcggcugggggaacggguguggucucuucggcaagggaagccugcugacgugcgccaaauucaagugcguaacgaaacuggagggcaagaucguccaguacgaaaauuugaaguacagugucauugugaccgugcacaccggggaucagcaccaggugggcaaugagacgacagagcacggcacgauagcgaccaucaccccccaggcacccaccucggagauccagcuuacagacuacggggcccucacgcuggacugcagcccaagaaccgggcuggacuucaaugagaugguguugcugaccaugaaagagaaguccuggcugguacacaagcagugguuccucgaccugccgcugcccuggacuucuggggcgagcacuagccaggagacuuggaaccgccaggaccucuuagugacguuuaagaccgcccaugcgaagaagcaggagguggugguacugggcucccaagaaggcgcgaugcacaccgcucucaccggagccacggagauacagaccucgggcaccaccacgaucuucgcugggcaucucaaaugccgccucaagauggacaagcucacgcugaagggcgugagcuacguuaugugcaccgguagcuucaagcuagaaaaggaagucgcugagacccagcaugggaccguccugguccaggugaaguaugagggcaccgacgccccuugcaagaucccgauaucgacucaggacgagaagggggucacccagaauggucgcuuaaucaccgccaaccccaucgugaccgacaaggaaaaaccaguaaauaucgagacugagccgcccuuuggggaaagcuacaucgucauuggcgccggugaaaaggcucugaaacugaguugguucaagaaggggagcagcaucgguaaaauguucgaggccaccgcgcgcggcgcccgccgcauggccauccucggcgacacugccugggacuuuggaagcauaggaggcguguucaccuccguggguaaguuaguccaccagguguucgguaccgccuauggggugcuauuuagcggcgucuccuggaccaugaaaauagggaucggcaucuugcuuacguggcucggacucaauagcagauccacaucgcugucuaugaccugcaucgcggugggcauggugacccuguacuuaggcgucauggugcaggcugacagcgggugcgugaucaacuggaaaggccgcgagcuuaagugcggguccggcaucuuugucacaaacgaggugcauaccuggaccgaacaguacaaauuccaggccgacagcccgaagcggcugucggcggcaauuggcaaggcaugggaggagggggugugcggaauccgcuccgcuacgcggcucgagaacaucauguggaagcaaauaagcaacgagcugaaccacauccugcuugagaacgacaugaaguucaccgucguggugggggaugccaacggcauccugacgcagggcaaaaagaugauccgaccucagcccauggagcauaaguacuccuggaaaucuugggguaaggccaaaaucaucggcgccgacacgcagaacaccaccuucaucauagaugggcccgacacgcccgagugccccgacgaccagagggccuggaacaucugggagguagaggacuauggguucggaguguucaccacuaauaucuggcugaagcuucgcgacucuuacacccagaugugcgaccaucggcugaugagcgccgcgaucaaggacuccaaggccguccacgcggacaugggcuacuggaucgagagcgaaaagaacgagaccuggaagcuggcccgcgcguccuucaucgaagucaagacuugcaucuggccacggucccacacccucugguccaauggcguacuggaguccgagaugaucauccccaagauauacggcgggccgaucucccagcauaacuaucgcccgggauacuucacgcagacggccgggcccuggcaccuggggaagcucgagcuggacuuuaaccucugcgagggcacuaccguaguuguggaugagcauugugguaaccgugggcccagccuccgcaccacgacgguaacugggaaaaucauccaugagugguguugucggucauguacccuuccccccuugcgcuucaggggggaagacggcugcugguacgggauggagauucgccccgucaaggagaaggaggagaaccucgugaggagcaugguauccgccggcucaggcgaggucgacagcuuuucccuuggccugcucugugugagcauuaugaucgaggaagugaugcguucccgauggagucgcaaaaugcugaugacgggcacccuggcuguguucuuccuuuuaaucauggggcaauugacauggaacgaccugauccggcuguguaucauggugggcgccaauguguccgaccggauggguauggguaccacuuaucuggcccugauggcgaccuucaagaugcgcccgauguucgcuguugggcuacuguuccggcgcuugacaaguagagaagugcugcugcucaccauugggcuguccuuaguugccucaguggagcuccccaacucgcuggaggaacugggugacggacuugccaugggcauuaugaugcugaaauuacucacggauuuccagagccaccaguuauggacgacgcugcuuuccuugaccuucaucaagacgacccugagccuugauuacgcuuggaagacaauggcgauggugcuguccauagucagccuauuccccuuaugccuguccaccacgagccaaaagacuaccuggcugcccguccuacugggcucuuucggcugcaagccacugaccauguuucugaucacagaaaacaaaauauggggucgcaagagcuggccccugaacgaggggaucauggcggugggcaucgucuccauucugcuuuccucacugcuaaagaaugacgugcccuuagcuggcccccugaucgcuggcggaaugcugaucgcaugcuaugucauauccgggagcucagccgaccucagucuggaaagagccgcggagguauccugggaagaagaggccgaacacagcggcgcaucgcauaacauacugguggaagugcaggacgacgguacgaugaaaauuaaggacgaggagcgugaugacacccucaccauucugcugaaggccacacuucuggcagucagcggcguuuacccuauguccaucccugccacgcuguucguuugguacuucuggcagaagaaaaaacagcguucgggagugcucugggacacucccagcccacccgagguugagcgcgcgguguuagacgauggaaucuaccggauacugcagcgcggcuuacucgggcggagccaggucggcgugggaguguuucaggacggagucuuucacacuauguggcacgugacacgcggggcagugcugauguaccagggcaagcggcuggagcccucaugggcgagcgugaagaaggaccuuaucuccuacggcggaggcuggcgauuccaagggagcuggaacacaggugaggagguccaaguuaucgccguugagcccgguaaaaaccccaagaaugugcaaaccacccccgggacauuuaaaacccccgagggagaagugggcgccaucgcccuagacuucaagcccggcaccucagggagucccaucgucaaccgcgagggaaagauaguuggucuguacggaaacggcguaguaacuacguccggaacguacgugagcgcgaucgcucaggccaaggccagccaggaagguccucuccccgagaucgaggacgagguuuucaagaagagaaaccuaaccaucauggauuugcacccuggaucuggcaagacccgucgcuaccucccagcgaucgucagagaggcgauaaagcgcaagcuccgcacccugauccucgcucccacgcggguaguggcuagcgagauggccgaggcgcugaagggcaugcccauccgcuaccagaccaccgccguaaaguccgagcacaccggcaaggagaucgucgaucugaugugccacgcgacauucaccaugcgguugcugagccccguaagagucccgaacuacaacaugaucaucauggacgaggcccauuucacggaccccgccuccaucgcugcacggggcuacaucagcacgcgcgugggaaugggcgaagcggcagccaucuuuaugacggcgacaccgcccggauccgucgagagcuucccgcaguccaaugcugucauucaggacgaggagcgggacauaccggagcgcucauggaacuccggcuaugacuggaucaccgacuucccgggcaagacgguuugguucgugcccaguaucaaguccgggaacgacaucgccaauugcuuacggaagaauggcaagcgggucauccaacucucacggaagacauucgauaccgaguaccaaaagaccaagaacaaugacugggacuaugucguuaccacggacauauccgagaugggggcgaacuuccgcgcggaccgggugaucgacccacgccggugccucaaacccgugauacugaaggacggccccgagaggguuauacuugcggguccgaugccagugaccgccgcuagcgcugcacaacggagagguaggauagggcgcaaccagaauaaggagggugaccaguacaucuacaugggccaaccuuuaaacaacgacgaggaccacgcacacuggacggaggccaaaaugcugcuagauaauaucaacacccccgaggggauuauccccgcucuguucgagcccgagagagagaaguccgcugcuaucgacggcgaguaucgcuugcgcggagaggcucggaaaacauucguggagcugaugcggcgaggugaccugccuguaugguuaagcuacaagguggcuagcgaggguuuucaauacagcgacagacggugguguuucgacggggagcgcaacaaccagguauuagaggagaacauggacgucgaaaucuggaccaaagagggcgaacgaaaaaagcugagaccccgcuggcuggacgcccguaccuacagcgaccccuuagcacugcgggaguucaaagaguuugcagccgggcgccggucaguaagcggcgaccugaucuuggaaaucggaaagcuaccgcagcaccugacacuacgcgcccagaacgcccuggauaacuuggugaugcuccacaacagugagcagggcgguaaggccuacaggcacgcgauggaagaacugcccgacaccaucgaaacgcuuaugcucuuggcgcugaucgccgugcuaacagggggagugacccuguucuuccucuccggaaaaggcuuaggaaaaaccuccaucgggcugcugugcgugauggccagcuccguccucuuauggauggcuagcguggagccccacuggaucgccgccaguaucauccuggaguuuuuccucauggugcugcugauccccgaaccggaccgacagcggacgccccaggauaaccagcucgccuacgucgugaucggauuacuguucaugauuuuaaccguggccgccaacgagaugggucuguuggagacgacgaaaaaggacuugggcauugggcacguaguagccgaaaaucaucaccacgcuaccaugcuggauauugacuugcacccagcuagcgccuggacccucuacgcuguugcaaccaccauaauaacaccaaugaugcgacacaccaucgagaauaccacugccaacauaucacugacugcuauagcaaaccaggcggccauacuuaugggucucgacaaaggguggcccauuaguaagauggacaucggggucccgcugcucgcccucgggugcuauucgcaggugaacccccucacccuuaccgccgccgugcucaugcuggucgcucacuacgccaucauugggccugggcuacaggccaaggccacccgggaggcgcagaaacgcacggccgccgggaucaugaaaaaccccacaguggacgggaucguggccauagaucucgaccccgucguguacgacgccaaguucgagaagcaguugggccaaaucaugcuccucauauugugcacuagccagauauuauugaugcgaaccacgugggcgcugugcgagaguauaacacuggcaacagggccacucaccacgcugugggaaggauccccgggcaaguuuuggaauacuaccaucgcuguauccauggccaauaucuuccggggcaguuaccuggccggcgcaggguuagcauuuagcuugaugaagucccuaggugggggacgccgcgguaccggcgcccaaggagagacgcucggcgagaaguggaagcgccagcugaaccagcugucgaaguccgaguuuaauaccuacaagcgcagcggaaucauggaaguugacagauccgaggccaaagagggucucaagcgaggugaaaccacgaaacacgcugugagcagagggacggcgaagcuucgcugguucgucgagcgcaauuuggugaagcccgagggaaaggugaucgaccuugggugcggacggggggggugguccuauuacugcgcgggccugaagaaagugacagaagucaagggguacaccaaggguggccccgggcacgaggagccgaucccuauggccacuuacggcuggaacaucgugaagcugcacucugggcgcgacguguuuuucacgccgcccgagaagugcgacacgcugcugugcgacauuggggaaucaagucccaacccaaccaucgaggagggccggacacuacgcguccugaagaugguggagcccuggcuccgcggcaaccaguuuugcauaaagaucuugaacccguacaugcccuccguggucgagaccuuggagcagaugcaaaggaagcauggcgggaugcuugugcguaacccacugucucgcaacuccacgcaugagauguacuggguuagcuguggcaccgggaauaucgucuccgccgugaacaugaccagccgaauguugcucaaccgcuucaccauggcgcaccgcaagcccacauacgagcgugacgucgaccugggcgcgggcacccgccacguugcgguagagcccgaaaucgccaaccuagacaucauugggcagcggauagagaacauuaagaacgagcauaaguccaccuggcauuacgacgaagacaaucccuauaaaacuugggccuaccacggcucguacgaggugaaaccgucugggagcgcguccaguauggucaacggcgugguccgucuccugacgaagcccugggacgugaucccaauggugacccagaucgccaugaccgacacgacgccuuucgggcagcagcgggucuucaaggaaaaggucgacacccggacuccgcggccuaaaaggggcaccgcgcagauuauggaggugacugcaaaauggcuguggggguuccucagccgaaauaagaaaccccgcaucuguacuagggaggaguucacccgcaagguccgguccaacgccgcgaucggugccguguucguggaugaaaaccaguggaacagcgcuaaagaagcagucgaggacgagcgcuucugggaccuggugcaccgggaacgcgaacugcacaagcaaggcaagugcgcgaccugcguuuacaauaugaugggcaaaagggagaagaagcucggagaauucgguaaagcgaagggcucccgugcuaucugguauauguggcugggugcccgguuccuggaguucgaggcgcucggguucaugaaugaggaucacugguucagccgcgaaaacagucugagcggugucgagggagaaggccuacacaagcucggauacauucugagagacaucuccaagaucccgggcgguaauauguacgcggacgacacggccgggugggacacacgcaucaccgaggacgaccugcagaacgaagccaagauaacggauauuauggagccugagcacgcacuccuggccacuagcauuuucaaacugaccuaucagaacaaggugguacgcguccagcgccccgcgaagucuggcacugugauggacgugauaucuagacgggaccagcgcgguaguggccaggucggaaccuacggccucaacacguucacuaacauggaggugcagcuaauccggcagauggagucggaaggcauuuucagcccaagcgagcuggagaacuccaaccuagccgagcgcguacuggacuggcuggagaagcacgggguagaacgucucaagcguauggccaucagcggcgacgacugcgugguuaaaccuacggaugaucgcuucgccacggcccugacggcucugaaugacaugggaaagguaagaaaggacauuccgcagugggagccguccaagggguggaacgacuggcagcagguccccuucugcagccaccacuuucaucagcucauuaugaaggauggccgggagauuguggucccuugccggaaccaggacgaacuggugggccgggcccgggugucucagggcgcggguuggagucugagagagaccgccugcuuaggaaagucuuacgcccagauguggcagcugauguacuuccaccgccgggaccugcgacuggcggccaaugcgaucuguuccgcugucccggucaacuggguucccaccagcagaaccaccugguccauccacgcccaucaucaguggaugacaaccgaggacauguuaucaguuuggaaccgcguguggaucgaggagaaccccuggauggaggacaagacgcacguguccucuugggaggacgucccguacuuagggaaacgcgaagaccaauggugcggcucucucauuggccugaccgcgcgggccacgugggccaccaacauacagguggcaaucaaucagguccgccggcuuaucggaaacgaaaacuaucuugacuacaugaccucaaugaagcgcuucaagaacgaguccgaccccgagggcgcgcugugguaa

SEQ ID NO: 24765 - RNA, 9879 nt, Artificial Sequence
  derived and/or modified CDS sequence (opt11) from DENV-1__KR024705__SS-prME
ucugucaccaugcugcucaugcugcugcccaccgcccucgcauuccaucugacaacgcgggggggugaaccccacaugauugugagcaagcaggagcguggcaagucacuccuguucaagaccagcgcaggggugaacaugugcacccugaucgccauggaucuuggcgagcucugcgaggacacgaugaccuacaagugcccccguaucaccgaggccgagcccgacgacguggacugcuggugcaacgccaccgacacuugggugacauaugguacaugcagccagaccggagagcaccggcgcgacaagcgguccguggcccuggccccccacguggggcuggggcuagagacgcggaccgagaccuggaugucguccgagggcgccuggaagcagauccagaagguggagacaugggcccuacgccaccccggauucacagugaucgcccuguucuuagcucacgccauaggcaccagcauaacccagaaggggaucaucuuuauccuguugaugcucgugacccccuccauggccaugcgcugcgucggcauuggcaaccgcgacuucguggaagggcuaagcggcgcgacguggguggaugucgugcuggagcacgguuccugcguuacaacuauggccaagaacaaaccaacccucgacaucgagcuguugaagacggaggucaccaaccccgcggugcuccgcaagcuguguaucgaagcaaagaucagcaaugcaaccaccgacucucggugccccacgcagggcgaggccacccuggucgaggagcaggacgccaacuucgucugccgccggaccuucgucgaccgcggcugggggaauggcugcggccucuucggcaaaggcucucugcuaacgugcgcgaaguucaaaugcgugacuaagcucgagggaaaaaucguccaguacgagaaucugaaguacuccgugaucguuaccguccacaccggugaccagcaccagguggggaaugagaccacggaacacggcaccaucgccaccauaacgccccaggcccccaccagcgagauccagcugacggauuacggggcccuuacccuggacugcagcccccggaccggccuggacuuuaacgagaugguccucuugaccaugaaggagaaguccuggcucgugcacaaacagugguuccucgaccugccgcuacccuggacgucaggagccagcaccagccaagagaccuggaaccgccaggaucuccuagugaccuucaagacggcgcacgccaagaagcaagaggucguggugcugggcucucaagagggcgccaugcacaccgcccucaccggggccacggagauccaaaccagcggcaccaccaccaucuucgcgggacaccugaaaugccggcugaagauggacaagcucacgcugaagggcgucuccuacgugaugugcaccgggaguuucaagcuggagaaggagguggcugagacccagcacggcaccguccugguccaggugaaguaugaggguacggacgcccccugcaagaucccuauuucuacucaggacgaaaagggggucacacagaacggccgacucaucaccgccaacccaaucguuacggacaaggagaagcccgugaacaucgagaccgaaccgccuuucggagagagcuacaucgucaucggcgcgggcgagaaggcccugaagcuauccugguucaagaaagggagcuccaucggcaaaauguucgaggccacugcacgcggggccaggcggauggcgauccucggggacaccgccugggacuucgggagcaucggagguguguucacgucgguggggaagcugguccaccagguauucggcaccgccuauggggugcuguucagcggcgucuccuggaccaugaagauugggauuggcauccuccugaccuggcugggccucaacagccgcuccacaucgcuuuccaugaccugcaucgccguagggaugguaacacuguaccucggcgucaugguucaggcagauagcgggugcgugaucaacuggaagggccgcgagcugaagugugggagcggcauauucgucaccaacgaggugcacacguggaccgagcaguacaaguuucaggcggacucgccgaagcgguuaagcgcugccauuggcaaggccugggaggagggggugugcggcauccgcuccgccacccggcucgagaacaucauguggaagcagaucucuaacgaacuuaaccauauccugcucgagaacgacaugaaguucacugucgugguuggggacgcgaacggaauccugacacagggaaagaagaugauccgcccccagcccauggagcacaaguacucuuggaaguccuggggaaaggccaagaucaucggcgccgacacacaaaacaccacauucaucaucgaugggcccgacaccccugagugcccagacgaccaacgggccuggaacaucugggagguggaggacuacgguuucgggguguucacuaccaacaucuggcugaagcugcgcgacuccuauacccaaaugugcgaccaucggcugaugagcgcggcgauuaaggacuccaaggcugugcacgccgacaugggcuacuggaucgagagcgagaagaacgagacguggaaacuggcccgcgcguccuucaucgagguaaagacgugcaucuggcccaggagccacacacucuggaguaacggcgugcuggagagcgagaugaucauccccaagaucuacgggggcccgauuagucagcacaauuaccggcccggguacuucacccagaccgccggcccauggcaccuagggaaguuagagcuggacuucaaccugugcgagggaacgacgguggucguggaugagcacugcggcaaccgugggccgagucuccguaccaccacggugacugggaagaucauccacgaguggugcugcagauccuguacgcucccgccccuacgcuuccguggggaagacggcugcugguacgggauggagauacgccccguaaaggagaaggaggagaaccucguccggagcaugguguccgccggcagcggcgaggucgacagcuucucccuggggcugcucugcguaucuaucaugaucgaggagguaaugcgcagccgguggagcagaaagaugcugaugaccggcacgcuggccgucuucuuccuccugaucaugggucagcugaccuggaaugaccucauccgccugugcauaaugguaggugcuaacguguccgaccgcauggggauggggaccaccuaucuggcccucauggccacguucaagaugcgcccgauguucgccgucggucuguuguuccggcgccucaccagccgggaggugcugcugcuuaccaucgggcugucccuggucgccagcgucgaacuccccaauucccuggaagagcugggcgacgggcucgcaaugggcaucaugaugcugaagcugcucacggacuuccagagccaucaacuguggaccacccuucucagccuuaccuucaucaagaccacguuguccuuggacuaugcguggaagaccauggccauggugcuaucuaucgucagcuuguucccccucugccuguccacgacaagccagaagacuaccuggcugcccguacuucuagggagcuucgggugcaagccguuaacgauguuccucaucaccgaaaacaaaaucuggggacgcaagagcuggccccugaacgaggggauaauggccgugggcaucgucaguauccuucucaguagccugcucaagaacgacgugccccucgccgggccccugaucgcgggcggcaugcugaucgcauguuauguuaucaguggcagcucugcugaccucagccucgaacgggcagcggaggucucaugggaggaggaggcggagcacagcggcgccucccacaacauccugguggaagugcaggacgaugggacaaugaaaaucaaggacgaggagcgcgacgacacgcucaccauccugcugaaggcuacccugcuggccgucagcggcguauacccgaugagcauccccgccacgcuguucgugugguacuucuggcagaagaagaagcagcggagcggaguccucugggauacgcccucuccucccgagguggagcgcgcggugcuggacgacggcaucuaccggaucuugcaacgcggccugcucgggcggucgcaggucggcguggggguguuccaggacggcgucuuccacaccauguggcacgucacccgcggggccgugcuuauguaccagggcaagcggcuggagccuuccugggccagcgucaagaaggaccugaucuccuacggcgggggcuggcgcuuccaggguagcuggaacacuggcgaggagguccaagugaucgccguugaacccgggaagaaccccaagaacgugcagacgacucccgguaccuucaaaaccccugagggcgaggugggcgccaucgcgcuggauuuuaagccaggcacguccgggagccccaucgucaaucgggagggcaagaucguaggccuguacggcaacggcgugguuacaaccuccgggaccuacgugagugccaucgcccaggccaaggccagccaggagggcccgcuccccgagaucgaggacgagguguucaagaaacgcaaccugacgaucauggaccuccacccgggguccggcaaaacucguagauaccucccggcgaucguccgggaggccaucaagcgcaagcugcgcaccuuaauccuggcucccacccggguggucgccagcgagauggcggaggcccugaagggaaugcccauccgcuaucagacgaccgccguaaagucggagcacaccgggaaggagaucguggaccugaugugccacgcgaccuucacgaugcgucuccugucccccgugcgcgucccgaacuacaacaugaucaucauggaugaggcccacuucaccgauccagcuuccaucgccgcacgcggcuauaucucuacccgcguggggaugggcgaagccgccgcgauauuuaugaccgcgacgccgcccggguccguggaggccuuuccgcagagcaacgcggucauccaagacgaggaacgggacaucccugagcgcuccuggaacagcggcuaugacuggauuacggacuuccccgguaagaccgugugguucgugcccuccaucaagagcgggaacgacauugccaacugccugcguaagaauggcaagcgcgucauacaacucucccggaagaccuucgacacagaguaccagaagacuaagaauaacgacugggauuacgugguaaccaccgacaucagcgagaugggggcgaacuuccgcgcggaccgggucauagacccgcgccggugccugaagccugugauccugaaggacggcccagagagagugauccucgcagggccaaugccggugacggccgcguccgccgcacagcgucgcggucggaucggcaggaaccagaacaaggagggggaccaguacauuuacaugggccagccccugaacaacgacgaagaccacgcacauuggacagaggccaagaugcugcucgacaacaucaacacgccggaggguaucauccccgcgcuauuugagccggagcgcgaaaaguccgcugccaucgacggcgaguaccggcucaggggcgaggcccggaaaaccuucguggagcucaugcgccggggcgaucugccagucugguuauccuacaagguggcuucagagggcuuucaguacucagacaggcgguggugcuucgacggggagcgcaacaaccagguauuagaggagaacauggacguggagaucuggacgaaagagggagagcggaagaagcugagaccccgcugguuggacgcgcgcaccuauuccgacccccuagcccugcgggaguucaaggaguucgccgccgggcgccggucggugucuggcgaccugauucucgagauaggaaagcugccgcagcaucuaacgcuuagggcccagaacgcguuggacaaccuggugaugcuccacaacucagagcagggcggcaaggcauaucggcacgcgauggaggagcugcccgacaccaucgagacccugaugcuccuggcccugaucgcggugcucaccgggggggugacucuguuuuuccugagcgggaaggggcucggcaagaccagcaucggucugcugugcgugauggccuccagcgugcuccuguggauggccaguguagagccccacuggaucgccgcaagcaucauccuggaguucuuccucauggugcuacugaucccggagccggaccgccaacguaccccccaggauaaccagcucgcauacguggugaucggccuauuauucaugauccucacgguggccgccaacgagaugggguuacuggagaccaccaagaaggauuuaggcaucgggcacguaguggccgagaaccaccaccacgccacaaugcuggacaucgacuuacaucccgcguccgccuggacgcucuacgccguggccacaaccauaauuaccccaaugaugcggcacacuaucgagaauaccaccgccaauaucagccugacugcgauagccaaccaagcggccauccugaugggcuuggauaagggcuggcccaucuccaagauggacauaggcguaccccugcuugcccucggcugcuacagccaggugaacccccucacccugaccgcggccgugcucauguugguggcccauuacgccaucaucgggccgggccugcaagcgaaggccacccgggaggcccagaagcgcaccgcggcggggaucaugaagaaccccacgguggauggcaucguggcgaucgaccucgacccagucgucuacgacgccaaguucgagaagcagcuuggccagaucaugcugcuuauacugugcaccucccagauccugcucaugcgcaccaccugggcccugugugagagcaucacgcuggcgaccgggccgcucaccaccuuaugggagggcuccccggggaaguuuuggaacacgaccaucgccgugagcauggcgaacaucuuccggggaagcuaccuggccggcgccgggcucgccuucuccuugaugaaaucccugggcggaggccgacgggggaccggugcccagggcgagacccucggggagaaguggaagcgccagcugaaucaacugagcaagagcgaauucaacacuuacaagcggaguggaaucauggaggucgaccgcagcgaggcgaaggaaggacucaagcggggcgagaccaccaagcacgccgugucccgaggaaccgcuaagcugcgaugguucguggagcgaaaccugguuaagcccgagggcaaggucaucgaccugggcugcgggcggggggggugguccuacuacugcgcugggcucaagaaagugacugaggugaaagguuacaccaagggcggccccggucaugaggagcccauaccgauggcgaccuacggcuggaacaucgucaaguuacacuccgggcgcgacguguucuucacgccgcccgagaagugcgacacccuacucugcgacauaggcgaaagcucccccaacccgacgaucgaggaggggcggacccuucgcguacugaagaugguagagcccuggcugcggggcaaccaguuuugcauaaagauucugaaccccuacaugcccagcguggucgagacccuggaacagaugcagcgcaagcacggcggcaugcuagugcguaacccgcugucccgaaacagcacccacgagauguacugggucuccugcggcacggggaauaucgucagcgccguaaacaugacgucccggaugcugcucaaccgcuucaccauggcccaccgcaaacccaccuacgaacgugacguggaccugggcgcaggcacccgccacgucgcgguggagcccgaaaucgcaaaccuggacaucauugggcaacggaucgagaauaucaagaacgaacauaagagcacauggcacuacgacgaggacaaccccuacaagaccugggccuaccacggcuccuacgaggucaagccgagcggguccgccuccuccauggucaacgguguugucagacuccucaccaagcccugggacgugauccccauggugacgcaaauugcgaugacggauacuacccccuucggucagcagcgggucuuuaaggagaagguggacacgaggaccccgagacccaagcgcggcaccgcccagauaauggaggugaccgcgaaguggcuguggggcuucuuaucucggaacaagaagccccgcaucuguacgcgggaggaauucacccgcaagguccggucuaacgcagcuaucggggccguguucguggacgagaaccaguggaacagugccaaggaggcgguugaggacgagcgcuucugggaccugguccaucgggagcgcgagcugcacaagcaggguaagugcgcaaccuguguguacaauaugauggggaagcgggagaagaagcucggggaguucgggaaggccaagggcagccgcgccaucugguacauguggcugggcgcgcgguuucuagaguucgaggcgcugggguucaugaacgaggaccauugguucucccgcgagaacucgcuguccggcgucgagggggaaggccugcacaagcuuggcuauauccugcgggauaucagcaagaucccgggcgguaauauguacgccgacgacaccgcugggugggacacgcguaucaccgaggacgaccugcagaacgaggccaagaucaccgacaucauggaacccgagcacgcacugcuggcaacaucuauauucaagcugacguaccagaacaagguggugcgcguccaaaggccagccaagagcggcaccgugauggaugucaucagccgccgggaccagcgcggguccggccaggucgggaccuacggacucaauaccuucacaaacauggaggugcagcugauccggcagauggaauccgagggcaucuucucgcccuccgagcuggagaacucgaaucucgccgagcgcguucuggacuggcuggagaaacacggggucgaacggcucaagcgcauggccauuuccggcgacgacuguguugugaagccgaccgacgaccgguucgcgaccgcccugaccgcccugaacgacauggggaaggugcgcaaggacauaccccaaugggagcccagcaaaggcuggaaugacuggcagcagguccccuucugcucccaucauuuccaccaacucaucaugaaagauggccgggagaucgucgucccgugccgcaaccaggacgagcuagucgggcgggcucgggugucccagggcgccggcuggagccuuagagagaccgcgugccucggcaaauccuacgcucagauguggcagcuaauguacuuccaccgccgggaccugcgacucgccgccaaugccaucugcagcgcgguccccguaaacugggugccuaccucccggacaacguggagcauucacgcccaccaccaguggaugacuacggaggauauguuguccguuuggaaccgcguauggaucgaggagaaccccuggauggaggacaagacacacguuagcagcugggaggaugucccauaccuagggaagcgcgaggaccaguggugcggcucacuuaucggccugaccgcacgggccaccugggcgacgaacauccaggucgccaucaaccaggugcgcagacugaucgggaacgagaacuaccucgacuauaugaccuccaugaagcgcuucaagaacgagagcgaccccgagggcgcacugugguga

SEQ ID NO: 24766 - RNA, 9879 nt, Artificial Sequence
  derived and/or modified CDS sequence (opt11) from DENV-1__KR024706__SS-prME
uccgugaccaugcugcucaugcugcugccgaccgcccucgcauuccaccugaccacccgcggcggcgaaccccauaugaucguuagcaagcaagagcggggcaagagccuccuguucaagaccuccgcggggguaaacaugugcaccuuaaucgccauggaccugggcgaguuaugcgaagacacgaugaccuacaagugcccuagaaucaccggggcggagcccgacgauguggacugcuggugcaacgccacggacaccugggugacauaugggacgugcagccagaccggagagcaccggagggacaagcguuccguggcucuggcgccccacguggggcuggggcucgagacccggaccgagaccuggaugucgagugagggcgcguggcggcagauccaaaaggucgagaccugggcccuccgccaucccggcuucacugucaucgcuuucuuucuggcgcacgccaucgggacguccaucacucaaaagggcaucaucuucauccugcuuaugcugguaaccccuagcauggccaugaggugcguaggcaucggaaaccgugauuucguggagggacucagcggggccacguggguggaugucguccuggagcauggauccugcgugacaaccauggccaagaacaagcccacccucgauaucgagcuccugaagacggaggugaccaaccccgcgguacuacggaagcucugcaucgaggcuaagaucucgaacaccaccacugauucccgcuguccgacccaaggagaggccacccugguugaagaacaagacgcgaacuucgucugccgccgcacgcuggucgaccgcgggugggguaacgggugcggccucuucgggaagggcagccugcugacgugcgcgaaguucaagugcgugaccaagcuggaggguaagaucguccaguacgagaacuugaaauacuccgugaucguuaccguccacacaggggaucagcaucaggugggcaacgagacgaccgaacacgggaccaucgcgaccauuacuccccaggcccccacauccgagauccagcugaccgacuacggcgcccuuacccuagacugcagcccccggaccgggcuggacuucaacgagaugguccuccucacgaugaaggaaaagagcuggcuggugcacaagcagugguuccucgaccugccgcugcccuggaccaguggcgcgucaaccagccaggagaccuggaaccggcaggaccuccuggugacuuucaagaccgcccacgcgaagaagcaagaaguaguggugcuggggucccaagagggggccaugcacacagcacucaccggcgccacggagauacaaaccagcgggaccaccacaauuuucgccggccaccugaagugccgccugaagauggacaagcucaccuuaaaggggguaaguuacgugaugugcacgggcagcuucaaacuggagaaggagguggcggaaacccagcauggcacgguccugguccaggugaaauacgaggggacggacgcaccaugcaaaauccccaucuccacacaagaugagaagggcgucacccagaacggacggcucaucacggccaauccaaucgugaccgauaaggagaagcccgugaacaucgagaccgagccgccauuuggcgaaagcuacauugucaucggugccggggagaaggcgcugaagcuguccugguucaagaaaggaaguuccaucgggaagauguuugaggccaccgccagaggggcccggcgaauggccauccucggagacacggcgugggacuuuggcagcauuggugggguguuuaccuccgugggcaagcuggugcaccagguguucgggaccgcauacggcguguuguuuagcggcgucaguuggaccaugaagaucggcaucggcauccuccugaccuggcugggguugaacucacgcuccacaagccuauccaugaccugcaucgccgugggcauggugacccuauacuuaggggucauggugcaggcggauagcggcuguguuaucaacuggaaggggcgugagcugaaaugcggcucuggcauuuucgucacgaacgaagugcacacuuggaccgagcaguacaaguuccaagcugacagcccuaaacgucuguccgcggcgauugggaaggcaugggaagaaggcgugugugggauccgguccgcuacgcggcucgagaacauuauguggaagcagaucagcaacgagcugaaccacauacugcuggaaaacgacaugaaguucacagucguggugggcgacgccaacgggauccugacgcaagggaagaagaugauccggccccagccaauggagcacaaguauuccuggaagagcuggggcaaggcuaagaucaucggagcggacacccagaacacuaccuucaucaucgacggacccgauacgccggaguguccugacgaucaacgcgccuggaacaucugggagguugaggauuacggguucggaguuuucacgacuaacaucugguuaaagcuccgggacuccuacacccagaugugcgaccaccgccugaugagcgccgcgaucaaggacaguaaggccgugcaugcagacaugggcuacuggaucgagagcgagaaaaacgagacguggaaacuggcucgggcuaguuucaucgaggucaagaccugcaucuggccgcgcagucacacccuauggagcaacggggugcuagagagcgagaugaucauccccaagaucuacggcgggccgaucucccagcacaauuaccgacccggauauuucacccagacagcggggcccuggcaucuugguaagcucgagcuggacuucaaucucugugagggcacgaccguugucguggacgaacacugcggcaaccgaggaccgagccucaggacaacuaccgugaccgggaaaaucauucaugaguggugcugcagaucuugcacccugccgccccugcgauuccgcggcgaggacggguguugguacggaauggaaauccggcccgucaaggaaaaggaggagaaccucgugcgcagcauggucuccgccggcagcggugaggucgacuccuucucccugggccugcucugcguguccaucaugaucgaggaggugaugcggagucgauggagcagaaagaugcuaaugacggggacgcuggccgucuucuuccuccugauuaugggccagcugacguggaacgaccucauccgccuguguaucaugguuggggccaauguaucagaccgaaugggcaugggcacuacguaccuggcccucauggcaaccuucaagaugcggccgauguucgccgugggccugcuguucagacggcucaccagccgcgaggugcugcuguuaacaaucggccugucccuggucgccucaguagagcuccccaacucccuggaggagcugggggacggccucgccaugggcaucaugaugcugaagcugcucaccgacuuucagagccaccagcuguggacaaccuugcucuccuuaacguucaucaagacgaccuuaagccuagacuacgccuggaagaccauggcuauggugcuguccaucgugagccucuucccccucugccuguccaccacgucucagaagaccaccuggcugccggugcuccugggcuccuucggcugcaagccccucaccauguuucucauaaccgagaacaagaucugggggcgcaaaagcuggccucugaaugaaggaaucauggccguggggaucguguccauccugcugagcucgcugcugaaaaacgaugugccccucgccggaccccugauugccggcgggaugcugaucgcaugcuacgugaucaguggcagcuccgccgaucucagccuggagcgcgccgccgaggugucuugggaggaagaggccgagcacucgggugccucccacaauauccugguggaagugcaggacgacggcacgaugaagaucaaagacgaggagcgggacgauacccuuacuauccugcugaaggcuacccuccuggccgugucggggguguacccgaugaguauacccgccacucuguucgugugguacuucuggcagaagaagaagcagcgcagcggcguccucugggacacgcccucgccgcccgagguggaacgggccgugcuggaugacgguaucuaccgcauccugcaacgcggccuuuuaggccguagccaagucgguguuggaguguuccaggacggagucuuccacaccauguggcacgugacccggggcgcgguucugauguaccagggcaagcgccuagagcccuccugggcuagugucaagaaggaucugaucuccuaugggggcggguggcgcuuccagggauccuggaauacgggggaggagguccaagugauagccgucgaacccggcaaaaaccccaagaacgugcagaccacccccgguaccuucaagacucccgagggggaggugggcgccaucgcccuggauuucaagccggggaccuccggcagccccaucgucaaccgcgaggguaagaucguggggcuguacggcaacgggguggucacaaccucgggcacuuacguaagcgcgaucgcccaggccaaggccagccaagaagggccgcuccccgagaucgaggacgaaguguucaagaagcggaaccugaccauuauggaccugcaccccggcaguggcaagaccaggcgguaccugccugccaucguccgcgaagcuauuaagcgcaagcugcgcacccuuauccucgcccccacacgcgugguggccagcgagauggcagaagcguugaagggaaugccuaucagauaccagacuaccgccgucaaguccgaacacaccggcaaggaaaucguggaccugaugugccacgccacguuuaccaugcgccuucugagcccuguccgggugccuaauuauaauaugaucauuauggacgaggcccacuuuaccgaccccgccuccaucgccgccaggggguauaucaguacccggguuggcaugggggaggccgccgccaucuucaugacggcgacgccgcccggcuccguggaggccuucccgcagaguaacgcagucauccaagacgaggaacgcgauaucccagagcgauccuggaacucaggcuacgauuggaucaccgauuuucccgggaagacggugugguucgugcccucgaucaagagcgggaacgacaucgcuaauugccugcggaagaacgggaagcgggucauccaguuaucccgcaagaccuucgauaccgaguaucaaaagaccaagaauaacgacugggauuacguggugaccacggauaucagcgagaugggugccaacuuccgggcggaccgcguaaucgauccgcgacgcugccugaagccugucauccugaaggacggccccgagcgcguaauccucgccggccccaugccugugaccgccgccuccgcggcccaaagacggggccgcaucgggcgcaaccagaacaaggagggcgaccaguacaucuacauggggcagccgcucaacaacgacgaggaccacgcccacuggaccgaagccaagaugcuacucgacaacaucaacacucccgaaggcauuaucccggcgcuguuugaaccggagagggagaaguccgcggcaaucgacggagaauaccgcuuagggggcgaggcccgaaagacguucguagaguuaaugaagcgcggggaccugcccgucuggcugucauacaagguggccucagagggcuuucaguacuccgauagacgcuggugcuucgacggggagaggaauaaucagguuuuggaggagaacauggacgucgagaucuggaccaaggagggugagcgcaagaagcuacggccccguuggcuggacgcccgcaccuauagcgauccccucgcucuccgggaguuuaaagaguucgcagccggcagacgcucggugucaggggaccugauccuagaaaucgguaagcuaccgcagcaccugacccuacgcgcccagaacgcccuggauaaccuggugaugcuccacaacucugaacagggggggaaagcguaucgccaugccauggaggagcuacccgacaccauugaaacgcugaugcucuuggcccugauugccguccuuaccgggggcgugacccuguucuuccugucaggcaaggggcucggcaaaaccagcaucggccugcugugcgugauggcguccagcguccuccuguggauggccuccguggaaccccacuggaucgccgccagcaucauccuggaguucuuccuaaugguucuauuaaucccggagccggaucggcagcgcacgccccaagauaaucagcucgccuacgucguaaucggccugcuguucaugauccucaccguggcugccaacgaaaugggacugcuggagaccaccaagaaggaccucgguaucggacacguuguggccgagaaccaucaccacgccacgaugcuggacaucgaucugcacccugcgagugcguggaccuuauacgcuguggccaccaccaucauuacgccuaugaugcggcacacaauagagaauacgaccgcuaacaucagccugacugccaucgcgaaucaagcagccauccucaugggccucgacaagggcuggcccauuuccaagauggacaucgggguccccuugcuggcccucgguugcuacucacaagugaacccccugacccugaccgccgcgguguugaugcuggucgcccacuacgccaucaucgggccgggucugcaggccaaagcgacgcgcgaagcacagaagcggacggccgccggcaucaugaagaaucccacaguggacgggaucguggccaucgaccuugacccggucguauacgacgccaaauucgagaagcagcugggucagaucauguugcucauacucugcaccucgcagauucuucugaugcgcacaacgugggcccugugcgagaguaucacacuggccaccgggccgcucaccacgcugugggagggcuccccgggcaaauuuuggaacacaaccaucgccgugagcauggccaacauuuuccgcggguccuaccuggcgggagcagggcuugccuucucucugaugaaaucccugggcgggggucgcagagggaccggggcucagggugagacgcucggggaaaaauggaaacgccagcugaaccagcugucuaagagcgaguucaacaccuauaagcgguccggaaucauggaggucgaucggucggaagccaaggaggggcuaaaacgcggugagaccaccaagcacgcaguaucccgggggacggccaagcugcguugguucgucgagcggaaccuggucaaacccgagggaaaagucaucgaucuggggugcgggcgcggcggauggagcuacuacugcgcgggccucaagaaggugaccgaagucaagggcuauaccaaaggcggccccgggcacgaagagccaaucccgauggcaaccuacggcuggaacaucgugaaacugcauuccgggagagacguguuuuucacgccgccagaaaagugcgauacucugcucugcgacauuggcgagagcucgccuaaccccaccauagaagagggccgcacucugcggguccugaagaugguggagcccuggcuccgcgggaaccaauucugcaucaagauccugaaccccuauaugcccagcgugguggagacccuggagcagaugcaacggaaacauggugggaugcucgugcgcaacccgcuuuccagaaauagcacgcacgagauguacuggguauccuguggcaccggcaacaucgucagcgcggugaacaugacgucccgcaugcugcucaaccgauuuaccauggcccacagaaagcccacguacgagcgcgacguugaccugggggccggcacccggcacguagccgucgagcccgaaauugccaaccuagauaucaucggccagcgcaucgagaauaucaagaacgagcacaagucgaccuggcacuacgacgaagauaaccccuauaagaccugggcguaccacggauccuacgagguaaagccuagcggaagugccagcuccaugguaaacggcguaguccgccuccugaccaagcccugggauguaauccccauggugacccagauagccaugacggacaccacgcccuucggacagcagcgcguauucaaagagaagguggacacacggaccccgcgccccaaacggggcaccgcccaaauaauggaggugacugcaaagugguuauggggcuuccucagccgcaacaagaagccccggaucugcacccgcgaagaguucacucggaagguucgcagcaacgcggccauaggggccguauucguggacgagaaccaguggaacuccgccaaggaggccguggaggacgagcgguucugggaccuggugcacagagagcgggagcugcacaagcagggcaagugugcaaccugcguguacaauaugauggggaagagagagaagaagcuuggcgaguucgguaaggcuaaggggagccgggcuaucugguacaugugguugggcgcccgcuuccuggaauucgaagcgcucggguucaugaacgaggaccacugguucucccgggagaacucauuguccggcgucgagggggagggccuacacaagcucggcuacauucuacgcgacauaagcaagauccccggggguaauauguacgccgacgacacggccgggugggacaccagaauuaccgaggacgaucugcaaaacgaggccaagaucaccgacaucauggagcccgaacacgcgcuccuagcgacguccaucuucaagcugaccuaccagaacaaggucgugcgcguccagagacccgcuaaaagcgggacggugauggacgugaucagccggcgggaccagcggggcuccggacaggucggcaccuacggauuaaacacguuuaccaacauggaaguucaguugauacgacagauggagucugaaggcaucuucagccccuccgaauuggagaacagcaaucuugcugagcggguccuggacuggcuugagaagcacggagucgagcgcuuaaagcggauggccauauccggcgacgacuguguugugaagccgaccgaugaucgcuucgcuaccgcgcuaacggcccugaacgacaugggcaaggugcgcaaggacauaccccagugggagcccaguaaggguuggaacgacuggcagcucgugccuuucugcucccaccauuuccaccaacuuaucaugaaggacggucgcgagauaguggucccgugccgcaaccaggacgagcuggucgggcgcgcccgggugagccagggcgccggguggagccuccgcgaaacugcgugccuggguaagucauacgcgcagauguggcagcugauguacuuucaccggagggaucuccggcucgccgcaaacgccauuugcagcgcgguccccgugaacuggguacccacgagccgcaccaccuggucuauccaugcgcaucaccaguggaugacgaccgaggacaugcugucgguuuggaaccgaguguggaucgaggaaaaucccuggauggaggacaagacccacgugagcuccugggaggacgucccguaccucggcaagagggaggaccaauggugcgggucccugauugggcugaccgccagggccacaugggccaccaacauccagguagcuaucaaucaggugcggcgcuugauugggaacgagaacuaccuggacuacaugaccuccaugaagcgguucaagaacgagagcgaccccgaaggcgcccugugguga

SEQ ID NO: 24767 - RNA, 9879 nt, Artificial Sequence
  derived and/or modified CDS sequence (opt11) from DENV-1__KR024707__SS-prME
agcguuaccaugcugcucaugcuacugccgaccgcccucgccuuccaccugacgacccgggggggggagccccacaugaucgugagcaagcaggagagaggcaaaagccuccuguucaagaccuccgcgggggugaacaugugcacccucauugccauggaucugggugagcucugcgaagacaccaugacguacaagugcccccgaaucaccgaagccgagccagaugacguggacugcuggugcaacgcgaccgacaccugggugaccuacgggaccuguagccagacaggcgagcaccggcgcgacaagagaucuguugcccuggccccccacgugggccugggccucgagacgcgcaccgagaccuggaugaguuccgagggcgccuggcggcaaauccagaagguugagacaugggcccugcgccaucccggguuuacggugauagcccuguuccucgcucaugccaucggcacuagcaucacccagaaggguaucaucuuuauccugcugaugcucgugacccccuccauggcgaugcggugcgucggcaucggcaaccgcgacuucguugaggggcugagcggcgccacuuggguggacgucgugcuggagcauggguccugcgugacgaccauggccaagaacaagccuacccucgacauagagcugcuaaagacggaggucacgaaccccgcgguccuccggaagcugugcaucgaagccaagaucuccaacaccacaacggacucccgcugcccaacucagggcgaggcaacccugguggaggagcaggacgccaacuucgucugccggcgcaccuucguggaccggggcugggggaacggcugcggccucuuuggcaaggggucucugcugacgugcgcuaaguucaagugcguaaccaagcucgaggguaagaucguccaguacgagaaccugaaguacuccgugaucgugaccguccacaccggcgaccagcaccagguggggaacgagacgacagagcacggcaccaucgcgaccaucacgccccaggcccccacgagcgagauccaguuaaccgacuacggggcccucacccuggacugcagcccucggaccggccuggacuucaacgaaaugguccuccugaccaugaaagagaaauccuggcuggugcacaagcagugguuccucgaccuaccgcugccguggaccuccggggcuaguaccagccaggagaccuggaaccggcaggaccuccuggugacguucaaaaccgcucacgcgaagaagcaggagguuguggugcugggcucacaggagggcgccaugcacacugcccucaccggggccacggagauccagaccagcggcaccaccacgaucuucgccgggcaccuaaagugccgccugaagauggacaagcucacccugaagggcgucuccuacgugauguguaccgggagcuucaagcuggagaaggagguggcggaaacccagcauggcacaguccugguccaggugaaguaugagggcaccgacgcccccugcaagauccccauauccacccaggacgagaagggggucacgcagaacggccggcucauuacggcaaauccgaucgucaccgacaaggagaaacccgugaacaucgagaccgagccaccguucggagagagcuacauagucaucggcgccggcgagaaagcgcugaagcuauccugguucaagaaggggagcuccaucggcaagauguucgaggccacagcccgcggggcucggcgcauggccauccucggcgacacggcgugggacuucgggucuaucggcggcguguucaccucaguggggaagcugguucaccagguauucggcaccgccuacggggugcuguucagcggcgucuccuggacaaugaagaucgggaucggcauccuccugacguggcuaggccugaacagccgcuccaccagccuguccaugaccugcaucgccguggggauggugacccuguaccucggggucauggugcaggccgauucggggugugugaucaacuggaaaggcagggaacuaaagugcgggagcgguaucuucgucacgaacgaggugcauaccuggaccgagcaauacaaguuccaggccgacagcccgaagcgccuguccgcugcuaucgguaaagccugggaggagggggucugcggcauacgauccgccacccgcuuggagaacaucauguggaagcagaucucgaacgagcugaaccacauccugcucgagaacgacaugaaguucaccgucgugguaggggacgccaacggcauccugacgcaggggaaaaagaugauccggccccaaccuauggagcacaaguacuccuggaaguccugggggaaggccaagaucaucggagcugacacccagaacaccaccuuuaucaucgacgggccugacacgccggagugcccagacgaccagcgcgccuggaacaucugggagguagaggacuacggcuucgggguuuucaccaccaacauauggcugaagcuaagagacuccuacacccagaugugugaccaucggcugaugagcgcggcgaucaaggacuccaaggccguucacgcugacaugggcuacuggaucgagagcgagaagaacgagacguggaagcuggcccgugccucuuucaucgaggucaagaccugcaucuggccccgcagccacacccucugguccaacggcgugcuggagagcgagaugaucauccccaagauuuacggggggccgaucucccagcacaacuaccggcccggguacuucacacagacugcgggacccuggcaccuggggaaacuggagcuggauuucaacuugugcgagggcaccacaguggucguggacgagcacugcggcaaccgcgggccgagccuccggacgacgaccgugaccggcaaaaucauacacgaguggugcugccgcuccugcacgcucccgccccugcgguuccggggagaggacggauguugguacggcauggagauccggcccgucaaggagaaggaggaaaaccugguucgcaguauggugucagccggcagcggugagguggacagcuucucucugggucugcucugugugagcauaaugauugaggaggucaugcggagccgcuggagccguaagaugcugaugacgggcacccuggccgucuucuuucuccugaucauggggcagcugaccuggaacgaccuuauccggcuaugcaucauggugggcgcuaacgugagcgaccgcauggggaugggcaccacguaucuggcccucauggcgacguucaagaugcggccgauguucgccgucggccugcuguuccgccggcucacgagccgcgaggugcuguuacucaccauaggacugucccuggucgccagcguggaguuacccaacucccuggaagagcugggcgacggccucgccaugggcaucaugauguugaagcugcucaccgacuuccaaagccaccagcuguggaccacccugcucucccugaccuucaucaagaccacccugagccucgacuacgccuggaagaccauggcgauggugcugucaaucgucagccuguucccucucugucugagcaccacgagccagaagaccaccuggcugcccgugcuccugggcuccuucgggugcaagccgcugaccauguuccucaucaccgagaacaagaucugggggcgcaagagcuggccacugaacgaggggaucauggcagugggcaucgucuccauucugcuaagcagccuccugaagaacgacguaccccucgccgggccccugaucgcagguggcaugcugaucgcuugcuacgugaucuccgguagcagugccgaccucagccuggagcgcgccgcggaggucuccugggaggaggaggccgaacacagcggcgcgucccacaacauccugguugaagugcaggacgacgggacgaugaagaucaaggacgaggagcgagaugacacccucaccauccugcugaaggccacccuccucgcagucagcggcguauacccgauguccauccccgccacgcuguucgugugguacuucuggcagaagaagaagcagcgcagcgggguccucugggacacccccagcccgcccgagguggagcgggccgugcuggacgacggcaucuaccgaauccugcaaagaggccugcuggggcgcagccaggucggcguggggguguuccaggacggcgucuuccacaccauguggcacgucacccgcggggccgugcugauguaccagggcaagcgccuggagcccuccugggccagcguuaagaaggacuuaaucuccuacggcgggggauggcgauuccaagggagcuggaacacgggcgaggagguccaggugaucgcggucgagcccggaaaaaaccccaagaacgugcagaccacucccggcaccuuuaagacgcccgagggcgaagugggggccaucgcccuggacuucaagcccggcacauccgggucccccauugucaaccgcgagggcaagaucgugggccuguacgggaacggcgucgucaccaccuccgggacauacgugagcgcuaucgcccaggccaaggccagccaggagggcccgcugcccgagaucgaggacgagguguucaagaagcggaaccuaaccaucauggaccugcaccccggguccggcaagacccgccgguauuuaccggccaucguccgcgaggcgaucaagcgcaagcugcggacucugauccucgcccccacgcgcgugguggccuccgagauggccgaggcgcugaagggcaugccgauccgauaccagaccaccgcggucaaguccgagcauaccgggaaggagaucguggaccugaugugccaugccacguucaccaugcgccuccugagccccgugcgggucccgaacuauaacaugaucaucauggacgaggcccacuucaccgaccccgcauccaucgcggcaaggggcuacaucagcacccggguugggaugggcgaagccgccgccaucuucaugacggcuacgccgccaggguccguggaggccuucccgcagagcaacgccgucauccaggacgaagagcgcgacaucccagagcgcuccuggaacagcggcuacgacuggaucaccgacuucccgggcaagaccgugugguucguaccuuccaucaagagcgggaacgacauagccaacugccugcgcaagaacgggaaacgggucauacagcucagccgcaagacguucgacaccgaguaccagaagacaaagaacaacgacugggacuauguggugaccacggacaucucugaaaugggagccaauuuccgggcggaccgcgucauagacccgcggcgcugccuaaaacccgugauccugaaggacggaccugagcgggucaucuuagccgggcccaugccggugaccgccgccagcgcggcccagcgccgcggccgcaucggccgaaaccagaacaaggagggcgaccaguacguguauaugggucagccccugaacaacgaugaggaccacgcccacuggaccgaggccaagaugcuguuggauaacaucaacaccccagaggggaucauccccgcccucuucgagccggagcgggagaagucggcggccaucgacggcgaguaccgucugcgcggggaggcgcgcaagacguucgucgagcuaaugcggcgcggcgaccuucccgucuggcuuuccuacaagguggcuagcgagggcuuucaguacucagaccggcgcuggugcuucgacggggagcggaacaaccagguccucgaggagaacauggacguggagaucuggaccaaggagggagagcgcaagaagcugcggccccgcugguuggaugcccggaccuauucugacccccucgcgcugcgcgaguuuaaggaguucgcugccgggcggcggucuguguccggcgaccugauccucgagauugggaagcugccgcagcaccugaccuuacgggcccagaacgcccuggacaaccuggugaugcuccacaacagcgaacagggggggaaggcuuacagacacgccauggaggagcugcccgauacuaucgaaacgcugaugcuauuaacccucaucgccgugcucaccgggggcgugacccuguucuuccugucggggaagggccucgguaagacgagcauugggcuacugugcguaauggcguccucagugcuccuguggauggcguccguggagccucacuggaucgccgccagcaucauucuggaguucuucuuaaugguccugcuaaucccggagccggaccggcaacgcacgccucaggauaaccagcucgcguacguugugaucggccugcuguuuaugauacucaccgucgcugcgaacgagaugggguugcuggagaccacgaagaaggaccugggcaucggacacgugguggccgagaaccaccaccacgccaccauguuggacauagaccuccaccccgccucugccuggacccucuacgcggucgcaaccacgaucauuacuccgaugaugcggcauaccaucgagaacaccacggccaacaucucgcugaccgccaucgccaaucaggcggccauccugaugggccucgacaagggcuggcccaucuccaagauggacaucggggugcccuugcucgcccucggcugcuacagccaggucaacccacugacgcugaccgccgcuguccucaugcugguagcgcacuacgccauaaucgggccgggccuucaggccaaggccacgcgcgaggcgcagaagcgcaccgccgccgggauaaugaaaaaccccaccguggauggcauugucgccaucgacuuggaccccgugguguacgacgccaaguucgaaaaacagcugggccaaauuaugcugcucauccugugcaccucccaaauccugcugaugcggacgaccugggcgcugugcgaaagcaucacccuggccaccgggccccuaacgacacugugggaggguuccccggggaaauucuggaacaccacgaucgccguauccauggccaacaucuuccgcggcagcuacuuggccggcgcagggcucgccuucucgcugaugaagucacucggcgggggccggcgcgggacgggcgcccagggcgagacccucggggagaaguggaagcggcagcugaaccagcugagcaagagcgaguuuaacacauauaagcgguccggcaucauggaaguggaccggagcgaggccaaggaggggcugaagcgcggcgagacaacgaagcacgccguuucccgggggaccgcgaagcugcgcugguucguugagcggaaccuggugaagcccgagggcaaagugaucgaccugggcugcggacgcggcggguggagcuacuacugcgccggccucaaaaaagucaccgaggugaagggguacaccaagggcggccccgggcaugaggagcccaucccgauggccaccuauggcuggaacauagugaagcuacacuccggccgcgacgucuucuucacgccgcccgagaagugcgacacccugcucugcgacaucggcgagagcucccccaacccgaccauagaggaggggcgcacccugcgggugcugaagaugguggagcccuggcuccgcggcaaccaguucugcaucaagauacucaaccccuacaugcccagcgucguagagacgcuggagcagaugcaacggaagcacggugggaugcucguccgcaacccgcugucccggaacagcacacacgagauguacugggucuccugcggcaccgggaacaucgugagcgccguaaacaugacuucccgcaugcuguuaaaccgcuucacuauggcgcaucggaagcccaccuacgagcgcgacgucgauuuaggcgcuggcacccggcacguggccgucgaacccgagaucgccaaucuggacauuaucgggcagcgcaucgagaacaucaagaacgagcauaaguccaccuggcacuacgacgaggacaacccuuacaagacaugggccuaccacggcuccuacgaggugaagccgagcggguccgcgagcagcauggugaacggggucgugcggcuccugaccaagcccugggacgugauccccauggucacccagaucgccaugaccgacacgacccccuucgggcagcagcgcguguucaaggagaagguggacacccggaccccgcggccaaagcgcggcacggcccagaucauggaggucacugcaaaguggcucuggggguuccucucucgcaacaagaagccccggaucugcacccgcgaggaguucacccggaaggugcgcagcaacgccgcgauuggggccguguucgucgacgagaaucaguggaacucagcaaaggaggccguggaggacgagcgauucugggaccuggugcaucgcgaacgugagcugcacaagcagggcaagugcgcuacgugcgucuacaacaugaugggcaaacgcgagaaaaagcucggcgaguucgggaaggcgaaaggcagccgggccaucugguacauguggcugggcgcccgauuccuggaguucgaggcacucggguucaugaacgaagaccacugguucucccgggagaacagccuguccggcguggagggggaggggcugcacaaacucggguacauccugcgcgacaucagcaagaucccuggcggcaacauguacgcggacgacaccgccgggugggacacccgcaucaccgaagacgaccugcagaacgaggcgaagaucacggacaucauggagcccgagcacgcccuccuggccaccuccauuuucaagcucaccuaccaaaacaagguggugcgggugcagcgccccgccaagagcggcaccgugauggacguaaucuccagacgcgaccagcgggggagcggccagguuggcacguauggccucaacaccuucaccaacauggaggugcagcugauacgccagauggaguccgagggcaucuucagccccuccgagcuugagaacagcaaccucgcugagcggguccuggacuggcuggaaaagcacgggguggaacgcuugaagagaauggccauuuccggugacgacugcguggucaagccgaccgacgaccgcuucgccaccgcccuaaccgcccucaacgacauggguaaggugcggaaggacaucccccagugggagcccucgaagggcuggaacgacuggcagcagguccccuucugcucccaccauuuccaccagcucauaaugaaggacggccgagagaucgucgugccgugccggaaccaggacgagcuggucggacgagcccgggucagccagggcgccggguggagcuuacgcgaaaccgccugucucggcaaguccuacgcccagauguggcagcugauguacuuccaccggcgcgaucugcggcucgcggccaacgccaucugcagcgcggugccugugaacuggguccccacaucccgcaccacguggagcauccacgcucaccaccaguggaugaccaccgaagacauguugagcguguggaaucgcgucuggaucgaagagaacccauggauggaggacaagacccacgucagcuccugggaggacgugccguacuuggggaagcgggaggaccaguggugcggcagcuuaaucggcuuaacggcgcgcgccacuugggccacgaacauccagguggcaaucaaccagguccggcgccugaucgggaacgagaacuaccucgacuacaugaccuccaugaagagauuuaaaaacgaaagcgaccccgagggcgcgcuuugguga

SEQ ID NO: 24768 - RNA, 9879 nt, Artificial Sequence
  derived and/or modified CDS sequence (opt11) from DENV-1__KC172829__SS-prME
agcgugaccaugcugcucaugcugaugcccacggcccuugccuuccaccucaccacccgcggcggggagccgcauaugaucgugagcaagcaggaacgcggaaagagccugcuguuuaagaccuccgccggggugaacaugugcacgcucaucgcgauggaccugggggaacugugcgaggauaccaugaccuacaagugcccccgcaucacagaggccgaacccgacgacguggacugcuggugcaacgcuaccgacacguggguaacguacgggacgugcucacagacaggugagcacaggcgcgacaagcgaagugucgcccucgcgccucaugugggucuggggcuggagacucgcaccgagaccuggaugagcuccgaaggugccuggaagcagauccagcggguggagaccugggcccuccgccauccggguuucacagugaucgcccuauucuuggcgcacgccaucggcaccagcaucacccagaaagggaucaucuucauacuccugaugcuggugacccccucgauggccaugaggugcgucggcauaggcagccgcgacuucguggaggggcucuccggcgccacguggguggaugucguguuagaacacgggagcugcguuacgacaauggcuaaggacaagcccacccuggauaucgagcuccugaaaacugaggucaccaaccccgcugugcuucggaagcucugcaucgaagccaagauaucuaauaccaccacagauagccgcugcccgacacagggcgaggccacacugguggaggagcaggacgccaacuucgucugccgccgcaccuuuguugaccggggcugggggaacggcugcgggcuguuugguaaggggucccugaucacuugcgccaaguucaagugcgucaccaagcucgaaggcaaaauuguccaguacgagaaucucaaauacagcgugaucgugaccguccacaccggcgaccagcaccagguggggaacgaguccacggagcacggcacgacggcgaccaucacgccccaggcccccaccacugagauacaacucaccgacuauggcgcgcucacccuggacugcagcccccgcacgggucucgacuucaacgaaaugguccucuuaaccaugaaggaaaagagcuggcucguucacaagcaaugguucuuggaccugccgcuacccuggaccagcggggccagcaccucccaggaaacuuggaaccggcaggaccugcuggucacuuucaagaccgcccacgcgaagaaacaagaagucguggugcucggcagucaagagggcgccaugcacaccgcccugacgggugccacggagauccagaccuccggcacaacgaccaucuucgccgggcaccuaaagugccgccucaaaauggauaagcugacacuaaaaggcaugagcuaugucaugugcacaggcacguucaaacuggagaaagagguggcggagacgcagcacggcaccguuuuaguccagaucaaguaugaaggcaccgacgcacccuguaagauccccuucuccacccaggacgagaaaggagugacccaaaacgguagguuaaucaccgccaauccgauagugaccgacaaggagaagcccgucaacauagaggccgaaccgcccuucggggagagcuacaucgugauaggcgcgggcgagaaggcacugaagcucuccugguuuaagaagggcagcuccaucggcaagauguucgaggccacagcccgcggggcccggcggauggcaauccuaggggacaccgccugggacuucggaaguaucgggggcgucuuuaccuccgucgggaagcuggugcaccagaucuucgggaccgccuaugggguccuguucagcggcgucagcuggacgaugaagaucgggaucggcgugcugcugacauggcucggccucaacucgcggucaaccucguuauccaugaccugcaucgccguugggcucgugacgcuguacuuaggcgugaugguucaggccgauagcgggugcguggugaauuggaagggccgcgagcucaaaugcggguccggcaucuucgugaccaacgagguucauacauggacugagcaguacaaguuccaagccgacagcccgaagcgcuugagcgccgccauuggcaaggcaugggaagagggcgucugcggcauccgguccgccacccgacuggaaaacaucauguggaagcagaucucaaacgaauugaaccacauacugcuggagaacgacaugaaguucacggugguaguaggggacguagcgggcauacucgcccaggggaagaaaaugauacggccccagccaauggaguacaaguacuccuggaaguccuggggcaaggccaagaucaucggcgccgacguccagaacaccaccuucaucauagauggcccgaacaccccggagugccccgacgaccagcgcgcguggaacauaugggagguggaggacuauggcuuugggauauuuacgaccaacauuuggcugagacuucgcgacuccuacacccaggugugugaccaccgucucaugagcgccgccaucaaggauuccaaagcuguucaugccgacaugggcuauuggaucgaguccgagaagaacgaaaccuggaaacuggcgcgcgcuuccuucauagaggugaagacgugcaucuggcccaagagccacacuuugugguccaauggggugcucgagagcgaaaugaucaucccgaagaucuacggcggccccaucucccagcacaacuaccggcccggcuauuucacgcagaccgccggcccguggcaccuggggaaacuggagcucgauuucgacuuaugcgagggcacgaccgucgugguagacgagcacugcggaaaccgcgggcccagccugcguaccaccacgguaaccggcaagaucauccacgaguggugcugccgcuccugcacccugccgccucugcgguuccgcggggaagacggcugcugguacgggauggagauccggcccgugaaggagaaggaggaaaacuuggucaagucaauggucucagcagggagcggagagguugacagcuucucgcucgggcugcugugcaucagcaucaugaucgaggaggucaugcggucccgguggagccguaaaaugcucaugaccggcacgcuggccguauucuuuuugcucaucauugggcagcugacauggaacgaccugauccgcuuaucuaucauggugggcgcgaacgccucagacaagauggggauggggacuaccuaccuggcacugauggccacguucaagaugcgccccauguucgccguggggcuccuguuccggcggcuuaccucccgcgagguccuccugcuuaccaucgggcucagccugguggcgucugucgaacugcccaacucucucgaggaacugggugacggccuggccaugggcaucaugauccucaaacugcugacagacuuucagucccaucagcucugggcgacgcuuuuaucuuugaccuucaucaagaccaccuucagccugcacuacgccuggaagacgauggcgauggugcucagcauugugucccucuuccccuuaugccugagcacgaccucccagaagaccacguggcugccaguccugcugggcagccucgggugcaagccgcugaccauguuccugauuacggagaacaagauuuggggucgcaaguccuggcccuugaacgagggcaucauggccguggguauaguaagcauccugcucucaucgcuccucaagaacgacgucccacuggccgggccccucaucgcuggcggcaugcugauagccugcuaugugaucagcgggaguagcgcggaccugucccucgagaaagccgccgaggugucaugggaggaggaagccgaacacuccggcgccagccauaacauucuggucgaggugcaggacgauggcaccaugaaaaucaaggacgaggagcgugacgacaccuuaacgauccucuuaaaggcgacccugcucgccguguccggcgucuacccguugagcaucccagccacccuauuugugugguacuucuggcagaagaagaagcagcgguccgggguauugugggacacuccgucaccgcccgaggucgagcgagccgugcuggacgacgguaucuaccgaaucaugcagcgcggucugcuggggcggucccaagugggugugggaguguuccaggagaacguguuccacacgauguggcacgugacaaggggcgccgugcucauguaccaggggaagcgacuggagcccagcugggcgucggugaagaaggaccuuaucucguacggcggcggguggcguuuacagggcuccuggaacaccggggaggagguccaggugauugccguggagcccggcaagaauccuaagaacguccagacggccccuggaacguucaagacgaccgagggggaagugggcgccaucgcccuggacuucaagcccgggacuagcgggucccccaucgugaaccgggaggggaagaucgucgggcuguacggcaacgggguggugacgaccucagggaccuaugucagcgcgaucgcccaggccaaggccucccaggagggcccccucccagaaaucgaggacgagguguuccguaagcguaaccucaccaucauggaccuucacccugguagugggaaaacgcgucgguaccucccagcgauuguucgcgaggccaucaagcggaagcugcgcacccugauccucgccccgacccgcguaguggcaagugagauggccgaggcgcuuaagggcaugcccauccguuaccagacgacggccguuaaaagcgagcauaccggcaaggagaucgucgaucugaugugccacgcgacauucaccaugcgccuccugucccccguucgggugcccaacuacaacaugaucaucauggacgaggcccacuucacggacccgagcuccaucgccgcgcgcggcuacaucucaacaagagugggcaugggggaggccgccgcaaucuucaugaccgccacgccacccggcuccguagaggccuucccccagagcaaugccgugauucaggacgaggagcgcgacaucccggagcggucuuggaacagcggauacgaguggaucaccgacuuuuccggcaagaccgucugguucgugcccaguauuaagucaggcaacgacaucgccaacugccugcguaagaacgggaagcggguuauccagcugucacgcaagaccuucgacaccgaguaccagaagacgaagaauaacgacugggauuauguagucacuaccgacauauccgagaugggagcuaacuuccgggcggaccgcgucaucgacccccgacgcugccugaagcccgucauuuugaaagacgggccugagcgggugauccucgccggucccaugcccgucaccguggccagugccgcacagcgccgggggcgcauaggccggaaccacaacaaggagggcgaccaguauauuuauaugggccagccccugaacaacgaugaggaccacgcgcacuggacagaggcaaagaugcuucuggauaacaucaauaccccggaggggaucauaccugcccuguuugagccugagcgcgagaaguccgcggccaucgacggggaguaucgccuacgcggcgaggcgaggaaaaccuuuguugagcucaugcgucgcggggacuuacccguauggcugagcuacaagguggccagcgagggauuccaguacuccgaccgccguuggugcuucgacggcgagaggaacaaccaggugcuugaagagaauauggaugucgagaucuggaccaaggagggggaacgcaagaagcugcguccgcgcuggcuggacgcccggacguauagcgacccucucgcccugcgcgaguucaaggaguucgcggcgggccggagguccgugagcggggaccugauccucgagaucggcaaacuuccgcagcaucucacgcaacgggcgcaaaacgcccucgacaaccuuguaauguuacacaacuccgagcagggcgggcgugccuaccggcaugcgauggaggaauugccagacaccauagagacccugaugcugcucgcacugaucgcaguccugaccggcggggugacccucuucuuucugagcggccgcggucugggcaagacgagcauaggccuccucugcgugauggccagcucuguccugcucuggauggcguccguggagccucacuggaucgcggcaucuaucauccuggaguucuuucugauggugcuccugauccccgagcccgaccggcagcgcacuccucaggauaaccagcuggccuacguugugauaggauugcuguuuaugauccugaccguagccgcaaaugagaugggucuucuggagacgaccaagaaagaccuuggaaucggccacguagcggacgagaaccaccaccaugccgccaugcuggacguggaucugcaccccgcgagugcuuggacucuguacgcgguggccaccacgaucauaaccccaaugaugcggcacacgaucgagaacaccacagccaacauaucucugaccgcgaucgcuaaucaggcggccauccugaugggguuggacaaaggcuggccgaucucgaagauggacauaggggucccucuccuggcccuggggugcuauucccaggugaacccgcucacccugacagccgccguucugauguuagucgcucacuacgcuaucaucgggccuggacugcaggcgaaggcaacgagagaggcgcagaagcgcaccgcagcaggcauuaugaagaaccccacuguggacgggauaguggccaucgaucuggacccggucguguacgacgccaaguucgagaagcagcucggccaaaucaugcugcugauucucuguaccagucagauccuacugaugcgcacgaccugggcgcucugugaguccauuacccuggcuaccggcccgcucacgaccuugugggagggaagccccggcaaguucuggaacaccaccaucgcuguguccauggccaauaucuuccgcgggagcuaccuggccggcgccggccuggccuucagccuaaugaaaucccucgggggagggcggcguggaacgggcgcacagggugagacccugggcgagaaguggaagcgucagcuuaaccagcugagcaaguccgaauuuaacaccuacaagcgcucagggaucauggagguugaccggucugaggccaaggagggacugaagagaggggagaccacgaagcacgcggugagccgcggcacugccaaguugcguugguucguagagcggaaccuggucaagccggaggggaaggugaucgaccugggcugcgguagagggggcugguccuacuacugcgccggccugaagaagguaaccgagguaaagggauacaccaagggagggccgggucacgaggaacccauccccauggcaacguacggguggaaccucgucaagcuccacagcggcaaggacguguucuuuauaccgccugagaagugcgacacccugcuuugcgacaucggggagucgagcccaaacccaaccaucgaggagggccggacccugcgcguccugaagaugguggagccauggcuccgggggaaccaguucuguaucaagauccugaaccccuacaugcccuccguaguugagaccuuagagcagaugcaacggaagcacggugguaugcucgugcggaacccccugagccgcaacuccacccacgagauguacugggugagcugcgggaccggcaacaucgucuccgcgguuaacaugaccagccggauguugcucaacagauucaccauggugcaccgcaagcccacguacgagcgggacgucgaccugggggcgggcacccgccacguggccgucgagccggaggucgccaaccuggacaucaucggccagcgaaucgagaacaucaagcacgagcacaaguccaccuggcacuacgacgaggauaaccccuacaagaccugggcauaccacgguagcuacgaagugaagccuagugggagcgccaguuccauggucaacgggguugugaagcuacugacgaagcccugggacgucauccccauggugacccagaucgcgaugaccgacacaacucccuucggucagcagcgcguguucaaggagaagguggacacacguacuccuaaggccaaacgagggaccgcacagauuauggaggugacggcucgguggcugugggguuuccucagccgcaacaagaagccccggauaugcacccgcgaggaguucaccaggaaggucagguccaacgcagcgaucggcgccgucuucguggaugaaaaucaguggaacagcgccaaagaagccguggaggacgagcgguucugggaccugguccacagggagcgggagcugcacaagcaggggaagugcgcaaccugcguguacaacaugaugggcaagcgcgagaagaagcucggagaguucggcaaggccaagggcucccgggcgaucugguacauguggcugggcgccagguuccuggaguucgaagcacucggcuucaugaacgaggaucacugguucucucgugaaaacagucugucugggguagagggcgaagggcugcacaagcuaggcuacauccugcgugauaucucaaagauccccgguggcaacauguacgcggacgacacggccgggugggacacccggaucaccgaggaugaccugcagaacgaggccaagauuaccgauauaauggagucagagcacgcccuccuugccaaguccaucuucaagcugacuuaccagaacaagguugugcgcguucaacgccccgcgaagaacgggaccgucauggacguaaucagccggcgcgaccagcggggcucuggccaaguuggcacguacggucucaacaccuucacgaacauggaggcgcagcugauccgccagauggagucagaggggaucuucucccccagugagcucgaaacgccaaaccucgccgagcgggcccuggacuggcuggagaagcacggcgucgaacgccucaagcggauggcgaucuccggggacgacugcgugguuaagcccaucgacgaucgcuuugcuacugccuuaaccgcucugaaugacaugggcaaaguccggaaagacauuccccagugggagcccagcaagggauggaaugacuggcagcaggucccguucuguagccaccacuuccaccagcucaucaugaaagacggucgcgaaaucguggugcccugcaggaaccaagacgaacuggugggccgcgcccgggugucccagggggcgggguggaguuugcgcgagacggcgugccucgggaagucauaugcccaaauguggcagcugauguacuuucaccggcgcgaucugcggcuggcggccaacgcuaucugcagcgccguucccguggacugggugccuacaagucgcaccaccuggagcauccacgcccaccaccaguggaugacaacagaggacaugcuguccgucuggaaucgcguguggaucgaggagaacccguggauggaggauaagacccacaucagcuccugggaggacguucccuaccuaggcaagcgcgaggaccaguggugcgguaguuugauuggccugaccgcccgcgccacgugggcaacgaauauacagguggccauuucccagguccggcgccuaaucggcaacgagaacuaccucgacuacaugaccagcaugaagagauucaaaaacgaaagugaccccgaaggugcuuugugguga

SEQ ID NO: 24769 - RNA, 9879 nt, Artificial Sequence
  derived and/or modified CDS sequence (opt11) from DENV-1__EU359008__SS-prME
uccgugacgaugcugcucaugcugaugcccaccgccuuagccuuccacuugaccaccagagguggggagccccacaugauugugagcaagcaagagagagguaagagccugcuguucaagaccuccgccggagugaacaugugcacccucauagccauggaccugggcgagcugugugaggacaccuugaccuacaagugcccacggauuacggaggccgagcccgacgauguggacugcuggugcaacgcaaccgauacuugggucaccuacgggacuuguagccagaccggcgagcaccgacgggacaagcggucgguggcccuggcgccccacgugggucuugggcucgaaacccgcaccgaaaccuggaugagcuccgagggugccuggaagcaaauccagcgggucgagaccugggcacuccgccaccccggguucaccgucaucgcucuguuucucgcgcacgcuaucgguacaaguaucacacagaaggggaucaucuucauccugcugaugcucgugacccccuccauggcuaugcggugcguuggcaucggcagccgagauuucguggagggguugagcggggcuacuuggguggacgucgugcuugagcauggaagcugcgucacuacaauggccaaggacaagcccacccuugacaucgaguugcugaagacggaagucaccaaccccgcggugcucagaaagcugugcaucgaggcgaaaaucuccaacaccacaacggauucucgcugcccgacccagggcgaagcuacccugguggaggagcaggaugccaacuuugugugccggcguaccuucguugaccggggcugggggaacggaugcgggcuuuucggcaagggcucccugauuacgugcgccaaguucaagugcgucacgaaguuggagggcaaaaucguccaauacgagaaccucaaguauagcguaaucgugaccguucacaccggcgaccagcaucagguugggaacgaguccacugagcacggcaccaccgcgaccaucacaccccaggcccccacaaccgaaauccagcugacugauuacggugcgcugacccucgacugcagcccuaggacuggccuggacuuuaacgaaaugguauugcucacaaugaaggagaaguccuggcugguucauaagcaaugguuuuuagaccucccccuucccuggaccagcggggcgucuacgacccaggagacguggaaccggcaggaucugcucgugacauucaagacagcccacgcgaaaaagcaggaaguaguggugcugggcucccaggagggugcgaugcauacggcccugaccggggccacagaaauccagaccucugguacgaccaccauauucgcagggcacuuaaagugucgccucaagauggacaagcugacacucaaaggcauguccuacguaaugugcacggguucguucaaacuugagaaagagguagcggagacccagcacgggaccguacuggugcagaucaaguacgaaggcaccgacgcccccugcaaaauccccuuccucacgcaggacgagaagggggucacccaaaacggccggcucaucaccgccaacccgaucgugaccgacaaggagaagcccgucaacaucgaggccgaaccgcccuucggcgagagcuacauaguaaucggugcuggcgaaaaggcucugaaacuuagcugguucaagaagggguccucgaucggaaagauguucgaggcgacggcccgcggggcccgccgcauggcgauccucggggauaccgccugggauuucgggaguaucggcggaguguucaccagcgucgggaaacuuguccaccagauauucggcacggcauacggggugcuauucuccggcguaagcuggacgaugaagaucggcaucggcgcccugcucacauggcugggcuuaaacucucgcagcacuucccugagcaugacaugcauagcgguggggcuugugacuuuguacuugggcgucauggugcaggcggacucggggugugugaucaacuggaagggccgggaacuuaagugcggaucugguauuuucgucacgaacgaaguucacaccuggacugaacaguacaaguuccaggccgacucaccgaagcgccucagcgccgccauuggaaaggccugggaggaggggguguguggcauccggagcgcgacccgccuggaaaacauuauguggaaacagaucaguaacgagcugaaccacaucuugcuggaaaacgacaugaaguucacgguaguggugggggauguggcgggcauacuugcccaaggcaaaaagaugauccggccccagcccauggaacacaaauacucguggaaguccuggggcaaggccaagaucauaggagcggauguccaaaacacuaccuucaucaucgacgggcccaacacgccugagugucccgacgaccagcgcgccuggaauauuugggagguagaggacuacggauuuggaaucuucacgacaaacauuuggcuaaaguugcgggauagcuauacccaggucugcgaccacagauugauguccgccgcuaucaaggacagcaaggcagugcaugcugacaugggcuacuggaucgaguccgagaagaacgaaacuuggaagcucgcgcgggcgagcuucauugaggugaagacgugcaucuggcccaagucccacacccuguggagcaacggggucuuggaguccgaaaugaucaucccuaagaucuacggagggccgaucagccaacacaacuaccgccccggauacuucacucagaccgcgggcccauggcaccucgggaagcuggaacuggacuucgaccuaugugagggcacgacuguggugguggacgagcacugcgguaaucgggggccgucccugcgcacuaccacugugacaggcaaaaucauucacgaauggugcugccgcagcugcacccuaccgccccuucguuuccgcggugaggauggaugcugguacgguauggagauucgcccugugaaggaaaaggaggagaaccuggucaaguccauggugagcgccggaucgggugagguagacagcuuuucccugggacuucuguguaucucuaucaugaucgaggaggucaugcggagccgcuggucucggaagaugcucaugacagguacucuagcgguguucuuucugcugaucaugggccaggugaccuggaaugaccucauucgccuuugcaucauggucggcgccaacgccagcgaccgcauggguaugggcaccaccuaccuggcccucauggccacguucaaaaugcggccgauguucgcggucggccugcuguuucgccgccucacgucgcgcgaggugcugcuccucaccaucgggcugucccugguugcuuccguagaauuaccgaacagccuagaggagcugggugacgggcucgcaaugggcauuaugauccugaaacugcucacugauuuucagucgcaccagcuaugggccacacuacucagccugaccuucaucaagaccacguuuucccuacacuacgcguggaagacgauggccauggucuuguccaucgugucccuuuucccccuuugucucucuaccaccucccagaagaccacauggcugcccguccuguuagggagcuuagggugcaaaccgcugaccauguuucucaucgccgagaacaagaucuggggcagaaagucuuggccucuaaacgaggggauaauggcggucggcaucguaagcauccugcucucgagcuuacugaagaacgacgugccccucgccgggccccugaucgccggcggcaugcugaucgccugcuacgucaucagcggguccagcgcggaccucucccuagagaaggcugccgagguuagcugggaagaggaggcggagcauuccggggccagccacaacauccuaguagagguucaggacgauggcaccaugaaaauuaaggacgaggaacgagacgacacccucacgauccugcugaaggccacuuugcuggccgugagcgguguguacccccugucgauccccgccacccuguucgucugguacuucuggcagaagaagaagcagcggucugggguccugugggauacuccaagcccgccggaaguagagcgcgcgguccuugacgacggcaucuaccggaucaugcagcgcggccugcucggacggucacaggugggcguagguguguuccaggagaauguauuucacaccauguggcaugugacccgcggcgccguccugauguaccaagggaaaaggcuggagcccagcugggccuccgucaagaaggaccucaucagcuauggaggcggguggcgccuucagggcucauggaacaccggggaggagguacaggugaucgccguggagcccggaaagaacccgaagaacgugcagaccgcacccgggacuuucaagacgccggagggugaggucggcgcaaucgcucuggacuuuaaacccgggaccagcggcagucccauugugaauagagagggaaagaucgugggacucuacggcaacggggucgugaccacgagcggcacauacguguccgcgaucgcccaggcgaaggcaucacaggaaggaccgcugcccgagaucgaggacgaggucuuccgcaagcggaaccugaccaucauggaccuccaccccggaagcgggaagacgcgccgguaccuuccagccaucgugcgcgaagcaaucaagcggaaacugcgcacccucauucuggcccccacgcgcguggucgcguccgagauggcugaggcacugaagggaaugcccauucgcuaccagaccacagccguuaagagcgagcacaccggcaaggaaaucguggaucucaugugccacgccacuuucaccaugcgccugcugucccccgugcgagugccgaauuacaauaugaucauaauggacgaggcgcauuucaccgaccccuccuccauagccgcccgcggguauaucagcacacgggugggcaugggggaggccgcagcgaucuucaugacggccacuccacccggcuccgucgaggcuuucccccagagcaacgcggcgauacaggacgaggaacgcgacauccccgagcgguccuggaacagcggguacgaguggauaacugauuuccccggcaaaaccgugugguucgugccuuccaucaagagcggcaacgacaucgccaacugccugcgcaagaaugggaagcggguaauccaacugucccgaaagacuuucgacaccgaauaccaaaagacuaagaacaacgauugggacuacguagugaccacggacaucucugaaaugggcgccaacuuccgggccgaccgugucaucgacccgcggcgaugccugaagccagucauccuaaaggacgggccugaacgggucauccuggccggcccuaugccggucacgguggcauccgccgcccagcgccgggggcgcaucggccggaaccacaacaaggagggcgaccaguacaucuacauggggcagccccugaauaacgacgaagaccacgcccauuggaccgaggccaagauguuacuggauaacaucaacaccccugaagggauaauucccgcgcuguuugagccggagcgcgagaagucagccgccauagacggcgaauacaggcuucggggcgaggcccgcaaaacguucguugagcuuaugcggcguggggaccuaccgguuuggcucuccuacaaggucgcgucugagggcuuccaguacuccgaccggagguggugcuucgacggugagcggaacaaccagguccuugaggagaacauggacguugaaaucuggacaaaagagggcgagcgcaagaaacugcguccccgcuggcucgaugcaaggaccuacagcgacccgcuagcccugcgcgaguuuaaggaguucgccgccggcagaaggagcgugucgggugaccucauccuggaaaucgguaaguuaccgcagcaccuuacgcagcgggcucagaacgcucuggacaaccucgucauguuacauaacagcgagcagggcgguagggccuaucggcacgccauggaggaauuaccugacacaaucgagacgcugauguuacuggcccugauugcggugcucaccggugggguuaccuuguucuuccuguccggccgcggccucggcaagaccuccauuggccuccuaugugucauggccucaucaguacuccucuggauggccuccguggagccgcacuggaucgcugccagcaucauccuggaguucuucuugaugguauuacugauccccgagccagaccggcagcgcacgccccaagacaaccagcucgcguauguagugauuggguugcuguucaugauacucaccgucgccgcgaaugaaaugggccugcuggaaaccacuaaaaaggaccuugguaucggacacguggccguggaaaaccaucaccacgcggcaaugcucgacgucgaccugcaccccgcauccgccuggacgcucuacgccguggcaaccaccaucaucacuccgaugaugagacacacaaucgagaauaccaccgcgaacaucagcuuaacggccaucgcaaaucaagccgcgauccucaugggacuagacaagggauggcccaucuccaaaauggacaucggcgugcccuuauuggcauuagggugcuacucgcaagucaacccccugacgcugaccgccgccguacucaugcugguggcccacuaugcuaucauugguccggggcuacaggccaaggccacccgggaagcccagaagcguaccgccgcgggcauaaugaagaaccccacggucgacgguauuguggcaaucgaccucgaccccgucguuuacgacgcuaaguucgagaagcaguugggccagaucaugcugcucauccugugcaccucccagauacugcucaugcgcacuacaugggcccugugcgagagcaucacucuggccaccggcccccuuacgacccugugggagggaagcccgggcaaauucuggaacacgaccaucgcggucuccauggcaaauauuuuccgcggguccuaccuggcgggcgcuggacucgcguuuucuuugaugaagucccucgggggagggcggcgcgggaccggggcacaaggcgagacacucggagagaaguggaagcggcagcuuaaccagcugucaaagucagaguucaacaccuacaagcgcuccggaaucauggagguggaccggucagaggccaaggagggcuuaaagcgcggggagaccaccaaacaugccgucagccggggcaccgccaagcuccgcugguucguugagcggaaucugguuaagccagaggggaaggucaucgaccuaggcugcggccggggcggguggagcuacuauugcgcgggccucaagaagguuacggaggugaagggguacacgaaaggcggcccaggccacgaggagccaaucccgauggcgacuuacggguggaaccugguaaagcugcauuccgggaaggacguguucuucaucccgccugagaagugcgacacccuauuaugcgauaucggggagagcucccccaacccgaccaucgaggagggccggacgcugcgcguacucaagaugguugagcccuggcugcgcgggaaccaguucugcaucaagaucuugaaccccuacaugcccagcgucguagagacccucgagcagaugcagcgcaagcacggcgguaugcugguucggaacccguugucucgcaacucgacccacgaaauguauugggugucguguggcaccggcaacauugucagugcggucaacaugacgucccggaugcuccugaacagguucaccauggcccaccgcaagcccacuuacgagagagacguggaccucggcgccggcacuaggcacguggcggucgagcccgaaguggccaaccuagacaucaucggacagcggaucgagaacauuaaacacgagcacaagucuacguggcacuacgaugaggauaaucccuacaaaaccugggcauaucacggcucguaugaggugaagccgaguggcucugccucgucuauggucaacggggucgucaagcugcugacgaagccuugggacguuauccccauggugacccagaucgccaugacugacaccacccccuucggccaacaaagaguauuuaaggagaagguggacacgcggacgccgaaagcgaagcgcgggaccgcgcagauuauggaggugacagcacgcuggcucuggggcuuucuaagccgcaacaaaaagccccggaucuguacccgagaggaguucacgcgaaagguccgcucaaacgccgcgaucggggccguguucguggacgagaaccaguggaacuccgccaaggaagccguagaggacgagcgcuuuugggaccuugugcaccgugaacgagagcuccacaagcaggggaagugcgcaaccuguguguacaacaugaugggcaagcgcgaaaagaaacuuggggaguucggcaaggcgaagggcagccgggccaucugguacauguggcuuggcgcccgcuucuuagaguuugaagcccucggcuuuaugaaugaggaccacugguucagcagggaaaauagccuguccggagucgagggcgagggacuccacaaacugggcuacauccugcgcgacaucagcaagauccccggaggcaacauguaugccgacgacacagcgggcugggacacccgaaucacggaggacgaccugcagaaugaggccaagaucacagauaucauggagccggagcacgcccuauuagccaaggccaucuucaagcucaccuaccagaacaagguuguccgcguccaacgcccggcgaaaaaugggacagugauggaugugaucagccggcgagaccagcgaggcagcggucaagucggcacguauggccuuaacaccuucaccaauauggaggcgcaacugauacgccaaauggaguccgaggggaucuuuagcccauccgagcuugagacccccaaccuggccgagcgggugcuggacuggcuagagaaguacgggguugagcgccugaagcggauggccauuagcggggacgacugcgucguuaagccaaucgacgaccgguucgccacggcucuuacugccuuaaacgacaugggaaaaguccgaaaggacaucccccagugggagcccuccaagggguggaacgacuggcagcaaguccccuuuugcucacaccauuuucaccagcuaaucaugaaggacggccgcgagaucgugguaccgugucggaaccaggacgagcuagucgggcgagccagaguuucccagggugccggcuggagccuccgcgaaacagcgugucuggggaagucauacgcucagauguggcagcugauguacuuccaucgccgagaccuacggcuggcugccaacgccauauguagcgcgguucccgucgacuggguacccaccagccggacaacauggucaauccacgcccaccaccaguggaugaccaccgaagacaugcugagcguguggaacagagucuggaucgaggaaaacccuuggauggaggacaagacgcauaucuccucaugggaggacgugccauaccucggcaagcgcgaggaccaguggugcggaucccugaucggccugacugcccgcgccacgugggcaaccaauauucaggucgcgaucaaucagguccggcgccuaauuggcaacgagaacuaucuggacuacaugaccagcaugaagcgguucaagaacgaauccgaucccgagggggcuuugugguga

SEQ ID NO: 24770 - RNA, 9879 nt, Artificial Sequence
  derived and/or modified CDS sequence (opt11) from DENV-1__AY835999__SS-prME
agcguaaccaugcugcugaugcucaugcccaccgcccuggccuuccaucugaccacgcggggcggggaaccccacaugaucgugucaaaacaagagcggggcaagucccuguuguuuaagacgagcgcgggggugaacaugugcacccucaucgcuauggaccuaggggagcucugcgaagauaccaugacuuacaagugcccccggaucaccgaggccgagccugacgacguggauugcuggugcaacgcuaccgacaccugggucaccuacgguaccugcagccagaccggcgagcaccggcgcgacaagcgcuccguggcucucgcgccccacgugggucugggacuggagacgcggaccgagacuuggaugagcucagagggcgccuggaaacaaauccagcgggucgagacuugggcgcuccgccacccgggguucacggugaucgcccuauuccuggcgcaugcgaucggcaccagcaucacucagaaggggauaaucuucauacucuugaugcuuguaacccccuccauggccaugcggugugucgguaucggcucucgcgacuucguggaggggcucuccggagccacguggguugacgucgugcuggagcacgguagcuguguaaccacgauggccaaggacaagcccacccuggacauagaacuccugaagacggaggucacuaaucccgcggucuuacgaaaacuaugcaucgaggccaagauaucgaacaccaccacggacagccggugcccgacccagggcgaggccacccucguggaggagcaggaugccaacuucgucugccggcgaaccuucguugaccggggcugggguaacggcugcggguuauucggcaaggggagucugcugacgugcgcaaaguucaaguguguaaccaaguuggagggcaagaucguacaguacgagaaccucaaguauagcgugauagugaccguccacaccggugaccagcaccaaguagggaacgaguccaccgagcacggcacaaccgcgaccauaacgccccaggcccccacgaccgagauccagcugaccgacuacggggcgcugacauuagauugcagcccccguacgggucuggauuucaacgagaugguccugcuuaccaugaaagagaagaguuggcuugugcauaagcagugguuccuggaccuccccuugcccuggacgucaggcgcgucgacaucacaggaaacguggaaccggcaggaucugcucguaaccuuuaagaccgcccacgccaagaagcaggagguugugguguuaggcagccaggagggcgccaugcacacugcccuuacuggggccacagagauccagacuucuggcaccacgacaauuuuugccgggcaccucaagugccgccugaagauggacaaacugacccucaaaggcaugagcuacgugaugugcaccggauccuucaagcuagagaaggaaguggcggagacgcagcacggcaccgugcugguccaaaucaaguacgaggguaccgacgcccccugcaagaucccguuccugacucaggaugagaagggggugacucagaacgguagguugaucacggcgaacccgauaguaacugacaaagagaagccagucaacauagaggccgaaccacccuucggagaaagcuacauugugaucggcgcgggugagaaagcgcugaagcuauccugguuuaagaaggggagcuccaucggcaagauguucgaggccacagcccgcggggcccggcgcauggcgauacuuggagacacggccugggauuuuggcagcgugggcggcgucuucaccucagugggcaagcugguucaccagaucuucggcaccgccuacggcguacuguucagcggcguauccuggaccaugaagcuggggaucggggugcugcugacguggcugggccugaacagccgcuccaccucccuguccaugacaugcaucgccguugggcucgucacucuguaccuaggcgugaugguccaggccgauucggggugcgugauuaacuggaagggccgggagcucaagugcggcuccggaaucuucgugacgaaugaagugcacaccuggaccgagcaguacaaauuccaggcggacagcccgaaaaggcugagcgccgccaucgguaaggccugggaggagggggugugcggcauccgauccgccacccgccuggagaacauuauguggaaacagauuagcaacgaacucaaccacauacugcuggagaaugacaugaaauucacuguggucgucggggacguggcgggcauccucguccaggggaagaagaugauucggccccagcccauggaguauaaguacuccuggaaauccuggggcaaggccaagaucaucggcgccgacgugcagaacuccacguucaucaucgacgggccuaacaccccugagugucccgacgaucagcgcgcuuggaauaucugggagguugaagacuacggauucgggauuuucaccaccaacaucuggcugaaguugcgggacagcuacacgcaagucugugaucaccgacucauguccgcggccaucaaggacucgaaggccgugcacgccgacaugggcuacuggauagaauccgagaagaacgagaccuggaagcuggcccgugccagcuucaucgaggugaagaccuguaucuggcccaagagccacacccuguggagcaacggcguccucgagagugagaugauuauucccaagaucuacgggggucccauaagccaacacaacuaccgccccggguacuuuacgcagacugccggucccuggcaccuggggaagcuggagcuagacuucgaccucugugaggguaccaccguggucguugacgagcacugcggaaacagggggccgucccugcgcacaaccaccguaacgggcaagauuauccacgaguggugcugccggagcugcacccugccgccccugcgcuuuagaggggaaaacgggugcugguacggaauggagauucgccccgugaaagagaaggaggagaaccugguaaaguccauggugagugccggcucuggcgaaguggauuccuucagccucgggcuccugugcaucuccauaaugauagaagaggucaugcguaguagguggucccggaagaugcucaugaccggcauucuggccguguucuuccuucucaucaugggucagcugaccuggaaugaccugauccgacucugcauuaugguuggcgccaacgccagcgacaggauggggaugggcaccacguaccuugcccugauggcgacguucaagaugcggccgauguucgccguaggacuucuguuccgccgucugaccucccgugagguccuccuacugacgaucgggcucagccuggucgccuccguggagcugccaaauagccucgaagaacugggcgacgggcuggcgaugggcauaaugaucuuaaagcuacuaacggacuuccagucucaccagcucugggccacucuucugagccucaccuucaucaagaccacguucagcuuacacuacgccuggaagaccauggccauggugcugucgauuguuucacucuucccccugugccugagcaccaccucccagaaaaccaccuggcugcccgugcuuuugggcagccuuggaugcaagccgcuaacuauguuccugaucgccgagaacaagaucuggggucgaaaauccuggccccugaaugaggggaucauggcgguggguaucguauccauccuguuaucaucccuccucaagaacgaugugccccuagccggcccgcucaucgccggcggcaugcucauugccuguuacgugauuagcgguucuagcgcggaccugucccucgagaaggcagccgaggugagcugggaggaggaggccgagcacuccggagcaagccacaauauccugguggaggugcaggacgauggcaccaugaagaucaaggaugaggagcgcgacgacacgcuaaccauccuccugaaggcgacccugcucgcaguauccggaguguacccgcuuucgauucccgcaacacuguucgugugguacuucuggcagaagaagaaacagcgguccgggguccuuugggauacccccagcccgcccgaaguggagcgcgcagugcucgacgacgggaucuaccgcaucaugcaacguggucugcuggggcguucccaggucggcguggggguguuucaggagaacgucuuccacacaauguggcauguaacccgcggcgcggugcucauguaccagggaaagagacuggagcccucaugggcguccgucaagaaagaucugaucucuuacggcggcggguggcgccuacagggcuccuggaauaccggggaagaaguccaggugauugcggucgagcccggcaaaaaccccaagaacguccagaccgcccccggcacuuucaagacucccgagggcgaaguaggcgcaaucgccuuagacuucaagcccgggaccagcggcucacccaucgucaaccgggaggggaagaucgugggccuuuacggcaaugggguaguuaccacaagcggcacauacgugagcgcgauagcccagaccaaggccucgcaggaggggccgcucccugagaucgaagacgagguguuccgcaagcggaaccugaccauuauggaccugcaccccggcagcgggaagacgcgcagauaccucccggccaucguucgcgaggcgaucaagcggaagcugcgcacccugauucucgcuccgacccgggugguggcuucggagauggcggaagccuuaaagggcaugccaauucguuaccagaccacggcgguuaagagcgagcacacuggcaaggagauuguggaccucaugugccaugccaccuucacgaugagacuccugucacccgugcggguaccgaacuacaacaugauaaucauggacgaagcccacuuuacggaccccagcucgaucgcugcccgaggauacauaagcacccgggugggcaugggagaggcggccgccauuuucaugaccgccacaccgcccggcuccauggaggccuucccgcagagcaacgcggugauccaggacgaggagcgcgacauucccgagagaagcuggaacagcggguacgaguggauuacggauuuccccggcaagaccgucugguucgugcccuccaucaaggccggcaacgauaucgcgaacugccugcgcaagaacgggaagagagugauccaguuaagcaggaagaccuucgauaccgaguaucagaagacgaaaaacaacgauugggacuacguugugacuaccgacaucucggagaugggagcuaacuucagggcggaccggguuaucgauccgcggcgcugcuugaagcccgucauacugaaggacgguccugagcgugugaucuuagcgggccccaugccggucaccguagcgagcgccgcccagcggcgggggcgcaucggccgaaaccacaacaaagagggcgaucaauacaucuacauggggcagccuuuaaacaacgacgaggaucacgcgcacuggacggaggccaagaugcugcucgauaacaucaacacacccgagggcaucauccccgcccuguucgagccggagcgcgagaaguccgccgccauagacggggaguaccgacuccggggcgaggcgcgcaagacguucguggaacucaugcggcgcggggaccugcccgucuggcucagcuacaaaguggcauccgagggcuuccaguacagcgaucggcgcuggugcuucgauggcgagcggaacaaccaggugcucgaggagaacauggacguggaaaucuggaccaaggagggggagcguaagaagcugcgcccacgcuggcuggacgcccggacguacagcgacccccuggcucuaagagaguucaaggaguucgccgcaggcagacgcuccguuagcggggaucuuauccucgagaucggcaagcugccacagcaccugacccagcgagcucaaaacgcccucgauaaccugguaaugcugcacaacuccgagcagggugggcgcgccuaucggcacgcgauggaggagcuccccgacacuaucgagacccugaugcugcuugcccucaucgcgguccugacgggcggggugacgcucuuuuuccugagcggcaagggauugggcaaaaccuccaucggccuccugugcgugauggccucguccguccuucucuggauggccucgguggaaccgcauuggaucgcggcauccauuauuuuagaguucuuuuugauggugcuccuuauucccgaaccggaucgccagcggacaccccaggacaaucagcuggccuacgucgugaucggguugcuuuuuaugauccugaccguagccgccaaugagaugggccuccuugagacgacuaagaaggaccuggggaucggccacgucgcgguggaaaaccaccaccacgcugccaugcucgaugucgaccugcacccggcuagcgccuggaccuuauaugcugucgccaccacgaucaucaccccgaugaugcgccacaccaucgagaauaccacggccaacauuucccugacagccauagccaaucaagcggcaauccucaugggguuagacaagggcuggcccaucagcaaaauggacaucggagugccgcuccuggcucuggggugcuacucccaggugaauccccucacccugacagccgcgcugcucaugcuggucgcccacuaugccaucaucgguccggggcuacaggcgaaggccacacgcgaggcgcagaagcgcaccgccgccgggauuaugaagaaccccaccaucgacggaauuguggcaauugaccucgacccggugguguacgacgccaaguucgaaaagcaacugggccagaucaugcugcucauucuguguaccagccagauccuguugaugcgcacgacaugggcgcugugcgagucgaucacccuggccaccggaccccucacaacucugugggaagggucuccgggcaaguucuggaacaccacgaucgccgucuccauggcaaauaucuuccgggggagcuacuuagccggagcgggccucgccuucucgcugaugaaaucccucgggggaggccgccgugguaccggcgcccagggcgagaccuuaggcgagaaguggaagcggcaguuaaaccagcugagcaagagugaguucaacaccuauaagcggucaggaauaauggagguggaccggagugaagcaaaggaagggcuaaagcgcggugaaaccacgaagcaugcggucagccgcggcaccgccaaacuccggugguucguggagcgcaaccuggugaaaccugaggggaaggucaucgaccuggguugcggccgcggaggcuggucguauuacugcgccggccucaaaaaggugaccgaaguaaagggguacaccaaaggcggucccggccacgaggagcccaucccgauggcuacguacggauggaacuuagucaaacuucacagcgggaaagacguguucuucaucccgcccgagaaaugcgacacccuccugugcgacauuggggaguccagccccaauccgaccauugaggagggacgcacccugcgggugcucaagaugguugagccuuggcugcgcgggaaccaauuuugcaucaagauucugaaccccuacaugcccuccgugguggagacucucgagcagaugcagcgcaagcacggcggcaugcuggugcgcaacccgcugucacggaacuccacccacgagauguacugggugucgugcggcaccgggaacaucguguccgccgucaacaugaccagccgcauguuacuuaacagauucacuauggcgcaccgcaagcccacuuacgagagggacguugaccugggggccggcacacggcacguggcagucgagccagagguggcuaaccucgacaucauaggccaacgcaucgagaacauaaagcacgagcacaaguccaccuggcacuacgacgaggauaacccuuacaagaccugggccuaccaugggagcuacgaagugaagccuuccggcagugccuccucgauggugaacgggguggucaaacugcugacaaagccaugggacgucauaccaaugguaacacagaucgccaugaccgauacgacgcccuucggccagcagcgggucuucaaggagaaaguagacacgcgcacccccaaggccaagcgggggacugcgcaaaucauggaggugacugcuagguggcuguggggguuccugagccggaacaagaagccccgcaucugcacccgggaggaguucacacgcaaaguacgguccaacgccgcuauaggagccguguucguugacgaaaaccaguggaauagcgccaaggaagcgguggaggaugaccgguucugggaucugguucaccgggagcgcgaauugcacaagcaagggaaaugcgcuacgugcguguacaacaugaugggcaagagagagaagaaauuaggggaguucgguaaagccaaggggucccgagcaaucugguacauguggcugggcgcucgcuuccucgaguucgaagcacuuggcuucaugaacgaggaccacugguucagccgcgaaaacucgcuaagcggggucgagggcgaggggcuacacaagcuaggguauauccugcgggacaucuccaaaauccccggggguaacauguaugccgacgacacggccggaugggacaccaggaucaccgaggacgaccuccagaacgaggccaaaaucaccgacaucauggagccggagcaugcccagcuggcaaagagcaucuuuaagcugacguaucagaacaagguggugcggguccagcgcccagccaagaacgggaccgugauggacgugauaucccgccgggaccagcgcggaagcgggcaggucgguaccuacggccucaacaccuucacgaauauggaggcccaacugauucgccaaauggaguccgaagggaucuucagccccaacgagcuggaaacacccaaccucgccgagcgagugcuugauuggcucgagaaauacggcgucgagcgccucaagaggauggcgaucuccggggacgacugcguaguuaagcccaucgacgaccgguucgcgaccgcgcuaacggcccuuaacgacaugggaaaagugcgcaaggacaucccccagugggagcccagcaagggguggaaugacuggcaacagguccccuucugcucccaccacuuccaccagcucaucaugaaggauggccgggagaucguggugccuugccgcaaccaggaugagcugguuggccgcgcccgugugagucagggagcuggcuggucccuacgggagacggcuugucucggcaagagcuaugcccagauguggcagcugauguauuuccacaggagggaccugcgccucgccgccaacgcgauaugcagcgccgugcccguggauugggucccuacuucccggaccaccuggagcauacacgcccaucaccaauggaugacgaccgaggacaugcugagcgucuggaaccgcguguggauugaggagaacccguggauggaggacaaaacgcgaaucucguccugggaggaugugccguaccuggggaagcgcgaggaccaguggugcggaagccucaucggccugacggccagagcuacgugggcgaccaacauccagguggccaucaaccagguccggagacuuaucgggaacgagaauuauuccgacuacaugacuagcaugaagcgguucaagaacgaguccgaacccgagggggcgcuuugguga

SEQ ID NO: 24771 - RNA, 9879 nt, Artificial Sequence
  derived and/or modified CDS sequence (opt11) from DENV-1__KP686070__SS-prME
agcgugaccaugcugcucaugcucuugcccacagcccuagccuuccaccugaccacucggggcggggagccccacaugauagugaguaagcaggaacggggcaagagccuccuguuuaaaacgagugcgggaguuaacaugugcacccugauugccauggaccugggugaguugugcgaagauacgaugaccuacaagugcccgcggaucacugaagccgagccggacgauguggauugcuggugcaacgccaccgacaccugggugaccuacgggaccugcagccagaccggcgaacaucggcgcgauaagcggagcguugcucuggccccccacgucggccuugggcuagagacccgcaccgagacuuggaugagcuccgagggcgcguggcggcagauccagaagguggagaccugggcgcugcggcacccgggguuuacggugaucgcccuguuccucgcgcacgccaucggcacuagcaucacccagaaagguaucaucuucauucuacugauguuggugaccccauccauggccaugcggugugucgggaucgggaaucgcgauuucguggaaggguugucuggagcgaccuggguggacgucguguuggagcacggguccugcgugacaacaauggccaaaaacaagcccacccucgacauagagcugcugaagacagagguuaccaaccccgcggugcuccggaagcuaugcaucgaggcgaagaucagcaacaccaccacagacucccgcugucccacccagggcgaagcgacccucguagaagagcaagacgccaauuucgucugccggcgcacauucguggaccggggcugggggaacggcugcggccucuucggcaaggggagccugcugacgugugccaaguucaagugcguaaccaagcucgagggcaagauuguccaguacgaaaaccugaaguacuccgugaucgugaccguccacaccggagaccagcaccagguagggaacgagacgaccgagcacggcaccaucgcgacuauuacuccccaggcuccgacgagcgagauccagcugaccgacuacggugcucucacccuggacugcagcccgcggaccggucucgacuucaaugagaugguacuccugacaaugaaggagaaguccuggcugguccacaagcagugguuccucgaccuuccgcuucccuggacauccggggcguccacaucucaagagaccuggaaccgucaggaccuccuggugacguucaaaaccgcccaugcgaagaagcaggaggucgugguacugggcucccaggaaggcgccaugcacaccgcccucaccggggccacggaaauccagaccucuggcaccacuacgaucuucgcugggcaccugaagugccgucugaagauggacaaacucacgcugaagggcgugucuuaugugaugugcaccgggagcuucaaacuggagaaggaaguggcggagacccagcacggcacuguacuugugcaggugaaguacgagggcacggacgcaccuugcaagauccccaucuccacacaggaugagaagggcgucacccagaauggacggcucaucacggccaacccaaucgugacggauaaggagaagcccgugaacaucgagaccgagccgccguucggggagagcuacauugucaucggcgcaggcgagaaggcgcugaagcugucaugguucaagaaggggagcuccaucggcaagauguucgaggccacagccaggggugcucggcgcauggccauccucggcgacacugcgugggacuucgggucaauuggcgguguguucacauccguggggaagcugguccaccagguguucggcaccgcguauggggugcuguuuagcggcguguccuggaccaugaagaucgggaucggcauccuccugacguggcugggccucaauagccgcagcaccagccuguccaugaccuguaucgccguggggaugguaacccuauaccucggcguuauggugcaagccgauagcgggugcgugauaaauuggaaggggcgggaacugaagugcggguccgggauauucguaacgaacgaggugcacaccuggaccgagcaguacaaguuccaggccgacaguccaaagcgcuugagcgcggcgaucggcaaagccugggaagaaggugugugcggcaucagguccgcgacuagacuugagaacaucauguggaagcagaucagcaacgagcugaaccauauucugcucgagaacgauaugaaauucaccguuguggucggugacgccaacgggaucuugacgcaggguaagaaaaugauccggccccagcccauggagcacaaguacuccuggaagucguggggcaaggcgaagaucauaggcgcugacacucagaacacuaccuucauuaucgauggucccgacacgcccgagugccccgacgaucagcgcgcauggaacaucugggaggucgaagacuacggcuucgggguguucaccacgaacaucugguugaaauugcgggacaguuauacccagaugugcgaucaccgccucaugagcgcugcgauaaaggacuccaaggccgugcacgccgacaugggauacuggaucgagagcgagaaaaacgaaaccuggaagcuagcccgggccuccuuuauagagguuaagaccugcaucuggccccgcagccacacccucugguccaacggcgugcuggaaagcgagaugaucauacccaagaucuacggaggcccgaucagccagcauaacuaccggccaggguauuucacccagacggcggggcccuggcaucuggggaagcucgaguuagacuucaaccuuugcgaaggcaccaccgugguaguggacgaacacugcggcaaccgcgggcccucacuccgcacuaccaccgugaccggcaagauaauccacgaguggugcugccgaucauguacccuaccgccccuucgguuccgcggggaggacggcugcugguacgggauggagauccgucccguaaaggagaaggaggagaacuuggugcgcagcaugguguccgccggaagcggagagguugacagcuucuccuuggguuuacucugcgugagcaucaugauagaggaggugaugaggagccgcuggucacgcaagaugcugaugacgggcacccuggccgucuucuuccuucugaucauggggcagcuaaccuggaacgaccucauccggcuuuguaucaugguuggcgcuaacgucagcgaccgcauggggaugggcaccacguaccuggcccucauggcgacauucaagaugcggccuauguucgccguuggucugcuguucaggcggcuuacaucaagggagguccuccugcucacgauugggcucucucuggucgccucgguggaacucccaaauagucuugaggagcuuggcgacgggcucgccaugggcauaaugaugcugaagcugcucacggauuuccagucucaccagcuguggacuacccugcucucgcugaccuucauaaagacgacccugucgcuagacuacgccuggaaaaccauggcgauggugcuaucgaucgucagccuguucccccucugcuuguccacuacgagccagaagacgaccuggcugccggugcuccugggcuccuuugguugcaagccgcugacgauguuucucaucaccgaaaacaagaucuggggccgcaagagcuggccgcugaacgaaggcauaauggccgugggcaucguuucgauccugcugucaagccuccugaaaaacgacgugccccucgcgggaccccuuaucgccggcggcaugcugaucgcgugcuacgugaucagugggagcagugcugaccugagccuggagcgcgcagccgaggucuccugggaggaagaagccgaacauagcggcgcuucccacaacauccucguggaggugcaggacgacgggacgaugaagaucaaggacgaggagcgggacgacacccucacaauccugcugaaggcaacucuccuggccgugagcgggguguacccgauguccauccccgccacucuauuuguuugguacuuuuggcagaaaaagaaacagcgcagcggcguccugugggacaccccaaguccccccgagguggagcgggccgugcuggacgacggaaucuaucgcauucugcagcggggucugcuugggagaagccagguuggcguggggguguuucaagacggagucuuucacaccauguggcacgugacccgcggggcgguucuaauguaccaagggaagcgccuggaaccauccugggccagugucaagaaggacuuaaucuccuacggcgggggcuggagauuccagggguccuggaacacgggcgaggagguccagguaaucgcugucgagcccgggaaaaaccccaagaacguacagacgacacccggcaccuuuaagacgcccgaaggcgaggugggugcaaucgcccuggacuucaagcccggcaccuccgggagucccaucgucaaucgcgagggcaagaucgugggccucuacgggaacggcguggucaccaccagugggacguauguaagcgcgaucgcccaggcuaaggccagccaagagggcccgcuccccgagaucgaagacgaaguguucaagaagcggaaucugaccaucauggaccugcauccuggguccgggaagacacgccgcuaucuccccgcuaucguccgcgaagcaaucaagcgcaagcugcgaacccuuauccuagccccaaccagagugguggcaagcgagauggccgaggcgcugaagggcaugcccauacgguaccagacuaccgccgucaaauccgagcacaccgggaaagagaucguggaccugaugugucaugccacuuuuaccaugcgccugcugagcccgguacgggucccgaauuacaacaugauaaucauggaugaagcgcacuucacugaccccgccuccaucgcggcccgcggguacauuaguacccggguggggaugggcgaggcugccgcgaucuucaugacggcgacgccgccgggguccguggaggccuucccacagagcaacgccgucauccaggaugaggagcgcgauaucccggagcgguccuggaacuccggcuacgacuggauuaccgauuuccccggcaagaccgugugguucgugcccuccauaaaaagcgggaacgacaucgccaauugccugcgcaaaaacggcaagcgggucauccaguugucccgcaagacguucgacaccgaguaccagaagaccaagaacaacgacugggacuacguggugaccacugacaucucggagaugggggcgaacuuccgggcggaccgcgucaucgacccacggcgcugccugaagcccguuauccugaaggacggccccgagagagucauccucgcaggucccaugccggugaccgccgccuccgccgcccagcgccggggccgcaucggccggaaucagaauaaggagggggaccaauacaucuacaugggccagccccugaacaacgacgaggaccaugcacacuggaccgaggcuaaaauguuacucgauaacaucaacacccccgaggggaucauccccgcccuauuugagccggagcgggagaaauccgcagcgaucgacggggaguaccgccugcgcggggaggcccgcaaaacguucguggagcucaugcggcgcggcgaccugcccgucuggcuguccuacaagguggcaagcgagggauuccaguacuccgaucggagaugguguuuugacggugagcggaacaaccaggugcucgaggagaacauggacgucgagaucuggaccaaggagggcgagcgcaagaagcugcggccgcgcuggcuggacgcccgcaccuacagugacccgcuugcgcugcgcgaguucaaagaauucgccgccggaaggcgcagcguguccggcgacuuaauccucgagaucggcaagcuuccacagcacuuaacacuccgggcccagaaugcccuggacaaucugguaaugcuucacaacagcgagcaaggcgggaaggcauaucgccacgcgauggaagaacugcccgacacaaucgaaacgcugaugcuccuggccuuaauagccguccugaccgggggcgugacucuguucuuccucuccgggaaaggccucggcaagaccagcauaggacuguuaugcgucauggcguccucuguccuccuauggauggcauccguggagccccacuggauagccgccagcaucauacuggaguucuuucucaugguucugcugauccccgagccggaccggcagagaacuccccaggacaaccagcuagccuacgucguaaucggcuugcuguucaugauacucaccgucgcggcaaacgagauggggcugcuggagacaaccaaaaaagauuuaggcaucggucacgucguggcggaaaaucaccaucacgcgacgaugcuggacaucgaucugcacccugccuccgccuggacccucuacgccguggcaaccacuaucaucacgccgaugaugcggcacaccaucgagaacacaacggccaacaucagccucaccgccaucgcaaaccaggcagccauccugaugggacucgauaagggcuggcccaucuccaagauggacaucggggucccccugcuggcacucggcugcuacagccaggugaacccccuaacccugaccgccgcgguguccauguuagucgcccauuacgccaucauagggccgggacugcaggccaaggcgacccgcgaggcccagaagcgcacggccgccgggauuaugaagaaccccacaguggacggcaucguggcaaucgaccuggacccggucguauacgaugcuaaguucgagaagcaguugggccagauuaugcugcugaucuugugcaccucacaaauccugcuaaugcggaccaccugggcucucugcgaguccaucacacuggccaccgggccucugacaacgcucugggagggaucgccggggaaauucuggaacaccaccaucgccgugucgauggccaacaucuuccgcggcagcuaccuggcgggcgccggguuggcuuuuucccucaugaagucccugggcggcggccggcgcggaaccggcgcccagggcgaaacgcugggggagaaauggaagcggcagcucaaucaauuaagcaaaagugaauuuaauacauacaagcgcagcgguaucauggaggucgaccgguccgaggccaaggaggggcuuaagaggggcgagaccaccaagcaugcggucagucgggggacggccaagcugcgcugguucguagagagaaacuuaguuaaacccgagggcaagguaaucgaccugggcugcggacggggcgggugguccuacuacugcgccggccugaagaaaguuaccgaggucaagggguacacaaagggcggcccggggcaugaggaacccaucccgauggccaccuacggcuggaacauaguaaagcuccacagcgggcgggacguguuuuucacgccgcccgagaagugcgacacguugcugugugauaucggggaguccagccccaacccgacaaucgaggaagggcgcacucuccggguacuuaagaugguugagcccuggcugcgcggcaaccaguucugcaucaagauccucaaucccuacaugccuucgguggucgaaacgcuggagcagaugcagcggaagcauggcggcaugcuggugcggaacccgcucucgcggaacagcacucacgaaauguauugggugagcuguggcaccgggaacaucguguccgcaguuaauaugaccagccgcaugcuccugaacagauucaccauggcucaccggaagcccaccuacgagcgggacguugaccucggcgccggcacccggcacgucgccgucgagcccgagaucgccaaccuggacaucaucggucaacgcaucgagaauaucaagaaugagcacaagagcacuuggcacuaugacgaagacaacccauauaagaccugggcguaccacggcagcuacgaggugaagccguccgggagcgcguccucuauggucaacggcgugguucggcugcucacgaagcccugggacguuauccccauggugacacagaucgccaugaccgauacaacgcccuuuggacagcagcgcgucuucaaggagaaggucgacacccggacuccccgacccaaacgggguaccgcgcagauaauggaggugacggcgaaguggcuguggggauuccugagccgaaacaagaagccccggaucugcacccgcgaggaguucacgcgaaagguccgcuccaacgcggcgauuggggcgguguucguggacgagaaccaguggaacagugccaaggaagccgucgaggaugagcgguuuugggaucucguccaccgcgagcgggagcugcauaagcagggcaagugcgcgacaugcgucuacaacaugaugggcaagcgcgaaaagaaguuaggcgaguucgggaaagccaagggcucccgggccauaugguacauguggcucggcgcccgcuuccuggaguucgaagcguugggauuuaugaacgaggaccacugguuuagccgggagaacucccucuccggagucgagggugagggccugcacaagcuuggguacauucuccgcgacauauccaagauuccgggcggaaacauguacgcagacgacacggccgggugggauacccgcaucaccgaagacgaucugcaaaacgaggccaagaucacggacaucauggagcccgaacacgcccuucucgcgacgucaauauucaaacugacuuaucagaacaaggucgugcggguccagcgccccgccaaguccgguaccgugauggacgugaucagccgucgcgaccagcgagggagcgggcaggugggcaccuacggguuaaacacguucaccaacauggaggugcagcucauccgccagauggaguccgagggcauuuucucaccgucugagcucgagaacuccaaccucgccgagcgggugcucgacuggcuggagaaacacgggguagagcgccugaagcggauggccaucagcggcgacgacugcguggugaaaccgaccgacgaccgauucgccaccgcauuaacggcccugaacgacauggggaagguccggaaggacaucccacagugggagcccuccaagggcuggaacgacuggcagcaagucccauucugcagccaccacuuccaccagcugauaaugaaggacggccgcgagauagucguccccugccggaaccaggacgagcucguggggcgcgcccggguaagccagggcgccggguggucccugcgcgaaaccgccugccucggaaagagcuacgcgcagauguggcagcucauguacuuucaccggagagacuugcggcuggccgccaacgccauaugcucagccgucccagugaacuggguucccaccagccgcaccaccuggucaauacacgcacaccaccaguggaugacaacagaggauaugcucagcguauggaaccgcguguggauugaggagaauccuuggauggaggauaagacucacgugucuagcugggaggaugucccuuaccugggcaagcgggaggaccaauggugcgggucccuuauuggccucaccgcccgagccacgugggcaaccaauauucaaguggcgauaaaccagguucggagguugaucgggaacgagaacuacuuggacuacaugaccagcaugaaacgguucaagaacgaauccgaccccgagggcgcucucugguga

SEQ ID NO: 24772 - RNA, 9876 nt, Artificial Sequence
  derived and/or modified CDS sequence (opt11) from DENV-1__KF672760__SS-prME
ucggucacaaugcuacucaugcuucugcccacagcguuggcguuucaccucacgacccgcggaggcgaaccccacaugaucguaucgaaacaagaacggggaaaauccuugcuauucaaaacaagcgcaggagugaacaugugcacgcuaauagccauggaccucggcgaacuuugcgaagacaccaugacguauaaauguccacgaauaacggaagccgaacccgacgacgucgacuguugguguaacgccacggauacuuggguaaccuacggaacaugcucacagacgggugaacaccgcagggagaaaagaagcguggcacuagcuccccacgugggccuaggacuagaaacacgcacagaaaccuggaugaguucagagggagcauggaaacagauccaaaggguugagacgugggcucuccgacacccgggguuuacgguaaucgccuucuuccucgcacaugcgauuggcacaagcauuacucaaaaaggcaucaucuucaucuuacuaauguuaguaacucccucaauggccaugcgcugcguugggauaggcaaccgagacuucguugagggacugucgggcgcgaccuggguggacgugguucucgagcacggaucuugcguaacgacuauggcuaaaaauaaaccgacccuagauauugagcuacugaagaccgaaguaaccaacccagccguccuacgcaaacuguguauagaagcaaaaaucuccaacacaacgacagacagccgcugcccgacacaaggggaagcuacgcuagucgaggagcaagaugcuaacuucgucugcagaaggaccuuuguggacagaggauggggaaaugggugcgggcuauucggcaaaggaagccugcuaaccugugcaaaauuuaaguguguuaccaaacuggaaggaaaaauaguccaguacgagaauuugaaauacuccguaauuguaacugugcacacgggugaccagcaccaaguggguaacgaaacaacagagcacggcacgauagcaacuaucacgccgcaggcgccaacgucagaaauccagcuaacagacuauggggcccucacacucgacuguucccccagaaccggccuugauuucaaugaaaugguccuuuuaacaaugaaagagaaaaguuggcuaguccacaaacaaugguuccuggaccuaccgcuacccuggacuucaggagcgucgaccagccaggaaaccuggaaccggcaggacuuacucgucaccuucaaaacagcacacgccaagaaacaagagguaguggucuuaggaucgcaggagggggccaugcacacggcccuaacaggagccaccgaaauccagacuucagggacaaccaccauuuucgcggggcaucugaagugccgccuaaaaauggacaaacuuacuuugaagggcaugagcuacguaaugugcacuggcagcuucaagcuagaaaaagaggucgcggaaacccaacacggcacugugcuuguccagguaaaauacgaagggaccgacgcgccaugcaaaauacccuucucgacacaagacgaaaagggagugacacaaaacggccgccuaauaaccgcaaaccccauaguuacagauaaagaaaaacccgugaacauagagaccgaacccccauucggugagagcuacaucguggucggagccggggaaaaggcacugaaacuaucaugguucaaacgggggagcagcauaggcaaaauguuugaggccaccgcuagaggcgccaggcgcauggcaauacuuggugacaccgccugggacuucggcucgaucggcggaguguucacuagcgucggaaaacucguacaccagguguucggcacagcauacggcguccuauucucaggcgucucuuggacaaugaaaauaggaauaggcauccuauuaacauggcugggacuaaacucccguucaacgucccucagcaugacgugcauugcggugggaauggucaccuuguaucuaggcguaaugguucaggcugacaguggcugcgugauuaauuggaaaggacgggaacugaaauguggaucuggaaucuuuguuacaaaugaaguccauacauggacggaacaauauaaguuucaagccgacagcccaaaacgccuaagugcagccaucgggaaggcuugggaggagggggugugcggaauccgcagcgcgacaaggcuugagaacaucauguggaagcaaauaagcaaugaacucaaccacauacuucucgagaacgacaugaaauucacaguaguagugggagacgcgaacggcauccuggcgcaggggaagaaaaugauaagaccccaaccaauggagcacaaauacuccuggaaaagcuggggcaaggccaagaucauaggggcagacauacaaaacaccaccuucaucauagacgggcccgacaccccagaaugccccgauggccagcgugccuggaacauaugggaaguagaggacuauggcuucggaguguucaccacuaacauauggcugaaacugcgagacuccuacacucagaugugugaccauaggcucaugagcgcugcaauuaaagauucaaaagcaguccaugcggauaugggguacuggaucgaauccgaaaagaaugaaacguggaaauuggcacgugccagcuuuaucgagguaaagacaugcaccuggccgaaaucgcauacucucuggucuaacggcguacuggagagcgaaaugaucauaccgaagauauucggcggcccaauuucacaacacaacuaccguccaggcuacuucacgcaaacagcagggccauggcaccuggggaagcuggaacuggacuucgaccucugugaggggacaaccguuguuguagacgaacacugcgggaauagaggaccgucacuaagaacgacuaccguuacaggcaagauaauccacgagugguguugccgaagcuguacacugccuccucuuagauucagaggcgaggacggcugcugguauggaauggagauuaggcccgucaaagaaaaggaggagaauuuaguuagguccaugguaagcgccggcucaggagagguugauucguucagccuaggaauccuaugcgugucaaugaugaucgaagaggucaugcgcuccagauggaguaggaaaaugcugaugacagggacccucgcagucuuucuacuacuuauuaugggacaacucaccuggaacgacuugauccgauuguguaucauggugggcgcaaacgcuagugauaggauggggauggggaccacauaucuggcucuuauggccacguuuaaaaugcgcccgauguucgccguuggacuacucuuccggagacucacaagucgagaaguccuacuacuaacaauaggccuaagccuagucgcaugcguagaauuaccgaacagccuagaagaacucggagacggacuagccaugggaaucaugaugcuaaaacuccugacggaauuucaaccccaccaguuguggacgacccugcucucccuaaccuucguaaagaccacccucucccucgacuacgcguggaaaaccacagcuaugguacugucaaucgucagucuauucccucuaugccucaguacaaccagccagaaaaccaccuggcugccagugcuucugggcucauucggaugcaaaccacucaccauguuucugauaacggaaaacaagauauggggacgcaaaaguuggccacugaaugaagggauaauggcgaucggcaucguaagcauucuucucucaucccugcuuaaaaacgacgugccacuggccggaccccucauagcugguggaauguuaaucgccugcuacgugaucagcgguucgagugcagaucuaagucuugagaaagcggcggaggucucaugggaacaggaagcggaacacagcggggcaucgcacaacauauuaguagagguccaagacgacggaacaaugaagaucaaggacgaagaacgagacgauacgcugacgauucuccuaaaggcaaccuugcuggccguaucgggagucuaccccaugaguauucccgcgacccuauucguuugguacuucuggcagaagaagaaacagcgguccggaguauuaugggauaccccaagcccuccugaggucgaaagggcgguccuagaugacgggauauaucguauucuucaacgcggcuuacuagguagaagucaagugggggucggaguauuucaggacggugucuuccauacaauguggcauguaaccagaggcgcagucuugauguaccaggggaaaagacucgaacccagcugggcaagcguaaagaaggaccugauauccuacggaggaggauggagauuucaggguucuuggaauacgggcgaagaaguccaagucaucgccguagaacccggcaaaaacccgaaaaacguacaaaccacacccggcaccuucaaaacacccgaaggcgagguuggagcgauugcgcuggacuuuaaacccggcaccaguggcucaccgauaguaaaccgagaaggaaaaauagucgggcucuacggcaacggugucguaaccaccucggggacguacguuucggcaaucgcccaggccaaagccucgcaagaggggccucuuccggaaaucgaagacgaaguauucaagaaacgaaaccugaccaucauggaucugcacccaggcagcggaaaaacacgacgauaccucccagccauaguccgggaagcaauaaaacgaaaacuacgcacuuugauacuggccccaacacgggucguggcaagugaaauggccgaggcauuaaaggggaugccaauuagauaccaaacaacagccguaaaaucugaacacaccggucgcgagaucgucgaucuaaugugccacgcaacguucaccaugcgacuccuuucgccaguacguguaccaaacuauaauaugauaaucauggacgaagcgcacuucacggaccccgcgagcauugcggccaggggauacauaucgacaagagucgggaugggagaagcugcagccaucuucaugaccgccacaccgcccgggucaguagaagcauucccccaaagcaacgcggugauacaagacgaagaaagggauaucccugagcggagcuggaacuccggcuacgacuggauaaccgacuuuccuggcaaaaccgucugguuuguacccucaauaaaaucaggcaaugacaucgcaaacugccuccggaagaacggaaaacggguuauucagcugucgaggaaaaccuucgauacugaguaccagaagacuaaaaacaacgauugggauuacgucguuaccacggacauaagcgaaaugggggccaacuuccgcgcggauagggucauagacccacgccggugccuuaagcccgugauccuuaaagacggaccggagcgaguaauauuagcaggaccuaugcccgucacaguagcaucagcugcucaacgccgcggacgaauaggcagaaaccagaauaaggaaggggaccaguacgucuacaugggacaaccauuaaacaacgacgaggaccacgcacacuggacggaggcgaagaugcugcucgacaacaucaauacaccagaggggaucauccccgcgcuguucgaaccagaaagggaaaaaucagcagccauagacggcgaauacagacugcggggcgaagcccgaaagacauucguagaacuaaugcggaggggagaccuuccuguguggcucucuuacaagguagcaagugaaggcuuccaguacagcgacagaagguggugcuucgacggagaaaggaacaaccagguccuugaagaaaauauggauguagagauauggaccaaagaaggcgaacgcaagaaacuccgccccagauggcucgaugcccgaacauacucagacccucuugcacugcgagaguucaaggaauuugccgcagggagacgcuccgugucgggcgaucuaauccuagagauagggaagcucccccaacaccugacacuacgagcccagaaugcccucgacaaccuagugaugcuacacaacagcgaacaaggagggaaggcauacagacacgccauggaggagcuaccagacacaauagaaacacucaugcuuuuagccuuaauugcgguacuaaccgguggaguuacgcucuuuuuccucuccggaaaagggcucggaaaaacaagcaucggacuccuauguguaaccgcauccucagcgcuacuguggauggcaucgguggagccacacuggaucgcagcaucaaucauauuggaguucuuucucaugguccuacuaauaccggaaccggacaggcagcgcacaccccaagauaaucaacuagccuacgucguuauaggccuccucuucaugauauuaaccguagcggccaaugaaaugggacuacuagaaacgaccaagaaagaucuaggaauaggcuacgucgcagcagaaaaccaccaacacgccacgaugcuggacguagaucuacacccagccucagcuuggacgcuguacgccguagcgaccaccgugauuaccccaaugaugcggcauaccaucgaaaauacaacggcaaacauuucacucacggccauagccaaccaagcugccauccuaaugggacuagacaaaggauggccaaucucuaaaauggacauuggggugccgcuguuagccuugggaugcuauagccagguaaacccccucacacuaaccgcugcaguccuuauguuggucgcccauuacgccaucauaggcccgggucuccaagcgaaagcaacccgggaagcacagaaaagaacggcagcggggauaaugaaaaacccuacgguagauggaauaguagcgaucgaucucgauccuguagucuacgacgccaaauucgaaaaacagcucgggcaaaucaugcuccuaauacuuugcacgagccagauccugcuaaugcgaacgacaugggcacucugcgaauccaucacccuagcgacaggcccccugaccacccucugggaggggagcccgggaaaguucuggaacaccaccaucgccguaagcauggcaaauauauucagaggcaguuaccuggccggagcaggacucgcauucagucugaugaaaucccuuggcggaggacggcgcgguacgggcgcacagggagaaacguuaggggaaaaauggaaaagacaguugaaccaacugucuaagucugaauuuaacaccuacaaacgaucgggcauaauggagguagaucggagugaagccaaggagggcuuaaagcguggagaaacaaccaagcacgccgucucacggggaacagccaaacucagaugguucguagagaggaacuuaguuaagcccgaaggaaagguuauagaccugggaugcggucgaggcggauggagcuacuauugcgcagggcugaagaaagugaccgaagucaaagguuacacaaagggcggccccggccacgaagaaccgaucccgauggcaaccuacggcuggaaccugguaaagcuccauuccggaaaggacguauucuucaugccgccugaaaaaugcgacacacugcugugcgauaucggagaauccagcccuaauccgacgauugaggagggacggacccuccggguacuuaagauggucgaaccauggcuaagggggaaccaguucugcauaaaaauccucaaccccuacaugcccucagucguagagacacuagaacggaugcaacgcaagcauggaggaaugcuaguccggaauccccucucacggaacagcacccacgaaauguacuggguuucaugcggcacaggcaacauaguuuccgcagucaacaugacuucgagaaugcuacucaaucgcuucacgauggcucaccgcaaaccaacauacgagcgggacgucgacuugggcgcgggcacaagacacguagcaguagaaccggaaguagcgaaccucgauaucauaggccagcgaaucgagaacaucaagaaugagcacaaaucaacuuggcacuacgaugaagacaacccauacaagacgugggcguaccacggcagcuacgaagucaaaccuagcggaucugcgagcucaaugguuaauggcgucgugagguuacuaacaaagccaugggacguaauaccaaugguuacgcaaaucgcgaugaccgacacuacccccuucggacagcagcgggucuucaaggaaaaaguugacacuagaacccccagagcaaagagagggaccacacaaauaauggaagucacugcaaaguggcuauggggauuucuaaguagaaauaagaaaccccggaucugcacacgcgaggaauuuacccgcaaagucaggagcaacgccgccauaggagccguguucguagacgaaaaucaguggaacagcgccaaagaggccguagaagaugaaagguucugggaccuugugcacagagaacgagaacuacauaaacaaggaaagugcgcaaccugcguauauaacaugauggggaaaagagaaaagaagcugggagaguucggcaaagcaaaggggucgagggcaaucugguacauguggcuaggcgcccgcuuucucgaguucgaagcacucgguuucaugaacgaggaccacugguuuagcagagaaaauagccuuuccgggguagagggagaaggccuacacaagcucggguacauauugcgggacaucagcaaaauaccaggcgggaacauguacgccgacgacacagcaggaugggacacacgaauaaccgaggacgaucugcaaaaugaagcaaaaauaacagauaucauggaacccgagcaugcacuacucgcaacgaguaucuucaagcucacguaccaaaacaaaguagugagagugcagagaccagccaaaaacgggacaguaauggacguuauuucccgucgggaccaacgaggcucgggccaaguagggaccuacgguuuaaacacauuuacaaauauggaagugcagcugauacgccaaauggaauccgaggggauauuccuaccuagugaauuagagaccccaaaccuggcagaacgagcccuagacuggcuagaaaaacacggagccgagcgucucaagcgaauggcaauaucuggggacgacugcguugugaaacccaucgacgauagguucgccacagcccuaacugcccugaaugauauggguaaaguacgcaaggacauaccucaaugggaaccuucgaagggauggaacgauuggcaacagguccccuuuugcucgcaccacuuccaccaacucauaaugaaagacggacgcgagaucguuguucccugcagaaaccaagacgagcuaguggggcgggccagagugucacagggagcuggauggucucugagagaaacagccugccucgggaaaagcuacgcucagauguggcaacuaauguacuuucaccgcagggaccuacgucuggcagcaaacgccauauguagcgccguccccguggauuggguucccgcaucaaggacaacauggagcauacacgcccaccaccaauggaugaccacggaagacauguuaucgguauggaaccgcgucuggauagaagaaaaccccuggauggaagacaagacgcacgucuccaguugggaagagguaccguaccuaggaaaacgagaagaccaguggugcggaagccuuauaggacuuacugcacgugcuacaugggcgacaaacauacaaguagcgaucaaccagguccgaagacugauagggaacgaaaacuaccuagacuacaugacuagcaugaaaagguuuaagaacgaaucggacccggaaggggcgcucugg

SEQ ID NO: 24773 - RNA, 9876 nt, Artificial Sequence
  derived and/or modified CDS sequence (opt11) from DENV-1__KF672759__SS-prME
agugugaccaugcuucucauguuacucccgacggccuuggcguuccaccuaaccacgcgcggcggugagccacauaugaucgugagcaagcaggaacggggcaagagccuccuuuucaagaccuccgugggggugaacaugugcacccugaucgcgauggaccugggugagcucugcgaggacacuaugacauacaagugcccccgcauaaccgaggccgagcccgacgacguggauugcuggugcaacgccaccgacaccugggugaccuaugggaccugcagccaaaccggcgagcaccggcgcgacaagcgguccguggcccuggcgccccacgucgggcuggguuuggaaacgcgcacggagaccuggaugagcagcgagggcgccuggaaacagauccagaagguggagaccugggcacugcggcaccccggguucaccgugauagcccuguuccuggcucacgccaucggcaccagcaucacccagaaggggaucaucuucauccuacuuauguuggugacgcccuccauggccaugcgcugugugggcaucggcaaccgggacuuuguggagggacugucaggcgcaacguggguugacguggugcuagagcacgguuccugugucacaaccauggcaaagaauaagcccacccuagauaucgagcuccugaagacggaaguuaccaaucccgcugugcuucgcaaacugugcaucgaggcgaagaucucuaauacuaccacagacucccggugcccgacccagggagaggcuacucuggucgaggagcaggaugccaacuucgugugucgccggaccuucguggaccgcggcugggggaacggcugcggccucuucgggaagggaucccugcugacgugcgccaaauuuaagugugucaccaagcucgagggaaagauaguccaguacgagaaccugaaguacuccgugaucgucaccguccacaccggcgaccagcaccaggucggcaacgaaacgaccgagcacggcacuaucgccaccaucacgccucaggcgcccaccagugaaauccagcuaaccgacuacggggcccucacccuggacugcagcccccguaccggccuggacuucaacgagaugguuuuacuuacgaugaaggagaaguccuggcugguacacaagcagugguuccucgaucugccgcugcccuggaccuccggggccagcacgagccaggagaccuggaaccgccaggaccuccuggucacguucaaaaccgcccacgccaagaaacaggaggugguggucuugggaucacaagagggagcgaugcacaccgcccucaccggggcaacggagauacaaaccagugggaccaccacgaucuucgccgggcaccugaagugccggcugaagauggacaagcucacccugaaggguauguccuacgugaugugcaccgguuccuuuaagcucgagaaagaaguggccgaaacccagcacggcacgguccugguccaggugaaguacgagggcaccgacgcgcccugcaagaucccguuccucacccaggacgagaaggggguuacacagaacggccgcuuaauuacggcgaauccgaucgugaccgacaaggagaaaccuguuaacaucgagaccgaaccgccauucggggaguccuacauagucgugggcgccggcgagaaggcccugaaacucagcugguuuaagaaggggucaagcauuggcaagauguuugaggcgacugcccgcggcgcccgccggauggccauccugggcgacaccgcgugggacuucggguccaucggcggccuguucacaagcguugggaagcucauccaucaggucuucggcaccgcguacggagugcuguucagcggggucagcuggaccaugaagaucgggaucgguauccugcucacuuggcugggccugaacucccggagcaccucccucucgaugaccugcaucgccguggggaugguaacccuguaucuaggcgugaugguacaggccgacuccgggugcgugaucaauuggaagggcagggagcuuaagugcggcagcggcaucuucgugacgaaugagguccacacguggaccgaacaguacaaguuccaggccgacuccccgaagaggcugagcgccgcgaucggcaaagccugggaggagggaguguguggcauccgcagcgccaccagacuggagaacauaauguggaagcagaucuccaacgagcuaaacuacauccugcuggagaacgacaugaaauucaccguggucgucggggacgugaacggcaucuuagcgcaggggaaaaagaugauccggccccaacccauggagcacaaguauagcuggaaaagcuggggcaaggccaagaucaucggugcggauauccagaacacaacauucaucaucgacgggcccgauaccccggagugccccgacgaucagcgggccuggaacaucugggaagucgaggacuacgguuucgggaucuucacaacgaacauuuggcugaaguugcgcgacagccauacccagaugugcgaccaucggcucauguccgccgcaaucaaggauagcaaagcgguacacgccgacauggguuauuggaucgaauccgagaagaacgagaccuggaaacuagcccgcgcuagcuucauugagguuaagaccugcaucuggcccaagucccacacgcuguggagcaacggcgucuuagagucggagauggugauccccaagaucuaugggggcccuauuucgcagcacaacuauagacccggguacuuuacccagacugccggccccuggcaccuggggaaacuggaacucgacuucgaccugugcgagggcaccacgguggugguggacgaacacugcggcuaccgcggaccuucccugagaaccaccaccgugacgggcaagaucauccacgaguggugcugccgcagcuguaccuuaccgccccugcgguuccgcggugaggacggcugcugguacggaauggaaauccggcccgucaaagaaaaggaggagaaccugguacgcuccauggugagcgcgggauccggcgaggucgacagcuucagccugggaauacuguguguguccauccugaucgaagaggugaugcggagccgcuggucccggaagaugcucaugacaggcacccucgcugucuuccuguugcugaucauggggcagcugacguggaacgaccucauacggcuaugcauuauggugggugccaacgccagcgacaggaugggaaugggcacaacauaccuagcacucauggcuacguucaagaugcggccuauguuugcagugggccugcuguuccgccggcucacgugccgcgagguccugcugcucacugugggccuuucccuggucgccaguguggagcuacccaacucccuggaggagcugggcgaugggcuugcgaugggcaucaugaugcugaagcugcucacggacuuccaaccccaccagcuauggaccacacugcucucccugacauucauccggaccucccugucccucgacuacgccuggaagaccauggcgauggcacuguccauugugagccuuuucccccucugccuguccacgacuucucaaaagaccacuuggcuaccgguccuccugggcuccuucgggugcaagccccugacgauguuccucauaaccgagaacaaaaucuggggccguaagagcuggcccaucaacgagggaaucauggcggugggcaucgugucgauccugcugagcucccugcucaagaacgacgucccccuggccgggccgcucaucgcgggcggaauguugaucgccuguuacgugaucuccgguagcuccgccgaccucagccucgagaaggcggccgaaguguccugggaggaggaggcggagcacucaggaaccucccacaacauccuagucgaggugcaagacgaugggaccaugaagaucaaagacgaggagcgggacgacacccuuacgauucuccugaaggcgacccugcucgccgugagcggcgucuaccccauguccauacccgcaacacuguucgugugguacuucuggcaaaagaagaagcagcgcucaggggugcugugggacaccccaaguccgcccaaggucgagcgcgccgugcuggacgacggcaucuaccgcauccuccagcggggccuacuggggcgcagccaggugggcgucgggguuuuucaagauggcguguuccacacgauguggcacgugacucgcggggcggugcucauguaccagggcaagcgccuggagcccuccugggccagcgugaagaaggaccugauuucguacggcggaggcuggcguuuccaagggagcuggaacaccggcgaagaaguccaagucaucgcaguugagccggggaagaacccgaagaacguacagaccacgccuggcaccuucaagacccccgagggcgagguaggggccauugcccucgacuuuaagcccggcaccucagggagcccgauagugaaucgcgagggcaaaauugucggccuguacgggaacgggguggugacgaccucgggcaccuacgucagcgcgaucgcccaggccaaggccacccaggagggaccccugcccgagaucgaggacgagguguucaagaaacguaaucuuacgaucauggaccugcacccggguaguggcaagacccgcagguaucuucccgccauugugcgagaagcuaucaagcggaagcuccgcacccugaucuuagcccccacccgcgucguggccagcgagauggccgaggcgcucaaggggaugcccauccgguaccagacgaccgccgugaagagcgagcacacugggcgcgagaucgucgaucugaugugccacgccacauucacgaugcggcugcucuccccggugcgcgugcccaacuacaauaugauaaucauggacgaagcucacuucaccgacccagcgucgaucgcggcccgagguuauaucuccacccgcguggggaugggcgaagccgcggccaucuucaugaccgcgacgcccccgggaagcguggaagccuucccccaguccaacgcuguaauccaagaugaagaacgggacauccccgagcgcagcuggaauucaggcuaugacuggaucacugacuucccuggcaagaccguuugguucgugccgagcaucaaguccgggaacgacaucgccaacugucuucggaagaacggcaagcgcguaauccagcugagccggaagaccuuugacacggaguaccagaagacaaagaauaacgacugggacuacguaguaaccacugacaucuccgaaaugggggccaacuuccgcgcggaccgggugaucgaccccagacggugucucaagccagucauacugaaggaaggucccgagagaguaauccuggccgggccgaugcccgucacgguggccagcgcggcgcaacggcgcggccggaucggccguaaccagaacaaggagggugaccaguauaucuacaugggccagccccuuaacaacgacgaggaccacgcccacuggacggaggcaaagaugcuucuggacaauaucaacacgccggagggcaucaucccugcacuuuuugagccugagcgcgagaaguccgccgccaucgauggcgaguaccggcugcgcggugaggcgcgaaaaaccuucguggagcugaugcgccggggcgaucuccccguauggcugagcuacaaaguggccucagagggcuuccaauacagugaccgccgguggugcuuugacggggaaagaaacaaccaaguccuggaagagaacauggacgucgagaucuggacgaaagagggggaacggaagaaacuccgcccccgcugguuagacgcccgcaccuacuccgacccccuggcucuccgggaguucaaggaguucgcggccggaagacggagcguuaguggcgaccuaauucuggagaucggcaagcucccccagcaccugacacugcgcgcccagaacgcccucgacaacuuagugaugcuacacaacagcgagcagggcgggaaggccuaccggcaugcuauggaggagcuacccgacaccaucgagacccugaugcugcucgcacugaucgcaguccugaccgguggagugacccucuucuuccugagcgggaaggggcuaggcaagaccucuauuggguuacugugugugauggccagcuccgcgcugcucuggauggccucuguggagccccacuggauagccgccaguaucauccuggaguucuuccugauggugcuccugauucccgagccggacagacagcgaacgccccaggacaaccagcuggccuauguggucaucggcuugcuguucaugauucugacgguggcggccaacgagaugggacuccuggagaccaccaagaaggaccugggcaucgggcacguggccgucgagaaccaccaccacgccacgauguuagacguggacuuaagaccugcaagugcguggacguuauacgccguggccacgaccgucaucaccccuaugaugcggcacacgaucgagaacaccaccgccaacauaucccucaccgccaucgcgaaccaagccgccauccucaugggccuggacaagggcuggcccauaagcaagauggauaucgggguaccccuccuggcucucggaugcuacucccagguaaacccgcucacguugaccgccgcgguccugaugcucguggcccacuacgccaucaucgguccuggucugcaggccaaggcgacccgcgaggcccagaagcgcaccgcugccgggaucaugaaaaacccgacgguggacggcaucgucaccauugaucuggacccagucguguacgacgccaaguucgagaagcagcucggccagaucaugcuucugauccucugcaccagccaaauccugcugaugcggaccacgugggcgcucugcgaguccaucacacuggcaacggggccgcugacuacguugugggagggaagcccaggaaaguucuggaacacuaccaucgccgucagcauggccaacaucuuucgcggcagcuaccuggccggcgcgggccuggccuucucccucaugaaaucacuuggcgggggccggcgagggaccggcgcccagggcgagacguugggggagaaguggaagcggcagcucaaccaacuguccaagagcgaguucaacaccuacaagaagagugggaucauggagguggaccgcagcgaggccaaagaagggcuaaaacgcggcgaaaccaccaagcacgccguuagccgcggcacggcgaagcugagaugguucgucgaacgcaaccucgugaaaccugagggcaaggucaucgaccuggguugcgggcggggcggguggucauacuauugcgccggccucaagaaggugaccgaggugaagggguacaccaagggcggccccggacacgaggaaccgaucccgauggccaccuaugguuggaaccucgugaagcugcauagcgggaaggauguguucuucacgccacccgagaagugcgacacgcuucucugcgacaucggugagucuagcccgaaccccaccauagaggaggggcgcacccuccgggugcugaagaugguggagccauggcuccgcggcaaccaguuuugcaucaagauccugaacccguacaugccguccgucguggagacccucgagcagaugcagcggaaacauggcgggaugcucgugcgcaacccccugagccggaacucaacgcacgagauguacuggguuagcugcggcaccgggaacaucgugagugccgugaacaugacgucucgcaugcugcucaacagguucaccauggcccacagaaagccgacguacgagcgcgacgucgacuuaggcgccggcaccaggcacguggcgguggagccagaggucgccaaucuggacaucaucgggcagcgcaucgaaaacaucaagaacgagcacaagucgacguggcauuaugacgaggacaauccguacaagaccugggccuaccacggcagcuacgaggugaagcccagugggagcgcuuccagcauggucaacggcguggugcggcuccugacgaagccaugggaugucaucccaauggugacccagaucgccaugaccgacaccacuccguucggucagcagaggguguucaaggagaaggucgacacccggacgccucgggccaagcggggcacagcccaaauaauggaggugacggcgaaguggcuguggggcuuccucucccguaacaagaagccccgaaucugcacccgcgaggaguucacccggaagguccgcaguaacgccgcaaucggggccgucuucguggacgagaaccaauggaauuccgcaaaggaggccguagaggacgagcgguucugggaucucguccaccgcgagcgggagcugcacaagcagggcaagugugcgaccugcguguacaauaugauggggaagcgcgagaaaaagcucggcgaguuugggaaggcgaaggggagccgggccaucugguacauguggcugggcgcccgcuuccuggaguucgaggcucucggcuucaugaacgaggaccacugguuuucacgggagaacuccuugagcggcguggagggggagggacuccacaagcucggguacauccugcgcgauaucuccaaaaucccgggcggcaacauguacgccgacgacacggccgggugggauacacggauuaccgaagaugaccugcagaacgaggcgaagaucaccgauaucauggagcccgagcacgcgcuccuagcgacgagcaucuucaaguugacauaccagaauaaagucgugcgcguucagcgccccgcgaagucagguaccgucauggacgucaucagccggagagaccagcgggguagcggacagguuggcaccuaugggcucaacacuuucaccaacauggagguccagcugauccgccagauggaaucggagggcaucuucuccccaagugagcuggagaccccaaaccucgccaagaagguacuggacuggcuagagaagcacggggccgagcggcucaagcgcauggcgaucucaggcgacgacuguguggucaagccaaucgacgaccguuucgcgacggcccugacggcccugaacgacauggggaagguucgcaaggacauuccccaaugggagcccagcaaaggcuggaaugauuggcagcaggucccguucugcucccaccacuuccaccagcucaucaugaaggacggaagagagauagucgugcccuguagaaaccaagacgagcugguggggcgggcccgcgucagccagggugccggguggucauugcgggagaccgcgugccucgguaagagcuacgcccagauguggcagcugauguacuuccaccgccgggacuugcgccuugccgccaacgccaucugcuccgcggugcccguggacuggguccccaccucuagaacuacuuggagcauucaugcccaccaccaguggaugacgaccgaggacaugcuguccguguggaaccgcguguggauagaggagaauccguggauggaggacaagacgcacgucagcuccugggaggagguccccuaccuggguaaacgggaggaucaguggugcggcagccucaucggcuuaaccgcccgcgccacuugggccacaaacauccaaguggccaucaaccagguccgccgguugauugggaacgagaacuaccucgacuacaugaccucgaugaaacgcuucaagaacgagagcgaccccgagggcgcccugugg

SEQ ID NO: 24774 - RNA, 9876 nt, Artificial Sequence
  derived and/or modified CDS sequence (opt11) from DENV-1__KF672761__SS-prME
agcguaaccauguuguucaugcugcugcccaccgcccuggccuuccaccucaccacccgcggcggggaaccccauaugaucgugagcaaacaagagcggggcaagucgcugcuuuuuaagacaagcgcgggcguuaacaugugcacccuuaucgccauggaccugggcgagcugugugaagauaccaugaccuauaagugcccucgcaucaccgaggccgagccagacgauguggacuguugguguaaugccaccgauaccugggucacguacgggaccugcucccagacggguggccaccggagagacaaaagguccguggcccucgcgccucacguggggcugggacuggagacccgcaccgagaccuggaugagcuccgaaggagcauggaagcaaauucagaagguagagaccugggcccuccgacaccccggcuucacgguaauugcacuguuccuggcgcacgccaucggaaccucgaucacccagaaaggcauuaucuucauccuccugaugcuagugacccccuccauggccaugcgcugcguuggcauugggaaccgggacuucguggagggacugucgggggccacauggguggacguugugcuggagcacggcuccugugugaccaccauggccaagaacaaacccacccuugacaucgagcuccuaaaaacggaagucacuaaccccgcggugcugcgcaagcucugcauagaggccaaaaucagcaauaccaccacggauucccgcugcccgacccaaggcgaagccacucuaguggaggagcaagacgcgaauuucgucugccgccgcacauucguggaccgcgguuggggaaacgggugcggccuguucggaaaggguagccuccugacgugcgcaaaguucaagugcgugaccaagcuagaaggcaagaucguccaguacgagaaucucaaguacuccgugauugugacuguacacacgggcgaucagcaccaggugggcaacgagacgacggagcacggaaccaucgcgacaauaacgccccaggccccuaccucggaaauccaguugaccgauuauggcgcguuaacccuagacugcagccccaggacggggcuggauuucaacgagaugguucuauugacgaugaaggagaagucguggcugguacacaagcagugguuccuagaccuaccucugccuuggaccuccggcgccagcacuagccaggaaaccuggaacagacaggaccugcucgugacguuuaagaccgcccacgccaaaaagcaggaggucguagugcuaggcucucaggagggggccaugcacaccgcccugaccggcgccacggagauccagaccagcggaaccaccacgaucuucgccggccaccucaagugucgguugaagauggauaaauuaaccuuaaaggggaccuccuacguuaugugcaccggguccuuuaagcuggaaaaggagguggcagaaacgcagcacggcacaguguugguccaggugaaauacgaggggaccgacgcccccugcaagauucccuucuccacacaggacgaaaagggcgugacucagaacgggcgcuugaucaccgcuaauccgaucgucacggacaaggagaagcccgugaacaucgagacagagccccccuucggagagagcuacauuguggucggcgccggggagaaggcucucaaacugaguugguucaagaaggguagcuccaucgggaaaauguucgaggccacggcccggggggcgcgccgcauggccauccugggggauaccgccugggacuucgggagcaucggcggggucuucaccagcgugggcaagcucguccaucaaguguuugggaccgccuacggcguacuguucagcgggguauccuggacuaugaagauugguauuggcauacugcuaacguggcuggggcugaauagccgaucgaccagccucuccaugacgugcauagccguggggaugguaacacuguaccugggggucaugguacaggccgacagcggcugcgugaucaacuggaaaggccgggagcuaaagugcggcuccggcaucuucgucaccaacgaggugcacaccuggaccgagcaguacaaguuccaggccgauagcccgaagcggcugagcgcggccaucggcaaggcgugggaggagggcgugugugggauacggagcgcuacucgauuagagaacaucauguggaaacaaauuucaaaugagcucaaccacauccugcuggagaacgacaugaaguuuacagucguggugggcgacgccaacgggauccucgcgcaaggcaagaaaaugauucgaccccagcccauggaacacaaguacaguuggaagaguuggggcaaggcuaaaaucaucggagcugauauccaaaacaccaccuuuauuauugacggccccgacaccccggagugccccgacgagcagcgggccuggaacaucugggagguggaagacuacggguucgguaucuucacaaccaacauuuggcugaagcuucgggacuccuacacccagaugugcgaccauagacucauguccgcggccaucaaggacuccaaggccgugcacgccgauaugggcuacuggaucgaaagcgagaagaacgagaccuggaagcuggcccgggcguccuucaucgaagugaagacguguaucuggccuaagagccauacccuguggucgaacgggguccucgagucggagaugaucauccccaagaucuacggcgggccgaucucccagcauaacuaucgaccaggcuacuucacccagacggcggggcccuggcaccuggggaaguuagagcucgacuuugaccugugugagggcacgaccguggugguggacgagcacugugggaacagagguccgagccuucggaccaccacgguaaccggaaagauuauccacgaguggugcugccgcuccugcaccuuaccuccccuccgguuccgaggagaagacggguguugguacggcauggagauccggccggugaaggagaaggaggaaaaucugguccgaagcaugguguccgccggaagcggggaggucgacagcuucucccucggcauccugugcguuagcaucaugaucgaagaggugaugcggucacgcuggagccgcaagaugcugaugaccgggacgcucgccguguuccuguuacugaucaugggccagcugaccuggaacgaucugauacgccuuuguauaauggucggggccaacgcguccgauaagaugggcauggguaccaccuaucuggcccugauggccacuuuuaaaaugcgcccuauguucgccguggggcucuuauuccggcgccugaccagucgagagguccugcugcugacaauuggucucaguuugguugcaagcguugagcugccuaauucccucgaggagcugggagauggccuggcuaugggcaucaugauguuaaagcugcuaaccgaguuccagccacaccaacucuggacgacccuguuaucccucacauucauuaaaaccacgcugucccuggauuacgccuggaaaaccaccgccaugguccucagcaucguaucgcuguucccccugugccucagcaccacgucccagaaaaccaccuggcuaccgguccugcucgguagcuuuggcugcaagccccugaccauguuucugauuaccgagaacaagaucugggggcgcaagaguuggcccuuaaacgagggcaucauggccaucggcaucguaucaauucugcugucuagccuccugaaaaaugacgugccccuggcgggcccuuugaucgcggggggaaugcugaucgccugcuacguuauuagcggcuccucggcagaucugucucuggagaaagccgcggaagugagcugggaagaggaggccgagcacucaggcacgucgcacaacauucugguugagguucaggacgacggaaccaugaagaucaaagacgaggaacgggaugacacccugacuauccuccugaaagcaacguugcucgcaguuuccgggguguacccuaugaguauaccagcuacccuuuucgucugguacuucuggcagaagaagaaacagcgcuccggcguccugugggacacccccucgccgcccgagguagaacgggcggugcucgacgauggcaucuaccgcauccuccaacggggucuguuggggcgcucgcaagucgguguaggaguguuccaagacggaguauuccacaccauguggcaugucacgaggggagcagugcucauguaccaaggcaagcgacuggagccuagcugggccuccguuaagaaggaccugaucucuuacgggggcggguggcgguuccagggcuccuggaauaccggggaagagguacaaguaaucgccgucgagcccggcaagaacccuaaaaacguacaaaccacuccaggcaccuuuaagacaccggagggggaagugggcgccaucgcgcuggacuucaaacccgggaccuccggcucgccgauuguaaaucgggaggggaagaucgucggccuauacggcaacggcgugguuaccacgagcggaacguacguauccgccaucgcccaggccaaggcaagucaggaggggccccugcccgaaaucgaagacgagguguucaagaaacggaaccucacgaucauggaucugcacccgggcagcggcaagacccgccgguaccuccccgcgaucguacgcgaagcaaucaagcggaagcuuagaacguuaauucuagcgcccaccagagugguugccuccgagauggcggaggcccucaaaggaaugcccauccguuaucagacgaccgccgugaagagcgagcacacgggccgggagaucguagaccugaugugccacgcuaccuucaccaugcggcugcucuccccagugcgcguccccaacuauaauaugaucaucauggacgaggcgcacuuuaccgacccggcgaguauagccgcgcggggguacaucuccacgcgcgugggcaugggggaggccgcggcgaucuucaugaccgcuacgccgccuggcagcgucgaggccuucccucaaucaaacgccgucauccaagaugaggaacgggacauccccgaacgcagcuggaacuccggauacgacuggauuaccgacuuucccggcaagacgguaugguucgugcccagcaucaagucaggcaaugacauagccaacugccugcguaagaacgggaagcgcgucauucagcuaagccguaagaccuuugacaccgaguaccagaagaccaaaaacaacgacugggauuacguggugacgacggacauauccgagaugggcgcgaauuucagagccgaccgggucaucgacccacgccggugccuaaagccggugauucugaaggacggucccgagcgcgugauccuggccggcccgaugcccguuaccguggccagcgcggcucagcggcgcggccggaucgggcguaaccagaacaaggagggcgaccaguacgucuacauggggcagccgcucaacaaugacgaggaccacgcacacuggaccgaggccaagaugcugcucgacaauauaaacacgcccgagggcauuauaccggccuuguucgaaccggaacgagagaaaucugcggcuaucgacggugaguaccgucugcgcggcgaggcccgaaagaccuuuguggagcugaugcgccggggcgaccuucccgucuggcugucauacaaagucgcgucggagggguuccaguacagcgaucgccgguggugcuuugacggugagcgcaauaaccagguauuagaggaaaacauggacguggaaaucuggaccaaggagggagagcggaaaaaacuccgcccaagguggcuggacgcucgcacuuacuccgacccccuggcacugcgggaauucaaggaauucgccgccggccgccggagcgucucaggcgaccugauacuggagaucgggaagcugccgcagcaccucacccugagggcccagaacgcuuuggacaaucuggugaugcuccauaauuccgagcagggggguaaggcguacagacacgccauggaggaguuaccagacaccaucgagacccugauguuacuagcccugauagcaguccucacaggaggggucacccuguuuuuccuuaguggcaaaggccuggguaagaccuccauugggcuccugugcgugacagccuccagcgcccuguuauggauggccucaguggagccccacuggauugccgcaagcaucauccuggaauucuuccuaaugguccuuuugaucccagaacccgaucgccagagaaccccccaggacaaccaacuggcguacgugguaauaggacugcuguuuaugauccugaccguugccgccaacgaaaugggccuccuagagaccacgaagaaggaucuugggaucggccacguggccgccgagaaccaucagcacgcgacuaugcuggauguggaucuuaggccggccagcgccuggacccuguacgcgguugccacgaccgugaucaccccgaugaugcgacacaccaucgaaaacacgaccgcgaacauuucccucacagccaucgccaaccaggccgcaauccugaugggccuggacaagggguggcccaucagcaagauggacaucggcgucccccuguuggcacuggggugcuacucgcaagucaacccccucacgcugacggccgccgugcugaugcugguggcacacuaugcgaucaucggcccuggguugcaggcaaaggccacgcgcgaagcccagaagcggaccgccgcuggaaucaugaagaaccccacggucgacggcaucguggccaucgaccuggacccgguggucuaugaugcaaaguuugagaaacagcucgggcagauuaugcuacugauccucugcacgucgcaaaucuuacugaugcgcaccaccugggcguugugcgaguccaucacccuggcgacgggcccgcugaccaccuuaugggagggaucccccgggaaguucuggaauacaacgauugcgguuaguauggccaacauuuuccgcggcagcuaccuggcuggggccggccuggccuucagucucaugaaaucacucgguggcgggcggcgcgguacaggcgcgcagggggagacacugggggagaaguggaagcggcagcugaaucaguuguccaagagugaguucaacaccuacaagcgcucuggcauaauggagguggaccggucugaggccaaggagggccuuaagcgcggggagacgacuaagcacgccgugagccggggcaccgccaagcucagaugguuuguggagaggaauuuggucaagcccgaggggaagguaauugaccucggauguggucgggggggcugguccuauuacugugcuggacugaagaaggucacggaaguaaagggcuacaccaagggcgggcccggccacgaggagcccauucccauggccacguacggguggaaucucgugaaguugcacucaggcaaagacguguuuuucaugccucccgagaaaugcgacacccugcuuugcgacauuggcgaguccagcccgaaccccacgaucgaggaggguagaacccugcgcguccuuaagaugguugaaccguggcuccggggcaaccaguuuugcaucaagauucugaacccuuacaugccgucagugguagagacgcuggagcagaugcagcgcaagcacgggggcaugcucgugcguaacccccugagucgaaacuccacucaugagauguacugggugagcugcgggaccggcaacaucguauccgccgucaacaugaccagccgcaugcugcucaaucgcuucaccauggcucaccggaagcccaccuacgagcgcgacguagaccuuggcgccggcacccgacauguggcggucgaaccugagguggccaaucuggauauuaucggccagagaaucgagaacauaaaaaacgaacauaagucuaccuggcacuaugacgaggacaacccuuacaagacgugggccuaccacggaucguacgaggugaagcccucaggcagcgccaguagcaugguaaacggaguggugcgccuccugaccaagccgugggauguaauaccaauggugacccagaucgccaugaccgacacgacgccguucggccagcagcgcgucuucaaggagaagguugacacccgcacgccccgggcgaaacgcggcacggcccagaucauggaggugaccgccaaguggcuguggggguuccuaucacggaacaagaagccccguauaugcacccgggaggaguucacacgcaagguacggagcaacgcugcgaucggcgcgguguuuguggaugagaaucaguggaauagcgccaaggaggcuguggaggacgagcguuucugggaccuggugcaccgggagcgcgagcugcacaagcaggggaagugcgccacguguguguacaauaugaugggcaagcgggagaagaagcucggagaguucggcaaggcaaaaggcucccgcgcaaucugguacauguggcugggggcccguuucuuagaguucgaggcccuaggcuucaugaacgaggaccauugguucagccgcgagaacuccuuaagcggggucgagggcgagggguuacacaagcucggcuacauccuacgagacaucucgaagaucccgggcgggaacauguaugccgacgacaccgcgggcugggacacccgcaucacugaagacgaccugcagaacgaggcuaagaucacagacaucauggagcccgagcacgcccucuuggcaacauccauuuucaaguugaccuaucaaaacaaaguggugcggguccagcgccccgccaagaacggaaccguuauggacgugaucucccgccgugaccagcgcggcaguggccaggucgggaccuacggcuuaaacaccuucaccaacauggaggugcagcugauccgucagauggaguccgaggggaucuuccugcccucggagcucgagaccccgaauuuggcggagagggugcuggacuggcuagagaagcacggcgcagagcgccugaagcgcauggcgaucucuggcgaugacugcguagugaagcccauugaugacagauucgccacugcccugaucgcacucaacgacaugggcaaggugcgcaaggacaucccccagugggagcccagcaaaggcuggaaugacuggcagcaggucccguucuguucccaccacuuccaucagcugauaaugaaggacgggcgggaaauaguagucccaugucgcaaccaggacgagcuggucggcagagcccgaguaagccagggggcuggcuggucccucagagagaccgcuugccugggcaagagcuaugcccagauguggcagcugauguacuuucaccgccgcgaccuccgccuggcggcuaaugccaucugcuccgcugugcccgucgacugggugccuacgucccggaccacauggagcauccacgcgcaccaccaauggaugacgacggaagacaugcuguccguguggaaucgcgucuggauagaagagaacccguggauggaggacaaaacccacgugagcuccugggaagaggugcccuaccucggcaagcgggaagaucaguggugcgggagccugaucggccugaccgcccgcgccacaugggcgaccaacauacagguugccauuaaucaggugcgucgcuugauugggaacgagaacuaccuggacuacaugaccaguaugaagcgcuucaagaacgagagugacccugagggggcucugugg

SEQ ID NO: 24775 - RNA, 9876 nt, Artificial Sequence
  derived and/or modified CDS sequence (opt11) from DENV-1__KF672762__SS-prME
uccgugaccaugcuucucaugcugcugccgacggcccucgccuuccaucugaccacucgcgggggcgagccgcacaugaucguaucuaagcaagagagaggcaagagccuccucuucaagaccagcgcaggggugaacaugugcacauugaucgccauggaucugggagagcuaugcgaggauaccaugaccuacaagugcccccggaucaccgaggccgagcccgaugacguggacugcuggugcaacgcgaccgauaccugggucaccuacgguaccuguucucaaacuggcgagcaccggcgcgauaagagguccguggcccuggcgccccacgugggccucggucucgagacgagaaccgagaccuggaugagcuccgaaggcgcuuggaaacagauucaaaaagucgagacuugggccuuacggcaccccggguucacgguaauagcccuguuccucgcgcaugccaucggcacaagcaucacccagaaggggaucaucuucauccugcugaugcucgugaccccuuccauggcaaugcgcugcguugggauaggcaacagagacuucguggagggucugucgggugccaccuggguggacgucgugcuagagcacggguccugcguaaccaccauggccaagaauaagcccacccucgacaucgagcugcucaaaacggaggucaccaaccccgcgguucuccgcaagcugugcaucgaggcuaagaucuccaacaccacuacagauucucggugcccuacccaaggcgaggccacccugguggaagaacaggacgccaacuucgucugucgcaggaccuucguggauagagggugggggaacgguugcggcuuauucggaaaggggagccugcuuacgugugccaaauuuaaaugcguuaccaaguuggagggaaagaucguccaguacgagaaccugaaguacuccguaaucgugaccguacacaccggcgaucagcaccaaguggggaacgagacgaccgagcacgggacuauugcgaccaucacgccccaagccccuacguccgagauacaacugacugacuacggggcccucacccuggacugcaguccccggacuggccuggauuucaacgagaugguccuccugacuaugaaagagaaguccuggcugguccacaagcagugguucuuggaccugccguuacccuggaccaguggcgccagcaccucccaggagaccuggaaucgccaggaccuccuggugacauucaagaccgcccacgcgaagaagcaagagguaguggugcugggcucccaagagggcgcuaugcacacggcacucacgggggcgacagagauacagaccagcggcacuacuacgaucuucgccgggcaccugaagugucggcuaaaaauggacaagcuuacacugaagggcaccuccuacgucauguguacaggaagcuucaagcuggaaaaggagguggcggagacccagcacggcacaguccugguccaggugaaguaugagggcauugaugcuccuugcaagauccccuuuucgacccaagacgagaaaggagugacucagaacggccgccucaucacugcaaauccgaucgucacugacaaggagaagccggugaauaucgaaaccgagccgcccuuuggggagagcuacaucguggucggcgcaggcgagaaggcguuaaaacuguccugguucaagaaggggaguuccaucggcaagauguucgaggccaccgcccgcggagcccgccgcauggccauccucggugacacggcgugggauuucgggucuaucggggggguguucacaagcgugggaaagcugguccaccagguuuugggcacagccuacgggguucuguucagcggcgucucuuggaccaugaagaucgggaucggcauucugcugacgugguugggccugaacagccguucuaccucccuguccaugacguguaucgccguggggauggugacccucuauuuaggcgucauggugcaagccgacucagggugcgugaucaauuggaagggacgggaguugaaguguggguccggaaucuucguaacuaaugaggugcacaccuggaccgaacaguacaaguuccaggcagacagcccgaagcggcucagcgcugcgauaggcaaggccugggaggaaggggugugcggcauccgcuccgcuacccgucuggagaacaucauguggaagcaaaucagcaacgaguugaaucacauccuacuggagaaugacaugaaguucaccguuguaguuggggacgccaauggcauccuggcgcaggggaaaaagaugauccgcccacagcccauggaacacaaguacucuuggaaguccuggggcaaggccaagauuaucggcgccgacauacaaaauacaacuuucaucaucgacggcccugacaccccggagugcccggaugagcagcgagccuggaacaucugggagguggaggacuacggguucgggauuuucacaacgaauaucuggcucaaacugcgggacaguuacacgcagaugugcgaccaccggcucaugagcgcagccauuaaggacagcaaggccgugcacgccgacaugggcuacuggaucgagucagagaagaacgagacguggaagcucgcgcgcgcgucguucaucgaggugaagaccugcauauggccgaagagccacacgcugugguccaauggcguccuagagagcgagaugaucauccccaagaucuacgggggcccgaucucacaacauaacuacaggcccggguauuucacccaaacugccggccccuggcaccugggaaagcuggaguuggacuucgaucucugcgagggaaccacggugguggucgacgaacacuguggcaacagagggccgagcuugagaaccaccaccguuacggggaagaucauccacgaguggugcugucgcuccugcacccugccucccuugcgguuuaggggggaggacgguugcugguacgggauggaaauccggccggucaaagagaaggaagagaaccuaguccguaguauggugucggccggaagcggggagguggacucuuucucccuggguauccucugcguaucuaucaugauagaagaagugaugcggagccgcuggagucggaagaugcugaugaccggaacucuggcuguguuuuuacugcugaucaugggacaacucacguggaacgaucugauccggcugugcaucaugguaggggcaaacgcuuccgacaagauggggaugggcaccacuuaccucgcccugauggccacauuuaagaugcgcccaauguucgccguaggguugcucuuccggcgccugacgagcagagaggugcugcuccugacgauuggguugucccuagucgcgucugucgaacugcccaacucccuggaagagcucggagauggccuggcgaugggcaucaugaugcugaagcucuugaccgaguuccagccccaccagcuguggaccacgcuguuaagccugaccuucaucaagacuacgcucucccuggacuacgccuggaagacgaccgccaugguucugaguaucgugucccuauucccucugugcuuaagcaccaccucgcagaagacgaccuggcucccgguccugcuuggcagcuucgggugcaaaccccuaacaauguuccugauaaccgagaauaagaucuggggaaggaagucauggccccugaacgaggggauaauggccaucggcaucgucucaauccucuuaucuagccuacucaagaaugacgugccacuggcagggccgcugaucgccggcggcaugcucaucgccugcuacguuauuuccggcagcagcgcagacuuaucccuagagaaggccgcggagguuagcugggaggaggaagccgaacacuccggcacuagccacaacaucuugguagaagugcaggacgaugggacgaugaagaucaaggacgaggagcgggaugacacccugacgaucuuacucaaggccacccugcuagccguuucgggaguguacccuaugucuauucccgcgacgcucuucgugugguacuucuggcagaaaaagaagcaacgcuccgguguccugugggacaccccuagcccacccgaaguggagcgggccguguuggacgacggcauuuaccggauccugcagcggggucucuuggggcgaucccaggugggugugggcguguuucaggacggcgucuuccacaccauguggcacgugacgcgcggcgccgugcuaauguaucagggcaagcgccucgagcccagcugggccuccguaaagaaagaccugaucucuuacggcgggggcuggcgguuccaaggcucauggaacacgggcgaggagguccaggugaucgccgucgaacccgggaagaaccccaagaacguccagaccaccccaggcacauuuaagacgcccgagggcgaggucggggccauagcccuagauuuuaagccagguaccucagggucccccaucgucaaucgcgaaggcaaaaucguaggccucuacgggaacggaguggucaccaccagcgggacguacguguccgccaucgcccaggccaaggccucccaggagggcccccuaccagagaucgaggacgagguguucaagaagcggaaccugaccaucauggauuuacacccgggcucggguaagacccgccgguaccuaccagcaaucgugcgcgaagccaucaaacgcaaacugcgcaccuugauccuggcccccacccgggucguggccagcgagauggcugaggcucugaaggguaugcccauccgcuaccagacaaccgccguuaaaagcgagcacaccgggcgcgagauuguggaucucaugugccacgccacguucaccaugcggcuccuguccccgguucgcgucccaaacuacaauaugaucaucauggaugaagcccacuucaccgaccccgcaagcaucgccgcccggggguacaucucaaccagggugggaaugggcgaggccgcugcgauuuucaugacggccacgccgcccgggagcguggaagccuucccacagucaaacgccgucauccaggaugaggagcgggauauccccgagcgcagcuggaauucaggcuacgacuggauaaccgauuuccccggacggacugugugguucgugcccagcaucaaguccggcaacgacaucgccaacugccuccgcaagaacgguaagcggguaauacagcugucacggaaaacguucgauaccgaguaccagaagacaaagaacaaugacugggacuacguggucaccacggacaucuccgagaugggcgcgaacuuucgagcagaccggguuaucgacccccgccgcugccugaagccggucauccucaaggauggccccgagcgggugauacuggcggggccaaugccagugacuguagcgagcgcugcacaacgccggggcagaaucggcaggaaccaaaacaaggagggggaccaguacguuuacaugggucagccccugaacaaugacgaggaccacgcccauuggaccgaggccaagaugcuccucgauaacauuaacacccccgaggggaucauuccggcccuguucgaaccagagagggaaaaaucggcggcaauugacggagaauaccgccuccggggagaggcacgcaaaacguuuguggagcugaugcggcgaggcgaccuucccguguggcucucauacaagguugccuccgaggguuuccaguauuccgaucggcgcuggugcuucgacggugagcggaacaaccaggugcuugaggagaauauggacguggagauuuggacuaaggagggugagcgcaagaagcuccggccccgguggcucgacgcccgcacuuacucugauccucuggcgcugcgugaauucaaagaguuugccgcagggcggcggagcgucagcggcgaccucauccuugagaucggcaaacugccccagcaccucacccugcgggcgcagaacgcgcuggacaaccuggugaugcugcacaacagugaacagggcggaaaggcguaccgccaugcuauggaggaacuccccgacaccauagaaacucucaugcugcuggcccucaucgccguguuaaccgggggcguuacccucuucuuccuauccgggaagggcuuaggcaagacgucaauaggucugcucugcgugacggcgaguuccgcuuugcuguggauggccagcgucgagccccacuggauugccgccuccaucauccucgaguucuuccugaugguccugcucaucccggagcccgaccggcagcguacgccgcaagacaaccagcucgcguauguggugauuggccuccuauucaugauccugaccgucgcggccaacgagauggggcuguuagaaaccaccaaaaaggacuugggcauugggcacguggccgccgagaaccaccagcacgcgaccaugcuggacguggauuuacggccggccuccgccuggacgcuguacgccgucgccaccacggugauuacgcccaugaugcgucacacgaucgagaacaccaccgcgaauaucagucugaccgccauugcaaaccaagccgccauucuuaugggccucgacaagggcuggcccaucagcaaaauggacaucggggugccccugcucgcccugggaugcuacagucaaguaaacccccuaacgcucaccgccgccgugcugaugcugguggcccacuaugccaucaucggacccggcuuacaggccaaagcaacgcgggaggcccagaagcgcacagccgcggggaucaugaagaaccccaccgucgacgguaucguggccauugauuuggaucccguggucuaugacgcuaaguucgaaaagcaacuaggucagaucauguuguuaauauuaugcacuagucagauccuccugaugcgcacgaccugggcccugugcgaguccaucacccucgccaccgggccgcugacgacccugugggaaggcucgcccgguaaguucuggaacacuaccaucgcgguguccauggcgaauauuuuccgggggucauaccuggccggcgcggggcuggccuucaguuugaugaagucccucggaggggggagaagagggaccggcgcgcaaggcgagacccugggggagaaguggaaacgccagcugaaccaacucuccaaguccgaguucaacaccuauaagaggagcgguaucauggagguugaccguagugaggccaaggagggauuaaagagaggcgaaaccacgaaacacgcggucagucggggaaccgcgaagcugcgaugguucguggagcgcaaucuggucaagcccgagggcaaggucaucgaccucgggugugggcgaggugggugguccuacuacugugcuggccugaaaaaggugaccgaaguuaagggguacacgaaggguggcccugggcacgaggagccgaucccuauggccaccuacggguggaaccuuguaaagcuccacagcggcaaagacguguucuucaugccgccggaaaagugugacacgcugcuuugcgacaucggcgagagcucgccgaaccccacgaucgaggaggggcguacacuucgggugcugaagaugguugagcccuggcugcgcggcaaccaguucuguauuaagauccucaacccauacaugccguccguaguggagacccuggaacagaugcagagaaagcaugggggcaugcugguccgcaacccccucagccggaacuccacgcacgagauguauugggugagcugcgguacggggaacaucguguccgccgugaacaugacgagccgcaugcuccugaaccgguucaccauggcccaccgcaagccuacuuacgaacgcgauguggaccucggcgccgguacccgccauguugcggucgagcccgaaguggccaaccuggacauuaucgggcagcgcauagagaauaucaaaaacgagcacaaauccaccuggcacuacgacgaagauaacccauacaagacaugggccuaccauggcagcuacgaggugaagcccucgggguccgccuccagcauggucaacgggguaguccggcugcuaacaaagcccugggacgucauacccauggugacucaaaucgccaugaccgacaccacgccguucgggcagcagcgcgucuuuaaggagaagguagauacccggacuccccgggccaagcggggaaccgcgcaaaucauggaggucacggccaaguggcuguggggcuuccugucccgcaacaagaagccccgaaucugcacccgcgaggaauucaccagaaagguacgcucgaacgcagccauuggcgcagucuucguggacgagaaccaguggaacagcgccaaagaggcaguggaggacgaacgguucugggaccucgugcaccgcgaacgggaacuccauaagcagggcaaaugcgcgacaugcguguacaacaugauggggaaacgcgagaagaaacugggagaguucgggaaggcgaagggcucacgagcaaucugguacauguggcucggcgcacgcuuccuugaguucgaggcccuggguuuuaugaaugaggaccacugguucucgcgcgagaacagucucagcggugucgagggggaaggacugcacaagcugggguauauacuaagggacaucucgaagauaccgggcgguaacauguacgcagacgacacggccgggugggacacccggaucacagaggacgaucugcagaacgaggccaagauuaccgacauaauggagcccgagcaugccuuacucgcgacgagcaucuucaagcugaccuaccaaaauaagguggugcgaguccagcggccugccaagaauggcaccgugauggaugugaucucacggcgcgaccagcgggggagcggccaggucggaacguacggucugaacacguuuacaaacauggaagugcagcucauucggcagauggagucggagggcaucuuccugcccuccgagcuugagacuccaaaccucgccgagcggguucuggacugguuggaaaagcacggggccgagcgccucaaacgcauggcuaucuccggcgacgauugcguagucaaaccuaucgaugaccgcuuugccacggcucucaucgcuuuaaacgacauggggaaaguuaggaaggacaucccccaaugggagcccucgaagggguggaacgacuggcagcagguaccguuuugcucccaccacuuccaccagcucauuaugaaggacggccgugagaucguggugcccugccgcaaccaggacgaguuagucgggcgggcccggguuagccagggugccggguggucccugcgcgagacggccugccucggcaagagcuacgcucagauguggcagcugauguacuuccaccggcgcgaccuucggcucgccgccaaugcaauuuguuccgccguccccauagacuggguacccacuucucgcaccaccuggagcauccacgcgcaccaccaauggaugacaacggaggacaugcuguccguuuggaacagaguguggaucgaggagaacccguggauggaggauaaggcucacgucuccaguugggaggaggugccauaucuggggaagcgcgaggaucaguggugcggcagccuaaucggccugaccgcccgcgccacgugggccaccaacauccaaguagcuaucaaccaggucagaagacucaucgggaacgagaacuaccucgauuauaugacuuccaugaagcgguucaagaacgagucagaccccgagggcgcgcugugg

SEQ ID NO: 24776 - RNA, 9879 nt, Artificial Sequence
  derived and/or modified CDS sequence (opt11) from DENV-1__JF459993__SS-prME
agcgugaccaugcuguucaugcuccugcccacuagccuggccuuccaccucacaacccggggcggcgagccgcauaugaucgugaguaagcaagagcgaggcaaauccuuacucuucaagacuagcgccggggugaacaugugcacccuaaucgccauggaccugggcgagcugugcgaggacaccaugaccuacaagugcccgcgcaucacggagaccgagcccgacgacguggauuguuggugcaaugccacggagaccugggugaccuacgguaccugcucccagacgggcgagcaccgacgcgauaaacggagcguggcccucgcgccccaugugggccugggucuggagacccggacugagacguggaugaguagcgagggcgccuggaagcagauacagaaaguggagacgugggcgcucgggcaccccggcuucacgguuauagcccuguuccuggcccaugccauagggaccuccaucacgcagaagggcauuaucuucauacuccugaugcuggugacccccagcauggcgaugcggugugucggcaucggaaaccgcgacuucguggaaggccucuccggggccaccuggguggacgucguacuggagcacggcagcugugucacuaccauggcuaaggacaagccuacgcuggauauugaacuccugaagaccgaggucacuaaccccgcaauccugcgcaagcucuguaucgaggccaagaucuccaacaccacaaccgauagccgcugcccgacccagggggaggcgacccugguggaggagcaggacacgaacuuugugugccggcgcaccuucgucgaccggggguggggcaacgggugcggccuguucggaaaggggucccucaucacgugugccaaguucaagugcguuacuaagcuggagggcaagaucgugcaguacgagaaccugaaguacagcgucauagugaccgugcacaccggagaccagcaccaggucggcaaugagaccaccgagcacgggaccacggccaccaucacgccccaggccccgacauccgagauccaguugacggacuacggcgcucucacccuggacugcagcccccgcaccgggcucgacuucaacgagauggugcugcugacaaugaaggagaaguccuggcucguucacaagcagugguuccuggaucugccucucccuuggacgagcggggcgagcaccucccaggagaccuggaaccggcaggaucugcuggugaccuuuaagacggcccacgccaagaaacaggaggugguaguucucggcagccaggagggugccaugcacaccgcccugaccggcgcgaccgagauccagacauccgggaccacgaccaucuucgccggucaccugaagugccgccucaagauggacaagcuaacgcugaagggugucucguacgucaugugcaccggcuccuucaagcucgagaaggagguugccgagacccagcauggcaccguguugguccaggugaaauacgaagggacggacgccccuugcaaaaucccauucagcucccaggacgagaaggggguaauccagaacgggcggcugaucacggccaacccgaucgucacggacaaggagaagcccgugaacaucgaggcggagccgcccuucggggagagcuacauuguagucggcgccggggagaaggccuugaaacuuuccugguucaagaaggguucgucaaucgggaagauguucgaggcgaccgcgcggggcgcccgucgcauggcaauccugggggauacggcuugggacuucgggagcaucggcgggguuuuuaccagugugggcaaacugguacaccagaucuucgggaccgccuacggcguacuguucucggggguguccuggaccaugaagauaggcaucggcauccugcugacguggcucgggcucaacucuaggucaaccagccuguccaugacaugcaucgcggucggcaugguuacccucuaccugggggugaugguccaagccgacagcggcuguguuaucaacuggaaggggcgagaguuaaagugcggcuccggcaucuucgucaccaacgagguacacaccuggaccgagcaguacaaguuccaggccgacuccccgaaacggcucagcgccgccaucgggaaagcgugggaggagggagugugcgguaucagguccgccacccgccuagagaacaucauguggaagcagaucucaaacgagcuaaaccacauccuccuggagaacgacaugaaguucaccguggucgugggugacguggcagggauccuggcccagggcaagaagaugauucggccccagccaauggaguauaaauacuccuggaagucauggggaaaggccaagauaaucggggcggacguccagaacgccacauucaucaucgacggccccaacaccccggagugccccgacgaccaacgcgcguggaacaucugggagguggaggacuacggguucgggaucuucaccaccaacaucugguugaaacugcgggacuccuacacucaagugugcgaccaccggcugaugucagccgcgaucaaggauuccaaagccguccacgccgacaugggcuauuggaucgagagcgagaaaaacgagaccuggaagcucgcccgagcuucguucaucgaggucaagaccugcguguggccuaagagccacacccucugguccaacgggguccuggagagcgagaugauaauacccaagaucuauggcggucccauaucccagcacaaccaccgccccgguuacuucacgcagacagcggggcccuggcaccucgguaagcuggagcuggacuuugaccucugcgaagggaccaccguggucgucgacgagcacugcgggaaccgaggcccgagccugagaacaaccaccguuaccgggaagaucauccacgaguggugcugcagguccugcaccuugccgccccucagguucagaggggaagacgggugcugguacggcauggagauccgcccagugaaggagaaggaggaaaaucugguaaagagcauggucagcgcgggcuccggggagguggacagcuuuucccugggccuccugugcaucucuaucaugauugaggaggucaugcggucccgcuggucucggaaaaugcugaugacugggacccucgccguguucuuccugcugaucaugggucagcucacuuggaacgaccugauccgccugugcaucauggugggggccaacgccucagaucggaugggcauggguacuaccuaccucgcgcucauggccaccuuuaagaugcgcccgauguuugccgucgggcuccuguuccggagacuaaccucuagagaggugcuccuccugacgaucggccugucccugguggcaagcguggagcugcccaacagucuggaggagcuaggggacggccuggccaugggcaucaugauccuaaagcuccugaccgacuuccagagccaccaacugugggcaacccuccugucccugaccuuuaucaaaacaaccuucucgcuccacuacgccuggaagacuauggccauggugcuaucaaucgucagccuguucccccucugccugagcaccacgucacagaagaccacauggcugcccgugcuccugggcuccuuaggcugcaagccgcucaccauguuccugaucgccgagaauaaaaucugggggcgcaagucuuggccccugaacgagggcaucauggcggucgguaucguuagcauccuccuguccagccuccucaagaacgacgugccacuggccggcccccugaucgccggcgggaugcucauagcguguuacgugaucuccggcuccucugcggaccugucccuggagaaggcagccgaggucaguugggaggaggaggccgagcauucuggggcaucccacaauauucucguggagguacaagacgacggcacaaugaagaucaaggacgaggagcgggacgacacccugaccauuuugcucaaggccacccuguuagccgucagcgggguguacccgcucuccauccccgcgaccuuguucgugugguacuucuggcaaaagaagaagcagcggagcggcguacuuugggacacgcccagcccucccgaaguagaacgcgcgguacuggacgacggcaucuaccggaucaugcagcgcgggcugcugggccggucccaggucggcgugggcguauuccaggagaacgucuuccacaccauguggcacgugaccagaggggccgugcugauguaccagggcaagagacucgagccauccugggccagcgucaagaaggaccugaucuccuacggcgggggcuggagacugcagggaagcuggaacaccggcgaggagguccaggugaucgccgucgagcccggcaagaaccccaaaaaugugcagacggcccccggaaccuucaagacccccgagggcgaaguuggagcuaucgcccucgauuucaagcccggaaccaguggcagcccgaucgucaaucgggagggcaagaucgugggcuuauacgggaacgggguggucacgaccagcgggacguauguguccgcuaucgcgcaggcaaaggccucgcaagagggcccgcugcccgagaucgaggacgaggucuuccgcaagcggaaccucaccaucauggaccuccaccccggauccggcaagacgcgccgguaccugccggccaucguccgcgaggcgaucaagcggaagcuccgcacccugauccuagcccccaccagggugguggcgagcgagauggcugaggcccuaaagggcaugcccauccguuaccagaccacggcggucaaauccgagcacaccgggaaggagaucguggaucugaugugccacgccaccuuuaccaugcgccugcucucgcccgugcgggucccgaacuacaauaugauaaucauggacgaggcccacuucacggacccguccagcauugccgcgcgcggcuacaucuccacccggguggggaugggcgaggcggcggccaucuucaugaccgccacgccgcccgggagcguggaagcguucccgcaguccaacgcugucauccaggacgaggagcgggacauaccugagcggagcuggaacuccggcuacgaguggaucacggacuuucccggcaagaccgucugguucgugcccagcaucaagucgggaaacgacaucgccaacugucugcgcaagaacggcaaaaggguaauacagcugagccguaagaccuucgacaccgaguaccagaaaacgaagaacaacgacugggacuacgucgugaccaccgacaucuccgagaugggggccaacuuccgggccgaucgcgucaucgacccgcgucgaugccucaagccugugauccucaaggacggcccggaacgggucauccuagcgggacccaugccugugaccguggccagcgccgcucagcgccgcggacgcaucggccggaaccacaauaaggagggugaccaauacaucuacaugggccagccccucaacaacgacgaggaucacgcccacuggacggaggcgaagaugcuguuagauaacaucaauacccccgaggggaucaucccagcccucuucgagccggagcgcgagaaguccgccgccauagacggcgaguaccggcugcgcggggaggccagaaagaccuucgucgagcugaugcggcgcggcgaucuucccguguggcugaguuacaaaguggcgagcgaaggcuuccaguacucugaccggcgcuggugcuucgacggcgagcggaacaaccaaguccuggaggagaacauggacguggagaucuggaccaaggagggugagaggaagaagcugcggccccgcuggcuggacgcccggacuuacuccgacccccuggcucuccgcgaguucaaggaguucgccgccgggcggcgcagugucucaggcgaccugauccuggagauaggcaagcucccgcagcaccugacucagcgagcccagaacgcccuggacaaccucgucaugcugcacaauuccgagcagggcgggcgagccuaccggcacgcucuggaggaacuccccgacaccaucgagacccugaugcugcuagcgcugaucgccgugcugaccgggggcguuacccucuucuuccugagcgggcgcggccuggguaagaccuccauuggguugcuuugcgucauggccagcuccgcccugcuguggauggccagcgucgaaccccacuggaucgcggccuccaucauccuggaguucuuccugaugguccuucucauccccgagccggaucggcagcgcacuccccaggacaaccagcuggccuaugucgugaucggucuccuguucaugauccugaccguggccgccaacgaaaugggcuugcuggaaaccaccaagaaggaccugggcauugggcacgucgcuguggaaaaccaucaccacgccagcaugcucgauguggacuuacaccccgccucggccuggacgcucuacgccgucgcuaccacgaucaucaccccgaugaugcggcacaccauagagaacacuacggccaacaucucccucaccgcgaucgccaaccaggccgcaauccugaugggccuggacaagggcuggccgaucuccaagauggacauuggggugccccuccuggcccugggcuguuacagccaggugaacccccucacccucaccgccgccguccugaugcuagucgcgcacuacgccaucaucgggcccggccugcaggccaaggcgacgcgggaggcccagaagcggacagcggccgggaucaugaagaaccccacggucgacggcauagucgcuaucgaccuggaccccgugguguacgacgccaaguucgagaagcaacucggccagaucaugcugcugauccuaugcacgucccagauccuucugaugcggacgacaugggcccucugcgagagcauaacccuggcaaccgggccccugacgacguugugggaaggcuccccggggaaguuuuggaacaccacuaucgccgucuccauggccaacaucuuucgcggcagcuaccuggccggcgccggguuagcguucuccuuaaugaaaucccugggcgggggccggcgcgggacgggcgcucagggcgagacgcugggagagaaguggaagcgucagcugaaccagcuguccaagucagaguucaauaccuauaaacgcuccggcaucauggaaguggauaggagcgaggcuaaggaggggcugaagcgcggcgagaccacgaaacacgccgugucccgggggaccgcgaaauuacgcugguucgucgaacggaaccugguuaagcccgagggcaagguaaucgaccuggggugcgggcgcggcggguggagcuacuacugcgccggccugaagaaggucacagaggucaagggguacaccaagggcggcccggggcacgaggagcccaucccuauggccacguacggcuggaaucucgugaagcugcacuccgggaaggacgucuucuuuaucccgcccgagaagugcgacacccugcuuugcgauaucggcgagagcucccccaaucccaccauagaagaggggcggacccugcgcguucuuaagaugguggaacccuggcuacggggcaaccaauucugcaucaagauucugaacccguacaugcccagcgucgucgaaacguuagagcagaugcagcgcaagcacggcgggaugcucgugaggaacccacugucccggaacagcacccacgaaauguauugggucuccugcggaaccgggaacaucgugagcgcggugaacaugacgucccggaugcugcucaaccgcuucacuauggcccaucggaagcccacauacgagcgcgaugucgaucugggcgcuggaacucgccacguggccguggagcccgaggucgccaaccuggacaucaucggucaacggaucgagaacauaaagcacgagcacaagagcaccuggcauuacgacgaggacaacccguacaagacaugggccuaucauggcucauacgaaguaaagccgucgggguccgcauccagcaugguuaacggaguggugaagcuccugacaaagcccugggaugucaucccgauggugacccagaucgcuaugaccgacaccacgccauucggccagcagcgcguguucaaggagaagguagacacccggaccccgaaggccaagcgcgguaccgcacagaucauggaggugacggcaagauggcuguggggcuuucucucgcgcaauaagaagccccggaucugcacccgcgaggaguucacgcggaaggugcguagcaacgccgcgauaggggccgucuucguggacgaaaaccaguggaacuccgccaaagaggccgucgaggacgagcgguucugggaccugguccaccgcgagcgggagcugcacaagcaaggcaagugcgcgaccugcguguacaacaugauggggaaaagagagaagaaacucggcgaguucggcaaggccaagggcagccgcgccaucugguauauguggcugggcgcacgcuuccuggaguucgaggcccucggguucaugaacgaggaccacugguuuucccgggaaaauuccuuauccggaguggagggugagggccugcacaaacucggcuacaucuuacgggacaucucuaaaauccccggcggcaacauguacgcagacgacacggcugggugggauacccggaucaccgaggacgaccugcagaacgaggccaagaucaccgacaucauggagccggagcacgcccugcuggccaaguccaucuucaagcugacguaccagaacaaggucguacgcgugcagcggcccgcgaaaaacgggaccgucauggacgugaucucccgccgcgaccagcggggguccggacaggugggaaccuacgggcuuaauaccuucacgaacauggaggcccaacucauccgucagauggaaagugaggagaucuucucccccagcgagcuggagacccccaaccucgcugaacgcguccuggacuggcuggagaaauacggcguugaacgccucaagcggauggccaucucaggggacgacugcgugguaaagccgaucgaugaccgauucgccaccgcgcugaccgcccugaacgacaugggcaaagucaggaaggacaucccccagugggagcccagcaagggguggaacgacuggcagcaggucccuuuuugcagccaccacuuccaucagcucaucaugaaggacggccgcgaggucguggugcccugcagaaaccaagacgaacuggucggccgcgcccgugugucccagggggccggcuggagccugcgcgagacggccugccucggaaaaucguacgcucagauguggcaguugauguacuuccaucggcgcgaccuaaggcucgcagcaaacgccauuuguagcgcggugcccguggacugggugcccaccucccguaccaccuggagcauucacgcgcaucaccaguggaugacgaccgaggacaugcuguccguguggaaccggguauggaucgaggagaaccccuggauggaggacaagacucauguuagcuccugggaggacgugccguaccugggcaagcgcgaggaccaauggugcgguagccucaucggccugaccgcccgggccacgugggccaccaacauccaagucgcuauuaaccaagugaggcgccucaucgggaacgagaacuaccucgacuacaugaccuccaugaagcgguucaagaacgagagugaccccgaaggggcacugugguga

SEQ ID NO: 24777 - RNA, 9876 nt, Artificial Sequence
  derived and/or modified CDS sequence (opt11) from DENV-1__KF672763__SS-prME
agcgucaccaugcugcucauguugcugcccacugcccucgccuuccaccugaccacccggggcggggaaccgcacaugaucguuucuaagcaggagcggggcaagagcuugcuguucaagacaucugcgggggugaacaugugcacccugaucgccauggacuugggcgagcuuugcgaggauaccaugaccuacaagugcccccggaucaccgaggccgagcccgacgauguggauugcuggugcaacgccaccgacacuugggugaccuauggaacauguagccagaccggcgagcaccggcgggacaagcguuccguugcucucgcgccucacgugggucugggguuagagacgcggaccgagaccuggaugaguuccgagggcgccuggaagcaaauucagaaggucgagaccugggccuuacggcaccccggguucaccgugauagcacuguuccucgcgcacgccaucgggacgagcaucacgcagaaggggaucaucuuuauccuacuuaugcuugugacucccuccauggcgaugcggugcgugggcaucggaaaccgggacuucguggaggggcugagcggcgccacguggguggacgucgugcuggagcacgguuccugcgugaccacuauggccaagaacaagccgacccucgauaucgagcugcugaagacggaggucacuaaccccgcugugcuccgcaaguugugcauugaggcgaaaaucucgaacaccacuacggacucccggugcccgacccagggcgaagccacccugguggaggagcaggaugccaacuucgucugccgccggaccuucguggaccgcggcugggggaacggcugcggucucuucgguaaaggaagccugcugacgugugcuaaguucaagugugugaccaagcucgagggcaagaucguccaguacgaaaaccugaaguauuccguaaucgugaccgugcacaccggcgaccagcaccagguggggaaugagacaaccgagcacggcaccaucgcaaccaucacgccccaagccccgaccagcgagauccaacucaccgauuacggggcgcucacacuggauugcagcccccggaccggccuggacuucaacgagauggugcucuugacgaugaaagagaaguccuggcuggugcacaagcagugguuccucgaccugccgcugcccuggaccuccggggccucgaccagccaggagaccuggaaccgccaggaccuccuggugacguucaaaaccgcccacgcuaagaagcaggaggucguggugcugggcucccaggaaggcgccaugcacaccgccuugaccggggccacggagauccagaccagcggaaccaccacgauuuucgccggacaccuuaagugccggcugaagauggacaagcucacucugaaggguaccuccuacguaaugugcaccgggucuuuuaagcuggagaaggagguggcggagacccagcacggcaccgugcugguucaggugaaguacgagggcaccgacgcuccgugcaaaauccccuucuccacccaggacgagaagggggugacgcagaaugggcggcugaucaccgccaacccgaucguaacugacaaagagaagcccgugaacaucgagaccgagccuccauuuggggagagcuacaucguggucggcgugggcgagaaggcccugaagcucuccugguucaagaaagguagcuccaucggcaagauguuugaagcgacggcccgcggggcccgccggauggcuauccucggugacaccgccugggacuucgggagcauaggcgguguguucaccuccguggguaaacugguucaccagguguucggaaccgcguacggggugcuguucagcggcguguccuggacgaugaagaucgggaucggcauccuccugaccuggcugggacucaacagccgcucgaccucgcucuccaugaccugcaucgccguggggauggucacgcuguaccucggcgugauggugcaggcggacagcgggugcgucaucaacuggaagggccgcgaacucaagugcgguuccggcaucuuugucaccaacgaggugcacaccuggacagagcaguauaaguuccaggcagacagcccgaagcggcugagcgcugcgaucggccgcgccugggaggagggggucugcggaauccgguccgccacccgccucgagaacauaauguggaagcagaucucaaaugaacugaaccauauccuguuggaaaaugacaucaaguuuaccgugguggucgggaaugccgacggcauccuggcccaggggaagaagaugauccggccucaacccauggagcacaaguacuccuggaaaagcuggggcaaggcgaagaucauuggggccgacauccagaacaccacuuucaucauugacggacccgauaccccggagugccccgacgagcagcgcgccuggaacauaugggagguggaggauuacggcuuugggaucuucacgaccaacaucuggcugaagcucagagacucauacacccaaaugugcgaccaucgcuugaugagcgcugcgaucaaggacuccaaggccgugcaugccgacaugggcuacuggaucgagagcgagaaaaacgagaccuggaagcuggcucgggccuccuucaucgaggucaagacgugcaucuggcccaagucccacacccuaugguccaacggcgugcuugagagcgagaugaucauccccaagauguacgggggcccgaucucccagcacaacuaccgacccggguacuuuacccagaccgcgggucccuggcaccuggggaaguuggagcuggacuucgaucuuugcgagggaaccaccguagucguggaugaacacugcggcucccgggggccaucccugaggacuaccacggugacgggcaagaucauccacgaguggugcugccggagcugcacccugccgccccugcgcuuccgcggggaggacggcuguugguaugggauggagauccgccccgucaaagagaaggaggagaacuuggugcggucaauggugagcgccggcagcggcgagguggacuccuucagccuggggauucuaugcguauccauaaugaucgaggaggugaugcgcagccguuggucaagaaagaugcucaugaccggcacccuggcggucuuccugcuccugaucauggggcaacuaaccuggaacgaccuuauucgccuuugcaucauggucggcgccaacgccagcgacaagaugggaaugggcacaaccuaccuggcgcucauggccacguuuaagaugcggccgauguucgccguggggcugcuguuccgcaggcugaccucccgcgaggugcugcugcucaccaucggacugucucugauggccuccguggagcuccccaacagccuggaagaacugggcgacggccuugccaugggcauaaugaugcucaaacugcucaccgaauuucagccccaccaacuguggacgacacugcucucccugacauucaucaagaccacgcugagccucgacuaugcuuggaagaccaccgccauggugcuguccaucgugagccuguucccccucugccugucgaccaccucccagaagacgaccuggcugccaguccuccugggcuccuucgggugcaagccccugaccauguuccucaucacugagaacgagaucuggggccgaaagagcuggccccucaacgagggcauaauggcuaucggcaucgucuccauccugcucagcagcuuacugaagaacgaugugccccucgccggcccacugaucgcaggcggcaugcuuauagccugcuaugugauuagcgggagcuccgcagaccucagccuggagaaagccgccgaagucaguugggaggaggaggcagagcacuccggcacgucccacaacauccugguggaagugcaggacgacgggaccaugaaaauuaaggacgaagaaagggacgacacccucaccauccugcugaaggcaacgcuacucgcugucagcggcgucuacccgauguccauccccgccacccuguucgugugguacuucuggcagaagaagaagcagcggagcgggguccuaugggauacccccuccccgccagagguggagcgcgccgugcuagacgacggcauuuaccggauacugcagcgcggccugcucgggaggagccaggucggcguggggguguuucaggacggggucuuccacacaauguggcacgugacgagaggggcggugcugauguaccagggcaagcguuuggaaccuuccugggccuccgucaagaaggaccucauauccuacggcgggggcuggcgcuuccaggggagcuggaacaccggcgaggagguacaggugauugccgucgagcccgggaagaauccgaagaacguucagacgacccccggcacuuuuaaaaccccagagggcgaggugggggccaucgcccuggacuuuaagcccggcaccagugggagcccgaucgucaacagagaaggcaagaucgugggucuguaugggaacggcguugucaccacguccgggaccuacguguccgcaaucgcccaggcaaaagccagccaggagggcccccuucccgagaucgaggacgagguguuuaagaagcgcaaccugaccaucauggaccugcauccgggauccggcaagacccggcgcuauuuacccgccaucgucagagaggcgaucaagcgaaagcuccggacgcugauacucgcccccacccgagugguggcgagcgagauggcagaggcgcuaaagggcaugcccauccgauaccagaccaccgccguaaagucugagcacacggggcgggagauaguggaccugaugugccacgccaccuucaccaugcgccuccugagcccgguccggguccccaacuacaacaugauuaucauggaugaggcccacuucacagaucccgccuccaucgcggcccgcggguacaucagcacccggguggggaugggcgaagccgccgcgaucuucaugaccgcgacuccgcccggauccguggaggccuucccccagagcaacgccgucauccaagaugaggagcgcgacauccccgagcgguccuggaacagcgguuacgacuggaucaccgauuuccccggcaagacggugugguucgugcccuccauuaagagcgggaacgacauugcaaacugccugcgcaaaaaugguaaaagagucauccagcuuucccgcaagaccuuugacaccgaauaccagaagacgaagaacaacgacugggacuacguggugacgaccgacaucagugagaugggcgcuaacuuucgggcggaccgcgucaucgacccccgacgcugccugaagcccgugauccuuaaggacggccccgagcgggugauccucgccgggccgaugcccgucaccguggcuuccgccgcgcagcgccggggacgcaucggacggaaccagaacaaggagggcgaucaguacgucuacaugggccagcccuugaacaacgacgaggaccacgcucacuggaccgaggccaaaaugcugcuggacaacauaaacacgcccgaagggauuaucccggcccuguucgagcccgagcgcgagaaguccgccgcgaucgacggcgaguaccgcuugcgcggggaggcccguaagaccuucguggagcugaugcggcgaggugauuuacccguguggcuguccuacaagguugcaagcgagggcuuccaguacuccgacagacgcugguguuucgacggugagcggaacaaccaggugcucgaggagaacauggauguggagauauggaccaaggaaggugaacgcaagaagcugcggccccgguggcucgacgcccggaccuacagcgauccacucgcccugcgagaguucaaggaauuugcggcagggcgccgcagcgucuccggcgaccugauauuggagaucggcaagcugccccagcaccugacccuccgggcgcagaacgcccuggacaaccuggugaugcuccacaacagcgaacagggcgggaaggcauauaggcacgcgauggaggagcugccagacacgauugagacccugaugcuccuagcgcugauagccgugcucaccgggggcgucacccuguuuuuccugucagggaagggucucgguaagacuagcaucgggcugcugugugugacggccuccagcgcucuccuguggauggccuccguggagccucacuggauagccgccaguaucauccuggaguucuuccugaugguccugcugaucccggagcccgacagacagcgcacgccccaggauaaccagcucgcauauguggugauuggccuguuauucaugauccucaccguugcggcgaacgagaugggucugcuggagacgaccaaaaaggaccucgggauagggcacguggccgccgagaaccaccaacacgccaccaugcuggacguagaccugcacccugcauccgccuggacacucuacgccguugccacgaccgugaucacccccaugaugcggcacaccauagagaacacgaccgccaacaucagccugaccgcuaucgccaaucaggccgccauccugaugggccuggacaaaggcuggccuaucuccaagauggaccugggagugccacugcuugcacugggaugcuacagccaggucaacccgcuaacccucacggcagccguccugaugcugguagcccauuacgccaucaucgggcccggccuccaggcgaaggccacccgcgaggcccagaagcggaccgcugcagguaucaugaagaaccccaccaucgacggcaucgucgcaauagaucuggaccccgugguguacgacgccaaguucgagaaacagcugggccagaucaugcuccugauccugugcacuucccagaucuuacugaugcgcaccacaugggcccugugcgagaguaucacacucgccacgggaccacuaaccacacugugggagggcucccccgggaaguuuuggaauaccacgaucgccgucagcauggccaacauauuccgcggcuccuaccucgccggcgccgggcuugcauucagccugaugaaaucccucggcggagggcggcgcgggacgggugcccaaggcgagacucugggggagaaguggaagcggcaacucaaucagcucagcaagagcgaguucaacacguacaagagaagcggcauaauggagguagaccggucagaggcgaaggaagggcucaagcgaggcgagacgacgaagcacgccgugucgcgggggaccgccaagcugcgcugguucgucgagcggaaccuggugaagcccgaaggcaaggugaucgaccucggcugcgggcgcggcggguggagcuacuacugcgccggucugaagaaagucaccgaggugaagggguauaccaagggcggcccggggcacgaggagcccauucccauggcgaccuacggcuggaaccuggugaagcuccacucagggaaggacgucuucuucaugcccccggagaagugcgacacccuguugugcgacauaggcgagagcucucccaacccaaccaucgaagaggggcguacccuccgcgugcugaagaugguggagcccuggcugcggggcaaccaguuuugcaucaagauucucaaucccuacaugccgagcgucguagaaacgcuggagcagaugcagcguaaacacggcgggaugcucguacgaaauccccucucccgcaacagcacccaugagauguacugggucaguugcggcaccgggaauaucgugagcgccgugaacaugaccucccggaugcugcuuaaccgauucaccauggcccaccggaagcccaccuacgagcgcgacgucgaccucggcgccggcaccagacauguggccguggagcccgaagucgcgaaccuggacaucauuggacagcggauugaaaacaucaaaaacgagcacaagagcaccuggcacuacgaugaggauaaccccuacaaaacgugggcguaccacggcagcuacgaggugaaacccagcggauccgccagcucuauggugaacggcguagugcgccugcuuaccaagccuugggacgucauuccuaugguaacccagauagcgaugaccgacacuaccccguucggccagcagcggguguucaaggagaagguagacacuaggacgccucgagcaaagagggguacggcgcagaucauggaggugaccgccaaauggcuguggggguuccucagucggaacaaaaagccccgcaucugcacccgggaggaguucaccaggaaggugcggagcaacgcugccaucggggcggucuucguggacgagaaccaguggaacuccgcgaaggaggccguggaggacgagcgcuucugggaccuagugcaccgugagcgcgagcugcacaagcaaggcaagugcgccacaugcguguauaacaugauggggaagcgggagaagaagcugggggaguuugggaaggccaagggcagccgcgcaaucugguacauguggcuuggcgccagauuccuggaguucgaggcccugggguucaugaacgaggaccacugguucucccgcgaaaacagccucuccggcguggagggggagggcuugcacaagcugggguauauccuccgggacaucucuaaaauaccgggcggcaacauguacgccgacgacacggccgggugggacacccgcaucacugaggacgaccuacguaacgaggcgaagauaacugacaucauggagcccgaacacgcucugcucgccacguccauauucaaacugaccuaccagaacaaagucgugcgugugcagcgccccgcaaagaacgggaccgucauggacgugaucaguaggcgcgaccaacggggguccggccaggugggaacauacgguuugaauacuuucaccaacauggagguccagcucauccgccagauggaguccgagggaaucuucuuucccucagagcuggaaagcccgaaucuugcggagcgcgugcucgauuggcuggagaagcacggggcggagcgccugaagcggauggccauuuccggcgacgacugcguggucaagcccauagacgaccgcuucgccaccgcccucaucgcacugaacgacauggggaaagugcggaaggacauuccccagugggagcccucuaagggcuggaacgacuggcagcagguaccguuuugcucccaucauuuccaucagcugaucaugaaggacggacgggagauagucgugcccugccggaaccaagacgagcucguggggcgcgcucgggucucacagggcgccggguggucucugcgggagacugccugccuuggcaaguccuacgcccagauguggcagcugauguacuuccaccgacgcgaucugcgucucgccgccaacgccauuugcucggcagugccaguggacuggguccccaccagccgcaccaccuggagcauacacgcccaccaccaguggaugacgacggaggacaugcucuccguguggaaccgggucuggaucgaggagaacccguggauggaggacaagacccacgucagcucuugggaagaggugcccuaucuggggaagcgcgaggaccaaugguguggcagccugauuggccucaccgcgcgcgccaccugggcgaccaacauccaggucgccaucaaucagguucgccgccugaucgggaacgagaacuaccuggacuacaugaccucuaugaagcgguucaagaacgagagcgaucccgagggcgcccuuugg

SEQ ID NO: 24778 - RNA, 9876 nt, Artificial Sequence
  derived and/or modified CDS sequence (opt11) from DENV-1__KF672764__SS-prME
agcgugaccaugcuacucaugcugcugcccaccgcccucgcguuucauuuaacaacccggggcggggagccucauaugaucguauccaagcaggaaaggggcaagagccuacuguucaaaaccagugcgggggugaacauguguacucuaaucgccauggaccugggcgagcucugcgaggauaccaugaccuacaagugcccccggaucacagaggcggagcccgaugacguggauugcuggugcaacgccaccgacaccugggucaccuacgggaccugcagccagaccggcgagcaccggcgugauaagcgaucggucgcgcuggcgccccacgugggcuuggggcucgagaccaggaccgagaccuggaugagcuccgagggcgccuggaagcagauucagaaggucgagacgugggcccugcggcaccccggguucacagugauugccuuauuuuuggcucacgccaucggaaccagcauuacccaaaagggaaucaucuucaucuugcugaugcucgugacccccuccauggccaugcgcugugucgggaucggcaaccgggacuucguggagggacugagcggcgccacauggguggacgucgugcuugagcacggguccugcgugaccaccauggccaagaacaagcccacccucgacauagaacuguugaaaacggaggucacaaaccccgccguacucagaaagcugugcaucgaggcuaagaucagcaacaccaccacggacucacguugcccgacacagggagaggccacguuaguggaggagcaggaugccaauuucgucugccgccggaccuucguggaucgcggcugggggaacggcugcggccuguuugggaaggggucccuccucacgugcgccaaguucaagugcgugacuaaacuugagggcaagaucguccaguacgagaaccuaaaguacagcgucaucgugaccguccauaccggcgaccagcaccaagucgggaacgaaacgacagagcacggcaccaucgccaccaucacgccccaggcccccacgagcgagauacagcugacggacuacggggccuuaacccuggacugcucuccccggaccggccuggacuucaacgaaaugguccuccugacgaugaaggagaaguccuggcuggugcacaaacagugguuuuuagaucugccgcugccuuggaccaguggggccaguaccagccaggagaccuggaaucgucaggaccucuuagugacuuucaagacggcccacgccaagaagcaggagguugugguucugggcucccaagagggugccaugcacacggcccucacuggugcaacugagauccagaccagcgguacgaccacgaucuucgccgggcaccugaagugccggcugaagauggauaagcucacacugaagggcaccuccuacgucauguguaccgggucguucaagcuggagaaggagguggcugagacacagcacggcaccguacuuguccaggugaaguacgagggcaccgacgcaccgugcaagaucccuuucuccacacaggacgaaaagggggugacccagaacggccgccucauaaccgcaaacccgauaguaaccgacaaggagaaacccgugaacauugagaccgagccacccuucggggaguccuauaucgugguaggcgccggcgagaaggcccucaaacuauccugguuuaagaaggggagcuccaucgggaagauguucgaggcuacggcaaggggggcacgccggauggccauacucggcgacaccgcuugggacuucgggucuaucggcggcguguuuacuuccguggggaagcucguccaccaaguauucggcacugccuacggggugcuguucagcggcgucuccuggaccaugaagaucgggaucggcauccuucugacauggcugggccugaacagccgcuccaccucucugagcaugaccugcaucgccguggguauggugacgcuauaccucggcguuauggugcaggccgacucugguugcgugaucaacuggaagggucgggagcugaaaugcgggucaggcauuuuugucaccaacgaagugcauaccuggacggagcaguacaaguuccaagccgauuccccgaagcggcugucugcggccaucggccgcgcgugggaggaggggguauguggaauccggucagccacccgccucgaaaacaucauguggaagcagaucagcaacgagcugaaucacauccuccucgagaaugacaucaaguucacggucgugguggggaacgccaacggaauccugacccagggcaagaagaugauaagaccccagcccauggagcacaaguacuccuggaaauccugggguaaggcgaagauaaucggcgccgauauccaaaacaccaccuucaucaucgacgggcccgauaccccggaaugccccgacgagcagcgcgccuggaacaucugggaggucgaggacuacggauucgguaucuucacaacgaacaucuggcuaaagcuccgggacuccuacacccagaugugugaccaccgccuaaugagcgcagcgaucaaggacuccaaggcagugcacgccgacaugggguauuggaucgagucugaaaagaacgagacauggaagcuggcccgggccagcuucaucgagguaaagacaugcauauggccgaagucccacacccucuggucgaacggagucuuagagucagagaugauaauccccaaaauguacggcgggccgaucucccagcacaacuaccgcccaggcuacuucacccaaacggcgggccccuggcaccuggggaagcuugagcuggacuucgaccuuugugagggcaccacugugguggucgacgagcacugugguagccgggggccaucccuccgcacaacaaccgugaccggcaagauaauccaugaauggugcugcaggagcugcacccucccucccuugcgcuuucgcggugaggauggcugcugguaugggauggagauucgcccugugaaggagaaggaagagaaccuugucaaauccauggugagugccggcagcggcgaaguagacuccuucagccuggggauccugugcgucagcaucaugaucgaggaggugaugcggagccguuggagucgcaagaugcucaugacgggcacccuggccguguuccugcuauuaaucauggggcagcuaaccuggaacgauuuaauccgcuuauguaucauggucggcgccaacgccagcgacaagauggggauggguaccaccuaccuggcgcucauggcuaccuucaaaaugcgaccgauguuugcuguggggcuguuauuccggcgccucaccucccgggaggugcugcugcuuaccaucggccugucccuggucgccuccguagaguuacccaacucgcucgaggagcugggagacgggcucgccaugggaaucaugaugcugaagcugcucaccgaguuccagccgcaccaauuauggaccacuuuacucucucuaaccuucaucaagacgacccuuucccucgacuacgcguggaagaccaccgccaugguccucucuauagucagccuguucccacuuugccuguccacgaccucucagaagaccaccuggcugccgguacuacugggcaguuucgggugcaagccccuaacaauguuccucaucacggagaacaaaaucugggggcgcaagucauggccacuaaacgaggggaucauggccaucggcaucgucuccauccuucuaagcagccugcugaagaaugauguccccuuagcagggccgcugaucgcgggaggcaugcugaucgccuguuacgugauuuccgggaguuccgccgauuugucguuggagaaagccgcugaggucuccugggaggaggaagcagagcauagcgguaccagucauaauauauuaguggaggugcaggacgacgggaccaugaagaucaaggacgaggagagggacgacacccucacgauccugcugaaagccacucuucuggccguaagcggcguguaccccauguccaucccugccaccuuauucgugugguauuucuggcagaagaagaagcagcgcagcgguguccucugggacacccccucuccuccugagguugagcgugccgugcuugacgacgguaucuaucgaauccugcagcggggccucuuggggcgcagccaagugggcguggguguguuccaagacggcguguuccacacuauguggcaugugacccgcggggccgugcugauguaccagggcaaacgccuggagccauccugggccagcgucaagaaggaccucaucuccuacggcggaggcuggcgguuucaggguagcuggaauacgggcgaggagguacaggugaucgccgucgaacccggcaagaauccgaagaacgugcagaccacacccggcaccuucaagaccccagagggcgaggugggggcgaucgccuuggacuucaagcccggcacgucggggagcccgaucgucaaccgcgaggguaagaucgugggccuguaugguaacggcguggucacgacuuccgggaccuaugucagcgcgauugcccaggccaaggccagucaagagggcccccuccccgagauagaagacgagguguucaagaagcggaauuuaacuaucauggaccugcacccggguuccggcaagacgcgccgguaccuccccgcgauuguccgcgaagcgaucaaaaggaagcugcgcacauuaauccuugcccccacucggguuguggccagcgagauggccgaggcgcugaaaggaaugcccauccgauaccagaccacggccgucaaauccgagcauacuggccgcgaaaucguagaccugaugugccacgcaacguucacuaugagauugcugagcccggugcgcgugcccaauuacaacaugaucauaauggacgaggcccacuucacggaccccgcaucgaucgccgcucggggcuauaucagcacgagaguggggaugggugaggccgccgcuauauucaugaccgcgacaccgccgggguccguugaggccuucccccagagcaacgcagucauccaggacgaggagcgagacauccccgagcgcuccuggaauucaggcuacgacuggauuacggacuuccccggcaagaccgugugguucgugccaagcaucaagagcgggaacgacaucgccaacugccugcggaaaaacggcaagcgcguuauccagcucucccggaagaccuucgacaccgaguaucagaaaacgaagaacaacgacugggacuauguggugacuaccgacaucucagagaugggagcaaacuuccgggcagaccgggugaucgacccacgccggugcuuaaagcccgugauccugaaagacggacccgaacgcgugauccucgccgggccgaugcccguaaccguagccuccgccgcgcaacggcgcggccggauaggcagaaaccagaauaaggaaggggaccaguacgucuauaugggccagccccuaaacaaugacgaggaccacgcucauuggacggaggccaaaaugcugcucgacaauauaaacacccccgaggguaucaucccggcacuguucgagcccgagcgggaaaaguccgccgcgaucgacggcgaguaccgccugcgcggggaagccaggaagacuuucguggagcucaugcgcaggggggaccugcccguguggcuguccuacaagguggccagcgaaggcuuucaguacuccgaccgccgguggugcuuugacggggagcguaacaaucaggugcucgaagagaauauggacguggagaucuggaccaaagagggcgagcggaagaagcugcgcccucgguggcuggacgcccgcacuuacagcgacccgcucgcccugagggaauucaaggaguucgcagccgggcgccggagugucucgggcgaccugauucucgagauuggcaagcugccucagcaccugacgcugcgcgcccagaacgcccuggacaaccuggugaugcuccacaacagcgaacaagggggaaaggccuaccggcacgcaauggaggagcugccagacaccaucgagaccuugaugcuucucgcccugaucgccgugcucaccggggggguaacgcuguuuuuccuguccgggaagggucucgggaaaacaucuaucggucugcugugcgucacggcguccagcgcccuccuguggauggccuccguugagccccacuggaucgcagccagcaucauccuggaguucuuccucaugguccugcugaucccggaaccagaccgccagcguacaccucaggacaaccaguuagccuacguggugaucggccuguuauucaugauccugacugucgcugccaacgagauggggcuguuagagaccaccaagaaggaccucggcauagggcacguggccgccgagaaccaucagcacgcgaccaugcuggacguggaccugcacccggcguccgcuuggacgcuauacgccgucgccaccaccgugaucacccccaugaugcgccacacgaucgagaacaccacugccaacaucagccugaccgcgaucgccaaccaggccgcaauauugaugggccucgacaagggcuggcccaucuccaagauggaccugggggugccccugcucgccuuagggugcuauagccaggucaacccgcugacgcugacagcagccgugcugaugcuaguggcacauuacgccauuaucgggccuggccuccaggcaaaggcgacgcgggaggcccagaagcguacugccgccgguaucaugaagaaccccacggucgacggcaucguggcgauagaccuggaccccguggucuaugaugccaaauucgagaaacaacugggccaaaucaugcuccucauccugugcaccucccagauccuccugaugcggaccacgugggcccugugcgagagcaucacacucgccaccgggccucugaccacgcugugggaaggcucucccgggaaguucuggaacacaaccaucgccgugagcauggcgaacauauuccgcggcuccuaccucgcaggcgccgggcuggcguucucucugaugaagucccucggaggggggcgccgggggacuggcgcccagggagagacgcugggggagaaguggaagaggcagcugaaccaacucagcaaaagcgaguucaauaccuacaagaggagcggaaucauggaggucgaccgcacggaggcgaaggaggggcucaagcggggcgaaaccaccaagcacgccgucucgagagggaccgccaagcuacggugguucguggagagaaaccuggugaagcccgaagguaagguuaucgaccucgguugcgggcggggcggaugguccuacuacugcgcugggcucaagaaggugaccgaggucaagggguacaccaagggugggcccggucacgaagagccgauccccauggcgaccuacggcuggaaucuagucaaacuccauuccgggaaggauguguucuucaugccacccgagaagugcgauacccuccugugcgacaucggagaguccagcccgaauccaacaauagaggaggggcgaacccugcguguacucaagauggucgagccauggcuaagaggcaaccaguucugcaucaaaaucuugaaccccuacaugccguccgugguggagacucuggagcagaugcagcggaagcacggcgggauguuagugcggaaccccuugagccggaacuccacccaugagauguacuggguaaguuguggcacggguaauaucguguccgcagucaacaugaccagccgcaugcuccuaaaucgguucacuauggcccaccgaaagcccacauaugagcgggauguggaucucggagccggcacgcgccacguggccgucgaaccggagguggcgaaccuggacaucaucgggcaacgcauagagaauaucaagaacgagcacaaguccaccuggcacuaugacgaggauaacccauauaagaccugggccuaccacggcagcuaugaggugaagccuuccgggagcgccucgucaauggucaacggcgugguccgccugcucacuaagcccugggacgugauacccaugguuacccagauugccaugaccgacaccaccccguucgggcagcagcgcgucuucaaggaaaagguggauacucgaacuccucgggccaagcgcggcaccgcgcagaucauggaggugaccgccaaguggcuuuggggcuucuuaucccgcaacaaaaagccccggaucugcacgcgugaggaguucacucggaagguccggagcaaugcugccauuggggccguguucguggacgagaaccaauggaauagcgccaaggaggccgucgaagacgagcguuucugggaccucgugcaccgggaaagagaacuccacaagcagggcaaaugcgcgacaugcguguacaacaugauggggaagagagagaaaaagcugggggaguucgggaaggccaaaggcucccgcgcuaucugguacauguggcuaggcgcccgauuccuggaguuugaggcccugggguucaugaacgaagaucacugguucucuagagagaacucccucagcggcgucgaaggggagggccugcacaaacuagguuacauucuccgcgacaucucaaagaucccagguggcaacauguacgccgaugacaccgccgggugggacacgcggaucaccgaggacgaccugcaaaacgaagcgaagaucaccgacaucauggagcccgaacaugcgcuacucgccaccagcaucuucaagcugacguaccagaacaaggucguacgcguccagcgucccgccaagaacggcaccguaauggaugucaucucccgccgcgaucagcgggggaguggacaagugggcaccuacggccugaacaccuucacgaacauggagguacagcucauccgacagauggagagugagggcaucuucuucccguccgagcuggaguccccgaaccuagccgagcgcgugcucgacuggcuggagaagcauggggcggagcgccugaagcggauggcgaucagcggcgaugacugcgucgugaagcccauugacgacagguucgccacggcccucaucgcucugaacgacauggggaaagugcggaaggauaucccccaaugggagccgagcaagggcuggaacgacuggcaacaggucccguucugcagccaccacuuucaccaacuaaucaugaaagacggccgcgagaucguggugccaugcaggaaccaggacgagcucguugggagggcgcgaguaucccagggcgcuggguggucccugcgcgagaccgccugccugggcaagucguaugcucaaauguggcagcuaauguacuuccaccggcgagaccugcggcuggcagcuaacgccaucugcagcgccgugcccguugacuggguucccaccagucgcaccacuugguccauccacgcacaccaucaguggaugaccacugaggauauguugagcguguggaacaggguuuggaucgaggagaacccguggauggaggauaagacccacgucuccagcugggaggagguccccuaccuggggaaaagagaggaccaguggugcgggagccugaucggccucacggcgcgggcgaccugggccaccaacauccaggucgccauuaaccaggugcgccguuugaucgggaacgagaauuaccuugacuacaugaccagcaugaagcgguucaagaacgaguccgacccugagggcgcccucugg

SEQ ID NO: 24779 - RNA, 9879 nt, Artificial Sequence
  derived and/or modified CDS sequence (opt11) from DENV-1__EU863650__SS-prME
agcgugaccaugcugcucaugcugcugcccacagugcucaccuuccacuuaaccacccgcggcggugagccccauaugaucgugagcaagcaggagcggggcaagagcuugcuguucaaaaccuccgccggggugaacaugugcacgcucaucgccauggacuuaggcgagcucugcgacgacaccaugaccuacaagugcccccgcaucaccgagacggagcccgacgacguggacugcuggugcaacgccaccgagacgugggugaccuacgggacuugcagccagacgggugagcaccggagggacaagcgguccguggcccuagccccccacgucggccuagggcucgagacccgaaccgagacguggaugagcuccgagggagccuggcggcagauccaaaagguggagaccugggcccugcgccaccccggcuucaccgugaucgcucuguuccucgcccaugccaucggcaccucgaucacgcagaaggggaucauauucauccugcugaugcucgucacccccucaauggccaugagaugcgugggcaucgguaacagggacuucguggaggggcugagcggagcgacauggguggacgugguccuggagcacggguccugugucaccacgauggccaaggacaaaccgacccucgacaucgagcugcugaagacugaagugaccaacccagcugugcuucggaagcugugcaucgaggccaagauuuccaacacgaccaccgauucccgcugcccaacccagggagaggcaacauuggucgaagagcaggauaccaauuucgugugccggcgcaccuucguggaucggggcugggggaacgggugcggccuguucggcaaagggucucugaucacaugcgcgaaguucaagugcgugaccaagcuggagggcaagaucgugcaguacgagaaucucaaguacuccgugauugucaccgugcacacuggcgaucaacaucaggucgguaacgagaccaccgagcacggcacgaucgcuaccaucacuccacaggcacccacuuccgagauacaacugacggacuacggagcauugacccucgacugcagcccccggacaggucuggauuucaacgagauggugcugcucacgaugaaggagaagaguuggcuuguccacaagcagugguuccuggaccuaccccugcccuggacgucaggggccagcacgagccaggagaccuggaaccgucaagaccuccucguuacuuucaagacggcgcacgccaagaagcaggaggugguggucuugggcucccaggagggcgccaugcauacggcacugaccggggcaaccgagauccagacgagcggcacgaccaccaucuucgccgggcaccucaagugccgccugaagauggacaaacugacgcuaaaaggcaucuccuacgugaugugcaccgggcuguuuaagcuggagaaggaaguggccgagacccaacacggcaccguccugguccaggucaaguacgagggcacugacgccccauguaagauccccuucucuucccaggaugagaagggagccacccagaauggccggcucgucaccgccaacccgaucguuaccgacaaggagaagccagugaauaucgaggcagagccgcccuucggagagucguauaucgucgugggcgccggugagaaggcccugaagcugucgugguucaaaaaagggagcuccaucggcaagauguucgaggccacggcgcgaggggcucggcgcauggccauccucggagacaccgccugggauuucgggagcauuggcggcguguucaccagcguggggaagcuggugcaccagauuuucgggaccgccuacggggugcuguucagcggcguguccuggaccaugaaaaucgggaucggaauucucuugacuuggcugggacucaacucccgcuccaccagcuuauccaugaccuguaucgcgguggggauggugacgcuuuaccucggcguaauggugcaggccgacagugggugcguuauuaauuggaagggccgggagcugaagugcggguccgguaucuucgucaccaaugaagugcacaccuggacggagcaguacaaauuccaggcggacucgccgaagcgccugagcgccgccaucggcaaggcgugggaggagggggugugcggaaucagguccgccaccaggcucgagaacauaauguggaagcagaucagcaacgagcugaaccacauccugcucgagaacgacaugaaguucacggucguggugggggacgucuccggcauacuggcccagggaaagaagaccauccguccccagcccauggagcacaaguacuccuggaaguccugggggaaagccaagauuaucggcgccgaugugcagaacacuacguucaucaucgacgggcccaacacgccggaauguccggacgaccagcgcgcguggaacauaugggagguggaggacuacggcuucgggaucuucaccaccaacaucuggcucaagcucagggauagcuacacgcaggucugcgaccacaggcugauguccgccgccaucaaggacucuaaggcagugcacgcggacaugggcuacuggaucgagagcgagaagaaugagacguggaagcuggcccgggccagcuucaucgaggugaagaccugcgucuggcccaagucccacacccuguggagccacggcguccuggaguccgagaugaucauccccaagauuuacgggggcccgaucagccaacacaacuaccgccccggcuacuucacgcagaccgccggccccuggcaccuggggaagcucgagcuggacuuugaucugugcgaaggcacaaccgugguaguggacgagcacugcggcaaccgugggccgucccuccgcaccacgaccguuacgggcaaaaucauccacgaguggugcuguagauccugcacccugccgccccugcguuucaagggggaggacgggugcugguacgggauggagauccgucccguuaaggagaaggaggagaaccucgugaaguccauggugagcgcuggcagcggcgaggucgacuccuucagccuggggcugcuuugcaucuccaucaugauagaagaaguuaugcgcagccgguggucccgcaagaugcugaugacgggcacucuggugguguuccuccugcuuacucucgggcagcugaccuggaacgaccugauccggcucugcauaauggugggcgcgaacgccagcgacaacauggggaugggcacgaccuacuuggcccuaauggcgacauuccgcaugcgcccuauguucgccgucgggcucuuguuccgccgacugaccucccgugaggugcucuuacugacgguggggcucagccuagucgccuccguagagcugcccaacucucucgacgaacugggcgauggguuggccaugggaaucaugauccucaagcugcugaccgacuuccagucccaccagcugugggcgacccugcugagccucaccuucgugaagacaacgcugucccugcacuacgccuggaagaccauggccaugauccucagcaucgucucccucuugccccucugccugucaaccacgucucagaagaccacguggcugcccgugcuccucggcucccuggggugcaagccucucacgauguuccugaucaccgagaacaagaucuggggccgcaaguccuggccccucaaugaggggaucauggcggugggcauugucagcauacuccugagcuccuugcucaagaacgacguuccccuggccggaccccugaucgccggcggcaugcucaucgccugcuacgugaucagcgggaguagugcggaccuuucccuggagaaggccgccaaagugagcugggaagaggaggccgagcacuccggcgccagccauaacauccuuguugagauccaagaugacgggacgaugaagaucaaggacgaggagcgggacgacaccaucaccauacugcugaaggcaacccuccucgccauuucagggguguacccgaugagcauccccgccacgcuguucgucuggcacuucuggcagaagaaaaagcagcgcuccggggugcugugggacacccccagcccgcccgagguggagaaggccgugcuagacgacggcaucuaucggauuuugcagcgcggccugcucggccggucccaggugggcguaggggucuuccaggagggcguguuccacacgauguggcacgugaccagaggugcuguccugauguaccagggcaagcggcuggagcccagcugggcgagcgugaagaaggaucucaucagcuacggggggggcuggcgcuuccagggguccuggaacacgggcgaggaggugcaagucaucgccguggagcccggaaagaauccaaagaacguucagacugcccccggcaccuucaagaccagcgaaggagaagucggggccaucgcccuggauuucaagcccggaaccuccggaagccccaucgugaaucgggaaggaaagauugucggccuguacgggaacggcgucgugaccaccagcggcaccuaugugucagcgaucgcccaggcaaaggccagccaagaagguccgcuccccgagauugaggacgaggucuuucgcaagcggaaccuuacaaucauggaccugcaccccggguccggcaaaacccgccgguaccuccccgcgaucgugcgcgaggcgaucaagcggaagcugcgcacccuggugcucgccccgacccgggucguggccagcgaaauggcagaggcgcugaaaggcaugcccauccgcuaccagacgacagcggugaagucggaacacaccgggaaggaaaucgucgaccugaugugccacgccaccuuuacgaugcgccuccugagcccugugcgggugcccaacuacaacaugauuaucauggacgaggcacacuucaccgacccugcuucgaucgcggcgcgcggcuacaucucaacucgcgucgguaugggugaggccgccgccaucuucaugaccgcgacgccgcccggguccguggaggccuucccccagagcaacgccguaauccaggacgaggagaaggauauccccgaacgcucauggaauagcggcuacgacuggauuaccgacuuucccggcaagacggucugguucgugccuuccaucaagagcgggaacgacaucgccaacugccuccgcaagaacgguaaacgcgugauccagcucucccggaagacauucgacacggaguaccagaagacgaagaacaacgacugggacuacgucgugaccaccgauauuucggaaaugggcgccaacuuucgcgcggaucgcgucaucgacccccgccggugccugaagccggugauccugaaggacggacccgagcgcgugauccucgccgggcccaugcccguaacgguggccuccgcugcgcagcggcgcggcaggaucgggcgcaaccagaacaaggaaggggaccaguacaucuauauggggcagccgcugaacaacgacgaggaccacgcccacuggaccgaggccaagaugcuccucgacaacaucaacacccccgaggggauuaucccggcccuguucgagcccgagcgggagaagucggccgccaucgacggcgaguaccgccugcgcggggaagcccgcaagaccuucguagagcugaugcgccggggugaccugcccguguggcuguccuacaaaguggcuagcgagggguuccaauacucggaccgccgguggugcuucgacggggagcgcaacaaccaggugcucgaggagaauauggacgucgagauauggacgaaagagggugagcggaagaagcuucgcccccgguggcuggacgccagaaccuauagcgacccucucgcccuccgggaguucaaggaguucgcggcggggcggcggagcgugagcggggaccugauccucgagaucggcaagcuuccccagcaccugacgcagcgcgcccagaaggcccucgauaaccuggugaugcuacacaacagugagcagggcgggaaggcguaccggcacgcgauggaagaacucccggacaccaucgagaccaucauguuacuggcccucaucgcuguccugaccggcggggugacccuguucuuucuuuccgggcgcgggcugggcaagaccuccaucgggcuguugugcgucaccucaagcuccgcucugcuguggauggcaucagucgagccccacuggaucgccgccagcaucauccucgaguucuuccugaugguacuucucauccccgaacccgaccggcagaggacgccgcaagacaaccagcucgcguacguggucaucggccuccucuucaugauucugaccgucgccgcgaccgagauggggcugcucgagaccacgaagaaagaucugggcaucgggcacgcugccgccgagaaccaucaccacgccgcgauguuggauguggaccuccaccccgccagcgccuggacccuguacgccgucgccaccaccauuaucacgccgaugaugcggcacaccauugagaacaccaccgcgaacaucucccugacggccaucgcuaaucaggccgccauccucaugggccuggacaagggcuggccgaucagcaaaauggacaucggggugccucuccucgcccugggcugcuacucccaggucaaccccuuaacacucacggcagccgugcugaugcucguggcccacuacgcgauuaucgggcccggccuccaggccaaggccacgcgcgaagcacagaagcguacggccgcgggcauuaugaagaacccgaccguggacggaaucgucgccaucgacuuggaccccgugguguacgacgccaaauucgaaaagcagcuaggccagaucaugcuccugaucuugugcaccagccaaauccuucugaugagaaccacgugggcccuuugugaauccaucacccucgccaccgguccccugaccacgcugugggagggcucgcccgggaaguucuggaacacuaccaucgcgguuuccauggccaacaucuuccgcggcagcuaccucgcaggugccgggcuggccuucagccugaugaaaucacucggcgggggccgccgcgggaccggcgcgcagggcgagacgcugggggagaaauggaagcggcagcugaaccagcucagcaaaucagaauucaaaacguacaaacgcagcggcaucaucgaaguggaccgcuccgaggccaaggaggggcugaagcguggcgagaccaccaagcacgcggugagccggggaacggcaaagcugcgcugguucgucgagcggaaccuggugaagccggaaggcaaggugauagaccucggauguggccgcggcggcugguccuacuacugcgcaggccuuaagaaagucacagaggucaaggggagcacgaaagggggccccgggcacgaggaacccauuccaauggccaccuacggcuggaaccucguuaaacugcacuccgggaaagacguauucuucaucccgccggagaagugcgacacccugcugugcgacaucggcgagagcuccccgaaccccacgaucgaggaggggcggaccuuacgcgugcugaagaugguggagccguggcuucggggcaaccaguucuguauaaagaucuuaaaccccuacaugcccagcgucguggagacccuggagcagaugcagaggaagcacggagggaugcuggugcggaauccacucucccgcaauagcacccacgagauguacugggucucuugcggcacggggaacaucgugagcgccgugaacaugaccucucggaugcugcucaaccgcuucaccauggcccaccggaagccgaccuacgaacgcgacgucgaccucggcgccggcacccggcauguagcgguggagccagaggucgccaaccuggacaucaucgggcagcgaaucgagaacaucaagaacgagcacaagucuaccuggcacuacgacgaggacaaccccuacaagaccugggcauaccacggcuccuacgagguuaagcccagcgguagugccuccagcauggucaacggcgugguacgccuuuugaccaaaccgugggacgucaucccaaugguuacgcagaucgccaugaccgacaccacccccuucgggcagcaacguguguuuaaggagaagguugacacccgcaccccuaaggcgaagcgcggcaccgcccagaucauggaggugacagcaaaguggcuauggggcuuucugucccgcaacaagaagccgcguauuugcacacgcgaggaguucacacggaaggugcggucaaacgccgccauaggggcggucuucguggacgaaaaucaguggaacuccccgaaggaggccguggaggacgagcgauucugggaccuugugcaccgcgagcgggagcugcacaaacagggaaaaugcgcgaccugcguguacaauaugauggguaagcgcgagaagaaacugggcgaguucgggaaggccaaaggcucccgcgcuauuugguacauguggcucggcgcccgcuucuuagaguucgaagcccugggguucaugaaugaggaccacugguucucccgggagaacucccucucaggcguugagggggaaggccuccacaaguugggguacauccuccgcgacaucagcaagaucccaggcggcaacauguacgccgacgacacagccgggugggacacgcggaucacagaagaugaccuccagaacgaggcaaaaaucaccgauaucauggaaccggagcacgcccugcucgcuaccucgaucuucaagcugacguaccagaacaaaguugugcgagugcagaggcccgccaagaacgggaccgugauggacgugaucagccgccgggaccagcgcgggucuggccaggugggcacuuauggccugaacaccuucacgaauauggaggcacaauugauccgccagauggagagcgaggggaucuuucugcccuccgagcuggaaccccccaaccucgcggggcggguccccgacuggcuggaaaaacacggcaccgagcgccugcggcgcauggccaucucuggugacgacugugugguuaagccaaucgacgaucgguucgccaccgcccuuaccgcccugaacgacaugggcaagguccgcaaggacaucccccagugggagccuuccaaggguuggaacgacuggcagcagguccccuucugcucccaccacuuccaccagcugaucaugaaggacgggcgugaaaucgugguccccugccgcaaccaggacgaguuggugggccgugcgcgcgugucucagggggccggcuggucucugcgggagacggcuugccuuggcaagagcuacgcccagauguggcagcucauguacuuucaccgccgggaccugcgccuggcggcgaaugccaucugcucggccgucccuguggacugggugccgaccagccggaccaccuggucuauccaugcccaccaccaguggaugaccacggaggacaugcucagcguguggaaccgcguauggauagaggagaaucccuggauggaggacaagacccacguguccucaugggaagauguucccuaucugggcaagcgggaggaccagugguguggauccuugauugggcuaaccgcgcgcgccaccugggcaacgaacauccagguggcuauuaaccaagugcggcgccugaucgggaacgaaaacuacuuggacuacaugaccagcaugaagcgcuucaagaacgaguccgaccccgagggcgcccucugguga

SEQ ID NO: 24780 - RNA, 9879 nt, Artificial Sequence
  derived and/or modified CDS sequence (opt11) from DENV-1__KU365900__SS-prME
uccgugacuaugcuucugauguugaugcccaccgcccuggccuuccaccucaccacccggggcggggaaccccacaugauagucagcaaacaggaacggggcaagagccugcuguucaagaccuccgccggggugaauaugugcacucucaucgccauggaccugggcgagcugugugaggacacgaugaccuacaagugcccccguaucaccgaggccgagccggacgacguggauugcuggugcaacgccaccgacaccugggucaccuacgggacuugcucccagaccggcgagcaccggcgggacaagcggagcguggcauuggccccucacgugggccuggggcuggagacgagaacugagacguggaugagcuccgagggcgccuggaagcagauccagcgggucgagaccugggcccuccgucaccccggguucacggugaucgcccuguuccuugcgcacgcuauaggcaccagcaucacgcagaaggggaucauuuucauacuccugaugcuggugacgcccuccauggccaugcggugcgucggcaucggcucacgcgacuucguugagggauugucuggcgccacguggguggacgucgugcuggagcacgguuccugcgugaccaccauggccaaggacaagcccacccuggacaucgagcuccugaagacggaggucaccaaccccgcagugcugcggaagcucugcaucgaggccaagaucuccaacaccaccacggacagccgcugcccgacccagggugaggccacccugguggaggaacaagacgccaacuucgucugccggcgaaccuuuguggaccgaggauggggaaacggcugcggguuguucggcaaaggcucccuaaucacgugcgccaaauucaagugcgugacaaagcucgagggcaaaauuguccaguacgagaaucugaaauacagcgugaucgugaccguccacaccggcgaccaacaccagguggggaacgaguccacggagcacgguaccacagcgaccaucacuccccaggccccuacgaccgagauccagcucaccgauuacggggcccugacccuggacugcagcccccgcacaggccuagacuucaaugagaugguccugcugaccaugaaggaaaagaguuggcucgugcacaagcagugguuccuggaccugccccuccccuggaccagcggggccagcaccucccaagagacguggaaccggcaagaccugcuggugaccuuuaagaccgcccacgcgaagaagcaggaggucguggugcucggcagccaggagggcgccaugcacaccgcccuuacaggggccacagagauccaaaccuccggcaccacgaccaucuucgccgggcaccugaagugcagguugaagauggacaagcugacccugaaggguaugagcuacgucaugugcacgggguccuucaagcucgagaaagagguagcggagacgcagcacggcaccgugcuggugcagauuaaguacgagggcacugacgcccccugcaagauccccuucagcacccaggacgagaagggggugacucagaacggccggcugaucaccgccaacccgaucguaaccgacaaggagaagcccgucaauaucgaggcagagccgcccuuuggggaguccuacaucgugaucggcgcgggcgagaaggcccugaagcucagcugguucaagaaggggucuagcaucggcaagauguucgaggccaccgcacgcggggcgcggcgcauggcaauccugggcgacacggccugggacuucgggucuauuggcgggguguucaccagcgucgggaaacuggugcaccagaucuucggcaccgccuacgggguacucuucuccggcgucagcuggaccaugaagaucgggaucggcgugcugcugacguggcucggccugaacucccgcucaaccucacugagcaugaccugcauugcagugggacucgucacccuguaucugggggugauggugcaagcugacuccggcugcgucaucaacuggaagggccgggagcugaagugcgggagcggcauauucgugacgaaugaggugcacaccuggacagagcaguacaaguuccaagcggauagcccgaagcgccuguccgccgccaucggcaaggccugggaagagggggucugcggcauccggagcgccacccgccuggagaacauuauguggaagcagaucuccaacgaacucaaccacauccugcuggagaaugacaugaaguucacaguaguggucggggacguggccggcauccucgcccaggggaagaaaaugauucggccccagcccauggagcacaaguacagcuggaaauccuggggcaaggccaagaucaucggggccgacgugcagaacaccaccuucaucaucgacgggccuaacaccccggagugucccgacgaccagcgcgcguggaacaucugggaggucgaggauuauggcuucgggaucuucaccacgaacaucuggcugaagcugcgggauucauacacacaggugugcgaccaccgccucaugagugccgcuauaaaagacagcaaggccgugcacgcagacaugggcuacuggaucgaguccgagaaaaaugagaccuggaaacuggcgcgggccucauucaucgaggugaagaccugcaucuggcccaagucccacacgcuguggagcaacggcguucucgaguccgagaugaucauacccaagaucuacgguggcccgaucagccagcacaacuaccgucccggguacuuuacgcagaccgccggacccuggcaccuggggaagcuggagcucgacuucgaucugugcgagggcaccacgguggucguggacgagcauugcggcaaucgggggccgucccugcgcacuaccaccgugacgggcaaaaucauccacgaguggugcugccggagcugcacccugccgccucucagauuccgcggggaggauggcugcugguacgggauggaaauccgccccgucaaggagaaggaggagaaccucgugaaguccauggugagcgccggcccaggcgaggucgacagcuucucccucggacugcucugcaucagcauaaugaucgaagaggugaugcggucucgguggagccggaagaugcucaugaccggcacccuggccguguucuuccugcucaucauggggcagcugacguggaacgaccugauccgccucugcaucauggucggugcgaacgccuccgaccgcauggggaugggcacgaccuaccuggcccuaauggccaccuucaagaugcgucccauguucgccgucggccuccuucugcgaagacucacgagccgcgaagugcuccugcucaccaucgggcugucccugguugcgagcguggagcuccccaacucccuggaggaguugggcgacgggcuggccaugggcaucaugauccugaaauuacucacugacuuccagagccaccagcugugggccacccugcucucccugacguuuaucaaaacuaccuucagccugcacuacgccuggaaaaccauggcgaugguccucuccaucgugagccuguucccccugugccucuccacgacgagccagaaaaccaccuggcugccggugcugcucggcucgcuggggugcaagccccugacgauguuccucaucgcagagaacaagaucuggggccgaaagagcuggccccugaacgaggggaucauggccgucggcaucgugucuauccugcucuccagccugcugaagaacgacgugccucucgccgggccgcugauagcaggcggcaugcugaucgcgugcuacgugaucuccgggagcuccgccgaccucagccuggagaaagccgccgagguguccugggaggaggaggccgagcacagcggcgcaucccacaacauacugguggagguccaggacgacgggaccaugaagauuaaggacgaggagcgcgaugacacccucaccauccugcugaaggccacccugcuggccguguccgguguuuacccccuguccaucccugccacccuuuucgucugguacuucuggcagaagaagaaacagcguagcggggugcuaugggacacccccucgccacccgaagucgagagagccguccuggacgacggcaucuaccggaucaugcagcgcggacugcucgggcggagccaggugggcgugggggucuuccaggagaacguguuccacacuauguggcaugugacccgcggugcggugcugauguaccaggggaagcggcuggagcccuccugggccagugugaaaaaggaccucaucuccuacggcggcggguggcgccuucagggcagcuggaacacgggggaggaggugcaggucauugccguggagcccggcaagaacccgaagaaugugcaaaccgcccccgggaccuucaagacccccgagggcgaagucggcgccauagcgcuggacuucaagcccggcacguccggaagcccgaucgugaaccgggaggggaagaucgugggccucuacggcaauggcguagugacgaccuccggcaccuacguaagcgccaucgcccaggcaaaggcgagccaggaggggccgcugcccgagaucgaggacgaggucuuccgcaagcggaaccugacaaucauggaccuccacccgggcuccggcaagacucgccgauaccugcccgccaucgugcgcgaggccaucaagcggaagcuacgcacccucauccuggcacccacccgcguggucgccagcgagauggcggaggcucugaagggcaugccaauccgguaccaaacgacagcuguuaagucagagcacaccgguaaggagaucguggaucucaugugccacgccaccuuuacgaugcgccugcugagcccggugcgggugcccaacuacaauaugaucauaauggacgaggcccauuuuaccgaccccucuagcaucgcggcccgcggguacauuuccacccgggugggcaugggggaggccgccgccaucuuuaugaccgcgacgcccccagggagcgucgaggccuucccacaauccaacgccgucauccaggacgaggagcgggauauucccgagcggagcuggaacuccggguacgaguggauuacagacuucccuggcaagaccgugugguucgucccgagcaucaaauccggaaacgacaucgcuaacugccuccgcaagaacgggaagcgggugauacaacugagccgcaagaccuucgacacggaguaccaaaagaccaagaacaacgacugggacuauguggucaccaccgacaucuccgagaugggcgcgaacuuccgggccgaccgcgugaucgacccccggcgcugccucaagcccgugauacuaaaggacgggcccgagagagucauucuggccggcccgaugcccguuacggucgcuagcgccgcgcagagacgcgggcgcaucggccggaaccacaacaaggagggcgaccaguacauauacauggggcagccccugaacaacgacgaggaucacgcccacuggaccgaggcgaaaauguuacuggacaacauaaacacccccgagggcaucaucccggcccuguucgagcccgagcgcgagaaguccgccgcgaucgacggggaguaccgccuccggggcgaggcccgcaagaccuucguggagcugaugcggcgcggggaccugcccguguggcucucuuacaaggucgccagugagggcuuccaguacagcgaccggaaguggugcuucgacggcgagcgcaacaaccaggugcuggaggagaacauggacguggagaucuggacgaaggagggggagcggaaaaagcugcgcccucgguggcucgacgcccgcaccuacagcgacccgcuggcccugagggaguucaaggaguucgcggccggccgcagauccgucagcggggaccucauucuggagauuggcaagcucccccagcaccucacccagcgcgcccagaacgcucuggacaaccucgugaugcuccacaauuccgagcagggcgggcgagcguaccgccacgccauggaagaguuaccagauaccaucgagacgcugaugcuccuggcccugaucgccgugcucaccggcggggucaccuuauuuuuccuuagcgggcgggggcucggcaagacuuccaucggcuuacugugcgugauggccuccagugugcuccuguggauggcgagcgucgagccccacuggaucgccgcuucaaucauccucgaguucuuccucaugguguuguuaaucccggagccagaccggcagaggacgccccaggacaaccagcucgccuacguggucaucggguuacuauucaugaucuuaacgguggccgccaacgagaugggccuguuagagaccaccaagaaggaccucgguaucggccacguggccgucgagaaucaccaccacgcgaccaugcuggauguggauuugcaccccgccagcgccuggacgcucuaugcgguggccacuaccaucaucacgccgaugaugcgccacaccaucgagaacaccacagccaauaucucucugaccgccauugccaaccaggcggccaucuugauggggcucgacaagggcuggcccauaagcaagauggacaucggcgucccccugcuggcgcucgggugcuacucccaggugaauccgcucacucugaccgccgcggugcucaugcugguggcccauuacgccaucaucggccccgggcugcaggccaaggccacccgggaggcgcagaagcgcacugccgcuggcaucaugaagaaccccacuguggaugggaucguggcuauagaccucgacccugucgucuacgacgccaaguucgagaagcaguugggccagaucaugcugcucauccuguguaccucgcaaauacugcucaugcgcacaacaugggcgcugugcgaguccaucacguuagccaccgguccgcucaccacccugugggaagggagcccagguaaguucuggaacacgacaaucgcagugucgauggccaacaucuuccgggggagcuaccuggccggcgcgggccucgccuucucccucaugaagucccuagggggcgggcgccgggggaccggggcccagggcgaaacccucggcgagaaguggaagcgccagcugaaccagcugagcaaguccgaguucaacacguauaagcggagugggaucauggaggucgaccgauccgaggccaaggagggccucaagcgcggggagaccaccaagcaugcggugagccgcggcaccgcgaagcugcggugguucguagagcgcaaccuagucaagcccgaggggaaggugaucgaccugggcuguggccgcgggggcugguccuacuacugcgccgggcucaagaaggugacggaggucaagggcuacacgaagggcggccccggccacgaggagccgauucccauggccaccuacggguggaacuuagugaagcuguacagcgggaaggauguguuuuucaucccgccggagaagugcgacacccuccugugcgacaucggggaguccagcccgaaccccacgaucgaggaggggcgcacccugcggguacucaagaugguggagcccuggcugcgcgggaaccaauucugcaucaaaauucugaaccccuacaugccguccguggucgagacucucgagcagaugcaacggaaacauggcggcaugcuggugaggaacccccugagccgaaacagcacgcacgagauguacugggugagcugcgggaccggcaacaucgucuccgcugucaacaugacgagccgcaugcucuugaacagauuuaccauggcccaccgcaagcccaccuacgagaaggacguggaccugggggccggcaccaggcacgucgccguggagcccgagguagccaaccucgauaucauuggccagcggauagagaauaucaagcacgagcacaaguccacguggcauuacgacgaagacaacccguacaagaccugggccuaucacgggucguacgagguuaagccauccggcucggcguccagcauggugaacggggucgucaagcugcugaccaaacccugggacgucauccccauggugacccagaucgccaugacggacaccaccccguucggccagcagcgcgucuucaaggaaaagguggacacccggacgcccaaggccaagcgcggaaccgcccaaaucauggaggucaccgcccgguggcucuggggcuucuugagucgcaacaagaagccccggaucugcacccgcgaggaguucacgcggaaggugcgcucgaacgcugccaucggagccguauucaucgacgagaaccaguggaacagcgccaaggaggcggucgaagacgagcgguuuugggaccuugugcaccgcgagagagagcuccauaagcaggggaagugugcgaccuguguguacaacaugaugggcaagcgcgagaagaagcugggggaguucggcaaggccaaggggucccgggcuaucugguacauguggcugggcgcccgcuuccucgaguucgaagcgcugggcuucaugaaugaagaccacugguucagcagggagaacuccuuaagcggggucgagggcgaggggcuccacaagcugggcuacauccuacgcgacauuuccaagaucagcggagggaacauguacgcggacgacaccgccggcugggauacccggaucacggaggacgaucuccagaacgaggccaaaauaaccgacaucauggagccggagcacgcccugcuggcgaaggccauauucaagcucaccuaucaaaacaagguggugcgcguccagcggccugccaagaacgggaccgugauggacgugaucucccgccgagaccagcggggcagcgggcaggucgguacguauggccugaauaccuucaccaacauggaggcacagcugauccgccagauggaaagcgaagggaucuuuagccccagcgagcucgaaacccccaaccuggccgaacgggugcuggacuggcucggcaaauacggaguggagcgccugaagcggauggcgaucagcggcgacgacugcgucgugaagccuauugacgaccgcuucgcaacggccuugacggccuugaacgacauggggaaggugcggaaggacauaccccagugggagccuuccaagggcuggaacgacuggcagcagguccccuucugcagccaccacuuccaccagcugaucaugaaagacgggcgcgaaaucguggugccgugccggaaccaggaugagcuggucgggcgcgcccgggugucccagggcgcgggguggagccuccgcgagaccgccugccugggcaagagcuacgcccagauguggcagcugauguacuuccacagacgcgaccuccggcuggccgcgaacgcuaucuguuccgcggugcccgucgauugggugcccaccucccgcacgaccugguccauccacgcccaccaccaguggaugaccaccgaagacaugcugagcguauggaaccggguauggaucgaggaaaaccccuggauggaggacaagacgcauaucuccagcugggaggacguuccguaccucgggaagcgggaggaccaguggugcggcucccugauuggccugaccgcccgggcaaccugggccaccaacauccaaguugccaucaaccagguccguagacuuaucgggaacgagaacuaccuggacuacaugacaucuaugaagcgguucaagaacgagagugaucccgagggcgcucucugguag

SEQ ID NO: 24781 - RNA, 9879 nt, Artificial Sequence
  derived and/or modified CDS sequence (opt11) from DENV-1__FJ176779__SS-prME
uccgugaccaugcugcucaugcucaugcccaccgcgcuggccuuccauuuaaccacccggggcggggagccccacaugaucguaucuaaacaggaacgggguaagagccugcuauucaagaccuccgcgggggugaauaugugcacccuuguggccauggaccugggcgagcucugcgaggacacgaugacauacaagugccccagaaucacggaagccgaacccgacgacguggacugcuggugcaacgccaccgacaccugggucacguacgggaccugcagccagaccggugagcaccggagagacaaacggucugucgcccucgccccccaugucggccugggacuggagacgcggaccgagaccuggaugucuuccgagggcgcauggaaacaaauccagcggguggagaccugggcccuccgccaucccggcuucacggugauagcccuguuucuagcgcacgccauaggcacuaguauuacccagaaggggaucauuuucaucuuguuaaugcuggucacccccuccauggcuaugcggugcguagguaucggcucacgagauuucgucgaaggguuauccggugccacgugggucgacguggugcuggaacacgggagcugcguuaccaccauggccaaggacaagccaacacuggacaucgagcuccugaagacggaggugacaaauccugcagugcugcggaagcucugcauagaggcgaagaucuccaacacgaccacggacucgcgaugccccacccagggcgaggccacacuggucgaggagcaggacgccaacuucgugugccgucgcaccuucguggaccggggcugggggaauggcugugggcuguucggcaagggguccuugcugacgugcgccaaguucaagugugucaccaagcuggaggguaagaucgugcaguacgagaaucucaaguauagcgugaucgucaccguccacaccggagaucagcaccaggucggcaaugaguccacggagcacggcaccaccgcgacgaucacgccccaggcaccgacaaccgagauccagcugaccgacuacggggcccugacacuugacugcagcccgcgcacgggccuggauuucaacgagaugguguuacucacgaugaaggagaaguccuggcuggugcacaaacagugguuccuggaccucccgcugccguggaccagcggagcuagcaccucccaggagacguggaaccggcaagaucuguuggucaccuuuaagaccgcccacgcaaagaaacaggagguggugguucugggcagccaggagggcgccaugcacaccgcccugacaggggccaccgaaauccagacguccggcaccacgaccauuuucgccgggcaccucaagugccgccugaaaauggauaagcucacacucaagggcaugaguuacgugauguguaccggguccuuuaaacuggagaaggagguggcggaaacacagcacgguaccguacuggugcagaucaaguacgagggcaccgacgcuccuugcaagaucccauucagcacccaggacgagaaggggguuacgcagaacggccggcugauaaccgcgaauccgauagucacugauaaagagaaacccgugaacaucgaggccgaaccgcccuuuggggaguccuacaucgugaucggcgucggcgagaaggcgcuuaagcugagcugguucaaaaaaggguccagcaucggcaagauguucgaagccaccgcccgcggugcccggcgcauggccauccugggggacacggcgugggacuucggguccaucggcggcgucuucaccuccguggggaagcuaguccaccagaucuucggcaccgccuacggcgugcuguucuccggcguaagcuggaccaugaagaucgggaucggcgugcugcucacuuggcugggccucaacuccagaagcaccucccucagcaugaccugcauagccguuggguuggugacccucuaucucggcgucauggugcaggccgauuccgggugugugaucaacuggaagggccgugaacugaagugcgguagcggcaucuucgucacgaaugaggugcauaccuggaccgagcaguacaaguuccaagccgacagcccgaaaaggcugagugcggcaaucgguaaagccugggaagaaggggucugcggcaucaggagcgcuaccagacuagagaacauuauguggaagcaaaucucuaaugagcugaaccacaucuuacucgagaaugacaugaaauucaccgucgucgugggugacgucgccggcauccuggcgcagggcaagaagaugauacggccccagcccauggagcauaaauauagcuggaagaacuggggcaaggcgaagaucauaggggccgacgugcagaacuccacguucaucauugacgggcccaauacuccugagugcagugacgaccagcgcgccuggaacauaugggagguggaagacuacgguuuugggaucuucaccaccaacauauggcugaagcuccgcgacuccuacacgcaggucugcgaucaccgccugaugagugcggccauuaaggacuccaaggcggugcaugccgacaugggcuacuggaucgagagcgagaaaaacgagaccuggaaacuagcccgggcguccuucaucgagguuaaaaccuguaucuggcccaagagccacacucucugguccaacggcguccuggaaagcgaaaugaucaucccuaagaucuacggcggccccaucagccagcauaacuaccgcccaggguacuucacgcagaccgccggcccguggcacuuagggaagcuggagcuggacuucgacuuaugugagggcaccaccgugguagucgaugagcacugcggcaaccgggggcccagccuccgcacgaccacuguuaccgguaagauaauccaugagugguguugccggucaugcacgcugccgccccuccgcuuccggggggaggauggcugcugguauggcauggagauccgccccgugaaggagaaggaggagaaccucgucaagagcauggugagcgccggauccggggagguggauaguuucuccuuggguuuguugugcaucagcaucaugauagaggaggugaugcggucgcgcuggagcaggaagaugcugaugacgggaacucuagccguguucuuccuucugaucauggggcagcugacguggaacgaccucauccgcuuaugcauaauggugggcgccaacgcauccgaccgcaugggaaugggcacgacguaccuggcucuaauggcaaccuucaaaaugcggccaauguucgcagucggccuccuguuucgccggcucacuucgcgcgaggugcuccugcucacgauugggcugagccuggucgccagcguggaacucccuaacucccuggaggagcugggcgacggccuugcgaugggcaucaugauccugaaacugcucaccgacuuccagagccaucagcugugggccacccugcucaguaugacauucaucaagacgaccuucagcuuacacuaugccuggaagacuauggcgauggugcuguccaucgucagccucuucccccugugcuuauccaccacgagucagaagacgaccugguugcccgugcugcugggcucccuggggugcaaaccccucaccauguuccugauugccgagaauaaaaucuggggccgcaaaagcuggccgcucaacgaggguaucauggccgugggcaucgucagcauccuccuguccagccuccugaagaacgacgugccccuggcggggccccucaucgccggagguaugcugaucgccugcuaugugaucucagggucaucggcagaccugucgcuggaaaaggccgcagaggucuccugggaggaggaggccgagcauagcggggccucccauaacaucuugguagaggugcaggacgacgggacgaugaagauaaaggaugaggaacgagacgacacccugaccauccuccuuaaggcgacccuguuagccgucagcgguguguacccccuaucuaucccggcaacccucuucgugugguacuucuggcagaagaaaaagcaaagaagcgggguccucugggacacccccaguccgcccaagguggagcgcgcggugcuggacgacggcaucuaccggauaaugcagcgcgggcugcuugggcguagccaggucggcgucgggguguuccaggaaaaugucuuccacacgauguggcacgucacccgcggcgcuguccucauguaccagggaaagcggcuggaaccgagcugggccagcguuaagaaggaccugaucuccuacggagggggguggagacuacaaggcucauggaacaccggggaagagguccaggugaucgccgucgagcccggcaagaauccgaagaacgugcagacggcccccggaacuuucaagaccccggagggcgaggucggcgcuaucgcccuggacuuuaagcccgggaccuccgggucccccaucgucaaccgggaggggaagauagugggccuguacggcaacggcguggucacgaccuccggcacuuacguguccgcgaucgcccaggccaaagccagccaggagggcccccucccugaaaucgaggacgagguguuucgcaagcggaaccugaccaucauggaccugcaccccggcuccgggaagacgagacguuaucuuccagccaucguacgcgaagcaauuaagcggaaaaugcgcacccugauccuggccccgacccgcgugguggccagcgagauggccgaggcguuaaagggcaugcccaucagauaucagaccacggccgucaagagugaacacaccggcaaggaaaucguggaccugaugugucacgcaaccuucaccaugcgacugcucagcccaguacggguacccaacuacaacaugaucauaauggacgaggcccauuucacggaccccuccagcaucgccgcgcgcggguacaucuccacccggguggguaugggggaggccgccgccauuuucaugaccgccacgccacccggcuccguggaggcauucccccaguccaaugcagucauacaagaugaggagagagauaucccggagcggagcuggaacuccggguacgaguggauuacggaguucccagguaaaacugugugguucgugccuuccaucaaggcaggcaaugacaucgccaacugccugcggaagaacggaaagcgggucauccagcugucccguaagacguucgacacugaguaccagaagacgaagaacaacgacugggauuacguggugacuaccgacaucagcgagaugggcgcgaauuucagagcugaucgcgucaucgacccccgacguugccuuaagccggugauacuuaaagacgggccagagcgggucauacucgccggccccaugccggugaccguggccuccgcagcgcagcgucggggucguaucggccggaaccacaacaaagagggcgaccaguacaucuacaugggucagccgcuaaacaacgacgaggaccaugcgcacuggaccgaggccaagaugcugcuggacaacaucaacacgcccgagggcauuaucccagccuuauucgagcccgaacgcgagaaauccgccgccaucgauggugaguaucgcuuacggggagaggcccggaagaccuuugucgaacugaugcggcgcggggaucucccuguuuggcuguccuacaagguggccucggagggcuuccaguacucagaccggcgcuggugcuucgacggcgagcggaacaaccagguccuggaagagaacauggacguggagaucuggacaaaggagggggagaggaagaagcucagaccccgcuggcuggaugcccggacguacuccgacccccuggcccuccgcgaguucaaggaguuugcggccggacggcgcucggucuccggggaccugauucuggagauugggaagcucccccagcaccugacucaacgggcccagaaugcucuggacaaccucgucaugcugcacaacagcgagcaaggcgggcgcgcguaccggcaugccauggaggagcugccugacacaaucgaaacgcucaugcugcuggcgcucaucgccgugcugacgggcggggucaccuuauucuucuuguccggcaagggacucggcaagaccuccaucggacugcucugcgucauggccucuagcguacuguuauggauggcgucuguggaaccccacuggauagccgcgagcaucauucucgaguucuuccugaugguccuacucauccccgagcccgaucgccaacggaccccgcaggacaaccaauuagcuuacgugguuaucgggcuccuguucaugauacugaccguagccgcgaacgagaugggccugcucgagacgaccaaaaaggaccuugggaucggccacguggcgguggaaaaucaucaccaugcugcaaugcuggacgucgaccuucacccagccuccgcuuggacgcuguaugccguggccaccacgauaaucaccccuaugaugcgccauacuaucgagaacaccacggccaacaucagccugaccgccaucgcgaaccaggcagccauacucauggggcuugacaagggcuggcccaucagcaagauggacauaggcgugccccugcucgcccuggguugcuacagccaagucaacccccuaacacucacggcugccgugcugaugcugguggcccauuacgccaucaucggucccgggcuucaagccaaggcgacgcgggaggcccagaagcgaaccgccgcgggcaucaugaagaacccgacuauagacggaaucguagccaucgacuuagauccuguuguuuacgacgcgaaguucgagaagcagcugggccagaucaugcuccucauccuguguaccucccagauacuccugaugagaaccaccugggcacuaugcgagucuaucacccucgccaccggaccccugacuacacugugggagggcucccccgguaaguucuggaacaccaccauugcuguuucaauggcgaacaucuuccggggguccuaccucgcgggcgccggucuugcguucagccugaugaagucccucgggggcgggcgacggggcacgggggcucaaggagagacccugggagagaaauggaagcgccagcugaaccagcucaguaagagcgaauucaacaccuacaagagguccgggaucauggaagucgaccgcagcgaagccaaagaaggccugaaacgcggcgagacaacaaagcacgccgugagucgcggcaccgccaaacugcguugguuuguggagaggaauuuggugaagccggaggggaaggugauagaucugggcugcggccgcggcggguggagcuacuacugcgccggacugaagaaggucacugaagugaagggauacacaaagggcggccccggccaugaggagcccaucccgauggccacguacggcuggaacuuagugaagcugcacuccggcaaagacgucuucuucauaccccccgaaaagugugacacauuacuaugcgacauuggugagucguccccgaaccccacgaucgaggaggggaggacauugcgugugcugaagaugguagagcccuggcugcgcgggaaucaauucugcaucaagauucuaaacccuuacaugccauccguaguggaaacgcuggagcagaugcaacggaaacacggcggcaugcuggugaggaacccucuaucccggaauaguacgcaugagauguacugggucuccugcggcacuggcaacaucgugucagcugugaacaugacaucccgcaugcugcuaaaccgguuuaccauggcccacaggaagcccacguacgagagggacgucgaucucggggccggaaccaggcacguggccguugagcccgaagucaccaaccuggacauuaucggucaacggaucgagaacaucaaguacgagcacaagagcaccuggcacuacgaugaggacaacccguacaaaacgugggccuaccauggguccuacgagguuaagcccagcggcuccgcguccagcauggucaacggagucguuaaacugcucacgaaaccgugggacgucauacccauggugacccagaucgcuaugacugacacgacccccuucgggcagcagaggguguucaaagagaaagucgacacacguacgcccaaggccaagcgaggaacggcgcagauuauggaggugacggcacgcuggcugugguccuuuuuaagccggaacaagaagccgcgcaucugcaccagggaggaguucacccgaaaggugcgauccaacgcggccaucggcgccgucuucguggacgagaaccaguggaacagugccaaggaggcgguggaggacgacagauucugggaccucguccaccgggagcgugaacugcacaagcagggaaagugcgcaacgugcguguacaacaugauggggaagcgggagaagaaacugggcgaguucgguaaggccaagggcucgcgggcgauuugguauauguggcuaggggcccgguucuuggaguuugaagcacugggcuucaugaacgaggaccacugguucucccgcgagaacagucucuccggcgucgagggggagggccuccacaaauuaggauacauacuucgugacaucuccaagauaccgggcgggaacauguacgccgacgacaccgccggcugggacacccgcaucacggaagacgaucugcaaaaugaagccaagaucacggacaucauggaacccgagcacgcccugcucgccaagagcauuuucaagcugaccuaccagaacaaaguagugcgggugcagcgcccggcaaagaacggcacugucauggacguaaucucccgacgggaccagcgcgguucuggccagguggguaccuauggccugaacacguuuacgaacauggaggcccaacucauccggcaaauggaguccgaaggcauauucagccccaacgagcuggaaaccccaaacuuagcagaaaggguguuggacuggcuggaaaaguacggcguggaacguuuaaagcgcauggccaucucgggcgacgauugcgugguuaagcccaucgaugaccgguucgcgaccgcccuuacggcccugaacgauauggggaaggugcgcaaggacaucccgcaaugggaacccagcaaagguuggaacgacuggcagcaggucccauucugcagucaccacuuccaccagcuuaucaugaaggacgggcgggagaucgucgugcccugccgcaaucaggacgagcuugugggccgggcgcgcgucagccagggcgccgguuggagccugcgggaaacagcgugccugggcaaguccuacgcccagauguggcagcucauguacuuucaccgccgcgaccugcggcuggcugccaaugcuaucuguagcgccgugccggucgacugggugcccacgucccggacaacguggagcauccaugcccaucaccaguggaugaccaccgaggacaugcucuccguuuggaaccggguguggaucgaggagaaucccuggauggaagacaagacccggaucagcuccugggaggacgugcccuaccucgggaagagggaggaccagugguguggcagccugaucgggcucacugcucgcgccacgugggcgaccaauauccagguagccaucaaccaagugcggcgcuuaaucggcaacgagaacuauuccgacuauaugaccagcaugaagcgguucaaaaaugaguccgagccugagggcgcgcugugguag

SEQ ID NO: 24782 - RNA, 9879 nt, Artificial Sequence
  derived and/or modified CDS sequence (opt11) from DENV-1__FJ176780__SS-prME
uccgugaccaugcugcucaugcugaugccgaccgcccuggccuuucaccucaccacccggggcggagagccccacaugaucguaagcaagcaagagcggggcaagucucuccuguucaagaccagcgccggggugaacaugugcacucucaucgccauggaccugggagaguuaugcgaggacacgaugaccuauaagugccccagaaucacggaagccgagcccgacgacguggacugcuggugcaacgccaccgacacaugggugaccuacgggaccuguagccagacgggggaacaccgacgggacaagagauccguagcccucgcuccccacgugggccuggggcuagaaacgcgaacugaaaccuggaugagcuccgaaggcgccuggaagcagauccaacgggucgagacaugggcccuccggcaccccggguucacugugaucgccuuauuucuggcucacgccaucgguaccagcaucacccagaaggggauuaucuucauucuccugaugcuagugacucccagcauggcuaugcggugcgugggcauaggcagccgcgauuucguggaggggcuuuccggcgccacguggguggacgucguacuggagcacggguccugugugaccaccauggccaaggacaagcccacccuggacaucgaacuccucaagacggaagucaccaaccccgcgguacugaggaaguuaugcauagaggccaagaucuccaacaccaccacggacagccgcugcccuacccaaggcgaagcuacgcuggucgaagaacaggacgccaacuucgucugucggcgcaccuucguggaccgggguugggggaacggaugugggcuuuucgggaaggggucacucauaaccugcgccaaguucaagugcgugaccaagcuggagggcaagaucguccaguaugagaaucugaaguacagcgugaucguuacaguccacacuggcgaccagcaucagguggggaaugagaguacggagcacggcaccaccgcgaccaucacgccccaggcaccaacgaccgagauccagcucaccgacuacggggcccugacccuggacugcagcccccgaacgggccucgacuucaacgagaugguacugcugaccaugaaagagaaguccuggcucgugcacaagcaaugguuccuggaccugccccuccccuggacgaguggggccucgaccucccaagagacauggaaccgccaggaccugcuggucaccuuuaagaccgcccacgcgaagaagcaggagguaguggugcucggcucucaggaaggcgccaugcacaccgcccugacgggggccaccgagauucaaaccuccggcacgaccaccaucuucgccggacaccuaaagugccgccucaaaauggacaaguuaacccugaagggcaugucuuacgucauguguacaggguccuucaagcucgagaaggagguggcggagacgcaacacggcacgguguugguucagaucaaguaugaggggacagacgcccccugcaagauccccuucagcacacaggaugagaagggggugacgcagaauggucggcugaucaccgccaauccgaucgugaccgacaaagagaagccagucaauaucgaggccgagccgcccuucggcgaguccuacaucgugaucggcgcgggcgagaaggcccugaagcucucuugguucaagaagggguccagcaucggcaagauguucgaggcaaccgcccgcggggcccgccgaauggcgauccugggcgauaccgcuugggacuucgggagcaucggcggcgucuucaccucggucgggaaacugguucaccagaucuucggcaccgccuacggggugcuguucuccggagucagcuggacgaugaagaucgggaucggcgugcuguuaacauggcucggccugaacucacgcagcaccucucuaaguaugaccuguaucgcaguggggcucgucacccuauaccuaggcgugaugguucaggccgacuccgggugcguuaucaauuggaagggcagggaacucaagugcgguagcggcauauucgugacgaacgagguacacaccuggacggaacaauacaaguuucaggccgacucgccaaagcgccugagugccgcaaucggcaaggccugggaggaaggggugugcggcauccggagcgccacccgccuggaaaauaucauguggaagcagaucuccaacgaacucaaccacauccuacuggagaacgacaugaaauucaccgugguggugggggacguggcggguauacucgcccaagggaagaagaugauccggccccagcccauggaguacaaguacuccuggaaaagcugggggaaggccaagaucaucggggccgacgugcagaauacgaccuucaucauugacggucccaacaccccggaguguccggacgaccagcgcgcguggaacaucugggaggucgaggacuauggcuucgggaucuucaccacgaacaucuggcugaagcuacgggacagcuacacccaggugugcgaccaucgccucauguccgcugccaucaaggacagcaaggccgugcacgccgacaugggguacuggaucgaguccgagaagaacgagacguggaagcuggcgcgggcgagcuuuauagaggugaagaccugcaucuggcccaaaucccacacgcugugguccaacgggguucuagagucagaaaugaucauccccaagauuuacgggggcccgauuagccaacacaacuaccgccccggguacuucacccaaaccgccggcccuuggcaccuggggaagcuagagcucgacuucgaccugugcgagggcacaacggucgugguggacgagcauugcggcaaccgggggcccucccugcgcacgaccacagucacgggaaaaaucauacacgagugguguugccguucaugcacacugccuccucuccgcuuccguggggaggacggcuguugguacgggauggagauccgccccgucaaggagaaggaagaaaaccuggugaaguccauggugagugccggcucgggcgaggucgacuccuuuagccuugggcugcuaugcaucuccauaaugaucgaggagguaaugagaagccgcuggucccguaagaugcucaugaccggcacucuggccguguucuuccugcucaucauggggcagcugacguggaacgaucugauccgccucugcaucaugguuggcgcgaacgccagcgaucgcauggggaugggcaccacauaccuugcccuuauggccaccuuuaagaugcggccgauguucgccguaggucuccuguucaggcggcugacgagccgggagguucuacugcugaccaucgggcucagccuggucgccuccguggagcugcccacaagccucgaggaacucggcgacggacuggccauggguaucaugauccucaaacuguugacggacuuccagucccaccaacucugggcuacgcugcugucgcucacguucgucaaaaccaccuucagucugcacuacgccuggaagacgauggcgaugguacugagcaucgugucccucuucccccugugucuuucgacuaccucccagaagaccacuuggcuccccguccugcugggcagccucgggugcaagccgcugaccauguuucugaucgccgagaacaagauauggggacgaagguccuggccccuaaacgaggggaucauggccguggguauuguaucgauccugcugagcucccuacugaagaacgacgucccacuggccgggccccucaucgcgggcggcaugcuaaucgcgugcuauguaaucagcggauccagcgcagaucugucccucgagaaggcggccgaggugaguugggaggaggaggcugagcacuccggcgcgagccacaauauccugguggaggugcaggacgacgggaccaugaagaucaaggacgaggagcgggacgacacuuugacuauccuccugaaggcgacgcuucuagccguguccggcgucuauccuuuaagcauccccgccacccuguucgugugguacuucuggcaaaagaagaagcaacgcucagguguccucugggacacuccaucgccgccagaggucgagcgggccgugcuggacgacggcauuuaccgcaucaugcagcgcggcuugcuggggcgcucccaggugggcgucggaguguuccaggagaacguguuccauaccauguggcacgucacgcggggcgcggugcuaauguaccaggggaagagacuggaacccagcugggccuccgugaagaaagaccugaucagcuauggcggcggguggcgucuccaggguuccuggaacaccggggaggagguccaggugaucgccguagagcccggcaagaaccccaaaaauguccagaccgcccccgggaccuucaagacgcccgaaggcgaggucggggccaucgcgcuggauuucaagcccgggacaagcggcucccccauagugaacagagagggcaagaucgucggucuguacggcaacgggguggugacuaccucaggcacguacguaagcgcgauagcccaggccaaggcgucucaggaggggccgcuccccgagauugaggacgagguguuccggaagcgcaacuugacgaucauggaccugcaccccggcagcgggaagacccggcgcuaccucccggccaucgugagagaggccaucaagcguaagcugcgcaccuugauucucgcccccacgcgggucguggccagugagauggcggaggcccugaagggaaugcccauccgcuaccagaccaccgccgucaagagugagcauacaggcaaggagaucguugaccugaugugccacgccacguucaccaugcggcuccuauccccugugcgcgugccgaacuacaacaugaucaucauggacgaggcccacuucaccgaccccagcuccaucgcggcccggggcuacaucagcacccgcgucggcaugggcgaggcggccgccaucuuuaugacggcgacgccgcccgguuccguugaggcauucccgcagagcaacgcgguuauccaggacgaggaacgggacauccccgagcgcuccuggaacuccggguaugaguggaucaccgacuuccccggcaagacagucugguucgugcccagcaucaagagcggcaaugacaucgccaacugccugcggaaaaacgggaagcgcgucauccagcucucccguaagacguucgacaccgaguaccagaagaccaagaacaaugacugggauuacgucgucaccacggacaucuccgaaaugggcgcgaacuuccgcgccgaccgggugaucgacccucgccggugccugaagcccgucauccugaaggacgggcccgagagaguaauccucgccgggcccaugccggucaccguagccucggccgcgcagcggcgcgggcggaucggccgcaaucacaacaaggaaggcgaccaguauaucuacaugggacaaccccugaacaaugacgaggaccacgcccacuggaccgaggcgaagauguugcucgacaacauuaacacccccgagggcauaauucccgcccuguucgagcccgagcgcgagaagucggccgcgaucgacggggaguaucggcugaggggcgaagcucggaagacguucguggaacucaugagaagaggagaccugcccgucuggcuguccuacaagguggcuucagaggguuaccaguacuccgaccggcgguggugcuucgacggcgagcgaaacaaccaggugcucgaggagaacauggacgucgagauuuggaccaaagaaggggaacgcaagaaacugcgcccccgguggcuggacgcccgcaccuacagcgacccccucgcccugcgggaguucaaggaauuugcggcaggccgucguagcgugucgggggaucuuauacucgagaucggcaaacuuccgcaacauuuaacccagcgcgcccagaacgccuuggacaaccuggugaugcugcacaauucagagcagggaggccgggcguaccgccaugccauggaggagcuccccgacacgaucgagacccuuaugcugcucgcucugaucgccguucugaccggcggggugacucucuucuuucuguccggccgagggcugggcaaaaccucuauuggccuacugugcgugauggccuccagcguccugcucuggauggcguccguagagccccacuggaucgccgccagcauaauacuggaauuuuuccugaugguucuccugauccccgagccggaccgccagcggacuccccaagacaaccagcuugccuacgucgugaucgggcucuuguucaugauuuugaccguggccgcuaacgagauggggcuccuggagaccacgaagaaggaccuagggaucggacacgucgcaguggagaaccaccaucacgccgcuaugcucgacguagaucugcacccggcuuccgcguggacgcuguacgccguggccacgaccaucaucaccccgaugaugcgccauacaaucgagaacaccaccgccaacaucagcuuaaccgccaucgcgaaucaggcagccauccugauggggcuggauaaggguuggccgaucuccaagauggacaucggggugccacuacuggccuuggggugcuauagccaggugaacccccucacgcugaccgcggccguccugaugcucguugcccacuacgccaucauuggaccgggccugcaggcuaaggcgacccgcgaggcccaaaagcggaccgccgccggcaucaugaagaaccccacgguggauggaaucgucgccaucgaccuggacccggugguguacgacgcgaaguucgagaagcagcucggucagaucaugcugcugaucuugugcaccucccagauccugcuuaugcggaccacaugggcccucugcgaaagcaucacgcucgccaccggcccucugaccacccucugggagggguccccgggcaaguuuuggaacacuaccauagccguuagcauggcaaacaucuuucggggguccuaccuggcgggcgcuggcuuagccuucagccucaugaagucucucgggggcgggcgcagagggaccggcgcccagggcgagacccugggcgaaaaguggaagcgccagcucaaccaguuauccaagagcgaguuuaacaccuacaagcgguccgggaucauggagguggaccgcagcgaggcaaaagagggcuuaaagcgaggggagaccaccaaacacgcagugucccgcggcaccgccaaguuacggugguucgucgagcgcaaccucgugaagcccgaggggaaggugauagacuugggcugcggccgcgggggcuggagcuauuacugugccgggcucaagaaggucacggaggugaagggcuacaccaaagggggccccggccacgaggaacccauuccgauggcgacuuacggguggaacuuagugaagcugcacagugguaaggacgucuucuucaucccgcccgagaagugugacaccuuacucugcgacaucggggagucuucccccaaccccacgauugaggagggccgcacccugcgggugcugaagaugguggagcccuggcuccgcgguaaccaguucugcaucaaaauccugaaccccuacaugccuagcgucguggaaacacuggagcagaugcagcggaagcacggcggaauguuagugcgcaacccgcuaucccggaacagcacccacgagauguacugggucuccugugggacuggcaacaucguguccgcggugaacaugacgagccgcaugcugcucaaccguuuuaccauggcucaccggaagccuaccuaugagcgggacguagaucugggggccggcacccggcacguggcgguggagcccgaggucacgaaccuagacaucaucggacagcgcaucgagaacaucaagcacgaacacaagagcaccuggcacuacgacgaagauaaccccuauaaaaccugggccuaccacggguccuacgaggugaagccaagcggauccgcgagcagcauggucaacgggguggugaagcuccugaccaagcccugggacgucauccccauggugacgcagaucgcaaugacggacacuacacccuucggacagcagcgaguguucaaagagaaagucgacacaagaaccccgaaggccaagcgagguaccgcccagaucauggaggugaccgcgaaauggcuguggggcuuccucucaagaaauaagaagccccggauaugcacgcgcgaggaguucacccggaaggugcgcagcaacgcggccaucggagcggucuucguggacgagaaucaguggaacuccgccaaggaggcgguggaagacgaacgguucugggaccugguucaccgugaacgggagcuccacaagcaggggaagugcgcgaccugcguuuacaacaugauggggaagcgcgagaagaagcucggugaguuuggcaaggccaaggggagccgggccaucugguacauguggcugggcgcucgcuuucuugaguucgaggcucucggcuucaugaacgaggaccacugguucucgcgggagaacagccuauccggggucgagggcgaaggccugcacaagcucgguuacauccugcgggacauuagcaagauacccggaggcaacauguacgccgacgacaccgcaggcugggacaccaggauuacugaggacgaucugcagaacgaggcccgcaucaccgauaucauggagccggagcacgcauuacuggcgaaguccaucuucaagcugacguaccagaacaaggucgugcgcgugcagcggcccgccaagaaugggacggucauggacgugaucagccgccgggaccagcgcggcuccggccagguggggaccuacggccugaacaccuucaccaacauggaggcacagcugauacggcagauggagagcgaggggauauuuucccccucggagcuggagacgcccaauuuagccgagcgcguccuggacuggcucgagaaguacggcguggagaggcucaagcgcauggccauauccggggacgacugcgugguaaagcccaucgaugaccgguucgcgaccgcucugaccgcucugaacgacaugggcaaggugcguaaggacaucccccagugggagcccuccaagggguggaaugacuggcagcagguuccguucugcucccaccacuuccaccagcucauaaugaaggacggccgggagaucgucgugcccugccgcaaccaggaugagcugguggggcgggcccgagucagccaaggggccggguggagccugagggagaccgcgugccucgggaaguccuacgcgcaaauguggcagcuuauguacuuccaccgccgugaccugcgccucgccgccaacgcgaucugcagcgcggugcccguugacuggauucccaccucccggaccaccuggagcauccacgcccaccaccaguggaugaccacugaggacaugcuguccgucuggaaccgcguguggaucgaggagaaccccuggauggaggacaagacucacauuagcuccuggggugacguaccguaccuaggaaagcgcgaggaucaguggugcggaagccucaucggccugaccgcccgggccaccugggccaccaacauacaggucgcaaucuaccaggucaggaggcugaucgggaacgaaaacuaccuugacuacaugacgucgaugaagcgcuucaagaacgaaagcgaccccgagggugccuuaugguaa

SEQ ID NO: 24783 - RNA, 9879 nt, Artificial Sequence
  derived and/or modified CDS sequence (opt11) from DENV-1__JN205310__SS-prME
agcgugacagugcuguucauguuacuacccaccgcccuggccuuccaccuuaccacccugggcggggaaccccauaugaucgugagcaagcaagaacgcggcaagagccuccuguucaaaacauccgcgggggugaacaugugcacccugauugccauggaccugggcgaacucugcgaagacaccaugaccuacaaaugcccccggaucacagaaaccgaacccgacgacguugacugcuggugcaacgccaccgagaccugggugaccuacgggacuugcagccagaccggcgagcaccgcagggacaaacgcuccguggcccuggcgccccacgucggccuggggcucgaaacccggaccgagaccuggauguccuccgagggagccuggaagcagauccagaagguggagacgugggcccugcgccacccuggguucaccgugauagcgcuguuucucgcucacgcgaucgggacaagcauaacccagaagggcaucaucuuuauacuauuaaugcucguuacgcccuccauggccaugcggugcgugggcauuggcaaccgcgacuucguggaggggcccagcggugccacauggguugacguggugcuggagcacggauccugcgucacuacaauggccaagaauaagccgacacuggacaucgaacuccuuaagaccgaggugaccaacccggccauuuuacggaaacuuugcauagaggcgaagauauccaacacuacgaccgacucgcggugccccacccagggcgaggccacccugguggaggaacaggacacgaacuucguaugucgccggacuuucgucgaccggggcugggggaacgggugcgggcuguucggcaaggggucacucaucacgugcgccaaguuuaaaugcgugaccaagcuggagggcaagaucguccaguacgagaauuugaaauacucggugaucgugacuguccacaccggcgaccagcaccagguugggaaugagaccaccgagcacggcaccacggccaucauaacgccccaggcuccgacaagcgagauccagcucaccgauuacggggcgcugacaccggacuguagcccccgcaccgggcucgauuucaacgagaugguucuucugacaaugaaggagaagaguugguuagugcacaagcagugguucuuagaucugccccuaccguggaccuccggcgccagcacgagccaggaaaccuggaaccggcaggaccugcuggugaccuucaaaaccgcccacgccaaaaagcaggaggucguggugcugggaucgcaggaaggugccaugcacaccgcgcucaccggggccaccgagauccagacuagcgggacgacaaccauauucgccgggcacuuaaagugccgccugaagauggacaaacucacccugaagggcgucucauacgugaugugcacagggagcuucaaacuggaaaaggagguggccgagacccagcacggcaccgugcucguccaggugaaguacgagggcaccgacgccccaugcaagauccccaguaguucgcaggaugagaagggaguuauccagaacggccgauuaaucacggcaaacccaauugugaccgacaaggagaagccugugaacaucgaggccgagccgcccuucggggagagcuacaucgucgugggcgccggcgaaaaggcccugaagcugucaugguuuaagaaggggagcuccaucggcaagauguuugaggcgaccgccagaggggcccggcgcauggcuauacucggcgacaccgccugggauuucggcucgaucggcggcguguucacguccgucgggaagcuggugcaccagaucuucggcaccgcguacgggguucuguucagcggcgucuccuggaccaugaagaucgggaucgguauccuccugacauggcuagggcucaacagccgguccacgagccuguccaugaccugcauugcggucgggauggugacccuuuaucucggcguuauggugcaggccgauagugggugcgugaucaacuggaagggaagggagcugaagugcggaagcggcauuuucgucacgaacgaagugcauacguggaccgagcaguacaaguuccaggcagacuccccuaagcgccuaagcgccgcgaucgguaaggcaugggaggaagggguguguggcaucagguccgccacccgucucgagaacaucauguggaagcagauuagcaacgagcugaaucacauccugcucgagaaugacaugaaguucacggugguugugggggaugucuccggcauccuggcccaggggaagaagaugauucggccccagccgauggagcauaaguacagcuggaagucuuggggcaaggccaagauaaucggcgcggacgugcagaacaccacguucauaaucgacggucccaacacgccugagugccccgauaaccagcgcgcuuggaacauuugggagguggaagacuacggcuucggaauauucaccaccaacauauggcugaaacuccgggauucguucacgcaggucugugaucaucgccugaugucugccgccaucaaggacagcaaggcggugcacgccgauaugggcuacuggaucgaguccgagaagaaggagaccuggaagcuggcccgggccucauucaucgaggugaagaccugcaucuggccaaagagccacacccucuggucuaauggcguucuagagagcgagaugauuauuccuaagaucuacgggggucccguuagccaacacaacuacaggccgggguacuucacacaaacagccggacccuggcaccucgggaaacuagagcuagacuucgaccugugcgaagguaccaccguggucguggacgaaaacugcggaaaccggggucccucgcucaggacgaccaccguuaccgguaagacgacccacgagcgcugcugccgcagcugcacccugcccccucugcgguuuaagcgcgaggaugggugcugguacggcauggagauccggcccguuaaggagaaggaggagaaccucguuaagucgauggugucagcgggaagcggcgaagucgacuccuucagccuaggccuacucuguaucaguauaaugaucgaggaggugaugcgaagccgauggucgcgcaagaugcugaugaccgggacgcuggccguguuccuccugcugaccaugggccagagcaccuggaacgaccuuauccggcugugcacaauggucggggcgaacgccagugacaugaugggaaugggcacgacguaccuggccuuaauggcgacauuccgcaugcggcccauguuugccguuggucugcuguuccggcgccugacgagcagagagaucuugcugcucacggucggccugucccucguggcauccguugagcuccccaacucccuggaggaacucggcgacggccucgccaugggaauuaugaugcugaaacuucucaccgacuuccagccgcaccagcugugggccacccuccucucucugaccuucgucaagacaacgcugucccuccauuaugcguggaagaccauggccaugaucuuaucuauagugucccuguugccccugugucucagcaccaccucccagaagaccaccuggcucccggugcuccuggguagcuuaggcugcaagccccuuaccauguuccugaucacagagaacaagaucugggggcgccggagcuggccgcucaacgagggcaucauggccaucgggaucgucaguauccugcugagcagcccccugaagaacgaugugccccuggcaggcccccucaucgcaggagggaugcucaucgcaugcuacgugaucaguggguccucggccgacuugucccuggagaaagccgccgaggucagcugggaggacgaggcggaacacuccggggcaagccauaacaucuugguggaggugcaggacgacggcacuaugaagauuaaggacgaggaacgcgaugacacccugaccauccugcucaaggccacucugcuggucaucuccgguguguacccgaugagcauucccgccacccucuucgugugguacuucuggcagaagaagaaacagagauccggcguccugugggacacccccuccccgcccgagguagagcgcgccgugcuggacaacgguaucuaccggauccuccagcgcggccugcuuggcagaucccaggucgggguaggcguguuucaggaagggguuuuccacaccauguggcaugugacccgcggcgcgguacucauguaucaggggaagcgguuggagcccucgugggcauccguaaagaaggaccugaucucauauggcggcggguggagauuccagggcuccuggaauacgggggaggagguccaggugauagccgucgagcccgguaagaaccccaaaaacguacagaccacccccgggaccuucaagacgcccgagggcgaggugggggccaucgcucuggauuucaagcccgggaccucgggcucaaccaucgucaaccgggaagggaagaucguagggcucuacggcaacgggguggucaccacguccgguaccuacgugagcgcgauagcucaggccaaagccucccaggagggaccacugcccgagauagaggacgagguuuuccgcaaacguaaccugaccauuauggaucuccaccccgggagcgguaagaccagacgguaccugccugccauaguccgugaggcgauaaagcggaagcugcgcacgcucgugcuggccccgacccgcguggucgccuccgagauggccgaggcucucaagggcaugccaauccgguaccagaccaccgccgugaagucagagcauacgggcaaagagaucguggaccuuaugugccacgcaacguuuacgaugcgccugcucucgcccguccgggugccgaacuacaauaugaucauaauggacgaggcccacuuuaccgacccggccagcaucgcggcccgcggguauaucagcacgcgggugggcaugggggaggccgcagcuaucuucaugaccgcgacgcccccaggcagcgucgaggccuucccacaauccaacgccgugauccaggacgaggaaagagauauuccggaacggagcuggaacucuggauacgaguggauuacagauuuccccggcaaaacggugugguucguccccuccaucaaguccggcaacgacaucgccaacugucuccgcaagaacgggaagagggugguucagcugagccgcaaaaccuucgacaccgaguaccaaaagaccaagaacaacgacugggauuacgucgugacgaccgacaucucugaaaugggcgccaauuuccgagcggacagggucaucgauccccggcgcuguuuaaagccggugauccucaaagacgggcccgagcgagucauccuggccggccccaugcccgucacgguugccagcgccgcgcagagacggggucgcauaggucggaauccuaauaaggagggcgaccaguacguguauaugggacaaccccuaaacaacgacgaagaccacgcgcauuggaccgaggccaagaugcucuuggauaacaucaacacgccugaggggaucaucccugcccuguuugagcccgagagggagaagagugccgcgaucgacggggaguaucgccugcggggcgaggcccgcaaaacuuucguggaguugaugcggagaggggauuuacccgucuggcuaagcuacaagguggcuagcgagggcuuccaauacuccgaccgaagaugguguuucgacggagagagaaacaaccaggugcuugaggagaauauggaugucgaaauuuggaccaaggagggggaacgcaagaagcugcgacccagguggcucgacgcacggacuuacucggacccacuggcucuacgcgaauuuaaggaguucgcggccggccggagauccgucagcggugaucucauccuggaaaucgggaagcugccgcagcaucucacccugaaagcccagaacgcccuggacaacuuggucaugcugcacaacuccgagcagggcgguaaagccuaccggcacgcgauggaggagcugccugacacgaucgagacccucaugcuguuggcccucauugccgugcugaccggcggagugacccuguuuuuccucagcggccgcggccuagguaagacguccaucggccugcuuugugucauggccuccuccguucugcuguggauggcgagcguggaaccccacuggauagccgccuccauuauccucgaguucuuccugaugguccugcucaucccggagcccgaccgccagcgcacgccccaggauaaccagcuagccuacguggucauagggcuccuguucaugaucuugaccguggccgcgaacgaaaugggccugcuagagacgacgaagaaggacuuggggaucggccacgcagccgccgagaaccaucaucacgccgcgaugcuggauguggaccuccaccccgccagcgcguggacccuguacgcaguugcuaccaccauuaucacgccgaugaugcggcauaccaucgaaaacaccacugcgaacaucucccugacagccaucgcuaaccaugccgccaucuuaauggguuuagacaagggguggccgaucagcaaaauggacaucggagucccccugcucgcguuggggugcuacucccagguaaacccccugacccucaccgccgcggugcugaugcuaguggcucauuacgcgaucaucggcccgggauugcaggcaaaggccacccgcgaggcccaaaagcggacggcggcgggcaucaugaagaaccccaccguggacgggauaguggcgaucgaccuggaccccgucgucuacgacgcuaagauagagaagcagcugggccagauuaugcuacugauccucugcaccagccagaucuugcuaaugaggaccacaugggcccugugcgagucaaucacccucgccaccggcccgcugaccacgcuuugggaggggagcccgggcaaguuuuggaauacuaccaucgcgguguccauggcgaacauauuccguggcagcuaccucgccggagccggucuggcauucagccugaugaagucccucggaggugggcgucgcgggacaggcgcgcagggagaaacgcugggcgagaaguggaagcggcagcugaaccagcucucgaaguccgaguucaacaucuacaagcgcucugggauuaucgaggucgaccgguccgaggccaaggagggccuaaagagaggggaaacgaccaagcacgccgugucucggggcaccgccaaacuucgcugguucgucgagcggaaccucgucaagccugaggggaaggugaucgaccugggcuguggccgcgggggcugguccuauuauugcgcagggcugaagaaggugacggagguuaagggcuacaccaagggcgggccugggcacgaggaaccgaucccgauggccaccuacgguuggaaccuuguaaagcugcacagcgguaaagacguauucuuuacgccgccggaaaaaugcgacacccuucugugugacaucggagagaguagccccaacccgaccaucgaggagggcaggacccuccgcguacugaagaugguggagccauggcugcgugggaaccaauucugcauaaagauccucaacccuuacaugcccuccgugguggagacgcuggagcagaugcagcguaagcacggcggcaugcucgugcguaauccguuaagccgaaacuccacucaugagauguacuggguaagcugcgggacgggcaacaucgucuccgccgugaacaugaccagccguauguuauugaaucgcuucaccauggcucaccguaagcccaccuacgagcgcgacgucgaccugggggccgggacccggcacgucgcgguggagcccgaggucgcaaacuuggacaucauuggccagcggauugagaauauaaagaaugagcauaaguccacuuggcacuacgaugaggacaaucccuacaagacgugggccuaccacgggagcuacgaggugaagcccuccggcuccgccagcucuauggugaacgggguggugcgccuacucaccaagcccugggauguuauccccauggucacccagaucgccaugaccgauaccaccccguucgggcagcagcggguauucaaggaaaagguagacacgcgcacuccgaaggcgaagcgggggaccgcccaaauaauggaggucaccgcccguugguuguggggcuuucugagccggaacaagaagccccgcaucugcacgcgggaggaguucacaaggaagguccguuccaacgccgcgaucggugcgguauucgucgacgagaaccaguggaacagcgccaaggaggcuguggaggacgagcgcuuuugggaccuugugcauagagagcgcgagcugcacaagcaagggaagugcgcaaccugcguuuacaacaugaugggccggcgcgagaagaagcugggggaguucggaaaagcuaaagggucacgggccaucugguacauguggcucggcgcccgcuuccucgaguucgaggcccugggguucaugaaugaggaccacugguucagccgggagaacucacucagcggcguggagggcgagggacaucacaaacugggcuacaucuuacgcgacaucaguaagauccccgguggcaauauguaugccgacgacaccgccggcugggacacgcggaucaccgaagacgaccuccaaaaugaagcaaagauuaccgacaucauggagcccgagcacgcccugcuggccacaagcaucuucaaacuuaccuaucagaacaagguggucagagugcagcgccccgcgaagaacgggaccgugauggacgucaucuccaggcgcgaccagcgggggagcggccaagugggcaccuacggccugaacaccuucacuaacauggaggcgcaacugauuagacaaauggagagcgagggaaucuucagcccauccgaguuggaaacacccaaccuggccgagcggguuuucgauuggcuggagaagcacggcaucgagcgccucaagcggauggccaucagcggggacgauugugucgugaagcccaucgacgaccgcuucgccacugccuuaaccgcgcuuaacgacaugggcaaggugcggaaggacaucccacagugggagccgcccaaaggguggaacgacuggcagcaggucccguuuugcucccaccacuuucaccagcucauuaugaaagacggucgagagauaguggugcccugccggaaucaggacgagcuggucggccgcgcccgggucucgcagggggccgguuggagucugcgcgaaacggcaugcuugggcaaguccuacgcccagauguggcagcuuauguauuuccaccggcgcgaccugcggcucgcggccaacgccaucugcagcgccguaccugucgacugggugcccaccucucguaccacuugguccauccacgcgcaccaccaauggaugaccacggaggacaugcuguccguguggaaccgcgucuggauagaggagaacccguggauggaagacaagacgcacgugagcuccugggaggacgugccuuaccugggcaagcgcgaagaccaguggugcggcucacucaucgggcugaccgcccgcgccaccugggccacgaacauucaaguggcaaucaaccaaguucggcgccuuaucggcaacgagaauuaccuagacuacaugaccuccaugaagagauuuaaaaaugaaagcgaccccgaaggggcgcugugguag

SEQ ID NO: 24784 - RNA, 9879 nt, Artificial Sequence
  derived and/or modified CDS sequence (opt11) from DENV-1__HQ332182__SS-prME
uccgucacgaugcugcucaugcugcugcccaccgcucuagccuuccaccugaccaccagaggcggggaaccgcauaugauagugucaaagcaggagcgaggcaagagccuguuauucaagaccagcgccggugugaauauguguacucugauagccauggaucugggcgagcucugugaggacaccaugaccuacaaauguccucgcaucacugaggcggagcccgacgacguggacugcugguguaacgcaaccgacaccugggugacuuacgggacaugcagccagaccggcgaacaccggcgcgacaagcgguccguggcccuugcgccccauguggggcucgggcucgagacgaggacugagaccuggaugagcuccgagggcgccuggaagcagauccagcgggucgagacgugggcccugcgccaccccgguuuuacugugaucgcuuuguuccucgcccacgccauaggcaccagcaucacccaaaagggaaucaucuuuauccugcugaugcuugugacccccuccauggccaugcggugcguuggcaucgggaaccgcgauuuuguggaagggcuuucaggcgccacguggguugacgugguccuggaacaugggucaugcgugacgaccauggcuaagaacaagccuacccuggacauugagcugcugaaaacggaagucaccaacccugcaguacugcggaagcuaugcauugaggcgaaaaucagcaauaccacuacggacucccgcugcccgacccagggcgaggccacccugguggaggaacaagacgcaaacuucgucugccggagaaccuucguggaccggggcugggggaacgguuguggccucuucgggaaagggagccuccugacgugcgccaaguuuaaaugcgugaccaagcucgagggcaagaucguccaguacgagaaccuuaaguauuccguuaucguuacgguccacaccggggaucagcaccagguggggaacgagacaacggagcauggcacuauagcgacgaucacgccccaggccccaacgagcgagauccagcugaccgacuacggugcucucacccuugacugcucuccuagaaccggccuggacuuuaacgagauggucuuacugacgaugaaggaaaaguccuggcuggugcauaagcagugguuccucgaccugccucugcccuggaccucaggggcuagcaccagccaggaaaccuggaaccggcaggauuuacucgugacguucaaaaccgcucacgcgaagaagcaggaggucguggugcuggguucccaggagggcgccaugcauacagcccuuacuggggcaacggagauucagaccagcggcaccaccacgaucuuugccgggcaccuaaagugcaggcucaagauggacaaacucacguugaagggcaccuccuacgucaugugcaccgggucguucaagcuggagaaggagguggccgagacgcagcauggcaccgugcugguccaggugaaguacgaaggcaccgacgcccccugcaagauccccuucuccacgcaggaugaaaagggcgugacgcaaaacggccgucucaucaccgccaauccgaucgucacggacaaggagaagcccguuaacaucgagaccgagccgcccuuuggugagagcuacaucguugucggagcgggcgagaaggcccugaaguuauccugguucaaaaaggggagcuccaucggcaagauguucgaggccacggcccgcggugcccggcgcauggccauccucggggauaccgcgugggacuucggaagcaucggcggcguuuucacguccguggggaagcucguacaccagguguucggcaccgccuacgggguguuguuuaguggagucaguuggacgaugaagaucgggaucggcauccuccugaccuggcuaggccucaacagcagaagcaccagccugucaaugacaugcaucgcgguagggaugguuacgcuguaccucggcgucauggugcaggcagacagcgggugugugaucaacuggaagggcagagaguuaaagugcgggagcggcaucuucgucacuaacgaggugcauaccuggacggagcaauacaaauuccaggcggacuccccgaagcgccugagcgcggccaucggcaaggcgugggaggaaggggugugcggcauccgguccgcaacccgccuggagaacauuauguggaagcagauuucgaacgagcugaaccacauucugcuagagaacgauaugaaauucacggucgugguuggggacgccaacggcauccuggcgcaggguaagaagaugauccggccccagcccauggagcacaaguacagcuggaaauccugggguaaggcgaagaucaucggcgccgacauccagaauacaacguucauaaucgacgggcccgacaccccagagugccccgaugaccagcgcgccuggaacaucugggaggucgaggacuauggcuuugggaucuuuacgacuaacauauggcugaagcuccgcgacuccuacacccaaaugugcgaccaccgccugaugagcgcagccauuaaggacuccaaggccgugcaugccgacaugggcuacuggaucgagagcgagaagaaugagaccuggaagcuggccagggcguccuucaucgaagugaaaacgugcacauggcccaagagccacacucuaugguccaacggcguccuggagagcgagaugauuauccccaagaucuacgggggcccgaucucccaacacaauuaccgccccggguauuucacccagacagccgggcccuggcaccuggggaagcucgagcuggacuucgaccuaugcgagggcaccaccgugguggucgacgagcacugcggcaaucgggggccuagccuccgcacuacgaccgugacggggaagaucauccaugaguggugcugccgguccugcacccuaccgccccugcgcuuucgcggggaggauggcugcugguaugggauggagauucgccccgugaaggagaaggaggagaaucucguccggagcauggugucggccggcagcggcgagguggauucauucucccuggggauccugugcgucagcaucaugauugaggaggugaugcgcagccgguggagccgcaaaaugcuuaugacgggaaccuuggcaguguuccuccuacugaucauggggcagcugaccuggaacgaucucauccgacugugcauaauggucggcgccaaugcguccgaccggauggggauggguacgacguaccuggcccucauggccacuuucaagaugcgcccgauguucgccgugggccuucuuuuccggcgccucaccucacgggaggugcuacuccuaaccaucgggcugagucugguagccagcguggagcugcccaauucgcucgaggagcugggugacgggcucgcgaugggcaucaugaugcugaaguugcuaacggaguuccaaccccaccagcuguggaccacccugcucucgcugaccuuuaucaaaacgacccugagucuagacuacgccuggaagacgaccgccauggcgcugagcaucgucuccuuauuccccuuaugccugagcacgacuucccagaagaccaccuggcugccggugcuacugggcagcuuugguugcaagccccugaccauguuccucaucacggaaaauaagaucuggggccggaaguccuggcccaucaacgaggggauaauggcgaucgggaucgugagcauauuacugaguagccuccugaagaacgacguaccacuugccgggccgcuuaucgccggcggaaugcugauugcuugcuacgugaucagcggguccucagccgaccugucacucgagaaggcggccgaggugucgugggagcaggaggccgaacauagcgguaccagccauaacauccuggucgagguucaggacgauggaaccaugcgcauuaaggacgaggagaaggaugauacgcugacgauacuccugaaagccacucugcucgcugucuccggaguguaccccaugagcauacccgcgacacuguucguuugguacuuuuggcagaagaagaagcaacgcuccggagugcugugggacacucccagcccccccgaggucgagcgcgcggugcucgacgauggcaucuacagaauacuucagcggggccugcugggaaggucccaagugggcgucgggguguuucaggacggcguguuccacacgauguggcacgugacccgcggggcggugcuuauguaccaaggcaagcgccuggagcccagcugggccuccgugaagaaggaccugaucagcuacggcggggguuggcgguuccagggauccuggaauaccggcgaagagguucaggugaucgccgucgagccagggaagaauccgaagaacguccaaaccacgcccggcaccuucaaaacacccgagggcgaggugggagcgaucgcucuggacuucaaaccgggcaccagcgggagcccgaucgugaacagggagggcaagauagucggccuguaugggaacggcguggugacgacauccgggaccuacguguccgccaucgcccaggccaaggccagccaggagggaccccugccugagaucgaggaugagguguucaagaagcguaaccucacgauaauggaccugcacccggggucagguaagacacgccgguaccugcccgccaucgugagagaagccauaaagcggaaguuacgcacccuaaucuuagccccaacccgugucguggcgucugagauggccgaggcgcucaaggggaugcccauuagguaccaaaccaccgccguaaagagcgagcacaccgggcgcgaaaucguagaucugaugugccacgccaccuucaccaugcggcuacucuccccggugcgcguccccaacuacaauaugaucaucauggacgaggcgcacuucacggacccggccuccaucgcugcccggggcuacaucuccacccgcguuggaaugggcgaagccgcggccaucuucaugaccgccaccccgcccggcuccguagaggccuuuccgcaguccaacgccgugauccaggacgaagagagggauauccccgagcgcagcuggaacuccggcuaugacuggauaacggauuucccaggcaagacaguaugguucguacccucgaucaaguccgggaacgacaucgccaacugucugcggaagaacggcaaacgggugauucaauuaucucgaaagacuuucgacaccgaguaucagaaaacgaagaacaacgacugggauuacguagugaccaccgacauauccgagaugggggcuaacuuccgcgccgaccggguaaucgauccccgucggugccuuaagccggugauucugaaggacggccccgagaggguaauccuggccgggccuaugcccgugaccgucgcgagcgccgcacagcggcggggucggauuggccgcaaccaaaacaaggaaggagaccaguacguauacauggggcagcccuuaaacaaugacgaagaccacgcccacuggacagaggccaagaugcuguuggacaacaucaacacccccgaagggaucaucccggccuuauucgagcccgagcgcgagaagucggcggccaucgacggcgaguaucgucugcgcggggaagcgcgcaagaccuucguugaguugaugcgacggggcgaucuccccguguggcugagcuacaagguggcuucugagggcuuccaguacagcgaccgccguuggugcuucgacggggagcgcaacaaccagguccuagaggagaacauggacguggagaucuggaccaaggagggugaacggaagaaacuucggccccggugguuggaugcgcgaaccuauuccgauccucuggcgcuccgggaauucaaggaauucgccgccgggcgccggagcgugagcggcgaccugauucuggaaaucgggaagcucccacagcaccugacgcugcgcgcacagaaugcgcucgacaaucuggugaugcuccauaacagcgaacaaggcgggaaggccuaccggcacgccauggaggagcuuccggacaccaucgagacccugauguugcucgcccugauugcggugcuuaccggcggcgugacacucuucuuccugagcgggaaaggccugggcaagaccuccaucgggcuccugugugugacagccagcucugugcuacuuuggauggccucaguggagccacacuggaucgccgccuccaucauucuggaguucuuccucaugguccuccugaucccugaacccgaccgccagcggaccccacaggacaaccagcuggccuacguggugaucggcuuacuguucaugauccugacgguggcugccaacgagaugggccuccuggaaaccacuaagagagaccuggguaucgggcacguggcagccgagaaucaucaacacgcgaccaugcucgacguggaucugcggccggccagcgccuggacgcuguaugcugucgccacgacugugaucacgcccaugaugcgccacacuaucgagaacaccaccgcgaauaucucccucaccgcaaucgccaaccaagccgccauccugaugggccucgacaaagguuggcccaucucgaaaauggacaucggggugcccuuacuggcacuagggugcuauucccagguaaauccgcucacuuuaaccgccgccguguugaugcucguggcccacuacgcaaucaucggccccgguuugcaggccaaggccaccagagaggcgcagaagaggaccgccgccggaaucaugaagaaccccacaguggacggcaucguggccaucgaccuggaccccguagucuacgacgccaaguucgagaagcagcucggccaaauuaugcuucuaauccucugugccucucaggugcugcugaugcgcaccaccugggcccucugcgaguccaucacccucgcgacggguccgcugaccacccucugggagggcucgcccggaaaguucuggaacaccacgaucgcagucucuauggcaaacauauuccggggcagcuaccuagccggcgccggccuggcguucagccucaugaagucacugggcgggggcagaagagggaccggagcccagggcgagacccugggggagaaauggaaacgccagcucaaccagcuguccaaaagcgaguucaacacuuacaagaggagcgguauuauggaggucgacagauccgaggccaaggaggggcugaaaagaggggagacgaccaagcacgcagugagccgcgggacagcgaagcuacggugguucguggaacgcaaccuagucaagccagaggggaaggugaucgaccugggcugcgggcggggugguugguccuacuacugugccggccugaagaaggugacugaggucaagggcuauaccaaggggggccccgggcaugaggagccuauucccauggcgacuuacggguggaaccucgugaagcugcacagcgggaaggacguguucuucaugccgccugagaagugcgacaccuuacucugcgacauaggggaaucaaguccgaaucccacaaucgaggaggggcgaaccuuacggguccugaagaugguggagcccuggcuacgcgguaaccaguuuugcaucaagauccuuaaccccuauaugccguccgugguagagacauuagagcagaugcagcggaagcacggcgggaugcucgugcgcaacccccuaagccggaacucaacgcacgagauguacuggguaagcugcgguaccgggaacaucguguccgcggucaacaugacuagccgcaugcuucucaaccgcuucacgauggcccaccggaagccaaccuacgagagagacguggaccugggcgcgggcacacggcacgucgcgguggagcccgaaguggccaaccuggacaucaucgggcagcgcauugagaauauaaagaacgagcacaaauccaccuggcacuacgacgaggacaacccguauaagacgugggccuaccacggcagcuaugaggucaagccgucugggagcgccucaagcaugguaaacggcgucgugcgucuccugaccaagccuugggaugugauccccauggucacccaaauagcgaugaccgacacgacuccguucgggcaacagcgcguguucaaggagaaagucgacacccguacaccccgggccaagagaggcacgacccagauaauggaggucaccgcuaaguggcuguggggguuccugucccgcaacaagaagccccggaucugcacgagagaggaguucacgcguaaagugcgcagcaacgccgcagugggggcggucuucguggacgaaaaccaguggaacagcgcuaaggaggcaguggaggacgagcgguucugggaccugguccaccgagagcgggagcugcacaagcaaggcaagugcgcgaccuguguguacaacaugauggggaagcgcgagaagaaacucggugaguucgggaaggcgaagggcucccgggcaaucugguacauguggcuaggugcccgcuucuuggaguucgaggcacuaggguucaugaaugaggaucacugguucucccgggagaacuccuugucaggcguggagggggagggccuucacaagcucggguacauccuacgcgacaucuccaagauccccggcggaaacauguacgccgacgauacugccggcugggacacacgaauuacggaggaugaucugcagaacgaggccaagaucacggacauaauggagcccgaacacgcucuucuggcgaccuccaucuuuaagcuuaccuaccaaaacaaaguuguucgggugcagcgacccgcgaagaacggcacagucauggacgugaucucccggagggaccagagagggagcgggcaggugggaaccuacggguuaaauaccuucaccaacauggagguacagcugauccgucagauggaguccgagggcaucuuccugccuagcgaguuggagacaccgaaccuggccgagcgggugcuggacugguuagagaagcacggggccgaacgccugaagcggauggccaucuccggcgacgacugcgugguuaagcccaucgacgaucgcuucgccaccgcccugaccgcgcucaacgacauggguaaggucaggaaagacauaccccagugggagccgagcaaagguuggaacgacuggcagcaggucccguucugcucgcaccacuuccaccagcugauaaugaaggacggccgcgaaaucgucguucccugccggaaucaagacgaacuaguggggcgcgcccgggucucucagggcgccggguggucucuccgcgagaccgccugccuggggaagagcuacgcccagauguggcagcugauguacuuccaucggcgcgacuuacggcuugcggcuaacgccaucugcuccgccgugcccguggacugggucccgacuagccgcacgaccuggagcauccacgcgcaccaucaguggaugaccaccgaggauaugcuguccguguggaaccgaguguggaucgaagagaacccguggauggaggauaaaacgcacguuucguccugggaggagguacccuaccucgggaagcgggaggaccaguggugcggcagccugaucggccugaccgcccgcgccaccugggcaacaaacauacagguggccaucaaccagguccggcgacucaucggaaacgagaacuaccuggauuauaugacuuccaugaaacgguucaagaacgagagcgacccagagggugcgcugugguga

SEQ ID NO: 24785 - RNA, 9879 nt, Artificial Sequence
  derived and/or modified CDS sequence (opt11) from DENV-1__HQ332181__SS-prME
aguguaaccauguugcuaaugcugcugcccacugcccuagccuuucaucugaccacccggggcggggaaccucacaugaucgugagcaaacaagaacggggcaagagccuccuguuuaagaccagcgcugggguuaauaugugcacccugauugccauggaccugggcgaacucugcgaggacaccaugaccuacaagugcccccgcaucaccgaggccgaaccggacgacguugauugcuggugcaaugcuaccgacaccugggugaccuacgggacuugcucccaaaccggcgaacaccggagggagaaacgguccguggcccuggcgccgcacgugggacuggggcucgaaacccgcacugagacauggaugucgucggagggcgccuggaagcaaauccaacgagucgagaccugggcgcugcgccaccccggguucacugugauagccuuuuuccuagcucacgccaucggcaccuccauuacccagaaggggauaaucuucauccuccugaugcuggugacgccgagcauggccaugcgaugcgucggcaucggcaauagggacuucguagaggggcucucaggcgccacauggguggacguuguccuggagcacgggaguugugucaccaccauggccaagaacaagcccacccuggacauagagcugcugaagaccgaggucaccaacccugcgguucuuaggaagcucugcaucgaggccaaaauuaguaacaccaccacagacucucgcugcccaacccagggggaagcaacccugguggaggagcaggacgccaacuucgugugucggcgcaccuuuguugacaggggcugggggaacgggugcgggcuguuugggaaggggagucuccugacgugugcgaaguucaaaugcgugaccaaacuggagggaaagaucguccaguacgagaaccucaaguacuccguuauugugaccguucacacaggcgaucagcaccagguaggaaaugagacgaccgagcacggcacgaucgcgacuaucacaccccaggcccccaccucugagauccaacugaccgacuacggggcacuaacccuggacugcucuccccggaccggucuggauuucaacgagaugguccuucucacgaugaaggagaaaagcuggcugguccacaaacagugguuccuggaccuaccauugcccuggacgaguggggcuaguaccagccaagaaacuuggaauagacaggaccugcucgugacauuuaagaccgcccaugcgaagaagcaggaggucguggugcugggcucgcaagagggcgccaugcacaccgcgcugaccggcgcuacggaaauccaaaccagcggcaccacuacgaucuucgccgggcaccugaaaugucgccucaagauggacaagcugaccuuaaaaggaauguccuacgucaugugcaccgggucauucaaguuggagaaagagguugcggaaacccagcacgggacggugcugguacagguaaaguacgaagggaccgacgccccaugcaagaucccuuucuccacacaggacgagaaaggcgugacccagaacggccgauugauuacggccaacccuaucgucacggacaaagaaaagcccgugaacaucgagacggagccgcccuucggcgagagcuauauagucguuggcgcgggcgagaaagcgcucaagcugucgugguucaagcgcgggucuagcauaggcaagauguucgaggccacagcuagaggggccaggcgcauggccauccugggcgacacggcgugggacuucgggaguauuggaggcguauucacuuccguggguaagcuaguucaccagguuuucggaacugcauacggggugcuguucagcggugucaguuggaccaugaagaucgggauuggcauacugcucacguggcucgggcugaacucgcgcucgacaagucucaguaugacguguauugccguggggaugguuacccucuaucuuggcgucaugguccaggccgacagcgggugcgugauuaauuggaaaggucgcgagcucaaaugcggguccggcaucuucgucacgaacgaggugcauacauggaccgagcaguacaaguuccaggcggacagcccgaagcgguuaucagcggccaucggcaaagccugggaggaggguguauguggaaucaggagcgccacgcggcuugagaauauuauguggaagcagaucagcaacgagcucaaucacauacuucucgagaacgacaugaaguucaccgucguggugggggaugccaacgggauccucguccaggggaaaaagaugauccgaccccagccuauggagcacaaguacaguuggaagucaugggguaaggcgaagaucauaggcgccgauauacagaacacgaccuucaucauugaugggcccgauacgccggagugccccgauggucaacgcgccuggaauaucugggagguggaagauuacggguuuggaguguucaccacgaacaucuggcugaagcugcgcgauuccuacacacaaaugugcgaccaccggcucaugagcgcggccauaaaggacuccaaggcgguccacgccgacauggguuacuggaucgaaagcgagaagaacgagaccuggaaacucgcccgugcauccuucaucgaggugaagaccugcacguggcccaagucucauacccuguggagcaacgggguguuagagucugagaugaucaucccuaagaucuacggcgggccgaucagucagcauaauuaccguccuggcuacuucacacagaccgcggggccuuggcaccugggcaagcuggaacucgacuucgaccugugcgagggcacgacuguggugguugacgagcauugugggaaccguggcccuagccugcggaccaccacgguuaccgggaagauaauccaugaguggugcugccgcuccugcacucuaccgccucugcgguuucgcggcgaggacgggugcugguauggcauggagauucggcccgugaaggaaaaggaggagaaucuggugcgcagcauggucagcgccggcacuggggaggucgacagcuucagccugggcauccucugcgucagcauuaugaucgaggaaguaaugcguucgcgcuggucccgcaagauguuaaugacggggacgcucgccguauuccuacugcucaucaugggucagcuuacuuggaacgaucugaucagguuauguaucauggugggggccaaugcaagcgaccgcauggggaugggcacgacuuaccucgcucugauggcaacuuucaaaaugcggccgauguucgcagucgggcuccucuuccgccggcugaccuccagagagguucuccuucugacuaucggccucucucuagucgccuccguggaacuuccaaacagccucgaggaacugggggacggcuuggccaugggcaucaugaugcuuaagcugcugacggaguuccaaccucaucagcucuggaccacccugcuuucccugaccuucgugaagacggcguugucccuggacuaugcguggaaaaccaccgccaugguccucuccaucgugagccuguucccccugugcuuguccaccacgucgcagaagaccaccugguuacccgugcuguuaggguccuucggcugcaaaccccugacaauguuccuaaucacagagaacaaaaucugggggcgcaagagcuggccccucaacgaaggcauaauggccaucgggaucguuuccauccugcucagcuccuuacugaaaaacgacguaccacuggcgggcccgcucauagcgggcgguaugcugaucgccuguuacguuauuagcgguagcuccgccgacuuaagccucgagaaggccgcggaggucucaugggagcaagaggccgagcacagcggcgcuucccacaacauccugguggagguacaggaugacggcaccaugaagaucaaagacgaggaacgcgacgauacccugaccauucuccugaaggcuacacuucuggccgucagcgggguguacccgauguccauucccgcaaccuuauucguaugguauuucuggcagaaaaagaaacagcggagcgggguguuaugggacacccccucuccgcccgagguggagcgcgccguauuggacaauggcaucuaucggauccugcagcgcgggcuucuagggcggagccaggucgggguagguguguuccaggacggggucuuccacaccauguggcacgucacucgaggagccguucucauguaccagggcaaacgacuggaacccuccugggccucugucaagaaggaccugaucucauacggaggcggguggcgguuucagggcagcuggaacacgggggaagagguccaggugaucgcggucgagcccgggaaaaacccgaagaacgugcagaccacucccggcaccuucaagacgcccgagggcgaggugggcgcgaucgccuuagacuucaagcccgggacgucuggcucaccgaucgucaaccgggagggcaaaaucguggggcuguacggcaacgggguugucacaaccuccgggacguacgucucagcaaucgcgcaagcuaaggcgucccaggaaggaccccugcccgagaucgaggaugagguguucaagaagcgcaacuuaaccauuauggaccugcauccggguucggguaagacccggcgcuacuuacccgccaucguccgggaggccaucaaacgcaagcuccgcacccucauccuggcccccacgcgggugguggcguccgagauggcagaggcccucaaggggaugcccauccgcuaccagaccacggccgucaagagcgagcacaccggccgggagauuguggaccugaugugccacgccacguuuaccaugcgucugcucagcccggugcggguucccaacuacaacaugaucaucauggacgaggcgcacuucaccgaccccgccaguaucgcggccaggggguauauuucgaccagggugggcaugggggaggcagcugcuaucuucaugacggccacgccgcccggcuccgucgaggcauucccccagagcaacgccgucauccaggacgaggagagagauauccccgaacgguccuggaacucgggcuacgacuggaucaccgacuucccagggaaaaccguuugguucgugcccuccaucaagagcggcaacgauauagcaaauugccugaggaagaacggcaagcgggucauccagcugagccgcaagacguucgacaccgaguaccagaagacgaagaacaacgacugggacuacguggugacgacggacauuuccgagaugggcgcaaauuuucgggccgaccgggucauugacccccggaggugucuaaaacccgugauccugaaggacgggcccgagcgugucauucuggccggcccgaugcccgugaccguggcaagugccgcccaaaggcgcgggagaaucggucgcaaucagaacaaagagggcgaccaauacgucuacaugggacagccccucaacaacgacgaggaccaugcccacuggaccgaagccaagaugcugcuggacaauaucaacacccccgaggggaucauaccggcgcuguucgaaccugagcgggaaaaaucagccgccaucgacggggaguaccgccuacggggcgaagcccgcaagacauuuguggaguugaugcggaggggagaucuccccguguggcuguccuacaaagucgcuagcgagggguuccaguauuccgaccggcgcuggugcuuugauggcgagcggaacaaccaggugcuugaggagaacauggacguggagaucuggacaaaggagggagagcgaaagaagcuccgcccccgguggcuggacgcucggacuuacagcgacccgcuagcgcuccgcgaguucaaagaguucgccgcaggacgccgcuccgucagcggcgaccugauuuuagagaucggaaagcuaccccagcaucugacucugcgugcacagaaugccuuggacaaccugguuaugcugcacaacagcgagcagggcgggaaggcauaucggcacgcuauggaggagcuccccgacacuaucgaaacgcugaugcugcucgcacugaucgccgugcugacaggcggagucacccucuuuuuccugaguggcaagggccuggggaagaccagcauaggccuccugugugugacggccuccucagcccugcucuggauggccuccgucgagccccacuggauagccgcgucuaucauccuugaguucuuucugaugguacuccugaucccggagccagaccggcagcggacgccccaggacaaccagcuggcguacgucgugaucgggcuccuguuuaugauccuuaccgucgcagcaaaugagaugggccuacuggagacaacgaagaaagaucuggggaucggcuauguggcagcggagaaccaccaacacgccaccaugcucgacguagaucugcaccccgccuccgcguggaccuuauacgcgguagcgaccacggugaucacccccaugaugcgccacacaaucgagaacaccacggccaauaucagccucaccgcgaucgcgaaccaggcggcgauccugaugggccuugacaaggguuggcccaucuccaagauggacauuggcgugccccuccuggcuuuaggcugcuacagccaggucaauccgcucacccugacggcagcggugcugaugcucgucgcgcacuacgcaaucaucggcccgggccugcaggccaaggcgacgcgcgaggcucaaaaacgcacagcggcagggaucaugaaaaaucccaccguagacggcaucguggcuaucgaucuagaccccguggucuacgacgcgaaguucgagaaacagcucggccagauaauguuacucauccucugcacuagccagauccugcugaugcggacuaccugggcccucugcgagagcaucacccuggccaccggcccgcuuacgacccucugggagggguccccuggcaaguuuuggaacaccaccaucgccgugagcauggccaacauauuucgcggcuccuaccuggccggggccggccuggcguucucgcucaugaaguccuuaggaggcggacggcgcggcacgggcgcccagggggagacccugggcgagaaguggaagagacaacugaaucagcugagcaagagugaguuuaacaccuacaaacgcagcggcaucauggaggucgaccggucugaagccaaagaggggcugaagcgcggagagaccaccaagcacgcuguuucgcggggcaccgcgaaauuacguugguucguggagcggaacuuagucaagcccgagggcaaggucaucgaucugggaugcgggcgcgggggcuggagcuacuacugugccgggcucaaaaagguaaccgaggugaagggcuacaccaaaggcgggcccggccacgaggagcccaucccgauggccacauacggguggaaccucgucaaguugcacucagggaaggauguguucuucaugccacccgagaagugcgauacgcugcucugcgauaucggggaaucauccccuaaccccacuaucgaagagggacgaacccugcgcgugcugaaaaugguagagcccuggcuacggggcaaucaguucuguaucaagauccuaaaccccuauaugccgucgguaguggagacgcuggagcagaugcagcguaagcacgguggcaugcucgucaggaauccccugucacgcaacagcacgcacgaaauguacuggguguccugcgggacaggcaauauugugagcgcagugaacaugaccucccguauguuacuuaaccgcuucacuauggcccaccgcaagcccacguacgagcgggacguugacuugggcgcggggacccgucauguugccguggagcccgaaguggccaaccuugacaucaucggacagcgcaucgagaacaucaagaaugagcacaagagcaccuggcacuacgacgaggacaacccguacaaaaccugggccuaccacggcuccuacgaggucaaacccucugggagugccagcuccauggugaacgggguggucagguugcugacgaagcccugggacguuauccccaugguaacucagaucgccaugaccgauacaacuccguucggccagcagaggguauucaaggagaaggucgauaccagaacgcccagggccaagagaggcaccacgcagaucauggaggugaccgccaaguggcugugggguuuccucagccgaaacaagaagccccgcauuugcacgagggaggaguuuacccgcaagguucgcuccaaugcugcgaucggagcgguguucguggacgaaaaccaauggaacucggcuaaggaggccguagaagacgagcgcuucugggaccuggugcaccgggagcgggagcuucacaagcaggggaagugcgccacgugcguuuacaacaugaugggcaaacgugagaaaaagcucggggaguucgggaaagcaaagggaaguagggccaucugguacauguggcugggggcccgauuucuggaauuugaggcccucggcuucaugaaugaagaccacugguucucgcgcgagaacucauuauccggcgucgaaggcgagggccugcacaaacucggcuacauacugcgagacauuaguaagauaccaggcgggaacauguaugccgacgauacugcgggaugggacaccagaaucaccgaggacgaccugcagaacgaagccaagaucacagacaucauggagcccgagcacgcccucuuggccaccucgaucuucaagcugacguaccagaacaaggucgugaggguucagcggccggcgaagaacggaaccgugauggacgucaucagccgccgggaccagcgaggcuccggccaagucgggacguacgggcuaaacaccuucaccaacauggaggugcaauuaaucagacaaauggagagcgaggggauuuuccugccauccgagcucgagaccccgaaccucgcggaacgcgcacuggacuggcucgagaaacacggcgccgaaagacucaagagaauggcaauaagcggagacgacugcguggucaagccgauugacgaccgguucgccacggcgcugacagccuugaacgacaugggaaagguucgcaaggauaucccccagugggagcccucgaaaggauggaacgacuggcagcaagucccguucugcucacaccacuuccaccagcugaucaugaaggacggucgggaaaucgucguucccugccguaaccaggacgaacuggugggccgggcacgcguuucccagggggccggcuggucgcuccgcgagaccgcgugccuggggaaguccuacgcgcagauguggcagcucauguacuuccauagaagggaccucaggcuugcugccaacgccauauguucagccgucccagucgauugggucccuaccucccggacgacguggagcauccacgcccaucaccaauggaugaccacggaggacaugcugagcguauggaaucgggucuggaucgaggagaauccguggauggaggauaaaacccacgucucgagcugggaggaagugcccuaccucggaaagcgcgaagaccaguggugcgggucccugauaggucucacugcgcgggcaaccugggcuaccaacauccagguggcaaucaaucaggugcggaggcuuaucggcaaugagaauuauuuagacuacaugaccucgaugaagcguuucaagaaugaguccgacagcgaaggcgcucugugguag

SEQ ID NO: 24786 - RNA, 9879 nt, Artificial Sequence
  derived and/or modified CDS sequence (opt11) from DENV-1__HQ332180__SS-prME
agcgugaccaugcucuugaugcuccugcccaccgcucucgccuuccaucugaccacccgcggaggggagccccacaugauaaucucaaagcaggagcggggcaagagccugcuguucaaaacuagcgcgggggugaacaugugcacccuuaucgccauggacuuaggcgagcucugcgaggacaccaugaccuacaagugcccucgcauaaccgaggcggagcccgaugauguggacugcuggugcaacgccaccgacacaugggugaccuacgggaccuguagucagaccggcgagcaccggcgcgauaagcgauccgucgcccuggcgccccacgugggcuuagggcucgagacccgaaccgagaccuggaugagcuccgagggcgcguggaagcaaauacagcggguugagaccugggcccugcgacauccgggguucacggugaucgcccucuucuuggcgcacgccaucggcaccagcauaacccagaaggguaucaucuucauucugcugaugcucgugacuccuuccauggccaugcggugcgugggcaucggcaaccgagacuucguagagggguuaucgggggccacguggguugacgugguucucgagcacggguccugcgugaccaccauggcuaagaacaagccgacccucgacaucgaguuacugaagacggaggugaccaaccccgcgguccugcggaaguuaugcaucgaggccaagaucagcaacacaaccacggacucccgcugcccgacccagggcgaggccaccuuaguggaggagcaggaugccaacuucgugugccggagaaccuuugucgauagaggcugggggaacggcuguggcuuauuuggcaaggggucacugcugacgugcgcuaaguucaagugugugaccaagcucgagggcaaaauagugcaguacgagaaccugaaguacucggucaucgugacagugcacacuggagaccagcaucaagucgggaacgaaacgaccgagcacggcaccaucgcgaccaucacgccccaggccccaacguccgagauccagcugaccgacuauggggcauuaacgcuagacuguagcccccgcacgggccuggauuucaacgagauggugcuccugacaaugaaggagaaguccuggcuggugcacaaacaaugguuccucgaccugccacugccguggaccucaggggcgagcaccagccaggagacauggaaucggcaggaccuucuggugacguucaaaaccgcccacgcuaagaagcaggagguggucgugcugggcagucaggagggcgcuaugcacacugcccucaccggggccacggagauccagaccucgggcaccaccacgaucuucgcgggucaccuuaagugccgccuuaagauggacaagcugaccuuaaaggggauguccuacgugaugugcaccgggucguucaagcuggagaaggaggucgcagagacgcagcacggaacaguucuggugcaggucaaguaugagggcaccgacgccccuugcaagauccccuucuccacccaggacgagaagggggucacccaaaacggccggcucaucacggccaacccgauagugaccgacaaggagaagcccgugaacaucgaaaccgagccgcccuucggggaauccuauaucguggugggugccggcgagaaggcgcugaagcuguccugguucaagaaagggucuagcaucggaaaaauguucgaggccacagcacgcggggcuaggcgcauggccaucuugggcgacaccgcgugggacuucgggucuaucgguggcgucuucaccuccguggggaagcuggugcaccaagucuucgggaccgccuauggggugcuguuuucgggcgugucuuggaccaugaagaucgggaucggcauccuccugacguggcugggccucaauucuagaagcaccagccugucaaugaccuguaucgccgucgguauggugacccuguaccucggcgccauggugcaggccgacagcgguugcgucaucaacuggaagggccgggagcugaaguguggguccggcaucuucguuacgaaugaggugcacacuuggaccgagcaguacaaguuccaggcggacagccccaagcgccugucugccgccaucggcaaagccugggaggagggggucuguggcauccgguccgccacccgccucgaaaauaucauguggaagcagauuagcaacgaacugaaucacauucugcucgagaacgacaugaaguucaccgucguggucggggacgcgaacggcaucuuggcccaggggaagaagaugauucggccucagcccauggagcacaaguacuccuggaagucuuggggaaaggccaagauaaucggcgcagacauccagaacacgaccuuuauuauagacgguccugacaccccggaaugccccgacggccagcgcgcguggaacauuugggaggucgaggacuacggguucggaaucuucaccacgaacauuuggcugaaacuucgggacuccuauacccagaugugcgaccaccgucuuaugagcgccgcgaucaaggacucgaaggccgugcacgcugacaugggcuauuggaucgagagcgagaagaacgagaccuggaagcuggcgcgggcuaguuucauagaggucaagaccugcacguggccaaagucgcacacccucugguccaacggggugcuggaaagcgagaugaucauacccaaaaucuauggcgggccgauuucccagcacaacuaccgccccggauacuucacccagaccgccggccccuggcaccucggaaagcucgaguuggauuucgaccugugcgagggcacgaccguggucguggacgagcacugcgguaaccgcggaccgagccuccgcaccaccacgguaaccgggaagauuauccacgaguggugcugccgcuccugcacccugccgccacugagguuccggggcgaggaugggugcugguacggcauggagauucgccccgucaaggagaaggaggagaaccucgugaggagcaugguguccgcgggcagcggagaggucgacagcuucucccugggcauucugugcguaucaaucaugaucgaggaggugaugaggucccgguggagccgcaagaugcucaugaccgggacguuagccgucuuccugcuccugauaaugggccaacugaccuggaacgaccucauccgccugugcaucaugguuggggcgaacgcuucugaccggauggggaugggcaccacgcaccuggcccucauggccacuuucaagaugcgcccgauguuugcgguggggcuucuuuucaggcgccucaccagccgggagguacugcugcucaccaucgggcugucccugauggcgaguauggagcuccccaauagucuagaggaacugggcgacggccuagccauggguauuaugaugcugaagcuacucacugaguuccagccucaccagcuguggaccacccugcucagccugaccuucgucaagacgacgcugucccucgacuacgccuggaaaaccaccgccaugauucugagcauugugucccuguucccccuuugcuuguccaccacgucccagaagaccaccugguuaccgguccuccuggggagcuucggaugcaagccccuuaccauguuccuuaucaccgagaacaaaauaugggggcggaaguccuggccccugaacgaaggcaucauggcgaucggaaucgucagcauucugcucagcagccugcugaagaacgacgucccccucgccggaccucugaucgcuggagggaugcugaucgccuguuacguuaucucuggcuccagcgcugaccucucccuggagaaggccgccgaggugagcugggagcaagaggccgagcacuccggggcgagccacaacauccuggucgaggugcaggacgacggcacgaugaaaaucaaggacgaggaacgggacgacacccucaccauccugcugaaagcuacccuccuggcgguguccggggucuaccccaugagcauccccgcuacgcuguucgucugguacuucuggcaaaagaaaaagcagcgcucaggugugcugugggacacccccagcccgcccgaagucgagcgggcgguccucgacgacggcaucuauaggauucugcagcgggggcuguuaggccgcucccaggugggggucggcguguuccaggauggggucuuucacaccauguggcacgucacccggggagccgugcugauguaccagggcaagagacuggagccgagcugggccuccguaaagaaggaccucaucagcuacgggggcggguggcgguuucagggcuccuggaacacaggggaggagguccaggugaucgcgguggaaccugggaagaacccgaagaacguccaaaccaccccggggacguucaagacccccgagggggaggugggcgccauagcccuggacuucaaaccggggaccagcggcucaccgaucgugaaccgcgagggcaagaucgucggguuauacggcaacgggguggugaccaccucuggcacguacgucucagcuaucgcccaggcgaaggcaagccaggaagggccccuccccgagaucgaggacgagguguucaagaagcggaauuuaaccaucauggauuugcacccggggagcggaaagacccgccgguaccugcccgccaucgugcgcgaagccaucaagcggaagcuacgcacccugauucucgcccccacgcgcgucguggccucugagauggccgaggcucugaaggggaugccaauccgguaucagaccaccgcggucaaaagcgaacacacuggccgcgagauaguagaccugaugugccacgcgacguucaccaugcggcuccuguccccagugcgcgugcccaacuacaacaugaucaucauggacgaggcccacuucacagaccccgccagcaucgccgccagaggguauaucuccacccgcgucggcaugggggaggcggcugccaucuucaugacggccacgccgcccggcagcguggaggccuucccacaguccaaugcggugauccaggaugaggagcgggacauccccgagcggucauggaacuccggcuaugacuggauuaccgauuuccccgggaagaccgucugguucguuccuagcaucaaaucuggaaacgauaucgcgaacugccugcggaagaaugggaagcgcgucauccagcugucccggaagacguucgacaccgaguaucagaagaccaagaacaacgacugggacuacguagugaccacggacauauccgagaugggcgccaacuuucgugcggacagagugaucgacccgcgccggugcuugaagccggucauccugaaggacggacccgagcgcguaauccucgcgggaccaaugcccgugaccgucgccagcgccgcgcagcggcgcggccggaucggccgcaaucagaacaaggagggcgaccaauacguguacauggggcagccacugaacaacgacgaggaccacgcccacuggaccgaggcgaagaugcugcuugacaauauaaacacucccgaaggcauuaucccggcucucuuugagcccgagcgcgaaaagagcgccgcuaucgacggggaguaccgucugagaggcgaggccaggaagacguucguggaacucaugcgccggggcgaccuucccgucuggcugagcuacaagguugcguccgaaggguuccaguacucagaccgcagauggugcuuugauggcgaacgcaacaaucagguccucgaggagaacauggacguggagaucuggacaaaagagggggaacggaagaaacuccgcccacgguggcuggacgcccgcaccuacuccgacccgcuugcccuucgggaguucaaagaguucgccgccggucgccggucugugagcggcgaccugauccucgagaucggaaagcugccccagcacuugaccuugcgcgcgcaaaacgcccuggacaacuuaguaaugcuccacaacucugagcagggcgggaaggccuaucggcacgccauggaggaguuacccgacaccaucgagacacugaugcuccuggcccugaucgccgugcucacaggcggggucacccuguucuuuuuaagcggcaagggccuugggaagaccuccaucggccugcucugcgucacggccaguuccgcccucuuguggauggccagcguggagccccacuggaucgcggcauccauuauccuggaguucuucuugaugguacugcugaucccugaacccgaccgccagaggacuccccaggacaaccaacucgccuaugucguuaucgggcugcuauucaugauccucaccguggccgccaacgaaaugggcuuacuggagacaacgaagaaggaccucgggaucggcuacgucgcggccgagaaccaucagcaugccaccaugcuggacguggacuuacgcccggccagcgccuggaccuuauacgcgguugccacuaccgucauuacgcccaugaugcggcacaccaucgagaacacaacugcgaacaucucccugaccgccauugccaaucaagcggccauccugauggggcucgacaaggguuggccgauuaguaagauggacauaggggugccauuacuggcucucgggugcuauucucaggugaacccgcugaccuuaaccgccgcugugcugaugcuggucgcccauuacgcaauuaucggucccgggcugcaagccaaggcuacgcgcgaggcgcagaagcgcaccgccgcaggcaucaugaagaacccaaccguggacgguaucguagccaucgacuuagauccagucguuuacgacgccaaguucgagaaacagcuggggcagaucaugcugcucauccuguguaccagccaaauccuguuaaugcguacgaccugggcgcugugcgaguccaucacccuggccaccgggccguuaacgacccuaugggaggggagccccggcaaguucuggaacacaacgaucgccgucuccauggccaacaucuuccgcggcagcuaccuggccggggcgggccucgccuucuccuuaaugaagucccucgguggcgggcggcgggggacgggagcgcagggggaaacccucggcgagaaguggaagcggcaauuaaaccaacuaagcaagagcgaguucaacaccuacaagcguucagggauaauggagguggaccgguccgaggccaaagaaggccugaagcguggggagacuacaaagcaugcggugagccggggcacggccaagcugcgaugguuuguugagcggaaccuggugaagcccgaggguaaggucaucgacuugggcuguggccgcgggggcugguccuacuacugugccgggcucaagaagguuaccgagguaaagggcuacaccaagggcgggcccggccacgaggaaccgauucccauggccaccuacggguggaaccuggugaagcugcacagcggcaaggacguguuuuucaugccgccugagaagugcgacacgcucuugugcgacaucggggaguccagccccaaccccaccaucgaggagggacgcacccugcgcgugcucaagauggucgagcccugguuaaagggcaaucaguuuugcaucaagauccugaacccauacaugcccuccgucguggagacccucgagcaaaugcagcguaagcacgggggcaugcuuguaaggaacccccugagccgcaauuccacgcacgagauguacugggucucgugcgggacuggcaacaucgugagugccgugaacaugaccucacgcaugcuucugaaccgguucaccauggcgcaccgcaagcccacuuacgagcgcgacgucgaccugggcgccgggacccggcacguggccguggagcccgagguagcgaaccucgacaucaucggccaacgcaucgagaacaucaagaaugagcacaaauccaccuggcauuaugaugaggacaacccguacaaaaccugggccuaucacgggucuuacgaggugaagcccuccggcagcgcguccagcauggugaacggggucgugcgguugcugacgaagccgugggacguaaucccgauggucacacagauagcgaugaccgauaccacgccguuuggccagcaacgcgucuucaaggaaaaagucgacacccggacuccccgcgccaaacggggcaccacgcaaaucauggaagugaccgccaaguggcucuggggguuccugucacgcaacaagaagccgcggaucuguacucgcgaggaguucacccgcaaagugcgcagcaacgccgcaaucggugccguguucguggacgagaaccaauggaacagcgccaaggaggccguagaggacgagcgguuuugggaccugguccaccgcgagagggaacuucacaagcaggggaagugcgcuacaugcguguacaauaugaugggcaagcgcgagaagaagcugggagaguucggcaaggccaaaggcucccgagccaucugguacauguggcugggggccagauuccuugaguuugaggcccugggguucaugaacgaggaccacugguuuagccgggaaaauucacugagcgggguggagggcgaggggcuccacaagcuaggguacauccugagagacaucucuaagaucccgggcggaaacauguacgcggacgacaccgcaggcugggacacccguaucaccgaggacgaccuccagaaugaggccaagaucacggauaucauggagccagagcacgcccugcuggccacguccaucuucaagcuaaccuaccagaacaaggucgugcgcgugcagcgccccgcuaagaaugggaccgucauggacgugaucucccggcgagaucagcggggcucaggccaaguggggacguauggccuaaacaccuucacuaacauggagguccaacugauacgccagauggagagcgaggggaucuuccuaccaagcgaacuugagacaccgaaccuggccgagagaguccucgauugguuagagaagcauggcgcugaacgacugaagcggauggcuaucucgggugacgacugcguggugaagccgauugacgaccgcuucgccacagcguugaccgcccugaacgacaugggcaaggugcggaaagacaucccccaaugggagcccagcaagggcuggaacgacuggcagcagguuccguucuguucccaucauuuccaccagcugaucaugaaggacggacgcgaaaucgucgugcccugucggaaccaagaugaguuagugggccgagcccgggucucccaaggggcuggcuggucucugcgcgagacagccugccuaggcaaaagcuacgcucagauguggcagcucauguacuuccaccggcgcgacuugcgacuggccgccaacgccauuugcuccgcggugcccguggacuggguccccaccagccgcaccacguggagcauccacgcccaccaccaauggaugacuacugaggacaugcugagcgucuggaaccggguguggauugaagagaacccguggauggaggacaagacccacguuagcucgugggaggaggugccauaccugggcaaacgcgaggaccaguggugcggcagccuuaucggucuuacggcccgcgccaccugggccaccaacauccagguggcaauaaaccagguccggcgccugaucggcaacgagaacuaccuggacuacaugaccuccaugaagcgguucaagaaugaaagcgacccagagggggcccucugguga

SEQ ID NO: 24787 - RNA, 9879 nt, Artificial Sequence
  derived and/or modified CDS sequence (opt11) from DENV-1__HQ332179__SS-prME
uccgugaccaugcuccucaugcugcugcccaccgcccucgccuuccaccugaccacgcgcggcggcgagccccacaugaucgugagcaagcaggagcggggcaagagccuccucuucaagaccagcgcgggggugaauaugugcacccugauugccauggaccugggggaacuaugcgaggacacgaugaccuacaagugcccacgcaucacugaggccgagcccgacgacguggacugcuggugcaacgccaccgacaccugggucaccuauggcacuugcagccagaccggggagcaccggcgcgacaagcgguccguugcccuggcgccccacgugggccugggucucgagacacgcaccgagacuuggaugucaagugagggcgccuggaagcagauccagcggguagagaccugggcccugcgccaccccggguucacggugaucgcccuauuccucgcgcacgccauuggcacaaguaucacccaaaaggggauuaucuucauccugcugaugcucgugaccccauccauggccaugcggugcgucggcaucggcaaccgcgacuucguggaggggcugagcggcgccacguggguggacgucgugcuggagcacgggaguugcgugaccacuauggccaagaacaaacccacccucgacaucgagcugcugaagacggagguaaccaacccagcgguucuccggaagcugugcaucgaagcuaagaucagcaacaccaccacagacuccaggugccccacccagggcgaggcgacccugguggaggagcaggacgccaacuuugucugccggcgcaccuucguggacaggggcuggggaaacggcugcggccuauucggcaaggggagccugcugacgugcgccaaguucaagugugugaccaagcucgaagguaagaucguccaguacgagaaccugaaguacucagugaucgugaccguccacaccggcgaccagcaccaggucggaaaugagacgacagagcacggcaccaucgcgaccaucaccccacaggcccccacgagcgaaauccagcugacugacuacggggcccucacccuggauugcaguccccgcaccggccuggacuucaacgagaugguccuccugacaaugaaggagaaguccuggcuggugcacaaacagugguuccuugaccugccucugccauggaccuccggggccagcaccagccaggagaccuggaaccggcaggaccuccuggugacguucaaaaccgcgcacgcgaaaaagcaggagguuguagugcugggcucucaggagggcgccaugcacaccgcccugaccggagccacggaaauccagaccagcgggaccaccacgaucuucgccgggcaccugaaaugccgccugaagauggacaaacucacccugaagggcauguccuacguuaugugcaccgggagcuuuaagcuggagaaggagguggcggagacccagcacggcacgguguugguccagguaaaguaugagggaaccgacgcccccugcaagauccccuucuccacccaggacgaaaagggagugacccagaauggcaggcucaucacggccaacccuaucgugaccgacaaggaaaagcccgugaacaucgagaccgagccgccauucggggagagcuacaucguugucggcgccggcgagaaggcgcugaaacuguccugguucaagaaggggucuuccauuggcaagauguucgaggccaccgccagaggggcccguaggauggccauacuaggagacacggcgugggacuucgggagcaucggcggcguguucaccuccgugggcaaacuuguccaccagguguucggcaccgccuacggggugcuguucagcggcgucuccuggaccaugaagaucgggauagggauuuugcugacauggcugggccucaacucccgcuccaccucacuguccaugaccugcaucgccguggggaugguuacccuguaccucggagucauggugcaggccgacagcgggugcgugauuaacuggaagggccgggagcugaagugcggcucgggcaucuuugucacgaacgaggugcacaccuggacagaacaguacaaguuucaggccgacaguccgaagcgccucucagcggccaucggcaaggccugggaggaggggguuugcggcauccgguccgcaacacgccucgaaaacaucauguggaagcagaucagcaacgagcugaaccacaucuugcucgagaacgacaugaaguucaccgucguuguuggagaugcuaacgguauucuggcgcaggggaagaaaaugauccggccgcagcccauggagcacaaguacuccuggaaguccuggggcaaggccaagaucauaggcgccgauauccagaacacgaccuucaucaucgacgggccugauaccccggagugucccgauggccagcgcgccuggaacaucugggaggucgaagacuacgguuucggcaucuucaccacgaacaucuggcugaagcucagggacuccuacacccaaaugugcgaccaccggcugaugagcgcggcuaucaaggacuccaaggccgugcacgccgacaugggcuacuggaucgagagcgagaagaacgagaccuggaagcuggcccgugcguccuucaucgaggugaaaaccugcacguggccaaagagccacacucucuggagcaacgggguccuggagagugagaugaucauccccaaaaucuacggcgggccgaucucgcagcacaacuaccgccccggcuacuuuacacagaccgccgggcccuggcaccuuggcaagcucgaguuggacuucgaccugugcgagggcacgaccgugguggucgaugaacacugcgggaaccgggggccgagccugcgcacuacaacggugaccgggaagaucauccacgagugguguugccgguccugcacccugccgccccugcgcuuccggggcgaggacgggugcugguauggcauggagaucaggccaguuaaagagaaggaggagaaccucguccggagcaugguauccgccggaagcggggagguggacagcuucucacugggaauccugugcgccagcaucaugauugaggaggucaugcgcucgcgguggagccgcaagaugcucaugaccgguacgcuggccgucuuccugcuccugauuaugggccagcugacauggaacgaccucauccgccugugcaucauggugggggcaaacgccuccgacaggaugggcaugggcaccaccuaucuggccuugauggccacguuuaagaugcgcccgauguuugccguaggguuacuguuccggcgguuaaccagucgagaggugcugcugcucacaaucggcuugucccuggucgcaucagucgagcuccccaauucccuggaggagcugggggacggccucgccaugggcauuaugaugcuaaaguuacucaccgaguuucagccccaucagcuguggacaacgcugcucucgcugaccuucgugaagaccacgcuguccuuggacuacgccuggaagaccaccgcaauggucuuaagcaucgugagccuguuuccacucugccugagcaccacgucccaaaagaccaccuggcugccggugcuccucgggagcuuuggguguaaaccccugaccauguuccucaucacggagaacaaaaucugggggcgcaaguccuggccccucaaugagggcaucauggcgaucgggaucgucagcauccugcucuccagccugcugaagaacgacgugccccucgccggcccguugaucgcuggcgggaugcuaaucgccugcuacgucaucagcggcuccagcgccgaccuccugcuggagaaagcggccgaagucuccugggagcaggaggccgaacacucgggggccucccacaacauccucguggaggugcaggaugacggcacgaugaagaucaaggacgaggagcgggacgacacccugaccauccugcucaaggccacccuucuggcggucagcggaguguaucccaugucaauccccgccacacuguucgugugguacuuuuggcagaaaaagaaacagcgcagcggcguccugugggacacccccagcccacccgaaguggagcgggccgugcuggacgacggcaucuacaggauccugcagcgggggcuccugggucgcagccaggucgggguggggguguuccaagacggggucuuccauaccauguggcaugugacccguggcgccgugcugauguaccagggaaagcgccucgagcccuccugggcuagcguuaagaaagaccugaucuccuacgggggcggguggcgguuccaggggagcuggaacacuggggaggagguccaagugaucgcggucgagcccggcaagaacccgaaaaacguucagaccacucccggcaccuucaagacgcccgagggggagguuggugccaucgcccuggacuucaagccagggaccuccggcaguccgaucgucaaccgcgagggcaagaucguggggcucuacggcaaugggguggucaccaccuccggcacguacgugucagccaucgcccaagcgaaggccucccaggaggggcccuugcccgagaucgaggacgagguguucaagaagcggaaucugaccaucauggaucuccacccgggcagcggcaagacccgccgguaccugcccgccaucguccgcgaggccauaaagcggaaacugcgcaccuuaauccuggcacccacacgcgugguggccagcgaaauggccgaagcccugaaggggaugcccauccgguaccagaccacugccgucaagucagagcacaccggacgcgagaucguggaccucaugugccacgcuacguucaccaugcgguugcugucgccgguacgcguccccaacuacaacaugaucauaauggacgaggcccacuucaccgaucccgccuccaucgccgcccggggguacaucagcacccgcgugggcaugggggaggccgccgcaaucuucaugaccgcaacgccgcccggcuccguggaggccuuuccccagucgaacgccguuauucaggacgaagaacgggacauccccgaacguuccuggaacagcggcuacgacuggaucaccgacuucccggggaaaaccgugugguucguacccucgaucaagucugggaacgacaucgcuaauugccuccggaaaaacgggaagcgcgucauccagcugucgcggaagacguucgacaccgaguaucagaaaacaaagaacaaugacugggacuacguggugaccacggacaucucggagaugggugccaacuuucgcgccgaccggguaaucgaccccagaaggugccugaagcccgugauccucaaggacgggcccgagcgcgugauccuggcgggcccgaugccgguuaccguggcguccgccgcgcagcggcgcggccggaucggucgcaaccagaauaaggaaggcgaccaguacgucuacauggggcagccccugaacaacgacgaggaccacgcgcacuggaccgaggcgaagaugcuccuggacaacaucaacacaccagaggggaucauaccggcccuguucgagcccgagcgcgagaaguccgccgccaucgacggggaauauaggcuccgcggcgaggcccggaagaccuucguggagcugaugagacggggcgaccugcccguuugguuauccuacaaggucgcgucugagggguuccaguacuccgaccggcgguggugcuucgacggcgagcgcaacaaccaggugcuggaagagaacauggacguggaaaucuggacuaaggagggggagcggaagaaacuucgcccccgguggcuggacgccagaaccuacagcgacccgcuggcccugagagaguucaaggaguucgccgccgggcgacgguccgucagcggcgaccucauccuggagaucgggaagcugccccagcaccucaccuuacgcgcgcagaacgcccuggacaaccucgugaugcugcacaacagcgagcagggagggaaggccuaccggcacgccauggaggaguuacccgacaccaucgagaccuuaaugcugcuugcgcucaucgccgugcugaccggaggggucacccuguucuuccucuccggcaagggauuggggaagacgagcaucggccugcucugcgugacggcguccagcgcccugcuguggauggccugcguggagccccacuggaucgcggccuccaucauccucgaguucuuccugaugguccugcuaaucccggagccggaccgccagcggacuccacaggacaaccaguuggccuacguggugaucgggcuccucuucaugauccugacggucgccgcuaacgaaaugggccugcuagagaccacaaagaaagaucuugguaucggcuacguggccgccgagaaccaccagcacgcgaccaugcuggacgucgaccuccgcccggccagcgccuggacccuuuacgcggucgccaccaccgugaucacccccaugaugcggcacaccaucgagaacaccacagcuaacaucuccuuaaccgccaucgccaaucaggcggccauccuuaugggccuggacaagggguggcccaucagcaagauggacaucggcgugccccugcucgcccuggggugcuacucccaagucaacccgcugacgcucacugccgcgguacugaugcugguggcccauuacgcuaucaucggccccggacuccaggcaaaggccacgcgcgaggcgcagaagcgcaccgccgccggcauaaugaagaaccccaccgucgacggcaucguggcaaucgaccuggaucccguggucuaugacgccaaguucgagaagcagcuggggcagaucaugcuacugauacugugcaccagccagauccuccugaugcggacgaccugggcgcugugugaguccaucacccucgcgaccggcccgcugaccaccuugugggagggcagccccggcaaguucuggaauaccacaaucgccguguccauggccaacaucuuccgcggcagcuaccucgcgggggcgggccucgcauucucccugaugaaaagccucgggggcgggcgcagaggcacgggcgcccagggggagaccuuaggggagaaguggaagcggcagcugaaccagcucuccaagagcgaguucaacacauacaagcgcuccgggaucauggagguggaccggagcgaggccaaggagggccugaagcgcggggagaccacgaagcacgcggucagccggggcaccgccaagcugcgcugguuuguggagcggaaccuggugaagcccgaggggaagguaaucgaccucgggugcggcagagggggcugguccuauuauugcgccgggcugaagaaggugaccgaggugaaggguuacaccaagggcgggcccggccacgaggaaccgauccccauggccaccuacggguggaaucucgucaagcuccacagcggcaaggacguauucuucaugccgccggagaaaugcgacacgcugcugugcgacaucggggaguccagcccgaaccccaccaucgaggagggccggacccuccgcgugcugaagauggucgagcccuggcugaagggcaaccaguucugcaucaagauccucaaccccuacaugccguccgugguggagacacuggaacagaugcagagaaagcacggggguaugcugguccgcaacccccucagucggaacuccacgcaugagauguacugggugagcugugggaccggcaacaucgucuccgcagucaacaugaccagccgcaugcucuuaaaccgguucaccauggcgcaccgcaagcccacguacgagcgugacguggaccucggcgcagggacccgucacguggccguugaacccgagguggcuaaccuggacaucaucggucagcgcaucgagaacauuaaaaacgagcacaaguccaccuggcacuacgacgaagacaacccguacaaaacaugggcauaccacgggagcuacgaagugaagcccagcgggagcgcguccagcauggucaacggggugguccggcugcugacuaaaccgugggaugugaucccuauggugacccagaucgccaugaccgacaccacucccuucggccagcagcgcguuuucaaggagaaaguagacaccaggacgccccgcgccaagcggggcaccacgcagaucauggaggugaccgccaaguggcuguggggguuccugucccgcaacaagaagccccgcaucugcacccgcgaggaguucacccggaagguccgcagcaacgccgcgauuggcgccguguucguagacgagaaccaguggaacuccgccaaggaggccgucgaggacgagcgguucugggaccucgugcaccgcgagcgagagcugcacaagcaggggaaaugcgcgacgugcguguacaacaugaugggcaagcgcgagaagaagcugggggaguucggcaaggccaagggcagucgggccaucugguacauguggcucggagcccgcuuccuggaguucgaggcgcugggcuucaugaacgaggaccacugguucagcagggagaacuccuugucgggugucgagggcgaagggcugcacaagcugggcuauauccuccgcgacauuaguaaaaucccgggcgggaacauguaugcggacgacaccgccggcugggauacccggaucaccgaggacgaccugcagaacgaggccaagaucaccgacaucauggagcccgagcacgcacugcuagccacuagcaucuucaaguuaacuuaccagaacaagguggugcguguacagcgccccgcgaaaaacgggaccgugauggacgugaucucccggcgcgaccaacggggcagcggccaggucggaacguacggccugaauacguucacaaacauggaggugcagcucaucaggcagauggaguccgaggggaucuuccugcccagcgagcuggagaccccgaaccucgccgagcgggugcuugacuggcuggagaagcacggcgccgagcgccucaagcgcauggccaucuccggggacgacugcgucgugaagcccauugaugaccgcuucgcgacggcgcugaccgcccugaacgacaugggcaaggugcggaaagacaucccccagugggagcccuccaagggcuggaacgacuggcagcaggucccguucugcucccaccacuuccaucagcucaucaugaaagacggacgggagaucguggugccgugccggaaccaggacgagcuggugggcagggccagaguuagccagggggccgguugguccuugcgcgagaccgccugccuuggcaagagcuacgcgcagauguggcagcuuauguacuuccaccggcgcgacuugcgguuagcggcgaacgccaucugcuccgccgugccggucgacugggucccaaccagccgcaccacgugguccauccacgcacaccaucaguggaugacgaccgaggacaugcugagcguguggaaccgggucuggaucgaggagaacccguggauggaggacaagacccacgugagcuccugggaggaggugccguaccugggaaagcgcgaggaucaguggugcggcucacucaucggauuaaccgcccgcgcgaccugggccaccaacauccaagucgcgaucaaccagguuaggcgccugaucggcaacgaaaacuaccucgauuauaugaccuccaugaagcguuucaagaacgagagcgaccccgagggggcauugugguga

SEQ ID NO: 24788 - RNA, 9879 nt, Artificial Sequence
  derived and/or modified CDS sequence (opt11) from DENV-1__KR919820__SS-prME
accguaguggcccugcucaugcuccugccuaugguguucuccuuucaccucaccacccgaggcggggagccgcacaugauagugaacaagcaggagagagguaagagccucuuauuuaagacauccgggggcauaaacaugugcacccuuaucgccauggaccugggggaccugugugaggacacuaugacguauaaguguccccggauaacagaggcugagcccgacgacguggauugcugguguaacgcaaccgacaccugggugacuuauggcaucugcagucccaccggcgaacaucggcgcgagaaacggagcguggcccucgcuccacacgucgggcugggacuggagacccgggccgaaaccuggaugagcagcgaaggcgcauggaagcaaauccagcgcguggagacgugggcacucaggcaccccggcuuuacggucaucgcucuguuucuggcccacaucaucgggaccuccauuacccagaagggcgucaucuucauucuccugaugcugguuacgccaagcauggcgaugaggugcgucggcguggggaacagagacuucguggagggacucucaggagccacauggguggacgugguguuggagcacgguaguugcgugaccaccauggccaagaacaagcccacacucgacaucgaacuccuaaagacggaggucuccaaccccgccgucuuaaggaagcucugcaucgaggcccguaucucaaacaccacaacagacagucggugcccuacgcagggagaggcgagccugagugaggagcaggauaccaauuucguguguagaagaacacuggucgaccgcggguggggcaacgggugcggccucuucgggaagggcagccugaucacgugcgcuaaguucgagugccucaccaagauggagggcaagaucgugcaguacgagaaccucaaguacucggugaucgucaccguccacaccggggaccagcaccagguuggcaacgagaccaccggucacggcacaacagccaccaucaccccacaagcccccacgagcgaaauccagcucaccgacuacggggcccuuacccucgacugcucuccgcggacaggccuugauuucaacgagaugguacugcuuaccaugaaggagaaaagcuggcugguccacaaacagugguuucuggacuuaccccugccaugggcgucuggcgccuccagcccgcaggaaacauggaauagacaggaccugcucguaacuuucaaaaccgcccacgccaaaaagcaggaaguggugguccugggcucccaggagggcgccaugcacacugcgcugacuggagcaacggaaauucaaacuagcggcaccacaaccauuuuugccggccacuuaaaaugccggcugaaaauggacaagcugacccuuaagggcauguccuacgugaugugcaccggcagcuucaagcuaaagaaggaaguggccgagacccaacacggcacugucuuaguccaaguggaauacgaaggcacggacgcgccguguaaaauccccuucaccacccaggacgagaaagggguaauccagaacggucgccugaucacggcgaaucccauuguuacagacaaagagaagccgguaaacaucgaggccgagccccccuucggcgaguccuacaugguuaucggcgugggcgacaaggcccucaagcugucaugguucaagaagggauccagccugggcaagauguuugaggcgacggcgcgcggggcgcgccggauggccauucucggcgacacagccugggacuucggguccgucggcggggucuucaccuccauggggaagcuggugcaccagauauuugggacggccuacgggguacuguucuccggaguguccuggacgaugaagaucggcaucgggcuccuucugaccuggcucggccucaauucccggaguacgucucugagcaugacguguaucgccguugguaucauaacccucuaccugggggugauggugcaggccgauaccgggugcgugguuaauuggaagggcagggagcuaaaguguggguccgggaucuucgucaccaaugaggugcauacguggacagaacaguacaaguuccaagcggauagccccaaaagacucagcgcugccaucggcaaggcuugggaggacggcguaugcggcauccgcuccgcuacacgguuggagaacauuauguggaagcagauagccaaugagcugaacuauauucuccucgagaacgauaugaaguucaccgucgugguaggggacgucaaggguauacucacucaaggcaagaaggggauucgcccccagcccauggagcauaaguacucuuggaaguccuggggcaaagccaagaucaucggcgcggacgugcagaacaccaccuucauaaucgacggcccggacacccccgagugccccgacagccagcgggcguggaacaucugggagguggaggacuauggauucggaaucuucaccacgaauaucugguuaaagcugcgcgauuccuacacccaaguuugcgaccaccgguuaaugagcgcagcgauaaaggacucccgggccgugcacgccgacaugggcuacuggauugagucagaaaaaaacgaaacuuggaaacuuuccagagcaagcuucauugagguaaaaacaugcacguggccgaagucccacacccuguggagcaacgggguccuggaguccgaaaugaucauccccaagaucuacggcgggcccauaucucaacauaacuaccgcccagguuacuuuacacaaaccgcugggccguggcaccucgggaagcuggaguuggauuucgaccugugugaggggacaaccgugguggucgaugagcaaugcgggaaccgggggccaucucugaggaccaccacagugacggguaagaucauucacgaguggugcuguagaagcugcacucugcccccgcuccgauucaaaggcgaggacggcugcugguaugggauggagauccggcccguaaaggagaaagaagagaaccuggucaagucaaugguguccgccggcagugggaaaguggauaacuucucgcuggggcuccucugcauuagcaucaugguagaggaggugaugcgcucccgcuggagugggaaaaugcugaugaccggcacgauggcgguguucuugcugcuggucaugggucagcucaccuggaaugacuuaauccgcgucugcaucauggucggggcgcaugcucuggauagcaugggcauggggacgacauaucucgccuugauggcaaccuucaagauucgcccuaugcuggccgugggacugcuguuccggaaacugaccagccgcgagauccucuugcugaccaucggccuuucacugaucacccccguggagcugccgaacagcaucgaggagcuuggggacggacuggcgauggggauuaugaugcugaagcuccugacagacuuccagcccuaccaacuuugggccacccucuuaucucucaccuucgucaaaaccaccuugagccugcacuacgccuggaagacugccgcgauggugcugucgaucgugagccuccugccauuaugcuuguccacaacuucccaaaagacuacguggcugcccauccuguuaggcucccuggggugcaaaccgcugacgauguuccucauaagcgagaacaaaauuuggggccggaggucuuggccgauaaaugagggcaucauggcggucgguaucgugagcauccugauguccagccugcucaaaaacgaugugccccuugcggggccccugaucgccgggggcaugcucgucgccugcuauguaaucagcggguccucugcggaccugacccucgaaaagacggccgaggugucgugggaggaagaagccgaacacucaggcacggcccacaauauauuagucgagguccaggaugacggaaccaugaagaucaaagacgaggaacgggaggauacccugacaaucuuacucaaggccgcccuguuggcacucuccggaguauaccccaugagcauaccggccacccuguucgucugguauuucuggcaaaaaaagaagcagcgcuccggcgugcuuugggacauccccagcccacccgagguggagaaggccguccuugacgacgggauauaccggauauuacagcgagguguuuuugggcggucccaggugggcguaggcguguuccaggaggggguguuccacaccauguggcacgucacgcgcggcgcuguccugaccuaccaggggaaacggcuggagccaagcugggccagugugaagaaagaucucauuaguuacggcgggggguggaggcugcagggcuccuggaacgucggggaggaaguccaggugaucgcggucgaaccaggcaaaaaccccaagaacgugcagacgguaccggggaccuuuaagacccacgagggcgaggucggcgccaucgcccuggauuucaagccugggaccagcggcucucccaucgucaaccgggacgggaaagugguaggucuuuacgguaacggcguaguaacgacuagcgggacuuacguguccgccaucgcacaguccaaggugucccaggagggaccgcugccugaaaucgaggacgaggucuucaaaaagaaaaaucugaccauuauggaccugcacccgggcagcggaaagacgcgccgguaccuuccggcaauaguccgcgaaagcaucaaacggcgccugcggacacucauccuugcaccgacucgcgugguggcauccgaaauggccgaggcgcucaagggccuccccauccgguaccaaaccaccgccguccgcaacgagcauaccgggcgcgagaucguggaccugaugugucacgccaccuucacaaugcgucugcuuucgccaguacgcgucccuaacuacaacaugaucaucauggaugaggcccauuucacggauccggcaucuauagccgcccgcggguauauaaguacccgcguuggaaugggggaggccgcggcaaucuucaugacggccaccccgcccgggagcgccgaagcguucccccaaucgaacagcguuaucuacgaugaagagaaggauaucccagagcggagcuggaacuccggcuaugacuggauaaccgacuuccagggaaaaaccgucugguucguuccuaguaucaagaccgguaacgacauugcgaauugccugcgcaagaacggcaagcgggugauccagcugucccggaagacuuuugauacggaguaccaaaagaccaagaauucggacugggacuucguuguuaccacugacauuuccgagaugggagcgaauuuucgggcugaccgcgucauagauccgcgucgcugccuuaaacccgugauucuaagagaugggccggagagggucauccuggccggccccaugcccgucacgguagccagcgcggcacaacgacgcgggcguaucggaaggaaccaguccaaagagggagaucaauacaucuauaugggccagccgcuuaauaaugacgaagaccacgcccacuggacugaggcgaagauguugcuggauaacaucaacaccccggaaggcauuauccccgcguuguucgagccggaacgggagaaauccgccgccauugacggggaguacagguuacgcggagaggccaggaagaccuucguagaacugaugcgacgcggggaucucccggucuggcuguccuacaaaguggcaagcgagggcauccaguacgccgaccgcaaguggugcuucgacggcgagagaaacaaccagauccuggaggaaaauauggacguggagaucuggacgaaggaaggggagcgcaagaagcuccggccucgcugguuggacgcccgcaccuacucagauccccuggcccuacgcgaauucaaagaguucgccgcgggccggcguucugucucgggugaccuuauacuggagauaggcaagcucccucaccacuugacccagcgggcccagaaugcucucgacaaccucgucaugcuacauaauagugaacagggcggucgcgccuaccgacacgccauggaggaacuacccgacaccaucgagaccuuaaugcugcuggccaugaucgccacucucaccggaggcgucgcgcuauuuuuccuaagcggcaaaggacucggcaagaccuccaucgggcuccuaugugucauggccagcuccacuuugcuguggauggccagcguggagccacauuggauugccgcgucaaucgugcucgaauucuuccuaaugguccugcuuauccccgagccggaucgucaacggacgccacaagacaaccaguuagccuacguggugaucggccuauuaguccuaauccugaccgucgccgccaacgagaugggcuugcucgagacgaccaaaaaggaucuggggauaggcagcgcugcggcugaaauccaacaccauacgaccauucuggacguggaccuucacccggccagugccuggacgcuguacgcggucgccacgacgguuauuacucccaugcugcgucacacgauagaaaacaccacggcuaacaugagccucaccgcuaucgcgaaccaggcugcgauccugauggggcuugacaaaggguggcccaucagcaaaauggauauaggugugccauugcuggcccuggguugcuacagccaggucaaccccaugacccucaccgccgccguucugauguugguggcccacuacgcgaucauaggcccaggguugcaagcaaaagccaccagggacgcacagaagaggacggccgcggggaucaugaagaaccccaccgucgacggcauaguggccauagaucuggacccgguagucuacgacaccaaauucgaaaaacagcugggucagauuauguuacuaauccugugcacgucccagauccuccugaugcggaccacgugggccuuuugcgaaagcauuacccuugcgacaggcccucucacgacccugugggaggggucccccggcaaguucuggaauaccacaaucgcgguuuccauggccaauauuuuucgaggcucguacuuggccggcgccgggcucgccuuuagccugaugaagucccugggcgguaaucgccgggggacgggcgcgcagggggagacucucggcgagaaauggaaacgccaacugaaccaacugucaaagcuagaauucaacaccuauaaacggucugggauaauggaggucgaucgcacggaggcgaaggaaggucugaagcggggcgagaccacccgccacgccgucucgagagggaccgccaagcugcgcugguucguggagcgcaaccuagugaagcccgagggaaaggucauagaccucgggugcggucgcgggggauggagcuacuacugcgccggcuugaagaaaguaacggaggugaagggguacacuaagggcgggccgggccacgaagagccaauacccauggcgacauacggguggaacuuagugaaguugcacuccggcaaggauguguucuucauaccgcccgagaaaugugacacucuguugugugauaucggcgagagcucacccaaucccaccaucgaggagggacggacacuccgaguguuaaagauggucgagccuuggcuacggggcaaucaauuuugcaucaagguacucaauccguacaugccaagcgugguagagacccuagagcgaaugcaacggaagcauggggggaugcucgucagaaacccccucucucggaacagcacccaugagauguacuggguuucuugcggcaccgggaacauugucagcgccgugaauaugacgucacgcaugcugcuaaaccgcuucacgaugacccaucgcaagcccaccuacgaaaaggacgucgaccucggcgccgggacgcgccacguugccguggagcccgagguagcgaacuuagacauuaucggccagagaauagaaaauaucaaaaaugagcacaagucgaccuggcauuacgacgaggacaaccccuacaagaccugggccuaccacggguccuacgaggugaagcccagcggauccgcaucuucaauggugaacggcgucgugcgccugcucaccaagccuugggacgugauaccgauggucacgcaaauugcaaugacggacaccacgcccuucggucagcagcgaguguucaaggagaagguggacacgcgcacccccaaggccaagaggggcaccgcgcagguuauggaaauaaccgcggggugguuguggaaauuucugucccgcaagaagaagccgcggaucugcacucgggaggaguucacacgaaaggugcgcuccaacgccgccauuggugccguguuugucgacgagaaucaguggaacagcgcgaaggaggccgucgacgacgagcgguucugggaccucgugaaccgcgagcgugagcugcacaagcagggcaagugcgcuaccugugucuacaauaugaugggcaagcgcgagaagaaacuaggagaauucgggaaggcaaaggguagccgggcgaucugguacauguggcucggggcgcguuuucuagaguuugaggcucugggcuucaugaacgaagaucacugguuuucccgggacaauagccuuuccgggguagaaggcgagggccugcacaagcugggguacauccuccgcgacaucgcucggaucccgggcggcaacauguaugcugacgacacagcgggcugggacacgcgcaucaccgaggaggaccugcagaacgaggcccgaguuaccgagcugauggagcccgaucacgcacagcucgcuaccagcaucuucagacugacuuaucagaauaaggucguacgcguccagcgcccagguaagaacggaacggucauggacguuaucucccgccgggaccagaggggcucuggccaggugggcacuuacgggcugaacaccuucacuaauauggaagcccagcuuauccgccaaauggaguccgagggcguguuuagcccgagcgagcuggagacgccuaaccuggcgaaccgggugcuagacuggcuggagaaguauggcguggagaggcuaaagcgcauggccaucucgggggacgacugcguagugaagcccaucgacgaucguuucgccaccgccuugacugcacuuaacgacaugggcaaggugcgcaaagacauuccccagugggagccgucccguggauggaacgacuggcagcagguaccuuuuuguucucaccacuuccaccagcugaucaugaaggacgguagggagauagugguuccuugccggaaccaagacgaacucgucgggcgugcgcgggugucccaaggggcaggcugguccuugcgcgagacagccugccuagggaaguccuaugcccagauguggcagcugauguacuuccaccggcgagaccugcggcuggccgcgaacgccaucugcagcgcugugcccgucgauuggguaccaacuucccggaccaccuggagcauacaugcccaucaccaauggaugaccacggaggacaugcugagcgucuggaaccgcgucuggauagaggagaacccuuggauggaagacaagacucaugugaccuccugggaggacgugcccuaucuggguaagagagaggaccaauggugcggaagcuuaaucggauuaagcgcccgcgcgacaugggccaucaacauccaaguggcgauaaaccaggugcggaaguugaucgggaacgaacauuaccaggacuacaugacgagcaugcgccgguuuaagaacgagagugaaccggagggcgcccugugguga

SEQ ID NO: 24789 - RNA, 9879 nt, Artificial Sequence
  derived and/or modified CDS sequence (opt11) from DENV-1__DQ285561__SS-prME
ucugugaccaugcuguuaaugcugcuuccgaccgcucucaccuuccaccuuaccaccaggggaggugaaccccacaugaucguggguaagcaggagcggggcaagucuuuguuauuuaaaacgagcgccgggguaaacaugugcacacucauugcgauggauuuaggagagcucugugacgacaccaugaccuauaaguguccccgcauuacugagaccgagcccgacgauguagacugcugguguaacgcaacagagacgugggugacuuacggaaccugcucucagaccggggagcacagacgcgacaaaagaucgguggcgcuggcgccccacgucgggcugggcuuagagacccggaccgagacguggauguccucugagggggcguggaggcagauccaaaagguggagacuugggcgcugcgacacccaggcuuuaccgugaucgcccuauuucuugcgcacgccauagggaccucaaucacgcaaaagggcauuauuuucauccugcuuaugcucgugacccccagcauggcaaugaggugcgugggcaucgguaaucgagacuucguggagggccuguccggggcaacguggguugacgucgugcuggagcacggcagcugcguaaccacuauggcgaaggauaagccaacccucgacaucgagcuguuaaagacugaaguuaccaaccccgccguguuaagaaagcugugcaucgaggccaagaucuccaacacuaccaccgacucucgcugcccuacccaaggugaggcgacccugguggaggagcaagacaccaacuuuguaugccgacgcaccuuuguggaucgggggugggguaacgggugcggccucuucgggaagggcucacugauaacaugcgcuaaguucaaaugcgugacgaagcuggagggcaagaucguucaguacgaaaaccucaaguacagcgugaucgucaccguccauacaggggaucaacaccagguggggaacgagaccaccgagcacgggacgaucgcgacaaucacgccucaagcgcccaccuccgagauucaacugaccgauuacggcgcguuaacacucgacugcaguccccgcaccgggcuagauuuuaacgagauggugcuacucaccaugaaggaaaaguccuggcuggugcacaagcagugguuucuggaucuuccgcuccccuggacgagcggcgcauccacuagccaagagaucuggaacaggcaagaucuguuggugacauucaagacugcgcacgcaaagaaacaggaggucgugguuuuaggcagccaggaaggggcuaugcacacggcccugacaggcgcaaccgagauccagaccuccgggacgacuaccauauucgcgggccaucucaagugcagacugaagauggacaagcugaccuugaagggaaucagcuacgucaugugcacgggcagcuuuaaguuggagaaggaaguugccgagacgcaacacggcaccguuuugguccaggucaaguacgaggggaccgaugcccccugcaagaucccauucucuucacaggaugagaagggcgucacacagaacggccgguugguuacugcaaacccgauagugaccgacaaagagaaaccggugaacauagaagcggagccacccuucggggagagcuacauaguggucggugccggggagaaagcgcugaaguuauccugguuuaagaagggcucaucaaucgggaaaauguucgaagcaaccgccaggggcgcuagacgcauggcuauauuaggugacacagcuugggauuucggcagcaucggcgggguguucacuuccgucgguaaacucgugcaccagaucuuugggaccgcauacggcgucuuauuuuccggugucuccuggacgaugaagaucggcaucggcauucugcuaacaugguuagggcugaacagccgcuccaccagccuauccaugacgugcauagcgguugguaugaucacccuguacuuggggguuaugguccaggccgacucuggcugcgucaucaacuggaaggggagagagcucaagugcggguccggcaucuucgugacuaacgagguccacaccuggaccgaacaguacaaauuucaggccgacagcccgaagcgccuuagcgccgccauagguaaggcgugggaggagggcguauguggcauccgguccgcaacucgccuggaaaacauaauguggaaacagaucuccaacgaauuaaaccacauacugcuggagaaugauaugaaauucaccguggucguuggggacgugagcggcaucuuagcccaaggcaagaaguccauccgcccccagccgauggagcauaaguacuccuggaaauccugggggaaggccaagaucauuggggccgacguucaaaacacgacuuucauuaucgacgggcccaauaccccggagugccccgacgaccagcgcgcguggaacauaugggaggucgaggacuacggcuucggcaucuuuaccacaaauauuuggcugaagcugagagacaguuacacacaggugugcgaccacagacugaugagcgccgccaucaaggacuccaaagccguacacgcggacauggguuauuggauugagagcgagaaaaacgagaccuggaagcuggcccgggccuccuucaucgaggucaagacaugcaucuggcccaagagccacacgcugugguccaacgguguccucgagagcgagaugaucaucccuaaaauuuauggagggccaaucucccaacacaacuaccgccccggcuauuucacgcagaccgccggacccuggcauuuaggcaaguuagagcucgacuucgaucugugcgaaggcacuacgguggugguggacgaacacugugggaaccgggggcccagccugagaaccacgacugucacggggaaaaucauucacgaaugguguugccgguccugcacccugccaccccuaagguucaaaggcgaggacgguugcugguacggaauggagauacggccagugaaggagaaggaggagaaccuggucaagagcauggucagcgccggaaguggggaaguggacagcuucucccucggccuccugugcaucagcaucaugaucgaggaagugaugaggagucgguggucccgaaaaaugcucaugacuggaacauuggccguuuuccugcuccugaccaugggacagcuuaccuggaaugaccucauccgacugugcauaauggucggcgccaacgcaucugacaacaugggcaugggcacuaccuacuuggcucucauggccaccuuucgcaugcguccgauguucgcgguagggcugcuguuccggagacucaccucucgggaggucuugcugcucaccgucggauugucacuggucgcgagcguggagcucccuaauucccuggaggagcugggagauggccuagccaugggcauuaugaucuugaaacugcucacggauuuccagagccaccagcucugggcuacauuauugucucugaccuucgugaaaacuaccuucagccugcacuacgccuggaagacgauggcgaugauuuuguccauugugagccuguuccccuuaugucucuccaccacgagccagaagacaacguggcugcccguacuguuggggagucugggcugcaagcccuugaccauguuccucauuaccgagaauaaaauauggggacggaagagcuggccccuaaaugagggcauuauggcaguggggaucgugagcauccuguuguccagcuuguuaaaaaaugacgugccucuugccggcccccugaucgccgggggaaugcugauagcgugcuacgugaucuccgguucguccgccgaucucagccuggagaaagccgccgaggucuccugggaggaggaagccgagcacagcggcgcgucgcacaacauccugguggagauacaagacgauggcacuaugaaaauaaaggaugaagagcgggaugacacuaucacgauauuacugaaagccaccuuacuagcgaucucagggguauacccuauguccauccccgcaacccuguuugucugguacuuuuggcagaagaagaaacaacgcucgggcguacucugggacacccccagcccgcccgaagucgagcgggccguccucgacgacggcaucuaccgcauucugcagcguggccugcugggccgcagccagguaggggucggcguuuuccaggaggggguguuucacaccauguggcaugugaccagaggcgcggucuugauguaccagggaaagcgacuggagccuucaugggccucaguaaagaaggaccugauaucauacgggggcgguuggcgguuccaggguagcuggaacacaggggaggaagugcaaguuaucgccguggaaccagggaagaaccccaagaacgugcagacggcccccggaacauucaaaaccuccgaaggcgagguuggugccauagcgcucgacuuuaagcccggcacaagcggcagccccauagucaacagggagggcaagauaguggggcuguacggcaaugggguagugacgacgucagggaccuacgugagcgccauagcccaagcuaaggccucccaagaagggccucugccggaaauagaagaugagguguuccguaaacguaaccucaccauuauggaccugcacccuggcuccggcaagacccgccgcuaccugcccgcgaucguacgggaggcuaucaagcgcaagcuccggacgcucgucuuagccccaacgcgugucguggccuccgagauggccgaggcacuaaaagggaugccaauccgauaccagaccacagccgucaagucagagcacacgggccgggagaucguagaccugaugugccacgccaccuuuacuaugaggcugcucucccccgucagaguucccaacuacaacaugauuauuauggacgaggcccacuucaccgauccggcaagcaucgccgcccgcggguacauauccacgcgggucggcaugggugaggcggcggcgaucuucaugaccgccacgccgcccggcagcguugaggccuucccccaaucuaaugccgugauccaggaugaggagaaagacaucccggagcgaagcuggaauagcggcuacgauuggaucacuggcuuucccggcaagacugucugguuugugcccagcaucaagucugguaaugacaucgccaacugccuuaggaagaauggcaagcgugugauccaguuaagccguaagacauucgacaccgaguaucaaaagaccaagaacaacgauugggacuacgucgugaccaccgacaucuccgaaaugggggcgaacuuccgcgccgacagagugaucgauccccgccggugccucaaacccgugaucuugaaggacggcccugaacgcgucaucuuagcggguccuaugcccgucaccguggcaagcgcagcgcagcgacgugggcguaucggaagaaaucaaaacaaggaaggggaccaauacaucuacaugggccagccccucaacaaugaugaagaucacgcgcauuggaccgaggcaaagauguuauuagacaacauaaacacgccagaggggaucauccccgcccucuucgagccggaacgggagaaguccgcugcaauagacggcgaguacagauugcgaggugaggcccggaagacuuucguagagcugaugaggcgaggggaccucccuguguggcuuagcuauaagguggcgagugagggcuuucaguacuccgaccgccguuggugcuuugacggggagcgcaacaaccaggugcuggaagagaauauggauguugaaauuuggaccaaagagggcgagcggaagaaacuacgcccccgguggcuggacgcccgaacauauagcgauccccucgcccuccgggaguucaaagaguucgccgccggccgucgguccguuuccggcgaccugauacuggagaucggcaaguugccccagcaccugacacaacgugcccagaacgcccucgacaaucucgucauguugcacaacuccgaacagggugggaaagccuaucggcacgccauggaggagcugccggacaccaucgagaccuugaugcuucuggcccucaucgcaguucugaccgggggggugacccuguuuuuccugucaggacgcgggcuggggaagacaucaaucggguuacucugcgugaugagcuccagugcgcuucuguggauggccuccgucgagccccacuggaucgcagcuucaaucauacuagaguucuuccugauggugcuacucauccccgaaccggaccggcaacgcaccccgcaggacaaccaacucgccuacguggucaucggacucuuguuuaugauccugacaguggcagccaacgagauggggcucuuagagaccacaaagaaagacuugggcaucggccacgccgccgcggagaaccaccaucaugcugcuaugcuggauguggaccuccaucccgcuuccgccuggacccuguacgccguggcgacaaccaucauaaccccgaugaugcggcauaccauagaaaacaccaccgccaacaucucacugacugcgauagccaaucaggccgccauccucaugggcuuagauaagggauggccgaucagcaagauggauaucgguguuccacugcucgcccuggguugcuauagccaggugaaccccuugacacucacugcagccguccugaugcugguagcgcauuacgccaucauagggcccggucuccaggcaaaggcuacccgcgaggcccagaagaggacggcggccggcaucaugaagaacccaacgguggaugggaucgucgccauugaccucgaucccgucguauacgaugccaaguucgagaagcagcuuggccagaucaugcuccugauacuguguaccucccagauccuccuaaugcgcacuacgugggcgcugugcgaaagcaucacgcuugccacuggaccacugaccacgcuaugggagggcucccccggaaaguuuuggaacaccacgaucgcagucagcauggcaaacaucuuccgcgguagcuaccuagcgggcgccgggcuggcuuucucauuaaugaagagccucgggggugggcggcgcggaaccggcgcccagggcgagacgcuaggggagaaauggaaacgccagcugaaccagcugaguaagagugaauucaacauauacaagagguccggcauaguggaaguugaccgaucugaagccaaagaggggcugaagaggggcgagaccauuaaacaugcgguaucucgcggaaccgcgaaacugcggugguuuguggagcggaaccucgugaagccagaagggaagguaauugaccuagguugugggcgcggaggguggagcuauuacugcgcaggauugaagaaagucaccgaggugaagggcuacacgaagggugggccaggucaugaggagcccauccccauggccacuuacgguuggaaccuaguuaagcuguacucagggaaggauguguucuuuaucccuccugaaaagugugauacccuguugugcgauaucggugagagcucccccaauccgaccauagaggagggacguacucuccgcguguuaaagaugguggagccguggcugagagggaaccaguucugcauaaaaauuuugaaucccuauaugccaucagugguggagacccuagagcagaugcaaaggaaacacggugggaugcugguucgcaacccacucucacgcaacucuacacacgagauguauuggguauccugcggcaccggcaacaucgugagcgccgucaacaugaccucccgaaugcugcuuaacagguucacgauggcgcaccggaagcccaccuacgagcgcgacgucgaccucggggcgggaacccgccacguagcugucgagccagaaguggcuaaccuggacaucauagggcagcgcaucgaaaacauaaagaaugaacauaagagcaccuggcauuacgacgaagacaacccuuacaaaacaugggccuaccauggcuccuacgaagugaaacccagcgggagcgccuccagcauggucaacggcguugugcgccugcucacgaagccuugggacgugauucccauggugacccagauugccaugacagacacgacgcccuucggucagcagcgagucuucaaagagaagguggacacccgcacccccaaggcuaaacgggggacggcccagaucauggaagugaccgcgaagugguuauggggauucuuaucucgaaacaaaaagccccggauuuguacccgggaggaguucacgcguaaaguccgcagcaacgcagccauaggugccguguucguggacgagaaucaguggaacuccgcaaaggaggcagucgaggacgagagguuuugggaccucguucgcagagagcgugaacugcacaagcagggcaagugcgcgaccuguguguauaacaugaugggcaagcgggagaagaaguuaggcgaauucggcaaggccaagggaaguagagcaauaugguauaugugguuaggggcacgguucuuagaguucgaggcauuaggauucaugaacgaagaucacugguucucacgcgagaacagccuaucugguguagagggggaaggccuccacaagcuugguuacauccuucgugacaucagcaagauucccggaggcaauauguaugcggaugacaccgccgggugggacacgaggaucaccgaggacgaccugcagaacgaggccaaaaucacggacaucauggaacccgagcacgcucuccuagcuacuagcauuuuuaaacuuacuuaucaaaacaaagucguacggguccagcgcccagcgaaaaacgggaccgugauggauguuaucucgcgccgggaccagcgcggcucgggacaggucggaaccuauggccugaauaccuuuacgaauaugggcgcccagcucauccgccagauggagagcgaagggaucuucucaccaagcgaacuggagacgccaaacuuagcuggccgcguucucgacuggcuggaaaagcacggcauagaacgucuccgccgcauggcaaucuccggcgacgacugcguggucaaacccauugacgaucguuucgccacugcgcucaccgcgcugaacgacaugggcaaagugcggaaggacaucccacagugggaacccagcaaaggcuggaacgauuggcaacagguucccuuuugcucccaccacuuccaccaguuaauuaugaaggauggccgcgagaucgucguccccugccggaaccaggacgagcuuguagggagggcccgagugucucaaggcgcgggcuggucacugcgcgagacggccugccuugggaaauccuacgcgcaaauguggcagcucauguacuuccauagaagggaucuucggcuugcugccaacgccaucugcagugcgguccccgucgacuggguccccaccuccaggacgacuuggucaauucacgcacaucaucaguggaugacaaccgaagauaugcucucgguuuggaacaggguuuggaucgaagagaaucccuggauggaagacaaaacgcacgucagcucaugggaggacgugcccuaccugggcaagcgcgaggaccagugguguggcagucugaucggccucaccgccagggcgacaugggccacaaacauucaaguggcgaucaaccagguaagacgccugaucgggaaugaaaacuaccuugauuacaugaccuccaugaaacgguuuaagaacgagagcgacccggagggcgcacucugguga

SEQ ID NO: 24790 - RNA, 9879 nt, Artificial Sequence
  derived and/or modified CDS sequence (opt11) from DENV-1__DQ285562__SS-prME
agcguaaccauguugcucaugcuucugccgaccgccuuggccuuccaccugacaacgcgcgguggugagccccacaugaucgugagcaagcaagagcggggcaagucgcuucuauucaagacuuccgcgggggugaacaugugcacacugaucgccauggacuuaggcgagcucugcgaggauaccaugaccuacaaaugcccccguaucacugaggcggaacccgacgacguggacugcugguguaacgcuaccgacacgugggugacauacgggaccugcagccaaacgggcgagcaucgucgcgacaagcgguccguggcccucgcgccccacguaggccuaggacucgagacgcgaaccgaaacguggaugagcagugaaggugccuggcggcagauccaaaaggucgagaccugggcccugcggcacccuggguucacggugauugcccuuuuccucgcgcacaccaucgguacaagcauaacccagaaggggaucaucuucaucuugcugaugcuugugacgccgaguauggccaugcggugcgugggcauuggaaaucgggacuucguggaggggcugagcggggccacguggguggacgucgugcuggagcacggguccuguguaacgaccauggccaagaauaagcccacgcucgacaucgagcugcugaagaccgagguaaccaaccccgcugugcuccggaagcugugcaucgaagcgaaaaucagcaacaccacgaccgacucccgcugucccacacagggcgaggccacccugguagaagagcaggacgccaacuucgucugccggcgaacguucguggaucgcgguugggggaacggcugcggccucuucgggaaggggagccuucugaccugcgccaaguucaagugcgugaccaagcucgaaggcaagaucguccaguacgagaaccuuaaauacuccgugaucguaacaguucacacgggcgaccagcaccaggucgggaaugaaaccacggaacacggcaccaucgccaccaucaccccucaagcgcccaccagcgagauccagcuuacagacuacggggcccucacccucgacugcagcccaagaacgggccuggacuuuaacgagaugguccuccugacgaugaaggaaaaguccuggcugguucacaagcagugguuccucgaucugccguuacccuggaccuccggggcgagcaccagccaagagacguggaaccggcaagaccuccugguaaccuucaagacagcacaugccaagaaacaggagguaguggugcugggcucccaagagggcgcgaugcacaccgcccucacgggggccacugaaauacagaccucuggcaccacgacaauauuugccgggcaccugaagugccgccugaagauggacaagcuaacccugaagggcgucaguuauguaaugugcaccgggagcuucaagcuggagaaggaggucgcugagacucagcacggaaccguacuaguccaggugaaguaugaaggcacggacgcgccuugcaagauccccuucaguacccaggacgagaagggggucacucagaacggccggcucaucaccgccaacccgaucgugaccgacaaggaaaagcccgugaacauagagaccgagccgccauucggggaaaguuauaucgucauaggcgccggcgagaaggcccugaaacuuaguugguucaagaagggcagcuccaucggcaagauguucgaggcgacggcccgcggggcacggcggauggccauccucggcgacaccgcaugggacuucgggaguaucggcggcguuuucaccuccguugggaagcugguccaucaaguguucggcacggcguaugggguguuguucaguggcgucuccuggacgaugaagaucgggaucggaauucuccugacgugguuaggccucaacagccgcuccaccucucuguccaugaccugcaucgugguggggauggucaccuuauaccucggaguuauggugcaagcugacucagggugcgucaucaacuggaagggccgggagcugaagugcggcuccggcaucuuugugaccaaugagguucacaccuggaccgagcaguacaaguuccaggcagauucgccgaaacgcuuaagcgccgcaaucggcaaagcgugggaggagggggucugugguauccgguccgccacccgcuuggagaacaucauguggaaacaaaucagcaacgagcuaaaccauauccugcucgagaacgacaugaaguucaccguggucgucggggacgccaacggcauccugacccagggaaaaaagaugauccggccccaaccgauggagcacaaguauuccuggaaguccuggggcaaagcuaagaucaucggcgccgacauucagaacaccacauucaucaucgacgguccagacacuccggagugucccgaugaccagagggcguggaacauuugggaaguugaggacuacggcuuugggauauucacaaccaacaucugguugaagcuccgggauagcuacacacagaugugcgaccaccgccugaugagcgcagccaucaaagauuccaaggccguucacgcggacaugggcuacuggaucgagagcgagaagaacgagacguggaaguuagcccgggccuccuucaucgaggugaagacgugcaucuggccccgcagccacaccuuauggucgaauggugugcuggagagcgagaugaucauccccaagaucuaugggggcccgaucucccagcacaacuaccggcccggguacuucacgcagacggccggccccuggcaccuggggaaguuagagcuggacuucgaucugugcgaaggaaccaccguagucguugaugagcauugcggcaaccgcgggccgagccuccggacuacuaccgucacgggcaagaucauccacgaguggugcugucguucuugcacccuaccgccuuugcgguucaagggugaagacggcugcugguacggcauggaaauccgucccgucaaggaaaaggaggagaaccucgugcggagcaugguguccgccggcaguggcgaggucgacuccuucucccuggggcugcucugcguaucuaucaugguugaggaggucaugcgcucacgauggagccgcaagauguugaugacgggcaccuuggccguguucuucuuguuaaucauggggcagcugaccuggaacgaccucauccgccucugcaucauggucggcgccaauguauccgaccggaugggcauggguaccacguaucuggcacucauggccaccuucaagaugcgcccgauguucgcgguggggcugcuguuccggcgccugacgagccgggagguccugcuguugacgauugggcugucccuggucgcaagcguggaacuccccaacucccuggaggaacugggcgacggacucgccaugggcaucaugaugcugaagcugcucacggauuuccagagccaccagcuguggaccacccugcugucccugacuuucauuaagacgacccugucucucgauuacgccuggaaaacgaucgccaugguacuuuccauagugucgcucuucccccucugccuguccacuacgagucagaagacgaccuggcuacccgugcuucugggcuccuucggaugcaaaccgcugacaauguuccucaucaccgagaacaagauauggggccgaaaaucuuggccccugaacgaggguaucauggcagucggcaucguauccauccuacucagcagccugcugaagaaugacgugccccucgcgggcccccugaucgccggcggcaugcuuaucaccugcuacgucaucucuggcagcuccgccgaccuuagucuggagaaggccgcggaggucucuugggaggaggaggccgagcacagcggcgccucccacaacaucuuaguggagguccaggacgaugggaccaugaagaucaaggacgaggagcgggacgacacacucacaauacuauuaaaagccacguuacuggccgugagcggaguguauccgauguccaucccggcgacccuguucgucugguacuucuggcagaagaaaaagcaacgcucaggggugcugugggacacccccagcccgcccgagguggagcgcgccgugcuggacgacgguauauauaggauuuugcagcgaggccugcucgggcgcagccaggucggggugggggucuuccaggacggcguguuccacaccauguggcacgugacgagaggggcaguccugauguaccagggcaagcgccuggaacccuccugggccagcgucaaaaaggaccucaucuccuacggcggaggcuggagauuccaggggagcuggaacaccggagaggaggugcagguaauugccgucgagcccgggaaaaaucccaagaacgugcagaccaccccaggcacuuucaagacccccgagggcgaagucggggcgaucgcccuggacuucaagcccggaacgagcgguagcccaaucgugaaccgcgagggcaagaucguaggccuuuacgggaacggagucgugacuacguccgggacuuacgugagcgcuaucgcccaggcaaaggcgagccaagagggcccacuccccgagaucgaagacgaggucuucaagaagcggaaccugaccauaauggaccugcaccccgggagcggcaagacccgccgguaccucccggccaucgugcgggaggccaucaagcggaaauugcgcacgcugauccucgcccccacccgagugguggccagcgagauggcggaggcguuaaaggggaugccaauucguuaccaaacaaccgccgugaaguccgaacacacgggucgugagaucguagaccucaugugucacgccaccuucaccaugcggcuccugagccccguccgcguaccgaacuacaacaugauuaucauggacgaggcccacuucaccgacccggccuccauagccgcccggggauauaucagcacccgcguggggaugggcgaggccgcggccaucuucaugacagcuacgccgcccggaucuguggaggccuuuccgcagagcaacgccgucauccaggacgaagagagggacaucccggagagguccuggaacagcggcuacgacuggaucacagacuuucccggcaaaacggucugguucguccccuccaucaaaagcgggaacgacaucgcgaacugucugcggaagaacggcaagcgcgugauccagcucuccagaaagaccuucgacaccgaguaucaaaagaccaagaacaaugacugggauuauguggucacgaccgacaucagcgagaugggggccaacuuccgugccgaccgggucauagacccgaggcggugccugaagcccguuauacuaaaggacggccccgagagggugauucucgccgggcccaugccggugacggucgccuccgcagcccagcgccggggccggaucggccgcaaccaaaacaaagagggggaccaguacaucuacaugggacagccacuaaacaacgaugaggaccacgcccacuggaccgaggcuaagaugcuccuugauaacaucaauacacccgaggggauuauuccagcauuauucgagccagagcgcgagaaguccgccgcaaucgacggagaguacaggcuacgcggggaggcucgaaagacauuuguggaacucaugcgccggggcgaccugcccguguggcuuuccuacaagguagcuagcgaggguuuccaguacagcgauaggcgguggugcuucgacggggagcgaaauaaucagguguuagaggaaaacauggacguggagaucuggaccaaggagggcgagcggaagaagcugcgcccccguuggcuggaugcccgaaccuacagcgauccucuugcgcuacgggaguucaaggaguucgccgccgggagaagaagcgucuccggggaccugauacucgagaucggaaagcuuccgcaacaccucacacuccgggcccagaaugcgcucgacaaccucguuauguuacacaauagcgagcagggcgggaaggccuaccgacacgcuauggaggagcugcccgacacgaucgagaccuuaaugcucuuagcccugauugcugugcucacugggggcgucacucucuucuuucugagugggaaggggcucggcaagacgagcauugggcuacugugcgugauggccuccagcgugcuccuguggauggccuccgucgagccucacuggauugcagccagcaucauccuugaguucuuccucaugguauugcugauuccggagccggacaggcagcggacgccacaggacaaccagcuggcguacgugguaauuggucuucuuuuuaugauucucaccguggccgcaaacgagauggggcuccuggaaaccacgaaaaaggaucucgguauagggcaugccguggcggaaaaccaccaucacgcgaccauguuagacaucgaccugcaccccgcgagugccuggacccucuacgccguagcgaccacgaucaucaccccgaugaugagacacaccaucgagaacaccacggcaaacauaagccugaccgccaucgccaaucaggccgcaaucuugaugggucucgacaagggcuggcccaucagcaagauggacaucggcgugccccugcuggcgcugggaugcuacucucaagugaacccccuaacccugaccgccgccguccucaugcugguggcccauuacgccaucauaggcccuggccugcaagcgaaggccacgcgggaagcccagaagaggacugcggcggguaucaugaagaaccccaccguggacggcauuguggccaucgaccucgaucccgugguguacgaugccaaguuugaaaaacagcugggacagaucaugcugcucaucuugugcaccagucaaaucuuacucaugcguacgacgugggcccuuugugagagcauaacccuggccacggggccacucacgacccugugggagggcucuccaggcaaguucuggaacaccaccaucgcggucagcauggccaacauauuccggggaucauaccuggcaggcgccggacucgcguucagccugaugaagucucugggagguggcaggcggggcacgggcgcgcagggggagacacucggggagaaguggaagcgccaguugaaccagcugagcaaaucggaauuuaacaccuacaagcggaguggcaucauggaggucgaccgcagcgaggccaaggagggguuaaaacggggcgagaccacgaagcacgccgugucccgagguaccgccaaacugcggugguucguugagagaaaccuggugaaacccgagggaaaagugaucgaccugggcugcggucggggcggguggagcuacuacugcgcuggucucaaaaaggucaccgaggugaagggguacaccaaagguggacccgggcacgaggaacccaucccaauggcgacauacggcuggaacuuggugaaacugcacucgggaaaagacgucuucuucacgccuccagagaagugcgacacccugcuuugugacauuggcgagagcucccccaacccaaccauagaggaggggcgcacccugagagugcucaagaugguagaacccuggcugcgcgguaaccaguucugcauaaagauccugaacccguacaugcccagcgucguggaaacgcucgaacagaugcagaggaagcauggcgggaugcuggugcgaaacccccugucccggaacucuacccacgagauguacuggguguccugcgguaccgggaacaucguguccgccguuaacaugaccucccgcaugcucuugaaccgguucaccauggcccaccgaaagccgaccuaugaacgcgacgucgacuuaggugccggcacccgucacguggcaguggagccggaaauagccaaccucgacaucauagggcagcgcaucgagaauaucaagaacgagcacaaaagcaccuggcacuaugacgaggauaacccuuauaaaacgugggccuaccauggcuccuacgaggugaagccgagcggauccgccagcuccauggucaacggcgucgugcggcuacugaccaagcccugggacgugauccccauggucacccagaucgccaugaccgacacgacccccuucggccaacagcgcguguucaaagaaaagguugacaccagaacaccgcgucccaagcggggcacggcgcagauaauggaggucaccgcaaaguggcucuggggguuccugagccguaacaagaagccccggauaugcacccgcgaggaguuuacaagaaagguacgauccaacgccgcuauaggggcgguauucguggacgagaaccaguggaacuccgccaaagaagccguggaagacgaaagguuuugggaccuggugcaucgcgagcgggagcuccacaagcaagguaagugcgccacgugcguauacaauaugauggggaaacgcgagaagaagcugggcgaguucgggaaggccaagggcucucgggccauaugguauauguggcugggagcgcguuuccucgaguucgaggcccugggguucaugaacgaggaccacugguucuccagagagaacagucuguccggcguggagggugaggggcuccacaaauuaggguacauccuccgcgacauaagcaaaauuccgggcggcaacguguaugccgacgauaccgccgggugggacaccaggauuaccgaggacgacuuacagaacgaggcuaagaucacugacaucauggagcccgagcacgcccugcuggcuaccagcaucuucaagcuaaccuaccaaaacaaagucgugcgaguucagagacccgccaagagcgggaccgugauggauaucauuucccggcgcgaccagcggggcucaggccaggugggcacguauggccugaacaccuucacgaacauggaggugcagcugauccgccagauggaauccgagggcauuuuuagucccucagagcucgagaacagcaaccuggccgagagaguccuggacugguuggagaagcacgggguggaacgccugaaaagaauggcgaucagcggcgacgacuguguggucaaaccgaccgacgaccgcuucgcaacggcgcugaccgcucugaacgacaugggcaagguucggaaggacaucccccagugggagccuaguaagggcuggaacgacuggcagcaggugcccuucugcucgcaccacuuucaccagcugaucaugaaggacggcagagagaucgucguuccuugucggaaucaagacgaguugguggggcgcgcccgggucucgcagggcgcggguuggagccuucgggagaccgccugccuggggaagaguuacgcccaaauguggcaguugauguacuuccaccggcgcgaccuccgucuggccgccaaugcgaucugcagcgcugugcccguggacuggguccccaccagccgcaccacauggagcauccacgcccaccaucaguggaugaccacugaggacaugcuguccguuuggaaucguguguggaucgaggaaaaucccuggauggaggacaaaacccaugugagcuccugggaggacgugccguacuuaggcaagcgugaggaccagugguguggaagccugaucggccugacggcccgcgccaccugggcgacaaacauccagguggccaucaagcagguacggcgccucaucggaaacgagaacuaccucgacuacaugaccuccaugaagcgcuucaaaaacgagagcgaccccgagggagcucugugguaa

SEQ ID NO: 24791 - RNA, 9879 nt, Artificial Sequence
  derived and/or modified CDS sequence (opt11) from DENV-1__DQ285558__SS-prME
agcgugaccaugcugcucaugcugcugcccaccgcccucaccuuucaucuuaccacccgcggcggugagccccauaugaucgugggcaagcaagagcggggcaagagccugcuguucaagaccagcgccggggugaacauguguacccugaucgcgauggaccugggagagcugugcgacgacaccaugaccuacaagugcccccgaaucaccgagacggagcccgaugacguggacuguugguguaacgccaccgagacuugggugacauacggcacgugcucgcagaccggcgaacaccgccgcgacaagcggucugucgcccucgcaccacacguagggcugggcuuggagacgcgcacugagacauggauguccagcgagggggccuggagacagauccagaaggucgagaccugggcccugcgccaccccggauucacagugaucgcccuguuccucgcccacgcgaucgggaccuccaucacucagaaaggcaucaucuucauccugcugauguuaguuacccccagcauggcgaugcguugcgucgggaucgggaaccgcgacuucguugaagggcuguccggggcuaccuggguggacgucgugcuggagcacggcagcugcgugaccacgauggccaaggacaagcccacccucgacaucgagcugcugaagaccgaggucaccaacccggccgugcuccggaagcugugcaucgaggccaagaucuccaacacaaccaccgacucacgcugcccgacucagggcgaggcuacacugguggaagagcaagacaccaacuucgucugccggcgaaccuuugucgaccgaggguggggcaacgggugcggucucuucgggaagggcucccugaucacaugcgccaaguuuaagugcgugaccaaacuggagggcaagauaguccaguacgagaaucucaaguacagcguuaucguaacuguccacacgggggaccagcaccaggucggcaaugagaccaccgagcacgggacgaucgccaccaucacgccacaggcccccaccuccgagauccagcugacagacuacggcgcgcucacccuugacugcagcccacgcacagggcuggacuuuaacgagaugguccugcucaccaugaaggagaaguccuggcuagugcacaagcaaugguuccuggaucucccgcugcccuggacuuccggagcguccacuucccaagagacuuggaacaggcaggaccugcucgugaccuucaagaccgcgcacgccaaaaagcaggagguaguggugcugggcagccaggaaggggccaugcacaccgcccugaccggcgcgacggagauccagacuuccggcaccaccacuaucuucgccggccaucucaagugccgccugaagauggauaaacuaacgcucaaagggauaucguaugucaugugcaccggcagcuucaagcucgaaaaggagguggccgagacccagcacggcaccgugcugguccaagugaaguacgaaggaacggacgcccccuguaaaaucccguucaguucccaggacgaaaagggagugacccaaaacggucggcuggucaccgccaauccuauuguaaccgacaaggagaagcccgugaacaucgaggcggagccgcccuucggugaguccuacauugucgugggcgccggggagaaggcccucaagcugucuugguucaagaagggcagcuccaucggcaagauguucgaggccacggcucgcggcgcccgacgaauggccauccugggggacacagccugggacuucggcagcaucggugggguuuucaccucagucggcaagcucgugcaccagaucuucgggaccgccuacggcguauuauucagcggggucaguuggacgaugaagaucgguaucggcauccugcucaccuggcuggguuugaacagccgcucaaccagccugaguaugacuugcaucgcggugggucugaucacguuauaccucggagugaugguccaggccgauagcggcugcgugaucaacuggaaggggagggagcugaaauguggauccggaauuuucgugaccaaugagguacacaccuggaccgagcaguacaaguuccaggccgacuccccuaaacgccugagcgcagccauugguaaagcgugggaggagggcgugugcgggauccggucagccacucgccucgagaacaucauguggaagcagaucagcaacgagcugaaccacauccuguuggagaacgacaugaaauuuacgguggucgugggugacguguccgggauccuggcgcaggguaagaagucaauccggccccagcccauggagcacaaguacuccuggaaguccuggggcaaggccaagaucauuggggcagacguccagaacaccaccuucauuaucgacgguccgaacaccccagagugccccgacgaccagcgggcguggaacauaugggagguggaggacuacggcuuugggaucuuuacgaccaacaucuggcugaagcugcgggacuccuacacccagguaugcgaccaucgccugaugagcgcagcaaucaaggauuccaaggccguccacgcggacaugggcuacuggaucgagagcgagaaaaacgagaccuggaagcuggcgcgggccuccuucaucgagguuaagacgugcaucuggccuaagagccacaccuuguggucaaacggggugcucgaaagcgagaugaucauccccaagaucuauggcgggccgaucucccagcacaacuaucgccccggcuacuucacccagaccgccgggcccuggcaccugggcaaacucgagcuggacuucgaucugugcgaggguacgaccgucgugguggacgagcacugcgggaaccggggcccgucacuccgaaccaccacggugaccgggaaaaucauccacgaguggugcugccgguccugcacgcuaccuccguuacgcuucaagggcgaggacgggugcugguacggcauggagauucggcccgugaaggagaaggaggaaaaccucguuaaaucuauggucagcgccggcuccggcgagguggacagcuucucccugggucugcucuguaucucuaucaugaucgaggaggucaugcgaucucgguggagccgcaagaugcugaugaccgggacacuggcgguuuucuuacugcugaccaugggccagcucacauggaacgaccuuauccggcuguguaucauggugggcgccaacgccuccgacaacaugggcauggggaccacguaccucgcgcugauggccaccuuucgcaugaggccaauguucgcgguagggcuccuguuccggcgccugaccucacgggagguccuacuccugacggugggccugucgcucguagccagcguggagcugcccaacucccuggaggagcucggcgauggccuggccaugggaaucaugauccugaaacuccugacggacuuccagagccaccaacugugggcgaccuuauuaucccugacauucgugaaaaccacauucagccuccacuaugccuggaagaccauggcgaugauacugucgaucguaagccuguuuccccucugcuuaucaaccaccagccagaagacgaccuggcugcccgugcuccuggggucccugggcugcaagccgcucaccauguuccugaucaccgagaacaagaucugggggcgcaaaagcuggccccugaacgagggcaucauggccguggggauagucagcauccuuuuguccagccugcucaagaacgacgugccccuggccggcccccugaucgccggcgggaugcucaucgcgugcuacgugaucucaggcucguccgccgaccugagccuugagaaggccgccgaggucuccugggaggaggaggcggagcacagcggggcgucccauaauauccucguggagauccaggacgacggcaccaugaagaucaaggaugaggagcgggacgauacgaucacgauucugcugaaagcgacacuccuggccaucagcggcguuuacccaauguccauaccggccacccuguuugucugguacuucuggcagaagaagaagcagaggucuggcguacugugggacacgcccagcccgccugagguggagcgggcaguccuggacgacggaaucuaccgcauucugcagcgggggcuguuaggccgcagccaggugggggugggcguguuccaggagggcguauuccauaccauguggcacgucacccggggcgcgguccugauguaccagggcaagcgccuugagcccuccugggcaagcgugaagaaggaccucaucuccuacggggguggguggcgguuccaaggcucguggaauaccggggaggaagugcaggucaucgccguggagccgggcaagaaccccaagaaugugcagacggcccccggaacguucaagacguccgagggggaggucggcgccauagcccuggacuucaagcccggaaccagcggcagccccauaguuaaccgcgaaggaaagaucguggggcucuacggcaacggggucgugacuaccuccggaaccuacguuuccgccaucgcccaggcuaaggccucccaggaggggccccucccggagaucgaggacgaggucuuccggaagcgcaaucugaccaucauggaucugcaucccgggagcggcaaaacgcggcgcuaccucccugcgaucguacgggaggccaucaagcgcaaacugcggacccuggugcucgccccgacccgcgucguggcuuccgagauggcagaggcgcugaaggggaugccgauccgcuaccagacuacggccgucaagagcgagcacaccggccgugagauagucgaccugaugugccaugccaccuucaccaugcgcuugcugucaccugugcgggugcccaacuacaacaugaucaucauggaugaggcccacuucacggauccggcgagcauagcagcgcgcggguacaucuccacccgggucgggaugggagaagccgcugcgaucuucaugaccgccacgccgccagguaguguggaggccuucccccaguccaacgccgugauccaggacgaggagaaggacaucccggaacgcagcuggaacuccgguuacgacuggaucacggacuuuccggggaagaccgucugguucgugcccucuauaaagucgggcaacgauaucgccaauugucuacggaagaaugggaagcgcgugauccagcucagccggaagaccuucgacaccgaguaccagaagacgaagaauaaugacugggacuacgucguaaccacugauauuuccgagaugggcgcgaacuuccgcgcagaucgagucauagauccccgcagaugccugaagccggucauccuaaaagacggccccgaacgcgugauccuugccggccccaugcccgucaccguggccagcgcggcgcagcggcggggccggaucgggcgaaaccaaaacaaggaaggagaucaguauaucuauauggggcaaccgcugaacaacgacgaggaccacgcucacuggacggaggcuaagaugcuguuagacaacauaaacaccccagagggcaucauccccgcccuguucgagcccgaacgggagaaguccgcggccaucgacggggaguaucgcuugcgcggugaagcccggaagaccuucguggagcucaugcgccggggcgaccugccgguauggcugagcuacaagguggccagcgagggguuccaauauucggaccgccgcuggugcuucgacggcgagaggaauaaccaggugcucgaggaaaauauggacgucgagaucuggaccaaggaaggggagagaaagaaguugcgcccccguuggcuggacgcccgcacguauagcgacccccucgcgcugcgggaguuuaaggaguucgccgccggucgccgguccguguccggcgaccugauccucgagaucgggaagcugccccagcaccugacacagcgcgcccagaacgccuuagacaaccuggugaugcugcauaacuccgagcaaggcgggaaggcguaccgacacgccauggaggagcucccagauaccaucgagacccugaugcugcucgcccugauagccguacugacuggaggggugacccucuucuuccugagcggccgcggccuggggaagaccucuauaggguuacugugcgugaugaguuccagcgcgcuguuauggauggccagcgucgagccacacuggauagcugccagcaucauccucgaguucuuccugaugguucuucugauccccgagcccgaccgccagcgcaccccgcaggacaaucaauuagccuacguggucaucgggcuacuguuuaugauccugaccguggcggccaacgagaugggccuccuggagacgaccaagaaggaccuggggaucggccacgcggccgcagagaaucaucaccacgcagccaugcucgauguggaucugcaccccgccagugcauggaccuuguacgcagucgcgaccacgauaaucacccccaugaugcggcacacgaucgagaacacaacggccaacauuucccucaccgccaucgcgaaucaagccgcgauccugaugggccuggacaagggguggccgaucuccaagauggacaucggcguaccccuccucgcccuggguugcuacagccaggugaacccccucacccugacugcagccgucuuaaugcucguggcgcacuacgccauaauaggccccgggcugcaagcgaaggccacgcgcgaggcccaaaagagaaccgcagcaggaaucaugaagaacccgaccguggacggcaucguagcgauagaccuggaccccgugguguacgaugcaaaauucgagaagcagcucgggcaaaucaugcugcugauccucugcaccucccagauacugcugaugcgcacuaccugggcucucugcgagucaaucacccuugcuacgggaccccugacgacccucugggaggggucccccggcaaguucuggaacacaaccauugccguaagcauggccaacaucuuccgcggcucauaucuggcgggggcggggcuggcguucucccugaugaagucccucgggggcgggcgucgcggcacgggcgcccagggggaaacccugggcgagaaauggaaacggcagcugaaccaguuguccaaaucagaguucaacaucuacaagcgauccgggaucgucgaaguagaccggagcgaggccaaggagggccugaaacgcggggagaccaucaagcaugcggucucccggggcaccgcgaagcuccgcugguucguggagagaaaccuggucaaaccggaaggcaaggugauagaccuggggugcggacgcgggggauggagcuacuacugcgcuggacugaaaaaggugacugaagugaagggcuacaccaaaggcgggcccggccacgaggaacccauccccauggcuaccuacgguuggaaccucgucaagcuguacuccggcaaggauguguucuucaucccgcccgagaaaugcgauacgcugcucugcgauaucggugagaguagucccaaccccacgauugaggagggccggacccuacgcguucugaagauggucgagcccuggcuccggggcaaccaauucuguauuaagauccugaacccauacaugcccagcguuguugaaacguuagagcagaugcagcgcaaacacggggguauguugguccggaacccucugucacguaacagcacccacgagauguacuggguguccugcgggaccgguaacaucgucagcgccgucaacaugacgucccggaugcugcucaaccgcuucacgauggcccaccggaagccuaccuacgagagagacguggaccugggcgcggggacccggcacguggcagucgaaccagagguggccaaucuggacaucaucggccagcggaucgagaacaucaagaacgagcacaagagcacguggcacuacgacgaggacaaccccuacaagacuugggccuaccauggguccuacgagguaaagcccagcggaagcgccuccagcauggugaacggggugguccgccuccugacgaagccgugggacgugauccccaugguaacacaaaucgcgaugacggacaccaccccauucggccagcagcgggucuucaaggagaaaguugauacccgcacgcccaaggccaagcgaggcaccgcccagaucauggaggugaccgcaaaguggcuguggggguuccucucccgcaacaagaagccgcggaucuguacccgagaggaguucacgcggaagguccgcagcaacgccgcgaucggcgccguauucguggacgagaaccaguggaacuccgccaaggaggccgucgaggacgagcgcuucugggaccuggugcgccgggaacgcgaacugcacaagcagggaaagugcgcaaccugcguguacaauaugaugggcaagcgggagaagaagcucggagaauucgggaaggccaaaggcagccgcgcuaucugguacauguggcugggcgcccgcuucuuggaguucgaggcacucgguuucaugaaugaggaccacugguucucccgcgaaaacucucugagcggggucgagggcgaggggcugcacaaacucggguacauccugcgggacauaagcaagaucccaggcgggaacauguacgcggacgacaccgccggcugggacacgcggaucacggaggaugaccugcagaacgaggccaagauaacggauaucauggagcccgagcacgcccuccuugccacuuccaucuucaagcugaccuaccagaacaagguggugcgggugcagcgcccggcaaagaacgggacggugauggacguuauaagccgccgggaccagcgcggcuccggccaggugggcaccuacggccucaacaccuucaccaacaugggggcccagcucauccggcagauggagagcgagggcaucuucucccccagcgagcuggagacucccaaccucgccgggcgcgugcuggauuggcuggagaaacacggcauugagcgucuccgccggauggccaucagcggcgacgacugcguggucaagcccaucgacgaccgguuugccacugcgcuuaccgcccugaacgacauggggaaggugcggaaggacauuccgcagugggaaccgagcaagggauggaaugacuggcaacagguccccuuuugcucacaccacuuccaccagcucaucaugaaggacgggcgugaaaucguggugccuugucgaaaccaggacgagcucgugggcagagcuagagucagccagggcgccggcuggucguuacgcgagaccgcuugccucggcaaguccuaugcgcagauguggcagcugauguacuuccaccggcgggaccugcggcucgccgcgaacgcaaucugcagcgcgguaccgguggacuggguccccacgagucgcacgacguggagcauccacgcccaucaccaauggaugaccacggaggacaugcuguccgucuggaaccggguguggaucgaggagaacccuuggauggaggacaagacacacgucagcaguugggaagacgugcccuaucucgggaagagagaggaccaguggugcgguagccuaaucgggcugaccgcccgcgcuacgugggccacaaacauccagguggcgaucaaccagguucggcgacugaucggcaacgagaacuaccucgacuacaugacguccaugaaacgguucaagaacgagagcgaccccgagggggcccugugguaa

SEQ ID NO: 24792 - RNA, 9879 nt, Artificial Sequence
  derived and/or modified CDS sequence (opt11) from DENV-1__DQ285559__SS-prME
ucugugaccauguugcuaaugcuacugccuaccgcccugaccuuccaccugaccacccgcggcggggaaccgcauaugaucguaagcaagcaggagcggggcaagucacuucuguucaagaccagcgugggggugaacaugugcacccugaucgccauggaccugggcgagcucugcgaagacacaaugaccuacaagugcccccgcauuaccgaggccgaacccgacgauguggacugcuggugcaacgcgacggauacuuggguuaccuacgggaccugcagccaaacgggcgagcaccggcgcgacaagcgguccguggcccuggcgccgcacguaggcuuggggcuagagacgcgcaccgagacauggaugagcuccgaaggcgccuggaagcaaauucaaaaagucgagacuugggcgcugcggcacccaggguucaccgugauugcccuguuccucgcacacgccaucggcaccagcaucacccagaaggggaucauauucauccugcugaugcucgugacucccuccauggccaugcguugugugggcaucgguaaccgcgacuucguggagggacugagcggcgccaccugggucgacguggugcucgagcacgggaguugcgucacaaccauggccaaaaacaagccgacccucgacaucgagcuucugaagacggaagugaccaacccagcagugcuccgcaagcuguguaucgaggccaaaaucagcaacaccacgacggacucccgaugcccuacccagggcgaggcuacccuggucgaggagcaggacgccaacuucgugugccgccggacguuuguggaccgcggcugggggaacggcuguggcuuauucggcaaggggagccuacucacuugcgccaaguucaagugcguaacuaagcucgaaggcaagauaguucaguacgagaacuuaaaauauucagucaucgucaccgugcacacgggcgaccagcaccagguugggaaugagaccaccgagcauggcaccaucgcgacuaucacaccgcaggccccgacuagcgagauccagcucauugauuauggagcgcucacccuggacugcucuccccggacaggccucgacuucaacgagaugguccuccugacgaugaaaggcaagagcuggcuugugcacaagcagugguuccuggaucugccgcugcccuggaccuccggcgccagcacgagccaggagaccuggaaccgccaggaccuccuggucacguucaagaccgcgcacgccaagaagcaggaggugguggucuugggcucccaagagggggcgaugcacaccgcguuaaccggcgcgacggagauccaaaccucagggaccacgacgaucuucgcuggccaccugaagugucgacugaagauggacaaacucacccucaaggggauguccuacguuaugugcacagggagcuucaaguuagagaaggaaguggcggagacccagcacggcacgguccucguccaggugaaauacgaggggacugacgccccaugcaaaauccccuucucaacgcaggacgagaagggcguuacccagaaugggagguuaauuacggcgaauccgaucgugaccgacaaagaaaagccagugaauaucgagaccgagccgcccuucggcgagucguacaucgucgugggcgccggggaaaaggcccugaagcuguccugguuuaagaagggcucauccauugggaagauguucgaggccaccgcgcggggcgcccgccggauggcuauccucggggacacggccugggacuucggcagcaucggcgggguguucacuucagucggcaagcugacccaccagguguuugggaccgccuacggcgugcuguucucgggggucuccuggacuaugaagaucggaaucgggauccucuuaacuuggcugggacucaacagcagaucgacuagccuguccaugacguguauagcggugggcauggugacacuguaccucggggucaugguucaggccgauagcggcugcgugaucaacuggaagggccgugaacuaaagugcggcuccggcaucuucgucacaaacgaagugcacaccuggaccgagcaauacaaauuccaggcugacagcccuaagaaacuuagcgccgccauuggaaaggccugggaggagggggugugcgggauccgguccgcgacccgccucgagaacaucauguggaaacagaucagcaacgaacugaacuacauccugcucgagaacgacaugaaguucacggucguggugggcgacgccaacgggauccuggcccagggcaagaagaugauacggccccagcccauggaacacaaguacuccuggaaauccuggggcaaggcuaagaucaucggcgcggacauccaaaacacgaccuucaucaucgauggccccgauaccccugaaugcccugaugaccagagggcauggaacaucugggagguagaggacuacggguucggcaucuucacgaccaauaucuggcugaagcuacgggacuccuacacccaaaugugcgaccaccgccuaaugagcgcugcaaucaaggacuccaaggcggugcacgccgacaugggcuauuggaucgaaucagagaaaaacgaaaccuggaagcuggcacgggccuccuuuaucgaggugaagacgugcaucuggccuaagagccacacgcucugguccaacgggguccucgagagcgagaugaucaucccgaaaaucuacggcgguccaaucucccagcauaacuaccgccccggcuacuucacccagaccgcugggccauggcaccugggcaaacuugaacuggacuucgaccuaugugagggcacaaccgugguggucgacgagcauugugggaacagaggcccgagccuccgcaccaccacagugacagggaagaucauccaugaguggugcugccgguccugcacccucccgccccuacgcuuucggggcgaggacgggugcugguauggcauggagauccgccccguuaaagagaaagaggaaaaccucguccggagcauggugagcgcuggcagcggggagguggacagcuucucccucggaauacuaugugucucuauccucaucgaggaggugaugcgcuccaaguggucccggaagaugcugaugaccgggacauuggccguguuccuccugcugaucaugggccaguuaaccuggaacgaccugacccgacugugcaucauggucggggccaacgcuuccgaucguaugggcaugggaaccacguaccucgccuugauggccaccuucaagaugcgcccgauguucgccguugggcugcuauucaggcgccugaccucccgcgaagugcugcuccucaccaucggacugucccucgucgcaagcguggagcuuccuaauucacuggaggaacucggggacggccuggcgaugggcaucaugauucuaaagcuccugacggacuuccaaccccaucagcucuggacaacacucuugagccucaccuucauaaagacgacucucucacuggacuacgccuggaagaccauggcgaugacccugagcaucgucucccucuucccccugugccucagcacgaccucccagaagacuacuuggcucccggugcugcuugggagcuucggguguaagccccucaccauguuccugauuacggagaacaagaucugggggcggaaguccuggcccauuaaugaggggauuauggccguagggauugugagcauucugcucuccagucugcugaaaaacgacgugccccuagccgggccgcugaucgcgggagggaugcugauagcgugcuaugugaucagcggcaguagcgccgacuuaucccuggagaaagcugccgagguaagcugggaggaagaggccgaacauuccggaaccagccacaacauccugguggaggugcaggacgacggcacaaugaagaucaaggacgaggagcgcgacgauacgcucacgauucugcucaaggcgacccuccuggccgucucggggguauaccccaugucuauaccagccacccuauucguuugguacuucuggcagaagaagaaacagcggucuggcguccucugggacaccccuagcccgccagaggucgagcgcgccguguuggacgauggcaucuaucggauccugcaacgcgggcugcucggccggagccaggucggggugggcguguuccaggacggcgucuuccacacgauguggcacguuacccggggcgcugugcugauguaccaaggcaaacggcuggagcccucgugggcuuccgucaagaaggaucucaucagcuauggaggcggguggcgcuuccaggguagcuggaacaccggggaggagguccaggugaucgccguagagcccggcaagaauccgaaaaauguucagacaacgccgggcaccuucaagacccccgagggggaggugggggcuaucgcucuggacuucaagcccgggaccagcggcucuccgaucgucaaccgggagggcaagaucguggggcucuacggcaacggcgugguaacgaccucuggcaccuacguguccgccaucgcgcaggcaaaggccagccaggaggggccccucccugagaucgaggaugagguguuuaagaagcgaaaccucaccaucauggaccugcacccgggcagcggaaagacucggagauaccucccugccaucguucgggaagccaucaagcggaaacugcggacccuuauccucgcccccacccgcgucguggccuccgaaauggccgaagccuugaaggggaugcccauccgcuaccagaccacggcggucaagucugagcacaccgggcgugagaucguggaccugaugugccaugcgaccuucacgaugcgccuccuguccccggugcgggucccaaacuacaacaugaucaucauggacgaggcacacuucacggaucccgccagcaucgccgcgcgcgguuacaucuccacccgggugggcaugggagaggccgcagcgauauucaugaccgccacgccuccaggcucgguggaggcauucccccaguccaacgcuguuauacaggacgaggagaaggauaucccugagcgcucuuggaacuccggauacgacuggauaacggacuuuccugguaagaccgugugguucgugcccucgaucaagucggguaaugacauagccaacugucugcguaaaaauggcaagcgcguuauccaacucagccggaagaccuucgacaccgaguaccagaagacgaagaacaaugacugggacuacguugugacgacugacauauccgagaugggcgcaaacuuucgcgcagaccgggucaucgacccccgcagaugccugaagcccgugauacugaaggacggucccgagagagugauccucgcgggcccgaugcccgucaccguggcgucagccgcccagcggagaggucggauagggcgcaaccaaaacaaggagggagaucaguacgucuacauggggcaaccccugaauaacgaugaagaccacgcgcacuggacggaggccaagaugcugcucgacaauaucaacacccccgagggcaucaucccggcccuguucgagccagaaagagaaaaguccgcggccauagacggggaauacagacugcguggcgaggcgcgcaagacguucguggagcucaugcgcagaggggacuugcccguguggcucagcuacaagguggcgucggaggguuuccaguacagcgaccgccgguggugcuucgacggcgagcgcaacaaccaggugcucgaagagaacauggacguggaaauauggaccaaagagggggagcggaaaaagcugcggccccgguggcuggaugccagaaccuacuccgacccauuagcgcugcgggaguuuaaggaguucgcugcgggccgccggagcgucagcggcgaccugauucucgagaucgggaagcugccccagcaccugacgcugcgcgcccagaacgcccuugacaaccuaguuaugcuccacaacuccgaacagggcgggaaggcuuaccgucacgccauggaggagcugccugauaccauugagacccugaugcuacuggcacugauugccgugcucaccggcggggucacgcuuuucuuccucagcgguaagggcuuagggaagacuuccauuggcuugcugugcgugauggccuccuccgcccuccuguggauggcgucgguggagccucacuggaucgcagccucuaucaucuuggaguucuucuugaugguucucuugaucccggagcccgaccgccagcggacgccccaggacaaccagcucgccuacguggugauagggcucuuguucaugauccucaccguagcugccaaugagaugggccuucucgagacgaccaagaaggaccucgggaucggucacguagccgcggaaaaucaccaccacgccaccaugcuggacguggaucugcgcccggcuagcgcguggacccucuacgccgucgccacgaccguaauaacuccgaugaugcgucacaccauagagaacacgaccgccaacaucucccugaccgcaaucgcaaaccaggccgccauccugaugggccuggacaagggauggcccauaucuaagauggacauaggcgucccccugcuggcucucgggugcuacucccaggugaacccucugacgcugacagcagcgguacugaugcugguggcccacuacgccauaaucggucccgggcugcaggccaaggccacgcgugaggcccagaaacgaacagccgccgguaucaugaagaaucccaccgucgacgguaucgucgccaucgaucucgaccccguggucuacgacgcgaaauucgagaagcagcucggacagaucaugcugcucauccugugcacaagccagauccugcucaugcguaccacgugggcccugugcgaguccaucacacuggcuacgggcccgcucaccacccugugggaagguagccccggcaaguucuggaacaccacgaucgccguuuccauggcaaacaucuuccggggcagcuaucuagcuggggccgguuuggccuuuucccucaugaagucccucggcggagggcgccgcgggaccggagcucagggggagacccucggcgagaaauggaagcggcagcugaaccagcucuccaagucggaguucaacacuuacaagcgaagcgggaucauggagguggaccggagugaggcuaaggagggcuuaaagcgcggggaaacuaccaaacacgcggucagccggggcacggccaaacugcgcugguuuguggaacggaacuuagugaagcccgagggaaaggucaucgaccuggggugcggcagagggggcugguccuauuacugcgcaggauuaaagaagguaaccgaggugaagggcuauaccaagggugguccaggccacgaggagccuaucccaauggccacuuacggauggaaccuggucaagcugcacuccggcaaggauguauuuuucaucccuccagagaaaugcgacacccuccugugcgacaucggggaguccagcccaaauccuaccaucgaggaaggucggacauuaagggugcuaaagauggucgagcccuggcucaagggcaaccaguucugcauaaagauccuaaaccccuacaugccgaguguaguggagacgcucgagcagaugcagcggaagcacgggggcauguugguacgaaauccauuaagcagaaacucgacccacgagauguacugggucagcugcgggaccggcaauaucguguccgcggucaacaugaccagccgcaugcuccuaaaccgguucacgauggcccaccgcaagcccaccuacgagcgggacguugaccugggcgcaggaacccgccacguggcagucgagcccgagguugccaaccucgacaucauuggccaacggauagagaacaucaagaacgagcacaaguccaccuggcacuacgacgaggauaacccguacaagaccugggcguaccacgggagcuacgaggugaagcccagcggcagcgccuccagcaugguaaauggggugguccgccugcugaccaagccgugggacgugauccccaugguaacacaaaucgcuaugaccgacacgacaccauucgggcagcaacgcgucuucaaggagaagguggacacacggacgccccgcgccaagcgaggaacggcccaaaucauggaagugaccgcgaaguggcucuggggguuccugagccgcaacaagaagccccggaucugcacccgcgaggaguucacccggaagguccgcagcaacgccgcuaucggagccguguucgucgacgagaaccaguggaauagcgcaaaggaggcggucgaagacgagcgguuuugggaccuggugcaccgggagcgggaacuccacaagcaagggaagugcgccacgugcguuuauaauaugaugggcaaacgcgagaagaagcugggggaauuuggcaaggccaagggcucuagggccaucugguauauguggcugggggcgagguuccucgaguucgaggcccugggcuucaugaaugaggaccauugguucagccgggaaaacucccuuagcggggucgaaggcgaaggccuccauaaacuuggcuacauacuucgcgauaucuccaagaucccgggcgggaauauguacgccgacgacacggccggcugggacacccggaucacagaggacgaucuacaaaacgaagccaagauaacagauaucauggagccagagcacgcgcugcuggccaccgccaucuucaagcucaccuaccagaacaagguggugcgaguccagaggcccgccaagagcgggacgguaauggacgugaucucccgccgcgaccagcgaggaagcggccaggucgggacauacggccugaacaccuucaccaacauggaggcccagcugauccgccagauggaauccgaagggaucuuccuccccuccgaacuugagacuccgaaccuggcgaagaggguacucgauuggcuggagaaauacggcgccgagcggcugaagcggauggccaucuccggagacgacuguguggucaaacccaucgacgaccgcuucgcuaaggcccucacggcguuaaacgauaugggcaaggugcggaaggacaucccccagugggaacccucgaaaggauggaacgacuggcagcagguaccguucugcucucaccauuuccaccagcugaucaugaaggacggccgggagaucguaguucccugcagaaaccaggacgagcucgugggccgugcccggguaucccaaggagccggcuggucccugcgugagaccgcaugccugggcaaaagcuacgcccaaauguggcagcucauguauuuccaccggcgcgaccuccgucuagcggcaaaugccaucugcuccgccguacccgucgacuggguccccaccagccgaaccaccuggagcauccacgcucaucaccaguggaugacuaccgaggacaugcucuccguguggaaccggguguggaucgaagagaacccguggauggaggacaagacccaugucagcucaugggaggaggucccauaucugggcaaacgcgaggaccaauggugcggcagccuuaucggguuaaccgccagagcuacaugggccaccaacauucagguggcaauuaaccagguccgccggcugauuggcaaugagaacuaucuggacuacauggcgagcaugaagcgcuucaagaacgagagcgaccccgagggggcccucugguga

SEQ ID NO: 24793 - RNA, 9879 nt, Artificial Sequence
  derived and/or modified CDS sequence (opt11) from DENV-1__AF311956__SS-prME
agcgugaccaugcugcucaugcugcugcccaccgccuuagccuuucaccugacaacgcggggcggggagccccacaugaucguaagcaaacaggagcggggcaagagccuccuguuuaagaccagcgcgggggugaacaugugcacccugaucgccauggaccugggggaguuaugcgaggauacuaugaccuacaagugcccccggaucacugaggccgaacccgacgacguugauugcuggugcaacgcgaccgacaccuggguaaccuacgggaccugcagccagaccggcgagcacagacgggacaagcgguccguggcccuggcuccccaugugggccuggggcucgagacccguaccgaaaccuggaugagcucggaaggugccuggaaacagauucagaaggucgagacuugggcccuccggcacccuggcuuuacggugaucgcccuguuucucgcgcacgccaucggcaccagcaucacccaaaaagguaucauuuuuauucugcucaugcugguuacccccucgauggccaugcgaugcguaggcauaggcaaccgggauuucguggaggggcucagcggcgccacguggguggacgucgugcuggagcacgggucuugcgugaccaccauggccaagaauaagccaacccucgacaucgagcuucugaaaacagaggucacgaaucccgccgugcugcgcaaguugugcauagaagccaaaauuucgaacaccacuacggacagucggugcccgacccagggcgaggccacccugguggaggagcaggacgccaacuucgucugccgccggaccuuuguggaccgcggcugggguaacgguugcggacucuucggcaaggggucacugcuuacgugcgcgaaguucaagugcguuaccaagcucgaggggaaaaucguccaguaugagaaccugaaguacucuguuauuguaaccguccacaccggcgaucaacaucaggugggcaacgagacaaccgagcacggcaccaucgcgaccauuacgccucaggcuccaacgagcgagauccagcucaccgauuacggugcccucacccuugacugcagcccuagaaccgggcuggacuucaaugagaugguccuccugacgaugaaggagaaguccuggcuggugcacaagcagugguuccuugauuuaccccugcccuggacguccggggccagcaccagccaggagaccuggaaccgccaggaccuucuggugacauucaaaaccgcccacgccaagaagcaggaggucguaguguuaggcucucaagagggcgccaugcacacggcccucaccggggccaccgagauccagaccucagggaccaccacgaucuucgccggccaccuuaagugccggcugaagauggacaagcucacccugaaggguaccagcuacgucaugugcaccggcaguuucaaguuggagaaggagguggcggaaacgcaacacgggaccgugcugguccaggugaaauacgagggcaccgaugcccccugcaagauucccuucuccacccaggacgagaagggagugacgcaaaauggccgucucaucaccgccaacccgaucgucaccgacaaggaaaagccugugaacaucgagacagagccacccuucggggagagcuacaucguggucggggccggcgagaaggcacugaagcuguccugguucaagaaggggagcuccaucgguaagauguuugaggccacggcccgcggggcucgccggauggccauccucggcgauacugcgugggacuucggaagcaucggggggguguuuaccuccguaggaaagcugguccaccagguguuuggcacagccuacggugugcuguucaguggagucaguuggacgaugaaaauugggaucgguauccuccucacguggcugggccuuaacagccgcagcaccagcuuauccaugacaugcaucgcaguggggaugguuacgcuguaccucggcgucauggugcaggcagacagcgggugcgugauaaacuggaagggccgcgaacuaaagugcggcuccggcaucuucgucaccaacgaggugcacaccuggaccgagcaguauaaauuccaggcagacagcccgaagcggcuaagugcggccauuggccgagccugggaggagggggugugcgguauacgauccgccacccgccucgagaacaucauguggaagcagaucagcaacgagcugaaucacauccuccucgagaacgacaucaaguucacggucgugguuggcaacgccaauggcauacuggcgcaggggaagaagaugaucagaccccagcccauggagcacaaguacuccuggaagucuuggggcaaggcuaagaucauuggcgccgacauccagaacaccacuuucaucauagaugggccagauaccccggagugucccgacgagcagcgggcguggaacaucugggaggucgaggacuauggcuucgggaucuucacgaccaacaucuggcugaagcucagagacagcuacacucagaugugcgaccaccgccucaugagcgcggcuauuaaggacuccaaggccgugcacgccgacaugggcuacuggaucgagagcgagaaaaacgagaccuggaagcuggcccgggcguccuucaucgaggugaagaccugcaucuggcccaagucucauacucucugguccaacggcguccuagaguccgagaugaucauccccaagauguacgggggcccgaucucccagcacaacuaccgccccggauacuucacccagacggccggccccuggcaccucgggaagcucgaacuagacuucgaccugugugagggaacaacagugguggucgacgaacacugcgguagccgggggccgucacuccgcaccacgacggugacgggcaagaucauccaugaguggugcugccggagcugcacacugcccccccugcgcuuccguggggaggauggaugcugguacgggauggaaauccgacccgugaaagaaaaagaggaaaaccuaguccgguccaugguaagcgccggaagcggcgagguggauucuuuuucucucggaauccuuugcgucuccaucaugaucgaggaagugaugaggagccggugguccagaaaaaugcucaugaccggcacguuagccguguuccugcuucugaucauggggcagcugaccuggaacgaucucauccgccucugcaucaugguuggcgccaacgcgagcgacaagaugggaaugggaaccaccuaccuggcccuaauggccacuuucaagaugcggccgauguucgccguggggcuacuuuuccgccggcucaccucgcgcgaggugcuccugcucacgaucgggcugaguuuagucgccucaguggagcuccccaacagccuggaggagcugggugacgggcucgcuaugggcaucaugaugcugaagcugcucaccgaguuccagccccaccaguuauggacgacccuguuaucccugaccuuuaucaagaccacguugagccucgacuacgccuggaagaccaccgcgaugguccuguccauugugagccuguucccccucugucuguccacuacgucacaaaaaaccacaugguugccggugcuccuggguuccuucggcugcaaaccccugacuauguuucucauuaccgagaacgagaucuggggccgcaagagcuggcccuugaacgagggcaucauggccauuggcaucguauccauccugcucuccagccuccugaagaacgaugugcccuuagcggguccgcugaucgccggcgguaugcuaaucgccugcuaugugaucuccggcagcuccgccgaccuuagccuagagaaggccgcggaggucuccugggaggaagaggccgaacacucgggcacgucccacaauauccugguggaggugcaggacgauggaaccaugaagaucaaggacgaagaacgugacgacacccugaccauccugcugaaggccacuuugcucgccgucuccggcguguaccccaugucaauccccgccacguuguuugugugguacuucuggcagaagaagaagcagcggagugguguucuuugggacacccccuccccgcccgagguggagcgcgcggugcucgacgacggaaucuaucggauccuucagcgcggccugcucggucggagccaggucggcgugggaguguuccaggacggcguguuccacaccauguggcacgugacgcguggggccguacugauguaccaaggcaagcgguuagagcccuccugggccagcguaaagaaggaccucaucuccuacggcgggggauggcgcuuccaggggagcuggaacacaggcgaagagguccaggugauagccgucgagccggggaagaacccuaagaacgugcagaccacccccggcacuuuuaagacccccgagggcgaggugggggccauagcgcuggacuuuaagcccggcacuuccgggagcccgauagucaaucgagagggcaagauugucggcuuauacgggaacgggguggucaccacguccgggacauacgugagcgccauagcccaggcgaaggccagccaggagggcccccucccggagaucgaggacgagguauuuaagaagcgcaaccugaccauaauggaccuacacccaggguccggcaagacccggcgcuaccuccccgcgaucgugcgggaagccaucaagcggaagcugcggacacucauccuggcccccacccgugugguggccagcgaaauggcggaggcgcugaaaggcaugcccauacgguaucaaaccacugccgucaaaucggagcacacggggcgcgagauugucgaucugaugugccacgccaccuucacaaugaggcuacugagcccggugcggguccccaauuacaauaugaucaucauggaugaggcccauuucaccgacccggcgaguaucgccgcccgcggguacauuagcacgcgggugggaaugggcgaagcugccgcgaucuucaugacugccacgccgcccggguccgucgaagccuuuccgcagagcaaugccgucauccaggacgaggagcgugacauaccugaacgcuccuggaacagcggguacgauuggaucaccgauuuccccggcaagacggucugguucgugcccuccauaaagagcgguaacgacaucgccaacugccuucgcaagaauggaaagcgggucauucagcucagucgcaagacauucgauaccgaguaccagaagaccaagaauaacgacugggacuauguagugacgaccgauaucagcgagaugggggcgaacuuccgcgccgaucgcgucaucgacccacggcgcugccugaagcccgugauacugaaggacggccccgagagaguuauccucgccgggccuaugccugugaccguggcuuccgcggcccagagacggggccgcaucggacggaaucagaauaaggagggggaccaguacgucuauaugggccagccccuaaacaacgacgaggaccacgcccacuggaccgaagcgaagaugcuccucgacaacaucaacacgcccgaggggaucauccccgcacuauuugaaccggagcgcgagaaguccgccgcuaucgauggcgaguacaggcugcgcggggaggcgcgcaagacguucguggagcuuaugcggcgcggcgaccugcccguguggcuguccuacaagguggccagugaaggguuccaguauuccgaccggcgaugguguuucgacggggagagaaacaaccagguauuagaggagaacauggacguggagaucuggacgaaggagggagagcgcaagaaacugagaccacgauggcuggaugcaaggacguacagcgacccgcuggcgcugagggaguucaaggaguucgccgccgggcggcgcucugucucgggcgaccugauccucgagaucggcaagcugccgcaacacuuaacccuccgggcucaaaacgcucuggacaaccuggugauguugcauaacagcgagcagggagggaaggcuuaccgccacgcgauggaggagcugccagauacgaucgagacacugaugcuucucgccuugaucgccguucucaccgggggcgucacucuguucuuucugucaggcaagggccucggcaaaacgucuaucggguugcucugcgugacugcguccucggcccuccuguggauggcaucaguggagccccacuggauugccgccagcaucauacuggaguucuuccucauggugcuguuaaucccggagcccgaucggcagcgcacuccacaggacaaccaguuagcauauguggugaucggccugcuguuuaugauccucaccgucgccgcuaacgaaauggguuuacuggagacuaccaagaaggaccucggaaucgggcacguggccgccgagaaccaccagcacgcgacuauccuggacguggaccugcacccggccuccgccuggacacucuacgccgucgccacgacugugaucaccccuaugaugcgacacaccaucgaaaacacgaccgcgaacaucagccugacugcgauugccaaccaggccgccauucugaugggucucgacaagggcuggcccauuagcaaaauggaccugggggugccacuucucgcgcugggaugcuacucucaagucaaccccuuaaccuuaacggcugccguacugaugcugguugcccacuacgcaaucaucgggcccggccuccaggccaaggccacacgcgaggcccagaagcggaccgccgcaggaaucaugaaaaaccccaccgucgacggcauuguggcgaucgaucuggaccccguggucuaugaugcgaaguucgagaaacaacugggacagaucaugcuccugauccucugcacgagccagaucuugcugaugcgcaccaccugggcccucugugagagcaucacucucgccacggggccucugaccacccuaugggagggcucccccgggaaguucuggaacacaacgaucgcggugagcauggcgaacaucuuccgcggauccuaccucgccggugccgggcuggccuucagccucaugaagagccucggcgggggccggagagguaccggcgcgcaaggcgagacccugggggagaaguggaaacggcaacugaaccaacucagcaagagcgaguucaacacguacaagaggucgggcaucauggagguggaccggucagaggccaaggaagggcugaagcggggcgagacgaccaagcacgccgucagccgggggacagcaaagcugcgcugguucguggagcggaaccugguuaagcccgaaggcaagguaaucgaccucggcugcgggcgcggcgguuggucauacuacugcgcgggccuuaagaaggugaccgaagugaagggguacacuaagggcggaccggggcacgaggagccgauccccauggccacuuacggcuggaaccuggucaagcuccacuccgggaaggacguguucuucaugccucccgaaaaaugcgacacccugcugugcgacaucggcgaaucuuccccgaacccaaccaucgaggaagggcggacccucaggguacugaagauggucgagcccuggcugcggggcaaccaguuuugcaucaagauccuuaaccccuacaugcccagcgugguggagacgcuugaacagaugcagcgcaagcacggcgggauguuggucaggaauccccucucccgcaauagcacccacgagauguacuggguauccugcgguaccgggaacaucgugagcgccguuaauaugacuucgcggaugcuacugaaccgcuucaccauggcccaccgcaagccuaccuaugagcgcgacgucgaccucggcgccggcacccgccacguggcugucgagcccgagguagccaaccuggacauuauagggcagcggaucgagaacaucaagaacgaacacaagagcaccuggcauuaugacgaggacaaucccuacaagaccugggccuaccacggcuccuacgaggugaagccgucgggguccgccagcuccaugguuaacggcgugguccgacugcucaccaaaccgugggacgugauaccaauggugacccagaucgccaugacugacacgacgccguucgggcagcaacggguuuucaaggaaaagguagacacccgcacgccccgggcuaagcgcggcacggcccagaucauggaggugaccgccaagugguuguggggcuuccugagccggaauaaaaagccccgcaucugcacccgggaggaguucacccgcaaaguccgcagcaacgccgcgauaggggcgguauucguggacgagaaccaguggaacucggcgaaggaggccguggaggacgagcgcuucugggaucucgugcaccgagagcgcgaacugcacaagcagggcaagugcgcuacgugcguguacaacaugaugggaaagcgggagaagaagcugggcgaguucggaaaggcgaagggcagccgggccaucugguacauguggcucggugcccgguuccuggaguucgaggcucugggguucaugaacgaggaccacugguuuucccgcgagaacagccucuccggugucgagggagagggucugcacaagcuuggguacauccucagggacauuagcaagaucccgggcggcaauauguacgccgaugacaccgcggggugggauacccgcauaaccgaggacgaccugcagaacgaggccaagaucacugacauaauggagcccgaacacgcccuucuggccaccuccaucuucaagcugacuuaccagaacaagguagugcggguucaacgccccgcgaagaauggcaccgugauggacguaaucagcagacgggaccagcgcggguccgggcaggucggcacguacggccugaacaccuuuacuaacauggaggugcagcucauccggcagauggagagcgagggcauuuucuucccuuccgaacuggagagcccgaaccuggcggagcgcgugcucgacuggcuggagaagcacggagccgagaggcugaagcgcauggccaucucuggugaugacugcgucgugaagcccaucgacgaucgguucgccacagcccucaucgcacugaaugacaugggcaagguacgcaaggacauuccccagugggagcccagcaagggguggaacgacuggcagcaggucccguuuugcucccaccacuuccaucaacugauuaugaaagacggccgggaaaucgucgugccgugccguaaccaggacgagcucgucgggcgggcgcgagugucacagggugcgggguggucacugcgggagaccgcaugccucggaaagagcuacgcccaaauguggcagcucauguacuuccaccgccgggaccugcgacuggcugccaacgccaucugcagcgccgugcccgucgacugggugcccaccucgcgaaccaccuggucaauccaugcgcaccaccaguggaugaccacggaggacaugcucuccguauggaaccgagucuggaucgaggagaacccguggauggaagacaagacccacgugagcaguugggaggaggugccauaccugggaaaacgggaggaccaguggugcgggagucugauaggccugacugcccgcgccaccugggccacgaacauccaggucgcuaucaaccagguacggcgguuaaucgggaacgagaauuaccuggauuacaugacauccaugaagagguucaagaaugagagcgaucccgagggcgcgcuaugguga

SEQ ID NO: 24794 - RNA, 9879 nt, Artificial Sequence
  derived and/or modified CDS sequence (opt11) from DENV-1__AF311958__SS-prME
ucugucacaaugcugcucauguuacugccuaccgcccuggccuuccaccucaccacgcgaggcggugaaccccacaugaucgugagcaaacaggagcggggcaagagccuccuguucaaaaccagcgcaggcguaaacauguguacucuuaucgcuauggaucugggcgaacucugcgaggacacuaugacguacaagugcccccggaucaccgaggcagagcccgacgacguggacugcuggugcaacgccaccgauacauggguuaccuaugggaccugcagccaaaccggcgagcaccgucgggacaagcgguccguggcccuggcgccccacguuggccugggacucgagacccgcaccgaaacguggaugagcuccgagggcgccuggaaacagauccagaagguggaaacuugggcccugcggcacccgggcuucacggugauugccuuauuccucgcacacgccauagguaccagcaucacccagaaagggaucauauucauccuauugaugcuaguaaccccguccauggccaugcgaugugucggcaucggcaaucgggacuucguggaggggcugagcggcgccacguggguggacguggugcuggagcacggguccugcgucaccaccauggccaagaacaagccaacacucgauauugaacuguugaaaacggaggucaccaaucccgcggugcuccgcaagcucugcaucgaggccaagaucagcaacaccaccacggacucccggugcccaacacaaggcgaggccacgcugguggaggagcaggacgccaacuucgucugccgcagaaccuucguggaccgcggaugggguaauggcuguggccucuucggaaaggggagccuguuaacgugcgcuaaguucaagugcguaacuaagcuugaagggaagauuguacaguaugagaaccugaaguacuccgugaucgugaccguccacacuggcgaccagcaccaggugggcaaugagacaacggaacacggcaccaucgcuacgaucacgccccaggcccccacgagcgagauccagcugaccgacuaugguacgcucacccuggauugcagccccaggacgggccuggacuucaacgaaaugguccuccugaccaugaaggaaaagagcugguuggugcacaagcagugguuccuagacuugccucugcccuggaccuccggggcuagcaccagucaggagacguggaaccggcaggaucuccuggugaccuucaagaccgcccacgcaaagaagcaggagguggugguacuaggcucucaggagggcgcaaugcacaccgcucucacgggggccaccgaaauccagaccagcggcaccacgacgauauucgcagggcaccugaagugccggcugaagauggacaagcuaacccugaaaggcacaaguuacgucaugugcacggggagcuucaagcuggagaaggagguggccgagacccagcacggcaccgugcuaguccaggugaaauacgagggcaccgacgcgcccugcaagaucccauucuccacgcaggacgagaagggagucacacaaaacggcaggcucauuaccgccaacccgaucguaaccgacaaggagaagcccgugaacauugagacggagccaccuuuuggagagagcuacauuguggucggcgcaggcgaaaaggcccugaaguuguccugguucaagaaggggagcuccaucggaaagauguucgaggcuacagcccgcggggcccgccggauggccauccucggcgacacagccugggacuucgggagcaucggcggaguguucaccagcguggggaagcugguccaccagguguucggcacugcguacgggguucuguucagcggugucuccuggaccaugaagaucgggaucggcauccucuugacguggcugggacucaauagccgcuccaccagccuuucaaugacgugcaucgcaguggggauggucacccuguacuugggcgucauggugcaggcagacagcggaugcgugaucaacuggaagggucgcgaacugaagugcggcuccggcaucuucguuaccaacgagguccacaccuggaccgagcaauacaaguuccaggcggauaguccgaagcggcugagcgcggcgaucggcagggccugggaggagggaguuugcggcauacgcuccgccacacgccucgagaacaucauguggaaacagauaucuaacgagcuuaaucacauccuguuggagaacgacauaaaguucacagucgugguggggaacgccaauggcauucuggcacaggggaaaaagaugauucgcccccaacccauggaacacaaauacuccuggaaauccuggggcaaggcaaagaucaucggcgcugacauccagaauacuaccuucaucaucgacggccccgauacgccggaaugucccgacgagcagcgcgccuggaacaucugggaggucgaggacuacggcuuugguaucuuuaccaccaacaucuggcugaaauuacgggacuccuacacacagaugugcgaucaccgccugaugagcgccgcgaucaaggacagcaaggcaguacaugccgauaugggcuacuggauagagagcgagaagaaugaaacguggaagcuggcccgggccuccuucauugaagugaaaaccugcaucuggccuaagagccacacccucugguccaacggaguccuggagucugagaugaucaucccgaaaauguacgggggcccuaucucccagcacaauuaucgccccggguacuucacgcagaccgcgggcccuuggcaucucggaaagcuggaguuagacuuugaccugugugagggcaccaccguggucgucgaugagcacugcggcucucggggcccgucccuccgcaccacaaccgugaccggcaagaucauccacgaguggugcugccgcagcuguacucucccgccccucagguuucguggggaggauggcugcugguacggaauggagauccgccccgugaaggagaaggaggaaaauuugguccggucaauggugagcgcgggcagcggcgagguagacucuuuuucccuggggauucugugcgucuccaucaugaucgaggaagugaugcgcagccgguggucccgcaagauguuaaugaccggcacguuagcgguguuccugcuccuuaucaugggccagcuaacguggaacgaucucauccgccugugcaucauggucggcgccaacgccucagacaagaugggaauggggaccacguaccuggcgcucauggccaccuucaagaugcggccgauguucgcggucgggcuccuuuuccgccggcucacgucccgcgagguacugcugcucacuaucgggcugagucuggucgccuccguggaguuacccaacagccuggaggaauuaggggacgggcucgccaugggcaucaugaugcugaagcugcuaacggaguuccaaccccaucaguuguggaccacccugcuuucccugacuuucaucaagacuacccugagcuuagacuaugcguggaagaccacagcuaugguacuguccaucgugucacucuucccccucugccugucuacgaccagccagaagaccaccuggcugccggugcuacugggcaguuucggguguaaaccccugaccauguuccucaucacggaguacgagaucuggggacgcaagucauggccccugaacgagggaaucauggccaucggcaucgugaguauccugcugucgagccugcugaagaaugaugugccccucgccggaccgcugauagcaggaggcaugcugauagccugcuacgugaucucugggagcuccgcagaccucucucuggagaaggccgcugaggucaguugggaggaggaggcggagcacagcggcaccucccacaacauccugguggaggugcaggacgaugggacuaugaaaaucaaagacgaggagcgcgacgacaccuugacgauccugcucaaagccacccuccuggcggucagcggcguuuacccuauguccauccccgccacccuguucgugugguacuucuggcagaagaaaaagcagcguucggggguacucugggauacccccaguccgccugagguugagcgggccgugcuggacgacggcaucuaccgcauccuacagcgcggccugcucggacgcagccaggucggcgucggaguuuuccaggacggagucuuucacacgauguggcacguuacucgaggggcggugcugauguaccagggcaagcggcuggagcccucgugggcuagcgucaaaaaggaccuaauauccuacggagggggcuggcgcuuucagggcagcuggaacaccggcgaagagguacaggugaucgccgucgagcccgggaagaacccuaagaaugugcagaccacgccuggcacguucaagaccccagagggcgaggugggggccauagcacucgacuucaagcccgggacaucuggaagcccgaucgucaaccgggaaggcaaaaucguggggcucuacgggaacggagugguuacgacguccgggaccuauguuucugcgaucgcccaagccaaggcuagccaggaggaaccccuccccgagaucgaagaugagguauucaaaaagcgcaaccugacgaucauggaccugcauccgggaucagggaagacgcgccgcuaccuccccgccaucgucagagaggcgaucaagcgcaagcuacggacccugauccuagcgcccacccgggugguagcuucggaaauggcugaggcccucaagggcaugcccauuagguaccagaccacggcggugaaguccgagcacaccgggcgggagaucguggaccugaugugucacgcgaccuucaccaugcgccuccugagcccggugcgggucccaaacuauaacaugaucaucauggaugaggcccacuuuacggacccugcuuccaucgcggcccgcggguacauuucaacccgggugggcaugggugaagccgccgccaucuucaugaccgcgacgcccccgggcucgguggaggccuucccgcagagcaacgcagucauacaggaugaggagcgcgacauccccgagcggucuuggaauaguggguacgacuggauaacggacuuucccggcaagaccgugugguuugugcccucaaucaaaagcggaaacgacaucgccaacugccuacgcaagaacgggaagcgcguuauccaauuaucucggaagaccuucgacacggaguaccagaagacgaaaaacaacgacugggacuacguggugaccaccgauaucagugagaugggcgccaacuuccgggcggaccgcguuaucgacccucggcgcugccugaagcccgugauccugaaggacgggccggagcgggucauauuggccggcccgaugcccguuacuguugccuccgcggcgcagcgccggggucgcaucggccggaaucagaacaaggagggugaccaguacguauacauggggcagccccugaacaacgacgaggaccacgcccacuggacggaggccaagaugcuauuagacaacaucaauacgcccgagggcauaaucccggccuuauucgagcccgagcgcgagaagagugccgcgaucgacggggaguaccggcugcggggagaggccagaaaaacauucguggagcuuaugcggcgcggggacuuacccguuuggcugagcuacaagguagcgagcgagggcuuccaguacuccgaccggcgcugguguuucgacggcgagcgaaacaaccaggugcucgaagagaacauggacguggagaucuggaccaaagagggggagcgaaagaagcugcggccacgcuggcuggacgcccgaacuuacagcgacccccucgcgcugagggaguucaaagaguucgcggcagggcggcgcagcgucuccggggaccugauauuggagaucggaaagcugccccagcaccugacgcuccgggcccagaacgcccuggacaaccuggugaugcuacacaacagcgagcagggcgggaaggccuaccgccaugcuauggaagagcugccggacaccaucgagaccuuaaugcuccuagcccugaucgccgugcucaccggcggcguuacucucuucuuccucuccgguaaagggcucggcaaaacgagcaucggccugcugugcgugaccgcuuccuccgcacucuuguggauggcuuccguggagccacacuggauugccgccagcauuauccuggaguucuuccucaugguccugcugaucccggagccugaccggcagcgcacaccccaagacaaccagcucgccuacguggugaucggacugcuguucaugauccucacagucgcggccaacgaaaugggccugcuggagaccaccaagaaggaccucgggaucggccacguagccgccgaaaaucaccaacacgccacaauguuggacguggaccugcacccggccuccgccuggacguuauacgccgucgccaccaccgucauuaccccaaugaugcggcauacgauugagaauaccaccgccaacaucucacugaccgcgaucgccaaccaggccgcgauccugauggggcucgauaagggauggccuaucucgaagauggaccugggagucccacuccucgcucuaggguguuauagccaagugaacccacuaacgcucaccgcggccgugcugaugcuggucgcccacuacgcuaucaucggccccgggcuucaggcgaaggccaccagggaagcccaaaagcgaacggccgccggcauaaugaagaaucccacggucgauggaaucguagcgaucgaccuggacccgguggucuacgaugccaaguucgaaaagcaacugggccagaucaugcuccugauccuguguaccucccagauucuccuuaugcgcaccaccugggcccugugcgagucgaucacgcucgccacuggcccgcugaccacacugugggaagggucccccgguaaguucuggaacacgaccaucgcggucagcauggcgaacaucuuccgcggguccuaccuagccggcgccgggcuugccuuuagccugaugaagucacucgggggcgggcggcgcggcaccggggcccaaggcgagaccuuaggcgagaaguggaagcgccagcugaaucaauuaucuaagagcgaguucaacacguauaagcgcuccgggauuauggaggucgacagaucagaggcgaaggaaggccugaagcgcggggagaccaccaagcacgccgucagucgcggcgccgccaagcugcgcugguucguagaacggaaccugguaaagcccgaggggaaaguaauugaccuaggcuguggccgggggggcuggagcuacuacugcgcggggcugaagaaggugaccgaggugaaaggcuacaccaagggcggacccggccacgaggagccgaucccaauggccacuuacggguggaaccugguuaagcuccacuccggcaaggacguauucuucaugccgcccgagaaaugcgauacccugcugugcgacaucggggagagcuccccgaaccccaccaucgaagaaggccggacccuccgcguccucaagauggucgagcccuggcugcgggguaaccaguucugcaucaagauccuaaaccccuacaugccuagcgugguggagacgcuggagcagaugcagcguaagcauggggggaugcuggugcgcaacccacucucucgcaauagcacccacgagauguacuggguaucuugcgguaccggcaacaucguuagcgcugucaacaugaccucccggaugcugcugaacagauucacgauggcacaucggaagcccacauacgaacgcgacguggacuugggggccggcacacggcacguugcggucgagcccgagguggccaaucuggacaucaucggccaaaggaucgagaacauaaaaaaugagcacaagagcaccuggcacuacgacgaggacaacccguacaaaacgugggccuaccacggguccuacgaggugaagcccucuggcuccgccagcuccauggucaacgggguaguccgucuguugaccaagccuugggacgucauacccauggugacccagaucgccaugaccgacacgacccccuuuggccaacagcgggucuucaaagagaaggucgacacccguacgcccagagcgaaacgcgggacagcucaaaucauggagguaacagccaaauggcuguggggcuucuuaucccguaacaaaaagccacguaucugcacccgggaagaguucacccgcaagguccggagcaacgccgccaucggcgcgguguucguggacgagaaccaguggaacuccgccaaggaggcgguggaggacgagcgcuuuugggaucucgugcaucgggagcgcgagcugcauaaacaggggaagugcgccacgugcguguacaacaugauggggaagcgggagaaaaagcugggggaguuuggcaaggcgaaggggagccgcgccaucugguacauguggcucggcgcccgguuccuggaguucgaggcccuggguuuuaugaacgaggaccacugguuuucuagagagaacagccucuccgggguggagggcgaagggcugcauaagcugggcuacauccuccgggacaucagcaagaucccuggcgggaauauguacgcggacgacaccgcgggaugggauacccgcaucacggaggacgaucuccagaacgaggccaagaucacggacaucauggagccagagcacgcccugcucgccaccuccaucuucaagcugaccuaccagaacaagguggugcggguccagagacccgcuaagaacgggaccgugauggacgugaucucucgccgugaccagcgcggcagugggcagguuggaaccuacgggcugaacacuuucaccaacauggagguucagcucauccggcagauggagagcgaggggaucuuuuuccccucggaguuagagagcccuaaccuggccgagcguguguuagacugguuagagaaacauggcgccgagcggcugaagcgcauggccaucuccggggacgacuguguggugaagcccaucgaugaccgguucgccaccgcccucauagcgcugaacgacauggggaagguucgcaaggacauaccccagugggagccuagcaagggguggaacgacuggcagcaggucccguucugcucccaucacuuucaccagcugauuaugaaggacggccgggaaaucguggugccaugccgcaaucaggacgagcucgucggaagggcccgugugucccagggggccggcuggucccugcgggagacggccugccugggcaagagcuacgcacagauguggcagcucauguacuuccacagacgggacuugcgucucgcggccaacgcuaucuguuccgccgugccugucgacugggugcccaccucgagaaccaccuggaguauccacgcccaccaccaguggaugaccaccgaggauaugcuaagcguguggaaccgcgucuggauagaagagaacccguggauggaggacaaaacacaugugagcuccugggaagaggugcccuaccugggcaagcgggaggaccaguggugcgggagccugaucggguuaaccgcccgcgcgaccugggccacgaacauccagguugccaucaaccaagugagacggcugaucgggaacgagaauuacuuggacuauaugaccuccaugaaacgcuucaagaaugagagcgaccccgagggagcgcucugguga

SEQ ID NO: 24795 - RNA, 9879 nt, Artificial Sequence
  derived and/or modified CDS sequence (opt11) from DENV-1__AF311957__SS-prME
uccgugaccaugcugcucaugcugcugcccacagcacucgccuuccaccuaaccacccgggguggggaaccccacaugauagugagcaaacaggagcggggcaagagccuccuguuuaagaccagcgcaggggugaacaugugcacccugaucgccauggaccugggggaacucugcgaagacacaaugacguauaagugccccaggaucaccgaagcggagcccgaugacguugauugcuggugcaacgccaccgacaccugggucaccuacgggacaugcagccaaaccggugagcacaggcgggauaagcgguccguggccuuggcgccccacgucggccuggggcucgagacccggaccgagacuuggaugaguagcgagggcgcauggaagcagauccagaaagucgagaccugggcccugcggcaccccgguuucacggugaucgcccuguuccuugcgcaugccauugggacuagcaucacccagaaggggauaauauucauccugcugaugcuugugacgcccuccauggccaugcgcugcgucggcauuggcaaccgggacuucguggagggauuaucaggcgccacguggguggacguugugcuggagcacgguuccugcgugaccacaauggccaagaacaagcccacacucgacaucgaacugcugaagaccgaaguuacgaaccccgcggugcuccgcaagcugugcaucgaagccaagaucagcaauaccaccacggacagccggugcccgacccagggcgaggcgacccugguggaggagcaggacgccaacuucgucugccgccggaccuucguagaccgaggcugggggaacgggugcggacucuucggaaaagggucucugcugacgugugccaaguuuaagugcgugacuaaacucgaggguaaaaucguccaguacgagaaccugaaguacuccgugaucgugacuguccacaccggcgaucagcaccagguugguaacgagacuaccgagcacggcacaaucgccaccaucacaccccaggcccccacgagcgagauccagcugacggauuacggggcccugacccuggacugcagcccccgaaccggccuggauuucaacgagaugguccuccugacgaugaaggagaagaguugguuggugcacaagcagugguuccucgaccugccgcugcccuggaccuccggggccagcacaagccaagaaaccuggaaucgccaggaccuguuggugacguucaagacagcccacgcgaagaagcaagaggucguggugcuaggcagccaggagggcgccaugcacaccgcacucacgggagcaacggagauccaaaccagcggcaccaccacuaucuucgccggccaccugaagugcagacugaagauggauaagcucacccugaagggcaccuccuacgucaugugcaccgguucauucaagcuggagaaggagguggcggagacgcagcacggcacgguacugguccaggucaaguacgagggcaccgaugccccuugcaagauccccuucuccacccaggacgaaaagggggugacucagaacggacgccucaucacggccaauccgaucguuaccgacaaagaaaaacccgugaacaucgagaccgaaccgcccuucggcgagagcuacaucguggucggugccggcgagaaggcacugaagcugaguugguuuaagaaggggagcuccaucggcaagauguucgaggcuacggcccgcggggcccgccggauggccauccucggcgacaccgcgugggacuucgggucuauuggcggcguguuuaccuccguggggaaacugguccaccagguguucggcacggcuuaugggguguuguucagcggcguguccuggacgaugaagaucgggaucggcaucuuacucaccuggcugggccucaauagccgcucuacuucccuauccaugaccuguaucgccgucggcauggugacgcuguaccucggcgucauggugcaggccgacagcggcugcgugaucaacuggaagggacgagagcugaagugcggguccggcaucuucguuaccaacgaggugcauaccuggacugagcaguacaaguuucaagccgacagcccgaagcgccugagcgcggccaucggccgagccugggaggagggagugugcggcauccgguccgccacccgcuuggagaacaucauguggaaacagaucucaaacgaacugaaccacauccugcuagagaaugacaucaaauucacgguggugguggggaacgccaacgguauccuggcgcagggaaagaaaaugauccggccccagccuauggagcauaaguacucuuggaaauccuggggaaaagcaaagaucaucggcgccgacauccagaacaccaccuucaucauugacggccccgacacaccggagugccccgacgagcagcgcgcauggaacaucugggaggucgaggacuacggcuuugguaucuucacuaccaacaucuggcugaagcuacgggacuccuacacccaaaugugcgaccaccgccugaugagcgcagccaucaaggacagcaaggccgugcacgccgacauggguuauuggauugaaucugagaagaacgagaccuggaagcuggcgcgggcguccuuuaucgaggugaagacaugcaucuggccgaaaagccacacucucugguccaacggcguccuggaguccgagaugaucauccccaagauguacgggggcccgaucagucaacauaacuaccgacccgguuacuucacccagacugccggccccuggcaccuagggaaacucgagcucgacuucgaucugugcgaaggcacgaccgugguggucgaugagcacugcggcucccgggggccgucccuccgcacuaccacugugaccggcaagaucauccacgaauggugcugccgguccugcacccugccgccacugagguuucggggagaggauggcugcugguaugggauggagaucagacccgugaaggagaaggaagaaaaccucguccgguccauggugagcgccggcagcggcgagguggacagcuucagccuggggauauugugcgucuccauuaugaucgaggaggugaugcgcagccgguggucccggaagaugcucaugaccggcacgcuggccguguuccugcuccugaucauggggcagcugacuuggaaugaccucauccgccugugcaucauggucggugccaacgcgagcgauaaaauggggaugggcaccaccuaccuggcccuaauggccacguucaagaugcggccgauguucgccguggggcuccucuucaggcgguuaacuagccgcgaggugcuguugcucacgaucggucugucacuggucgccuccguggagcuucccaacucgcuggaggagcugggcgaugggcucgcgaugggaaucaugaugcugaagcugcugacugaguuccagccccaccagcuguggacgacccugcugucccugacguuuaucaagaccacgcugagccucgacuacgccuggaaaaccaccgccacuguccuguccaucgugucacuguucccccucugcuuaucgacaacuagccagaagaccaccuggcugcccgugcuacugggcuccuucgggugcaaaccccugaccauguuccucaucacggagaacgaaaucugggggcgcaagucauggccuuuaaacgaggggaucauggcgaucggcaucguuuccauccugcucagcagccugcugaagaacgaugugccccucgcggggccgcugaucgccggcgguauguugaucgccugcuacgugaucuccgggagcuccgccgaccucagucuggaaaaggccgcggaggucuccugggaggaggaggcugagcacagcggaacgucccacaacauccugguggaggugcaggaugacgggaccaugaagaucaaggacgaggagcgcgacgacacccucacgauccuacugaaggcaacccuccuggccgucagcgggguguaccccauguccauccccgcgacccuauucgugugguacuuuuggcagaagaagaagcagaggagcgggguccucugggauaccccaagcccacccgagguagagcgcgccguccuggacgacggcaucuaccggauccugcagcggggccugcuugggcggagccaggucgggguagggguguuccaggaugguguguuccacacgauguggcacguuacucgcggagcagugcuaauguaccaaggcaagcggcuggagcccuccugggccucgguuaaaaaggaccucaucuccuacggagggggcuggagauuccagggguccuggaacaccggcgaggagguccaggugaucgccgucgagcccgggaagaacccgaagaacgugcagacaacgcccggcaccuucaagacccccgaaggcgaggugggggccaucgcgcuggacuucaagcccggcaccuccgggagcccgauuguuaaccgugagggcaagaucgugggcuuauacgggaacggaguugucaccaccuccgggaccuacgucagcgccaucgcgcaagcaaaggccagccaggagggcccguugcccgagaucgaggacgaaguguucaagaaacgcaaucuuaccaucauggaccugcacccgggguccggcaagacgcggcgcuacuuacccgcaauaguccgggaggcaauaaagcgcaagcugcguacccugauccucgcccccacccguguuguggccagcgagauggccgaggcgcugaaaggcaugccgauccgcuaucaaaccacggcugucaagucugagcacaccggucgggagaucguggaccugaugugccacgccaccuuuacaaugcgucuccugagcccggugcguguccccaacuauaauaugaucaucauggacgaggcacacuucacagaccccgcguccaucgccgcccgcggcuacaucagcacgcggguggggaugggggaggccgccgcgaucuuuaugaccgccacgccuccaggauccguggaggccuucccccagucuaacgccguuauccaggaugaagaacgcgacauccccgagcgguccuggaacagcggcuacgauuggaucacggacuucccagguaagaccgugugguuuguucccuccaucaagagcgggaacgacauagccaacugccugcgcaagaaugggaaacgggucauccagcucuccaggaagaccuucgacacagaguaccagaagacgaagaacaacgacugggacuauguggugacuaccgacaucagcgagaugggggcgaacuuccgggccgaucgcgucauagacccccggcgcugccugaagccuguuauccugaaggacggccccgagcggguaauacuugccggaccgaugcccgucacaguggccuccgcggcccagcgacgaggccgcaucggccggaaccagaacaaggagggggaccaguacguuuacaugggccagccccucaacaacgacgaggaccacgcccacuggacagaggccaagaugcugcucgacaacaucaacacccccgaagggaucaucccggcacuguuugaacccgagcgcgagaagucagcggccaucgacggcgaauaccgccugcgcggggaggcccgcaagaccuucguagaacucaugcguagaggcgaccugcccguauggcuguccuacaaggucgccagcgaggguuuccaguacucagaccggcgcuggugcuucgacggggagcguaacaaccaggugcucgaggaaaacauggacguggaaaucuggacuaaggagggcgagcgcaagaaacugcggccccgcuggcuggacgcccggaccuacagcgauccgcuugcgcugcgcgaguucaaggaguuugccgcagggcggcguagcgucuccagcgaccugauccucgagauuggcaagcuaccccagcaucugacgcuccgggcccagaacgcccuugauaaccuugugaugcuccauaacuccgagcaaggcgggaaggcguaccgccacgcaauggaggagcuacccgauacgaucgagacccugaugcuccuggcccugaucgccgugcugaccggcggggucacgcuguucuuucugagcggaaaggggcucgggaagaccuccaucggcuugcugugugucacagcaagcuccgcccuccuauggauggccagcgucgagccgcacuggauagccgccuccaucauccuggaguucuuccucauggucuuacugauaccggagcccgaucgucagcgcacgccccaggacaaucagcucgcguacguggugaucgggcugcuuuucaugauccucacggucgcagccaaugagaugggccugcuggaaaccacaaagaaggaccucgggaucggccacguggcagccgaaaaucaccagcacgcgaccaugcuggacguggaucuacacccggccagugccuggacgcuguacgccguggccaccaccgucaucaccccaaugaugcggcacacaauugagaauaccaccgcgaacaucucccugacggccauugccaaccaggccgccauccugaugggguuagacaaggguuggcccauaagcaagauggaccuuggcgugccccugcuagcgcuagggugcuacucccaggucaauccgcugacauugaccgccgccgugcugaugcugguggcccacuaugcgaucauuggcccgggucuccaggcgaaggccacccgcgaggcccagaagcggaccgcagcgggcaucaugaagaaccccacagucgacgggaucguggccaucgaucuggaccccguuguuuacgacgccaaguuugagaagcagcugggccagauuaugcuccugauccuaugcaccagccagauccuacuaaugcgcaccacaugggcccugugcgaguccaucacacucgccaccggaccguuaaccacccuuugggaggggagccccggcaaguucuggaacacgaccaucgcgguguccauggcuaacauuuuccgcgggaguuaucucgcgggggccggccuagccuucucccugaugaaaucucucgggggcgggaggcgcggcaccggggcgcagggcgagacgcugggcgagaaauggaagcggcagcugaaccaguugagcaagagugaguucaacaccuacaagcggagcggaaucauggagguggaccggucggaggccaaggagggccucaagcgcggggagaccaccaaacacgccgucagccggggcaccgccaagcugcgcugguucguggaacgaaacuuaguaaagcccgaagguaaagugaucgauuugggcugcggccgcgguggcuggucauacuauugcgcggggcugaagaaagugaccgaagugaaaggcuacaccaagggcgggcccggacacgaggagccuauccccauggcuaccuacggguggaaccuggucaaacuccacucuggcaaggacguguucuuuaucccgcccgagaagugcgacacacuguugugugacaucggcgaguccagcccuaaccccaccaucgaggagggccggaccuugcgcguucugaagaugguugaacccuggcugcggggaaaucaguucugcaucaagauccucaaccccuacaugccgagcgugguugagacccuggagcagaugcaacgcaagcacggaggaaugcugguccggaacccccucagccgcaacuccacucacgagauguacugggugaguugcgggaccggcaacauugugagcgcggucaacaugacgagccggauguugcucaaccgcuucaccauggcccaccggaagcccacuuacgagcgcgauguagacuuaggggccggaacccgacacguugcgguugagccugagguggcaaaccuggacaucaucggccagcggauugagaacaucaagaacgagcacaaguccacguggcacuacgacgaggacaaucccuacaagaccugggccuaucacgggagcuacgaggugaagcccuccggcagcgccucaagcauggucaacggaguggugcgccugcucacaaagcccugggacgugauccccauggugacccagauugccaugacggacaccaccccguucggacagcagcgggucuucaaggaaaaaguggacacccgcacgccuagagcgaagcgagggaccgcccagaucauggaagugaccgcaaaguggcuuuggggguuccugucuagaaauaagaagccccgcauaugcacccgggaggaguucacgcgcaaaguacgguccaacgccgccaucggcgcuguguucguggacgagaaccaguggaacagcgccaaggaggccgucgaggacgagcgcuuuugggaucucgugcaccgggagcgcgagcuccacaagcaagggaagugugcgaccugcguguacaacaugaugggcaaacgcgagaagaagcugggggaguucggcaaggcgaaagggucccgggccaucugguacauguggcuaggagcucgguuccuggaguucgaggcacugggcuucaugaacgaagaccacugguucucucgcgagaacucccucagcggcguugagggcgagggacugcacaagcugggcuacauccuccgggauaucuccaagaucccgggugggaacauguacgccgacgacaccgcggggugggacacucgcaucacggaggacgaccugcagaacgaggcuaagauuacggacaucauggagcccgagcacgcccuguuggccacgaguaucuucaagcugaccuaccagaacaagguggugcggguccagcgccccgcaaagaacggcacggugauggacgugaucucccgccgggaccaacgcgguagcggacaggugggcaccuacggccugaacaccuucaccaacauggagguccagcucauccggcaaauggaguccgaggggaucuucuuccccagcgagcuggaguccccaaaccuggcggagcgaguccucgacuggcuggaaaagcacggcgccgagcggcugaagcgcauggccaucagcggggaugacugcgucgugaaacccaucgacgaccgguucgccacggcccucaucgcgcugaacgacaugggcaaggugcggaaggacaucccccagugggagccuagcaagggcuggaacgacuggcagcaggucccguuuugcagccaccacuuccaucagcugaucaugaaggacggcagagagaucguggugccgugccgcaaccaggacgagcuugucgggcgggccagagugucgcaaggggccggcuggagccugcgggagacagccugccuuggcaagucguacgcccagauguggcaguuaauguacuuccaccgcagggaccugcgccuggcggccaacgccaucugcagcgccgugcccgucgacuggguccccaccucuaggaccaccugguccauccacgcacaucaucaauggaugacgaccgaggacaugcucagcguguggaacaggguguggaucgaagagaauccguggauggaagacaaaacacacguguccagcugggaggagguacccuaccuggguaagcgugaggaucaguggugcgggagccugauuggccucaccgcgcgcgcaacaugggccaccaacauucaggucgcgaucaaccaagugcgccggcugaucggcaacgagaacuaccuggacuacaugaccucaaugaagagguuuaaaaacgaguccgaccccgagggagcgcucugguga

SEQ ID NO: 24796 - RNA, 9879 nt, Artificial Sequence
  derived and/or modified CDS sequence (opt11) from DENV-1__EU280167__SS-prME
agcgugacuaugcugcuaacccugaugcccacggcccuggccuuccaccucaccacgagaggcggggaaccccauaugaucgugagcaagcaagagcgcggcaagucacuccuguucaagaccuccgcgggggugaacaugugcacccucaucgccauggaccugggcgaacugugcgaggacaccgugaccuacaaaugcccaaggaucacagaggcugagccggaugaugucgacugcuggugcaacgccaccgacaccugggugacuuacgggaccuguagccagacgggcgaacaccggcgggauauccgguccguggcccucgcgccccacguuggcuuggggcuggagacccggacagagacauggaugagcuccgagggcgcguggaagcagauccagcggguugacacgugcguccuccgccacccugguuucaccgucaucgccuuauuccuggcccacgcgaucggaaccagcaucucccaaaaggggaucauauucauucucuugaugcuagugaccccuaguaugaccaugcguugcgugggcauagggucccgcgacuucguggaggggcuuagcggcgcaaccuggguggacguaguccuggagcacgggaguugcguaacauccauggccaaggauaagccaacccuggacaucgaguugcugaagacggaggugcccaaucccgccguccugaggaaacucuguaucgaggcaaagaucuccaacaccaccacagacagccgcugcccuacgcaaggcgaggcaacccugguugaggagcaggacgccaacuucgugugccggagaaccuucguugaccggggaugggggaauggcugcggccuguuuggcaagggcucccuccugaccugcgacaaguucaagugcgugacgaagcuggagggcaagaucauccaguacgagaauuucaaguauagcgugauagucacggugcacaccggcgaccagcaccaagucggaaacgaguccaccgagcacggcacaacagccaccaucacuccucaggcucccaccacggaaauccagcucacggacuauggggcacugacgcuggacugcucaccgcgcacaggccucgauuucaacgagauggugcugcugacaaugaaagaaaaguccuggcucgugcauaagcagugguuccuggaccugccccuccccuggaccuccggggcgagcacaucccgggagacuuggaaccgucaggacuuacuggucacguucaagaccgcccacgccaagaagcaagaggugguggucuugggcagccaggagggcgccaugcacacggcccugaccggggcgacggagauucagaccucgggcaccaccacuaucuucgccggccaccugaagugccgccucaagauggacaagcuaacccugaagggcaugagcuacgugaugugcaccggauccuuuaagcucgagaaggaggucgccgaaacccagcacgguaccguucugguccagauuaaauacgagggcaccgaugcccccugcaagauuccauucagcacccaagacgagaaggggguaacacagaacggacgcuugaucacggccaaccccaucgucacggacaaggaaaagccggugaacauugaggcggaaccuccguuuggggaguccuacauugugauaggcguaggcgagaaggcucucaagcuaagcugguucaagaagggauccagcaucggcaagauguucgaggccaccgcgcgcggcgcgcgccgcauggccauccugggcgacaccgccugggacuucggguccaucggcggcguguucacuucuguagggaaacuuguccaucagaucuucggcaccgccuacggugugcuguucucuggggugagcuggacuaugaagauagggauaggcguccugcuaaccuggcucggccugaauucccgguccaccucccucucuaugacauguauugccgugggccucgugacgcuguauuuaggagucaugguacaggcggacucagggugcgugaucaacuggaagggccgcgggcucaagugcgguuccgggaucuucgucacuaacgaggugcauacguggaccgggcaguacaaguuccaggccgacagucccaaggggcuaagugccgccauagggaaggccugggaggaaggcgugugcgggauccggagcgcgacccgccuggagaacaucauguggaagcaaaucuccaacgagcucaaccacauccuuuuggagaacgacaugaaauuuacuguaguggugggcgacguggccgguauucuagcccaagggaagaagaugauccggccccagcccauggaacacaaauacagcuggaagaauuggggcaaggccaagauuauaggggccgacguucagaacagcacauuuauuaucgauggcccgaacacgccggagugcagcgacgaccaacgcgcguggaacaucugggagguggaggauuacggcuucgggaucuucacuaccaauauuuggcugaagcugcgggacuccuacacgcaagucugugaccaccgacucaugagcgccgcaaucaaggacuccaaagccgugcaugcggacaugggauauuggaucgagagcgaaaagaacgagacguggaagcuggcgcgggccuccuucaucgaggugaagaccugcaucuggcccaaaagccacacccuguggucgaacggggugcucgagagcgaaaugaucauccccaagaucuacggcgggccuaucucccaacacaacuaccgccccggguacuucacccagacggccggccccuggcaccuggggaagcuggaauuagacuucgaccugugugagggaaccaccgugguggucgacgaacacugugggaaucgggggccgagccugggaaccacuaccgugacgggcaagaucauccaugagugguguugccggucuugcacgcucccgccgcuccgcuuccgaggagaggacgggugcugguacggcauggaaauccgccccgugaaggagaaggaagagaaccuggugaagucgauggugucagcugggucgggugagguggacucguucucccuggggcugcugugcaucuccaucaugaucgaggaagucaugcgcucccgcuggagucgcaagaugcucaugacgggcacucuggcgguuuucuuccuccucauuaugggccagcuaaccuggaacgacuuaauccggcugugcaucauggucggggcaaacgcgucugaccgcauggggauggggaccacguaccuagcccugauggccaccuucaaaaugcgcccgauguucgcggucggccuccuuuuccgucgccugacaagcagggaagugcuccuguugaccaucgggcucucucuggucgccagcguggagcugcccaacagucucgaggaacugggggacggccuugccauggggaucaugauacuuaagcuucugacugacuuccgcagccaccagcucugggccacccugcuguccaugacuuucaucaagaccgcauucagccugcacuacgcguggaaaacgauggccaugguucugucaaucgucagccuguucccccucugucuguacaccacaucccaaaagacgacguggcugcccguguugcugggcucccugggguguaagccgcuuaccauguuccugaucgcugagaacaaaaucuggggccgcaagucuuggccccugaacgagggcaucauggccgucgggaucgucuccauccuccugagcucgcugcucaaaaacgacgucccccuggccggcccccugauagcuggaggcaugcucaucgccugcuacguaaucucgggguccagcgcagaccuaucccuggagaaggccgcagaggugagcugggaggaagaggcagagcacuccggcgccagccacaacauucucguggaggugcaggaugauggcaccaugaagaucaaggaugaggaacgcgacgacacucugacgauucugcucaaggccacccugcuggcagucucugggguguacccgcucagcauccccgcgacccucuucguauggugcuucuggcagaagaagaaacaacgguccggcguccugugggacacucccagcccucccaagguggagagagccguacucgacgacgggaucuaccggauaaugcagcggggccugcuggggcggucccagguaggcgucggaguguuccaggagaaugucuuccacaccauguggcacguaaccagaggcgcggugcugauguaucagggcaagcggcucgagcccucuugggccucggugaaaaaggaccugaucagcuacggggggggguggcgccugcaaggauccuggaacaccggcgaggagguccaggugaucgccguagagccagggaaaaaccccaagaaugugcagaccgcgccuggcaccuucaagacucccgagggggaggugggcgccaucgcacucgacuucaagcccgguacuucagggagucccaucgugaaccgggagggaaagaucguggggcuguacggcaacggggucguaaccacguccggcacguacgugagcgccaucgcccaggcgaaggcgucccaggagggcccgcugccugagaucgaagacgagguguucagaaaacggaaccucaccaucauggauuuacaccccgggucggggaagacccgccgguaucugccggccauaguccgggaggccaucaagcgcaaaaugcgcacccucauccuggcgcccacgcgaguggucgccuccgagauggccgaggcccugaagggaaugcccauccgguaccagaccacagccgucaagagcgagcacacuggcaaggagauaguggaccucaugugccacgcgacguucaccaugcgucugcugucacccgugcgggucccgaacuauaacaugaucaucauggacgaggcccacuuuacggacccgagcuccaucgcugcacgaggguacaucagcacacgggugggaaugggugaagccgcugcgaucuuuaugacggccacgccccccggguccguggaggccuuuccacagucgaacgcagucauccaggacgaggagcgcgacaucccagaacgguccuggaacagcggcuacgaguggaucaccgacuuccccggcaagaccgugugguucguucccucgaucaaagcgggcaacgacaucacgaacugucuccgcaaaaacggcaagcgggucauccagcugagcagaaagaccuucgacacugaguaccagaagaccaagaacaacgacugggauuacguggugacgaccgacaucagcgagaugggcgccaauuucagagccgauagggucauggacccgcgucgcugccugaagcccgugaucuuaaaggacggccccgagcgggucauacuggccgguccuaugccggugaccguggcgagcgcggcccagagacggggccgaaucgggcggaaccacaacaaagagggcgaccaguacaucuacauggggcagccucugaccaacgacgaagaccacgcccacuggacggaagcuaagaugcuacuggacaacaucaacacccccgaaggcaucauccccgcccuguucgagccggagcgcgagaaaucagcugccaucgacggcgaguaccgccugcgcggggaggccagaaagaccuucguugagcugaugagaaggggcgacuuacccguguggcucagccacaagguggcaagcgagggcuuucaguacuccgaucggcgcuggugcuucgacggugagcggaauaaccaggugcuggaggagaacauggacguggagauuuggaccaaggagggagagcgcaagaaguugcggcccagguggcucgacgcgcggacuuacagcgacccccuggcccucagagaguucaaagaguuugccgccgggcgacguucggugagcggcgaccuaauccuggagaucgggaagcuaccacagcauuugacccagcgggcgcagaacgcgcuggacaacuuggucaugcugcacaacuccgaacagggcggccgcgccuaccggcaugccauggaagaacugccugacaccauagaaacacugauguuacuggcacugaucgcgguucucacgggcggcgugacccuguucuuucugucagguaagggguuagguaagacuuccauuggccugcugugcgucauggccucaagcguacucuuguggauggcgaguguggagccccauuggaucgccgccuccaucauucuggaauucuuccucaugguccugcuuauccccgagccggaccgccagaggacgccccaggacaaucaacucgcguacguggugaucggccuucuguucaugauccucaccgucgccgccaacgagaugggccuacuggagacgaccaagaaggaccucggcaucggccacguggccguggagaaccaccaccacgccgcgaugcuggacguagaucuucaccccgcaagcgccuggacccuauacgcaguggccacgacgaucaucaccccuaugaugcggcacacuaucgagaauaccacggccaacaucucucuuaccgccaucgcuaaccaggcugcgauccugaugggacucgacaaaggguggccgaucaguaagauggacauaggcgugccccuguuggcacuaggcuguuacucccaggucaacccccugacccugaccgccgcaguucucaugcugguggcccacuacgcgaucaucggcccuggcuugcaggccaaagccacgcgggaggcgcagaaacguaccgccgcggggauuaugaagaaccccacgaucgacggaaucgucgccaucgaccuagaccccguaguguacgacgccaaguucgagaagcagcuggggcagaucaugcuccucauccuguguaccucgcagauccugcucaugcgcacgacuugggcccugugcgaguccauaacgcuggccaccgggccccuaacgacccugugggaggguagcccaggaaaauucuggaacaccacaauagcgguuuccauggccaacaucuuccgcggcagcuaccucgcuggggccgggcucgccuucucacugaugaaguccuuagggggcggcaggcgggggacgggcgcucagggggagacucucggcgagaaguggaagcgccagcugaaccaacugagcaaguccgaauuuaauaccuacaagcggagcgggauaauggagguggacagauccgaggccaaggagggccugaagcggggugagacaacgaaacacgccgugagccgggggaccgcuaagcugcggugguuugucgagcgcaaccugguaaagccugagggcaaggugaucgaccucgggugcggccgcgggggaugguccuacuauugcgcgggccugaagaaggucaccgagguuaagggauauacgaagggcggcccugggcaugaggagcccaucccgauggccacguacgguuggaacuuggugaagcugcacagcggcaaggacgucuucuucaucccgcccgaaaagugcgacacccuccugugcgauaucggagaaucuagccccaacccgaccauagaggagggucggacacuucgggugcucaaaaugguggagcccuggcugcgcggcaaucaguuuugcaucaagauccugaacccuuacaugcccuccgucgucgaaacgcucgagcagaugcagcggaagcacggaggcaugcuggugcgcaacccgcuaagcagaaacagcacccacgagauguauugggucagcugcggaacagggaauaucguguccgccguaaauaugacuagccgcaugcucuugaaucgguuuaccauggcccaccguaagcccacguacgagcgcgacgucgaccugggcgcagggacacgucauguggcgguggaacccgaggucgcuaaccucgacaucaucggccagagaauagagaacaucaagcacgagcacaaaucuaccuggcauuacgacgaggacaaccccuacaagaccugggcguaccacgggagcuacgaggugaagccgucuggaagcgccagcaguauggucaacggaguggugaaauuacugacaaagccgugggacgucauuccgaugguaacccagauugcaaugaccgacaccacgcccuucgggcagcagcggguauuuaaggaaaaggucgacacccgcaccccgaaggcgaagcggggcacggcacaaauaaugguggugacggcccgcuggcucuggagcuuccugucccggaauaaaaagcccagaaucugcacccgggaggaguucacucgcaaaguccggagcaacgccgccaucggggcgguguucguugacgaaaaucaguggaacucggcgaaggaggccgucgaggacgaucgcuucugggaccugguucacagggagcgcgagcuccacaagcagggcaagugcgcaacuugcguguacaacacgauggggaagcgggaaaagaagcugggcgaguucggcaaggcgaaggggagucgcgcuaucugguacauguggcuaggcgcccgguuccucgaauucgaagcccucggguucaugaaugaagaccacugguucucccgugagaacagccucuccggagucgagggggagggucuccauaaguuaggcuacauccugcgggauaucagcaagauacccgggggcaacauguacgccgacgacacagcggggugggacacgcgaaucaccgagggugaucuccagaacgaggccaagauaacggacaucauggagcccgagcacgcgcugcuggccaagagcauauucaagcuaaccuaccagaacaaggugguaagaguccagagacccgccaagaacggcaccgugauggacgugaucagccgcagagaccagcguggguccggccaagucggaaccuacgggcugaacacguucaccaauauggaggcgcagcugauacgccagauggagucggaaggaaucuuuagucccaaugagcucgagacccccaaccucgccgaacgagugcuggacugguuggagaaguacggcguggagcgacugaagcgcauggccaucagcggcgaugacugcgucgugaagccgaucgacgaccgguucgcaaccgcccuaacggcacucaacgauauggggaaggugcgcaaggacaucccccagugggagccgucuaagggcuggaacgauuggcagcagguccccuuuugcagccaccauuuucaccagcucaucaugaaagacgggcgagagauuguggugccgugccgcaaccaggacgaguuagucggccgugcccgcgugagccagggagccggcuggucccuccgugagaccgccugccucggcaagaguuacgcccagauguggcagcugauguacuuccauaggcgggaccuacgccuagcugccaacgccaucugcuccgcggugcccguugacugggugcccaccagccggaccacgugguccauccacgcgcaucaccaguggaugaccaccgaggacaugcugucuguguggaaccgcgucuggaucgaggaaaaccccuggauggaggacaagacccgcaucucauccugggaggacgugcccuaucucggggagcgggaggaucaguggugugguucccugaucggucugacggcccgcgccaccugggccacgaacguccaggucgccaucaaccaggugcggcgccucaucggcaacgagaacuacagcgacuacaugaccagcaugaagcgguucaagaacaagagugaacccgagggggcgcugugguaa

SEQ ID NO: 24797 - RNA, 9876 nt, Artificial Sequence
  derived and/or modified CDS sequence (opt11) from DENV-2__AJ968413__SS-prME
accgcggguaugaucauaaugcugaucccgacaguuauggcuuuccaccugaccacccgaaauggggagccucauaugaucguaagccgucaggagaagggcaagagccugcuauucaagaccgaggacggcgugaacaugugcacccucauggcgauggaccugggggagcugugcgaggacaccaucacauauaagugcccccugcugcggcagaacgagccggaggacauugauugcuggugcaacuccaccucaaccugggucaccuacggcacgugcaccaccaccggcgaacaucggcgcgagaaacgaucggucgcccucgugccccacgugggcaugggccucgagacccgcacagagacguggaugucgagcgagggcgccuggaagcacgcccaaaggaucgagacguggauacugcgccacccgggguuuaccuugauggccgccauccuugccuauaccaucggcacuacccauuuccagcgggcccuaauuuucauccuacucaccgccguggcgcccuccaugacaaugcguugcaucgggaucucgaaucgggacuucguggagggcguuuccggcgggagcugggucgacaucgugcuggagcacggcuccugugugaccacgauggccaaaaacaagccuacccuugacuucgaguugaucaagaccgaggcgaagcagcuugccacgcugcgcaaguacuguauugaggccaagcucacgaacaccacaacagagucccgguguccaacgcagggggagcccagccugaacgaggagcaggacaagcgcuucgucugcaaacacagcaugguggacagagguuggggcaacgguugcggccuguucgggaagggcgggaucgugaccugugcgauguucacgugcaagaagaacauggagggcaaaaucguccagcccgagaaccucgaguauaccaucgugaucacgccccacuccggugaagagcacgcgguggguaacgacaccggcaaacacgggaaggagaucaagaucacgccgcagagcuccaucaccgaggccgagcugacaggauacggcacagucaccauggagugcagcccgcgcaccggccuggacuuuaacgagauggugcuccugcagauggagaacaaggccuggcuggugcaccggcagugguucuuagacuuaccacuacccuggcuccccggcgccgacacccaaggguccaauuggauucagaaggagacgcucgucaccuucaagaacccgcacgcgaagaagcaagacguuguaguccugggaucacaggagggggccaugcacaccgcccucacaggggcgacggaaauccagaugagcuccgguaaucugcuauucaccggccacuugaaaugucgccugcggauggauaagcuccagcucaagggcaugagcuacucaaugugcacagggaaguuuaagguggucaaggagaucgccgagacccaacacggcacgaucguggugcgcguacaguacgagggggauggcagcccaugcaagauacccuucgaaaucauggaccuggaaaagcggcauguucuagggcgccucaucaccgugaacccuaucguaacggagaaggauuccccggucaauaucgaggcggagccgcccuucggggacagcuacgugaucauaggcgucgagcccgggcagcuaaagcugaacugguucaaaaagggcuccagcauuggccagauguucgagaccacgaugagaggcgcuaagcggauggccauccucggcgacacagcuugggacuucggcucccugggcggcguguucaccucuaucggcaaggcccugcaccagguguucggggcaaucuacggcgcggccuucuccgggguuagcuggacgaugaagauccucaucggggugauaaucacguggauuggcaugaacucgcguaguaccucccucucugugucgcugguccugguaggggugguaacccucuaccugggcguggugguccaggccgacagcgggugcgugguguccuggaagaacaaagagcugaaguguggcagcggcauauuuauaaccgauaacguccacacauggacugagcaguacaaguuccagccggagagccccuccaagcucgcuagcgccauccagaaggcccaccaggaaggcauaugcggcauccgcuccgugaccagacuggagaaccugauguggaagcagaucacgcccgaacucaaucauauccugucggagaacgaggucaaacugacgaucaugaccggugacaucaagggcaucaugcaugccgggaagcggucccuucggccccagccgacagaacugagguauagcuggaagaccugggguaaggccaagauccuguccacggagagccacaaccagaccuucuugaucgacgggccggagaccgccgagugcccuaacaccaaccgcgccuggaauucccuagaggucgaggacuacggguuuggcguguuuacgaccaacaucugguugaagcucagggagaagcaggacguguucugcgacagcaaguuaaugucugcggcaaucaaggacaaccgcgccguccaugcggacaugggguacuggaucgagagcgcccugaaugacaccuggaaaaucgagaaggccucguucaucgaggugaagaguugccacuggccuaagucacacacccucuggucgaacggcguccuggaauccgagaugaucauccccaaaaacuucgcaggccccgugucucaacacaacuaccggccagguuaccacacccagacggccgggccguggcaccugggaaaacucgagauggacuuugacuucugugagggcacgaccgugguggucaccgaggacugugggaaccgcggcccaagccugcguacaaccaccgcguccggcaaguuaaucaccgaguggugcugccgcagcugcacgcugcccccccucagauacaggggggaagacggcugcugguacgggauggagauccggccgcuaaaggagaaggaggaaaaccucguaaacucccugguuaccgccggccaugggcagaucgacaacuucagccuggggguccucggcauggccuuguuccuggaggagaugcuccgcaccaggguggggacuaagcacgccacgcuccugguggcugucuccuucgugacccucaucaccggcaacaugagcuuccgcgaccuagggcguguuauggugauggugggcgcaacaaugacggaugauaucgggaugggcgugaccuaccuggcgcuacuggccgcguuuaagguaagacccacuuucgcggcaggccugcuccugcgcaagcugaccucuaaggagcuaaugaugacgacuaucggcguuguccugcugagccaguccaccauacccgaaaccauccucgagcugacggacgcccuggcccugggcaugaugguccugaagaucgucaggaaaauggagcgcuaucagcuggcuguaaccaucaccgccauauugugugugcccaacgccgugaucuugcagaacgccuggaaggucuccugcacgauccuggccgugguguccguuagcccacuccuucuuacuuccagccagcaaaaggcugacuggaucccacucgcgcugaccauuaaggggcugaaccccaccgccaucuuccucaccacgcugagucggacauccaagaagcgcucuuggccccugaacgaagccauuauggcugucggcauggucagcauccucgcguccagccuguuaaagaacgacaucccgaugaccgguccucucgucgccgggggccuacuuaccgugugcuacgugcucacggggcggagcgcugaccuugagcuggagaaggccgccgacguacgcugggaggaccaagcggagaucuccggcaguuccccaauccucagcaucacuaucuccgaggacgguagcauguccaucaagaaugaggaggaagagcagacgcugaccauacucauccggacaggccuacuagugaucagcggcuuauucccgguguccaucccgaucacggccgccgccugguaucucugggaagucaagaagcagcgagccggugugcuuugggacguucccuccccgccgccugucggcaaggcagagcuggaagauggggcauaccggaucaagcaaaagggcauccucggguacagucagaucggagcagggguguacaaggaggggaccuuccacaccauguggcacgugacacgaggcgcgguccugaugcacaaggggaagcggaucgagccaagcugggccgaugugaagaaggaccugaucaguuacggagggggcuggaagcucgagggcgaguggaaggagggggaagaggugcagguccuugcgcuggagcccggcaagaacccccgcgccgugcagacaaaaccuggccucuucaagacaaacaccgguaccaucggggcagugagccuggacuucuccccuggcacgagcggcucccccaucaucgacaaaaaggggaagguggugggccuguacgguaauggaguggucacccggaauggcgccuacgugucggccauagcccagaccgagaaauccaucgaagacaacccggagaucgaggacgauauauuccgcaagaagaggcugaccaucauggaccuccacccuggagccggcaagacgaagagguaucugcccgccaucguuagggaggccaucaagcgcgggcugcguacccucauucucgcgcccacaagggucguggccgccgagauggaggaggcccugagaggccugccaauacgguaucagacccccgccauccgcgcagagcacacgggucgggaaaucgucgaucucaugugccacgccaccuucaccaugcgccugcucagccccguacgugugcccaauuauaaccugaucaucauggaugaggcccacuucacugacccagccucgaucgccgcacggggcuauaucaguacgcggguggagaugggggaggccgccgggaucuucaugaccgccacgccgcccggcagcagagaccccuucccgcaguccaacgcccccaucauggacgaggaacgggagauacccgaacgcagcuggaacuccgggcacgaaugggucaccgauuucaaggguaagacggugugguucguaccaucaaucaaagcugggaacgacauagccgccugccuacggaagaauggcaagaagguaauccaauugucccgaaagacuuucgacagcgaguacguuaagacccggacaaacgacugggacuucguggucacgaccgacaucuccgagaugggcgccaacuucaaagcggagcgcgugauugacccgcggaggugcaugaagcccguaauccugaccgacggggaggagcgggucauccuggccggccccaugcccgugacccacuccuccgccgcccagcgccggggacgcaucggccgcaauccaaagaacgagaacgaccaauauaucuacaugggggagccacuagagaacgacgaggacugcgcccacuggaaggaggcgaagaugcugcuggacaacaucaacacgccugaagggauuauuccuagcauguucgaaccggagcgggagaaaguggacgccauagacggcgaauaucgccuucgcggggaagcccgcaagaccuucguugaccugaugcggcgcggcgauuuaccgguguggcucgccuacaaggucgccgcggaggggaucaauuacgccgaccggcgguggugcuucgacggcauccggaauaaccaaauccucgaggagaacguggagguggagaucuggaccaaggagggggagcgcaagaagcugaaaccccgguggcuagacgcuaggaucuacuccgacccgcuggcccuuaaggaguucaaggaguucgccgcaggccgcaagagccucacccugaaccugaucaccgagaugggccgccuccccaccuuuaugacccagaaggcccgggacgcccuggacaaucuggccguucuccacaccgcggaagccgggggccgagccuauaaucaugcgcugucugaguuacccgagacgcucgaaacccuucugcuucugacccugcucgccacggugaccgggggcaucuuccucuuccuaaugagcggucgggguaucggcaagaugacgcucggaaugugcugcaucaucaccgcguccauacugcugugguacgcgcagauccagccccacuggaucgccgcaagcauaaucuuagaguucuucuugauugugcugcucaucccggagcccgagaagcaacgcacgccgcaggauaaccagcugacguaugucgugaucgccauccugacuguggucgcggccacaauggccaacgagaugggcuuccucgagaagacgaaaaaagaucuggggcugggcaguauaaccacgcagcagcccgagucgaacauacucgacauugaccugcgcccggccagcgccuggacauuguacgccguggccaccaccuuugugaccccgaugcucaggcacaguaucgagaacagcuccgucaacgugagccugaccgccaucgccaaucaggccaccgugcugaugggccuggggaagggcuggccccuuucgaaaauggacaucggggucccucugcucgcgaucggcugcuacagccaggugaauccgaucacccuaacggcggcccugcuccuacugguggcacauuacgcgaucaucggaccaggguuacaggccaaggccaccagagaagcccagaagcgcgccgccgccgggaucaugaagaaccccacaguugaugggauaacugugaucgaccuggaccccaucccguacgauccaaaguuugagaagcagcucggccaggugaugcuccucguucugugcgugacccagguguugaugaugcgcacgaccugggcccugugcgaggcgcucacccucgccacgggcccgauauccacgcugugggaggggaaccccgggcgguucuggaacacaaccaucgccgucagcauggcaaacaucuuccgaggcucguaccuggccggcgccgggcuccuguucucuauaaugaagaacacuaccaacacccggcgcggcacagggaauaucggcgagacgcugggcgagaaauggaagaaccgguuaaacgcucuggggaaguccgaauuucagauuuacaagaaguccggcauccaagagguggaccgcacccuggccaaggaggggauuaaaaggggagaaaccgaccaccacgcugucucccgcgguagcgcuaaacuccggugguucguggagcgcaacauggucacaccggagggcaaaguggucgaccugggcugugguaggggcggguggucuuauuacugcggugggcuaaaaaaugugcgcgaggugaagggccucacgaaggguggacccggccacgaagagcccauccccaugagcaccuacggcuggaaccugguccggcugcaguccggcguggacguguucuucacuccgcccgagaaaugcgacacccugcuaugcgacaucggagagagcuccccgaaccccaccguggaggcgggucgaacgcugcggguucucaaucugguggagaacuggcugaacaacaauauccaauucugcaucaaagucuugaacccguacaugccaucaguuaucgagaagauggaggcacuccaacgcaaauacggcggcgcccuggugagaaacccccugagccgcaacuccacgcacgagauguacugggucagcaacgcauccggaaacaucgugagcuccguaaacaugaucagccggaugcucaucaaucgcuucaccaugaagcacaaaaaggccaccuacgagccggacgucgaccugggguccggaacgcgcaacauugggaucgagucggaggugccgaaccucgacaucaucggcaagcgaaucgagaagaucaagcaagagcacgaaaccuccuggcacuacgaccaagaccaccccuacaagaccugggccuaccacggcagcuacgagacuaagcagacgggguccgcgaguagcaugguuaacggcgucguaagacuucugaccaagcccugggauguggucccgauggugacacagauggcuaugacugacaccacccccuucgggcagcagcgggucuucaaggagaaaguggacacgaggacccaggaaccgaaggagggaacuaagaagcugaugaaaauaaccgccgaauggcucuggaaagaacuuggcaagaagaagacuccccggaugugcacccgcgaggaguuuacgaggaaggugcgcagcaacgcagccuuaggggccauuuucaccgacgagaacaaguggaaauccgcacgugaagccguagaagauucccgguucuggggauuggucgacaaagagcggaaccugcacuuggagggaaagugcgagaccugcguguacaacaugaugggcaagcgcgagaaaaagcucggggaguucggcaaggcaaagggcucccgugccaucugguacauguggcugggggcacgauucuuagaguucgaggcucuagguuuccugaacgaggaucauugguucagucgcgaaaacucccuaagcggcgucgaaggcgagggccuccacaagcuuggcuacauccugcgcgacgucagcaaaaaggagggcggggcuauguacgccgacgauaccgcgggcugggacacgcggaucacccuagaggaccugaagaacgaggaaauggugaccaaucauauggagggugagcacaaaaagcuggccgaggcuaucuucaagcuaaccuaccagaacaaagucgugagagugcagcggccgacgccccgcggcacagucauggacauuaucucccgucgcgaccagcgcggaucgggccagguggguacuuacgggcugaacacauucacgaacauggaggcccagcugauucgccagauggaaggcgaggguguguucaaguccauacagcaccucaccgugaccgaggagaucgcggugcagaacuggcuugcgcgcgugggccgggagcgccugagccggauggcgaucagcggcgacgauugugucgugaaaccccucgacgaccgcuucgccagcgcccugaccgcccugaacgacauggggaaggugcggaaggauauccagcagugggagcccucccgcggcuggaacgacuggacucaggucccguuuugcucacaccacuuccacgagcucaucaugaaagacgggcgggugcuggugguccccugcagaaaccaggacgagcugauaggacgugcgcgcaucucccagggggccggguggagccuacgggagaccgccugcuuggguaaguccuacgcccagauguggagccuuauguacuuucaccgccgggaccugcgccuggccgcgaaugccaucugcuccgcagugccaagccauugggugccuacgucucggaccaccuggagcauacaugccaagcaugaauggaugacaacugaggacaugcugaccgucuggaaccgcguguggauacaggagaacccguggauggaggacaagacccccguggagucuugggaggagauccccuaccucgggaaacgcgaggaccagugguguggcagccugaucggccugacgagcagagcaacaugggcgaagaacauacaaaccgcuauuaaucaggucaggucccucaucggcaacgaggaguacaccgacuacaugcccagcaugaagcgguuccgccgcgaggaagaggaagccgggguguuaugguag

SEQ ID NO: 24798 - RNA, 9876 nt, Artificial Sequence
  derived and/or modified CDS sequence (opt11) from DENV-2__AB543624__SS-prME
agcgcggggaugaucaucaugcugauccccaccgugauggccuuccacuuaaccacccgcaauggggagccgcacaugaucgugggcauccaggaaaagggcaagagccugcuguucaagaccgaggacggcguuaauaugugcacccucauggcgauggaucugggggagcugugcgaggacaccaucaccuacaaaugcccccuccugcggcagaaugaaccugaggacauagacugcugguguaacagcaccucuaccugggugaccuacggaaccugcacgaccaccggcgaacaccgccgggagaagcgcucggucgcccuggugccccacguggggaugggccucgagacccggaccgagaccuggauguccagcgagggggccuggaagcacgcccaacgcaucgagaccuggauccuucggcacccuggguucacgauuauggccgcaauccuggcauacaccaucgggacuacgcauuuccaacgcguccucaucuucauauugcugacggccguggccccaagcaugaccaugcgguguaucggcauaagcaacagggacuucguggaaggcgucuccggcgggagcugggucgacaucgugcucgagcauggguccugcguuaccaccauggcgaagaacaagcccacguuggacuucgagcugauaaagacagaggcgaagcagcccgccacccuaaggaaguacugcaucgaggccaagcugaccaacaccaccaccgagagccgcugcccaacccaaggggagccgucccuuaaggaggagcaggacaagcgguucguaugcaagcauagcaugguggaccgcgguugggggaacggcugcggccuguucggcaagggcgggaucgucacuugugcuauguucacaugcaagaagaacauggaggguaagauuguacagcccgagaacuuggaguacaccauaguggucacaccccacuccggcgaagaacacgcggugggcaacgacacagggaagcacggcaaggagaucaaggucacuccgcagagcucgaucaccgaggccgagcuuaucggguacggcaccgucacgauggagugcagcccccggaccggccucgacuucaacgagauggugcugcugcagauggaaaauaaggccuggcucgugcaccgccagugguuccucgaccugccccugcccuggcugccgggagcugacaaacaggaguccaauuggauccagaaagagaccuugguaacguucaagaacccccacgcuaaaaagcaggacguugucguccucggcagccccgagggggcgaugcacaccgcacuuacgggcgccacagagauccagaugagcagcggaaaucuccuuuucaccggccaccuuaaaugccggcugaggauggacaaacuucaacugaagggcaugagcuacuccaugugcaccgggaaguucaagguugucaaggagaucgccgagacgcagcauggcacuaucgugauccgggugcaguaugagggggacggcagccccugcaaaauuccguucgagaucauggaccuggagaagcgcuacguccucggccgguugaucaccgugaauccuaucgugacggagaaggacaaccccguaaauauagaggcagagcccccguucggggauuccuacaucaucaucggcguggaacccggacaacuuaagcucaauugguucaaaaagggcagcaguaucggacagauguucgagacgaccaugcgcggugcgaagcgcauggccauucugggcgacaccgccugggacuucgggagcuugggcggcguguucaccuccaucggcaaagcccuccaucaggucuucggggccaucuauggcgcggccuuuagcggcguguccuggacgaugaagauccugaucggggugaucauuaccuggauaggaaugaacagccgguccaccagccuauccgucucacugguguugguggggaucgucaccuuguaccugggcgugauggugcaggcagacuccgggugugugguguccuggaagaauaaggagcucaagugcgguuccggcaucuuuaucacggacaauguacacaccuggaccgagcaguacaaguuucagcccgagagucccagcaagcuggccuccgcuauucaaaaggcccaggaggaggggaucugcggaauacgcagcgucacccggcuggagaaccucauguggaaacaaaucgccccggagcugaaccacauccuggccgagaacgaggugaagcucacgauuaugaccggugauaucaagggaaucaugcaggccgggaagcgcucuuugcggccccagcccaccgaguugaaguacagcuggaagaccuggggcaaggcgaaaaugcugaguacggagagcuauaaucaaaccuuccugaucgacggcccggagacugccgaaugucccaacaccaacagggccuggaacucccuggagguggaggacuacggguucggcgucuucacgaccaauaucuggcucaaauugaaggagaggcaggacgcuuucugugacagcaaacugauguccgcagccaucaaggauaaccgagccgugcacgcggacaugggguacuggaucgaaagcgcgcucaacgacaccuggaagaucgagaaggcuuccuucaucgaggucaagaacugccacuggcccaagucacacacccugugguccaauggcguccuggagagcgagaugaucauucccaagaaccucgcgggccccgugucccagcacaacuaccggcccggguaccacacccagaucgcgggccccuggcaccuggggaaacuggaaauggacuuugacuucugcgacggcaccacagugaucgucaccgaagauugcgggaaccguggccccagccuccggaccacgacugccucggggaaacuuaucacagaguggugcugcaggagcugcacccugccgccccuacgguauagaggggaggacggcugcugguacgggauggagauccggccccugaaggagaaggaggagaaccuggugaauagccucguaacggccggccacgggcagguugauaacuucucgcugggcguucucggcauggcccuguuccuugaagagaugcuucgcacccggguggggacaaagcacgccauccuccuggucgccgugagcuucgugacccugaucacgggcaacauguccuucaaggaccuagggagagucgugguaaugguaggcgccaccauggccgacgacaucgggaugggcgugaccuacuuagcucugcucgccgccuucaaggugcgucccaccuucgccgccggccuucugcuccgcaagcugacuuccaaggagcuuaugaugaccaccaucggaaucguccuccugucccagagcacgaucccggagaccguucuggaguuaaccgacgcgcuggcccuggggaugauggugcucaagauuguacgaaacauggagaaguaccaguuggcggugaccauuauggcgauucugugugucccaaacgccgugauccuccagaacgcguggaagguguccuguaccauccucgccguagugagugugagcccccugcuccugacaucaucccagcagaagaccgacuggaucccccuggcauugacuaucaagggguuaaacccgacugccauauuccugacgacccucagucggaccaauaagaagcgauccuggccccugaaugaggcgaucauggccguaggaauggugagcaucuuggccucuagccuccugaagaacgacauccccaugaccggccccuuaguggccgguggccuccugacggucugcuacguauugaccgggcgauccgccgaccucgagcuggagcgugcgaccgaugugaagugggaggaucaggccgagaucucuggcucgagccccauucugagcaucacuaucucggaggacgguagcaugaguaucaagaaugaggaggaggagcagacgcucaccauccugauccggacaggcuuacucgucaucagcggguuguucccuaucuccauccccaucaccgcggccgccugguaccugugggagguaaagaagcagcgcgcagggguucucugggacguucccagcccuccgccgaugggcaaagccgagcuggaggacggggccuacaggaucaagcagaagggcauccugggguacucccagauuggcgccggcguauacaaggaggggacguuccacaccauguggcacgugaccaggggcgccguccucaugcacaaggggaaacggauugagccgucuugggcggacgugaagaaagaccugaucuccuacggcggaggcuggaaacuggagggggaauggaaggagggggaagaaguacagguguuggcccuggaacccggcaagaauccccgcgccguacagaccaagcccggccuguucaagacuaauaacggcacgauaggagccgugagccucgacuucuccccgggcaccagcggauccccuaucaucgacaagaaggggaaaguugugggucuguaugggaacgggguggucacucggagcggugccuacguguccgcgauugcccagaccgagaaauccaucgaggacaaccccgagaucgaggaugacaucuuccgcaagagacgacucacgaucauggacuuacaccccggggccgguaagaccaagcgguaccucccagccaucgugcgggaggcaaucaagcgggggcugagaacucuuauccucgcccccacccgggucguggcagcugagauggaggaggcccugcguggccuacccauccgguaccagacgccggcgauccgcgccgagcauaccgggcgcgagauugucgaccucaugugccacgccaccuuuaccaugcggcugcuguccccgguccgcgugcccaacuacaaccucaucaucauggacgaggcccacuucacagacccggccaguaucgcagcccggggcuacaucuccacucgcguggagaugggcgaagcggccgguaucuucaugacugccacgccgcccggcagccgggauccauucccccagagcaaugcgccgaucauugacgaggagcgcgagauccccgagcgauccuggaacucggggcacgaguggguaacggacuucaagggcaagacggugugguucguccccuccaucaaggccgggaacgacaucgccgccugccuacgcaagaacggcaaaaaggucauccagcugucgcggaagaccuucgacuccgaguacgugaagacccguacgaacgacugggacuucguggugaccaccgacaucagcgagaugggcgcgaacuucaaggcugaacggguaauugauccccgccguugcaugaagcccgucauccucaccgacggggaggagcgcgucauacuggccggaccgaugccgguaacccacuccagcgccgcccagcgccgcgggcggaucggccgcaaucccaagaacgaaaacgaccaauacauauacaugggcgagccgcuggagaacgacgaggacugcgcgcacuggaaggaggccaaaaugcuccuggacaacaucaauaccccugagggcaucauccccuccauguuugaacccgagcgggagaagguggacgccaucgacggcgaguaccgccugcgcggggaggcgcggaagacauucgucgaccuuaugcgccggggcgaccugccgguguggcuggccuauaagguggcugccgaggggaucaacuacgcggacaggcguuggugcuuugacggcaucaaaaacaaccagauccucgaggaaaacgucgagguggagaucuggaccaaagaaggggagcgcaagaaacugaagccgcgguggcuggacgcccgcaucuacagcgacccacucgcccuuaaggaguucaaggaguucgcagccgggcguaagucccugacgcucaaccuaaucaccgagaugggccgccugcccaccuucaugacccagaagacacgcgacgccuuggacaaccuggccguccugcacacggccgaggccgggggccgcgccuacaaccacgcucucagcgagcugccggagacccuggagacccuccugcugcucacgcuguuggcuaccgugaccggcggcaucuuccuauuccugauguccgggcgggguaucggaaagaugacucuggggaugugcugcaucaucaccgcgagcauccuccugugguacgcccagauccagccccacuggaucgccgccaguauaauauuagaguucuuccuuaucguacugcugauacccgaacccgagaagcagcgcaccccgcaggacaaucaacucacguacgucgugaucgcuauccugaccguggucgcggccaccauggcaaacgaaaugggcuucuuagagaagacgaagaaggaccucggacuuggcagcaucgccacccagcaccccgaguccaacaucuuagacaucgaccuacggcccgccucugcguggacccuguacgcgguggccaccacguucaucaccccgaugcugcgccacuccauagaaaauaguagcgugaacguuucccucaccgccaucgcuaaccaggcgaccguccugaugggucuggggaagggcuggccgcucagcaagauggacauuggggugcccuugcuggccaucggcugcuacucccaggucaaccccaucacgcucaccgccgcucuacugcuccugguggcgcacuaugccaucaucgggcccggucuucaggcuaaggcaacccgggaggcacagaagcgggcggccgccggcaucaugaagaacccgaccguggacgggaucacggucauugaccuggaccccauucccuacgacccgaaguuugagaaacagcugggacaggugaugcugcucaucuuaugcgugacccagguccugaugaugcggaccacgugggcccucugcgaggcccugacccuagcuaccgggccaauuagccccuuaugggagggcaaccccggcagauuuuggaauaccacaaucgccguguccauggccaacauuuuuagaggcagcuaucuggcuggggcugggcuccucuucuccaucaugaaaaacacgaccaacacccgccgcggcaccggcaauaucggcgagacgcugggcgagaaguggaaaucccgucugaacgcgcucggaaagagcgaguuccagaucuacaaaaagucuggcauccaggagguggaucguacccuggccaaagaggggaucaagcggggugagaccgaccaucacgcagucagccgcgggagcgccaagcugcggugguucguggagcgcaacauggugacgcccgagggcaaggucguugaccucggcugugggcggggcggcugguccuacuacugcggcggguugaagaacgugcgagaagucaagggacugacgaagggcgggccgggucacgaggagcccauucccaugaguaccuacggguggaaccucguccggcugcagaguggcguggacgucuucuucauaccucccgagaagugcgauacacugcuaugcgacauuggcgagagcucccccaaccccaccguggaggccggacggacgcuucgcguucugaaccucguggagaacuggcucaacaaccacacccacuucugcaucaagguucugaacccguacaugccuuccgugcuggagaagauggaggcccuccaacgcaaguacggaggggcccuaguccggaacccccugucccgcaacagcacccacgagauguacuggguuagcaacgccucaggcaacaucgucagcuccgucaacaugauuagccggaugcucauuaaucgcuucaccaugcggcacaagaaggccacguacgagccagacguggaccuggggagugguacccgcaacauagggaucgagagcgagauaccgaauuuggacaucaucggcaagcguaucgaaaagaucaagcaggagcacgaaaccuccuggcacuacgaccaggaccacccauacaagaccugggcguaccauggcagcuacgagaccaagcagacggguuccgccagcuccauggugaacggcgucgugcgccuccugaccaagcccugggauguacugcccaccgucacccagauggccaugacggacaccaccccuuucgggcagcagcgcguguucaaggagaagguggacacccggacgcaagagcccaaggaaggcacgaaaaagcucaugaagaucacggccgaguggcuguggaaggagcugggaaagaagaaaacgccgcgcaugugcacgcgggaggaguucacccgcaagguucggagcaacgccgcgcucggggccaucuucaccgacgaaaacaaauggaaguccgcccgcgaggccguggaggacagccgguuuugggagcugguggacaaggagcgcaaccugcaccucgagggcaagugcgagaccugcguauacaacaugauggggaagcgggagaagaagcugggcgaguucgggaaagcgaaaggcucccgcgcgaucugguacauguggcugggcgcccgguucuuggaguucgaggcccugggguuccugaacgaggaccacugguucagucgcgagaacucucucuccggcguggagggggagggccuucacaagcugggguacaucuugcgggacgucuccaaaaaggagggcggcgccauguacgcggacgacacugccgguugggacacccgcauaacccuagaggaccugaagaacgaggagaugguaaccaaccacauggagggcgagcacaagaagcucgccgaagccaucuucaagcugacguaccagaacaaggugguccggguacaacgccccaccccgcgggggacugucauggacaucaucagccgcagggaccagcgcggcucaggacagguaggcaccuacggccugaacacguucaccaacauggaggcgcaacucauccggcagauggaaggggaggguguguucaagaacauccagcgcuugaccgugacagaggaggucgcugugcacaacuggcuggcgcgcguggggagggagcgccucucccggauggccaucagcggcgacgacugcgucgugaagccguuagacgaccgcuuugccaacgcccugacggcgcucaacgauaugggcaagauccgcaaagacauccagcagugggagccguccaaaggguggaacgacuggacccaagugcccuucugcagccaccauuuccacgaauugauuaugaaggacggccgcguccuagugguaccguguagaaaccaggacgagcucaucgggcgcgcccggaucagccagggcgccggguggagccugcgagagaccgccugccucggcaagucguacgcccagauguggagccucauguauuuccaucggagggaccugcggcuggcggccaaugccaucugcuccgcuguccccagccacuggguucccaccucccgcacgaccugguccauucacgcaaagcacgaguggaugacgaccgaggauaugcucacgguguggaaccgggucuggauucgcgagaaccccuggauggaggacaaaaccccgguggaauccugggaggagauaccguacuuaggcaagcgggaagaccaguggugcgggagccugauuggccucaccucccgcgcgaccugggcuaagaacauccaggccgccaucaaccaggugcgaagccugaucgggaaugaggaguauaccgacuacaugcccuccaugaagcgcuuccgccgggaggaagaggaggccggcguccuaugguga

SEQ ID NO: 24799 - RNA, 9876 nt, Artificial Sequence
  derived and/or modified CDS sequence (opt11) from DENV-2__AB189122__SS-prME
acggcgggcgugaucaucaugaugauccccaccgugauggcguuccaucugaccacccgcaauggggagccccacaugaucgugucgcggcaggagaaggguaagucccuuuuguuuaagaccgagaauggggugaacauguguacccuaauggccauggaucucggcgaguugugcgaggacacuaucaccuacaacugcccacugcuccgccagaacgagcccgaggacaucgacugcuggugcaacagcaccuccaccugggucacuuacgguacuuguaccgccaccggcgaacaucggcgcgagaagcggagcguggcccuggcaccccacguuggaauggggcuggagacucgcacugagaccuggaugaguagcgagggggcuuggaagcacgcgcaacggaucgagaccugggucuuaagacauccgggcuucacgaucauggccgccaucuuggccuacaccauuggcaccacguacuuccagcgugugcugaucuucauccuccugacggcgguugcacccuccaugacaaugcgcugcauagggaucuccaaucgggauuucguugagggcguguccggcggguccuggguugacaucguacuggagcauggcucaugcgugaccaccauggcgaagaacaaaccaacgcucgacuucgagcugaucaagaccgaggccaaacaccccgccacccugcgaaaguacugcaucgaggcgaagcuuacuaacacgacgaccgccagccguugcccaacccagggggaaccgucccugaacgaggagcaggauaagcgcuucguaugcaagcauagcauggucgaccggggcuggggcaacgggugcgggcuguucgggaaaggcgggaucgucacgugcgccauguucacgugcaagaagaacauggaagguaaggucguccaaccggagaaccucgaguacacgaucguaaucaccccccacucaggcgaggagaaugccguggggaacgacaccggcaagcacgggaaggagaucaagguaacgccgcagagcuccaucaccgaggccgagcugaccggcuacgguaccgugacuauggaaugcuccccccgaaccgggcuggacuuuaaugagauggugcuccugcagauggagaacaaagcguggcugguccaccggcagugguuccucgaucugccccugccauggcugccaggcgccgacacccagggauccaacuggauccaaaaggagaccuuggucaccuucaaaaacccucacgccaagaagcaagacguagugguccugggaagccaggagggugcuaugcacacggcccuuaccggcgcgaccgagauccaaaugagcagugggaaccugcuguucacgggccauuugaaaugucgcuuacggauggacaaacugcagcucaagggcaugucuuacuccaugugcaccgggaaguucaaggucguuaaggaaaucgccgagacccaacauggcaccaucguaauccgcguccaauacgagggggacggcagccccugcaaaauccccuucgaaaucauggacuuagagaagcgacacgugcuggggcggcucaucacgguuaauccuaucgucaccgaaaaagauucccccguaaauaucgaggccgaaccgcccuucggugacucauacaucaucauaggcguugagccugggcagcugaaacugaacugguucaagaagggcuccagcauugggcagauguucgagacuaccaugcgcggcgccaagcggauggcgaucuuaggcgacacugccugggacuucgggucccucggcggggucuuuaccuccaucgggaaggcucugcaucaggucuuuggugcuaucuacggcgccgcguuuagcggcgugagcuggaccaugaagauccugaucggggucgugaucaccuggaucggaaugaacuccagaagcacgucccugagcgugucgcugguccuggugggggugguuacccucuaccuuggugugauggugcaggcggacuccgggugcgucgucuccuggaagaacaaggagcugaagugcggcucgggcauuuucaucaccgacaacguacacacuuggacggagcaauacaaauuccagcccgagucucccuccaaauuggccagcgccauucagaaggcccacgaggaggggaucugcggaaucagauccgucacccggcuggagaaccugauguggaagcagaucacuccagagcucaaccacauccucucagagaacgaggugaagcuaaccaucaugacgggggacauuaagggcaucaugcaggcggggaagagaucccuccgaccgcagcccaccgagcugaaguacagcuggaaggcauggggcaaggccaagaugcuuucgaccgaacuccacaaccacacauuccugauugacggccccgaaacugccgagugcccgaacaccaaccgagccuggaacagcuuagagguagaggacuacggcuucggcgucuucaccacuaacauauggcuaaagcugaaggagcgccaggacgucuucugugacuccaagcugaugagcgcggcaauaaaggacaaccgggccgugcacgcagacaugggguacuggauugagagugcccucaacgacacguggaagaucgaaaaagcuagcuucaucgagguuaaguccugccacuggcccaagagccacaccuuauggucgaacggcgugcucgagagcgagaugauuaucccgaagaacuucgcaggucccgugucccagcauaacuaccgcccgggguaccacacccagaccgccggccccuggcaucucgguaagcuggagauggacuucgacuuuugugagggaacgacggucguugugaccgaggacugugggaaccggggccccagccugcgcaccaccacggccagcgggaagcugaucaccgagugguguugccgguccuguacccugcccccgcugcguuacaggggagaagacggcuguugguaugguauggagauacgccccuugaaggagaaggaagagaacuuggucaauagccugguuacugcuggccaugggcagaucgauaacuucucccucggcgugcucggcauggcgcuguuccuugaagagaugcugcggacaagggucgggaccaagcaugccauccugcuaguggccguuagcuucgucacgcugaucaccggcaauauguccuucagagaccuggggcgcgugauggugauggucggcgccacgaugaccgacgacaucgggaugggugugaccuaccucgcgcugcuggcugccuucaagguucgucccaccuuugccgcgggccuccugcugcggaaguugacgagcaaggaacugaugaugacaaccaucgggaucgucuuacucucccaaagcaccauccccgagacgauccuggagcugaccgacgcgcucgcccucgggaugauggugcugaagaucguucguaacauggagaaguaccaacucgcagugaccaucauggcaauccugugcgugccgaacgcugucaucuuacagaacgcuuggaagguguccugcacgacgcucgccguggucucagugagcccccuucuuuuaaccucgucccaacaaaaggccgauuggaucccccuggcccugaccauuaaaggccucaaccccacagcgaucuuccugacuacccuuagccggaccuccaagaagaggucauggccgcucaacgaggcgaucauggccgugggcauggucucaauccuagcaagcucccuucucaagaacgacauacccaugaccggcccccugguggccgggggccugcuuaccgugugcuacguguuaaccgggagaagcgcggaccuugagcucgagcgcgccgccgacgugcggugggaggagcaggccgagauuagcggcuccagccccauacuguccaucacuaucucugaggacggguccaugagcaucaagaacgaggaggaggagcagacccugacgaucuugauucgcaccggccuacuggucaucuccggucucuucccugucucgauccccaucaccgccgcggccugguaccugugggaagugaagaaacagcgggccggggugcuuugggacguccccucgccgccgccagugggcaaggcugagcucgaggacggggccuacagaaucaagcagaagggaauacugggguacagccagaucggggugggcguuuacaaggaggggaccuuccacaccauguggcacgugacucggggcgcggugcugaugcauaaagggaaacgcauagagcccuccugggccgacgugaagaaagaccucaucucuuacggcgggggcuggaagcuggagggagaguggaaggagggggaagaaguccaggugcuggcccuggaacccggcaagaauccccgggcaguccaaacgaagccggggcucuucaagaccaacaccggcacgaucggggccgugucgcuugacuucagucccggcaccuccgguagccccauuguggacaaaaaggggaagguggugggccuuuacgggaauggcguggucacccgcuccggcaccuacgugagcgccaucgcgcagacggaaaagaacauugaggacaaucccgagaucgaggacgacaucuuccggaagaagcgccugaccauaauggaucugcaccccggggccggcaagaccaagagguaccugcccgcuaucgugcgggaggcgaucaagcgagggcuccgcaccuuaauucuggccccgacacgggucguugcugccgagauggaggaggcccuccgcggacugccgauacgguaccagacucccgcgauacgggccgaacacaccgggcgcgagaucguggaccugaugugccacgccaccuucacgaugcgacuccugucccccauacgcgucccaaacuauaaccugaucaucauggaugaggcccauuuuacagaccccgccaguaucgcggcccggggcuacaucagcacccguguggagaugggugaggccgcuggcaucuucaugacugcaacgccucccggcucccgggacccguucccccagagcaacgcgcccauuauggacgaggaacgcgaaauccccgagcgaucuuggaauuccgggcacgagugggugaccgacuuuaagggcaagacagucugguucgugcccuccaucaaagcagggaacgacaucgcggccugccuccguaagaacggcaagaaggugauccagcugagccggaagaccuuugauagugaauacaucaagacgcgcaccaaugacugggacuucgucguaaccaccgacaucucagagaugggcgcgaacuuuaaggcagagcgagugaucgauccccgccggugcaugaagcccgucauccugacggacggggaggagcgcguaauccucgccggccccaugccggugacccacuccagugccgcccagcggcgcggcagagucggucgcaaccccaagaaugaaaacgaccaguacaucuacaugggagagcccuuagagaacgacgaggacugugcucauuggaaggaggccaagaugcuacucgacaacaucaacacgcccgagggcaucauccccuccauguuugagcccgagcgcgagaagguggacgcuaucgacggcgaguaccgccugcgcggggaagccaggaagaccuucgucgaccugaugagacggggggaccuccccgugugguuggccuaccgcguggcugccgaggggaucaacuacgccgauaggcgcuggugcuucgacggcgucaaaaacaaccagauccuggaggagaacguugaaguggagaucuggacgaaagagggugagcggaagaagcucaagccacgcuggcuugacgcccguaucuacagcgacccccuagcuuuaaaggaguucaaggaguuugccgccggaagaaagucccugacccuaaaucucaucaccgaaaugggccggcuacccaccuucaugacgcaaaaggcccgcaacgcccuggauaaccucgcgguccugcacacugccgaggccggaggccgggccuacaaccaugcacugucagaacuccccgaaacccuggagacccugcuccugcugacacuccuggcgaccguaaccggggguauuuuccuuuuccuuauguccggaaagggcaucgggaagaugacccuggggaugugcugcauuaucaccgcuagcgugcugcugugguaugcccagauccagccgcauuggaucgccgccuccaucauacuggaguucuuccuaaucguccuccugauacccgaacccgaaaagcagcgcacgccccaggauaaucagcucaccuauguggugaucgcgauccucaccguagucgccgcgaccauggccaacgagaugggcuuucuggagaagacgaagaaggacuucggacugggcuccaucgccacccaacagccggaguccaacauuuuagauauagaccugcguccggcuagcgccuggacccucuacgccguagccaccacguucaucacgcccaugcuccgccacagcauugagaacucaagcguuaacgucagucuaacugccaucgccaaccaggccacgguccugaugggccucgggaagggauggccccucagcaaaauggacaucgggguuccgcugcuggcaaucggcuguuacucccaggugaacccuaucacacugaccgccgcgcuccuccuucugguugcccacuacgccauuaucggacccggccuccaggcaaaggcaacgagggaggcacagaagcgugccgccgccggaaucaugaagaaccccaccgucgacgggaucaccgugaucgaccuagacccgauccccuacgacccgaaguucgaaaagcagcuggggcaggugaugcuacugguucugugcgucacccaggugcuuaugaugcgaaccaccugggcccugugcgaagcgcuaacgcucgccaccgggcccaucagcacccugugggaggggaauccggggcguuucuggaauacuacgaucgcugucucaauggccaacaucuuuaggggcucuuaccuggcuggcgcgggccuccuguuuuccauuaugaagaacaccgcaaauacccggcgcggcaccgggaacacgggcgagacucugggcgagaaguggaaaaaccggcucaacgccuuagggaaguccgaguuccagguguacaagaagucggggauacaagagguggaccggacccuugcgaaggaggggaucgagcggggugagaccgaccaccacgcgguaagccgcggcuccgccaagcuccggugguucgucgaacgcaaccugguaacgccggagggcaaagucguggaccugggcugcgggcggggaggguggagcuacuacugcgggggguuaaagaacgugaaggaagucaagggccuaaccaagggcggucccggacacgaggagcccaucccgauguccaccuacggauggaaccuggugcgccugcagucaggcguggacgucuucuucaccccgcccgagaagugcgacacgcuguuaugcgacaucggggaguccagccccaacccgacuguagaggccggccggacgcuccgcgugcugaaccuggucgagaacuggcucaacaauaacacccaguucugcauuaaggugcugaaucccuacaugcccuccgugaucgaaaagauggaggcccugcagcggaaguauggcggggcgcuggucagaaacccgcucagucggaacagcacccacgaaauguacugggucuccaacgccagcggaaauaucguguccagcgugaacaugaucucccgaauguuaaucaaccguuucacgaugcgccauaagaaagcgacauacgagccagacguggaccuggggagcgguacacggaauauuggaaucgaaucggagauccccaaccuugacaucaucggcaagcgcauugagaagaucaagcaggagcacgagacaucauggcacuacgaccaggaccaccccuauaagaccugggcuuaccacggcuccuacgagacuaagcagacagggucugcaagcagcaugguaaacggggucgugcgccugcuaacgaagccuugggacgucauccccauggugacacaaauggccaugaccgacacgaccccuuucgggcagcaacggguguuuaaggagaaggucgacacgcguacucaggaacccaaggagggcaccaaaaaacucaugaagauuaccgcggaauggcuguggaaggagcugggcaagaagaagacgccgaggauguguacgcgcgaggaguucacccggaaaguacgcucgaaugccgcccugggagccauauucaccgacgagaauaaguggaaguccgcacgggaggccguggaggacucgggguuuugggagcuuguagacaaggagcgcaaucugcaccucgaggguaagugcgagacgugcguguacaacaugaugggaaaaagggagaaaaagcugggcgaguucggcaaggcgaagggcagccgcgccaucugguacauguggcucggagcccgguucuuagaguucgaggcacugggcuuccugaaugaggaccacugguucucccgugagaacagccuguccgggguugaaggcgagggucuucacaaauugggcuacauccucagagacgucagcaaaaaggagggcggggcaauguacgccgacgacaccgccggcugggauacccgcauaacgcuggaggaccugaagaacgaggagauggugaccaaccacauggaaggugagcacaaaaaacucgccgaggcuauauucaagcugacguaucagaacaaagugguccgcgugcagagacccaccccccggggcaccgugauggacauaauuagccgacgcgaccagagagggucuggccaaguagugacguacggccugaacaccuucaccaacauggaggcccagcucauccggcagauggaaggggagggaguguuuaaguccauccagcaccugaccgucacggaggagaucgccguaaagaacuggcuagcccgcgucgggcgcgaacggcucagucguauggccauuuccggcgaugauugcgucguuaagccccuggacgaccgguucgcguccgcccugaccgcccucaacgacaugggcaaggugcgcaaagacauccagcaaugggagccgagccggggguggaaugacuggacccaggugccguucuguucccaccacuuccaugagcugaucaugaaggacggacgggugcuggugguccccugccggaaccaggacgagcucaucggccgcgcccggauuucucagggcgccggguggucacugcgcgaaaccgcgugucugggaaaaucauacgcccagauguggagccucauguacuuccaccgccgcgaccugcggcuggccgccaacgccaucuguagugccguacccucccauugggugccuacgucucgaaccaccugguccauccacgccacccaugaguggaugacaacggaagauaugcucaccguguggaaucgggucuggauccaggagaaucccuggauggaagacaagacccccguggaguccugggaggagauucccuaucugggcaagcgagaggaccaguggugcgggucccugaucggccucaccagccgggccacaugggccaagaauauucaaaccgcgaucaaccaagugcguagccugaucgggaacgaggaauacacggacuauaugcccucgaugaagcgguucagacgcgaggaggaggaagcuggcgugcugugguga

SEQ ID NO: 24800 - RNA, 9876 nt, Artificial Sequence
  derived and/or modified CDS sequence (opt11) from DENV-2__AB189123__SS-prME
accgccggcgugauuaucaugaugauccccaccguuauggccuuccacuugacaacgcggaauggcgaaccccacaugaucguuucgcggcaggagaagggcaagucccuccuuuucaagaccgagaauggggugaauaugugcacccugauggccauggaccugggugagcugugcgaggacacaaucaccuacaacugcccccugcuccgccagaacgagcccgaagacauugacugcugguguaacagcaccuccaccugggucaccuaugggacgugcacggccaccggggagcaccgucgcgagaagcggagcguggcccucgcgccccacgucggcauggggcuagagacacgcaccgagaccuggaugucgagcgagggcgcauggaagcaugcgcagcggaucgagaccuggguccuccggcaccccggguuuacgaucauggccgcuauccuggccuacacuauuggcacuaccuacuuccaacgcgugcugauauucauccuccugacugcgguggccccguccaugacuaugcgcuguaucgggaucagcaaccgggacuucguagagggcguguccggcgggagcuggguagacaucgucuuggaacacggcaguugcgugaccaccauggccaagaacaagcccacacucgauuucgagcugaucaagaccgaggccaagcaucccgccacauugagaaaauacuguaucgaggcgaaacuuaccaacacgacgacggccagucggugcccaacccagggggagcccucgcugaacgaggagcaggacaagcgauucguuugcaagcacaguauggucgaccgcggcuggggcaacgggugcggccuauucgggaaaggcgggaucgugacgugcgcgauguucacgugcaagaagaacauggaagggaagguggugcaacccgagaaucucgaauacacuauugugaucacaccccauuccggcgaggaaaacgccguggggaacgacacuggcaagcacgggaaggagauuaaggucaccccgcagagcuccaucaccgaggccgagcugaccggcuacgggaccguaacgauggaguguagcccccgcaccggccuggacuucaacgagauggugcugcuacaaauggagaacaaggcguggcugguccaccggcagugguuccucgaccugccucugcccuggcucccaggggcggacacgcaaggcuccaacuggauccagaaagagacccuggugacguuuaagaacccucacgccaagaagcaggacguaguggugcugggcagccaggagggggccaugcauaccgcccuuaccggugccacggagauccagauguccucugggaaccugcuguucacuggccaucucaagugccgacucaggauggacaagcugcagcuuaagggcaugagcuacuccaugugcaccggcaaguucaagguugugaaagagaucgcagagacccagcacggcaccaucguuauacgcguccaguacgagggggaugggucgccaugcaagauaccuuuugagaucauggaccuggaaaagcggcauguucugggcaggcucaucaccgugaacccgaucgucacggagaaggacucuccggugaacaucgaggccgagccgccauucggagacaguuacaucaucaucggcguugagccgggacaguuaaagcugaacugguucaagaagggcuccuccaucggucaaauguuugagaccacgaugcgcggagccaagcggauggcuauacugggcgauaccgcgugggacuuugggucccugggcggggucuucaccagcauugguaaggcgcuucaccagguguucggggcaaucuacggcgcggcguucuccggcgugagcuggaccaugaaaauccucaucggggucgugaucacguggaucggcaugaacucucguagcacgucacugagcgugucccugguccuggugggaguggucaccuuauaccugggcgugaugguucaggcugauagcgggugcgucguuucuuggaagaacaaggagcugaaguguggcagcgguaucuucauaaccgacaacguucacacguggacugaacaguacaaguuccagcccgagagccccucgaagcucgccagcgccauacagaaggcccaugaggaggggauuugcggaauaagauccgucacucgccucgagaaccugauguggaagcaaaucacacccgaacucaaucacauccugagcgagaacgagguuaaguugaccaucaugacgggagacauaaaaggcauaaugcaggcggggaagcggucccuccgcccgcagcccaccgagcugaaguacucuuggaaggccuggggcaaggccaagaugcuguccaccgagcuccacaaucacacuuuucugaucgacggccccgaaacggcagagugcccgaacaccaaucgggcauggaacucucuagagguggaggacuacggguucggcgucuucaccaccaauaucugguugaaauuaaaagagcgccaggacguguucugugacuccaagcugaugagcgcggccaucaaggacaaccgagccguccacgccgacaugggguauuggaucgaguccgcuuugaacgacacguggaagaucgagaaggcgagcuucauagaggucaaguccugccauuggccaaagagccacacucuguggucaaacggcguuuuagaaagcgagaugaucauccccaagaacuucgccggcccggugucccagcacaacuaccgccccggguaccacacccagaccgccgggcccuggcaucucgggaaguuggagauggacuucgacuuuugugagggcaccacaguaguggugacagaggacugcggaaaccggggacccucucugcgaaccaccacugcuuccggcaagcucauaaccgaaugguguugucgguccugcacgcugccaccccugcgcuaccgcggugaggaugggugcugguacgggauggagaucaggccacucaaagagaaggaggagaaccuggucaacagccucgugaccgcgggccacggccagauagacaacuucucccucggcgugcugggaauggcccuguuccucgaggagaugcuccggacgcgcgucgggaccaagcacgccauccugcucguggccguuagcuucgucacccugaucaccggaaacauguccuuccgggaccuggggcgugugaugguuaugguuggagcuaccaugaccgacgacauaggcaugggcguaaccuaccuggcgcuccuugcugcauucaaagugcgccccaccuucgcggccggccuccuacuccgcaagcucacuagcaaggagcugaugaugaccaccaucggaaucguacugcucucccagagcaccauccccgagacgauccuggaauugacggacgcccucgcccugggcaugauggugcuaaagaucguccgcaacauggagaaguaccagcucgccgugaccaucauggccaucuuaugcgugccgaacgccguaauccugcaaaaugccuggaagguauccugcacgacucucgccguggucagcguuagcccccuucugcuaaccucaucucagcagaaagccgauuggauuccccuggcccugaccaucaaagggcucaaccccaccgcgaucuuccucacgacccugagccggaccuccaagaagcgcuccuggccgcucaacgaggcgauaauggcggugggcauggucucaauccuggcaagcuccuugcucaaaaacgacauccccaugaccggacccuugguggccgggggcuugcucacggugugcuacguauugaccgggaggagcgcggaccuggagcuugaacgcgcggccgaugugcggugggaggagcaggccgagaucagcggcuccagccccauccucuccaucaccauaagcgaggacgggaguaugagcaucaagaacgaggaggaggaacagacccugaccauccucauccgcaccggucugcugguaaucaguggccuauucccggucagcauccccaucaccgccgcggccugguaccuaugggaggugaagaagcagcgggcagggguacugugggaugucccuagcccgccucccgugggcaaggcugagcucgaggacggggcauaccgcaucaagcagaaaggcauccugggauacagccagaucggcgcgggcguguauaaagaggguaccuuucacacaauguggcacgucacgcggggcgccgugcuuaugcauaaggggaaacgcaucgagcccuccugggcagacguaaagaaagacuugaucagcuacggagggggcuggaagcuggagggcgaguggaaggaaggggaggagguccagguucuggcgcucgagcccggcaaaaacccccgggcgguacagaccaagcccgggcuguucaagaccaacaccggcacgaucggggcggucagucuagacuucagcccaggcaccuccggcagccccaucguagacaagaagggaaagguggucgggcucuacgggaauggcguggugacccgcucaggcaccuaugucagcgccauagcccagacagagaagaauauagaggacaaccccgagaucgaggacgacaucuuccggaagaagcgccugaccaucauggaccugcaccccggggccgggaagaccaagcgguaccuacccgcgaucgugcgggaggccaucaagcgggggcuccgcaccuuaauauuggccccgacccggguugucgccgccgagauggaggaagcgcuucggggccugcccauccgcuaccagacuccggccauccgggcugagcacacaggucgugaaauagucgaccugaugugccacgccaccuucacgaugcgucuccugucacccauucgggugccgaacuacaaccugaucauaauggacgaggcccacuucaccgacccugccagcaucgccgcccgcggcuacaucagcacccgcgucgagaugggcgaggcggcugggaucuucaugaccgcgacaccuccaggcuccagagaccccuucccccagagcaacgcaccgaucauggaugaggagcgcgagauaccggagcgguccuggaacagcgggcacgagugggugaccgacuucaaggguaagaccgugugguucgucccauccauaaaagccggaaacgacauagcggcgugucuccgcaagaauggcaagaagguuauccaacugucccggaagaccuuugacuccgaguacauuaagacacgcaccaacgacugggauuucguggucaccacagauaucuccgaaaugggggccaacuucaaggccgagagagucaucgacccuagacggugcaugaagcccgugauacuaacggacggagaggagcgcguaauacucgccggcccgaugccugugacccacuccaucgcagcgcaacggcgggggagggucggccgcaaccccaaaaacgaaaacgaccaguacaucuauaugggggagccccuugaaaaugacgaggacugcgcucacuggaaggaggccaagaugcugcuggacaacaucaauaccccagagggcaucaucccgucuauguuugagccggagcgcgagaaggucgacgccaucgacggcgaguacaggcugcgcggggaggcccggaagacauucguggaccugaugcgccggggcgaccuccccguauggcuagcauaccgcguggccgccgaggggauaaauuacgcugaccggagguggugcuucgacggcgugaagaacaaccagauccuugaggagaacgucgaagucgagaucuggacgaaggaaggcgagcggaagaaguugaagccgcgcuggcuggacgcccggaucuacagcgaucccuuggcgcucaaagaguuuaaagaguucgccgcaggcagaaaaagccugacccuaaaccucaucacugagaugggccggcugcccaccuucaugacucaaaaggcacgcaacgcgcuggacaaccuugccguacugcacacugccgaggcagggggccgagccuacaaccacgcgcuguccgaacuccccgagacccuggagacccuguuacuccugacguugcuggcgacggucaccgggggcaucuuccuguuccucaugagcggcaaggggauaggcaagaugacccuggggaugugcugcauaaucacagcgagugugcugcugugguaugcgcagauccagccccacuggaucgccgcgucuaucauacuggaguucuuccugaucguucugcugauccccgagccggagaagcagcgcacgccccaagacaaccagcugaccuacgucgugaucgcgauacucaccguggucgccgccaccauggcaaacgagaugggcuuccucgagaaaacgaagaaggacuucgggcugggcuccauagcgacccaacaaccggagagcaauauccucgauaucgaccugcggcccgccuccgccuggacacuguacgccguugcuacaacguucauuacccccauguugcgccauucgaucgagaacaguucagugaacgucagccuuaccgcuaucgccaaccaggcaaccgugcuaaugggcuuagggaagggauggccgcugucaaaaauggacaucggggucccucugcuugccaucggcugcuacagccaagucaaucccaucacguugaccgcggcccugcuacuacugguggcccacuacgccaucauuggccccggccuccaggccaaggcaacccgggaggcacagaagcgcgcggccgccggcaucaugaagaacccaaccguggaugggaucacggucauagaccuggauccgauacccuacgaccccaaguucgagaagcagcugggccaggugaugcuccugguacugugcguaacccagguguugaugaugcggacuaccugggcguuaugugaggcacugacgcucgcgaccgggccaauauccacccucugggaggguaacccugggcgcuucuggaauaccacgaucgcggugucgauggccaacaucuuccgcggcuccuaccuggcgggcgccgggcuccuguucagcauaaugaagaacaccgccaacacccggagaggaacagggaacacgggcgaaacccugggcgagaaguggaagaaccgguuaaacgcccuggggaaguccgaguuccagaucuacaagaaguccggcauccaggaggucgaccggaccuuggcaaaggaggggaucgaacggggcgagaccgaccaccacgccgugagcagggguagcgccaagcuccgguguuuuguggaaagaaaccucgucacacccgaggguaaagugguagaccucgguugcggacggggcgggugguccuacuacugcggcggguugaagaacgucaaggaaguaaaggggcugacgaagggcgggcccggccacgaggagcccaucccgaugagcaccuacggauggaacuuggugcgccuccaguccggcguagacgucuuuuucacgccgcccgagaagugcgacacgcuauuaugcgauaucggugagucuucccccaaucccacaguggaagccggccgaacccugcgcguccugaaccugguggagaauuggcuuaagaacaacacacaauucugcaucaaggugcugaacccguauaugccgagugucaucgagaagauggaggcccugcaacggaaguacggcggggcgcugguccgcaauccgcucucccggaacuccacccacgagauguacuggguuagcaacgccuccgggaauauugucagcucugugaacaugauaagccgcaugcugaucaaccgguucacgaugcgccacaaaaaggccaccuacgagcccgacguagaucuuggauccgggaccaggaacaucgggauugagagcgagaucccuaaucucgacaucauuggcaagcgcaucgagaagauaaagcaggaacacgagaccuccuggcacuaugaccaggaccaccccuacaagaccugggccuaccauggcagcuacgagaccaagcagaccgguucugccucauccauggucaacggcguggugcgccugcugaccaagccgugggacgucauccccauggugacgcagauggcgaugaccgacaccacccccuuugggcagcagcgcgucuucaaggagaaaguagacacgcgcacccaagagcccaaggagggcacgaaaaaguugaugaagaucacggccgaguggcuguggaaggaacugggaaagaagaagaccccgcguaugugcacgcgcgaagaguucacccgaaagguucgcagcaacgccgcccuaggggccauuuucaccgacgagaacaaguggaaguccgcgcgggaggccguggaggacucaggcuucugggagcugguggacaaggagcgcaaucugcaccuugaggggaagugcgagaccugcguauacaacaugaugggcaagcgugagaagaagcugggagaguuugguaaagcaaagggaucccgcgccaucugguauaugugguugggugcgcgguuuuuggaguucgaggcccugggcuuccugaacgaagaccacugguucagccgcgagaacucccuuagcggggucgagggcgaggggcugcacaagcugggcuacauccuccgcgacguguccaagaaggaaggaggggccauguacgccgacgacacagccgguugggacacccggauuaccuuagaggaccugaagaacgaagagauggugacgaaccauauggagggcgaacacaagaaguuagcggaggccaucuucaaacugaccuaucagaauaaggucgugcgcguacaacgcccaacgccccggggcaccguucuagacaucaucagccgccgggaucagcgggggucgggacagguggucacguacggccuaaacacauucaccaacauggaagcccagcugauccggcagauggaaggcgagggcgucuucaaguccauccagcauuugaccguuacggaggagaucgccgugaaaaacuggcucgcccgcgucgggcgagaaaggcugagccgcauggcgauauccggcgacgacuguguagugaagccccuggacgaccgguucgccagcgcccuuaccgcccugaacgacauggguaagguccgcaaggacauccagcagugggaaccuagucguggguggaacgacuggacccaggugcccuucuguagccaccacuuccacgagcugaucaugaaggauggccgugugcuaguugugcccugccggaaccaggaugaguuaauugggcgcgcacgaaucucccagggggcgggauggucgcugcgcgaaacugccugcuugggcaaauccuaugcccagauguggagccugauguacuuccaccggcgcgaccugcggcuggccgcaaacgcgaucugcuccgccguccccagccacuggguuccgacgucccgaaccaccuggagcauccacgcaacccacgaguggaugacgacggaggacaugcugaccguguggaaccggguuuggauacaggagaaucccuggauggaggacaagacucccguugaaagcugggaggagauccccuaccugggcaaacgagaagaccaguggugcgguagccucaucgggcucaccucccgggccacgugggcgaagaacauccagacggccaucaaccaagugcgcagccuaaucgggaacgaggaguacaccgacuauaugccgagcaugaagcguuucaggcgcgaggaggaggaggccggcguguugugguga

SEQ ID NO: 24801 - RNA, 9876 nt, Artificial Sequence
  derived and/or modified CDS sequence (opt11) from DENV-2__AB189124__SS-prME
acagcaggagugaucaucaugaugauacccaccgucauggccuuucauuuaaccacacguaauggcgagccccacaugauuguaagccggcaggaaaagggcaagucccuccuguuuaaaaccgagaacggugugaacauguguacguuaauggccauggaccucggcgagcugugugaggacaccaucaccuauaacuguccccuucuccgccaaaacgaacccgaagauaucgauuguugguguaacagcacguccaccugggucaccuacgggacguguaccgcaaccggcgagcaucggcgcgagaaacggucgguggcccuggcgccccacgugggcauggggcuggaaacucguaccgagaccuggaugaguagcgagggcgccuggaagcacgcgcaaaggauugagaccuggguccuccgccaucccggguuuacgauaauggcggcgauccuugcauauaccaucggcacgaccuacuuccagagaguguuaaucuucauucuccugacagcgguggcccccuccaugacaaugaggugcaucggcaucucgaauagggauuucguggagggcgucuccggcgggagcugggucgauaucgugcuggagcacggcuccugcgugacuacuauggccaaaaacaagccuacacuagacuucgagcuaauaaagaccgaagccaagcacccugccacccuacgcaaguacugcaucgaggccaaauuaaccaauacgacuacagccagccggugcccaacccagggggagccuucccugaaugaggagcaggacaaacgcuucgugugcaagcacucgauggucgaccgaggcuggggcaacggcugcggccuguucggaaagggcgggaucgucacgugugccauguuuacgugcaaaaagaacauggagggcaaggugguccagccggagaaccucgaguacaccauagugaucacgccccacuccggcgaggagaaugccgugggcaacgacacgggcaagcacgggaaggagaucaagguaacgccccagagcucgauaaccgaagcggagcugacuggcuacgguaccgugacgauggaguguagcccccgcaccggccuggacuucaacgaaauggugcuccugcagauggagaauaaggcguggcucguucacaggcagugguucuuagaccugccccugcccuggcucccgggggcugauacccagggcucaaacuggauccagaaggagacacucgugacauucaaaaacccccaugccaaaaagcaggaugucguggugcuuggcagucaagagggcgccaugcacaccgcacucacgggcgcgaccgaaauccagaugucuagcgguaaccugcuguucaccggacaccucaaaugccgccugcggauggacaagcugcaguuaaagggcaugagcuauuccauguguacugggaaguucaaggucguuaaagaaaucgccgagacccagcacgggaccauagugauccgcguacaguacgaaggggacggaagccccugcaagaucccauucgagauuauggaccuugagaagcgucacgugcugggucgccucaucacgguaaaccccaucgucaccgagaaggacucucccgugaacaucgaggcugagccgccauucggggacagcuauaucaucauagggguggaaccgggucaacucaagcugaacugguucaagaagggcuccagcaucgggcagauguucgagacaaccaugcgcggcgccaagaggauggccauccucggugacacggcuugggauuuugggucccugggcggggucuuuaccagcaucggcaaagcccugcaccaaguguucggggccaucuauggugcggcguucuccggcguuucguggaccaugaagauccuaaucggugucguuaucaccuggaucggcaugaacucccgcucuacuucccugaguguuagccuggugcuggugggaguagugacccucuaccugggcgugauggugcaggccgacagcgggugcgucguguccuggaagaacaaggaguugaaaugcggcucggggaucuuuauaacugacaaugugcacaccuggacugagcaauauaaauuccagccggagucacccuccaaacucgccagcgcgauccaaaaggcccaugaggagggcaucuguggcauccgguccguaacccgccucgagaaccugauguggaagcagauuacccccgagcucaaccacauccugucggagaacgaagugaagcugaccaucaugacgggagacaucaagggcaucaugcaggcgggaaagaggucguuacgcccgcagccgaccgagcugaaguacucguggaaggccugggggaaggccaagauguuguccaccgaacuccacaaccacaccuuccugaucgacgggcccgagacggcggagugcccgaacaccaaccgggccuggaauagccuggagguggaggacuauggguuuggagucuucaccaccaauaucuggcucaaguugaaggagcgccaagacgucuucugcgacuccaagcugaugagcgcggccaucaaggacaaccgggcugugcacgccgacauggguuacuggaucgagucggcccucaacgauacguggaagauugaaaaagcgucuuucaucgaggucaaguccugccauuggcccaagagccacacccuguggaguaauggcgugcuggaaagcgagaugauaauccccaagaauuucgccggccccgugucccagcacaacuaccgaccgggauaccacacacaaaccgcggggcccuggcaccucgggaagcuggagauggacuucgacuucugcgagggcacuacggucgucgugaccgaggauugcgggaaccgugggcccagccugcgcaccaccacggcgagcggcaagcucaucacggaguggugcugccggucuugcacccugcccccgcuucgcuaccggggggaggacggcuguugguacgggauggagauccgcccucucaaggagaaagaagagaaccuagucaacagccuggugaccgccggucaugggcagauugacaacuucuccuugggcgugcuggguauggcgcuguuucucgaggagaugcugcguacgcgcgucgguaccaaacacgcgauacugcucguggccgugagcuucgugacccucaucaccgggaauauguccuuucgggaccugggccgggucauggucauggucggcgccacuaugacggacgacaucgggaugggcgugaccuaccucgcacugcuggcugccuucaagguucgccccaccuucgccgccggccucuuguugcgcaagcucacgucgaaggaacugaugaugacgacuaucgggaucguacugcucucccaguccaccauccccgagacgauucuggagcugacggacgcucucgcgcugggcaugauggugcugaagaucgugcgcaauauggagaaguaccagcucgccguuaccauuauggccauccugugcguaccgaacgccguaauccuccagaacgcguggaaggucuccugcaccacgcuggcuguggucagcguuuccccccugcugcucaccagcagucagcagaaagccgacuggauuccucuggcccugacuauaaagggauugaaccccaccgcgauuuuccugaccacucugagccggaccucgaagaagcgcuccuggccgcucaaugaggccaucauggccgugggcaugguuuccauucucgcuuccucacugcucaaaaaugacauccccaugaccggcccauuaguggccggggggcuccucacggugugcuacgucuuaaccgggcgaagcgcagaccuggagcucgagcgcgcagccgacgugcggugggaagaacaggcugagaucagcggcuccagccccauccuguccauuacaauaagcgaagacggguccaugagcauaaagaacgaggaagaagagcagaccuuaacgauccucaucaggaccggucugcuggugaucuccggcuuguucccggucagcauucccaucacagccgcggccugguaucuuugggaggugaaaaaacagcgggcuggggugcugugggacguccccucuccuccgcccguggguaaagccgaacucgaggacggcgccuaucgcauaaagcagaaaggcauccugggguauagucaaauaggggcgggggucuacaaggaagggaccuuucacacgauguggcaugucacgcguggcgccgucuuaaugcacaaggggaagcgcauagagcccucaugggcugacguuaagaaggaccucauuagcuacggugggggcuggaagcuggaaggcgaguggaaggagggggaggaaguccagguuuuagccuuggagccgggcaaaaauccgcgugccguccagaccaagccugggcuguucaaaaccaacaccggaacgauaggggccgucuccuuagacuucagcccgggcaccuccggcuccccuauuguggacaagaaggggaaaguugucggccucuacgggaacggcguaguuacucgcucgggcaccuacgucucagccauugcccagacggagaagaauaucgaggauaaccccgagaucgaggaugacaucuuccggaagaagcgccugacgaucauggaccugcaucccggggccgggaagacgaagagguaccuaccggcgaucgugcgcgaagccaucaagcgggggcuucgcaccuuaauccuugcuccgacgcggguggucgcugcggagauggaggaggcgcuccgaggcuuaccuauaagauaccagacccccgcuauccgggcggagcauaccggccgcgaaaucguagaccugaugugccacgcaaccuuuacgaugcggcuccugucaccuaucagagucccgaacuacaaccugaucauaauggacgaggcgcacuucaccgaccccgcgucuauagccgcccgaggcuacauaagcacacgcguugaaaugggagaggcggcggggaucuucaugaccgcaacgccucccggcagucgggacccguucccucaaagcaaugcccccaucauggacgaggagcgcgaaauccccgagcgguccuggaacagcgggcacgaaugggucaccgacuucaagggcaagaccguuugguucguaccguccaucaaggccgggaacgacaucgcugcgugccucaggaagaacggaaagaaggugauucagcugagccggaaaacuuuugauuccgaauacauaaagacgcgcacaaacgacugggacuucguggugacgacagacauuagcgagaugggugccaacuucaaggcggagcgggugauugacccgcgccggugcaugaaacccgugauccugacugauggggaagaacgcgugauccucgccggcccuaugcccgugacccacuccagcgccgcgcagcggcgcggucggguggggaggaacccgaagaacgagaaugaccaguacauauacaugggggagccgcuggaaaacgacgaagacugcgcucauuggaaagaagccaagaugcuucucgacaauaucaauacccccgaaggcauaaucccgucuauguucgagccagagcgcgaaaaggucgacgccaucgauggagaguaccggcugcgcggggaggcgcggaagacguucguggaccugaugcgccguggggaccuccccgucugguuagcguaccgcguggccgccgaagggaucaacuacgcugaccggcgcuggugcuucgauggcgugaagaauaaucaaauucuggaggagaacguggagguggagaucuggacgaaggagggggagcggaagaagcucaaaccucgauggcuggacgcucggauauacagcgacccccuggcuuugaaagaguuuaaggaauucgcggccggccggaagucccugaccuuaaaccucaucacggagaugggccggcugcccaccuuuaugacgcagaaggcccggaacgcguuagauaaccuagccgugcugcacacugcagaagccgggggucgggccuacaaccacgcgcugagcgagcugccagagacccuggagacccugcuccuguugacacuccuggcaaccgucacugguggaaucuuucuguuucucauguccggcaaggggauaggcaaaaugacccuggggaugugcugcaucaucacggcaucugugcugcucugguacgcccagauccaaccgcacuggauagccgcguccauaauccuggaauucuuccugaucgugcuccugaucccagagccagagaagcagcgcacgccacaggacaaucagcugaccuacgucgugaucgccauccucacaguggucgccgccacuauggccaacgaaaugggguuucuggaaaagacgaagaaagacuuugggcugggcagcaucgcuacccagcagccggaguccaacauccuagacaucgaccugcggcccgcaagcgccuggaccuuguacgccguagccaccaccuucaucacccccaugcuccgacacagcaucgagaauuccagcguuaacgucucguugacagccauagccaaccaggccacuguccugaugggccucgguaagggauggccgcugucaaagauggauaucggagugccucuguuagccaucggcugcuacucgcagguaaaccccauuacccugaccgcggcauuacuccugcugguugcccacuacgccauuaucgggcccggccuccaggccaaggcgacccgggaggcccagaagcgcgcugccgccgguaucaugaagaacccgacaguggauggaauuacggucaucgaccuugacccgauaccguacgaccccaaguucgaaaagcagcuugggcaggugaugcuacucgugcugugugucacgcaggugcuaaugaugcggacgaccugggcgcugugcgaggcccuaacgcucgccacagggccuaucagcacccugugggaggggaauccggggagguucuggaacaccacgauugccguguccauggccaauaucuuccguggcagcuaccuggcgggugccggacuccuguucagcaucaugaaaaacaccgccaacacccggagaggaacggggaacacgggagagacucugggcgagaaguggaagaacagacugaacgcccugggcaaauccgaguuccagauuuauaagaaguccggcauccaagagguggaccgcacccuggcgaaggaggggaucgagcguggugagaccgaccaccacgccgucagccgagggagcgcaaagcuccguugguucguagagcguaaccuggucacgcccgaagggaaggugguagaccugggaugugggcgaggugguuggagcuauuauugcggugggcucaagaacgucaaagaagugaagggacugacaaagggcgggcccggccacgaagaaccuaucccgauguccaccuacggguggaaccuggugcggcuucagagcggcguagauguguucuucacgccgcccgagaagugcgacacgcugcuaugcgacaucggggagucuucgcccaacccuaccguggaggcugggcggacgcucagaguucuaaaccugguggagaacuggcucaagaacaauacgcaauucugcaucaagguacugaauccauacaugccaagugucaucgagaagauggaggcccugcagcggaaguauggcggggcgcuggugcggaacccgcucagucggaacagcacccacgagauguacuggguguccaacgccagcgguaacauugucuccaguguaaacaugaucucccgcaugcugaucaauagguucaccaugcgccacaagaaggcuaccuacgagcccgacguggaccuggggagcggcacccggaacauuggaaucgagagugaaauucccaaccucgacaucauaggcaagcgcauagagaagaucaagcaggagcacgagaccucauggcacuacgaccaggaccaccccuacaagacaugggcuuaccacggcagcuaugagaccaagcaaaccgggagcgccagcucgauggucaacggcgugguacgucuucugacaaaaccaugggaugucauucccauggucacgcagauggcgaugaccgacaccacccccuucgggcaacagaggguguucaaagagaagguagacacccgcacccaggagccuaaggaggggacaaagaagcucaugaagaucaccgccgaguggcuguggaaggagcuaggcaaaaagaagacgccgcggaugugcacacgcgaggaauucacccggaaagugcgcuccaacgccgcccucggugccauauucaccgacgagaacaaguggaagagcgcccgugaggcggucgaagacucgggauucugggagcuuguggacaaggaacgcaaccugcacuuggagggaaaaugcgagacgugcguauacaauaugaugggcaagcgggagaaaaagcugggggaguucggcaaggccaaggguagucgcgcaaucugguauauguggcugggggcgcgguuccucgaguucgaggcccuagguuuccugaacgaggaucacugguucucucgcgagaacagccucuccggggucgagggcgagggccugcacaaguuaggcuacauccuuagagacguuuccaagaaggagggcggggcuauguaugccgacgacacugcaggcugggacaccagaaucacuuuagaggacuuaaagaacgaggagauggugaccaaccacauggagggggaacauaaaaagcucgccgaggccauauuuaaacugacguaccagaacaaaguaguccgagugcagcgcccaacaccuagaggcacagucauggacaucaucagccgccgggaucagcgcgggagcggccaaguggugacguaugggcugaacaccuucacgaacauggaggcacagcucauccggcagauggagggggaggggguguucaagaguauccagcaccucacagugacggaggaaauagccgugaagaauuggcuggccagggucggacgcgaacgcuuaucaaggauggcuaucagcggcgacgauugcguagugaagccacuugacgaccgguucgcaucugcccugacggcccucaacgacaugggaaagguccggaaggauauccaacagugggagcccagcaggggguggaacgacuggacccaggugccguucugcagucaucauuuccacgagcugaucaugaaagacggccgcguucugguugugcccugccggaaccaggaugagcucauagggcgcgcccggaucucucagggcgccggguggucccugcgcgagaccgcgugccuaggcaagagcuacgcccagauguggucacucauguacuuucaucggcgggacuuacgccuugccgccaaugcgaucugcagcgccgugcccucccacugggucccgacgucacgcaccaccuggucaauccacgcgacccaugaguggaugaccacggaggacaugcuaaccguauggaauagggucuggauccaggagaaccccuggauggaggauaagacccccguugagagcugggaggagauccccuaccugggcaaacgggaggaccaguggugcgggucccugauaggccucaccagccgggccacuugggcgaaaaacauccagacggcuaucaaucaggugaggagccugaucgggaacgaggaguacaccgacuauaugccguccaugaagcgguuccgcagagaggaggaggaggcgggcguauuaugguga

SEQ ID NO: 24802 - RNA, 9876 nt, Artificial Sequence
  derived and/or modified CDS sequence (opt11) from DENV-2__AB122020__SS-prME
acugccggcgugaucgucaugcugauccccaccgcgauggccuuccaccucaccacccggaacggggagccccacaugauagucggccggcaggagaaggggaagucccugcuguucaagaccgaggauggcgugaacaugugcacccugauggccaucgaucugggcgagcugugcgaggacacaaucacauacaaaugcccauuacugcgccagaaugagcccgaggauauugacugcuggugcaacucaaccagcaccuggguuaccuacgguaccuguaccaccacuggugagcaucggcgcgagaagcgcuccguugcccuggugccccacgucgggauggggcucgagacaagaaccgagaccuggaugagcuccgaaggggccuggaagcacgugcaacggaucgagacuuggaucuugcgccacccgggcuucacgaucauggccgcgauccuggccuacaccaucgggaccacgcacuuccagcgggcacucaucuucauccugcugaccgcuguggcgcccaguaugaccaugcguuguaucggcaucuccaaccgggacuucgucgagggcgugagcggggguuccuggguggauaucguacucgagcacgggagcugcgugaccaccauggccaaaaacaagcccacacuggacuucgagcuaaucaagaccgaagccaagcaacccgccacccucaggaaguacugcaucgaggcgaagcuuacgaauaccaccaccgagagccggugcccgacucagggcgagcccagccuuaaugaagaacaggacaagcgguucauauguaagcacuccaugguagaccgaggaugggggaacggcugugggcuguucggaaaagggggcaucguaaccugcgcgauguucacuugcaagaagaacauggaggggaagaucgugcagcccgagaaccuggaguacaccaucgucaucacgccccacucgggcgaggagcacgcaguaggcaacgacaccggcaagcacggaaaggagauaaagaucaccccgcaguccuccaccaccgaggccgaacugacgggguacggcaccgucaccauggagugcagcccucggaccggccucgauuucaacgagaugguguugcugcagauggaggacaaggccuggcucguccaccggcaaugguuccuggaccugccccuccccugguugccaggggccgacacucagggcagcaauuggauacaaaaggagacccuggugaccuucaagaauccccacgcaaagaagcaggacguggucgugcucgggucccaagagggcgccaugcauaccgcccugacgggggcaaccgaaauccagaugucgucaggcaaucugcuguucaccggccaccugaaauguagacugcgaauggauaagcuccaguugaaagguauguccuacagcaugugcacaggcaaauucaagaucgucaaggaaaucgccgaaacucagcacggaacuauagucauucgcgugcaguacgagggcgauggaagcccuugcaagauccccuuugagauuacagaucuggaaaagcgacacguacucggccggcugaucaccgugaacccgaucgugacggaaaaggauagcccggucaacauagaggcugagccgccguucggcgacuccuacaucaucguggggguggagccgggccagcugaagcucaacugguucaagaaggggagcuccauaggccagauguuugagaccaccaugcgcggagccaagcgaauggccaucuuaggugacaccgcuugggacuucgggucauuggguggugucuucacguccaucgggaaggcccuccaccagguguucggggcgaucuauggagccgccuucagcggaguguccuggacgaugaagauacugaucgguguuauaaucaccuggauagggaugaacagcagauccaccagccuguccgugagccuggugcucgucggcguggucacccuguaccugggggcuaugguccaggcggacagcggcugcaucgugagcuggaagaacaaggaguuaaagugcggcuccgggaucuucaucaccgacaacgugcacaccuggacagagcaguacaaauuucaacccgagagcccaucaaagcuggcuagcgcuauucagaaagcccacgaggagggcaucugcgggauccgaagcgucacgaggcuggagaaccucauguggaagcagaucacccccgagcucaaccacauccucagcgagaacgaggugaagcucaccaucaugaccggcgacaucaaggggauuaugcaggccggcaagcggagccugcggccgcaaccgacggaacucaaauacaguuggaagacguggggcaaagcgaagaugcuaagcaccgagucccacaaccagaccuucuuaaucgacgggccugagacagcugagugcccuaacaccaaccgggccuggaacagccuggaaguggaggauuacggauucggugucuucaccaccaacaucuggcucaaacugcgugagaagcaggacguauucugcgacuccaaacugaugagcgccgccaucaaggacaaccgggcggugcaugccgacaugggcuacuggaucgaguccgccuuaaaugacaccuggaagauggagaaggccagcuucauugaggugaaguccugucacuggcccaagagccacacgcuaugguccaacggcguucucgagagcgagaugaucauccccaagaauuucgccgggcccgugucccaacauaacuacaggcccggauaucacacacagaccgcggggcccuggcauuuggggaagcuggagauggauuuugauuucugcgagggcacgacggucguggugacugaggacugugguaaucggggcccaagcuuacgcaccacuacggccagcgggaagcucaucacugaauggugcugcagguccuguacccuccccccgcuacguuaccggggugaagacgguugcugguacggcauggagauccgcccccuaaaagagaaggaagagaauuuagucaacagccuggugaccgccggucacggacaaauugacaauuucucccucggagugcugggaauggcccuguuucucgaggagaugcugcgaacacgcgucggaaccaagcacgcgauucugcucguugcucucucuuuugugacacugauaaccgggaacauguccuuccgggaccucggucgcgucauggugaugguaggggccacgaugaccgacgacaucggcaugggcgugaccuaccuggcccugcuugccgcguucaaggugcgcccgacuuuugccgcugggcuccuguugcggaaguugacgagcaaagagcugaugauggccacuaucggcaucgcccugcugucccagagcacccugccugaaaccauacucgagcugacggacgcgcuugcccucgggaugaugguguugaaaaucguaaggaacauggaaaaguaccagcuggccgugaccaucauggccaucucuugugugccgaacgccgugauccuccaaaacgcguggaaggugucaugcaccauucuggccgccguguccguaagcccccugcuccugaccuccagccagcagaaagccgauuggaucccccuggcgcucacgauuaaagguuugaacccuaccgccaucuuccugaccacccucucucgaacgagcaagaaacggaguuggccucuaaacgaggccaucauggccguugggaugguaagcauacuggccuccagccuucugaagaacgacauccccaugaccgggccccugguggcgggcgggcucuugaccgugugcuacguccugaccggccggagcgccgaccucgaguuggaacgcgccgccgacgugaagugggaagaucaggccgagaucuccggcagcucccccauacuguccauaacgauuuccgaggacgguagcauguccauaaagaacgaagaggaggaacagacccuuaccauccugauacggaccggccugcugguuaucagcggggucuuuccagugucuaucccaauaaccgccgccgccugguaccugugggaggugaagaaacagcgcgccggcguucugugggacguuccgagcccaccgcccguagggaaggcggaacucgaggacggcgcguaucggaucaagcagcgcgggauccuaggguauucccagauuggcgcaggggucuacaaggagggcacguuccacacuauguggcacgugacacgcggagccgugcugaugcaccgcggcaagcgaaucgagcccagcugggccgacgucaagaaggaccucaucuccuacgggggcggcuggaaguuagagggggaguggaaagagggcgaggagguccagguacuggcccuugagcccgggaaaaacccacgcgcgguccaaacgaagcccgguaucuucaaaacuaacaccgggacgaucggcgccguuagccuggacuucucccccggcaccagcggguccccaauaguggacaggaaggguaaggugguggggcuguacgguaacgguguggucacgcgcaguggagccuacguguccgccaucgcgcagaccgagaaguccaucgaggacaaccccgagaucgaggacgacaucuuccggaagaagcgucucaccaucauggaccugcaccccggugcagggaagaccaagcgguacuuacccgcuauugugcgcgaggcuaucaagcggggacugcgcacacucaucuuggcaccgacccgcgucguugcggccgagauggaggaggccuuacgaggguugccuauccgcuaccaaacccccgccauccgggcggagcacaccggacgugagaucguggaucucaugugccacgcgaccuuuaccaugcggcugcucagccccguucgcgugccaaacuacaaucuaaucaucauggacgaggcacauuucaccgaccccgccuccauugcggcccgcggcuacaucagcacccgcgucgagaugggggaggcggccggcaucuucaugaccgccacgccgcccgggucccgggacccauucccucaguccaacgcucccaucauggacgaggagcgagagauccccgagcgauccuggaacaguggucacgagugggucacugauuucaaggggaaaaccgugugguucgugccguccaucaaggcgggaaaugacaucgccgccugccugcguaagaacggcaagaaggugauccagcugagccggaagacguucgauuccgaguacguaaagacacgcgcgaacgauugggacuucgugguuaccaccgacaucucugagaugggggccaacuuuaaggcggagcgagugaucgacccccgcagaugcaugaagccugugauauuaacggacggggaagagcgcgucauccuggccggacccaugccggugacccacuccagugccgcccagcgucgcggacgaauugggcggaaccccaagaacgagaaugaccaguacaucuacaugggcgagccgcucgagaacgacgaggacugcgcccacuggaaagaggccaagaugcugcuggacaacauuaacacccccgagggcaucauuccgucaauguucgaacccgagcgagagaaaguagaugccauagauggggaguacaggcuccgaggcgaggcccggaagaccuucgucgaccugaugcgccgcggggaccugcccguauggcucgcuuacaaaguggcugcggagggcaucaacuacgcggaccgcaagugguguuucgacgggaucaagaacaaccagauccuagaagagaacgucgagguggagaucuggacgaaggagggcgagagaaagaagcugaagccgcgcuggcucgacgcccggaucuacagcgacccccuggcguugaaggaguucaaggaguucgcggccggccgcaagucccucaccuugaaccuuaucaccgagaugggccgccuccccacauucaugacgcaaaaggcccgcaaugcccuggacaaucuggccguucuccacaccgcggaggucggcgggcgagccuacaaccacgcacuaagcgagcugcccgagacauuggagacucuucuguuacugacgcugcucgcgaccgugaccggcggcaucuucuuguuccuaaugucugggaagggcaucgggaaaaugacacucggcaugugcugcaucaucaccgccagcauucugcucugguacgcgcagauacaaccgcacuggaucgcagccucgauuauccucgaguucuuccugaucguccugcucauccccgagcccgagaaacaacgcacuccccaggacaaccagcuaaccuacguggugaucgccauccugaccgugguggccgcgaccauggccaacgagauggguuuccucgaaaagacgaagaaggaccugggauucggcucgaucaccacccaggagucugaauccaacauccuggacauugaccuccggccugccagcgcguggacucuuuacgccguggcgacuaccuucgucacuccuaugcugcgccauuccaucgagaacagcuccgugaauguaagccucaccgccaucgccaaucaggccacgguccugauggggcucggcaagggguggccccuguccaaaauggacauaggagugccccugcuagccaucggguguuacagccaggugaacccgaucacccuaacugccgccuugcugcuccuggucgcgcauuacgccaucaucggcccuggccugcaggcgaaggccacccgggaggcccagaagagggcggccgcgggcaucaugaagaaccccacgguggacggcaucaccguuaucgaccucgagcccaucccguacgacccaaaguuugagaagcagcuggggcaggucaugcugcucaucuuaugcgugacucaggugcuaaugaugcggaccacaugggcccucugcgaggcccucacccuggccaccggccccaucuccacccucugggaggggaaccccgggcgcuucuggaauacgaccaucgccguaagcauggcaaacaucuuccgggguuccuaccuggccggcgccggccuucuuuuuagcaucaugaagaauaccacaaacacgcgccgcggaaccggcaacgugggcgagacguugggcgagaaauggaaguccagauugaacgcccucgggaagagcgaguuccagaucuacaagaaguccgguauccaggaaguggaccgcacccuggcaaaagagggaaucaagcgcggugaaacggaccaccacgcugugucacgcggcucugccaagcugcggugguuuguggaaagaaacauggugaccccggaaggcaagguuguggaccucgggugcggccgcggaggcuggagcuacuacugcgggggccugaagaacgugcgcgaggucaagggccugacaaaaggcggccccgggcaugaggagccaauuccuaugucuaccuacggcuggaaccucguucggcugcagagcggugucgacgucuuuuuuacgccucccgagaaaugcgacacgcuccucugugacaucggcgagagcucccccaaccccaccauagaagcaggccgcacccugcgggugcugaaccuuguggaaaauuggcugaauaacaauacccaauucugcaucaagguccuaaacccguacaugccaagcgugaucgagaagauggagacgcuacagagaaaguacgggggugcacuuguccggaacccccugucccgcaacagcacccaugagauguacuggguguccaacgcgaccggcaacaucgugagcuccgugaauaugaucagccggauguuaaucaacagauucacaaugaagcauaagaaggccacguacgagccggacguagaccucggcagcgggacccggaauaucgggaucgagagcgagauccccaaccuggauauuaucggaaagagaaucgagaagaucaaacaggagcaugaaaccuccuggcacuacgaccaggaucaccccuacaaaaccugggccuaccacgggagcuacgagacgaagcagaccggcuccgccagcuccauggugaacggggugguccgccugcucaccaagcccugggacgucgucccgauggucacacagauggcuaugacugacacgaccccguuuggccagcagcgcguguucaaggagaagguggacacccgcacgcaagaaccgaaggaaggaaccaagaagcugaugaaaauaaccgcggaauggcuguggaaggaacucggaaaggagaagacgccccggaugugcacgcgcgaggaguuuacccggaagguccguagcaacgcugcccugggcgcgauauucaccgaugagaauaaguggaaguccgcccgcgaggcuguugaggacgggcgcuucugggagcugguggaccgcgagcggaaccuacaccuagagggcaagugcgagaccugcgucuacaacaugaugggaaagcgggagaagaagcugggggaauuuggcaaggccaaggguagccgcgccaucugguacauguggcucggcgcacgguuccuggaguucgaagcgcugggguuccucaacgaggaccauugguuuucacguggcaacucccugucgggaguggagggcgagggccugcaccggcucggcuacauccugcgcgagguggguaagaaggaaggcggcgcuauguacgccgacgacacggccgggugggacacaaggaucacccuggaggaccuaaagaacgaagagauggugaccaaccacaugaagggcgagcauaaaaagcuggccgaggcgaucuucaaacugacguaccaaaacaaggugguccgcguucagcggccgacgccacgcgguacagugauggacaucauaucacggaaggaccaacgaggcuccgggcaagucgggacuuacggccucaauacuuucacgaacauggaggcccagcugauccgccagauggagggagaggggaucuucaaguccauccaacaccugaccgccaccgaggagauugcagugcagaacuggcucgcccggguugggcgcgagcggcugagccgcauggcaaucucuggugacgacugugucgucaagccgauagacgaccgguucgccuccgcccugacggcacuuaacgauaugggcaaagugcgcaaggacauccagcaaugggaacccucccguggguggaacgacuggacccaggucccuuuuugcagccaccacuuccacgaauuagugaugaaggacggacgcguguuggucgugcccugccggaaccaagacgagcucaucggccgcgcacggauuucccaaggggcuggcuggucccuuaaggagacagccugccuggggaaguccuacgcucagauguggacgcucauguacuuccaccgccgggaccugagacuggccgccaacgcgaucugcagcgccgugcccucucacugggugcccaccagccggacgaccugguccauccaugccaagcacgaguggaugacaaccgaggacaugcuagccguguggaaccgcguguggauccaggagaauccguggauggaggacaaaacccccgucgagagcugggaggaggugcccuaccugggaaagcgcgaggaccaauggugcgguucccuuaucggccucaccagccgcgcgacaugggccaagaacauucagaccgccaucaaucaggugcggucacugaucggcaacgaggaauacacggacuacaugccguccaugaagcgcuuccgcagagaggaagaagaggccgguguucuaugguga

SEQ ID NO: 24803 - RNA, 9876 nt, Artificial Sequence
  derived and/or modified CDS sequence (opt11) from DENV-2__LC121816__SS-prME
accguggggaugaucauuaugcugauccccacggccauggccuuucaccucaccacccgcaacggugaaccacacaugauagucagccggcaggagaagggcaagagccugcuguuuaagacggaggacggaguaaacaugugcacccucauggccauggauuugggggagcugugcgaggacacuguuaccuacaauugcccccuccugcgucagaaugaacccgaggacaucgacugcugguguaacagcacaaguaccugggugacauacgggaccugcaccgccaccggggagcaccggcgcgaaaagcggucgguagcucugguaccgcacguaggaaugggcuuagagacccgaaccgagacguggauguccucagagggugccuggaaacacgcccaacggauugagaccuggaucuuacgccaccccggauucacgaucauggcagcuauccuggcgcacaccaucggaaccaccuacuuucagcggguucuuauauucaucuugcugacagcuguggcgcccuccaugaccaugcgcugcaucgggaucucuaaucgggauuucguggaagggguguccggcgggagcuggguugacaucguccuagagcacggcucgugcgugacaacuauggcuaagaacaagccgacguuagauuuugagcucauuaaaaccgaggccaaacagcccgccacguuacgcaaguacugcauugaggccaaacuaaccaauacuacaaccgcgagucggugcccgacgcagggggagccuuccuuaaacgaggagcaggacaagcgcuucguauguaagcacagcauggucgaccggggauggggcaaugggugcggccucuucgggaaaggcggaaucgugaccugcgccauguuuacguguaagaagaacauggaggguaagauugugcaacccgagaaccuggaguacacgaucgucaucacaccccacuccggcgaagagaaugccgucgggaacgacacgggaaagcacgggaaggaggugaaggucaccccgcaguccaguaucacggaggcggagcucacgggcuacgguaccgugacgauggagugcaguccccgcaccggcuuagacuucaacgagauggugcuguugcagauggagaacaaggcuuggcuuguacaccgccagugguuccuggacuuaccucuccccugguugccgggcgcggacacccaagggucgaacuggauccagaaggaaacccuggugacguucaagaauccccaugccaagaaacaggacguagugguguuaggcagccaggagggagcuaugcacacggcccugaccggcgccacagaaauacaaauguccuccgggaaccucuuguucacgggccaucugaagugccgccuacggauggauaagcugcagcuuaaaggcaugucauacuccauguguaccgggaaguucaaggucgugaaagaaaucgcggagacccagcacggcacgaucgugauucguguacaguacgagggugacggcucucccugcaagauacccuuugagaucauggacuuagagaagaggcacguguuagggcgucuuauuacgguuaacccaauagucaccgagcgcgauuccccagugaacauugaggccgagccaccuuucggugacucauauaucaucauugggguggaaccggggcagcugaagcucuccugguucaaaaagggcagcucaauugggcaaauguucgagaccaccaugcggggcgcaaaacgcauggccauccugggcgacacagccugggacuucgguagccucggcggggucuuuacgagcaucggcaaggcgcugcaucaaguguuuggggccaucuacggcgcagcguucagcggcguguccuggaccaugaagauucuaauaggggucguaaucacuuggaucgggaugaacagccgguccacgagcuuauccgugagcuuaguccucguagggguggucaccuuauaccugggcgugauggugcaggcggacuccgguugcgucgugagcuggaaaaacaaggagcuuaaaugcggcagcggcaucuucaucacugacaacgugcacaccuggacggagcaguauaaauuccagcccgagagccccagcaagcuggccuccgccauccagaaggccuacgaagagggaaucugcggcauucgaucuguaacacggcuggagaaccucauguggaaacaaauaacaccagaacugaaccauauucuguccgagaacgaggugaagcugacgaucaugacgggugacaucaagggcauaaugcaggccgguaagaggagcuugcggccgcagcccaccgaauuaaaauacucuuggaagaccugggggaaggcgaaaauguugagcaccgagcaucauaaccagacguugcugauugacgguccugagaccgcggaguguccgaacaccaaucgcgccuggaacagucucgaggucgaagacuacggguuuggcgucuucaccacgaacaucuggcugaagcugaaggagcggcaggacguguucugcgacagcaagcucauguccgccgccaucaaggacaacagagcggugcacgcggacaugggauacuggauugagagcgcucugaacgacaccuggaaaauugagaaggccaguuucaucgaggucaagagcugucacuggcccaagucgcacacacuauggagcaauggcgugcucgagagugagaugauaauccccaagaacuucgccgguccggugucccaacacaacuaucggccgggauaucacacacagaccgcggguccauggcaccucggcaagcuggagauggacuuugacuucugcgaagguacgacaguggucgugaccgaggacugcgguaaccgcggucccagcuugaggaccacgaccgccucagggaaauuaauaacagaauggugcugccgaagcugcacccuacccccgcuccgguaccgcggggaagacggcuguugguaugguauggagauccgaccucuuaaggagaaggaggagaacuuggugaacucucuggucacggccggacauggacagaucgacaacuucagccugggcguacuuggcauggcccucuuccuggaggaaaugcuuaggacccgggucggcaccaagcacgcacuccuccugguggccguuucuuuuaugacucucauaacgggcaacaugagcuuccgcgaucucggacgcguaauggucauggucggcgcggccaugaccgaugacauagggaugggcgucaccuaccuggccuuauuagcugcuuucaagguacggcccacuuuugccgcaggccugcuucugcgcaagcugacgucaaaggaacucaugaugaccaccauagggaucgugcugcuuucucaguccaccauucccgagaccauccucgagcugacggacgcucuggcgcucgggaugaugauccuuaagaucgugagaaauauggaaaaguaucagcuugcagugaccaucauggccauccucugcgucccgaacgccgugauccugcagaacgccuggaagguuagcugcacgauccuggcgguuguguccgugacgccccuccucuugaccagcagccggcagaaggccgacuggauaccucuagcccugaccauaaaggggcucaaccccaccgccaucuuccucacuacccugucgcggaccaauaaaaagcgcuccuggccucuuaacgaagcgaucauggcgguuggcauggucucaauacuugcuuccagucugcugaagaacgacauucccaugaccggaccccucguggcggggggacugcucacggucuguuaugugcucacagggagaucggccgaucuggaacuggagcgcgcggcugacguccggugggaggaccaggcggagauuagcggcagcucacccauccucagcaucacuaucucagaggauggguccauguccauuaagaacgaggaggaggagcagacccugacgauccugauacgcaccggccuacuggucaucucaggccuguucccggugagcauucccaucaccgcagccgcuugguaccucugggaggugaagaagcagcgggcggggguccucugggaugucccgagcccaccgcccguggggaaggccgaacuggaggacggagcuuaccgcaucaagcaaaagggcauccuuggguacucccagaucggcgcuggcgucuacaaggaagggaccuuccacaccauguggcaugucacgcgaggugcgguucugaugcacaagggcaaaaggauagagccgagcugggccgacguacgcaaggaucucaucucauacggcggcggcuggaaauuggagggcgaguggaaggagggggaagagguccaggugcuggcccuggaaccggguaagaauccccgcgccguccaaacuaagccaggccuguucaaaaccgacaccgguacgaucggggccguuagccuagacuucucccccggcaccagcggguccccaaucguggacaagaaagggaagguggugggccuuuacgggaacggcguggucacccguagcggcaccuacguguccgcgaucgcccagaccgaaaagaguauugaagacaaccccgagaucgaagacgauaucuuccgcaagcgucgccugaccaucauggaccuccaucccggggcggguaagaccaagcgcuacuuaccggcuauugugcgugaagcgaucaagcgagggcuucgaacccuuauccuggccccgacuagggucguagcagccgagauggaggaggcucugagaggcuugccaauccgcuaccagacccccgcgauacgggcagaacauacaggaagagaaaucgucgauuugaugugccacgcaaccuucacgaugaggcuguugucccccguacgcgugccaaacuauaaccucauuaucauggaugaggcccacuucaccgacccagccaguauagcggccaggggguacaucagcaccaggguggaaaugggagaggccgcggggauuuuuaugaccgccacgccccccggcucgcgggacccguuuccccagagcaaugcaccuauuauggacgaggaacgcgagauccccgagcggaguuggaacuccggacacgagugggugacagacuucaagggcaagaccgugugguucgugccguccaucaaggccggcaaugauauagccgccugucugcgcaagaacggcaagaaggucauacaacucagccggaaaacauuugacuccgaauauauuaaaacccgcacuaacgacugggacuuuguggugacgaccgacaucagcgagaugggcgcaaacuuuaaggcagaacgcgucaucgauccccgccguugcaugaagcccgucauccugacggacggggaggagagagucaucuuggccggucccaugccuguaacucauuccagcgcugcucagcgccguggacgcaucggccggaacccaaagaacgagaacgaccaauauauauauaugggggagccccucgagaacgacgaggacugcgcgcacuggaaggaggccaagaugcugcuggacaacaucaauacccccgagggcaucauaccgucaauguuugaaccggagcgcgagaagguggaugcgauugacggagaguaccggcugcgcggggaagcccggaaaaccuucgucgaccugaugcgccggggcgaccuacccgucuggcucgccuaccgugucgcggccgaagggaucaacuacgccgaccggcguuggugcuuugaugguguaaagaacaaccagauccuggaggagaauguggagguggagaucuggaccaaggagggcgagcggaaaaaguuaaagccucgcuggcucgacgcgcggaucuacucugacccccuggcauuaaaggaauucaaggaauucgcggccgggcgaaaguccuuaacccugaaucugaucaccgagauggggcggcuccccacguuuaugacacagaaggcucgcaacgcucuggacaaccuggcggucuuacacaccgcugaggcaggcggacgggcguacaaccacgcccugagugagcugccugaaacccucgagacccuguuauugcuaacgcuccucgcgaccguaaccggcgggaucuuccuguucuuaauguccggcaaggguauugggaaaaugacacuugggauguguuguaucauuacggcgaguauacugcugugguaugcccaaauccaaccccacuggaucgccgccuccaucauccucgaguucuuucugauugugcugcuaauccccgagcccgagaagcagcgcacgccccaggacaaccaacugacauauguggugaucgcgauucugaccguggucgccgcuacgauggccaacgagaugggauuucuagagaagacgaagaaggacuucgggcugggaagcaucgcgacccagcagccggaauccaauauacuggacaucgaccuccggccggccagcgccuggacuuuauacgcuguggcuacaacguuuauuacccccaugcugcgccacaguauugagaacagcuccgugaacgucucacucaccgccaucgcgaaccaggcgacugugcucauggggcuggggaagggcuggccgcucagcaaaauggacaucggggucccacugcuggccaucggcuguuacagccaggucaaccccauaacgcucaccgccgcccugcugcuccuuguggcccacuacgccaucaucggcccggggcugcaggccaaggcuacgcgggaagcucagaaaagagcggcagccgguaucaugaagaauccuacaguggacgggaucacugucaucgacuuagauccaauccccuacgaccccaaguucgagaagcagcuuggccaagugauguugcucgugcugugugucacgcagguacugaugaugcggaccacuugggcccucugcgaggcucugacgcuggccacugggcccaucuccacccucugggagggcaauccgggacgcuucuggaacaccacgaucgcaguguccauggcuaauauauuccgcggaagcuaccuggcaggugcuggauuacucuuuucaaucaugaagaauacgaccaacacccggcgcggcacgggcaauaccggagagacgcuuggcgagaaguggaagaaccggcugaaugcccucggcaaaagcgaguuccaaacuuauaaaaaguccggcauacaggaggucgacagaacgcuggcgaaggagggcaucaagcgcggugagaccgaucaucacgccgugucacgcggguccgcgaaacugcggugguucguggagcggaaccuugugacacccgagggcaaagugguggacuuggguugcgggagaggcggauggagcuacuauugugggggccugaagaauguucgcgagguuaaaggucugaccaaggggggacccggccacgaagagccaauaccuaugucaacguacgguuggaaccugguccggcuacagagcggcgucgacguguuuuucacgccccccgagaagugcgacacucuccuaugcgacaucggcgagucaagcccaaacccuaccguggaggccggccgcacccugcggguucucaacuugguagaaaacuggcugaacaacaacacacaguucuguaucaaaguucugaaucccuauaugcccuccgucaucgagaagauggaagcccuccagcgcaaguacggcggugcccucguacgcaacccgcugucuaggaauucgacccacgagauguauuggguguccaacgcaagcggcaauaucguaucaucugugaacaugaucucgaggauguuaaucaaccgguucaccaugcggcacaagaaggcgacguacgagccggacguggaccugggaagcgggacgcggaacauugguauugaaucagagacccccaaccuggacaucaucggcaaacgcaucgagaaaauccggcaagagcacgagaccucuuggcauuacgaucaggaccaucccuauaaaaccugggccuaccacgguucauacgaaaccaagcaaacuggcuccgcgucaucgauggucaacgggguaguccgccuacugacgaaaccgugggacgugauccccauggugacccaaauggccaugacggacaccacccccuuugggcagcagaggguuuucaaagagaaggucgacacccgcacccaggagccuaaggagggcaccaagaagcugaugaaaaucaccgccaagugguuauggaaggaguuaggcaagaaaaagacaccgcgcauguguacgcgcgaggaguucacuaggaagguccgaagcaacgcggcuuuaggggccauuuucaccgaugagaacaaguggaaguccgcccgggaggccguagaggacucccgcuucugggagcucguggauaaggaacggaaccugcaccuggagggcaagugcgagaccugugucuauaacaugaugggcaagcgcgagaaaaaguugggggaguucggaaaagcaaaggggagccgggccaucugguauaugugguuaggugccagauuccuggaguucgaggcccucggcuuucugaacgaggaccacugguucucgagggaaaacagccugaguggcguugagggggaaggccuccacaagcugggguacauccugcgagacgugucaaaaaaggagggcggcgccauguacgccgacgacacggcagguugggacacgcggaucaccuuggaggaucugaagaacgaggaaauggugaccaaccacauggagggggaacacaagaaauuggccgaggcaaucuucaagcucacuuaccagaacaaggucgugcgcgugcagcgccccacgccgcggggaaccgucauggauaucaucagccgccgugaccagaggggguccgggcagguaggcacuuacggccugaauacguucaccaacaugggugcgcaacugauccgucaaauggagggcgagggcguguucaagagcauacaacaccugacugcuaccgaggaaaucgcuguccaagacuggcuggccagagugggccgcgaacgccugucccguauggccaucaguggggacgacugcguggucaaaccccucgacgaccgcuucgcguccgccuuaacggcguugaacgacauggggaaagugcggaaagauauccagcaaugggagccgucccggggcuggaaugauuggacccaggugccauucugcucucaucacuuccacgaguuaaucaugaaggacgggcggguucuggugguuccgugcagaaaccaggacgagcugaucgggcgggcgcgcaucucgcagggcgcaggcuggucccuccgggagacagcaugccuggggaaaucuuaugcccagauguggucacucauguacuuccaccgccgggaccuccgccuggcagccaacgccauaugcagcgccguccccucccacugggucccgaccagccgcaccacguggucgauccacgcaaagcaugaauggaugacaacagaggauaugcugaccguguggaaucgugucuggauucaggaaaaccccuggauggaggauaagacacccguggagaguugggaagagauccccuaccucgggaaacgagaggaucaguggugcgggucccugauagggcuaaccucucgagcaacaugggccaagaacauacaaacggcgauuaaccagguaaggagccugaucggaaacgaagaguauacggauuacaugccauccaugaagcguuuccgccgggaagaggaggaggcugguguccucugguga

SEQ ID NO: 24804 - RNA, 9876 nt, Artificial Sequence
  derived and/or modified CDS sequence (opt11) from DENV-2__LC111438__SS-prME
accgcaggcauuaucaucaugaugauucccacggugauggcauuccaccugacuacgagaaacggggaaccccacaugaucgucagccggcaggaaaagggcaaaagccuccuguucaaaaccgaaaacggggugaauaugugcacccugauggcuauggaccucggggaacuuugcgaggacaccaucacuuacaacugcccccugcuccgccagaacgagcccgaggacaucgauugcuggugcaacagcaccucaaccugggugaccuacgguaccugcaccgccaccggcgagcaucgacgcgagaagcggagcgucgccuuagugccccacguuggcauggggcuggagacccgcaccgaaacauggauguccagcgagggugccuggaagcacgcccagcggaucgaaaccugggugcuacgccaccccggguucaccaucauggcggcuauucuggccuauaccaucgguaccacgcauuuucagcguguacugaucuucauccuccuuacagccguggcgcccuccaugaccaugcgcugcaucgggaucagcaaccgggacuuugucgaaggcgugaguggcgggucguggguggacaucguccuggagcacggguccugugugaccaccauggccaaaaacaagcccacucucgacuucgagcugaucaagacagaagcuaagcaccccgccacccugcgcaaguacugcauugaggcgaagcucaccaauacuaccaccgcaagccggugcccaacgcagggagagccuucccugaaugaggagcaggacaagagguucguaugcaagcacagcauggucgaccggggcuggggcaacggcuguggccuguucgggaagggcgggauaguuacgugugccauguucacaugcaaaaagaacauggaaggcaagguuguccagcccgagaaucucgaguacaccaucgugaucacaccgcacucaggggaggagaacgccguggggaacgacacgggcaagcacgggaaggagaucaagguuacgccgcagagcuccaucaccgaggccgagcugaccggauacgggaccgugacaauggaaugcagcccccggaccggccuggacuucaacgaaaugguccuccugcagauggagaauaaggcauggcugguccaccgucagugguuccucgaccugccccugcccuggcugccgggagcggauacccagggguccaacuggauucagaaggagacacuggugacguucaagaauccgcaugccaagaagcaggacgucgugguuuuaggcagccaggaaggcgccaugcauaccgcccucaccggcgcuacggagauccagaugucauccgggaaccuguuauucaccggccaccucaagugccgccugcggauggacaagcugcagcucaagggcaugagcuacagcaugugcaccgggaaguuuaaagucgugaaggagaucgcggagacccaacacggcaccauugugauccgcguccaguacgagggggacgggucaccuugcaagauccccuuugagaucauggaccuugaaaagcgccauguacugggccgccucaucaccgugaacccuaucgucaccgagaaggauagcccuguuaauaucgaggccgagccuccuuucggggauagcuacaucauaauuggcguggaaccugggcaacugaaacuauccugguucaagaaaggcagcuccaucgggcagauguucgaaaccacuaugcgcggcgccaaacggauggcgauccucggcgacacagccugggacuucgggucccuaggaggggucuuuaccucgaucggcaaggcgcugcaccaagucuucggcgccaucuauggcgcggccuucucgggcguguccuggaccaugaagaucuuaaucggggucgugauuaccuggauagggaugaacagccgcagcacgucucuguccgugucccuggucuuaguggggguagucacccuguacuuaggcgugauggugcaggcagacuccggcuguguagugagcuggaagaacaaggagcugaagugcggcagcggaaucuucaucacugacaacgugcacaccuggacggaacaauauaaguuccagcccgagagcccgcccaagcucgcgucggccauccagaaggcccaugaagaggggauuugcggcauccggagcgucacccgucuggagaaccugauguggaaacagaucaccccggaguugaaccacauccugagcgagaacgaggugaagcugaccaucaugacgggggacaucaaaggaauaaugcaagcuggcaagagaucccuccgaccccagcccacagagcugaaguacagcuggaaggccugggguaaagccaagaugcugucgaccgagcuccacaaccacaccuucuuaaucgacgguccggagacggccgagugccccaacacgaaccgggccuggaacagccuggaaguggaggacuacggguucggcgucuucaccacuaacaucuggcucaagcugaaggagaagcaggacguguucugcgacuccaagcuaaugagcgccgcgaucaaggacaaccgcgccgugcacgcugacaugggguauuggaucgaguccgcucucaacgacacguggaagaucgagaaggcuaguuucaucgaggucaaaucuugccacuggcccaagagccacacgcuguggucuaacggcguguuagagucagagaugauuauccccaagaacuucgccggaccagugagucagcauaacuaccggcccggguaccacacccagaccgccggcccauggcaccucggcagccuggagauggacuucgacuucugcgagggcaccacggucgucguuacugaggacugcggaaaccguggcccaagccuccggaccaccacggcguccggcaaacuuaucaccgaguggugcugccgaucgugcacccugccgccccuacgcuaucgcggggaggacgggugcugguacggaauggagauccggccccucaaggagaaggaggagaaccuggugaacucccucguaaccgccggucacgggcagauugacaacuucucucucggaguccugggcauggcucuguuccuggaagagaugcugcgcacgcgggucgggaccaagcacgccauccuccucguggccguuuccuucgucacccugauaacgggaaacaugagcuuccgcgaccugggacgggugauggugauggucggugccacuaugacggacgauaucgggaugggcgugaccuaccucgcccugcuugcggccuucaagauccgcccgaccuucgccgccggccuccugcuacgcaagcucacguccaaggagcugaugaugacaacgaucgggaucguguuacuaucccaguccaccaucccggagacuauacuggagcucaccgacgcccucgcgcucggcaugauggugcugaagauugugcguaauauggagaaauaccaguuggccguuaccaucauggccauccugugugugcccaacgccgugauccugcagaacgcauggaagguuagcugcaccacacucgcggugguuucugucagcccccuguuacucaccaguucccaacagaaggcagauuggauuccccuggcacucacgaucaaagggcuuaauccgaccgccaucuuucuuacgacccugucccgcaccuccaagaagcgguccuggccguugaacgaggcgaucauggcagugggcauggugagcauccuggccuccagcuuacucaagaacgacauccccaugacagguccucuggucgccggcggccugcucacggugugcuacgugcuuaccggcaggucggcugaccuggagcuugagagagcggccgauguccgcugggaggagcaggccgagaucuccggcagcuccccgauccugagcaucacuauuuccgaggaugggagcaugaguaucaaaaacgaagaggaggagcaaacucuuacaauccugauccggaccggucugcuggugaucucgggacucuuccccguguccauccccauuaccgcugccgcgugguauuuaugggaggucaagaagcagcgugccggggugcugugggacguucccuccccgccucccgucgggaaggcagagcucgaggacggggccuaccggaucaagcagaagggcauuuugggguacagccagaucggcgcaggcguguacaaagaggggaccuuccacaccauguggcacgugacgcgcggcgcgguccucaugcacaaggggaagcgcaucgaaccgagcugggccgacgucaaaaaggauuuaauauccuacggcggaggguggaaguuggagggcgaguggaaggagggggaggaggugcagguacuggcacucgagccaggcaagaacccccgcgccgugcagaccaagcccgggcuuuucaagaccaacaccggcacgauaggugccgucagccuggauuucucuccgggaaccagcggcagucccaucgucgacaagaaggggaagguagugggccucuacgggaacggcgucgugacccggucgggcaccuacguguccgccaucgcacagacggagaaguccauagaggacaaccccgagaucgaggacgacaucuuuaggaagaaacggcucaccaucauggaccuacaccccggggccggcaagaccaagcgcuaucugccugccaucguccgggaggcaaucaagagagggcuccguacccugauccuggcccccacacguguaguggccgccgagauggaagaagcccuccggggcuugcccauccguuaccagacuccagcgauccgcgccgagcacaccggucgugagaucgucgaucugaugugccacgcgaccuuuacuaugcgccuccugagcccgauccgggugcccaacuacaauuuaaucaucauggacgaggcucacuucaccgaucccgccuccaucgcugcccgcggauauaucucgacacggguggaaaugggggaggcggcggggauuuucaugaccgccacgccuccgggcucgcgcgauccguucccccagucuaacgcgcccaucauggacgaggagcgggagauuccggagcgcucuuggaacagcggacaugagugggucaccgacuucaagggcaagaccgugugguucguucccuccauuaaggccgggaacgauaucgccgccugccucagaaagaacgguaagaaggugauccagcugagccgcaagaccuucgacuccgaguacaucaagacacggacaaacgacugggacuucgucgugaccaccgacaucagcgaaaugggcgcaaacuucaaggcugagcgcgucauagacccccgacgcugcaugaagcccgugauccucacggacggggaggaacgggugauacuggcaggaccgaugcccguuacccacuccagcgccgcucaacgcagagggcgugucggccggaacccuaagaaugagaacgaccaguacaucuacaugggagagccgcuggagaacgacgaggacugcgcacauuggaaggaagccaaaaugcugcucgacaacaucaacacuccggagggcaucaucccguccauguucgagcccgagcgcgagaaaguggacgcgaucgacggagaauaccgccugcgcggggaggcccgcaaaaccuucgucgaccugaugcggcgcggugaccucccgguguggcuggccuauagggucgcggcggaggggaucaacuacgccgaccgccgguggugcuucgauggcgugaagaacaaccagauccuggaggagaacguggaggucgagaucuggaccaaggaaggcgagcggaagaaacucaaaccccguuggcucgacgcgcgcauauauagcgacccccuggcccugaaggaguuuaaggaguucgcggccggccggaagagucuggcauugaaccucaucacggaaaugggccgacugcccaccuucaugacgcaaaaggcccggaacgcgcuugacaaccucgcaguccugcacacggccgaggcugggggccgcgccuacaaccacgcucugagugagcuccccgagacgcuggagacccugcuccuguugacccuccuggccacggucaccgggggcaucuuccuauucuugaugucuggcaaggggaucggcaagaugacuauggggaugugcugcaucaucaccgcgagcauccuacucugguacgcccaaauacagccccauuggaucgccgcauccaucauacucgaguuuuuccuaauagugcugcucauccccgaacccgagaagcagcguaccccgcaggacaaccagcugaccuacgugguuaucgcuauccugaccguagucgccgccaccauggccaacgagaugggcuuuuuagagaagaccaagaaagacuucgggcuggguagcauagcgacgcagcaacccgagagcaacauccucgacaucgaccuccgccccgccucugccuggacccuguacgccguggcgaccaccuucaucacgcccaugcugcggcacagcaucgagaacuccagcgucaacguuucccucaccgccauagccaaccaagccaccguauugauggggcugggcaagggcuggccgcuauccaagauggacaucggcgucccccugcuagccauugguugcuacucccaagugaaccccaucacccucauggcggcccugcugcuccugguggcccacuacgcaauuauugggcccggccuacaggccaaagcgacgcgcgaggcccagaagcgggccgcagccggcaucaugaagaacccgaccguagacgggaucaccgugaucgacuuagauccaauccccuacgaccccaaguucgagaagcaauugggucagguuaugcugcucguccuaugcgugacccagguccugaugaugcgcacgaccugggcgcugugcgaggcucugacgcucgccaccgggccgauuagcacgcucugggaggguaaucccgggcgguucuggaauaccaccaucgcagucuccauggcuaacaucuuuaggggauccuaccuggcgggcgccgggcuccuguucuccauaaugaagaacaccgccaacacgcggcggggaacggggaauaccggcgaaacgcugggugagaaguggaagaaccgccugaacgcccucgggaagucagaguuccagauuuauaagaaaucaggaauccaggagguagacaggacgcuugcgaaggaggggaucaagcgcggagagaccgaccaccacgccgugagccggggguccgccaagcugcgcugguucguggaacguaaccuugugacccccgaaggcaagguggucgaccugggcugcgggcgcggcggguggagcuacuacugcggaggucugaagaacguuaaggaggugaagggccucacgaagggcgggcccggacacgaggaaccuauccccaugucaacguauggguggaaccugguccggcuccaaucgggaguggacguguucuucacuccacccgagaagugcgacacucugcuaugcgacaucggggagaguucaccaaaucccaccgucgaggccggccgcacacugcgggugcucaaucuaguggagaauuggcugaacaacaacacccaguucugcaucaagguacucaacccguacaugccgagcgugaucgagaagauggaggcccugcagaggaaguacggcggggcacuggugaggaaccccuugucccgcaacagcacccacgaaauguauugggucucgaacgccagcggcaauaucguguccagcgugaacaugaucucccggaugcucaucaaccgcuucaccaugcggcacaagaaagccaccuaugagcccgacguggaccuggggaguggcacacgcaacaucgggaucgaguccgaaacuccuaaccuggacauaaucgguaagcggauugagaagaucaagcaggagcacgagaccagcuggcacuacgaucaggaccacccguacaagaccugggcuuaccacggcaguuacgaaacgaagcagaccgggagcgccucaagcauggugaacggcgugguccggcuacugaccaagcccugggacgugauccccauggugacccagauggcgaugacggacaccacgcccuuugggcagcagcgagucuucaaggagaagguagacacccgaacacaggagccgaaggaggguacuaagaagcuaaugaagauuacggcgaaguggcucuggaaggagcugggcaagaagaaaacgccccggaugugcacacgggaggaguucacgcgcaaaguccguucgaaugccgccuuaggggccaucuucaccgaugagaauaaguggaaguccgcgcgagaggcaguggaggauuccggcuucugggagcucguggacaaggaacggaaccugcaucucgaggggaaaugugagacgugugucuacaacaugaugggcaagcgcgagaagaaacuuggugaguucggcaaggccaagggcucgcgggccaucugguacauguggcugggggcaagguuccuggaguucgaagcccucgguuuccuuaacgaggaccauugguuuucccgagaaaacagccucucgggaguggagggcgagggcuuacacaagcucggguauauccugcgcgacguauccaagaaggaaggcggggccauguacgccgacgacacagccggaugggacacccggaucacccucgaggaccugaagaacgaggaaauugucaccaacuauauggagggggaacauaagaaguuagcggaggccaucuucaagcucacguaccagaacaaggucgugcgcguccagcggcccacgccuaggggcaccguaauggacaucaucagccggcgagaccagcgggggaguggucaagugguaaccuacggccugaacacguucaccaacauggaagcccagcugaucaggcagauggagggggagggcguuuucaagagcauccagcaccucacggugacagaggagaucgccguggagaacuggcuggugcggguggggcgggagcgacugucccgcauggcgaucagcggggacgauugcgucgugaagccccucgacgaccgcuucgcguccgcccugacggcccugaacgauaugggcaagguccggaaggacauccagcaaugggagcccagccgaggcuggaacgacuggacccagguucccuuuugcucccaccacuuccacgaguugaucaugaaagacggcagggugcuggugguacccugccgcaaccaggacgaacucauugggcgggcccggaucagccagggcgcgggguggucccucagggagacggcgugccugggcaagagcuacgcccaaaugugguccuugauguacuuccaccgccgggaucuccgccuggccgccaaugcaaucuguagcgcagugccgucacacuggguuccgaccagccggacgaccugguccauacacgccacacacgaguggaugacuaccgaggacauguugaccgucuggaacagaguguggauccaggagaacccguggauggaggauaagacacccguggaaagcugggaggagauuccguaccucggcaagcgagaggaccaguggugcgggagcuugaucggacugaccagccgcgccaccugggccaaaaacauccagacggcgaucaaccagguccggucgcucaucgggaacgaggaguauacugacuacaugcccaguaugaagcgcuuucggcgcgaggaggaggaggcgggagugcugugguga

SEQ ID NO: 24805 - RNA, 9876 nt, Artificial Sequence
  derived and/or modified CDS sequence (opt11) from DENV-2__KF744400__SS-prME
accgcaggcaugaucaucaugcugauccccacuguuauggccuuccacuugacgacccguaacggugaaccucacaugaucgucagccggcaggaaaagggcaagagccugcuguucaagaccgagaacggggugaacaugugcacacuaauggcgauggaccugggcgagcuaugcgaggacaccaucacuuacaaaugcccccuccugcgccagaacgagccggaggacauugacugcuggugcaacagcaccagcaccugggugacguacgggaccugcacaaccaccggcgagcaccgacgcgagaagcgaagcgucgcccuggugccacacgugggcaugggguuggagacacggacggaaaccuggaugagcagcgaaggcgcuuggaagcaugcgcagcggaucgagacguggauccuacgucauccaggguucacccugauggccgcaauacuugccuacacaaucggcaccacgcacuuccaaagggcguugauuuucauccugcucaccgcggucgcacccagcaugaccaugcgauguaucgggaucagcaaccgggacuucguggagggcguguccggcgggagcuggguagauaucgucuuggaacauggcuccugcgugaccacaauggccaagaacaagcccacccuggacuucgagcucaucaagaccgaggccaaagagcccgccacccugcgcaaguacugcauugaggccaagcugacaaacacgaccaccgagagucggugcccaacacaaggggaacccucccucaacgaagaacaggacaagcgguuuguuugcaagcacucaaugguggaucgaggcugggggaacggguguggccuguucggaaagggagggauagugaccugcgcuauguucacguguaaaaagaacauggaggguaagauaguccagccagagaaccuggaauauaccauaguuauuacuccccacuccggagaggagcaugccgucggaaacgacaccggcaaacacgggaaggagaucaagaucaccccucagagcuccaccaccgaggcggagcucacgggcuacgggaccgugacgauggagugcucaccucguaccggccuggacuuuaaugaaauggugcugcuacaaauggagaacaaggccuggcuggugcaccgacagugguuuuuggaccuuccccugccuuggcugcccggggccgacacacaggggagcaacuggauccagaaggagacucucgucaccuuuaagaacccacacgcgaagaagcaggacguugucgugcugggaagccaggaaggcgccaugcacaccgcgcugacaggugccacagacauccagaugagcuccgggaaccuucuguucaccggacaccugaaaugccgucucaggauggauaagcugcagcugaagggcaugagcuauucaaugugcacggggaaguucaagguggucaaggaaaucgccgaaacgcagcauggcaccauaguugugcggguccaauacgagggggacggcagcccaugcaagaucccauucgaaaucauggaccuugagaagagacaugugcugggccgccugaucaccgugaacccgaucgucacggaaaaggacucccccguaaacaucgaggccgagccgcccuucggugacagcuacgugauaaucggcgucgagccugggcaacucaagcugaacugguucaagaagggcagcagcaucgggcagauguucgaaacaacaaugcgcggggcaaagagaauggccauccugggcgacaccgcuugggacuucggguccuuaggugggguauucaccagcaucggcaaggcucugcaccagguguucggggcgaucuacggcgccgccuucuccggcgucagcuggacaaugaagauccugaucggggucauuaucaccuggauuggcaugaacuccagaagcaccagucugagugugucgcucguccugguggggguugucacccuguaccuuggggucgucguccaggccgacuccggguguguagugucguggaagaacaaggagcugaagugcggcagcggcaucuuuaucacugacaacguccacacuuggaccgagcaguauaaguuccaacccgaaucucccucuaaacuugcgucagcuauacagaaagcgcaccaggaggggaucugugggauucggucagugacucgccucgagaaccugauguggaagcagaucacgccugaacugaaccacauccucagcgagaacgaagugaaacuaaccaucaugacgggggacauuaaggguaucaugcacgccggaaaacggucccugcgcccacaacccacugaacugcgauauuccuggaagacuuggggcaaggcuaaaauccuguccaccgagagccacaaucagacguuccuaaucgacggccccgagaccgcggaaugcccgaauaccaaccgcgccuggaacucccuugaggucgaagacuacggguucggcgucuuuacaaccaauauauggcugaagcugcgggagaaacaagacgccuucugcgaccccaagcucaugucugccgccauuaaggacaaccgagcugugcacgcugacaugggguacuggaucgaauccgcccuuaacgacacguggaagaucgagaaggcgagcuucauugaagucaagaacugucacuggccuaagucccacacacuguggaguaacggcguucucgaguccgaaaugauuaucccaaagaauuucgccgguccgguaucccagcacaacuaccggcccggguaccauacgcagaccgcggggcccuggcaccuagggaaacuggaacucgacuucgacuucugugagggcaccaccgucgugguuacggaggacugcgguaaccgcggacccucccuacgcacgaccaccgccagcggaaaacucaucacagaguggugcugccgcucgugcacccucccaccccugcgauacaagggcgaggacggcuguugguaugguauggagauccguccccugaaggagaaggaagagaaccucgucuccucacuggugaccgccggccacggacagauagacaacuucucccugggugugcucggcauggcccuguucuuggaggaaaugcuccggacacgcgucgggaugaagcacgcuauccugcuuguagcggugagcuucgucacgcugaucacaggcaacauguccuuccgggaccuggggcgagugaugguaauggucggcgcgaccaugaccgaugauaucgggaugggcgugacuuaccuggcccuccuggcugcguucaaggugagacccaccuucgccgcaggguuacuacuacggaagcugaccaguaaggagcucaugaugacgacaauugggaucguacuacugucccaauccaccauacccgagacaaucuuggagcugaccgacgccuuagcccuuggcaugauggugcugaagauugugcgaaagauggagcgauaccaguuggcugucaccaucauggcuauccucugcguucccaacuccgucauccugcaaaacgccuggaaggugucaugcacaauacuggccgugguguccgugagcccccuucuacugaccucgucgcagcaaaaagccgacuggaucccccucgcccugaccaucaagggccuuaauccgacugcaauuuuccucaccacccuuucccgcacuuccaagaagcgguccuggccccuuaacgaggccaucauggcuguaggcauggugagcauccucgcgucgagucugcugaagaacgacaucccuaugacagguccacucguggccgguggccuucugaccgugugcuauguccucaccgggcgcagcgccgaccuugagcuggagaaggccgcagacgugcgaugggaggaccaggcugaaaucuccggcagcuccccaauucucagcgugaucguauccgaggaugguagcauguccaucaaaaacgaggaggaagaacaaaucuuaaccauccuaauucgcacuggccuccuggugauuagcggacuguuccccguguccaucccgaucaccgcggccgccugguaucucugggagguuaagaagcagagggccggggugcugugggaugugccuagcccgccgccugucggcaaggcggaacucgaggacggagcauaccgcauaaagcagaaggggauccucggguacagccagaucggcgcaggcguguacaaggaagggaccuuccacaccauguggcacguaacacggggcgccguccugaugcacaaggggaagcgcaucgagccaagcugggcggacgugaagaaggaccugauaucguacggcggggguuggaagcucgaaggcgaguggaaggagggggaagaggugcagguccuggcguuggagcccgggaaaaacccacgggccgugcagacaaagccuggccucuuuaagaccaacgccggcaccauaggggccgugagccuggacuucagcccgggcaccuccgguucgcccaucaucgacaagaaggggaagguagugggucucuacgggaauggagugguaacgcgaaacggcagcuacgugagugccaucgcccagaccgagaaguccauugaggacaaccccgaaauugaggacgacaucuuccgaaagaagagauugaccaucauggaccuccaccccggggccggcaagaccaagcgguaccugccggcaauagugcgagaggccaucaaacgcggguuacgcacucucauccuggcgccgacccgggucguggccgccgagauggaggaagcgcugaggggccuccccaucagauaccagacccccgcaauccgggcggaacacaccgggcgcgagaucgucgaccucaugugccaugcaacguucaccaugcgacuauugagcccgauccgcguaccuaacuauaaccugaucauuauggaugaggcacauuucacugaccccgcuucgaucgccgcgaggggcuauauuagcacccgcguggagaugggcgaggccgcugggaucuucaugacugcuacgccgccgggcuccagagacccauucccgcagucuaacgccccgaucauggacgaggagcgcgaaauacccgagcggucauggaacagcgggcacgagugggugaccgacuucaaggguaagacggucugguucgugcccuccaucaaggcggggaacgacaucgccgccugccugcgaaagaauggcaagaagguuauccagcugagccggaagacguuugacuccgaguauguuaagacacgcaccaacgacugggacuuuguggugaccacagacaucucugagaugggcgcgaacuucaaagccgagcgggucaucgacccccgccgcugcaugaaaccugucauacugaccgacggggaagaacgcguaauccuggcuggcccaaugcccgucacccacuccagcgccgcccagcgucgcgggagaaucggccguaacccgaagaaugagaacgaccaauacaucuauaugggggagccccucgagaacgaugaggacugcgcacacuggaaggaggcgaagaugcuccuggauaauaucaacacgcccgagggcaucauucccuccauguucgagccggagagggagaaaguggacgcuaucgacggcgaguaucggcuccgcggggaggccaggaagacguucgucgacuuaaugcgcaggggcgaccugccagucugguuagccuacaagguggccgcggaggggaucaacuacgcugaccgacgguggugcuucgacggcauccggaacaaccagauccuggaagagaaugucgagguggaaauuuggacaaaggagggagagcggaagaaacugaagccacgcuggcucgacgcacgcaucuacagcgacccccuggcacugaaggaguucaaggaguucgcggccggccgcaagagccucacccugaaucugaucacugagaugggccggcuccccacauucaugacccagaaggcacgcgaugcccuggacaaccuggccgugcuccacaccgcugaggccggugguagagccuacaaccacgcccugagcgagcuaccggagaccuuggagacacugcuguuacugacucugcucgcgacggucaccggaggcaucuuccuguucuugauguccggucgcgguaucggcaaaaugacgcucgggaugugcugcaucauaacugcguccaucuuacuaugguacgcccagauccagccacacuggaucgccgcaucaaucauccucgaguucuuccugaucguauugcugaucccugagccagaaaagcagcggaccccucaggacaaccaacugacauacgugguaaucgccauccugacagugguggcggccacgauggccaacgaaaugggcuucuuggagaaaaccaagaaggacuugggcuugggaucuaucgccacccaacagcccgaaagcaacauccuggacaucgaccugcggccggccuccgcguggacccuguaugccgucgcgacgaccuucauuacccccaugcucagacacagcauagaaaacuccagcguaaacguaucgcugaccgcgaucgcaaaccaggcgacgguucugaugggucucgggaagggcuggccgcugagcaagauggauaucggggugccacugcuugccaucggcugcuacucccaagugaaucccaucacccugaccgcagcccuguugcuccugguugcgcacuacgcuauuauagggcccggccuucaggccaaggcgacccgcgaggcccagaagcgcgcggccgccgguauaaugaagaacccgacgguagacggcaucacggcuaucgaucuggacccgaucccuuacgaccccaaguucgaaaaacagcugggucaggugaugcuccugguccugugugucacccagguacucaugaugagaaccacgugggcgcugugcgaggcgcugacccuugccaccggaccgauuagcacgcugugggaagguaacccugggagguucuggaacacgaccaucgccgucucgauggccaacaucuuccggggcagcuaccuggccggcgcggggcuucuauucuccaucaugaagaacacaacuaacacgaggcggggaaccgguaacauaggcgaaacccugggcgagaaguggaagucccgccucaaugcacugggcaaguccgaguuccagaucuacaagaaguccggcauacaggaggucgaucggacccuagcuaaagaggguauaaagcgcggcgaaacggaccaccacgccgucucucguggcagcgccaagcucaggugguucgucgagcguaacaugguaacaccagagggcaagguagucgaccucggcugcggucgcggcggguggagcuacuauugcggcggucuuaaaaacgugagggaggugaagggccugaccaaaggagggccaggccaugaggagccgauccccaugagcaccuacggauggaaccuggugcgccugcaauccggaguggacguguuuuucacgccgcccgagaagugcgacacccuucugugcgacaucggggagagcagcccgaaucccacggucgaggcaggccggacccuccgagucuugaaccugguagaaaacugguuaaauaacaauacucaguucugcaucaaagucuugaauccauacaugccauccguuaucgagaaaauggaggcacuccagcggaaguauggcggcgcccuugugcgcaacccccugagcagaaauuccacacaugagauguauugggucuccaacgccucaggcaacaucguaagcucugugaacaugaucagccgcaugcucaucaacagauucaccaugaagcacaagaaagcgacuuacgaacccgaugucgaccuggggucugggaccugcaacaucgguaucgagagcgaaguccccaaccuggacaucaucggcaaacgcaucgagaagaucaagcaggaacacgagacuuccuggcauuacgaccaagaccacccguacaagaccugggcuuaccacggcagcuacgaggccaagcagaccgggagugcguccagcauggugaacggcgucguucgucucuuaaccaagcccugggacgugaucccaaugguaacgcaaauggccaugaccgacaccacccccuucgggcagcaacgggucuucaaggagaagguggacacgaggacccaggagccgaaggaggguaccaagaagcugaugaagaucaccgccgaguggcucuggaaagagcugggcaagaagaaaacgccccgcaugugcacccgcgaagaguucaccaggaaaguccgcagcaacgccgcccugggggccauauucacggacgaaaacaaauggaagucggcgcgggaggcaguugaagacagucgcuucugggaguuggucgauaaggagcggaaccugcaccuugagggcaagugcgagacgugcguguacaacaugaugggaaagcgagagaagaaacucggagaguucgggaaggccaagggcuccagggcgaucugguacauguggcugggcgcccgauuucuggaguuugaggcucucggguuccucaacgaggaccacugguuuagcagggaaaauagccucagcgguguggagggggagggccucuacaagcugggauauauccugcgggacgucagcaagaaggagggcggcgccauguacgccgacgacaccgccgggugggauacccggauuacccucgaggaccucaaaaaugaggagaugguuacgaaccacauggagggcgagcauaagaaacuugcggaggcaaucuucaaacuuaccuaccagaacaaggugguccgcguacagcggcccacuccccguggcaccgucauggacaucaucagcagacgcgaucaacggggcuccgggcaggucggaacguauggccugaacaccuucaccaacauggaggcccagcugauccgccagauggagggggaggguaucuucaagucaauucagcaccuuaccgcgaccgaggagaucgccguucagaacuggcuaacucgcgugggcagggagcgccugagccgaauggccaucuccggggacgauugcgucgugaagccucucgaugaucgcuucgccagcgcccugacugcucugaacgauaugggcaaggugcguaaagauauccagcaaugggaacccagccgcggauggaaugacuggacccagguccccuucuguucucaucauuuccacgagcucaucaugaaagauggccgcgugcuugugguccccugccgcaaucaggacgaacugaucggacgggcccgcaucucccagggcgccggguggucacuccgcgagacggcgugucugggcaagucauacgcgcagauguggagccugauguacuuccacagacgagauuugcgcuuagccgccaacgccauuugcuccgcggugccgucgcacugggugcccaccucccggaccaccuggagcauccacgcuaagcacgaguggaugacaacggaagauaugcugaccgucuggaauagaguuuggauucaggagaaucccuggauggaggauaagacccccguggaaucaugggaggagauuccguaccucgggaagcgggaagaucaguggugcgggucucugaucgggcugaccagccgcgcaacgugggccaagaacauacagaccgcgaucaaccagguccggagccucauagggaacgaagaguacacagauuacaugcccagcaugaaacgguuucgccgcgaagaggaggaggcaggcgugcugugguaa

SEQ ID NO: 24806 - RNA, 9876 nt, Artificial Sequence
  derived and/or modified CDS sequence (opt11) from DENV-2__KF744401__SS-prME
accgccggcaugaucaucaugcugauccccaccgugauggccuuccaccucacgaccaggaauggggaaccccacaugaucgucucacggcaggagaagggcaagucccugcuguuuaagaccgaaaacggagugaacaugugcacucucauggccauggaccugggcgagcugugcgaggacaccauuacuuacaagugcccccuccugagacaaaacgagccggaggacaucgauugcuggugcaacagcaccagcaccugggugaccuaugggaccugcaccacaacgggcgagcaucggcgagagaaacggagcgucgcccuagugccacacgucggaauggggcucgagacccgcaccgagacguggaugagcucggagggcgccuggaagcacgcgcagcggaucgagacauggauccugcgucaccccggguuuacccuaauggccgcgauccucgccuacaccaucggcaccacacacuuccagcgggcccugaucuucauccugcucaccgccgucgcgcccagcaugacuaugcgcugcaucgggaucucgaaccgggacuuuguggagggcguguccggcgggagcuggguugauaucgugcuugaacaugguuccugcgugacuacgauggcaaagaacaaacccacacuugacuucgaacucaucaaaaccgaggccaaggagccggccacucugcgcaaguauugcaucgaggccaaacugacgaacaccacgaccgagucgcggugccccacgcaaggggagcccuccuugaacgaggagcaggacaagagguuugucugcaaacacucuaugguggacaggggcuggggcaaugggugcggucucuucgggaaaggcgggaucgugaccugugcgauguucacaugcaagaagaacauggaaggcaagaucguccagcccgagaaccuggaauacacuaucgugaucacgccucauuccggggaggagcacgcagucgggaacgacaccggcaagcacggaaaggaaauaaaaaucaccccgcagagcuccaccaccgaggcggagcucacuggcuacgggaccgucacuauggagugcagcccccgcaccggccuggacuucaacgaaauggugcugcuccagauggagaacaaggccugguugguucaccggcagugguuccuggaccucccgcugccuuggcugccgggagccgacacucagggguccaacuggauccagaaggagacccuugucacguucaagaacccccacgcgaagaagcaggacgugguggugcuuggcucacaagagggagccaugcacacagcgcugaccggcgcgaccgagauccagaugagcuccggaaaucuccucuucacuggccaucuaaagugccgccuccggauggauaagcuacaguugaagggcaugagcuauuccaugugcaccggcaaguuuaaggucgucaaggagaucgccgagacgcaacacggcaccauaguggugcgcguccaguacgaaggggacggcagccccugcaagauccccuucgagaucauggaccucgagaagcggcacguccugggccgccuuauuacagugaacccgaucgucaccgagaaggacuccccggugaacaucgaggcggagccgcccuucggggacagcuaugugauuaucggcguagagccggggcagcucaaacugaacugguucaagaagggcucgagcauaggacagauguuugagacgaccaugcgaggagccaagcggauggccauacugggcgacaccgccugggacuuugguucccucggugggguguucacuagcaucggcaaagcccugcaccagguguucggagcgaucuacggcgccgcauucaguggggucagcuggacgaugaagauccugauaggggugauaauuaccuggaucggaaugaacucccgcagcacuucccugagcguuucccucguccuggugggggugguuacacuguaucuugggguggugguccaggccgauagcgggugcgugguuuccuggaagaacaaggagcuaaagugcggcaguggcaucuucaucacggacaacguccacaccuggaccgagcaguacaaguuccagcccgagagcccguccaaacuggcgagcgcuauccagaaggcccaccaagaggggaucugcggcauccggagcgugacccgccuugaaaaccuuauguggaagcaaauuacgccagagcugaaccacauccucagcgaaaaugaaguaaagcugaccaucaugacuggggacaucaagggcaucaugcacgccgggaagcggucccugagaccgcaaccgaccgagcugcgguacucuuggaagacguggggcaaggcgaagauccuuuccaccgaaagccacaaccaaacuuuccuaaucgacgggcccgagaccgcggagugcccgaacacuaacagagccuggaacucccucgaggucgaggacuacggguucggcgucuucaccacuaauaucuggcuuaagcugcgggagaaacaggacgccuucugcgaccccaaacuuaugagcgccgccaucaaggacaaccgcgcggugcaugccgacaugggcuacuggaucgaguccgcccugaaugacaccuggaaaaucgaaaaggccagcuucaucgagguuaagaacugccacuggcccaagagucacacccuuuggagcaacggcguccuugaguccgagaugauaauccccaaaaacuuugccggccccgugucucagcacaacuaccggcccggguaccacacgcagaccgcggggcccuggcacuugggcaaacuggaauuggacuucgacuucugugagggcaccaccgucguggugacggaggauugcgggaauagaggccccucccugcggaccaccaccgccagcggaaagcugaucacggaguggugcuguaggagcugcacccucccuccacugcgguauaagggggaagacgggugcugguacgggauggagauccgcccccugaaggagaaggaggagaacuuggucuccagcuuagugaccgcaggccacgggcaaaucgacaacuuuuccuugggcgucuuagggauggcucucuuccuggaggagaugcuccguacccgcgucgggaugaagcaugcgauccuacuaguggccguuagcuucgucacgcucaucaccggcaacauguccuuccgggaucuggggcgcgugauggugauggucggagccacgaugaccgaugacaucggaaugggcgugacguaccucgccuugcuagccgccuucaaggugcgucccaccuucgcggccggccugcuccugaggaagcuuaccucuaaggaguugaugaugaccacgauagggauaguccugcugucccagagcaccaucccagagacaauccucgagcugaccgacgcccuggcuuugggcaugauggugcugaagauaguccgcaagauggagcgguaccagcuagccgucacgaucauggccauccucugugugcccaacuccgucauccuccagaacgcguggaaggugagcugcaccaucuuagccguaguaucagucagcccccuccugcuuaccuccagccaacagaaggcggacuggaucccacucgcgcugaccaucaaggggcugaacccgacagccaucuucuugaccacucuuucccggaccagcaagaagcgguccuggccccucaacgaagcgaucauggccgugggaauggucagcauccucgcgucgagccuacugaaaaacgauauccccaugacgggcccccucguggccggcggccugcugaccguaugcuacguccucaccgggcgcagcgcagaccuggagcuggagaaggccgccgacgugcggugggaggaccaagcggagaucaguggcagcucaccgauccucagcgugaucgugucagaggacgggagcauguccaucaagaacgaggaggaggagcagacccucacgauccugauccggacaggucuccuggugaucagcggacuguuccccgucucuauccccaucaccgccgccgccugguaccucugggaggucaagaagcagcgggccggggugcugugggacgugcccagcccgccgcccguggguaaggcggagcuggaggacggugccuaucggaucaagcagaagggcauccugggguauucccagaucggggccggcguguacaaagaggggaccuuucacaccauguggcacgugacgcggggcgccgugcugaugcacaaggggaagcgcaucgagccuagcugggccgacgugaaaaaggaccugaucagcuacggugggggcuggaagcuggagggggaguggaaggagggagaggaaguucagguccucgcccuggagcccggcaagaaccccagagcagugcagaccaagccgggccuauucaagacaaacgcgggcaccaucggggccgugagccuggacuucucccccggcacuaguggcucccccaucauagacaagaaagggaagguggugggccuguacggcaacggcguggucacaagaaacggcucauacguguccgccauugcgcagacagagaagagcaucgaagacaacccugagauugaggacgacaucuuccggaagaagcgacugaccaucauggaucuucaccccggagccggcaagacuaagcgguaccugcccgccaucgugcgcgaggcuauuaagcgugggcugcgcacacugauccucgcgccaacccgagucguggccgccgagauggaggaggcccuucgcggccuccccauccguuaccaaacuccugccaucagagcugagcacaccgggcgcgagauugucgaucugaugugccacgccaccuucaccaugaggcugcucagcccuauccgcguccccaacuacaaccugaucaucauggaugaagcccacuucaccgaccccgccaguauagccgcgcgggguuauauaagcacgcgcguggagaugggagaggcggccgguaucuucaugaccgcaacgccccccggcagucgggacccguucccccagagcaacgccccgaucauggacgaggagcgagagauccccgagcgguccuggaacagcgggcaugagugggugaccgacuucaagggaaagacgguaugguucgugcccuccaucaaggcagggaacgacauagccgcgugccuucgcaagaacggcaagaaggugauccagcucagccggaagaccuucgacuccgaguaugucaagacccgaaccaacgauugggacuucgugguaacaacggacaucucagagaugggcgccaacuucaaggcggagcggguaauugauccccgacguugcaugaagcccgugauucugaccgacggggaggagcgagugauucuggcuggcccgaugccagucacucacagcagcgccgcccagaggcgcgggagaaucggucguaaccccaaaaaugagaacgaucaguacaucuacaugggggagccccucgagaaugacgaggauugcgcccacuggaaggaggccaagaugcuguuagacaacaucaacacgccggaaggcaucauucccuccauguucgagcccgagcgcgagaagguagacgcgauagauggcgaguaccgucuccgcggggaggcgcggaagaccuucguggaccugaugcgccggggugaccugccgguauggcuugcguauaagguggccgcggagggcauuaacuacgccgaccgccgguggugcuucgacggcauucgcaacaaccagauucuggaggaaaaugucgagguugaaaucuggaccaaggagggggagagaaagaaguuaaagccucgcuggcucgacgcccggaucuauagcgacccucuggcccugaaggaauuuaaggaguucgccgccggccgcaagucccucacccuuaacuugaucacugaaaugggucgguuacccacuuucaugacccagaaggcgcgcgacgcgcuggacaaucuggcggugcuacacacugccgaggccgggggccgggcauacaaccacgcguuaagcgagcugccggagacgcucgagacccugcugcuucugacccuguuagccaccgucaccggcgggaucuuccuguuccugauguccgggagggggaucggcaaaaugacccuaggaaugugcugcauaaucaccgcgagcauucugcugugguaugcccaaauccagccccacuggaucgccgcuuccaucauccucgaguuuuuccuuaucgugcuucucauccccgagcccgagaagcaacggaccccgcaagauaaccagcugaccuacguggucaucgccauuuugacgguggucgcggccacaauggccaacgagaugggcuuucuggagaagaccaagaaggaccuggggcuggguagcaucgcaacucagcagccagagaguaacauccucgacaucgauuugcgucccgccuccgcguggacacuauaugcagucgccaccaccuucaucacccccaugcugcggcacagcaucgagaacagcucugugaaugugucccugacggccaucgccaaucaagcgaccguccuaaugggccucggcaaaggcuggccguugagcaagauggauaucggggugccccuguuagcuaucggaugcuauagucaagugaacccgaucacccugaccgccgcucuacuccuacuggucgcgcacuacgccaucaucgggcccggccuccaggccaaggccacacgcgaggcucagaaacgggcggccgcgggcauuaugaagaauccaaccgucgacggcauaacggccaucgaccuggaucccauccccuacgacccuaaguucgagaagcaacugggccaggugaugcuccugguccuuugcgugacccagguucuagucaugcgcacgaccugggcacugugugaggcguugacccucgccacagggccgaucucaacucugugggaagguaauccagggcgcuucuggaauaccaccaucgcaguguccauggccaauaucuuccggggcagcuaccuggccggcgcgggcuuacuguuuuccaucaugaagaacaccacgaauacccgccgggggaccgggaacauaggcgaaacgcuuggcgagaaauggaagucccgccucaacgcacugggcaaaagugaauuccagauuuauaagaaguccggaauccaggagguggaccggacgcuggccaaggaggggaucaagcgcggcgaaacugaccaccacgccgucucccgggggagcgcuaagcuccgcugguucguugagcgaaacauggugacaccggagggcaaggucguggacuuaggcugcggaaggggcggguggucguacuacugcgguggacuaaaaaacgugcgugaggucaaaggccucaccaagggcgggcccggacacgaggagccgauacccaugagcacguacggguggaaccuggugcgccugcagucuggcguagacguguucuucacgccacccgagaagugugauacccuccugugcgauaucggcgaaucaagcccgaacccuacaguggaggccggucggacgcugcgcguuuuaaaccugguagagaacuggcugaauaauaacacacaauucugcaucaaggugcugaaccccuacaugccuuccgugaucgaaaaaauggaggcccuucaacggaaguacggcggggccuuaguccgcaacccccugagccggaauuccacucacgagauguauugggugucgaacgccucagggaauaucguaagcucagucaauaugauuucucgcaugcucaucaaccgguuuacaaugaagcauaaaaaggcgacguacgagccagauguugaccugggguccggcacgcgcaacaucgggauagagagcgaggugcccaaccuggauauuauuggcaaaagaaucgagaagauaaagcaggagcacgagaccuccuggcacuacgaccaggaucacccuuacaagaccugggccuaccacgggagcuacgaggccaagcagaccggaagugcaagcuccauggucaacggaguggugcggcuccugacgaagcccugggacguuauccccauggugacccagauggccaugaccgacaccacgcccuucgggcagcagcgcguguucaaagagaaggucgauacccggacccaggagccgaaggaaggcaccaaaaaguugaugaagaucacagcggaguggcucuggaaagagcugggcaagaagaagacgccgcgcaugugcaccagggaagaguucacgcgcaaggucagaagcaaugccgcccugggggccaucuucacggaugaaaacaaguggaaguccgcccgcgaggcgguugaggauagccgguucugggagcucguggacaaggagcgcaaccugcaucuggagggcaagugcgagacauguguuuacaacaugauggggaagcgggagaaaaagcucggagaguucgggaaggcaaagggcucccgcgccaucugguacauguggcugggcgcccgguuccuggaguucgaggcauugggguuccugaacgaggaccacugguuuagucgcgaaaacagccuguccggcgucgagggggaaggccucuauaagcugggauacauccugcgcgacgugagcaagaaagagggcggcgccauguacgccgacgacaccgccggaugggacacccgcauaacccuugaggaccugaagaacgaggagauggucaccaaccacauggaaggcgaacauaagaagcuggcggaggcgauauucaagcuuacuuaccagaauaaagucguccggguucaacgccccacgccccgggggacagucauggacaucaucuccaggcgggaccaacgcggcagcgggcaggucggcaccuacggccucaacacguucaccaacauggaggcacagcucauccgacagauggagggggagggcaucuucaagucuauccagcaccugacggccaccgaggaaaucgccgugcaaaauuggcugacacgggucgggcgcgagcggcucucucgcauggccaucuccggcgaugauugcgugguaaagccgcucgacgacagguucgcgagcgcccugaccgcccugaacgacaugggcaagguccgcaaggauauccagcaaugggagcccucuagaggguggaacgacuggacccaagugcccuucuguagccaccacuuccacgagcuuaucaugaaggacggccgaguguuggucgugcccugccggaaccaggacgaguugaucggacgugccaggaucucccagggagcuggguggagccuccgcgaaacugcgugccugggcaaauccuacgcccaaauguggagccuaauguacuuccaccgucgcgauuuacggcuggccgccaacgccaucugcuccgcggugccgagucacuggguuccaaccucgcgcacaacauggagcauccacgccaagcacgaauggaugacgaccgaggacaugcucaccgucuggaaccguguguggauccaggaaaaccccuggauggaggacaagacccccguugagagcugggaggagauuccguaccucggcaagcgcgaggaucaguggugcgggucccugaucggccugacgucacgagccaccugggccaagaacauccagacagcgauuaaccaagugaggucccucaucgggaacgaggaauacaccgacuacaugcccagcaugaagcguuuccggcgcgaagaggaggaggccggcguauuaugguga

SEQ ID NO: 24807 - RNA, 9876 nt, Artificial Sequence
  derived and/or modified CDS sequence (opt11) from DENV-2__KF744402__SS-prME
accgcgggcaugaucaucaugcugauucccacagugauggccuuccaccucaccacccgcaacggggagccccacaugaucgugucucggcaggagaaggguaaaagccugcuguucaaaaccgaggacggggugaacaugugcacccucauggccauggaccugggcgagcugugcgaggacaccaucaccuacaagugcccccugcugcgacagaacgagcccgaggacaucgacugcuggugcaauagcaccagcaccugggugaccuacgguacgugcacuaccaccggcgagcaccggcgcgagaagcggucuguagcccuggugccccacgugggcauggggcucgagacccgcaccgagaccuggaugucuagcgagggcgccuggaagcacgcccagcggaucgaaacauggauccuacgccaccccggguucacacugauggcugcgauucucgccuacaccauuggcaccaccaacuuccagcgggcccugaucuucauccugcucaccgcugucgcuccuuccaugaccaugcgcugcaucgggaucucuaaucgggacuucguggagggcgugucgggcgggucgugggucgacaucgugcuggagcacggcucgugcgugaccacgauggccaagaacaaaccaacccuagauuuugaacuaaucaagacagaggccaagcaccccgccacgcugcgcaaauacuguaucgaggcaaagcugacgaacaccaccaccgagagccggugcccgacgcagggggagcccucccucaacgaggagcaggacaaacgcuucgucugcaagcacagcaugguggaccggggcuggggcaacggaugcggccucuucgguaaaggcgggaucgucacuugcgcaauguucacgugcaagaagaacauggagggcaagaucguccaacccgagaaccucgaguacaccauugugaucacgccgcauuccggcgaagagcacgccguagguaacgacaccggcaaacacgggaaggagaucaaggucaccccgcagagcucgaucaccgaggccgagcucaccggcuacgggacggugaccauggaguguagcccccgcaccggccuagacuucaacgagauggugcuguugcagauggagaacaaggccuggcugguccaucgacaaugguuccuggaccucccccuacccuggcugccgggcgccgacacccagggguccaauuggauacaaaaggagacgcucgugaccuucaagaacccacacgcgaagaagcaggacguggucgugcugggcagucaggaaggggccaugcauaccgcccugaccggcgccacggagauacagaugaguuccgggaacuuacucuucaccggccaccugaaaugccgccuccgaauggauaagcugcaguugaaaggcaugucguacuccauguguacugggaaauucaagguugugaaggagaucgccgagacucaacauggaacgaucgugguacgcgugcaauacgagggggacggcagccccuguaagauccccuucgagaucauggaucuagaaaagcggcacgugcuggggcgcuugaucaccgucaacccgaucgugaccgagaaggauucccccgugaacaucgaagcggagccgcccuuuggggacagcuacgucaucaucggcguggagccggggcagcucaagcuaaauugguucaaaaaagguuccagcaucggacagauguucgagacuacgaugcgaggggccaaacggauggccauccugggcgacaccgccugggacuucgguucccugggcgguguguucacuucaauuggcaaggcccuccaccaaguauuuggagcgaucuacggcgccgccuucuccggcgugagcuggaccaugaaaauucugauugggguuaucaucacguggauugguaugaauucccggucgacuucacugagcgucucccucauccuggucgggguggugaccuuguaucucggaguggucguccaggccgauagcgggugcguaguguccuggcggaacaaggagcugaagugcggcagcggcaucuucaucaccgauaacguccacacguggaccgagcaguauaaguuccagcccgagagccccucuaagcuggcgagcgccauacagaaggcccaucaggagggaauuugcggcauccgcuccgugacccggcucgagaaucugauguggaagcagaucacccccgagcugaaccacauccucagcgagaacgaggugaaguugacgaucaugaccggggacaucaagggcaucaugcacgccgggaagcgcucccugcggccgcagcccacagagcuccgcuacagcuggaagaccuggggacgggccaagauccuguccacggagagccacaaccagaccuuccugauagacggaccagagacugcagagugcccgaauaccaaucgcgccuggaacucucuugagguugaggacuacggcuuuggcguauucacgaccaacaucuggcugaagcugaaggagcggcaggacguauucugcgacucgaaguuaaugucggccgcaaucaaggauaacagggcgguucacgcugauaugggguacuggaucgagagcgcccucaacgacacuuggaagaucgagaaggccuccuucaucgaggucaagagcugccacuggcccaagucccauaccuuguggagcaacggcgugcucgaauccgagaugaucauacccaagaacuuugccggcccugugagccagcacaacuaccggccgggguaccacacucaaaccgccgggcccuggcaccuggggaaacuagagauggauuucgacuucugcgagggcacaaccgugguagucaccgaggacugcgggaacaggggccccucccucagaacgacuaccgcguccggaaagcugaucacggaguggugcugccgcagcuguacguuacccccguuacgguacagaggcgaggacgguugcugguacgggauggagauccggccucuuaaggagaaggaggagaaccuggugaacucccucgugaccgccggccacgggcagaucgacaacuucagccugggcguccuuggcauggcccucuuccuggaggagaugcugcgcacgcgcguugggacuaaacacacgauuuuacugguggcagucucguucgucacccugaucaccgguaacaugagcuuccgggaccuuggucgcgugauggucaugguuggcgcgaccaugacggacaacaucgggaugggcgucacuuaccuggcccugcuggccgccuucaagguccggcccaccuucgccgcgggccuccugcucagaaagcugaccuccaaggagcugaugaugaccaccaucgggaucgugcugcugagccaguccaccauccccgaaaccauccuggaguuaacggacgcccucgcgcugggcaugauggugcucaagaucguacggaacauggagaaguaucagcuugcugugaccaucauggccauccuguguguaccgaacgcagugauccuccagaacgccuggaaggugagcugcaccauccuggccgucgugagcgugagcccccugcucuugaccuccagucagcagaaagccgacuggauuccccuggcccucacgaucaaggggcugaacccaaccgcgaucuuucuaaccacgcucuccagaacuagcaagaagcgguccuggccgcugaacgaggccaucauggcggucggcauggugagcauucuggcuuccucgcuccugaagaacgacauccccaucacuggcccccuuguggcuggcggucuccugacggucugcuacgugcugaccgggcgcagcgccgaccuggagcuggagcgggccgccgacgugcgcugggaggagcaggcugagaucuccgggaguucucccauccugucuaucaucauuuccgaggaugggagcauguccaucaagaacgaggaggaagagcagacgcucacuauccugauccggaccggccugcucgucauuucuggccuguuccccguguccauccccaucaccgcggccgcgugguaccugugggagguaaagaaacagcgcgcugggguuuuaugggacguacccagccccccgccggucggcaaagcagagcuggaagacggggcguaccggaucaaacagaagggcauccugggguacucccagaucggcgcgggcgucuacaaggaggggaccuuccacacuauguggcacgugacaagaggagccguguuaaugcacaagggcaagaggaucgagcccagcugggccgacguuaagaaggaccugauauccuacggggggggguggaagcuggaaggcgaguggaaggagggggaggagguccaggugcuugcccuggagcccggcaagaauccucgcgcggugcagaccaagccugggcuguucaagaccaacgccggaaccaucggggccgugagccucgacuucucccccgguaccagcggcucccccaucaucgacaagaagggaaagguggucggucuguacgggaacggcguggucacacggaacggcaguuacgucuccgcaaucgcccagacuggcaaguccaucgaggacaauccggagauagaggacgacaucuuccgcaagaagagacugacgaucauggacuugcacccuggugcggggaagaccaagcgcuaccucccggccaucguacgagaggcuaucaagcgaggccugcgcacccuaauccucgccccgacccgagugguugcggccgaaauggaagaggcccuucgcgggcuuccuauccgguaccagacuccggccauccgggccgaacacaccggacgggagaucguggaccucaugugccacgcgacguucaccaugcgccugcugagccccauccgggugccgaacuacaacuugaucaucauggacgaagcccacuucaccgaucccgccuccaucgccgccagaggcuacaucagcacccgugucgagaugggggaggccgccggcaucuuuaugaccgcgacgccgcccgggucccgggacccguucccccaaucuaacgcccccaucauggaugaggagcgggagauuccugagagauccuggaacagcggacaugagugggucacggacuuuaaggggaagaccgucugguucgucccuuccaucaaggccggcaacgacauugcggccugcuuacggaagaacgguaagaaggucauccaacuaaguaggaagacauuugacuccgaguaugugaagacccggacuaaugacugggacuuuguugugaccaccgacaucagugaaaugggggccaacuucaaggccgaaagggugauugacccccgacgcugcaugaagcccgucauccucacugacggggaagagagagugauccuggcugggcccaugccggugacgcacuccagcgccgcccagcgccgcggccggaucgggcgcaaccccaaaaacgagaacgaccaguacaucuauaugggcgagccccuggagaacgacgaggaccaugcacacuggaaggaagccaagaugcucuuagacaacaucaacaccccagaaggcaucaucccguccauguucgagccagaacgggaaaaggucgacgcgaucgacggggaguaccgucugcggggcgaggcccgcaagacguucguggaccucaugcggcgcggcgaccugcccguguggcuugcuuauaaggucgccgccgagggcaucaacuacgcugaucggcgcugguguuuugacgggauccgcaacaaccagauccuugaggagaauguggaggucgagaucuggaccaaagagggagagcgcaaaaagcugaagccgcgcuggcuggacgcgaggaucuacagcgacccccucgcccugaaggaguucaaggaguucgccgccggccggaaaucccugacgcucaaccugauaaccgagauggggcgucuaccaaccuucaugacacagaaggcgcgggaugcccucgacaaccuggccguguugcauaccgcggaagcgggcgggcgcgccuacaaccaugcgcucagcgagcuuccagagacccuggagacccuccugcuacucacccugcuggccacggugacgggcggaaucuuucucuuccugauguccgggaaaggcaucgggaagaugacccugggcaugugcugcaucaucaccgccagcguccuccugugguacgcgcagauccagccacacuggaucgccgcuuccaucauccuggaguucuuccugauaguccuucugauccccgagccagagaagcaacggacuccgcaggauaaccagcucacguacguggucaucgccauccuaaccgugguggcagcgaccauggccaacgaaaugggcuuccuggagaagaccaagaaggacuucggccucggcucgaucgccacgcagcaaccggaaagcaauauucuggacaucgaccugcgcccagcuagugcauggacucucuacgcggucgcaaccacuuuuauaacuccaaugcugcggcacaguauugaaaacuccagcgugaaugugagccugaccgccaucgcuaaccaggccaccguccucauggggcugggcaaaggauggccccuaagcaagauggacauaggcgugccgcuccuggcgauagggugcuacucccagguuaaccccaucacccugacggccgcacuccuguuacucguagcccacuacgcgaucaucggccccggccuucaagccaaagcuaccagggaagcgcagaagcgcgccgcggcgggaaucaugaagaaccccacgguggacggaaucaccguuaucgaccuggacccgauucccuacgaccccaaguucgagaagcaguuagggcaagucaugcuacuggugcucugcguuacgcaaguccugaugaugcggacgaccugggcccuuugugaggccuuaacccuggccaccggcccaaucagcacauugugggaagggaauccgggccgcuuuuggaacaccaccaucgcggugucuauggccaacauuuuccggggcagcuauuuggccggugccggccugcuguucuccauuaugaagaacacgacgaacacccgccgggggaccggcaacaucggugaaacccucggggagaaguggaagucccgucugaacgcucugggcaaguccgaauuucagauauacaaaaaauccgggauccaggagguggacaggacccuggcgaaggagggcaucaagcgcggugagaccgaccaccacgccgucucccggggcagcgccaagcugagaugguuuguggagcgcaacauggugacccccgaggguaaggucguggaccuggggugcggccgcgggggcugguccuacuacuguggggguuugaagaacguccgggagguuaaaggccugacgaagggcgggcccgggcacgaagagccgaucccgaugucaaccuacggcuggaaccugguucgccuccaauccgggguggacgucuuuuucacgcccccugagaagugcgacacccugcugugcgacaucggugagagcagccccaauccgacgguugaggcuggccguacccuccgcgugcugaaucuggucgagaauuggcuuaacaacaauacccaguucugcauuaaggugcugaaccccuacaugccuuccguuaucgagaagauggaggcgcuucagagaaaauacgggggcgcccugguucgcaacccgcucagccggaacuccacgcacgaaauguacuggguguccaacgccuccgguaauaucgugagcuccguaaacaugaucaguagaauguuaaucaaccgcuucaccaugcggcacaaaaaagcgacguaugagccagacguggaccugggcuccggcacccgcaacaucggcauugagagcgaggugcccaaucucgacaucauugguaagcggaucgagaagauaaagcaggagcacgaaaccucuuggcacuacgaccaggaccaccccuacaaaaccugggccuaccacgggucuuacgaaacgaagcaaaccggcuccgcgagcuccauggugaacgggguagugcgccuguugaccaagccgugggacguuauccccauggugacgcagauggccaugaccgacaccaccccuuucggccagcagcggguguucaaggagaaggucgacacccgcacucaggagccgaaggagggaacaaagaagcucaugaaaaucaccgccgaguggcuguggaaggagcuggguaagaagaagacuccgcggauguguacgagggaggaguuuacacggaaggugcgcucgaacgccgcccucggcgcgaucuucaccgacgagaacaaguggaaguccgcccgggaggccgucgaggacucgcgcuucugggaacugguggacaaagaacggaaccuucacuuagaagggaaaugcgagaccugcguguacaacaugaugggcaagcgcgagaagaagcuuggggaguucggcaaggccaaaggcucacgcgccaucugguacauguggcucggggcgcgcuuccucgaguucgaagcccugggguuccugaacgaggaccacugguuuucccgggagaauucgcucuccggggucgagggcgaggggcuccauaagcugggcuacauccucagagacgugagcaagaaggagggcggggccauguacgccgacgauacggcgggcugggauacccggauuacccuagaggaccugaaaaacgaggaaauggugacaaaccacauggagggggaacacaagaagcuggccgaggccauuuucaaguuaacguaccagaacaaggucgugagaguacagcggcccacgccccgcggcaccgucauggacauaaucucccgccgggaccagcgcgguagcggccaggugggcaccuacgggcugaacacguucaccaacauggaggcccaguuaauccgccagauggagggagaggggguguuuaaauccauacagcaccugaccgccaccgaggagaucgcuguccagaacuggcuagccagagugggccgggagcgccucaguagaauggccaucuccggcgacgacugcguggucaagccucuggacgaccgcuucgccagcgcccugacggcauugaacgacauggggaaggugcggaaggacauacagcagugggagccgucccgcggcuggaacgacuggacccaggugccuuucugcucucaccauuuccacgagcuaaucaugaaggacgggcggguacuggugguaccuugccgcaaccaggacgagcucauaggccgggcucgcaucucccagggcgcuggcuggagccugcgggagaccgcaugcuugggcaaguccuaugcccagauguggucgcucauguauuuccaccgccgggaccuccgccuggcggccaacgccaucugcuccgccguccccagccacugggugccaaccucccggacgaccuggagcauccacgccaagcaugaguggaugaccaccgaggacaugcucacuguguggaaccgcgucuggauccaggagaaccccuggauggaggacaagacgccaguagagagcugggaggagauccccuaucuggguaaacgugaagaccaauggugcgggucccucaucgggcugaccagcagagcuacgugggccaaaaacauccagaccgcaaucaaccaggugcgcucccuaaucggcaacgaggaauacacggacuacaugccgagcaugaagagauucagacgggaggaggaggaggccgguguccugugguga

SEQ ID NO: 24808 - RNA, 9876 nt, Artificial Sequence
  derived and/or modified CDS sequence (opt11) from DENV-2__KF744408__SS-prME
accgcgggaaugaucaucaugcuuaucccuaccgugauggcauuccaccucaccacacggaacggggaaccucacaugaucgucagccggcaagaaaagggcaaaucgcugcuguuuaagaccgaggacggagugaauaugugcacucuaauggcgauggaccugggugagcugugcgaggacaccauaaccuacaagugcccccuacugcggcagaacgagcccgaggacaucgacugcuggugcaacuccaccuccaccugggugaccuacgggacuugcaccaccaccggcgagcaccgccgcgagaaacggagcguugcccuggugccccacgucggcaugggauuggagacacggacagagaccuggauguccagcgagggcgccuggaagcacgcccagcggauugaaacguggauacuacggcaccccgguuuuacccugauggcggcgauucucgccuacaccaucggcaccacgaauuuucagcgggcccugaucuucauccugcucaccgccgucgcgcccuccaugacuaugcggugcauugggaucucgaaucgggauuucguggagggcgugucuggcgguagcugggucgacaucguccuggaacacggcucaugcguuaccacaauggccaagaacaagccuacacuggacuucgaacuuaucaagacagaggccaagcauccugccacccuacguaaauauugcauugaggccaaguugaccaacaccacgaccgcaagcaggugcccgacgcaaggggagccuucccucaacgaggagcaggacaagcgcuucgucugcaagcauuccaugguagaccguggcuggggaaacggguguggcuuauucgggaaaggggggaucgugaccugcgccauguucacgugcaagaagaacauggaggguaagauuguacagcccgaaaaucuggaauauacaauagucaucaccccccacuccggcgaggaacaugccguggggaacgacacuggcaagcacgggaaggagaucaaaauaacaccccaaagcuccaucaccgaggcugagcucaccggauacgguacggucaccauggaguguagcccccgcacgggccuggguuucaacgagauggugcuacuccaaauggaggauaaggcguggcucgugcaccggcagugguuccuugacuuaccccuucccuggcugccgggcgcggacacacagggaucgaacuggauccagaaagagacgcucgucacauucaagaacccccacgccaaaaagcaagauguggugguccuggggucccaggagggugccaugcacacugccuuaacuggggccacggaaauccaaaugaguucgggcaaccucuuauucacaggccaccuuaaaugccgccuucggauggacaagcuccagcugaagggaauguccuacucuaugugcacgggcaaguuuaagguggucaaggaaaucgcagaaacccagcaugggacaauaguggugcgcguccaauacgagggagacggcucacccugcaagauaccguucgagaucauggaccucgagaagcggcacgugcuggggcgcuugaucacgguuaacccaauagugaccgagaaagauucuccagugaacaucgaggccgagccgccuuucggcgacucuuacgucaucaucggcgucgaaccgggccagcuaaagcugaguugguucaagaaggguagcucaauaggacagauguucgagaccaccaugcgcggugccaagcguauggcuauccuaggggacacggcaugggacuuuggcagccucgggggcguauucacauccaucgggaaggcgcuacaccaggucuucggcgccauuuacggggcggccuucuccgggguauccuggacuaugaagaucuugaucggcgugaucauaacauggauagggaugaacagccgcuccaccucccugagcgugucacucguuuuggugggcguggucacccuguaucucgggguggugguccaggcggacuccgggugcguugugagcuggcggaauaaggagcugaagugcgggagcgggauauucaucaccgauaacguccacacguggaccgagcaguacaaguuccagcccgagagccccuccaagcuggccucagcuauccagaaggcccaccaagagggcaucugcggcauccgcagcgucacccggcucgagaaccuaauguggaagcaaaucacccccgaguugaaccacaucuuguccgagaacgaggugaagcugaccaucaugacgggugacauaaagggcauaaugcaagccggaaagcgcagccuucggccgcagcccacagaacuccgguacuccuggaagaccuggggcaaggcgaagauauuguccacugagucccacaaucaaaccuuccugauugacgggcccgaaaccgccgagugcccgaacacaaaccgggccuggaacagccuggagguugaggauuauggguucgggguauucacgaccaauaucuggcugcgccuccgggaaaagcaggacgccuucugcgacuccaagcucaugagcgcagcgauuaaagacaaccgcgccguucacgccgacaugggcuacuggaucgaguccgcccugaaugacaccuggaagaucgagaaggccaguuucaucgaggucaagucaugucacuggcccaaaagccacacccugugguccaacggcgugcuggaguccgaaaugaucauccccaagaacuuugcggggcccgugagccagcauaacuaucggcccgguuaucacacccagacggccgggccuuggcaccucggcaagcuggagauggauuucgacuucugcaaggggaccaccgucgugguaaccgaggacugcggcaaccgcggcccgucacugcguacgacgacugcgagcgggaagcuaaucaccgaguggugcugucgcuccugcacacugcccccgcuccguuaccgcggcgaggacggguguugguacggaauggagauccggccgcuaaaggagaaggaggagaaccuggucaauagucucgucacggccggccacggucagaucgacaauuucagucugggagugcuggguauggcacuguuucuagaggagaugcugcgcacccgcgucggcaccaagcaugccauccuauuaguggccgugucuuucgucacucuuauaacugggaacauguccuuccgggaccucgggcgugugauggucauggucggugcuacuaugaccgacgacauaggcaugggcgugacguaccuggcccugcucgccgccuucaagguacggcccaccuucgcugcaggguuacugcugcgcaagcugacuagcaaagagcugaugaugaccacgaucggcaucguccucuugucccagucgaccaucccagagacgauccuggagcuuaccgaugccuuggcgcugggcaugauggugcucaagauugugcggaacauggaaaaguaccagcuggcggucacgaucauggccauccugugcguuccgaacgcugucauccuccaaaacgccuggaagguauccugcaccauccuggcgguagucagcgugagcccccugcugcugaccagcucccagcagaaggccgauuggaucccuuuggcccucacaauuaaggggcugaacccgacggccauauuccugaccacacucucccgcacaucaaagaaacgcagcuggccguugaacgaggcgauaauggcagugggcauggucaguauucuggccagcucccuccuuaagaacgacauccccaugacagggcccuugguggcagggggccuacugacaguuugcuauguacuuaccggccgcuccgccgaccucgagcuggaaaaggcggcagauguccguugggaagaccaggccgagaucagcgggagcagucccauccugucaauaaucaucagcgaagacggcuccaugagcaucaagaacgaggaggaggagcagacccugacaauucugauccgcaccggucuucucgugaucuccggucuguucccggugucaauacccaucacugccgcagcgugguaucuuugggaagugaagaagcagcgggccgggguacucugggacguacccagcccgccgcccgugggaaaggcggagcuggaggacggcgccuaccgcaucaagcaaaaggggauacuuggcuacagccagauuggggcaggcgucuacaaggaggggacguuccacaccauguggcauguaacgcgcggugccguuuugaugcacaagggcaaacgaauugagcccagcugggccgacguuaaaaaggaccugaucagcuacgggggaggcuggaaacuggaaggggaguggaaggagggcgaggagguucaaguguuggcacuggagcccgggaagaaccccagagccguucagaccaaacccggccuguucaagaccaacgccggaacgaucggcgccguaucccuugauuucagcccaggcacgucugggagccccaucaucgacaagaaaggcaagguggugggccuguacgguaacggcgucgugacccgaaauggguccuacguuagugccaucgcacagaccgagaaguccaucgaggauaaccccgagauugaggacgauaucuuucgcaaaaagcgccuaaccaucauggaucugcacccaggagcugguaaaacaaagagguaucuccccgcgaucguccgcgaggccaucaagcgggggcuaaggacccugauucucgcgccgacccggguagucgcugccgagauggaggaggcgcuccggggguugcccauacgguaucagacacccgcuauccgggccgagcacacuggccgcgagaucguggaccucaugugccaugccaccuucacaaugcgguuacuguccccaauccgcgugccgaauuauaaucucaucaucauggaugaagcacauuuuaccgaccccgccagcaucgccgcgcggggcuauaucucgacucgaguggagaugggggaggcggccggaaucuucaugacggcgacgccacccggcagccgagauccauucccccaaucuaacgcccccaucauggacgaggagcgggagauacccgaacggagcuggaauuccgggcacgagugggugacagacuucaaggggaagacugugugguucguccccagcaucaaggcgggcaacgacauugcugcgugcuugcgcaaaaacggcaagaagguuauucaguugucgcggaaaaccuuugacagcgaguauguaaaaacccgcacgaacgauugggacuucguggucacgaccgacaucucugaaaugggugccaacuuuaaggccgagcgggugaucgacccgcgccggugcaugaagcccgugaucuuaacugacggugaggagcgcgucauccuggccggcccaaugccggucacccauagcuccgccgcacaacguagggguagaauuggccggaaccccaagaaugagaaugaccaguauauauauaugggcgaaccccucgaaaacgacgaagacugcgcccauuggaaggaggccaagaugcuccuagacaauaucaauacucccgagggaaucauaccuagcauguucgagccugaacgcgagaagguugacgccaucgacggggaguaucgacugcguggcgaagcucggaagacuuuuguugaucucaugcgucgcggugaccugccaguuuggcuagcguacaagguggccgcggagggcaucaacuacgccgaccgccgguggugcuucgaugguauccgcaacaaccaaauccucgaggagaaugucgagguggagaucuggaccaaggagggcgagcggaaaaaacuaaagccgcgcuggcuggacgcccggauuuacagugacccccucgcacugaaggaguucaaggaguucgcggcaggacgcaagucauugacccucaaccugaucacggagaugggucgacugcccaccuuuaugacccagaaagcacgcaaugcgcuggacaacuuggcaguccugcacaccgcugaagccggcggucgggcauacaaccacgcucuguccgaguugcccgagacgcuggagaccuuguuauugcucacccuguuggccaccgugacgggcggaaucuuccuauuccuuaugagcgggaagggcauagggaagaugacccuggguaugugcuguaucaucaccgccaguguucuccuaugguaugcucagauccaaccgcacuggauugccgcgucaaucauccuagaguuuuuccucaucguccugcugauccccgaacccgagaaacagaggacgccacaggacaaccaguuaacauacguuguaaucgccauccucacuguaguggccgcuacuauggccaaugaaauggguuucuuggagaaaaccaagaaggaccucggccucggcuccaucaccacacagcagccagaguccaacauccuggacaucgaccuaaggccagccagcgccuggacccuguaugcgguggccaccaccuucauuacgcccaugcuuaggcacucaaucgagaauagcucagucaacguaucacucaccgcaaucgcgaaccaagcaaccguguugaugggucugggcaagggguggccccucucgaagauggauaucggcgucccccugcuagcaauugggugcuacucccaggugaaccccauuaccuugacggccgcgcugcugcuccuggucgcacacuacgccaucaucgguccaggccuccaggccaaagcuacccgggaggcgcaaaaacgcgccgccgcggggauuaugaagaaccccacggucgacggcauuaccgucauagaccuagacccgaucccguacgaccccaaguucgagaaacagcugggccaggugaugcugcucguucugugugugacccaaguucugaugaugcgcacaacuugggcucuaugcgaggcgcugacgcuggcuacgggccccaucuccacccugugggaggggaacccgggucgguucuggaauacaacuaucgccgucucuauggccaauaucuuccgcggauccuaccuugcuggggcgggccuacuguucagcaucaugaagaacacgaccaauacucggaggggcacgggaaauaucggggaaacgcugggagagaaguggaagagccggcugaacgcgcucgggaagagcgaauuccagaucuacaaaaaguccgggauccaagaggucgaccgaacucucgcgaaggaggguauaaagcggggggagacugaucaccacgccguuagcagaggcuccgcgaagcugcggugguucgucgagcgcaacaugaucacgcccgagggcaaggugguggaccucgggugcggccgcggcggcugguccuacuacugcggcggguugaagaacgucagggaggugaaggggcuuacuaagggcgggcccgggcacgaggagcccaucccgauguccaccuacggcuggaaccucgugcggcugcagaguggugucgacgucuucuucacgccgcccgagaagugcgacacccugcucugcgacaucggcgaaucgucccccaacccaaccguggaagccggucgcacccugcggguccuaaaucucgucgaaaacuggcucaacaacaacacccaguucugcauaaagguucugaacccuuacaugcccucggucauagagaagauggaggcccugcagcgcaaauauggcggugcccucguacgcaacccguuaucgagaaauagcacccacgaaauguacugggugucaaacgcuucaggcaacauugucuccagugugaacaugauuucgcgcaugcugaucaaccgcuuuacaaugaagcacaagaaagcgacuuacgagcccgauguggaccucggcucgggaacccgcaacaucgguauugaguccgaggucccuaauuuagacaucaucggcaagcgaaucgagaaaaucaagcaggaacacgagacgagcuggcacuacgaucaggaccaccccuauaagaccugggccuaucacgguaguuacgagacgaagcagacgggcucugcuucgagcauggugaacggcguggucaggcuccugaccaaaccuugggacguuauccccaugguuacccagauggccaugacggauacgaccccuuuuggccagcaacgcguauuuaaggagaagguagacacccgcacucaggaacccaaggagggcacaaagaagcugaugaagauuacugccgaguggcuguggaaggagcucgggaagaagaagaccccgcgaaugugcacgagggaggaguuuacccggaaggugcgcuccaacgcggcucugggcgcaaucuuuaccgacgagaacaaauggaaguccgcccgggaggccgucgaagacucacgcuucugggagcuuguggacaaggagcggaaccuccaccuggaaggaaagugcgagaccuguguuuacaacaugaugggcaagcgcgagaagaaacugggagaguuuggcaaagcaaagggcagccgggccaucugguacauguggcucggggcgcgauuccuggaguuugaggcccugggauuucucaaugaggaccacugguucagcagagaaaauucguuaagcgggguggagggcgaggggcuucauaagcucggguauauuuugcgcgacgugucaaagaaggagggcggcgccauguacgccgaugacacggccggcugggacacccggauuacacuggaggaccucaagaaugaggagauggucaccaaccauauggaaggcgagcacaaaaagcucgccgaggccaucuucaaguugacguaccagaacaaggugguacgcguccagcgcccaacgccccgaggcaccgugauggacauuauuagccggcgcgaccagcgcggguccgggcaggugggcacuuacgggcugaacacauucacuaauauggaggcgcaacucauccggcagauggagggcgaaggggucuucaagagcauccagcaccucacagccacagaggagaucgccgugcagaauuggcucgcccgcgugggcagagaaagacugucccggauggcaaucagcggcgaugacugcgucgugaagccccuggacgaccgcuucgcgagugcccucacugcccugaacgauauggggaagguucggaaagacauccaacagugggaacccucaaagggcuggaaugacuggacacagguccccuuuugcucccaccacuuccaugagcugaucaugaaagaugggaggguccucgugguccccugucgaaaucaggaugagcugaucggacgcgcccgcauaucgcagggcgccggcuggucucuccgcgagaccgcuugccucgggaaaagcuaugcccaaauguggucccugauguacuuccaccgcagggaucuacgucucgccgccaaugcgaucuguagcgcgguacccucccacugggugcccaccagccguacgaccuggagcauccaugccaagcaugaauggaugacuaccgaggacaugcuaaccgucuggaaucgagucuggauucaggagaaucccuggauggaggacaagacacccguugaguccugggaggagauccccuaccuagguaagagagaagaccaguggugugggucacugauaggccucaccucccgggcgaccugggcgaagaacauccagaccgcgaucaaccagguccggagucugaucggcaacgaggaguacacugacuacaugccguccaugaagcgcuuccggcgggaagaggaagaggccgggguucuaugguga

SEQ ID NO: 24809 - RNA, 9876 nt, Artificial Sequence
  derived and/or modified CDS sequence (opt11) from DENV-2__JX669476__SS-prME
accgccggcgugaucgucaugcugauccccaccgccauggcguuccaucucaccacucgcaacggcgaaccccacaugauugugggucggcaggagaagggcaagagccugcuguuuaaaaccgaagacggcgugaauaugugcacccucauggccauugaccugggggaacugugcgaggacaccaucaccuacaaaugcccgcuucugaggcagaacgagcccgaagacaucgauugcuggugcaauucgaccucgacuugggucaccuacggcaccugcaccaccacgggcgagcaccggcgcgagaaacgguccguggcccugguuccccacgucgggauggguuuggagacccgcacagagaccuggaugagcagcgaaggagccuggaagcacgugcagcggaucgagaccuggaucuugcgacaccccggcuucaccaucauggcugcgauauuggccuauaccauugggaccacucacuuccagcgcgcccucaucuucauccuguugaccgccguggcgcccagcaugaccaugcgcugcaucggcaucuccaaccgggacuucgucgagggaguaagcgggggcagcuggguggacauuguccucgagcacgggagcugcgugaccaccauggcaaagaauaagcccacccuggacuucgagcugauuaagaccgaggcuaagcagcccgcuacccuccgcaaguacugcauagaagccaaauugacgaacaccaccaccgagucucggugcccgacgcagggcgagccuagucugaacgaggagcaggacaagcgcuucaucugcaagcacuccaugguagaccggggcugggggaacggcugcggacuguucgguaagggcgggaucgucacaugcgcgauguucacaugcaagaagaacauggagggcaaaaucgugcagagcgagaaccuagaguacacgaucgugaucacgccccacuccggggaggagcacgccgucggcaacgacaccgggaagcacgggaaggagaucaaaaucacaccccagucuuccaccaccgaggccgaacucacgggguauggcacaguuaccauggaguguagcccgcgcaccggccuugauuuuaaugagaugguccugcugcaaauggaggauaaggcguggcucguccaccggcagugguuccuggaccuaccacuccccuggcugcccggggccgacacgcagggcuccaauuggauacagaaggaaacccuagugaccuucaagaacccacacgcuaagaaacaggacguugucgugcucgggagccaggagggcgccaugcacaccgcccuaacgggggccaccgaaauccaaaugucauccggcaaccuccuguuuaccggccaccugaagugccgccugcggauggacaaguuacagcugaaggggaugagcuacuccaugugcaccgguaaguucaaaaucguuaaggagaucgccgagacgcagcacgguaccauaguaauucgcgugcaguacgaaggcgacggcagccccugcaagauccccuucgagauuacagaccuggaaaagagacacguguuagggcgcuuaaucaccgugaaucccauagugaccgagaaggacuccccggucaacaucgaggcggagccacccuucggggacucguacaucauaguggggguugagcccggccaguugaagcucaacugguucaagaaagggucuucgauugggcagauguucgagacuaccaugagaggcgcuaagcggauggccauccugggggacaccgccugggacuuuggcucgcucggcggcguauucacgagcaucgguaaggcccuccaccagguuuucggugcaaucuacggugcugccuucuccggggugucuuggaccaugaaaauccugauaggagucaucauaaccuggaucgggaugaacucccgcagcaccucccuaagcgugagucuggugcucguuggcguugugacgcuuuaccugggggccaugguacaagcggacagcgguuguaucgucuccuggaagaacaaagaauugaagugcggcagcggaaucuucaucaccgauaacguucacaccuggacugagcaauacaaguuccagccggaguuccccagcaaacuggcauccgccauucagaaggcgcacgaagagggaaucugcgggauccggagcgucacgcgccucgagaaccucauguggaagcagauaacccccgagcugaaccacauucucuccgaaaacgaggugaagcuaaccaucaugaccggugacaucaaggggaucaugcaagccggaaagcgcagccugcgcccgcagccgacggagcugaaguauuccuggaagaccuggggcaaggcgaagaugcugucuaccgaaucccauaaucagaccuuccugaucgacgggcccgagacugccgagugcccaaacacaaaccgggcauggaacagcuuggagguggaggacuacggcuucgggguuuuuacaaccaacaucuggcuaaagcugcgggagaagcaagacguguucugcgacuccaagcugaugagugccgccaucaaggacaaccgagcugugcacgccgacaugggcuacuggaucgagagcgcccucaaugacaccuggaaggucgaaaaggcuucuuucauagaggucaagaguugccacuggcccaagucccacacgcuguggaguaauggagugcuggagagcgagaugaucaucccaaagaacuucgccggccccguuagccagcacaacuaucgucccggcuaccacacccagaccgccgggccguggcaccucggcaaauuagagauggauuuugacuucugcgagggaacaacggugguggucaccgaggauugugggaaccgcggccccucgcugcgcaccacuacggcgagcgggaagcucaucaccgaguggugcugucgguccugcacccugccgccccuacguuaccguggcgaggacggguguugguacgggauggagauacgcccguugaaggagaaagaggagaaccuagugaacagccuggugacagccgggcacggucagauagacaacuucucauuaggcguucuggggauggcacuguuccuggaggagaugcugcggacacgcgugggcaccaagcacgcaauccugcucguugcccuguccuucgucacacugauuaccggcaacauguccuuccgugacuuaggucgugugauggugauggucggggccaccaugaccgacgauaucgggaugggcgugacuuaccuggcgcuacucgccgcauucaagguucgccccacuuucgccgccggccugcuguugcguaagcugacgagcaaagagcuuaugauggccacuaucggcaucgcccugcucucccaaucgaccuuacccgagaccauacucgagcugacggacgcgcuggcguuagggaugauggcucuaaagauuguuaggaacauggaaaaguaccaguuggccgucacaaucauggccaucuccugcgugccgaacgcgguuauacuccaaaaugccuggaaagugagcugcacaauccuggcugccgucuccgucagcccgcugcuacugacuuccagccagcagaagacugacuggaucccccuggcacucaccaucaagggccugaaucccaccgccaucuuccugaccacgcucucccgcaccagcaagaagagguccuggccccugaacgaagccauuauggcgguagggauggucaguauacuggccucuagcuugcucaagaacgauaucccgaugacugggccccugguugcgggcgggcuccugaccgugugcuacguuuugacgggccgguccgcugaccucgagcuggagagggccgccgacgugaagugggaggaccaggcugagaucagugggagcucgcccauccuuuccauuacgaucuccgaggauggcuccauguccauuaagaacgaggaggaggaacaaacccucaccauccugauccggaccggucugcucgugaucucaggugucuuccccgugucuaucccgaucacggcggccgccugguaccuaugggagguaaagaagcaacgcgccggcguucugugggacgugcccucaccaccaccuguagaaaaagcugagcucgaggacggggcguacagaauuaagcagcgaggcauccugggguacucccagaucggggcuggcgucuauaaggaagggacguuccacaccauguggcaugugacccggggagccgugcugaugcaccgcggaaaacggaucgagcccagcugggccgacgucaaaaaggaucucaucuccuacggcgggggcuggaagcuggagggcgaguggaaggagggcgaggaaguccaggugcuagcccucgaacccggcaaaaacccaagggcgguccagacgaagcccgguauuuuuaagacuaacacuggcaccaucggggccgugagccuggacuucucccccggcacaagcggcucucccauuguggaccgaaagggaaaggucgugggacuguacgggaacggugugguaacccgcucaggcgcuuauguguccgccauagcucagaccgagaaguccaucgaagacaacccagagauugaagaugacaucuucagaaaaaagcgccucaccauaauggaccuccacccaggggccggcaagaccaaacgguaccugcccgccaucgugcgcgaggcgauuaagcggggacugcgcacccucauccuggcccccacccgagucguggcggccgagauggaggaagcccuccggggcuugccaauacguuaccagaccccggccauacgggccgagcacacuggccgcgagaucguggaccugaugugccacgccaccuucaccaugcggcuucucucucccguccgcguuccaaauuacaacuuaaucauuauggaugaggcccacuucaccgacccggcguccauugccgcccgcggcuacauaagcacccgcgucgagaugggcgaggcggccggaaucuucaugaccgccacgccgcccggcucuagagacccuuucccccaaagcaacgcccccaucauggacgaggaacgcgaaauccccgagaggucauggaauaguggacacgagugggucaccgacuucaagggcaagacgguuugguucgugcccuccaucaaggccggcaaugacaucgccgcaugucugcgaaagaacgguaaaaaggugauacaacucagcagaaagaccuuugacucagaguacgugaagacccgggcaaacgacugggacuucguggucacaacggacaucagcgagaugggcgccaacuucaaggcggaacgggugaucgauccacgccgcuguaugaagcccgugauacugaccgacggggaggaacgcgucauacuggccggccccaugcccgugacccacuccagcgccgcccagcgucgcgggagaaucggccggaacccgaagaacgaaaacgaccaguacaucuacaugggggagccgcucgagaacgaugaggauugcgcccauuggaaggaggcgaagaugcuccuggacaacaucaauaccccagaaggcaucaucccguccauguucgagccggagcgagagaagguggaugccaucgacggagaguaucggcuccgcggggaagcccggaagacuuuugucgaccucaugcgccggggcgaccugccaguguggcucgccuacaagguggccgcggaagggaucaauuacgccgaccgcaaguggugcuucgacggcaucaagaacaaccagauucuggaagagaauguugagguggagaucuggaccaaggagggggagcggaagaaguuaaagccccgcuggcucgacgcccggauuuacagcgacccgcucgcccugaaggaguucaaggaguucgcugccggccgcaagucccuuacccuuaaccugaucaccgagaugggccggcuccccacguucaugacccagaaggcccgcaacgcccuggacaaucuggccgucuugcacaccgcggaggucgggggccgggccuacacacaugcccugagcgaacugcccgagacgcucgagacccugcugcucuuaacuuuacucgccgccgugaccgggggcaucuuucucuuccuaaugucggguaaagggaucggaaagaugacccucggaaugugcugcaucauuacggcuagcauccugcugugguaugcccagauccagccccacuggaucgccgcuuccauaauccucgaguuuuuccugaucguccuacucaucccggagccagagaaacagcgcacgccccaggacaaccagcugaccuacguggugauugcuauccugacugucguggccgcaacgauggcgaaugagaugggcuuccucgagaagacaaagaaggaccugggguucggcagcauaacaacccaagagagcgaauccaacauacuggacaucgaccuccggccagccagcgcguggacgcuguaugcgguggcgaccaccuuugugacgccgaugcugcgccacuccaucgagaacagcuccgugaacguaagccucacggccaucgcuaaccaggcgacuguccugaugggccuggggaagggcuggccccucuccaagauggacaucggggugcccuugcuggcgaucggcugcuacucucaggucaacccgauaacucucaccgccgcccuguuguuacuggucgcccacuacgcaaucaucgggccgggccugcaggccaaggccacccgagaggcgcagaagcgcgccgcggccgguaucaugaagaaucccaccguugacggcauaacggugauugaccucgagcccauuccuuacgacccgaaauuugagaagcagcugggccaggucaugcugcucauccuuugcgugacccagguacuuaugaugcgaacgaccugggcuuuaugcgaggcccugacccuugcaaccgggcccaucagcacgcucugggaaggcaaucccggccgcuucuggaacacaaccaucgccgucucaauggcaaacauauuucgcgguuccuaccuggccggcgccggucucuuauucagcauaaugaagaacaccacgaacacccggcgcggcaccgggaaugugggugaaacccugggugaaaaguggaagucccggcugaaugcccucgggaagagcgaguuccagaucuacaagaaguccggcauccaggagguugaccgcacgcuggcuaaggaggggauaaaacggggcgaaacagaccaccacgccguuucacgcgggucagcgaaacugcggugguucgucgaacgcaacauggugacccccgagggcaaagucguagaucucggcugcgggcggggcggguggagcuacuacugcggcgggcugaagaaugugcgugaggucaaaggccugacaaagggcggaccgggacacgaagagccgauucccauguccacguacggguggaaucucgugcggcugcagucgggcguggaugucuucuucacgccgcccgagaaaugcgacacauuguuaugcgacaucggugaaagcucccccaaccccacgauagaggcaggccguacccuucgggugcugaaucucgucgaaaauuggcugaacaacaacacgcaguucugcaucaagguucugaaccccuacaugcccagcgugaucgagaagauggagacccuccagcgcaaauacggcggggcacuagugcggaacccccuaucccggaacagcacccacgagauguacugggucuccaacgcaaccggcaacaucgugucuucugugaacaugaucagccggaugcugaucaaucgcuucacuaugaaacacaagaaggcuaccuacgagcccgacgucgaccucggguccggcacacggaacauagggauugagucggagaucccgaaccuggacaucaucggcaaacguaucgaaaaaaucaagcaggagcacgagaucuccuggcacuacgaccaagaccaccccuacaagaccugggccuaucacggcagcuaugagacgaagcagaccggguccgccagcuccauggugaacggagugguaagacugcucaccaaacccugggacguggugcccauggucacccagauggcgaugacggacaccaccccuuucggucagcagcggguguuuaaggaaaagguggacaccagaacucaggagcccaaggaagguaccaagaagcuaaugaagaucaccgcugaauggcuguggaaggagcucggcaaagagaagacgccccguaugugcacgcgugaagaguucacgcgcaaaguccgcagcaacgccgccuuaggcgccguguucaccgacgaaaacaaguggaaguccgcgcgggaggccguggaagaugaccgcuucugggagcuugucgaccgggaacgcaaucuacaccuggagggcaagugugagaccuguguguacaacaugauggggaaacgagagaagaagcuaggcgaguucgggaaggccaagggcucucgugcaaucugguacauguggcucggcgcgcgguuucuggaguucgaggcccuggguuuccucaaugaggaccacugguuuucuagaggcaacagccugucuggggucgagggagaggggcuccaucggcucgguuacauccuccgcgaggugggcaagaaggagggcggggccauguacgcggaugacacggccgggugggauacccggaucacccucgaggaucucaaaaacgaggagauggugacaaaccacaugaagggcgagcacaagaaguuagcggaggccaucuucaagcugacguaccagaauaaggucgugcgcgugcagcgacccaccccgagggguacgguuauggacaucauaagucggaaggaucagcggggcagcggucagguggggacuuacggccuaaacacguucaccaacauggaggcccagcuaauccgccagauggagggggaaggcaucuucaaauccauccaacaccugaccgccaccgaagagaucgccguccagaacuggcucgcacgugucggccgugaacggcugagccgcauggccaucagcggggacgauugcguggugaagcccaucgacgaccgguucgccagcgcccugacagcccucaacgacaugggcaagguacggaaggacauccaacagugggagccaucccggggguggaacgacuggacccagguacccuucuguagccaccacuuccacgaguugguaaugaaggacggccgaguucugguaguucccugucggaaucaggaugagcucaucgggcgcgcgcggaucucccagggcgccggguggagccuuaaggagaccgcgugccuggggaaaucauacgcgcaaauguggacccucauguacuuccaucgucgagacuugcgccuggcagcgaacgccaucuguagugccgucccuucccacuggguacccacuucucggacgaccugguccauacacgccaagcaugaguggaugacgaccgaggacaugcucacgguguggaaccgcgucuggauucaggagaaucccuggauggaggacaagaccccuguggaaagcugggaggaagucccuuaccuuggaaagcgagaggaucaguggugcgggucccugauaggucucacgagccgugcgacuugggccaagaacauccagacggccaucaaucaggucagaagccugaucgggaacgagggcuacaccgauuacaugcccuccaugaagcgguuccgacgggaggaagaggaggccggcgugcugugguag

SEQ ID NO: 24810 - RNA, 9876 nt, Artificial Sequence
  derived and/or modified CDS sequence (opt11) from DENV-2__JX475906__SS-prME
accguggggaugaucaucaugcucauccccaccgcaauggccuuccaccucaccacccggaauggggagccccauaugaucgugucucggcaggagaaggggaaaagccugcuauucaaaacugaggacggggucaacaugugcacccucauggcgauggacuugggcgagcugugcgaggacaccgugaccuauaacuguccccucuugcgacagaaugagcccgaagauaucgacugcuggugcaacucuacguccacgugggucaccuacgggaccugcaccgcaaccggcgagcacagacgcgagaagcggagcguagccuuagugccccacgucggcauggggcucgagacccgcaccgagaccuggaugagcagcgagggcgccuggaagcacgcccagcggaucgagaccuggauccugcgacaccccggguucacgaucauggcggccauccuggcuuacaccaucggcaccacuuacuuccagcgggugcucaucuucauccugcugacggcaguggcacccuccaugaccaugcgcugcauagggaucagcaaccgggacuucgucgagggcguguccggggggagcuggguggacaucguccucgaacacggcuccugcgugaccaccauggccaagaacaagccuacgcuggacuucgagcuuaucaagaccgaggccaagcagcccgcaacccuccgcaaguacuguaucgaggccaagcugaccaacacgaccaccgcgagccggugcccgacccagggggagcccucccugaaugaggagcaggacaagcguuucgugugcaagcauagcauggucgaccggggcuggggcaacgggugugggcucuucgggaagggcgggaucguaacgugcgccauguucacgugcaagaaaaauauggagggcaagauaguacagcccgagaaccuugaauacaccauugucaucacgccucacagcggcgaggagaaugcggucgggaaugauacgggcaagcacgggaaagaggugaaggucaccccgcagagcuccaucaccgaagcagaguugaccggcuacgggaccgugacgauggagugcuccccccgcacugggcucgacuucaacgagauggugcugcugcagauggagaauaaggccuggcucguccaucggcagugguucuuagaccugccccucccguggcugccuggcgcagacacccagggcucuaacuggauccagaaggaaacauuaguuacguucaagaacccccacgccaagaaacaggacgucguggugcucggcucccaggagggagccaugcacaccgcccugaccggcgccaccgagauccagaugagcucggggaaccucuuguuuacgggccacuuaaagugccggcugcggauggacaagcuccagcugaagggcaugagcuacuccaugugcacagggaaguucaaggucgugaaggagaucgccgagacccagcacggcaccaucgucauacgcgugcaguacgagggggacggcagccccugcaaaaucccguucgaaaucauggaccucgagaaacggcacgugcucggccgccuaaucacggugaacccgaucgucacggagaaggacucccccguaaauauagaggccgagccccccuucggggacagcuacaucaucaucgguguggagccgggacaacugaagcucuccugguucaagaagggcagcuccaucgggcagauguucgagaccaccaugcgcggcgccaagcggauggccauucuaggcgacacggccugggacuucgggucgcuggguggggucuuuaccuccauaggcaaggcacuccaucagguuuucggggccauauacggcgcugccuucagcggaguguccuggaccaugaagauacugaucggcgucgugaucaccuggaucggcaugaacagccgcaguacgagucuguccguaagccugguucucguagggguggucacucuguaccugggcgugauggugcaagcggacuccggcugcguugucagcuggaagaacaaggagcugaagugcgggagcggcaucuuuaucaccgacaacguucacaccuggacugagcaguacaaguuccagcccgagucccccagcaaguuggcuuccgccauccagaaggcccacgaggaagguauaugcggcauccggagugucacccgucuugagaaccuuauguggaagcagaucacccccgagcugaaucacauccuguccgaaaacgaggucaagcucaccauaaugacaggggacauuaagggaaucaugcaggccgggaagcggucucugcgcccgcaacccacugagcugaaguacagcuggaaaaccuggggcaaggcgaagaugcucagcaccgaaccgcacaaccagacuuucuugaucgauggcccggagacagccgagugccccaacacuaaccgagccuggaacucccuugaaguggaggacuauggcuucggggucuucaccacgaauaucuggcucaagcuuaaagagcgccaggacguguuuugcgacagcaaacugauguccgccgccaucaaggacaaccgggcggugcacgccgauauggguuauuggauugaaagcgcccucaacgauaccuggaagauagaaaaggcaucguucaucgagguaaaaucuugccacuggcccaagucccacacccuguggagcaacggcgugcuggaguccgagaugaucauccccaagaacuucgccggcccggugagccagcauaauuaccgccccggguaccacacgcagaccgcggggcccuggcaccuagguaagcuggagauggacuuugacuucugcgagggcacgacggucguugugacugaggauugugggaaucggggccccagccugagaaccacgaccgccuccggcaagcucaucaccgaguggugcugcagaagcuguacgcugccaccgcugcgcuaccgcggggaggauggcugcugguacgggauggagauccgcccccucaaagaaaaggaggagaaccuggucaauuccuuggugaccgcaggucaugggcagaucgacaacuuuagccucggcguguuaggcauggcccuguuccucgaggaaaugcugcggacgcgcgucggcaccaagcacgcgcugcugcugguggccguguccuuuaugacucugaucacgggcaacaugagcuuccgggauuuggggcgcgucauggugauggugggcgccgccaugaccgacgacaucggcaugggcgugaccuacuuggcccuacuggcggccuucaagguacgacccacauucgccgcuggccugcugcugcggaagcugacguccaaggaguugaugaugaccaccaucgggaucgugcuccugagccaauccaccaucccggagacgauccuugagcuuacggacgcccuggcgcugggcaugaugauccucaagaucguccgcaacauggagaaguaccaacuugcagugaccauaauggccauccugugcguccccaacgccgugauucuccagaacgccuggaaaguguccugcaccauccuggcggucguguccgugagcccccugcuccugacgagcagccggcagaaggccgacuggaucccccuggcucucacgaucaaggggcugaacccgacagccaucuuccugaccacgcucucccggaccaacaagaagcggagcuggccccuaaacgaggccauuauggcggucggcaugguauccauucuggccucgagucuccucaagaacgacaucccaaugaccggcccccugguggccgggggccucuuaaccgucugcuacguacugacgggcaggagcgccgaccucgagcuugagcgggcggccgacgugcguugggaggaccaggccgagaucagcggcuccagcccgauucuguccauuaccaucagcgaggacggcuccaugagcaucaagaacgaggaggaggaacaaacccucaccauccugauccggacgggcuuacucgucaucucaggccuguuucccgugagcauccccaucaccgccgcggcgugguacuugugggaggugaagaagcaacgcgccgggguccucugggacgugcccucgccgccgcccguggguaaggccgagcucgaagacggagccuaccggaucaagcagaagggcauacugggguacagccaaaucggggccggcguguauaaggaagggaccuuccacaccauguggcaugugacccggggugcggugcucaugcauaaggggaagcggauagagccguccugggccgauguacgcaaggaccugauaagcuacggcgguggcuggaaacuggagggcgaguggaaggagggggaggagguacaggugcucgcccuggagcccggcaagaacccccgugcaguccaaacgaagcccggguuguucaagaccaacaccggcaccaucggggccgugucuuuagacuucagcccaggcacguccggcagcccuaucguggacaagaaggggaagguggugggccuguaugggaauggcguggucacaagguccggaacguacguaagcgcgaucgcacaggccgagaaguccaucgaggauaaccccgagaucgaggacgacaucuuccggaagcgccggcugacgaucauggaccugcaucccggggcgggcaaaacaaagcgcuaccugcccgcgaucgugcgggaagccaucaagcgagggcugcgcacacugauccuggcccccacccgggucguagcugcagagauggaagaggcgcugcgaggccugccuauccgguaccagacccccgccauccgcgccgagcacacgggucgggaaaucguggaccuaaugugccacgccaccuucaccaugcgccuguuaagcccgguccgggugcccaauuacaaccucaucaucauggacgaggcucacuucaccgacccagccagcaucgccgcucgcggcuacauauccacgcggguggaaaugggugaggccgccgggauuuucaugacggcgacgccgcccggcagcagagacccauucccccagagcaacgcgcccaucauggacgaggagcgggaaauccccgagcgcagcuggaacucggggcacgagugggucaccgacuucaagggcaagacggugugguuuguucccagcaucaaggcggggaacgacaucgcagcgugccuccggaagaacggcaagaaaguuauccagcugucccgcaagacauuugacagcgaguacaucaagaccaggacuaacgacugggacuucguggugacgaccgacaucucagagaugggcgccaacuucaaggcagagcgcgugaucgacccucggcgcugcaugaagcccgugauccucaccgacggggaggaacgggugauccuagccggcccgaugcccgucacccacagcagcgccgcgcagcgccgagggcggaucggccgcaaccccaagaaugagaacgaccaguacaucuauaugggagagccccuggagaaugacgaggacugcgcccacuggaaggaggccaaaaugcuccuggacaacaucaacacgccggagggaauuauuccuucuauguuugagccugagcgggagaaagucgacgccaucgacggggaguaccgucugcgcggugaggcccgcaagacauucguagaccucaugcggcgcggcgacuuaccggucuggcuggcguaccggguggccgccgaggggaucaacuaugcagaccgcagauggugcuucgacggcgucaagaacaaccagauccucgaagagaacguggagguggagaucuggaccaaagaaggcgagcgcaaaaagcucaagccccgguggcucgacgcccgcaucuacuccgauccacucgcgcugaaggaguucaaggaauuugccgccggccgcaagucgcugacccucaaccuuaucacggagaugggccgccuuccaacguucaugacccagaaggcacggaacgcgcucgacaaccuggcaguccuacacaccgcagaggcugguggccgcgccuacaaccacgcgcucuccgaacucccggagacgcuggaaaccuuacugcuccucacccugcuugccaccgugaccggggggaucuuccucuuucugaugagcggcaaagggaucggcaagaugacgcucggaauguguugcauaaucacugccuccauccucuugugguacgcccagauccagccgcacuggaucgccgcgagcauuauccuggaguuuuuccucaucgugcugcugauccccgagccggagaagcaacggaccccgcaggacaaccaguugaccuacgucgugaucgccauucuaacugugguagccgcgaccauggccaacgaaauggguuuccuggagaaaacaaagaaggacuucgggcucggcuccaucgcgacucagcagcccgagagcaacaucuuggacaucgaccugcgccccgccagcgccuggacgcucuaugcggucgccaccaccuuuaucacccccaugcugagacacuccaucgagaacuccuccgugaacgucucgcugacggccauugcaaaccaggccaccgugcucaugggccuugggaagggcuggccgcugucuaagauggacaucgggguuccgcuccuugccaucggcugcuauagccagguaaacccaaucacccugaccgcggcccucuuacuacuaguggcccacuacgccauaaucgggcccggauugcaggccaaggcaacgagggaggcucagaagcgcgccgccgcagguaucaugaagaacccuaccguggacgggaucacggucaucgaucuggauccuaucccguacgaccccaaguucgagaaacagcucggacaggugaugcuccuggugcuuugcgucacucaaguguugaugaugcggacgaccugggcgcucugcgaggccuuaacccuggccacagggccgaucuccacgcugugggaaggcaacccggggagauucuggaacacgaccaucgcggucagcauggccaauauuuuccggggcuccuaccucgcaggcgccgggcugcuguucucgaucaugaagaauacaacgaacacccgucgcggcacagggaacaccggcgaaacucucggcgagaaguggaagaaccgccugaacgcccucgggaaguccgaauuccagauauacaagaagucaggcauacaggaggucgacaggacgcucgcaaaggaggggaucaagcgcggcgagaccgaccaccacgcggugucccgugggagcgccaagcugcgcugguuuguggagcgaaaucuggucacccccgaaggcaaggugguggaccucggcugcgggagaggcgggugguccuacuacugcggcgggcugaaaaacguccgggaggugaagggccugacaaagggcggccccggccacgaggagccgauccccaugagcaccuacggguggaaccucgugcgcuuacaauccggcgucgacguauuuuucacgccucccgagaaaugcgacacccugcucugcgacaucggggagagcucccccaaccccacgguggaggcuggccggacccugcgcgugcugaaccucguggagaacuggcugaacaacaauacucaguucugcaucaaagugcugaacccguacaugccgucagucaucgagaaaauggaggcccugcaacggaaguacgguggggcccucgugcgcaacccauuaagccggaauaguacccacgaaauguacuggguguccaacgcguccgguaacaucgugagcucugugaacaugauaagccggaugcugaucaaucgcuucaccaugcgucacaagaaggccacuuacgagcccgauguggaucucggguccggaacacgcaauaucgggaucgagagcgaaacccccaaccuggacaucauugggaagcggaucgagaaaauaaagcaggagcaugagaccuccuggcauuaugaccaggaccauccguacaagacgugggccuaucauggcagcuacgagaccaaacagacagggucggccagcuccaugguaaacggcguggugcgccugcucaccaagcccugggacgucauccccauggucacgcaaauggccaugaccgacaccacccccuuugggcagcaacggguguucaaggaaaagguggauacgcggacccaagagcccaaggaaggcacuaaaaaacugaugaagaucacggcggaauggcuguggaaggaacucgguaagaagaagacgcccaggaugugcacccgcgaagaguucacccggaaagugcgcagcaacgccgcacugggugccaucuucaccgacgagaacaaguggaaguccgccagggaggcggucgaagacucgagauucugggaacugguggacaaggagcggaaccuccaucuagagggcaagugcgagaccugcguguacaacaugauggggaagcgcgagaaaaagcugggcgaauucgggaaggccaagggcucccgggccaucugguacauguggcucggggcccgguuccuggaguucgaagcgcugggguuccucaacgaagaccauugguucagucgggagaacucacugaguggcgucgagggggagggccugcacaaguugggguacauccugcgcgacgucagcaagaaggagggaggcgccauguacgccgacgacacggccgguugggacacccggaucacccuggaggaucuuaagaacgaggagauggugacgaaucacauggagggcgaacacaagaagcuggccgaggcgauauucaagcugacuuaccagaacaaggucgugcgcgugcagcggcccacgccccggggcaccguaauggacaucaucucccggcgggaccagcgcggcagcggccagguggguacauauggcuuaaacaccuuuaccaacaugggggcccaacugauccggcagauggagggggaaggaguguucaaguccauccagcaccugacggccacggaggagauagccguccaggacuggcucgcccgcguggggcgcgaacgccugagccgaauggcuaucucaggcgaugauugugucgucaagccgcuggacgaccgguucgccucggcguuaaccgcccugaacgacauggggaaggugcggaaggauauccagcagugggagcccucccgcggcuggaacgacuggacccagguaccauucugcagccaucacuuucacgagcugaucaugaaagacgggcggguccucguugugcccugucggaaccaggacgagcugaucggccgggcccgcauaucccagggggcgggauggagccuacgggagaccgcauguuuaggcaaguccuacgcccagauguggagccugauguacuuccaccgccgggaccuacgccucgccgcaaacgccauuugcagugccgucccaagccacugggugccuaccucgcggacuacuuggagcauccacgccaagcacgaguggaugaccaccgaggacauguuaacggucuggaaccgcgucuggauccaagagaaucccuggauggaggacaagacccccguggaguccugggaggagaucccuuaccuggggaagcgcgaggaccaguggugcggcagccucaucgggcucacuucucgggccaccugggcgaagaacauccaaacggccauaaaccaggugagguccuugauugggaacgaagaguacacagacuauaugcccagcaugaagcgcuuccgccgggaggaggaggaggcagggguccucugguga

SEQ ID NO: 24811 - RNA, 9876 nt, Artificial Sequence
  derived and/or modified CDS sequence (opt11) from DENV-2__JX669477__SS-prME
accgccggcgugaucgucaugcugauccccacugcgauggcguuccaccucaccacacgcaacggugaaccccacaugauaguuggccggcaggaaaaagggaagagccugcuguucaagacugaggacggugucaacaugugcacccucauggccaucgaccugggggaacuaugcgaggacacgauuaccuacaagugcccccugcugcgccagaacgagccggaggacaucgacuguugguguaauagcacaucuaccuggguuaccuacgggaccugcaccacuacgggcgagcaccggcgcgaaaagcgguccgucgcccuggugccacacguggggaugggccuagagacucgcaccgagacauggaugagcuccgaaggggccuggaagcacgugcaacgcaucgagaccuggauccugcgccacccgggcuucaccaucauggcagcgauccuggccuauaccauagggaccacgcacuuccagcgggcccucauuuucauccugcugaccgcuguggcgcccagcaugaccaugcgcugcaucggcaucuccaaucgggacuuugucgagggcgucagcggaggcucguggguugauaucguccucgagcacggaagcugcgugaccacgauggccaagaacaagcccacccuagauuucgagcugauuaaaaccgaggccaagcaacccgcuacccuacgcaaauacugcauugaggcaaagcugacgaauaccaccaccgagucccgcugcccgacgcagggcgaacccagccugaacgaggaacaggacaagcgcuucauaugcaagcacuccaugguggaccggggcugggggaacggcugcgggcuguucggcaagggcgggaucgugacuugcgcuauguucacaugcaagaagaacauggagggcaagaucguucaaccggagaaucuggaguacaccauugugaucacgccgcacagcggugaggaacacgccguagguaacgacaccgggaagcacggcaaggagaucaagauaacuccgcaguccucaaccaccgaggccgagcugacggguuacggcaccgugaccauggagugcagcccccggaccggccuagacuucaaugagauggugcugcugcagauggaggauaaagccuggcucguccaccgccagugguuccuggauuuaccccuccccuggcuccccggggccgacacgcagggcagcaacuggauacagaaggagacccuggugaccuucaagaacccccacgcgaaaaaacaggauguggucgugcucgggagccaggagggcgccaugcacacagcccuuacgggggccacugagauccagaugucuagcggcaaccuccucuucaccggccaccugaagugccgccugcggauggacaagcuccaguugaaggggauguccuacagcaugugcaccggcaaauucaagaucgucaaggagaucgccgagacgcaacacgggaccaucgugauccgcgugcaauacgagggggacggcucccccugcaagauccccuucgaaaucaccgacuuagagaagcggcacgucuuagggcgccugaucaccguaaacccaauagugacugagaaagacucccccgucaacaucgaggcggagccgcccuucggagauuccuauaucaucguggguguggagccgggccagcugaagcucaauugguucaagaaggggagcuccaucggccagauguucgagaccaccaugcgcggcgccaaacggauggccauccugggggacaccgccugggacuucggcagccucggcggggucuucacuuccaucggaaaggcccuccaccagguguucggggcgaucuacggagccgccuucagcggggugaguuggaccaugaagauccugaucggcgucaucaucaccuggaucggcaugaacagccgcucgacgagccugucugugucucuggugcucgucggcgucgugacgcuguaccugggagccaugguacaagcggacuccggcugcaucguaucauggaagaacaaggaacucaagugcggcuccgggaucuucauaacagacaacgugcacaccuggaccgagcaguacaaguuucaaccagagagccccucuaaacuggccuccgccauucagaaagcccacgaggaggggauuugcgggauccggagcgucacgcgccuggaaaaccucauguggaaacagaucacccccgagcugaaccacauacuauccgagaacgaggugaagcucaccauuaugaccggcgacaucaaggggaucaugcaggccggaaagagaagccugcgcccgcagcccacggaguuaaaguacuccuggaagacauggggcaaggccaagauguuaagcaccgagucccacaaccagacguuccugaucgacgggcccgagacagccgaguguccgaacaccaaccgggccuggaacagccuggagguugaggacuauggcuucggagucuucaccaccaacauuuggcucaagcuucgcgaaaaacaggacguguucugugacuccaagcugaugagcgccgccauuaaagauaaccgggcgguccacgccgauaugggcuacuggauagaaagugcccucaaugacaccuggaagauggagaaggccagcuucauagaagucaaguccugccauuggcccaagagccacacgcuguggucuaacggaguuuuggagucagagaugaucauuccuaagaacuucgccgggcccgugucgcagcauaacuaccgccccggcuaccacacccagaccgcggggcccuggcaccucggcaaacuggaaauggacuucgacuucugcgaaggaaccacugucguggucaccgaagacugcggcaaucguggacccucccugaggacgaccacggccagcgggaagcucaucacggaguggugcugucgguccuguacacugcccccccugcgcuauagaggcgaggacgggugcugguacggcauggagauacgcccccucaaggagaaggaggagaaucuggucaacagcuuaguuaccgcgggccacgggcaaaucgacaacuuuucccucggcguacugggcauggcucuuuuccuggaggagaugcugcggacgcgcgucggcacuaagcacgcgauccugcucgucgcccugucuuucguuacauugaucaccgggaacauguccuucagagaucucggccguguuauggugauggugggggcaaccaugacggaugacaucggcaugggcgucacuuaccuggcccugcucgccgcauucaaagugcgacccaccuucgccgccgggcuguugcuccggaagcugacgagcaaggagcugaugauggccaccaucggcaucgcgcucuuaucccagagcacccugcccgagaccauacuggagcugacggacgcgcuggcccucgggaugauggcacugaagaucguucgaaacauggagaaguaucagcuggccguuaccaucauggccaucucuugcgugcccaacaccgugauccuccagaacgcguggaaggucagcugcaccauccuggcugccguguccgugagcccccuucucuugacguccagccagcagaaggccgacuggauuccccuggcgcucacaauuaagggccugaaccccacagccauuuuccugacaacgcugucccggaccucgaaaaagcgcuccuggccgcugaaugaagcgaucauggccgucggcauggugagcaucuuagcuuccucucuucugaagaacgauauccccaugaccgggccgcugguugcgggcgggcuccuaaccgugugcuacguccugacgggccggagcgccgaccucgagcuagaacgcgcagcggaugucaagugggaagaccaggccgaaaucuccggaagcucccccauccugagcaucacaaucuccgaagaugggucaauguccaucaagaacgaagaggaggaacagacccucaccauccugauucggacgggccuguuagugaucagcggaguguuuccuguauccauccccaucacggcggccgccugguaccugugggaggugaagaagcaacgugccggcgugcugugggacgucccaagcccgccccccguggggaaggccgaacucgaggacggagcguaucggaucaagcagcgcgggauccugggcuauucccagauaggggccgggguauacaaagaggggaccuuccauacaauguggcacgucacccgcggggccguucucaugcaccgcggcaagcggaucgagcccagcugggccgauguuaagaaggaccucaucuccuacgggggagguuggaaacuggagggggaguggaaggagggcgaggagguccaagugcuagcccuugagcccgggaagaacccccgcgcggugcagacuaagcccggcauuuucaagaccaacacaggaacgaucggagccgucagucuggacuuuaguccuggcacaagcgggucccccaucguggaccggaaaggcaagguggucggucuguacggcaacggcguggugacccgcagcggggccuacgugucagcaauagcucagacggaaaaauccaucgaggacaaccccgagaucgaggacgacaucuuccggaagaagcgccucaccaucauggaccugcaccccggcgccgggaagacgaagcgguaccugcccgccaucgugcgcgaggcgaucaagcggggccuccgcacacucauccuggccccgacucgcguggucgcggcagagauggaagaggcccugcgggggcucccuauucgcuaccagacccccgccauccgggcugagcauaccggccgcgagauaguggaccugaugugccaugcgaccuuuaccaugcggcuccucagcccggugcgcguuccgaacuauaaccugaucaucauggacgaggcccacuucaccgaccccgcuuccaucgccgcacggggcuacaucagcacgcgcguggagaugggggaggccgccggcaucuucaugacugccacgccucccgggucccgggacccguucccccagagcaacgcccccaucauggacgaggagagagagauccccgagcgguccuggaacagcggucacgagugggugaccgauuucaaggggaagacggucugguucgucccgaguauuaaggcgggcaacgacaucgccgccugccugagaaagaacggcaagaaggugauccagcucucccggaagaccuucgacuccgaguacgucaaaacccgcgccaaugacugggacuucgugguaacgacugacaucucagaaaugggggcgaacuucaaggcggagcgggucaucgacccccgccggugcaugaagcccgugauccugaccgacggcgaagagcgcguuauccuggcaggccccaugccggucacucacuccagcgcagcccagcggcguggccgcaucgggcggaaccccaagaacgagaaugaccaguacaucuacaugggagagccccucgagaaugaugaagacugcgcccauuggaaggaggcgaagauguuacuggacaacaucaacaccccggaaggcauaaucccgagcauguucgagccggagcgagaaaaaguggacgcgaucgacggggaguaccggcuccgcggcgaggcccggaagacguucguagaccuuaugcgccgcggggaccugccuguauggcucgccuacaagguggccgcggagggcaucaauuacgcggaucgcaaguggugcuucgacgguaucaagaauaaccaaauccuggaggagaacguggaggucgagauauggaccaaggagggcgagcggaagaaguugaagccucgcuggcucgacgcccggaucuacagugacccccuagcccugaaggaauucaaagaguuugcggcuggccguaagucccucacacuuaaccugaucaccgaaauggggcggcucccuacuuuuaugacccagaaggcacguaacgcccuggacaaccuggccgugcuccauacugcggagguaggcgggaaggcccacacgcaugcccugagcgaguugcccgagacacucgaaacccugcugcucuugacccugcucgccgcggucacuggcggcaucuuucuguuccugauguccgggaagggcaucgggaagaugacccucggcauguguuguaucaucacggcgagcauccugcucugguacgcacagauccaaccgcacuggaucgccgcuuccaucauucucgaguucuuccugaucgugcugcucauacccgagcccgaaaagcagcgaacuccccaagacaaccagcugaccuacgucgugaucgcaauccugaccgugguggcggcaacgauggccaacgagauggguuuccucgagaagaccaagaaggacuugggcuuuggcagcaucacuacgcaggagucagagucaaacauccucgacaucgaccuccgcccggccagcgcguggacgcuauacgcgguagccaccaccuucgugaccccaaugcuacggcacuccauugagaacucgucgguaaacgugagccucaccgccaucgcgaaccaagcgaccgugcugauggggcugggcaagggauggccccucaguaagauggacaucggcgucccucugcuggccaucggaugcuacagccaggugaauccuaucacguugaccgccgcccugcuguuacugguggcccacuacgcgauuaucggccccggccugcaagccaaggccacgcgcgaggcccagaagagggccgcggccggaaucaugaagaaccccaccgucgacggcaucaccgugaucgacuuagaaccuaucccuuacgaccccaaguucgagaagcagcuggggcaggucauguuauuaauccugugugugacgcaagugcuaaugaugagaacuaccugggcccuaugcgaggcccugacccuggccaccggccccaucagcacgcucugggaggggaaccccggccgguucuggaacaccaccaucgcggugagcauggccaauaucuuccgggggucauaccuggccggggcaggccuccuguucagcaucaugaagaacaccacgaacacgcgccgggggaccgggaacguuggagagacccugggagaaaaguggaagucccgccugaacgcgcucggcaagagcgaguuccaaauuuacaagaagagcgggauccaggagguggaccggacgcuggccaaggagggcauaaaacgcggggagaccgaccaccacgccguaagcagaggcuccgccaagcugcgcugguuugucgaacggaauauggucaccccggaagggaaggucguugaccucgggugcggacgcgggggcuggagcuauuacugcgggggccugaaaaacgugagagaagugaagggccugaccaagggcgggcccgggcacgaagagcccauccccauguccacguacggcuggaaccucguucgccugcaaagcgggguggacguguucuucacuccucccgaaaagugcgacacccugcucugugacaucggagagagcuccccgaaccccaccaucgaggccggccggacacugcgcguccugaaccucguggagaauuggcugaauaacaacacucaguucugcauaaaggugcugaacccguauaugccgucggugaucgagaaaauggagacccuccagcggaaguacgggggcgcgcugguucgcaacccccugucccggaacagcacccaugaaauguacuggguguccaacgccaccgguaacaucgucagcuccguuaacaugaucagccgcaugcugaucaaucgguuuacgaugaagcacaagaaagccacguacgagccggacguggaccucggcagugggacacgcaacaucgguauagagagcgagaucccuaaccuggacaucauaggcaagcggauugaaaagaucaagcaggagcacgagaccuccuggcacuacgaccaagaccacccuuacaagacuugggccuaccacggaagcuacgagaccaagcagaccggcuccgccagcuccauggugaacgggguggugcgccugcucaccaagcccugggaugucgugccgauggucacgcagauggcgaugaccgauaccacccccuucgggcagcagcgcguauuuaaggagaaaguggacacgcggacucaggagcccaaggagggcaccaagaagcugaugaagaucaccgccgagugguuauggaaggaguuagggaaggagaaaaccccccggaugugcacccgggaagaguuuacccgcaaggugcgcagcaacgcugcccugggcgcagucuucaccgacgagaauaaguggaagagcgcgcgagaagccguggaggacggacgguucugggagcugguugaccgcgagcggaaccuccaccuggagggcaaaugcgagacuugcguauacaacaugauggggaagcgcgagaaaaagcucggcgaguucggcaaagccaaggguagccgggccaucugguacauguggcucggcgcgcgcuuccuggaguucgaggcucucggguucuugaaugaagaccacugguucucccgcgagaacagccugucaggcguggagggggagggccugcaccgccucggauacauccuacgggacgucuccaagaaggagggcggagccauguacgccgaugauaccgccgggugggacacccgcauuacccuggaggaccugaagaaugaggagauggugacgaaucacaugaagggcgaacacaagaagcuggcggaggccaucuucaagcuuacguaccagaauaaggugguccgggugcaacgcccgacgccccggggcaccgugauggacaucaucagcagaaaggaccagcggggauccggccaggucgggacguacggccucaacacauucacgaauauggaggcacaguugauacgccagauggagggugagggcaucuuccggagcauucagcacuugaccgcaacggaggaaaucgccgugcagaacuggcucgcgcgggugggccgcgaacggcugucccgcauggcgaucagcggggacgacugcgucgugaagcccauugacgaccgauucgcguccgcccugaccgcacucaaugacaugggcaagguccgcaaggacauccagcagugggagccuagccggggguggaaugacuggacccaggugccguucugcucacaccacuuucacgagcuggucaugaaggacgggcgcguguuagucguucccugccggaaccaggacgagcucauugggcgcgcgcggaucagccagggcgccggcuggucccugaaggagaccgccugccugggcaagucguacgcucagauguggacucucauguacuuccaccgccgggacuuacgccuggccgcgaacgccaucugcagcgccgugcccagccacuggguccccacguccagaaccaccuggagcauucacgcuaagcacgaauggaugaccacggaagacaugcucgcgguguggaaucgcguguggauccaggagaacccguggauggaggacaagacgcccgucgaguccugggaggaggugcccuaccugggcaagcgggaagaccagugguguggcagccugaucggccucaccagccgcgccaccugggccaagaauauccagacggcaaucaaccaggugcggucccugaucgggaacgagggcuacacugacuacaugcccagcaugaagcgauuccgcagagaggaggaggaggccggaguccugugguga

SEQ ID NO: 24812 - RNA, 9876 nt, Artificial Sequence
  derived and/or modified CDS sequence (opt11) from DENV-2__JX669478__SS-prME
accgccggcgugauagucaugcugaucccgaccgccauggcauuccaccucacaacccgcaauggggagccccacaugaucgugggucggcaggagaaagggaagucccuucuguucaaaaccgaggacggcgugaacauguguaccuugauggccaucgaucugggggagcugugugaggacaccaucaccuauaaaugcccccuccuucgucagaacgagcccgaggacaucgauugcuggugcaacagcaccagcacgugggucaccuacgggaccugcacuaccacgggcgagcaccggcgcgagaaacggucaguggcacugguuccccacgucgggaugggccucgagacccgcaccgaaaccuggaugagcuccgagggggcguggaagcacgugcagcguauugagaccuggauucugcgccacccgggcuucaccaucauggccgccauccuggccuacaccaucggaacuacgcacuuucagcgggcccucaucuuuauccugcugaccgccguggcacccagcaugaccaugcgcugcaucggcauaaguaaccgggacuucguugagggcgugagcggcggcuccuggguggacaucguacucgaacacggcagcugugugaccacgauggcuaagaacaagccuacucuggacuucgagcugaucaagacagaggccaaacagccugccacccucaggaaguacugcauugaggcgaagcugacaaauaccacuaccgaguccaggugcccgacgcagggagagcccagccugaacgaggaacaggacaagcgcuucaucugcaagcacuccauggucgaccggggcuggggcaacggcugcggguuguucgggaagggcgggauagugaccugcgcgauguucacguguaagaaaaacauggaggggaagaucguccagcccgagaaccuggaguacaccaucgugaucacgccccacagcggggaggagcacgccgucggcaacgacaccgggaaacacggcaaggagauaaagaucacuccucaguccagcacgaccgaggccgaacugacgggguacggcaccgugaccauggagugcagcccuaggaccggccucgacuucaacgagauggugcugcugcagauggaggauaaagccuggcuaguucaccggcagugguuccuggaccugccccucccguggcugccgggagcagacacgcaggggagcaacuggauccagaaggagacccuggugaccuucaagaauccccacgcgaagaagcaggacguggucgugcucgggucccaggagggcgccaugcacaccgcccugacgggggccaccgaaauccagaugagcagcggcaaccuccuguucaccggccaccugaaaugccgccuacggauggacaagcuccaguugaagggaauguccuacagcaugugcaccggcaaguucaaaaucgucaaagaaaucgccgaaacgcagcacggcaccauagugauccgcguucaguacgagggcgacggaucccccuguaagauccccuucgagaucaccgaccuggagaaacggcacguucucgggcgucuuaucaccgugaacccgaucgugacggagaaggacagccccgucaauaucgaggcggagccacccuucggcgacuccuacaucauuguugggguggagccgggccaacugaagcucaacugguucaagaaggggagcuccaucgggcagauguucgagaccaccaugcgcggagccaagcguauggccauccugggggacaccgcgugggacuucggcagccucggcggagucuucacgucgaucgggaaggcccuccaccagguguucggggcgaucuauggcgcggcuuucagcggugugagcuggacgaugaagauccugauaggcgucaucaucaccuggaucgggaugaacucgcgcuccaccagccuguccgugagccuggugcucgucggcguggugacgcuguacuuaggggccaugguccaggcggacuccggcugcaucgugagcuggaagaacaaggagcucaagugcggcuccgguaucuucaucaccgauaacgugcacaccuggaccgagcaauacaaguuccagcccgaaagccccagcaagcuggccuccgccauccagaaggcccacgaagagggcaucuguggaauacguagcgucacgcgccuggagaaccucauguggaagcagauaacccccgagcugaaccacauccugucagaaaacgaggugaagcucacgaucaugaccggcgacaucaaggggaucaugcaggcgggcaagcggagccuucguccgcagcccacggagcuaaaguacucguggaagaccuggggcaaggccaagaugcucagcaccgagucccacaaccagaccuuccugaucgacggaccagagaccgccgagugcccaaauaccaaccgggcuuggaacucgcuggagguggaagacuacggcuucggggucuucacaaccaacaucuggcucaagcugagggagaagcaggacguguuuugugacuccaagcugaugagcgcagccaucaaggauaacagggccgugcacgcugacaugggguacuggaucgaguccgcccucaacgacacguggaagauggagaaggccagcuucaucgagguuaaguccugccacuggccaaagagccauacacugugguccaacggcguacuugagagcgagaugaucaucccgaaaaacuucgccgggcccgugucccaacacaacuaccguccgggcuaucacacccagaccgcugggcccuggcaccucgguaagcuggagauggacuucgacuucugcgaggggaccacugucguagucaccgaggacugcggcaaccggggcccgagcuugcgcaccacaacggcaagcggcaagcucaucaccgaguggugcugccgguccugcacccugcccccgcuccgcuaucggggcgaggacgggugcugguacggcauggagauccgcccccucaaggagaaggaggagaaccuggucaacagccugguaaccgccgggcacggccagauagacaacuucucccucggugugcuggggauggcgcuguuccucgaggagaugcugcggacgcgcgucggcaccaagcacgcgauccugcucgucgcccugagcuuugugacccugauuaccggcaacauguccuuucgggaccucggccgcgucauggucaugguaggggccacgaugacggacgacaucggcaugggcgucaccuaccuggccuuacucgccgcauucaaggugcgccccaccuuugccgccgggcugcugcuacggaagcugacgagcaaagagcuuaugauggccaccaucggcauugcccuccugucgcagagcacucugccggagaccauccucgagcugacggacgcgcuggcccucgggaugauggcccugaagaucgugcgcaacauggagaaguaccagcuugccgucaccaucauggccaucucuugcgucccgaacgcagugauccuccagaacgccuggaaggucagcugcaccauacuugccgcuguguccgugagcccucuguugcuaaccagcucgcagcagaaggcggacuggaucccccuggcacucacuaucaagggucugaaccccaccgccauuuuccugaccacccuauccagaacgagcaagaagcgcucuuggccgcugaacgaggccaucauggccgucggcaugguguccauccuggcgagcagccuccugaagaacgacauccccaugaccgggccccuggucgccggcgggcuccugaccgugugcuaugugcugacgggccggagcgccgaucucgagcuggagcgcgccgccgacgucaagugggaggaucaggcggagaucuccgggagcuccccuauacugucaaucacgaucuccgaggacggcagcauguccaucaagaacgaggaggaggagcaaacccucacuauccucauccggacuggccugcucgugaucagcgggguguucccggucuccauaccaaucaccgccgcggccugguaccugugggaggugaagaagcagcgcgccggaguacugugggaugugccaucgccgccgcccguggggaaggcugagcucgaggacggcgcguaucgcaucaagcagcgcggcauuuucggcuauucucagaucggcgccggggucuacaaggagggcacguuccacaccauguggcacgucacccgcggcgccgugcugaugcaccgcggcaagcggaucgagcccagcugggccgaugugaagaaggaucugaucuccuacgggggcggcuggaaacuagagggggaguggaaggagggugaggaaguucaaguucuagcucuggagcccgggaagaacccucgcgccgugcagaccaagccagggaucuucaagacgaacaccgggaccaucggcgcggucucucucgacuucucccccggcaccucugggaguccgaucgucgaccggaagggcaaggucgucgggcuguacgguaacggcguggucacgcgcaguggggccuacgucuccgcgaucgcccagaccgagaaguccauugaggacaaccccgagaucgaggacgacaucuuccggaagaagcgguuaaccaucauggaccuccacccgggugccgggaagaccaagcgguaccugcccgccaucgugcgagaggccauuaaacggggccuucgcacgcugauccuagcgccgacccgcguggucgcggccgagauggaggaggcccugagagggcugcccauccgcuaucagacacccgccauccgcgcggagcacacaggccgcgagaucguggaccucaugugccacgccacguucaccaugcggcuguugucacccguacgcgucccgaauuacaaccuaaucaucauggacgaggcccacuucaccgacccggccuccaucgccgcucggggcuauaucagcacccgcguggagaugggggaggccgccggcaucuucaugacggccacaccgcccgggagccgggacccguuuccccagagcaacgcacccaucauggacgaggagcgcgagauccccgagcggucguggaacagcggccacgagugggugaccgacuucaaggggaagaccgucugguucgugcccuccaucaaggccggcaacgacaucgcggccugccugcgcaagaacggcaagaaggugauucagcugagccggaagacguucgacuccgaauacgucaagacgcgugcaaaugacugggacuucguggugacaaccgacaucagcgagaugggggcaaacuucaaggccgagcgggucaucgacccccgccggugcaugaagcccgugauacucacggacggcgaagagcgagugauccuugccgguccaaugccggucacucacuccagcgcagcccagcggcgcggucgcaucgggcggaaucccaagaaugagaacgaccaguacaucuacaugggcgagccccuggagaacgacgaggacugcgcgcacuggaaagaggcuaagaugcuccuggacaauaucaacacccccgaaggcaucaucccguccauguucgagcccgagcgcgagaagguggacgccaucgacggggaguaccggcugcguggcgaggcccggaaaacguucguugaccuuaugcgccgcggggaccugcccguauggcuggccuacaagguggcggccgagggcaucaacuacgccgaccgcaaguggugcuuugacgggaucaagaacaaccagauccucgaggagaacgucgaggucgagaucuggaccaaggagggcgagcggaagaagcugaagccgcgcuggcuggacgcucgaaucuacagcgacccacucgcgcugaaggaguuuaaggaguucgccgccggccgcaagucacugacccucaaccugaucaccgagaugggucggcugcccaccuuuaugacgcaaaaggcccgcaaugcccucgacaaucuggcggugcugcacaccgccgaggugggcgggaaggcguacacacaugcccucuccgagcugcccgaaacacuggagacgcuccugcugcugacccugcuggccgcggugaccggcggaaucuuccucuuccugauguccgguaaggguauagggaagaugacacugggcaugugcugcauaaucaccgccagcauccuccucugguacgcucagauccaaccgcacuggaucgccgccuccauuaucuuggaguucuuucucaucguguugcugauaccagaacccgagaagcagagaacgccccaggacaaccagcucaccuacgucgugaucgcgauccugaccguggucgccgccacaauggccaacgagaugggguuucuggaaaagacgaagaaggaccucgguuucgguagcaucaccacccaagagagcgagucgaacauccuggacaucgaccugcggccggccagcgcguggacccucuacgcaguggcuacgaccuucguuacccccaugcugcggcacaguaucgaaaacagcucagucaacgugagccugaccgccaucgcgaaccaggccaccgugcucauggggcugggaaagggguggccccuguccaagauggacaucggcgucccccuccuggcgaucggcugcuacagccaggugaacccgaucacccugacggccgcgcuccugcugcugguagcucauuacgccauaaucggccccggccuacaagccaaggcgacgcgcgaggcccagaaacgggccgccgccgggaucaugaaaaaucccacggucgacggcaucaccgugaucgaucuggagcccaucccguacgaccccaaguucgaaaagcaacucgggcaggucaugcugcugauccucugcgucacgcaggugcuaaugaugcgcaccacaugggcccugugcgaggcccucacccuggcgaccggccccaucuccacccugugggaggggaaucccgggcgguuuuggaacacgaccaucgcugugagcauggccaacaucuucagaggcuccuaccucgccggggcuggucugcuuuucuccauuaugaagaacaccaccaacacgcgccgggggacaggcaacgucggcgagacccugggggagaaguggaagucccgccugaacgcucugggcaagagcgaguuccagaucuacaagaaguccgggauccaggagguggaccggacccucgccaaggaggguaucaagcgcggggagacggaccaccacgccgugagccggggcuccgccaagcugcgcugguucgucgagcggaacauggugaccccagaggggaagguugucgaccugggguguggccgcgggggcuggagcuacuacugcgggggccucaagaacgugcgugaagugaagggccugaccaagggcggccccggccacgaggagcccauccccauguccaccuacggcuggaaccugguccgccuccagucuggcguagacguguucuucacgccgcccgagaagugcgacacccugcugugcgacaucggcgagagcucccccaaccccaccaucgaggcgggccggacccuccgcguccugaaccugguggagaacuggcuaaacaacaacacccaguucugcauaaaggugcugaauccguacaugcccucggucaucgagaagauggagacgcugcagcggaaauacgggggcgcccucgugcgcaacccccugagccggaacagcacccaugagauguauuggguguccaacgccaccggaaacaucgucagcucggugaacaugaucagccgcaugcugaucaaccgguucaccaugaagcacaagaaggccacguacgagccggacguggaccugggcuccgggacccgcaacaucggcaucgaaagcgagauucccaaccucgacaucaucggcaagcggaucgagaagauuaagcaggagcacgagaccucguggcauuacgaccaggaccaccccuacaagacgugggccuaccacgggagcuaugagacuaagcagaccggcuccgcgagcuccaugguaaacgguguggugcgcuugcuuaccaagcccugggacgucaucccuauggugacccagauggccaugacggauaccaccccuuucggccagcagcgcguguucaaggagaaggucgacacucggacgcaagagcccaaggagggcaccaagaaacucaugaagauuaccgccgaguggcuguggaaggagcuggggaaggagaagacgccccggaugugcacgcgggaggaguucacccgcaaggugcggagcaacgccgccuugggcgcgguguucaccgacgagaacaaguggaaguccgcccgcgaggccgucgaggaugggcgguucugggagcugguggaucgcgaacggaaccuucaccucgagggcaagugcgagaccugcguguacaacaugaugggaaagcgcgagaagaagcugggggaguucggcaaggccaaggguagccgggcgaucugguacauguggcugggcgcccgcuuccucgaauucgaggccuuaggguuccugaacgaggaccacugguucucccggggaaacucucugagcggggucgagggcgagggccugcaccgcuuaggguacauucuccgggagguaggcaagaaggaggggggcgccauguacgccgacgacacggcggggugggacacccgcaucacccucgaggaucugaagaacgaggagauggucaccaaccacaugaagggggagcacaagaagcucgccgaggcaaucuucaaacugacuuaccagaacaagguggugcgcguucagcguccgacgcccaggggcaccgugauggacaucaucuccaggaaggaccagcgggggucaggccagguggggaccuacggccugaacacguucaccaacauggaggcccagcucaucaggcagauggagggcgaggggaucuucaaguccauucagcaccugaccgccacagaggagaucgcgguccaaaacugguuggcgcgcgugggccgggagcgccucagcaggauggccaucuccggggacgauugcguggucaagcccaucgacgaccgcuuugccagcgcccugacggcucugaacgacaugggcaagguucggaaggacauccagcagugggagcccucccgcggauggaacgacuggacccaggugccguuuugcagccaccauuuccacgagcuugucaugaaggacggccgaguguuagugguccccugucgcaaccaagacgagcugaucggccgggcccgcaucucccagggggcgggcuggucguugaaggagaccgccugccuggggaagucauacgcccagauguggacccugauguacuuucaccggcgcgaccuccggcuggcugcuaacgccaucugcucugccgugcccucacacugggugcccaccagccgaacgacauggucgauccacgcgaagcacgaguggaugaccacagaggauaugcuggccgucuggaaccggguguggauccaggagaacccguggauggaggacaagacgcccguggagagcugggaggagguucccuaccucggcaagcgcgaagaccaguggugcgggucccugaucggccugaccagcagagccaccugggccaagaauauccagaccgcuaucaaccaggugcgcucgcucaucgguaacgagggguacaucgauuacaugcccuccaugaagcgguuucgccgcgaggaggaggaggcgggcguucugugguga

SEQ ID NO: 24813 - RNA, 9876 nt, Artificial Sequence
  derived and/or modified CDS sequence (opt11) from DENV-2__JX669480__SS-prME
acugccggcgugaucaucaugcugauccccaccgccauggccuuccaccucacuacccgaaauggggaaccccacaugaucgugggccggcaagaaaagggaaagucccugcuguucaagaccgaagauggcgugaacaugugcacucucauggccaucgaccugggugaauuaugcgaggacaccaucaccuacaagugcccccuccugaggcagaacgagcccgaggauaucgacugcuggugcaacucuacgagcaccugggugaccuacgguacuugcacuaccacgggcgagcaucggcgcgagaagcgcuccguugcgcuggugccccacguggggaugggccucgagacucgcaccgagaccuggaugagcuccgagggggccuggaagcacguccagcggauagagacguggauccuccgucauccgggcuucgccauuauggcugcuauccuggccuacacgaucgggaccacccauuuucagcgggcacucaucuucauccugcugaccgcggucgcccccucaaugaccaugaggugcaucggcaucuccaaccgggacuucguugaaggcgucagcggcggcaguuggguggauaucgugcucgagcacgggucaugugucacgacuauggccaagaacaagcccacgcuggauuucgagcugauaaagaccgaggccaagcagccggccacgcuacgcaaguacugcauugaggcgaagcuaacuaacacgaccaccgaguccaggugcccgacucagggagaacccagccugaacgaggagcaggacaagcguuucaucugcaagcacagcaugguggaccguggcugggggaacggcugcggccucuuuggcaaaggcgggaucguuacgugcgccauguuuacgugcaagaagaacauggaggggaaggucguguuacccgagaacuuggaguacaccauugugaucacgccccauagcggggaggagcacgccgucggcaaugacaccgggaagcacggcgaggagaucaagaucaccccgcaguccagcaucaccgaggccgagcucaccggguaugggaccgugacgauggagugcagcccccggaccggccuggauuucaacgagauggugcuguuacagauggaggagaaggccuggcugguccaccggcagugguuccuugauuugccccuucccuggcugccgggggccgacacacagggcucgaacuggauucagaaggagacccucgugacuuucaagaacccucaugccaagaagcaggacguugucgugcucgggucacaagagggggcuaugcacaccgcgcucaccggggccaccgagauacagaugagcagcgguaaccuccucuucacagggcaccugaagugccgccuccggauggauaagcugcaguugaaggguauguccuacagcauguguaccggaaaguucaaaaucguaaaggagaucgcggagacccaacacgggaccaucgugauccgcgugcaguaugaaggugacggcagccccuguaagauccccuucgagauuauggaccucgaaaagcggcacguccuggggcgccugaucacggugaacccgauaguuaccgagaaggacagccccgucaacaucgaggccgagccgcccuucggcgacuccuacaucauaauugggguggagccggggcagcucaaacugaacugguucaagaaggggagcuccaucggccaaauguucgaaaccaccaugcggggcgcaaagcggauggcaauccugggggauacugcgugggauuucggcagccucgggggcguguucaccuccaucgggaaggcgcuccaccaggucuucggcgccaucuacggggccgccuuuagcggagugucuuggaccaugaagauuuuaaucggcguuauaaucaccuggaucgggaugaacucucgcuccacaagucuguccgucucgcuugugcugguuggcgucgugacguuguacuuaggggcgauggugcaggcugacucggggugugucgugucguggaagaacaaggagcugaaaugcggcuccgggaucuucaucacugacaacgugcacaccuggaccgagcaguauaaguuccagccggagagcccuaguaaacuggccuccgccauucaaaaggcccacgaggaaggcaucugcgggauccggagugucacgcggcucgaaaaccugauguggaagcagauaacccccgagcugaaccacauccucuccgaaaacgagguaaaacucaccaucaugacgggggacaucaaagggaucaugcaggccggcaagcguagccugcgaccgcagcccaccgaguuaaaguauuccuggaagaccuggggcaaggccaagaugcugaguacggagucccacaaccagacguuucugaucgacgggcccgagaccgccgagugcccgaacacaaaucgggcuuggaacucgcucgagguggaggauuauggcuucggugucuucacuacgaacauuugguuaaagcugcgugagaagcaggacgucuucugcgacuccaagcucaugucggccgcaaucaaggacaaccgggccguccacgcagauaugggcuacuggauugaaagugcccugaacgacaccuggaaaauggagaaggccucuuucaucgaggucaaaucuugccacuggccaaagagccacacacugugguccaauggaguacuugagagcgagaugaucauccccaagaauuucgcgggccccgugucgcagcauaacuaccgcccaggcuaccauacccagaccgccggucccuggcaucuuggcaagcuggagauggacuucgauuucugcgaggggacgacagucguggugacagaggacugcggcaaccggggccccagccugcgcacgacgaccgccagcgggaagcucaucaccgaauggugcugcaggaguugcacucugccuccgcuccgcuaccgaggcgaagacgggugcugguacggaauggagauccgcccccugaaggaaaaggaggagaaucuggucaacagccucgugacagcugggcacggacagaucgacaacuucucccuaggaguucuggggauggcccucuuccuggaggagaugcugcggacccgagucgguaccaagcacgccauccuccugguugccgucagcuuuguaacccugauaacagguaacaugucauucagagaccucggccgcguaauggugaugguaggggugaccaugaccgacgacauuggcaugggcgugaccuaccuggcccugcuagccgcauucaagguacgcccaaccuucgccgccgggcugcugcuccggaagcugaccucaaaggagcugaugauggccacgaucggcauaacccuccugucacagagcaccauccccgagaccauccuugaacucaccgacgcccuggcgcuuggcaugauggugcucaagaucguacgcaauauggagaaauaucagcuggccguuaccauuauggccauauccugcguccccaacgccgucauccugcucaacgccuggaaggucagcugcacgauccuggcggcgguguccgucagcccacugcuccugaccuccagucagcaaaagaccgauuggaucccucuggcccucaccaucaagggacugaaccccacggccaucuuccugaccacgcucucccggaccuccaagaagcgcuccuggccccugaacgaagcgguaauggcagugggcauggucucuauucuggccuccucucuccugaagaacgacauccccaugacggggccccugguggccggugggcuccugaccguuuguuacgugcugaccggccggagcgcugaucucgagcuggagcgcgcggccgacgugaagugggaggaccaggccgagaucuccgguagcucccccauccugagcaucaccaucucagaggacggcagcauguccaucaagaacgaggaagaggaacagacguuaaccauuuugauaaggaccggccugcucgugaucagcggggucuucccgguguccauucccaucacugcugccgcaugguaccugugggaagugaaaaagcaacgcgcuggaguccugugggacgugcccagcccgccucccguggguaaggcggagcucgaagacggcgccuacagaaucaagcagcgcgggauccugggcuauucccagaucggcgccggaguauauaaggaaggcaccuuccacacgauguggcaugugacccgcggggcgguguuaaugcauagaggaaagcggaucgagcccucaugggccgacguaaagaaggaccucaucuccuacgggggcggcuggaagcuggaaggagaguggaaggagggcgaggagguccaaguucucgccuuggaaccugggaagaauccccgcgccguccagacaaagcccggccuguucaagaccaacacgggcaccauaggugccgucagccuggacuuuucccccggcaccucugggagucccauuguggaccggaagggcaaggucguggggcucuacggcaauggcguggucaccaggucgggggcguacgugucagcuaucgcccaaacagagaagucuaucgaggacaaccccgagauugaggaugacauauuucgaaagaagcgccugaccaucauggaucugcaccccggcgccggaaagacuaagcgguaccugcccgcuaucgugcgcgaagcuaucaagcgaggccuccgcacccugauauuggcuccgacgcgcgucguggccgccgaaauggaggaggcgcugagggggcugcccauccgcuaccagacgcccgcgauucgggccgagcacaccggccgcgagaucguugaccugaugugccacgcuaccuucaccaugcggcuccugagccccguccgcguuccaaacuacaaccugaucaucauggacgaggcucacuuuaccgaccccgcuagcaucgcugcccgggguuauaucagcacgcgcguggaaaugggugaggccgccggcaucuucaugaccgcuacuccaccaggcucccgcgacccguucccccagucuaacgcucccaucauggacgaggagcgggagauccccgagcggucguggaacucagggcacgagugggucaccgacuuuaaggggaagacaguaugguuugucccguccauuaaggccgggaacgacaucgccgcgugccuccgcaaaaacggcaagaaggucauccagcugagccggaagaccuucgacagugaguacgugaaaacgcgugcaaacgauugggacuucguggucaccacagacauaagugaaaugggggccaacuuccgggccgagcgcgugaucgacccgaggcgcuguaugaagcccgucauccugaccgacggcgaggaacgggucauccucgccgggccgaugccggugacgcacagcucagcggcccagcgccgcggccguguugggcgcaaucccaaaaacgagaacgaucaauacaucuacaugggcgagccucuggaaaacgacgaagacugcgcucacuggaaggaagccaagaugcugcuggacaacauuaacacccccgaaggcaucaucccauccauguuugagcccgaacgcgagaaggucgacgccaucgacggggaguaccgccugcggggugaagcgcgcaaaaccuucguggaccugaugcggagaggggaccuaccuguguggcuggcguaucgggucgcagcagaggggauaaacuacgccgaccgccgguggugcuucgacgggaucaagaacaaucagauccuggaagagaauguggaagucgagaucuggacuaaggaaggcgaacgcaagaaacucaagccucgauggcuagacgcacgcauauauagcgacccguuggcacuaaaggaguucaaggaguuugccgccggccguaagucccugacgcugaaccucaucacugagaugggacgccuuccuaccuucaugacgcagaagacgagagacgcgcuggacaaccucgccgugcugcacaccgcagaggccggcgggcgagcuuacaaccacgcgcugagcgagcuccccgagacucuggagacgcugcugcugcugacguuacuggccaccguaaccggcggcaucuucuuauuccugaugucggggaaaggcauugggaagaugacgcugggcaugugcuguaucaucaccgccagcauacugcucugguaugcccagauccagccgcacuggaucgccgcguccaucauccuggaguucuuccugaucguccugcugauccccgagcccgagaaacagagaacgccgcaggacaaccaguugaccuauguggugaucgccauccucacagucguggccgccaccauggccaaugagauggguuucuuagagaagacgaagaaggaccugggacucggcagcaucaccacccaagaaagcgaauccaacauccuggacaucgacuugcgaccggcgucugccuggacccucuaugcugucgcaacgacguuugucacccccaugcuacgucauucgaucgagaauagcucggucaacgugagccucacagcaauagcgaaccaggccacgguacucauggggcugggcaagggguggccgcuaucuaagauggauaucggcgugccucuccuggcaaucggcugcuacagccaaguuaacccgaucacccugaccgccgcgcuccugcuucuuguagcccacuacacuaucaucggccccggucuucaggccaaggcgacaagggaagcccagaagcgcgcggccgccgggaucaugaagaacccuaccguggacggcaucaccgugauugaccuggagcccauaccguacgacccaaaguucgagaagcagcuuggacaaguaaugcugcugaucuugugugucacccaggugcucaugaugcggacgaccugggcccugugcgaagcccucacccuggcgaccggccccaucuccacgcugugggaggggaaccccggccgcuuuuggaauacaaccaucgcugucucgauggcuaacaucuuccggggcuccuaccuagccggggccggccugcuauucagcaucaugaagaacacgacgaacacacgccggggcaccgggaacauuggcgagacccucggggaaaaguggaagucccgccugaacgcguugggcaagucugaguuccagauuuacaagaaauccgggauccaggaaguggaccggacacucgccaaggagggcaucaagagaggggaaacagaccaccaugccgugagccgaggcuccgcuaagcugcgaugguuuguggagcggaacauggucaccccggaggggaagguggucgaccuaggguguggccgcgggggcuggagcuauuacugcgggggccuaaagaauguucgcgaggugaagggcuuaaccaagggcgggccgggccacgaggagcccaucccaaugaguacuuacggguggaaucugguccgccuccaaagcgggguggacgucuucuuuacaccacccgagaagugcgacacccugcugugcgacaucggcgagagcucccccaaccccacaaucgaggcgggccggacccuccgcguucuaaaccugguggagaauuggcuaaacaacaacacgcaguucugcauaaaggugcugaacccguauaugccuuccgucaucgagaagauggagacucugcagcggaaguacgggggcgcccucgugcgcaacccgcucucucguaauagcacacacgagauguacugggucuccaacgcaaccgguaacaucguaaguuccguaaacaugaucagccgcaugcugauaaaucgauucacuaugaagcacaagaaggccaccuacgagccggacguagaccugggcagcggaacccggaacaucggcauugagagcgagauccccaaucucgauauaaucggcaagcggauugagaagaucaagcaggaacacgagaccuccuggcacuacgaccaagaccaucccuacaagacgugggcguaccacggguccuacgagacuaagcagacgggauccgcgaguuccauggucaacgggguggugcggcugcuaaccaagcccugggauguugugccuaugguaacacagauggcaaugaccgacaccacccccuucggccaacagcgugucuuuaaggaaaagguggacacacgaacccaggaacccaaggaagguacaaagaagcugaugagaaucacugccgagugguuguggaaggagcuggggaagaaaaagacgccccgcaugugcacccgcgaggaguucaccagaaaggugcgcagcaacgccgcccuuggcgcgauuuucacggacgagaacaaguggaaguccgcucgggaagccguugaagacagucgcuucugggagcuaguggaccgggagcgcaacuuacaccucgagggaaagugcgagacgugcgucuacaacaugaugggcaagcgggagaaaaagcugggcgaguucggcaaggccaagggcagucgcgcuaucugguacauguggcucggggcacgguuccucgaguucgaagcccugggcuuucugaacgaggaccacugguuuagccgcggcaacagccuaucagguguggagggggaggggcugcaccggcuaggcuacaucuugcgcgacgugucuaagaaggagggcggagccauguacgccgacgacaccgcugguugggauacccggauaacgcuggaggauuuaaagaacgaggagauggugacgaaccacaugaagggcgagcacaagaagcuggccgaggcaaucuucaaacuuaccuaucagaauaagguggugcgcguccagcgcccuacuccacgggggaccgugauggacaucaucaguaggcgcgaccagcgcgguagcggccaagugggcacuuacggccugaacaccuucaccaacauggaggcccagcucauucggcagauggagggggagggcauuuucaaauccauccagcaucugaccgucacggaggagauugccgugcagaacuggcuggcgcgcgugggccgagagcgcuugagccggauggcuaucuccggggacgacugcguagugaaacccuuggacgaccgcuucgcgagcgcccugaccgccuuaaacgacauggggaaggugcggaaggacauccagcagugggaacccagccgcggguggaacgacuggacucagguaccguuuugcagucaccacuuccaugagcuuguuaugaaggacggccgaguacucgucgugcccugccgcaaccaggaugagcuuauaggccgggcgaggaucagccagggcgccggcuggucacucaaagagaccgccugucuggggaaaagcuacgcccagauguggacccucauguacuuccaccggcgcgaccugcggcuggcugcgaacgccauaugcucugccguuccgucccacuggguccccacgucaaggaccacaugguccauccacgccaagcaugaguggaugaccacggaggauaugcucgccguguggaaccgcguguggauccaggaaaaucccuggauggaggacaaaacccccgucgagagcugggaagagguucccuaccugggcaagcgugaggaccaguggugcgggagcuuaaucggccugaccucucgagcgaccugggccaagaauauccagacggccaucaaucaggugcggucuuugaucgggaacgaagaguauaccgacuacaugcccagcaugaagcguuuccggcgagaagaggaggaggccggcguccugugguga

SEQ ID NO: 24814 - RNA, 9876 nt, Artificial Sequence
  derived and/or modified CDS sequence (opt11) from DENV-2__JX669483__SS-prME
acagcgggcgugauuaucauguuaaucccgaccgccauggcauuucauuugacuacccgcaacggcgagccccauaugauaguggguaggcaggagaagggaaagucccuccuuuucaagaccgaagauggcgugaacaugugcacgcucauggccaucgaccuaggggaacuuugugaagacaccaucaccuacaaaugccccuuacugcggcaaaaugagcccgaggacauugacuguuggugcaacucaacuuccacuugggucaccuaugggaccuguacgaccacgggcgagcacaggagagagaagcggucgguagcgcuggugccacauguggggaugggccucgagacccgcaccgaaaccuggaugagcagugagggggccuggaaacacguccaacgcaucgagacguggauauugcgccacccugguuucgccauaauggcagccaucuuggcguacaccaucgggacaacccacuuccaacgggcacuuaucuucauccuguuaacggcaguggcccccagcaugacaaugcggugcaucggcaucuccaaccgggacuucguggagggugucagcggggggucguggguggacaucguucucgagcacgggucgugcgucaccaccauggccaaaaauaagccaacgcuggacuucgaguugauaaaaaccgaggcaaaacaacccgccacccucagaaaauacugcaucgaggcgaagcugaccaacacuaccaccgagucccguuguccuacgcagggagagcccagccucaaugaagaacaggacaaacgcuucaucugcaagcacucgaugguagacagaggauggggcaacggcugcggcuuguucggcaagggggggaucguuaccugugccauguucacuugcaagaagaacauggaggggaaggucgugcugcccgaaaacuuagaauacaccaucgugauuacgccgcacagcggugaggaacacgccgucggcaacgacacaggaaagcacggugaggagaucaaaaucaccccccaguccucaauuacagaggccgagcucaccggguauggcaccgugaccauggagugcuccccccgcaccggacuggauuuuaacgagauggugcugcuacagauggaggagaaggcuuggcuagugcauagacagugguuccuugaccuccccuugccuuggcucccaggggcggauacccaaggcagcaacuggauucagaaggagacacucgucacuuucaagaacccccacgccaagaagcaggacguggugguacuggggagccaagagggugcgaugcacaccgcccugaccggggcgacugagauccagaugagcucggguaaccuccuauucacgggccaccuaaaaugccggcuccggauggauaagcuccaacugaagggaauguccuauucuaugugcaccggcaaguucaaaauugucaaggaaaucgcggaaacacagcauggaacgaucguuaucaaagugcaguacgaaggugacggaucuccuuguaagauccccuucgagaucauggaccucgagaagaggcacguucugggucgacugaucacggugaauccaaucguuacggagaaggacagccccgucaauauugaagcugagccacccuucggcgauuccuacaucauaaucgggguggagccuggccagcucaagcuuaacugguucaaaaaagggaguagcaucggccagauguucgagacgaccaugaggggagcgaagaggauggccauccugggggacacugccugggauuuuggcaguuugggggggguguucaccuccauugggaaggcgcugcaucaggucuuuggcgcuaucuacggcgccgcguucucgggggucuccuggacgaugaagaucuuaauaggagugauaauaacauggaucggcaugaacucccgguccacgucguuauccgucagccucguguuaguaggcguggugacccuguaccucggggcgauggugcaagcagacuccggaugcgucguuagcuggaaaaauaaagagcugaaguguggguccgggauauucauuaccgacaacguccacacauggaccgaacaguacaaauuucagcccgagucaccuucgaagcuggccuccgcuauccagaaggcacacgaggaagguauauguggcauccgcagcgucacccgucuagagaaccugauguggaagcagaucaccccugaauugaaucacauccucagcgagaacgaggugaaacucacgauaaugacgggcgacauaaagggaauuaugcaggcggggaaacgcucacugcgaccgcagcccaccgaacugaaguacuccuggaagaccuggggcaaggccaagaugcugagcaccgagagccacaaccagaccuuucugaucgacggacccgagacggccgaguguccgaauacgaaccgcgccuggaacagccucgagguggaagacuacggauucggggucuucaccacgaacaucugguugaaacugcgggaaaagcaggacguguucugugauucaaagcucaugagcgccgcgauuaaggacaaccgagccguacacgccgauaugggcuacuggaucgagagugcccucaaugacacguggaaaauggagaaggcuagcuucaucgaaguaaaguccugccacuggcccaagagccauacucucugguccaacggcgugcucgagucagaaaugaucauaccgaagaacuuugcggggcccgugucacagcacaacuaucgaccgggcuaccacacccaaaccgccgggcccuggcaccugggcaagcucgagauggauuucgacuucugugagggcaccaccguggugguaacggaggauugcggcaaucgcggccccucgcuccggaccacgacggccagcgggaagcugauaaccgaauggugcugcagguccugcacccugcccccgcucagguaccgaggcgaggacgggugcugguacgguauggagauccggccacugaaggagaaggaggaaaaccuggucaacucacuuguaacggccgggcacggucaaaucgacaacuucucgcugggcgugcuggggauggcacuuuuucuggaggagauguuaagaacucgggucggaacgaagcacgccauccuucugguagcggucucauucgucacccugaucacaggcaacaugucuuuucgcgaucucggccgugugaugguaauggucggugucacaaugaccgacgacauaggcaugggcgugaccuaccuggcccuucucgccgcguuuaaggugcgaccgacuuuugcggccgggcuccugcuccguaagcuaacgucaaaggaacugaugauggcaaccaucggcauaacuuuacuuucccaauccacgauacccgagacaauccuggagcucacugacgcccuggcauuagggaugaugguucucaagaucgugcguaacauggagaaguaucagcuugccgucacgaucauggccaucaguugcgucccgaacgccgugauucuguuaaacgcauggaaggugagcuguacgauucucgcggccguuuccguuagcccacugcuguuaacauccagccagcagaagacagacuggaucccccuugcgcucaccaucaagggacuuaacccuacggccauauuucugaccacucucuccagaacguccaagaaacgguccuggccgcugaaugaggcggugauggcugugggaaugguauccauuuuagcauccucgcuccugaaaaacgauauuccaaugacggggccccugguggcaggcgggcuucuaaccguuugcuauguucugaccggcaggagcgcggaucucgaacuggagcgggcggcugacgugaagugggaggaccaggccgaaaucuccggaagcagcccgauccugucaaucacaaucuccgaagauggcagcauguccaucaaaaacgaggaggaggagcagacgcucaccauccugauccggaccggacuguuagugauuaguggggucuuuccuguuagcauaccaaucaccgccgcugcaugguaccuuugggaggugaagaagcagcgcgccggcguacugugggacgugccaagcccucccccuguggggaaggcggaacuagaagacggggccuaccgaaucaaacagagggggauccugggcuacucgcagaucggcgccggcgucuacaaagagggcaccuuccacacaauguggcauguaaccaggggggcggugcucaugcaccggggaaaacgcaucgagccaagcugggcugaugucaagaaagaucucauuucuuacggggguggcuggaagcuggaaggggaguggaaagagggcgaagagguccaagugcuggcucuugagccaggcaaaaacccccgggcuguccagaccaaaccgggucucuucaagacaaacacgggcaccaucggcgcugugagccuugacuucuccccugggaccagcggaaguccaauaguggaucgcaaaggcaaagugguuggccuuuacgguaacggcguggucaccaggagcggugcguacgugagcgcaaucgcccagacggaaaaguccaucgaagacaaccccgagaucgaggaugacaucuuccguaagaagcggcuuaccauaauggaccuacacccgggcgccggcaaaacuaagagauaccugccggcaauugugcgcgaggccauuaagaggggcuugcggacacugaucuuggcuccgacgagggucguagcggccgagauggaggaggcguuacgcgggcuuccgauccgguaucagacuccagccauccgugccgagcauacagggagggagauuguagaucuaaugugccacgccaccuuuaccaugcgccuucucagcccuguccgagugcccaauuacaauuuaauaaucauggacgaagcucauuucacugauccugcaagcauugcagcccgcggcuacaucagcaccagaguugaaaugggggaggcugccggcaucuucaugacggcgacgccgccggggucccgcgauccuuucccucagucuaaugcaccaauuauggacgaggagcgggagaucccagagcgcuccuggaacagcggccacgagugggugaccgacuucaaggggaagaccgugugguuugugccguccauuaaggcugggaacgauauagccgcaugccucaggaagaacgggaaaaagguaauccagcucagcagaaagacauucgauuccgaauacgugaaaacgagagcgaaugacugggacuucgucgugaccacggacauaagcgaaaugggugcaaacuuucgcgccgagcgcgugaucgacccccgcaggugcaugaagccugugaucuugaccgacggcgaggagcgcgucauccucgcaggucccaugccggugacgcacaguagcgcggcgcagcggcgcgggcggguggggcggaacccgaagaacgagaacgaucaguauauauauaugggggagccccuggagaacgacgaagauugugcacauuggaaggaggccaaaaugcuucucgacaacauaaacacgccggaggguaucaucccuuccauguucgagccggaacgcgagaaagucgacgcaaucgauggggaguaucggcugcgcggcgaggcccgcaagaccuuuguggaccugaugcgcaggggugaccuccccgucuggcuggccuaucgggucgcagccgagggcauuaauuacgcggaccgccgcuggugcuucgaugggaucaaaaacaaccaaauccuggaggagaauguagagguagaaaucuggaccaaggagggcgagcgaaagaaacucaagccgagguggcuggacgcgcguaucuacagcgauccgcuagcccugaaggaguucaaggaguuugccgccggucgcaagucucuuacucugaauuuaaucacagaaaugggucggcugcccaccuucaugacccagaagacacgggacgcacuggacaacuuagcgguauugcacaccgcagaggcgggcgggcgggccuacaaucacgcucuaagcgaacuuccggagacauuagagacacuguuacuccugacacugcuugcgacgguuaccggaggcauuuuucuuuucuugaugucggggaaagggaucgggaagaugacccuuggaauguguugcaucaucacugccagcauacuccugugguacgcgcagauacagccgcacuggaucgccgcauccaucauccuugaguuuuuccucaucguccuccugaucccugagccagaaaagcagcgcaccccccaggauaaccagcugacauacguggugauugccauucucaccgucguggcagccaccauggccaacgagauggguuuucuggagaagacgaagaaagaucucggccucggcagcauuacuacccaagagucggagucaaauauucucgacaucgaccuucggccggcgucugccuggacccucuacgcaguggcaacgaccuucgucaccccuaugcuccgccauuccaucgagaacagcagugugaacguaucccuaaccgccauagccaaucaggcgacgguccucauggggcuggguaagggguggcccuugagcaagauggacaucggcgugccccuacuagccaucggaugcuacagccaggugaacccgaucacccucacagcugcguuacugcuccucguagcacacuauacuaucaucggccccggauugcaggccaaagcgacgcgggaggcccagaagcgcgcugccgcgggcauuaugaagaaccccaccguggacggcaucacggucaucgaccucgaacccaucccguaugacccaaaguuugagaagcagcuagggcaggucaugcuguuaauccucugcgugacacagguacucaugaugcgcacuaccugggcccugugcgaggcacucacccuggccaccggcccaaucagcaccuuaugggaagggaacccaggcagguucuggaauaccaccaucgcagucagcauggccaauauauucaggggcuccuaccucgccggugccggucuucuguucagcauaaugaaaaauaccacgaacacccgccgagggacugggaacaucggagagaccuugggagagaaauggaagagucggcuaaacgcacuggguaaguccgaauuccagauauauaagaaguccgggauacaagagguggacaggacguuggcuaaggagggcaucaaacgcggcgagaccgaucaccacgccgugagccguggauccgccaagcugcggugguuuguagaacgcaauauggugacgcccgagggcaaaguggucgaccuaggguguggccgcgguggguggucauauuacugcggcggccuaaaaaauguacgcgagguaaaagggcugaccaaaggcggcccugggcacgaggagcccauccccaugagcacguauggcuggaaccuuguccgguugcagagcgguguggauguguucuucacuccuccggagaaaugcgacacccugcuuugcgacaucggggaaucgucccccaaucccaccauagaggcgggcaggacccucaggguccugaaucucguggagaacugguugaacaacaacacucaauuuugcauuaaagugcugaacccguauaugcccagcgucauugagaagauggagacgcuccagcggaaauacgggggggcccucgugcggaauccuuuaucccgcaauaguacccacgaaauguacugggucuccaacgcaaccgggaacauugucagcagcgugaacaugauuucacggaugcuuaucaaucguuucacuaugaagcauaaaaaagccaccuaugaaccggacguugauuugggcuccgggaccagaaacaucggcaucgagagcgagauccccaaccucgauaucaucggaaagcggaucgagaagaucaagcaggagcacgagaccuccuggcacuacgaucaagaccaucccuacaagacuugggcauaccacgggagcuaugagacuaagcagaccggguccgcgagcuccauggucaacgggguggugcgcuuguuaaccaagccgugggaugucgugccgaugguuacgcaaauggccaugacggauacaacccccuucgggcagcagcgggucuucaaagagaaagucgauacucggacccaagagcccaaggagggcacaaagaaacucaugcggaucacugccgaauggcuguggaaagaacugggaaagaagaagacgccccgcauguguacccgggaggaguuuaccagaaaggugcggagcaacgcggcccucggcgcgaucuucaccgacgagaauaaguggaagagugcccgcgaggcagucgaggacucucguuucugggaacugguggaucgugaacggaaucugcaucucgaggggaaaugcgaaaccugcgucuacaacaugaugggcaaaagagagaagaagcugggggaguucgggaaggcgaaggggucccgggcaaucugguacauguggcugggggcgcgcuaccucgaguucgaagcccugggauuccuuaaugaagaccacugguucagccgaggcaauagucugucgggcguagagggggagggccugcaccgccugggcuacauacugcgugacgugagcaagaaggaaggcggcgccauguacgcggacgacaccgcugggugggacaccagaaucacucuggaggaccugaagaaugaggagaugguuacgaaccacaugaaaggcgagcacaagaagcucgcugaagcgauuuucaaacugacuuaucaaaacaagguagugcggguccaacgcccaacaccccgggguaccguaauggauaucaucucccgucgcgaccagaggggcucuggccagguggggacauacggucugaauaccuucaccaauauggaagcacagcucauccgccagauggagggagaggguaucuucaagucgauccagcaucugaccgucacugaggagaucgcugugcagaacuggcuagcucgggugggccgcgagcggcucucuaggauggccaucuccggagacgacugugugguaaagcccuuagacgaccgguuugccucagcucucaccgcucucaaugacauggggaagguucgcaaggacauucagcagugggagcccagccggggguggaacgacuggacucaaguuccauuuugcagccaccauuuccacgagcugguuaugaaggacggccgcgugcuagucgugcccugccguaaccaggacgagcucauagggcgcgcgcggauuucccagggcgcggguuggagcuuaaaggaaacugcaugccucgggaaguccuacgcgcagauguggacccuuauguacuuucaccgccgggaucugcgcuuggccgcgaacgcaaucugcagcgccgugcccucccacuggguccccacaucgcgcaccaccugguccauccaugccaagcacgaauggaugacaacggaggauaugcucgccgucuggaaccgcguauggauccaggagaacccguggauggaggacaagacccccgucgagagcugggaggaggugcccuaucucggaaagcgggaagaccaguggugcgggagcuuaaucggccucaccucccgggcuacuugggccaaaaacauccagacggccaucaaccaaguccgcagccugaucgggaacgaagaguacacggauuacaugcccuccaugaagcgguuccgacgggaagaagaggaggcuggcguuuugugguaa

SEQ ID NO: 24815 - RNA, 9876 nt, Artificial Sequence
  derived and/or modified CDS sequence (opt11) from DENV-2__JX669484__SS-prME
accgcugggguaaucauaaugcugauccccaccgccauggcuuuccaucuuaccacgcgcaauggggaaccccacaugauugugggccggcaagagaaagggaagucucugcuguucaaaaccgaggacggagugaacaugugcacacuaauggccaucgaccugggugagcucugcgaggacacgauaaccuauaaaugcccccucuugcgccagaacgagcccgaggacaucgacuguuggugcaauagcacauccaccugggucaccuacgggaccugcaccacaacuggcgagcaccggcgcgagaagcgaagcguagcucuggugccacacguagguaugggccucgagacgcgcacugaaacauggaugucauccgagggagccuggaagcacguccagaggaucgagaccuggaucuugcgucacccgggguucgccauuauggcggccauccuggccuacacgaucgggaccacacacuuccagcgggcccucaucuucauucugcuaacugccgucgcccccagcaugaccaugcgcugcaucggcaucuccaaccgggacuuuguggaaggcgucuccgggggcuccuggguggacaucgugcucgagcacggaagcugcgugaccaccauggccaagaacaagccgacacuugauuucgaacugaucaagaccgaggccaagcagcccgccacacuccgcaaguacugcaucgaggcgaagcugacgaacacuacuaccgagucccggugcccgacucagggggagcccucuuugaacgaggagcaggauaaacgauuuaucuguaagcacucgaugguggacagggguugggggaacgggugcggccucuucgguaaaggcggcaucgugaccugugccauguucacguguaagaagaacauggagggaaaggugguucugcccgagaaucuggaguacaccaucguuaucacgccgcacagcggcgaggagcacgccgucggcaacgacacugggaagcacggaaaggagaucaaaaucaccccgcaaucuagcaucacggaggccgagcuuaccggguacgggaccguuacgauggaguguagcccgcgcaccggccuggacuucaacgagauggugcugcuacagauggaagagaaggcauggcuaguccaccggcagugguuccuggaccucccgcuucccuggcuaccgggggcggacacucagggcagcaauuggauccagaaggagaccuuagugacguucaagaacccccacgccaagaagcaggauguggucguccuagggucccaagaaggcgcgaugcacaccgcccugaccggggccacugagauacagaugaguagcggcaacuugcuguucacgggccaccucaagugucgacuccggauggacaagcugcaacugaagggcauguccuauagcaugugcacaggcaaguucaaaaucgucaaggaaaucgcggaaacccagcacgggacuaucguuauccgcgugcaauacgagggcgacggcucccccugcaagauaccguucgagaucauggaccuugagaagcggcacguccuggggcgccugaucaccguuaacccuaucgugaccgagaaggacagccccgucaacauagaggccgaaccgcccuuuggcgacuccuacaucauuauugggguggagccgggccagcuaaagcugaauugguucaagaaggggucauccaucggccagauguucgagacgacgaugcgcggugccaaacggauggcuauacugggggacacugcgugggacuucggcagcuuaggggggguauucaccuccauugggaaagcgcugcaccaggucuucggcgcuaucuacggcgcugccuucagcggggugucguggaccaugaagauccugaucggggugaucaucaccuggaucgggaugaacucucggucgacgagccucuccguuucgcucgugcuggugggggucgugacccuguaccucggggcgauggugcaggccgacucgggcugcgucguaagcuggaagaauaaggagcuaaaguguggguccgguaucuucaucaccgacaacgugcauaccuggacggagcaguacaaauuucaacccgaaagccccagcaagcucgccuccgcuauucagaaggcccacgaggagggcauuugcgggauuaggaguguaacucgccucgagaaccucauguggaaacagauaacccccgagcugaaccacauccuauccgagaacgaagugaagcugaccaucaugacgggagauaucaaggggaucaugcaagcaggcaagcggagccugaggccgcagccgacugagcucaaauacucauggaagaccugggggaaggcuaagaugcugagcacugagucccacaaucagacguuccugauugacgggcccgagaccgccgaauguccgaacacuaaccgggcguggaacagccucgagguggaggacuacgguuuuggggucuucaccacgaacauauggcuaaaguugagggagaaacaggauguuuucugcgacagcaagcuaaugagcgccgcgaucaaggacaaccgggcaguacacgcagacaugggauacuggauagagagugcccuaaauggcacuuggaagauggagaaggccagcuucauugaggucaaguccugccacuggcccaagucccauacccugugguccaauggagugcucgagucagaaaugaucauccccaagaacuucgcgggcccagugucccagcauaacuaccgcccgggguaucauacccagaccgccggcccuuggcaccuaggcaaacuggaaauggacuuugauuuuugcgagggaacgaccgucguugugaccgaggacuguggaaaccgcggaccgucccugagaacaacuaccgcauccggcaagcugauuaccgagugguguugccggucuuguacccugcccccucuccgcuaccgcggggaagacggcugcugguacgggauggagaucaggccacugaaggagaaggaggagaaccugguuaacucauuggucacggccggccacggccagaucgacaacuuuucccugggggugcugggaauggcgcucuuccuggaggagaugcuacggacucgugucgggaccaagcacgccauccuccugguggccgugagcuucguuacccugaucacugguaauauguccuucaaggaccucggccgugugauggugauggucggcguagccaugaccgacgacaucggcauggggguaaccuaccuggcccugcucgcugcauucaaggucaggccaaccuucgccgccggccuccuguugcgcaagcugacaagcaaggagcugaugauggcaaccauugggaucacacuccuaucccagagcaccauccccgaaacgauccuggagcucacugacgcgcuggcccuggggaugaugguguugaaaaucguucgaaacauggaaaaguaccagcuggccgucaccaucaugaccaucuccugcgucccuaacgccguuauccugcuaaacgcguggaaggucagcugcacgauucuggcggccguguccgucuccccccugcuuuugacguccagccagcaaaagacugacuggaucccacuggcgcucaccaucaagggccugaauccgacugccaucuuccuaacaacccugucccgcaccagcaagaaacgguccuggccgcugaaugaggcgguaauggcuguggggaugguaaguaucuuggccuccagccucuugaagaaugacaucccuaugacggggccccugguggccgggggacuuuuaaccgugugcuacguucugaccgggcguagugccgaccucgagcuggaacgggcggccgaugucaagugggaggaccaggccgagauaagcggcaguucaccaauccugucaaucaccauaagugaagacggcucuauguccaucaagaacgaggaggaggagcagacacucaccauucugauccgcaccgggcugcuggugaucagcggcguuuucccugugaguauaccaaucaccgccgccgcgugguaccuaugggaagugaaaaagcagcgggccgggguccuaugggacgugcccagcccgccacccgucggcaaggccgagcucgaggauggggcauaucgcaucaaacagcggggaauucugggcuauucccagaucggggccggcgucuacaaggaggggaccuuccacacaauguggcacguaacgcgcggugcggugcugaugcaccgggggaaacgcaucgagcccagcugggcagacgugaagaaggaucucauuaguuacggcgggggguggaaacuggagggcgaguggaaggagggggaggaaguucaagugcuagcccucgagcccggcaagaacccccgggcuguucagaccaagcccggacuguuuaagacaaacacugguacgaucggcgcugugucucuggacuucucccccgguacgagcggcuccccgaucguggacagaaagggaaaagugguaggcuuauacggaaacgggguggucacgcggucaggugcauacgucuccgcgaucgcccagacugaaaagucgaucgaggacaaccccgagaucgaggaugacauuuuccgcaagaaacggcuuaccauaauggaucugcacccaggggccggcaagacaaaacgcuaccugcccgcgaucgugcgggaggccaucaaacgggggcuucgaacccugauccuggccccgacgcgcgucguagccgcugagauggaggaagcucuccgaggguugcccauccgguaccagacgcccgccauccgcgcagaacacaccggucgggagauaguagaccugaugugccacgcgaccuucacgaugcgccuacugagcccgguccgcguaccgaacuauaaucugaucaucauggacgaggcccacuucacggaccccgcgucaaucgcugcccguggguacaucagcacccggguggagaugggugaggccgccgggauuuucaugaccgcgaccccgcccggcucccgcgacccguucccucaguccaacgccccuaucauggacgaggagcgcgaaauccccgagagguccuggaacuccggacacgaaugggucaccgacuucaagggcaagaccgugugguucgugccguccaucaaggccggcaacgacauagccgcgugccuacgaaagaaugggaagaaggucauccaauugagccgcaagaccuucgacucugaauacgugaaaacgcgggcuaacgauugggacuucguggucaccacggauauaagcgagaugggcgcuaacuuccgcgccgagcgggugauagacccccggcggugcaugaagccagugauccugacugacggggaggagcgcgucauccuugcuggcccuaugccggugacgcauuccucugccgcgcagcggcgcgggcgcgucgggcgaaaccccaagaacgagaaugaccaguacaucuacaugggggagccgcuggagaaugacgaggauugcgcacauuggaaggaggccaagauguugcucgacaacauuaacacccccgaagggauaauuccaaguauguucgagccugagcgcgaaaaagucgaugcgaucgauggagaguacagguuacggggugaggcgcggaaaaccuucguggaccugaugcggcggggcgaccucccgguguggcuggccuaccgcgucgccgccgagggaaucaacuacgccgacaggagguggugcuucgacggcauuaagaauaaccagauauuggaggagaacguggaggucgaaaucuggacaaaggaaggagagcggaagaagcugaagccgcgguggcuggacgcgcggaucuauucagacccccucgcccucaaggaguucaaggaauucgccgccggacgcaagagccugacacuaaaucuaauaaccgagauggguaggcugcccaccuucaugacccagaaagcgcgcgacgcgcucgacaaccucgccguuuuacacacugccgaggccggaggccgcgcguacaaccacgcccugagcgagcuccccgagacccuggagacccuacucuuguuaacccucuuggccaccgucaccggcgggaucuuccuguuucuaauguccggcaagggugucgguaagaugacccuggggauguguugcauaaucaccgccagcauccugcucugguaugcccagauccagccacacuggauugcggccuccaucauacuggaguucuuccugaucgugcuucugauucccgagcccgagaagcagcgcacgccccaggacaaccagcugacguacgugguaaucgcgauacucaccgugguggccgcgaccauggcgaacgagaugggcuuccuagaaaaaaccaagaaggaccugggccuuggaucuaucacgacccaggagucggaauccaacaucuuggacaucgaccugcggccggccagcgccuggacccucuacgccgucgccaccacauucguaaccccgaugcugcgccacucgaucgagaacagcuccgugaaugucagccugaccgcgaucgcgaaucaggccacgguacucaugggccuggggaagggcuggccccugucuaagauggacauugggguaccccuccuggcuaucggauguuauagccaggucaacccaaucacgcugaccgcagccuuacugcuucucguagcucauuacgccaucaucggccccgggcuccaggccaaggcgacuagagaagcacagaagcgcgccgccgccggaauaaugaaaaacccgaccguggacgggaucacggucaucgaccucgagccaaucccauacgacccuaaguuugagaaacaacuaggccagguuaugcugcugauccucugcgugacccagguccugaugaugaggaccacaugggcccugugugaagcucuuacucuggccaccggacccaucucuacccugugggagggcaaccccggccgguucuggaacacaacgaucgccgucagcauggcaaacaucuuccgcggguccuaccuagcgggcgcugggcugcuguucagcaucaugaagaacaccaccaauacccggcgcggcacgggcaacaucggggagacccucggcgagaaguggaaguccagacucaacgccuuaggcaagagcgaguuccagaucuacaagaaauccggcauccaggagguggaccgcaccuuagcuaaggaggggauuaaacggggcgagaccgaccaccacgcggucucgagaggcuccgccaagcugcggugguucguggagcgcaacauggucacgccggagggaaagguaguugaccuuggcugcgggcggggcggguggagcuauuacugcggcggccuaaagaacgugagggaggucaaagggcugaccaagggcggucccggccacgaggagcccauccccauguccaccuacggguggaaccugguccggcuccaaagcggcguggacgucuucuucaccccucccgagaagugcgauacgcuuuuaugcgacaucggagagagcucccccaaccccacgaucgaggccggaagaaccuugcgggugcugaaccugguggagaacuggcucaacaacaacacccaguucugcaucaagguccugaacccguauaugcccagugugauagagaagauggagaccuugcaaaggaaguacggaggggcccuggugaggaacccacucuccaggaacagcacucacgagauguacugggucucuaacgccacugggaauaucguaagcuccgugaacaugaucucgcgcauguuaaucaaucgcuucacuaugaagcauaagaaagcgacauaugagccagacgucgaccugggguccgguacgaggaacauuggaaucgagucggagauacccaaucucgacauaaucgguaagcgaauagaaaagaucaagcaagagcacgagacaucuuggcauuacgaccaggaccaccccuacaagaccugggccuaccauggcagcuaugagaccaagcagacgggguccgccagcucgauggugaauggcguuguccgccugcuaaccaagccaugggacguggugccgaugguuacacagauggcaaugaccgacacgacgcccuucggccagcagagaguguucaaggaaaaaguggacacgcgcacccaagagccaaaggagggcacaaagaagcuuaugcguaucaccgcagaauggcuguggaaggaacugggcaagaagaagacgccccguaugugcacccgggaggaguuuacgcgcaagguucgguccaacgcggcccucggggcgaucuucaccgacgagaacaaguggaaauccgccagagaggccguagaggacagccgguucugggagcuagucgaccgcgagcggaaccuucaccuagagggcaagugcgagaccugcguuuacaauaugauggggaagagggagaagaaacugggcgaguucggcaaggcgaagggcucccgggccaucugguauauguggcucggcgcccgcuucuuggaguucgaggcccugggauuccugaacgaggaccacugguuuagccggggcaacucuuuguccggaguggagggugaggggcugcauagacugggguauauacuccgggacgucagcaagaaggaaggcggugcgauguaugccgacgacacagcaggcugggacacgagaaucacccuagaggaccugaagaacgaggagauggugaucaaccacaugaagggggagcacaagaaacucgcggaggccauuuucaagcuuaccuaccaaaacaaaguggucagagugcagcgcccuacgccgcgcggcacggucauggauaucauuucccggcgcgaucagcggggaagcgggcagguuggaaccuaugggcugaacaccuuuaccaacauggaagcgcaacucauccgucagauggaaggcgaggguaucuucaaguccauccagcaucugacggugaccgaggagauagccguucagaacuggcuggcccgggugggacgcgaacggcucucacgcauggcaauauccggugacgacugcguggugaagccuuuggacgaccgguucgccagcgcacugacugcucucaacgacauggguaaggucaggaaggacauccagcagugggagcccucucguggcuggaacgacuggacacaggugccguuuuguucacaccacuuccacgaguuagugaugaaggacgggcgcguacuaguggugcccugccggaaccaggacgaacuaauaggucgugcccggaucucgcagggcgccggcuggucacugaaagagacagccugccuuggcaaauccuacgcucagauguggacccucauguauuuccaccgccgggaccugcgauuagccgccaacgccauuugcagcgccguccccucccacugggugcccaccagccggacaaccugguccauccacgcgaagcacgaguggaugacgaccgaggacaugcucgccguguggaaccgagucuggauccaggagaacccguggauggaagacaagacucccguggagagcugggaggaggugcccuaccuuggaaaacgcgaggaucaguggugcggcagccuaaucggucucaccucacgugccacgugggccaagaauauccagaccgcgaucaaucaaguccggucucuaaucggcaacgaggaguacaccgacuauaugcccaguaugaaacgguuccgccgggaggaagaagaggccggcguacuaugguga

SEQ ID NO: 24816 - RNA, 9876 nt, Artificial Sequence
  derived and/or modified CDS sequence (opt11) from DENV-2__JX669485__SS-prME
accgcaggggugaucaucaugcugaucccuaccgccauggcguuccaccucaccaccagaaacggggagccccacaugaucguaggcaagcaggagaaggggaagucccugcuguucaagacggaggacggcgugaacaugugcacccucauggccaucgaucugggggagcugugcgaggacaccauuacguacaagugcccccuccuccggcagaacgagcccgaagacaucgacugcuggugcaauagcaccagcaccugggugacauacgggaccugcaccaccacgggcgagcaccgccgggagaaacgcuccgucgcccuggugccccacguagggaugggccucgagacgcggaccgagacuuggaugagcuccgagggggccuggaagcacguacagcguaucgagacguggauccugcggcacccgggcuuugccaucauggcggccauccuggccuacacuauaggaaccacccacuuccaacgcgcccucaucuucauccuguuaacggcgguggcucccucaaugaccaugcgcugcaucgguauauccaaccgugacuucgucgagggcgucagcggcggcucuuggguggacaucguccucgagcacgggagcugcgucaccaccauggccaagaauaagccaacgcuggacuucgagcugaucaagaccgaggccaagcagcccgcaacccuccguaaauacugcaucgaggcgaagcugaccaacacgacaaccgagucacgcugcccgacccagggugagcccagccugaacgaggagcaggacaaacgguucauaugcaagcacagcaugguggaucgaggcugggggaacggcugcggccucuucggcaagggcgggauugugacgugcgccauguucacgugcaagaagaacauggagggcaaggucguguugcccgagaacuuggaguauaccaucgugauaacgccacacagcggggaggagcacgcgguaggcaacgacaccgggaagcacggcaaggagaucaagaucacuccgcaguccagcaucaccgaagccgagcucacaggguacggcaccgugacgauggaaugcuccccccggaccggccuggacuucaacgagauggugcugcuccagauggaggagaaggccuggcugguccaccgccagugguuccuggaucuuccccugccauggcugccgggggccgacacccagggcagcaacuggauacagaaggagacgcucgucacguucaaaaacccccacgccaagaagcaggacguggucgugcuggggucccaagagggcgccaugcacaccgcccugaccggagccacugagauccagaugagcagcggcaaccuccuguucacgggccaccugaagugccggcuccgcauggacaagcugcagcugaaagggauguccuacagcaugugcaccgguaaauucaagauuguaaaggagaucgcggagacccagcauggaacgaucgugauccggguacaguacgagggcgacggcuccccuugcaagauuccauucgagaucauggaccucgagaaacgccacguccuggggcggcugaucacggugaauccgaucgugaccgagaaggacagcccagucaacaucgaggccgaaccgcccuucggcgacucuuacaucaucaucggcguugagccgggccagcucaagcuaaacugguucaagaaggggagcuccaucggccagauguucgagaccaccaugcgaggcgccaagcgcauggcgauucugggggauacggccugggacuucggcagccuggggggcguauucaccuccaucgggaaggcgcugcaccaggucuucggcgccaucuacggcgccgccuucagcggggugucguggaccaugaagauccugaucggcgugaucauuacguggaucgggaugaacagccggucaacgagccuguccgucucacucgugcuggugggcgucgugacccuguaccucggcgcgauggugcaggccgacuccggaugcgucgucagcuggaagaacaaggaacugaagugcggcuccgguaucuucaucaccgacaacguacacaccuggacggagcaguacaaauuccagcccgagucgcccagcaaacuggccuccgccauccaaaaagcccacgaggagggcaucugugggauccgcagcgucacccggcucgagaaucuaauguggaagcagaucacccccgagcugaaucacauccuguccgagaacgaggugaaacugaccauaaugacgggcgacaucaaggggaucaugcaggcgggcaagcgcagccugaggccucagcccaccgaacucaaguauuccuggaagaccuggggcaaggccaagaugcugagcaccgagucccacaaccagacguucuugaucgacggccccgagaccgcagagugcccgaacacgaaccgcgccuggaacagccuagagguggaggauuacggcuuuggggucuucacgacgaacaucuggcugaaacuccgggaaaagcaagacguguucugcgacuccaagcucaugagcgccgcgaucaaggacaaccgcgccgugcacgccgacaugggcuauuggaucgaguccgcccugaacggcaccuggaagauggagaaagccagcuucauugagguaaagaguugccauuggcccaagagccacacccugugguccaacgggguauuagaaagcgagaugaucaucccuaagaacuucgcgggccccgugucccagcacaacuaccggccgggguaccacacccaaaccgccggccccuggcaccuggggaagcuggagauggacuucgauuucugcgaaggcacgaccgucguggugaccgaggacugcggcaaccgcgggcccagcuugcggacaacgaccgccagcggcaagcugaucaccgaguggugcugccguuccugcacccugcccccccuacgguaucgcggugaggacggcugcugguacgggauggagauucggccccugaaggagaaagaggagaaucuugucaacagccucgugacggccggccacggccagaucgacaacuucuccuugggggugcugggcauggccuuauuccuggaggagaugcugcgcacucgggucggcaccaagcacgccauccuccugguagccgugagcuucgucacucugaucacggggaacauguccuuccgcgaucuaggccgugugauugugauggucggcgucaccaugacagacgacaucggcaugggggugaccuaccuggcccugcucgcggcguucaagguccgcccaacguucgccgcggggcugcugcuccgcaagcugaccagcaaggagcugaugauggccaccaucgguaucacccuccugucccagagcacgauucccgaaaccauccuggagcucaccgacgccuuagcgcugggcaugauggugcucaagaucgugcggaacauggagaaguaccagcuggccgucaccauuauggccauuuccugcgugccuaacgcggugauccugcugaacgccuggaaggucagcugcacgaucuuggcgguggucuccguuagcccccugcuccugaccuccagccagcaaaagaccgacuggauuccucucgcccucaccaucaagggccugaaucccacggccaucuuccugacaacccucagucgcaccagcaagaagcggucauggccgcugaaugaggccgugauggcggucgggauggugagcauccuggccuccagccuccugaagaacgacauccccaugacuggcccucugguggcagggggccuccugaccgucugcuacgugcugaccgggcgcagcgccgaccuggagcuggagcgggcagcggacgucaagugggaggaccaggccgagauuuccgguagcucccccauccugagcaucaccaucuccgaggacggcagcauguccaucaagaacgaggaggaggagcaaacccuuaccauccugauccgaacggggcuccucgucauaagcggcguguucccugucuccauccccauuaccgccgcggccugguaucugugggaagucaagaagcaacgggcgggggugcugugggacgugcccucgccgccgcccgucgagaaggccgagcucgaggauggcgccuaccgaaucaagcagcgggggauccugggcuacucccagaucggcgcugggguguauaaggagggcaccuuccacacaauguggcacgugacccgcggggccguacugaugcaccggggcaagcgcaucgagcccagcugggcagacgugaagaaggaccucaucuccuacgggggcggcuggaaacuggagggggaguggaaggagggcgaggaggugcagguccuggcacucgaacccgggaagaacccccgggccgugcagacaaagccgggccuguucaagaccaacacgggcaccaucggggccguaagccuggacuucuccccuggcaccagcggguccccgaucgucgaccgcaagggcaaggugguggggcucuacggcaacggcgucgugacccggagcggggccuacguguccgcuaucgcccagacggagaaguccaucgaggacaaucccgagaucgaggacgacauuuuccgcaaaaagcgucugacgaucauggaccugcaucccggugccgggaagaccaagcgcuaccugcccgccaucguccgggaggcgauuaagcgcggcuugcgaacccugauccuggcuccgacgcgcgugguugccgccgaaauggaagaggcccuccgcggccugcccauccgguaccagaccccagcgaucagggcugagcacacaggccgggagauagucgaucuaaugugccacgcgaccuucacgaugcgccuccuuagccccgugcgggugccgaacuacaaccugauaaucauggacgaggcccacuucaccgaccccgcuagcaucgcggcccgcggcuacaucagcacccgggucgagaugggggaggccgcgggcaucuucaugaccgccacgccgcccggguccagggacccguuuccccagagcaacgcgcccaucauggaugaggagcgggagauccccgagcgcuccuggaacagcggccacgagugggugaccgacuucaaggggaagaccgugugguucgucccguccaucaaagccggcaacgacaucgccgccugcuugcggaagaacggcaagaaagucauccagcugucccgcaagaccuucgacuccgaauacgucaagacgcgggcgaacgacugggacuucgucgucaccaccgacaucagcgagaugggggccaauuucaaggccgagcgcgugaucgacccccggcgcugcaugaaaccagucauccugaccgacggcgaggagcgagugauacucgccgggcccaugccggugacgcacucgagcgcugcacagagacggggccgcgucgggaggaacccgaagaaugagaacgaccaguacaucuacaugggcgagccacuggagaacgaugaggacugugcccauuggaaggaggccaagaugcugcucgacaacaucaacacccccgagggcaucaucccgucaauguucgagcccgaacgggagaagguggacgccaucgacggggaguaccgccugcggggcgaggcccgcaagaccuucguggacuuaaugcggcgcggggaccuucccgucuggcuggcauaccggguggccgccgagggcaucaacuacgcugaccgccgguggugcuucgacgggaucaagaacaaccagauauuagaggagaacgucgaaguggaaaucuggaccaaggaaggcgaacgcaagaaguugaagccgcgauggcuggacgcccgcaucuauucugaccccuuagcgcucaaggaguucaaggaguucgccgcaggucggaagucccugacgcucaaucucaucaccgagaugggccgccugcccacauucaugacgcagaaggcccgcgacgcgcuggacaaucucgccgugcugcacacggccgaggcuggcgggcgggccuacaaccacgcgcugagugagcuccccgagacucuggagacccugcucuuacugacccuccuggccacggucaccggcggcauuuuccuguuccucauguccgggaagggcaucgggaagaugacccugggaaugugcugcaucaucaccgccagcauccugcucugguacgcccagauccagccgcacuggaucgccgcguccaucauccuggaguucuuccugaucguccuccuuaucccagagccagagaaacagcggacgccccaggacaaucagcugacguacguggucaucgccauccuaaccgucguggccgccacuauggccaacgagaugggauuucuggagaagaccaagaaggaccugggccugggcagcaucacuacccaggagagcgaguccaacauccuugacauugaccugcgcccggcgagcgccuggacgcucuaugccgucgccaccacguucgugacacccauguuacggcauuccaucgagaacagcagugugaacgucagccugacugcuaucgcgaaccaggccaccgugcucauggggcucggcaagggguggccgcuguccaagauggacauuggcgugccccuccuggcgaucgggugcuacagccaggucaacccgaucacgcugaccgccgcgcugcugcuguuaguggcccacuacgccauaauaggcccaggccugcaagccaaagccacccgcgaagcgcagaagcgggccgcggccgggaucaugaagaaccccaccguggacggcaucacggucaucgaccuggagcccaucccguacgaccccaaguucgagaagcagcucggacaggugaugcuccugauuuuaugcgugacccagguccugaugaugcguaccacgugggcccugugcgaggcgcucacgcuggccaccgguccuauuuccacccugugggaggguaaccccggccguuucuggaacacuacgaucgccguuagcauggccaacauauuucggggcuccuaccucgccggggcuggucugcuguucagcaucaugaagaacaccaccaacacccggcgggggacgggcaacaucggcgagacccucggggagaaauggaagucccgccugaacgcccuuggcaagagcgaguuccagaucuacaagaaguccggaauccaggagguggaucggacgcucgcaaaagagggcaucaagcgcggagaaaccgaccaccacgccgucagucggggcuccgcgaagcugcgcugguucguggagcggaauauggugacaccggagggcaaggucguggacuuggguugcggccgcggggguuggagcuacuacugugggggccucaagaaugugagagaggucaagggccugaccaagggcgggcccgggcacgaggagccgaucccuauguccaccuacggcuggaauuuagugcgccuccagucagggguggauguuuucuucaccccgcccgagaagugcgacacgcugcuaugcgacaucggcgaauccuccccaaaccccaccaucgaggccggccggacccuccgugugcugaacuuaguggagaacuggcucaacaacaacacgcaguucuguaucaagguccugaauccuuacaugccuagcgugaucgagaagauggagacucuacaacggaaguacgggggcgccuuggugcgcaacccccugucccggaauucaacgcacgagauguacugggucuccaacgcgaccgggaauaucgugagcuccgugaacaugaucagccgcaugcugauuaaccgguucaccaugaagcacaagaaggccaccuacgagcuggacgucgaccucggcuccgggacgcgcaacaucggcaucgagagcgagaccccgaaccuggacauuaucggcaagcgcaucgagaagauaaagcaggagcacgagaccuccuggcacuacgaccaggaccaccccuacaagaccugggcguaccacgggagcuacgagacuaagcagaccggcuccgccagcuccauggugaacggggugguccgacugcucacgaagccaugggacguggugcccauggucacgcagauggccaugaccgacaccacgccguucggccagcagcgcguguucaaggagaagguggacacgcggacgcaggagcccaaggagggcacgaagaagcugaugaggaucacugccgaguggcuguggaaggagcucggcaaaaagaagacgccccggaugugcacgcgcgaggaguucacccggaagguccgcagcaacgcugcuuugggagccaucuucacugacgaaaacaaauggaaguccgcccgggaggccguggaggacagccgcuucugggagcuggucgaccgugaacgcaaccuccaucucgaagggaagugcgagacuugcguuuacaacaugaugggcaagcgggagaagaagcugggcgaguuuggcaaggccaaaggcucgcgcgcgauuugguacauguggcucggggccagguuccuggaguucgaggcccugggauuccucaacgaggaccacugguucagcagagggaacagcuuauccggcguggagggggaggggcugcaccggcucggcuacauccugagggacgucagcaagaaggaaggcggggccauguacgcugacgacaccgccggcugggacacacggaucacccuugaggaccucaagaacgaggagauggugaccaaccacaugaaaggcgagcacaaaaagcuggccgaggccaucuucaagcugacguaucaaaacaaggugguccgcgugcagcggccaaccccgcgcgggaccgugauggacauaaucucccgucgggaccagcgcgggucugggcagguugggaccuacggccuuaacacguucacgaacauggaggcacaguugauccggcaaauggagggggagggcaucuucaaguccauccagcaucugaccgugaccgaggaaaucgcggugcagaacuggcucgcccgcgucggccgggagcgccugagccggauggcaaucuccggggacgacuguguggugaagccacuggacgacagauucgccucagcccucaccgcucugaacgacauggggaaaguacgcaaggacauacagcagugggaacccucccgcggguggaacgacuggacccaggugcccuucugcagccaccacuuccacgagcugguaaugaaagacggccgcguccucguggugccgugccgcaaccaggacgagcuaaucgggcgggcccgcaucucccagggcgccggguggagccugaaggagaccgccugccucggaaaguccuacgcccagauguggacuuuaauguacuuccaccggcgcgaccuacggcuagcggccaacgcuauuugcagugccguccccucccacugggugcccaccucgcgaacgacaugguccauccacgcaaagcacgaguggaugaccaccgaggauaugcuggcgguauggaaccggguauggauucaggagaaccccuggauggaggacaaaacaccgguugagagcugggaggaggugcccuaccugggcaagcgcgaggaccaguggugugggagcuuaauuggccugaccucccgcgccaccugggccaagaacauccaaaccgcgaucaaccagguccggagccugaucgguaacgaagaguacacggacuacaugccguccaugaagcgcuuccgacgcgaggaggaggaggcgggcguccucugguga

SEQ ID NO: 24817 - RNA, 9876 nt, Artificial Sequence
  derived and/or modified CDS sequence (opt11) from DENV-2__JX669486__SS-prME
acagcgggcgugaucaucaugcugauucccaccgccauggcguuccaccucacgacccgcaacggggagccucacaugaucgugggccggcaagaaaaggggaagucccucuuauucaagaccgaggacggcgugaauauguguacccuaauggccaucgaccugggggaacugugcgaagacaccauuaccuacaaaugcccccuccugaggcagaacgagcccgaggacaucgacugcugguguaacagcaccagcaccugggucacguacgggaccugcaccaccacgggcgagcaccgucgcgagaaacgguccgucgcccuggugccccacguugggaugggucucgagacccgcaccgaaaccuggaugucauccgagggggcauggaaacacguccagcggaucgagaccuggauucugcgccaccccggguucgcuaucauggcggccauucuggcuuacacuaucgggacuacacauuuccagcgggcccucauauucauccuacuaaccgcaguggcccccucaaugaccaugaggugcaucggcaucaguaaccgggacuucguggagggugucagcgggggcuccuggguggacaucguucucgagcacgguagcugcgucaccaccauggccaaaaauaagcccacgcuggacuuugaacugaucaagaccgaggccaagcagcccgcuacucuccgcaaguacugcauugaggcaaaguugacgaacacgaccaccgagucccggugcccgacccagggcgagcccagccugaacgaggagcaggauaagcgguucaucugcaagcacucaauggucgaucggggcugggggaacggcugcggcuuguucggaaaaggcgggaucgugacgugcgccauguuuaccugcaagaaaaacauggagggaaaggucgugcugccugagaacuuagaguacaccaucgucaucacuccacacagcggggaagagcacgccguuggcaaugacacggggaagcacggagaggaaaucaaaauaacgccgcaguccagcauuaccgaggccgagcugaccggguacgggacggugacgauggaaugcuccccccggaccggccuagacuuuaacgagaugguucugcuccagauggaggagaaggccuggcugguccaccggcaaugguuucuagaccucccccugcccuggcuaccgggggccgacacucaaggcucuaauuggauucaaaaggagacgcucgucacguuuaagaacccccacgccaagaagcaggacguaguaguguuagggucccaggagggcgccaugcauaccgcccugacgggcgccaccgagauacagaugucuagcggcaaucuacuguucacgggccaccugaagugccggcuacguauggauaagcugcaauuaaaggggauguccuacagcaugugcacaggcaaguucaagaucgucaaggagauagcggagacgcaacacgggacaaucgugauccgcgugcaauacgagggagauggcucccccugcaagauccccuucgaaaucauggaucuagagaaacggcacguccuggggcgcuuaaucacuguaaacccgaucgugacggagaaggacuccccgguuaacauugaggccgagccgcccuucggcgacuccuacaucaucaucgguguggagccgggccagcucaagcugaauugguucaagaaggggagcuccauuggucaaauguucgagaccaccaugcgcggcgccaagcgcauggccauucugggggacacagcgugggacuucgguagucucgggggcguguucaccucaaucgggaaggcgcugcaucaggucuucggcgccauauacggcgccgcauucuccgggguguccuggaccaugaaaauuuuaaucggggugauuauaacuuggaucgggaugaacagccgcuccacaucguugucaguaagucucguacugguaggugucguaacccuguaccuuggggcgauggugcaggccgauuccggcugcgucgugagcuggaaaaacaaagagcugaaaugcggcucugggaucuuuauaaccgacaacguucacaccuggacggaacaauacaaauuccagcccgagagcccgagcaagcuggccuccgcuauccagaaagcacacgaggagggcaucugcgggauccggucggugacccgccucgagaaucugauguggaagcagaucacccccgagcugaaucacauccucucggagaacgaggugaagcugaccaucaugacgggugacaucaaagggauuaugcaggcgggcaagcggagccugcgcccgcagcccacagagcucaaauacucguggaaaaccuggggcaaggccaagauguuaagcacugagagucacaaccaaacguuccugaucgacgguccagagaccgcagagugccccaacaccaaucgggccuggaacagccucgagguugaggacuacggcuuuggggucuuuaccacaaacaucuggcugaaauugcgcgagaaacaggacguguucugcgauuccaagcucaugagcgccgcgauuaaggacaaucgggccguacaugcggacaugggcuacuggaucgaauccgcccugaacgacaccuggaagauggagaaggccagcuucaucgaggucaagucaugccacuggcccaagagccacacccuaugguccaacggcguguuggaaagcgaaaugauaauuccaaagaacuucgcggggccagugucacaacacaacuaccgcccgggauaccacacccagaccgccgggccauggcaccugggcaagcuggagauggacuucgacuucugcgaggggaccaccgucgucgugaccgaggacugcggcaaccggggccccagcuuacguaccacaaccgccagcggcaagcugaucaccgaauggugcugccgguccugcacccugcccccgcuacgcuaccggggggaggacgggugcugguacggcauggagauccgcccucugaaggaaaaggaggagaaccuuguaaacucuuuggugacggccggacacgggcagaucgacaacuucucccugggggugcuggggauggcacucuuccuggaggaaaugcugcggacccgcgucggcacuaagcacgccaucuugcuaguggccgugagcuucgucacgcugauuacgggcaacaugaguuuccgggaccucggucgugugauggugauggucggagugacaaugacagacgacaucggaaugggcgugaccuaccuggcgcuucucgcugcuuucaagguccgacccaccuucgccgcagggcuguuacuccgcaagcugaccagcaaggagcugaugauggccacgauaggcaucacccucuugucgcagucgacgacccccgagaccauccuggagcucaccgacgcucuggcgcuagggaugauggugcucaaaaucgugcgcaacauggaaaaguaccagcuggccgucacgaucaugacuauccugugcgugccgaaugcugugauccuucugaacgcguggaaggugucgugcaccauccuggcgguggucucugucagcccccuucugcugacgagcucacagcaaaagacggacuggaucccgcucgcgcugaccauuaagggccugaaccccaccgccaucuuccucaccacgcuuagccggacguccaagaagcgaagcuggccgcugaacgaagccgugauggccgucggcaugguuuccaucuuggcgagcucucugcugaagaacgacauacccaugacggggccgcucgucgcgggugggcugcugaccgucuguuacgugcuuacgggccggagcgcagaucuggagcuggagagagcggccgacgugaagugggaggaccaggcggaaauaagcgggagcagcccaauccucuccaucaccauuagcgaggacggcuccaugagcaucaagaacgaggaagaagagcagacccugaccaucuugauacggaccggacuccuggugaucuccgggguguucccgguuagcaucccaaucacggcugccgccugguaccugugggaggucaagaaacagcgcgccggcgugcucugggacguuccgagcccgccgcccgucgaaaaggcggaacuggaggacggggccuaccggaucaagcagcgaggcauucugggauauagccagaucggcgccggaguguacaaggaggguacguuccacacuauguggcacgugacccguggugccguucucaugcaccgcgggaagcggaucgagcccuccugggcggacguaaagaaggaccugauuucuuacggcggcgguuggaaauuggagggcgaguggaaggagggugaagaggugcaggucuuagcacuggagcccggcaaaaacccucgcgccgugcagacuaagcccgggcuguucaagaccaauaccggcacuaucggggccgugagccuagacuucagccccggcacgucgggaucacccauugucgaccggaagggcaagguggugggccuguacgggaacggcgucgugacacgcaguggggcauacgugagugccaucgcgcaaaccgagaagaguaucgaggacaaucccgaaaucgaagacgauauauuucggaaaaagagacugaccaucauggaccugcaucccggcgccgggaagacaaaacgguacuugccugccauuguccgcgaagcgaucaaacgggggcugcguacucugauccucgcgccgacccgcguuguggcagccgagauggaggaggcccugcggggacuuccaauccguuaccagacccccgccaucagagccgagcacacggggcgcgagaucgucgaccucaugugccacgccacguucaccaugcgauuacugucgccagugcgcgugccgaacuauaaucugaucaucauggacgaggcccacuucaccgacccggccagcaucgccgcgcggggauacaucuccacacgcgucgaaaugggggaggccgcggggaucuucaugacagcuacaccgcccggaagccgggauccguucccccagucuaacgccccaaucauggacgaggagcgagagauccccgagcggagcuggaacucgggccacgagugggugaccgacuucaagggcaagacggugugguucguccccagcaucaaggcagggaaugacaucgccgccugcuuacgaaagaacggcaagaaggugauccagcugucgcggaagacguucgacagcgaguacgugaagacccgggccaacgacugggacuucgugguaacgaccgacaucuccgagaugggagcgaauuucagagccgagcgggugaucgacccccgccgcugcaugaagcccgucauucuuaccgacggcgaggagagggugauccuggccggccccaugccggugacacacagcuccgccgcccagcgccgcggacgggucggucgcaacccaaagaacgagaacgaccaguacauuuacaugggcgagccccuggagaaugacgaggacugcgcgcacuggaaagaggccaagauguuauuagacaacaucaacacgcccgagggcaucaucccgucaauguucgagccggagagggagaaggucgacgcaaucgacggggaauauagacugcgcggugaggccagaaagacauucguggaucucaugcgccgcggcgaccugccagucuggcuggcuuaccggguggcagcagagggaauuaacuacgcagaccgccgguggugcuucgacggcauaaagaacaaccagauccuagaagagaacgucgagguugagauuuggacaaaggagggggagcgcaagaagcugaagccacggugguuggacgcucgcaucuauuccgacccccucgcacugaaggaguucaaggaguucgcggccgggcggaagucccugacccucaaccuaaucaccgaaaugggccgccucccgaccuuuaugacccagaaagcccggaacgcccuggacaaccuggcggugcugcacaccgccgaggccggaggccgcgccuacaaccaugcccucucggaguuacccgagacccuggagacuuugcugcuccucacccuucuggcgaccguuaccggggguaucuuccucuuuuugaugagcggcaaggggaucggcaagaugacccuugggauguguugcaucaucacggccuccguccuccugugguacgcccagauccagccgcacuggaucgcggccagcaucauuuuggaguucuuucucaucguguugcugauacccgagcccgagaagcagaggaccccgcaggauaaucagcucaccuacgucgugaucgcgauccugaccguggucgccgcgaccauggccaacgagaugggcuuccuggaaaagaccaagaaggaucucggccugggcuccaucaccacccaagagagcgagagcaacauccuggacaucgaucuccggccugcuuccgcguggacgcuguacgcaguggcuacgaccuucgugaccccuaugcugcggcauucgauugagaauuccucggucaaugugucgcucacggcgaucgccaaucaggcgacuguuuugaugggacuugggaagggcuggccccuuucgaagauggacaucggcgucccccugcuggcgaucgggugcuacucccaggugaauccuauaacccucaccgcagcucuccuucuccugguggcgcacuacgccaucauaggcccuggccugcaggccaaggccacucgcgaggcgcaaaagagggcggccgcuggcaucaugaagaaccccaccgucgacggcauaaccgucguggacuuagagcccauaccguacgaccccaaauucgagaagcagcugggccaggucaugcuguugauccugugcgugacacaaguccugaugaugcgaacuaccugggcacucugcgaagcccugacucuggcgaccggacccauuagcacgcuuugggaaggcaacccgggaagauucuggaacaccaccaucgccgucuccauggcuaacauuuuccgggggucauaccuggccggcgccgggcuccucuucuccaucaugaagaacacgacgaacacccgccggggcacggggaacauuggcgaaacccugggcgaaaaguggaagucccgccuaaacgcgcucgggaagucggaguuccagaucuacaagcggagcggaauccaggagguggaucggacucuggccaaggagggaaucaaacggggcgaaaccgaccaucacgcugugucacgcgggagcgcgaaacuuaggugguucgucgagcgcaacauggugaccccggaaggcaagguggucgacuuaggcugcgggcggggcgggugguccuacuacugcggcggccugaagaacguaagagaggucaagggccugaccaagggcgggcccggccacgaggaacccaucccgaugagcaccuacgguuggaaccucguucggcuucaguccggcguggacguauuuuucacgccgccugagaagugcgacacucugcucugcgacaucggugaguccucccccaaccccaccaucgaggcgggccgcacccugcggguccuuaaccucgucgaaaacugguuaaacaacaauacgcaguucugcaucaagguguuaaacccguauaugcccuccgucaucgaaaagauggaaacacugcagcgcaaguacggcggggcccucgugcggaaccccuuaagccgcaacuccacgcaugagauguacuggguaaguaacgccaccggcaacaucgucuccagcgugaacaugaucucccgcaugcugauuaacagauucacuaugaagcacaagaaggccacauacgaaccggacguggaccucgggagcggcacccgcaacaucgguaucgagucggagauccccaacuuggacaucauagggaagcggaucgagaagaucaagcaggagcacgagaccucauggcacuaugaccaggaccauccauacaagacgugggccuaccacggcuccuacgagaccaagcagaccgggucagcguccagcauggucaacggcgucgugcgccugcucaccaagcccugggacgugguaccgauggugacgcagauggccaugacggauacaacccccuuuggccagcagcgggucuucaaagagaagguggacacgaggacccaggagccgaaggagggcacaaagaagcugaugcggaucaccgccgaguggcuguggaaggagcucggcaagaagaagaccccccgcaugugcacccgcgaggaguucacccgcaagguccgguccaacgccgcccugggggccaucuuuaccgacgaaaacaaguggaaguccgcccgcgaggcaguggaggacuccagguucugggagcugguggaucgcgagcggaacuuacaucuggagggcaagugcgagacguguguuuacaauaugauggguaagcgcgagaaaaagcugggcgaguucgggaaggcuaaaggcucacgggcuaucugguacauguggcucggagcgcgcuuccuggaguucgaggcacugggguuccucaacgaggaccauugguucucccggggcaauucccugagcgggguggagggcgaaggauuacaccgccucggcuacauucuacgggacguaaguaaaaaggaaggaggggccauguacgccgaugacaccgcgggcugggacacucgcaucaccuuggaggaccucaagaacgaggaaauggucacgaaucacaugaaaggggagcacaagaagcuggcagaagcgguguuuaaacugacuuaucagaacaaggugguccgcgugcagcggccgacgccacgcgguaccgugauggacaucaucagccggcgcgaucagaggggguccggccaggucggcacauacgggcuuaacaccuuuaccaauauggaggcccagcugauccgccagauggagggggaagguaucuucaagagcauucagcaccugaccgucacggaggagaucgccgugcagaauuggcucgcgcgcgucggucgcgagcggcugucccggauggccaucagcggcgacgacuguguggugaaaccccuggaugaccgguuugccuccgcucucaccgcccugaacgacauggggaagguccgcaaggauauccagcaaugggagcccagccgaggcuggaaugacuggacacaggugccguucugcagccaucauuuccacgagcugguuaugaaggacgggcgcgucuuagucgugcccugcagaaaccaggaugagcugaucgguagagcgcggaucagccaaggggccggcuggagccuuaaggagacagccugucucgggaagucguacgcccaaauguggacacugauguacuuccaccggcgggaccuccgccucgccgcaaacgccaucuguucugcuguccccagccacugggugccaacgucccggacgaccuggagcauccacgccaagcacgaauggaugaccaccgaggacaugcuggcaguguggaaccgggucuggauccaagagaacccguggauggaggauaagaccccaguugaaucuugggaagaggugcccuaccuggggaagcgcgaggaccaauggugcgguucgcuuaucgggcugaccagccgggcgaccugggccaagaacauacaaacggccauaaaccagguccggucccugaucgguaacgaggaguacaccgacuacaugcccaguaugaagcgguuucgccgggaggaggaggaggccggggugcucugguag

SEQ ID NO: 24818 - RNA, 9876 nt, Artificial Sequence
  derived and/or modified CDS sequence (opt11) from DENV-2__JX669487__SS-prME
accgcgggcgugaucaucaugcugauccccacugcgauggcguuccaccucacaacccgcaacggggagccccacaugauagucggccggcaagagaaagggaagucccugcuguucaagaccgaagacggagugaacaugugcacccucauggcaauagaccuaggagagcugugcgaggacacuauaaccuacaagugcccgcuccuucggcaaaacgagcccgaagauaucgacugcugguguaacaguaccagcacaugggugacuuaugggacaugcaccaccacgggugagcaccggcgugagaaacgguccguugcccugguuccccacguggggaugggccucgagacccgcacagagaccuggaugagcuccgaaggggccuggaaacacguccaacgcaucgagaccuggauccuucgccacccgggcuucgcuaucauggcggccauucuggcguauaccaucggaaccacucacuuccagcgcgcccucaucuucauccugcugacggcgguagcucccagcaugaccaugcgcugcaucggcauuuccaacagggacuucguggagggcgucagcggcggcuccuggguggacaucgugcucgagcacgggagcugcgucacuaccauggccaagaacaagcccacgcuugacuucgagcugaucaagacugaggccaagcagcccgccacacucagaaaguacugcaucgaggcaaaguuaaccaacacaacgaccgagucccggugcccgacgcagggugagcccagccuaaacgaagagcaggacaaacgcuuuaucugcaaacauuccaugguggaccgggggugggggaacggcuguggccucuucggcaagggcgggaucgugacgugcgcgauguucacgugcaagaagaacauggagggcaaggucgugcugcccgaaaaccuggaguacaccauaaugauaacgccccacucgggggaggaacacgccguuggcaacgacaccgggaagcacggcaaggagaucaagaucacuccgcagucgagcaucaccgaagcagagcucaccggguacggcaccgucacuauggagugcagccccaggaccggccuggauuucaacgagaugguguugcugcagauggaggagaaggccuggcuugugcaccggcagugguuccuggaccucccccugcccuggcugccgggugcggacacgcaggguagcaacuggauucaaaaggagacacucgucacguucaagaacccccaugccaagaagcaagauguggugguccugggcucccaagagggugccaugcacaccgcccucaccggcgccaccgagauccagaugucaagcggcaaccuccuguucacgggccaccugaagugccggcuccggauggauaagcugcagcugaaggggauguccuacagcaugugcacgggcaaguucaagaucgugaaagagaucgcggagacccagcaugggaccaucguaauccgcgugcaauaugagggcgauggcuccccaugcaagauccccuucgagaucauggaccucgagaagcggcacguacuggggcgccugaucacggucaacccgaucgugacagagaaggacagccccgugaacaucgaggcagagccgccauucggcgacuccuacaucauaaucgggguggagccggggcaacucaaauugaacugguucaagaaagggagcuccauuggccaaauguucgaaaccaccaugcgcggcgccaagcggauggccauccugggggacaccgccugggacuucggcagccucgggggcguguucaccucgaucgggaaggcacuacaccagguguucggcgccaucuacggcgccgccuucucuggugucuccuggacuaugaagauacugaucggcgugauuaucaccuggaucgggaugaauagccgcuccacgagccuguccgugagccucguccuuguaggcguggucacccuguaccuuggggcgaugguucaggccgacuccgguuguguggucagcuggaagaacaaggagcucaagugcggcuccgggaucuuuauaaccgacaacguacacaccuggacggagcaauacaaguuccagcccgagucaccaagcaagcuggccuccgccauccagaaggcccacgaggagggcaucugcgggauacggagcgugacccgccucgagaaucuuauguggaaacagaucacccccgaacugaaccacauccuaucagagaacgaggucaagcuaaccaucaugacgggagacaucaaggggaucaugcaggcgggcaagcggucauuacgcccccagcccaccgagcucaaauacuccuggaagaccuggggcaaagccaagaugcuuagcacagagucccacaaccagacguuucugaucgaugggcccgagaccgccgaaugcccgaacaccaaccgugcuuggaacagccucgagguggaagacuacggcuucgggguguucaccacgaauaucuggcugaagcugcgcgagaagcaggaugucuucugcgacuccaaguugaugagcgccgcgaucaaggacaaccgggccgugcacgcugacaugggcuauuggaucgagagugcccugaacgacaccuggaagauggaaaaagccagcuucaucgaggugaaaucgugccauuggccaaagucccauacucuguggucgaacggcguacuugagagcgagaugaucauccccaagaacuucgcggggcccgugucccagcacaacuaccgcccaggcuaccacacccagacagccgggcccuggcaccucggcaagcuggagauggacuucgacuucugcgaggggacgaccguaguugugaccgaggacugcggcaaccggggcccuagccuccgcaccacgacugccagcgggaaguuaauaaccgaguggugcugccggucaugcacacuucccccguuacgcuaccggggcgaagaugggugcugguacggcauggagauccgaccccugaaggagaaggaggagaaccugguaaauagccuugucacugcagggcacggacagauugauaacuucucccugggcgugcuuggcauggcucucuuccuggaggagaugcugcggacucgcgugggcaccaagcacgccauccuccuaguagccgugagcuucgugacccuuauaacggggaacauguccuuccgugaccucggccgugucauggugauggucggggugacgaugacagacgacaucggcaugggcguaaccuaccuagcccuucucgcugcauucaagguucgccccacguucgccgcggggcugcuccuccggaagcugacaagcaaggagcugaugauggccacaaucgggaucgcccuguuaucccagagcaccauccccgagacgauccuggagcucaccgacgcgcuggcccucgguaugaugguucucaggaucgugcggaacauggagaaguaccagcuagcugugaccaucauggccaucuccugcguaccgaacgccgucauucuccucaacgcauggaaggugagcugcaccauccuugccgccgucuccguguccccacugcucuugaccucaucgcagcagaagaccgacuggaucccccuggcucucacaauuaagggccugaaucccaccgcgaucuuucugaccacccucucccgcaccagcaagaagcggucguggccccugaacgaggcggucauggccgugggcauggugagcauccuggccaguucacuccugaagaacgauauccccaugacagggccauuggucgccggcgggcuccugacggugugcuaugucuuaacgggccgcagcgcggaccucgagcuggagcgggccgccgacgucaagugggaggaccaggccgagaucuccgggucauccccaaucuugagcaucacgaucucggaggauggcagcauguccaucaagaacgaagaggaggagcagacccuuaccauacugauccgcacgggccuccucguaaucagcgggguuuucccggucuccauccccauaaccgccgcggcgugguaccugugggaagugaaaaagcagcgggccggcguucugugggacguccccagcccaccucccguggaaaaagccgaguuggaggacggggcguacagaaucaaacagcgaggcauauugggguacucccagaucggcgcgggcguauacaaggaagggacuuuccacacaauguggcacgucacacgcggugccguccugaugcaccgggggaagcgcauagagcccaguugggcggacgugaagaaggaccucaucuccuacggcgggggcuggaagcuggaaggcgaguggaaggagggggaagagguccaggugcuggcgcucgagccuggaaagaacccccgcgcugugcaaaccaaacccgggcuguucaaaaccaacaccggcaccaucggggcaauaagccuggacuucuccccuggcaccagcggcucuccgaucgucgaccgcaaggggaagguggugggucucuacgggaacggcgucgugaccagaagcggugccuacguguccgccauagcccaaacggagaaguccaucgaggacaaccccgagauugaggacgacaucuucaggaaaaagcggcucacgaucauggaccugcaccccggagcgggcaaaaccaagcgcuaccugccggccaucguccgggaggccaucaagagagggcuccgcacccugauccuggcuccaacccgagugguggccgcggagauggaggaggcccuccgcggcuugccgauccgcuaccagacgcccgccauccgggcagaacacacggggagagagaucgucgauuugaugugccacgccaccuucaccaugcgccuccugagccccgugcgggugccgaacuacaaccugaucaucauggacgaggcgcacuucacggaccccgccuccauagccgcacgcggcuauaucagcacaagggucgagaugggcgaggccgcggggaucuucaugacugccacgccgcccggcucccgcgacccguucccgcagucgaacgcgcccaucauggacgaggagagggagauccccgagcgauccuggaacagcgggcacgagugggucacggacuucaagggcaagaccguuugguucgucccguccaucaaggcagggaacgacaucgcggcgugccuccggaaaaacggcaagaaggugauccagcugagccgcaaaaccuucgacucugaauacgugaagacccgggccaacgacugggacuucguagugaccacggacaucagcgagaugggcgcaaacuuccgcgccgagcgggugaucgacccccgccggugcaugaagcccgucauccugaccgauggggaagagcgggugauucucgcgggccccaugcccgugacgcacuccagcgccgcccagaggcgggggcgcaucggacgcaacccgaagaacgagaacgaccaguacaucuauaugggggagccccuugaaaaugacgaagacugcgcccauuggaaggaggccaaaaugcuguuagacaauaucaacacgccggaggguauuauuccguccauguucgagcccgagcgcgaaaaagucgacgcgauagacggcgaauaucgccugcgaggggaggcuagaaagacguucguggaccugaugcgccguggcgaccucccgguguggcuggcuuaccgcgucgccgccgaggggaucaacuacgcggaccggcgcugguguuucgaugguauaaagaacaaccagauacuggaagaaaacgucgagguggagauauggacuaaggagggggagcggaagaaguugaagccgcguuggcuggacgcccggaucuacagcgaccccuuggcccucaaggaguucaaggaauuugccgcagggaggaagucccugacccugaaucucaucaccgaaaugggccggcuccccaccuucaugacgcagaaagcccgcgacgcccuggacaaccucgccguccugcacacugcggaagcaggcggccgggccuacaaacacgcgcugucagaguugccggagacgcuggagaccuugcuccugcugacucuccucgccaccgugaccggcgggaucuuccuguucuuaaugucaggaaagggcaucggcaagaugacgcuggggauguguugcaucauuacagcguccauccuucucugguacgcgcagauccagccgcacuggaucgcugccucgaucauccuggaguucuuccugaucgucuuacugauccccgagcccgagaaacagcgcacuccccaggauaaccagcugaccuacguggugaucgcuauccuaacgguuguggccgcgaccauggccaacgagaugggcuuccuggagaaaacgaagaaggaucuggggcucggcuccaucacgacgcaggagagcgaguccaacauccuugacaucgaccugcggccggccagcgcauggacauuauaugcuguugcgaccaccuucgucacucccaugcugcgucacuccaucgagaacaguuccgugaacgugagccugaccgccaucgccaaccaggcgaccguccugaugggccuaggaaagggcuggccccuguccaagauggacaucggggugccguugcuggcgauuggaugcuacagccaggugaauccgaucacccugacggccgcccuccuucugcuagucgcacacuacgccaucaucgggccaggccugcaggcgaaggccacucgggaggcccaaaagcgcgccgccgcagggaucaugaaaaaccccaccguggacgggaucaccguuaucgaccuggagcccaucccauacgaccccaaguucgagaagcagcucggccaggucaugcuacugauucucugcguuacccagguguugaugaugcgcaccaccugggcccugugcgaggcacucacccuggccacggggcccaucuccaccuuaugggaggguaaccccgggagauucuggaacacgacuaucgcugucagcauggccaacaucuuccgcggcuccuaccucgccggcgccggguuacuguucucuaucaugaagaauacgacaaacacccggcgcggcaccgguaauaucggcgagacgcucggcgagaaauggaagucccggcugaacgcccugggcaagagcgaguuccagaucuacaagaagucuggcauccaagagguggaccgcacccuagcgaaagaaggcaucaagcggggugagaccgaucaccacgccgugagcaggggcuccgccaagcugcggugguucgucgagcgcaauauggucaccccggaggguaaaguggucgaccugggcugugggcggggcggguggagcuacuacuguggcgggcucaagaacguucgcgaagugaagggacugacaaagggcgggccaggccacgaggaaccgauaccuaugucaaccuacggguggaaccugguccggcuccagagcggcguggacguguucuucaccccgccugaaaagugcgacacucugcugugcgacaucggagagucuucccccaaccccacgaucgaggccggccgcacccuccggguccugaaccuggccgagaacuggcucaauaacaacacgcaguucuguaucaagguguugaacccguacaugcccucugugauugaaaagauggagacccugcagcgcaaguacgggggagcgcugguccggaauccacuuucccgcaacucgacccacgagauguacuggguuuccaaugccacgggcaacaucgugucuuccgucaauaugaucagccgaaugcugaucaaccgguuuaccaugaaacacaagaaggcuaccuacgaaccagacguggacuuaggguccggcacccgcaacauagggaucgagagcgagauacccaaccucgacauaauuggcaagcggaucgagaagaucaaacaagagcacgagacauccuggcacuacgaccaggaccacccauacaaaacuugggccuaccacggcucguacgagaccaagcagaccggguccgccagcuccauggucaacggugucgugcgccugcugacgaaaccaugggacguggugccuauggugacacagauggccaugacggacaccacgcccuucggacagcagcggguguucaaggaaaaggucgacacucgcacccaggagcccaaggagggcacuaagaagcucaugcggaucacggccgaauggcuguggaaggaacugggcaagaagaagacgccccgcauguguacccgggaggaguucacccggaaggugcggagcaacgccgcccucggggccauauuuacagaugagaacaaguggaaauccgcgcgcgaggccguggaggacagccguuucugggagcuggucgaccgggagcggaacuuacaucucgagggcaagugcgagacauguguguauaacaugauggggaagagagagaagaagcugggcgaguuugggaaagccaaggggucccgggccaucugguacauguggcugggcgcacgguuccucgaguuugaggcccugggguuccugaaugaagaccauugguucucucggggcaacagccuuucagggguggaaggcgaggggcugcaccgccugggcuacauacuccgagacgucagcaagaaggagggcggggccauguacgcugaugauaccgcaggcugggacacacgcauaacuuuagaagaucugaagaacgaggaaauggugaccaaccacaugaagggggagcacaaaaagcucgcggaggcuauauucaagcugaccuaccagaacaaggucguacgcgugcagagaccgacgccgcguggcacagucauggacaucauaucccggaaggaccagcgcgggagcggacagguggggaccuacggccugaacaccuuuaccaacauggaggcccagcuaauccggcaaauggagggcgaggggaucuucaaguccauccaacaccugacggugaccgaggagaucgcaguccaaaacuggcuggcccgcgugggccgggagcgauuaucucggauggcgaucuccggcgacgacugcguggugaagccucuggacgaccgcuucgcguccgcccugaccgcgcucaacgacauggggaagguucggaaggauauccagcagugggagcccucccgcggcuggaacgacuggacccaggugccguucugcucacaccacuuccacgagcuggucaugaaggacgggcgugugcugguggucccuugcaggaaccaggacgagcucaucggccgugcucgcaucucccagggggcgggcuggagccugaaggagacugccugccuuggcaagucuuacgcacagauguggacgcuaauguacuuucaccggcgggacuuacggcuggccgccaacgcgaucuguagcgccgugcccucccacugggugcccaccucccgaaccaccuggucgauccacgcaaagcacgaguggaugacgaccgaggacaugcucgccguauggaaccgcguauggauccaggagaacccguggauggaggacaagaccccuguggagagcugggaggagguccccuaccuagggaaacgggaggaccaaugguguggcucccugaucggauugaccucccgugccaccugggccaagaacauccaaacugccaucaaccaggugcggagccugaucggcaacgaggaguauaccgacuacaugcccuccaugaagcgauuccggcgcgaagaggaagaggccggggugcuuugguga

SEQ ID NO: 24819 - RNA, 9876 nt, Artificial Sequence
  derived and/or modified CDS sequence (opt11) from DENV-2__JX669488__SS-prME
accgcgggagugaucaucaugcugauccccacugcuauggcguuccaccucaccacccgcaacggggagccucauaugaucgucggccgacaagagaaggggaagucccugcucuucaaaaccgaggacggcgucaacaugugcacccucauggccaucgaccugggagagcugugugaggacacgaucaccuauaagugcccccuccugcgccagaacgagcccgaggauaucgauugcugguguaacagcacgaguaccugggucacguacgggaccugcaccaccacgggcgaacaccggcgcgagaagcgguccguugccuuggugccccacguggggaugggccucgagaccagaaccgagaccuggaugucauccgagggggccuggaagcauguacagcggaucgagacguggauccugaggcacccggguuucgcaaucauggcagccauacuggccuacaccaucgggaccacacacuuccagcgcgcccucaucuucauccuguuaacggcgguggccccaagcaugacuaugcgcugcaucggcaucuccaaccgggauuucguggagggagucuccgggggcuccuggguggacaucguacucgagcacgggagcugcgucacuaccauggcaaagaacaagcccacauuagauuucgagcucaucaagaccgaggccaaacagcccgccacccuccgcaaguauuguaucgaagcgaaacucaccaauacgaccaccgagucccggugccccacucagggcgagccaagcuuaaacgaggagcaggauaagcguuucaucugcaagcacuccaugguggaccgcggguggggaaauggcugcggccucuucgguaagggcgggaucgugacgugcgccauguucacuugcaagaaaaauauggaaggcaaggucguguugcccgaaaaccuggaguacaccaucgugaucacaccgcacagcggagaggagcacgccgucggcaacgacacggggaagcauggcaaggagaucaagaucaccccacaguccagcauaaccgaggccgagcucaccggcuacggcaccgucacgauggagugcagcccccgcacaggucuggacuucaacgagauggugcugcuccagauggaggagaaggcuuggcuggugcacaggcagugguuccuggaccugcccuugccaugguuaccaggggcggacacccagggcagcaacuggauacagaaagagacccuagugacguucaagaacccccacgccaagaagcaggacguggucguucuggggucacaggagggcgcgaugcacaccgcccugaccggggcuaccgagauccagaugagcagcggcaaccuccuguucacgggccaucugaagugucgacuccgcauggacaagcugcagcugaaagggauguccuacagcaugugcaccggaaaguucaagaucgugaaggagaucgcggagacccaacauggaaccaucgugauccgcgugcaguacgagggcgacggcuccccuugcaagauccccuucgagaucauggaccucgagaagcggcacguccuggggcgccuuaucacggugaacccgaucguuaccgagaaggauagccccgucaacaucgaggccgagccgcccuucggcgacuccuacaucaucaucgggguggagccgggccagcucaagcugaacugguucaagaaagggucauccaucggccagauguuugagaccaccaugcgaggcgccaaacggauggccauccugggcgauacggccugggacuucggaagccucgggggcguguuuacgucgauugggaaggcccugcaccaggucuucggcgcgauauacggugcggccuucagcgggguguccuggacaaugaagauccuaaucggcgugaucaucacauggaucgggaugaacagccgcuccacgucgcuguccgucagccuagugcuggugggcgucguuacccuguaucucggggcgauggugcaggccgacucaggcugcguuguuagcuggaagaacaaggagcugaagugugguucggggaucuucaucaccgacaacgugcacacuuggacggaacaguacaaguuccagcccgagucgccuagcaagcuggccuccgccauccaaaaggcccacgaggagggcaucugcggaauucggagcgucacccgccucgaaaaccugauguggaagcagaucacccccgagcugaaucacauccucuccgagaaugagguaaagcuaaccaucaugacgggcgacaucaaaggaaucaugcaggcaggcaaacgcucgcugcgcccgcagcccaccgagcucaaguacucguggaagaccuggggaaaggccaagaugcugagcaccgagucccacaaccagacguuucugauugacgggcccgagaccgccgaguguccaaacaccaaccgggcauggaauagucucgagguugaggacuauggcuucggcgucuucaccacgaacaucugguugaagcugcgcgagaagcaggacguguucugugacuccaagcugaugucggccgccauaaaggacaaccgggccgugcacgccgauaugggauacuggaucgaguccgcccuaaacgauaccuggaagauggagaaggccagcuucaucgagguaaaguccugucacuggcccaagucacacacccuaugguccaacggcguacucgagucugagaugauuauccccaagaacuucgcgggacccgugucucagcacaauuaucgcccgggcuaccauacccaaacggccggucccuggcaccugggcaagcuggaaauggacuucgacuucugugaggguacuaccgucguggugaccgaggacugugguaaccgcggacccagccucaggaccacgaccgcaagugggaagcugaucaccgaguggugcugccgguccuguacgcuccccccacuccgauaccggggugaggacgggugcugguauggcauggagauccgcccccugaaggagaaagaggagaaccuggucaacagccucgugacggcaggccacggacagaucgacaacuucuccuugggcgugcuggguauggcccucuuccuggaggagaugcuucggacucgugucggcaccaagcacgccauacuucugguggccgccagcuucgugaccuugaucacugggaacauguccuuccgggaccucggccgcguuauggugauggugggggccacgaugaccgacgacaucggcaugggcgucaccuaccuggcgcugcucgccgccuucaaggugagacccacauucgcggcggggcugcugcuccggaagcugacgagcaaggaacugaugauggcgacuaucggcaucgcccuccugucgcagagcaccauccccgaaacgauccuggagcucaccgacgcacuggcacuggggaugauggugcuccgcaucguccguaacauggagaaguaccagcuagccgugaccaucauggcgauuuccugcguaccgaacgccgucauccugcucaacgccuggaaggucaguugcacaauucuggccgcggugucugucagcccccugcugcugaccuccagccaacagaaaaccgauuggaucccccuagcccucacgauaaagggccugaaccccaccgccaucuuccugacgacgcucucuaggaccagcaagaagcgguccuggccccuaaacgaggcugugauggccgucggcauggugagcauccuggcguccagccuccugaaaaacgacauccccaugaccgggccgcugguggccggcgggcuccugacggucugcuacgugcugaccggccgcagcgccgaccuugagcuggagcgggccgccgacgugaagugggaggaccaggcggagaucuccgggagcucccccauucugagcaucacuaucucggaggacggcagcauguccaucaagaacgaggaggaggagcagacucucacaauccugauacgcaccggacugcucgucaucucagggguguucccuguguccaucccaaucacagccgccgccugguaccugugggaggucaagaagcagcgggccggcgugcucugggacgugccaagcccgccgcccgucgagaaagcggaacucgaggacggggccuaucgaaucaagcagcggggcauccuaggcuacucacaaaucggcgccggcguuuacaaagagggaaccuuccauacuauguggcacgugacgcgcggcgccguccugaugcaccgggggaagaggauugaacccagcugggccgacgugaagaaagaucucaucucguacggcgggggcuggaaacuggagggugaguggaaggagggggaggagguccaggucuuggcgcucgagcccggcaagaacccccgggccgugcagaccaagcccgggcuguucaagacuaacaccggcacgauaggggcuaucagucuggacuucucccccggcacgagcggcucccccaucguggaccgaaaagggaaggucgugggccucuacggcaacgguguggucacccguagcggcgcguauguguccgcaaucgcccaaaccgagaaguccaucgaagauaaccccgagaucgaagacgacauauuucgcaagaagcgacugacgaucauggaccugcaccccggggccggcaagaccaagcgguaccugcccgccaucgugcgggaggccaucaagcgggggcucagaacauugauucuggcgccgacccgggucguggcugccgagauggaagaagcccuccgcggguuacccauccgguaccagacccccgccauccgcgccgagcacaccgggcgggaaaucguggaccugaugugccacgccaccuuuacuaugcgccuccuuagucccguccggguuccuaauuauaaccugaucaucauggacgaggcucacuucacggaccccgccuccaucgccgcgcgugguuacaucagcacccgcguugagaugggcgaggccgccgggauauucaugaccgccacgccgcccggguccagggacccguucccccagagcaacgcgcccaucauggacgaggaacgggaaauccccgagcgcuccuggaacagcgggcacgagugggucaccgacuucaaggggaagaccguaugguucgucccauccaucaaagcggggaacgacaucgccgccugccuccggaaaaacggcaagaaggucauccagcugagccgcaagaccuucgacuccgaguacgugaagacccgggcgaacgacugggacuuuguagucacgacggacaucucugagaugggugcaaacuuccgcgccgagcgggugaucgacccccgccggugcaugaagccgguaauccugaccgauggggaggagagggucauccucgccggccccaugccggucacacacuccagugccgcccagcggcgggggcgcaucggacggaacccuaagaacgagaacgaccaguacauauacaugggggaaccccuggagaaugacgaagacugcgcgcacuggaaggaggccaagaugcugcuagacaacaucaacaccccugaaggcaucauaccuuccauguucgagcccgagcgcgagaagguggacgccaucgacggugaauaccggcuacgcggggaggcccggaagacguucgucgaccugaugcguagaggcgacuugccgguguggcuggccuauaagguugcggcagaggggaucaacuacgccgaccgccgguggugcuucgacggcaucaagaacaaccagauccuggaggagaacgucgagguugagauauggacaaaagagggugaacgcaagaaacucaagccgcgguggcuggacgcccguaucuacagcgacccccuugcgcuuaaggaguucaaggaguucgccgccggaagaaaaucccugacucugaaccucaucacggaaaugggccgccugcccacguuuaugacacagaaggcccgggacgcccuggacaacuuagcgguacugcacacagccgaggccggcggccgcgccuacaagcacgcccugagcgagcuccccgagacgcuggagacccuguuacugcugacauugcuggcgaccgucacaggagggaucuuccuguuuuuaaugagcgggaaggggaucggcaagaugacguuagggaugugcuguaucaucacugcuagcauacugcucugguacgcccaaauccagccucacuggaucgccgccuccauaauccuggaguucuuccugaucguccuccugauccccgagccugagaagcagcggacgccccaggacaaccaacuaaccuacgucgugauugcgauacucacggugguagccgcgaccauggccaacgaaaugggguuccuugagaagaccaagaaggaccucgggcuuggcucaaucaccacucaggagagcgaguccaacauccuggacauugaccugcgcccggccagcgcguggacccucuacgcuguugcaaccaccuucgugacgcccaugcuacggcacuccaucgagaacagcuccguaaacguuagccugaccgccauugccaaucaggccacggugcuuaugggccuggggaagggguggccccugucgaagauggacaucggggugccacuccuggcgaucggcuguuacagccagguuaacccgaucacccugacggccgcccuccugcuucucguagcgcacuacgccauuauagggcccgggcuacaggccaaggccacacgggaagcucagaagcgcgcggccgcgggcaucaugaagaauccuaccgucgacgguaucaccgugaucgaccuggagccuauaccguaugacccgaaauucgaaaagcaguugggccagguaaugcugcugauccucugcgucacccaggugcugaugaugcggaccacgugggcgcugugcgaggcccucacccucgcgacgggucccaucucgacccugugggaggggaacccagggcgcuucuggaacacaaccaucgccgugagcauggccaacauuuuccgaggcuccuaccuggccggagcgggacugcuuuucagcaucaugaagaauacggccaacacccgccggggcaccgguaacauuggugagacccugggggaaaaguggaagucccgccugaacgcccugggcaagagugaauuucagaucuacaaaaaguccggcauccaggaggucgacagaacgcucgcgaaggaagguaucaagcgcggcgagaccgaccaccacgcugugagccggggguccgcgaagcugcgcugguucguggagaggaacauggucaccccggagggcaagguaguggaucugggcugcggacgcgguggguggagcuacuacugcggcgggcucaagaaugucagggaggugaaggggcugaccaagggcgggcccgggcacgaggagcccauccccauguccacauacggauggaaccuggugcgcuuacagagcggcgucgacguguuuuucaccccucccgagaagugcgacaccuuacugugugacaucggggagagcucccccaaccccaccaucgaggccggccgcacgcuccgcguguugaaccuggccgagaacugguugaauaacaacacucaguucuguauaaaggucuuaaauccguacaugcccuccgugaucgagaaaauggaaaccuuacaacggaaguacggcggugcccuggugcgaaacccccucucccggaacagcacacacgaaauguacugggucagcaacgcaaccggcaacaucgugagcuccgugaacaugaucucacgcaugcugaucaaccgcuucacgaugaagcacaagaaggcgaccuacgaaccggacgucgaccuggggucagggacccggaacaucgggauagagagcgagauccccaaccuagacaucaucggcaagagaaucgaaaagaucaagcaggagcacgagaccucauggcauuacgaccaggaccacccauacaagacgugggcauaccacggcucauacgaaaccaaacagaccggguccgccagcuccauggugaacggcgugguccggcuacugaccaagcccugggacguggugccgauggucacacagauggccaugacagacaccacccccuucgggcagcagcgcguauucaaagagaaaguugacacgcggacccaagagccuaaggagggcaccaagaaguugaugcgcauaaccgcugaguggcuguggaaggagcuuggcaagaagaagacgccccggaugugcacgcgcgaggaguucacccgaaaggucagaagcaacgccgcccuuggggccaucuucacugacgagaacaaguggaaguccgcccgggaggcgguggaggacagccgcuucugggaacugguggaccgggagcgcaaccugcaccuagagggcaagugcgagacgugcguguacaacaugauggggaagcgggaaaagaagcucggagaguucggaaaggcuaagggcucccgcgccaucugguacauguggcugggcgcccgguuucuggaguucgaggcccugggguuccugaacgaggaccacugguucagccggggcaacucccuuuccgggguggaaggcgaggggcugcaccggcugggcuacauccuccgugacgugagcaaaaaggagggcggggcuauguacgcugacgacacagccggcugggauacccggaucacccuggaggaccugaaaaaugaggagauggucacgaaccacauggagggggagcacaaaaagcucgccgaggccauauucaagcucaccuaccagaacaaggugguccgcguccagaggccuacgccacggggcacugugauggacaucaucucccgcaaagaucaacggggcagcggccaggugggcacuuauggccugaacaccuucaccaacauggaggcgcaacuaaucagacagauggagggugaggggaucuucaaauccauccagcaccugaccguaacggaggagaucgccgugcagaacuggcuggccagggucggccgcgagcggcuuucaagaauggcuaucagcggugacgauugcguggugaagccccuagacgauagauucgcaagcgcccuuaccgcucucaacgauaugggcaagguccgaaaggacauccagcagugggagcccucccguggcuggaacgacuggacccaggugcccuucugcagccaccacuuccacgagcugguuaugaaggacgggcggguccuggucguacccugcagaaaccaggacgagcucaucggccgcgcacgaaucucgcagggggccggcuggagccucaaagagaccgccugccugggcaaguccuacgcucagauguggacgcucauguauuuccaccgccgggaccugcgccuagccgccaacgccaucugcagugcgguccccucccacugggugcccacaucacgaaccacaugguccauccacgcaaagcacgaguggaugacgacggaggacaugcucgccgucuggaacagggucuggauccaggagaacccguggauggaggacaaaacgcccguugagucgugggaggaggugcccuauuuagggaagcgggaggaccaguggugcgggagcuuaaucggucucacaucccgggccaccugggccaagaacauccagacggcgaucaaccagguccgcagcuuaaucggcaacgaggaguacaccgacuacaugcccucuaugaaaagguuccgccgggaagaggaggaggccggggugcugugguga

SEQ ID NO: 24820 - RNA, 9876 nt, Artificial Sequence
  derived and/or modified CDS sequence (opt11) from DENV-2__JX669479__SS-prME
accgcgggcguaaucguaaugcucauaccaacggccauggcauuccaucugacaacacgcaacggcgaaccccauaugaucgucggccgucaggagaaaggcaaaagccuccucuucaaaacggaggacggugucaacaugugcacccugauggcuaucgaccugggggaauugugcgaggacaccaucaccuacaaauguccucuccucaggcagaacgagccagaagacauugauugcuggugcaauagcaccuccaccuggguuacguauggcacaugcaccaccaccggggagcaccgucgagagaaacgcagcguggcccuaguaccacacgucggaaugggauuagagacacgaaccgaaacauggaugaguucggaaggagccuggaaacacguacagcguauagagacuuggauccugagacacccagguuucacaaucauggccgccauacuggccuacacgauagggaccacucacuuucaaagagcccuaauauuuaucuugcugacagcagucgcacccuccaugacgaugcguugcaucggaauuagcaacagagauuucguagaaggagugagcgggggaagcuggguggacaucguacuagagcauggcaguugcgucacaaccauggcgaagaacaaaccaaccuuggacuucgaacugaucaaaaccgaggccaagcagccagcaacacugagaaaguauugcauagaagccaagcucaccaacacaacuacagaaaguaggugucccacccaaggggaaccuucccuuaacgaagaacaggacaagcgguucaucuguaaacauaguaugguggaucgaggcugggguaacggaugcggccucuucgggaagggcgggauaguaacgugcgcaauguucacuugcaaaaagaacauggagggcaagaucguucaaagugagaaucucgaguacacuauugugaucacaccccauagcggagaggaacacgccguagguaaugacacgggcaagcacggcaaggaaaucaagaucaccccacagagcagcacaaccgaggcagagcucaccggauauggaaccgucacaauggaaugcagccccagaacagggcuagacuucaacgaaauggugcuacuacagauggaagacaaagcauggcucguacaucgacaaugguucuuagaccugccauuaccguggcugcccggagccgacacacaggguuccaacuggauacagaaagaaaccuuagugaccuucaaaaacccacaugcuaaaaaacaagacguaguggugcuaggaagccaagaaggcgccaugcacacagcccugacaggagcaaccgaaauccaaauguccagcggaaauuuacuuuucacuggucaccuaaaaugccgucuacgcauggacaaacuucaacuaaaaggaaugucauacucgaugugcacgggaaaguucaaaauagucaaagaaaucgcagagacucaacauggcaccauagugauacgcgugcaauacgaaggugacggaucucccugcaaaauuccauucgagauuacugaccucgaaaaaagacacguccuaggccgauuaauuacagucaacccaauaguaacggaaaaggacagccccgugaauauagaagcggagcccccguucggagacucuuacauuaucguuggaguagaaccaggacagcucaaacuaaacugguucaagaagggauccucaaucgggcaaauguucgaaacaacaaugcgcggagcaaagcgcauggcaauacucggagacaccgcaugggacuucggaagccuaggaggagucuucacgagcaucggcaaagcgcuacaccaagucuucggagcaauauacggcgcugcguucucagguguuaguuggacaaugaagaucuuaaucggagucaucaucacauggauuggaaugaauagcagaucgacaagucuaagugucagccuaguucucguuggaguugucacccuguaccucggagcaaugguacaagcggauucagguugcauaguaucguggaaaaacaaggaauuaaagugcggaaguggaauauucaucacagacaacguucacaccuggacggaacaauacaaauuucagccggaauccccuucgaaguuagcuucagcaauccaaaaagcgcacgaagaaggcauaugcgggauacgaucagugacaaggcucgaaaaccucauguggaaacagauaacaccggagcucaaucauaucuuauccgaaaacgagguaaaacuuacgauaaugacaggagacauaaagggcauaaugcaagcaggcaaacgaagucuacggccucaaccaacggaauugaaguacucauggaaaaccuggggaaaggcgaaaaugcuuaguaccgaaucucacaaucaaacuuuucuaauagacgggccagaaacagcagaauguccgaauacuaaccgagcauggaauagccuagaaguggaggauuauggcuucggcguguucacaaccaauaucuggcuaaaauuacgugaaaaacaagacguuuucugcgacucaaaacucaugucugccgcaauaaaagauaauagggcaguacaugcggacaugggauacuggaucgagucagcauugaacgacacauggaaaauggagaaagccucauucaucgaagugaagucgugccacuggccaaaaucccacacccuaugguccaacggaguacuugagagcgaaaugaucauccccaaaaauuuugccgguccagugucccaacacaauuacagacccggauaucacacccaaacagcgggaccguggcaccugggaaaacuagagauggacuucgacuucugcgaaggaacaacagucguugugaccgaggacugcgggaacagaggacccagccuccguacaaccaccgcuagcgggaagcuaauuaccgaguggugcugucgauccugcacucuacccccccuuagguacaggggugaggacggcugcugguacgggauggagauaaggccgcuaaaggagaaagaagagaaucuugugaacucccuuguaaccgcaggacauggacagauagacaacuucucauuggggguccugggcauggcccucuuccucgaagagaugcuacggaccaggguggggacuaaacacgccaucuuacucguagcccucuccuuugucacgcuuauuacuggcaacaugucguuccgcgaucuaggacgggugauggugaugguaggagccacgaugacagacgacaucgggauggguguaacguaccuagcgcuccuagccgcguucaagguccgaccgaccuucgcagccggucuccuacugaggaagcuaacuaguaaggaacuaaugauggcuaccaucgguauagcgcuccuaucucagucaacccuaccagagacgauccuagaauuaaccgacgcgcucgccuuagguaugauggccuuaaaaauaguccgaaacauggaaaaauaccagcuugcagucacuaucauggccauaucuuguguacccaacgcggugauccuacagaacgccuggaaagugaguugcaccauauuagcggcagucucaguuucaccucuacuauuaacguccagccaacaaaaggcagacuggauaccacuagcacuaacaauaaaaggacucaaccccacggcgauuuuccucaccaccuuaagccguacauccaaaaagaggucguggccuuugaaugaagcaauuauggccgucgggaugguaucgauacuugcgagcucccuccugaagaacgacaucccuaugacaggcccacucguugccgguggacugcugacagucuguuauguucuaacagguagaucagcggaccuggaacuagaacgcgcagccgauguuaaaugggaagaccaagcagagauaagcggcuccucaccaauacuaucaauuacgauaucggaggacggaucgaugagcaucaaaaacgaggaggaggagcaaacucugacuauacugauccggacaggacuacucgugauuagcggcgucuucccagugucaauucccauaacggccgccgcaugguaucugugggaagucaagaaacaaagagccggaguucuaugggacguaccaucacccccaccaguagaaaaagccgagcuggaagauggagcauaucgaaucaagcagcgcggcauccugggauacagucaaauaggggccggagucuacaaagaaggaacauuccacacaauguggcaugugacgcgcggcgccgucuugaugcaccgcgggaagcgcaucgagccuucuugggcagacgugaaaaaggaccugauauccuauggcggaggguggaaauuggagggggaguggaaggaaggcgaagaggugcagguacuagcauuagagccaggcaaaaacccccgagcaguacaaacaaaacccggaaucuucaaaacaaacacugggacaauaggagcaguaucgcuggauuucucuccggggacaaguggguccccgauaguagaucgaaaaggcaagguaguggggcuguacggcaauggcguaguuacgcggucaggggccuacgucuccgcgaucgcccagacggagaaauccaucgaggacaaccccgaaaucgaggaugauauauuucgaaagaagcgguugacuaucauggaucuccaccccggugccgggaaaacgaagcgauaccugccagccaucguccgggaggcgauaaaacgaggacuccgcacgcuaauucuugcucccacacgcgucguugcugccgaaauggaggaagcgcugcgaggccuaccaauucgauaccaaacgccagcaauacgagccgagcacacuggcagggagauagucgaccucaugugccacgcgaccuucacaaugcgacucuuaagcccagugagagugccaaacuacaaucugaucaucauggacgaagcacacuucacugacccggccagcauagcggccaggggauacauauccacgcgcguggagaugggcgaggccgcaggcauauucaugaccgccaccccuccuggaagccgagauccguucccucaaagcaacgccccgaucauggaugaagaacgagaaauacccgagaggagcuggaauucaggacacgagugggugaccgauuucaaaggcaaaaccgucugguucguacccagcauaaaagccggcaacgacauugccgcaugccucagaaagaacggcaagaaagucauccaacucucccgaaaaacguucgacagcgaauacguaaaaacucgcgccaacgauugggauuucguaguuacuacggauaucuccgagaugggcgcgaauuucaaagccgaaagggucaucgacccacggcgaugcaugaaaccaguaaucuuaacagacggggaggagcggguaauccuagcaggcccaaugccggucacgcacucauccgcggcucaaaggcgcggaaggaucggccguaacccaaaaaaugagaacgaccaguacauuuauaugggcgagccgcuagagaacgacgaagacugcgcacacuggaaggaagccaagaugcuauuagacaauaucaacacgccggaggggauaauaccauccauguucgagccagagcgagaaaaaguggacgccauagacggugaauaccgccuccgcggagaggcccgcaaaacguucguagaccucaugcgaaggggagaccugccaguuuggcuagccuacaaagucgcagcugaagguauaaacuacgccgacaggaagugguguuucgacggcaucaagaacaaccagauccuugaggaaaacguagagguugaaauuuggaccaaggagggggaaaggaagaaguugaaaccccgauggcucgacgcacgcaucuacagcgacccgcucgcucuaaaggaauucaaagaguucgccgccggacguaaaagucugacgcugaaucuaaucacugagaugggcaggcucccuacauucaugacacaaaaggcacgcaacgcccuagacaauuuagcagugcuacacacugcggaagucgggggucgagcguauacacacgcacucucggagcuaccagagacccuggaaacgcucuuacuccucacgcuacucgccgcaguaacuggcggaauauuccuauuccugaugagcggcaaggggaucggcaagaugacguuagggauguguugcauuaucaccgccuccaucuuacucugguacgcccaaauacagccucacuggaucgcggcaucaauaauccucgaauucuuccucaucgugcuacuuauucccgaacccgaaaaacagcgaacaccacaggauaaccagcuaaccuacgucgugaucgcaauacucaccguuguggcagccacgauggcgaaugaaauggguuuccucgaaaaaaccaaaaaagaccugggauucgggagcaucaccacccaagaaagugaauccaacauucucgacaucgaccuaagaccagcaucggcauggaccuuauacgccgucgcgacgacauucgugacaccgaugcugcgacacagcaucgaaaacaguagcgucaaugucagccugaccgccauagcgaaccaggccaccguucuaaugggguuaggaaagggauggcccuugucgaaaauggauauaggcguaccgcuacuagccauagggugcuauucacaggugaacccuaucacacugacggcggcgcuacucuuauuaguugcccacuacgccauaauaggaccaggucuacaggcaaaagccacccgcgaagcgcaaaagagggcggcagccggaauaaugaaaaacccaaccguugauggcauaaccguaauagaccuagaaccgauacccuacgacccaaaguucgaaaagcaauuaggccaagucaugcugcuaauccuaugcguaacccagguacugaugaugaggacuacaugggcacucugugaagcguuaacucuggcgacgggaccgaucuccacguugugggaaggaaacccaggaagguucuggaauacuaccaucgcugugucaauggcaaauauuuucagaggaagcuaccuagccggggcaggacuacucuucuccauaaugaaaaacacaacuaacaccagaaggggaacuggaaaugugggagaaacgcucggcgaaaaauggaagucccgacucaaggcccuagggaagagcgaauuccagauuuacaaaaagaguggcauacaggaggucgaccgaacgcuggcgaaggaagggauuaaacgaggagaaaccgaucaccaugccguaagcagaggcucagcuaagcuuaggugguuuguagaacggaacaugguaacucccgaggggaaaguagucgaccucggaugcggcagaggcggauggucguacuacugcggaggacugaaaaacguccgggaagugaaaggacuaacuaaaggcggcccgggacacgaagaaccaauuccgaugagcacauacggguggaaccuagugcggcuccaaagcggcguagacguguucuuuacuccacccgaaaagugcgauacacuuuugugcgacauaggagagucgaguccaaacccuacaauagaagcgggucgcacccuucgugucuugaacuugguagaaaacuggcugaacaacaauacccaauucugcaucaagguacuaaacccauacaugccaagcguaaucgagaaaauggagacgcuccagcgcaaguacggaggugcacugguucgcaaucccuugagucggaacuccacacaugagauguauuggguaucaaacgccacgggaaacauagugucgagcguaaacaugaucucgaggaugcuaaucaacagguucacaaugaaacacaagaaagcaaccuacgagccugauguagaccuaggguccgggacacgaaacaucggaauagaaagcgagauaccgaaccucgauauaauuggaaaaagaauugaaaaaaucaagcaggagcacgagacaaguuggcacuacgaccaggaccaccccuacaaaacaugggcguaccacggcagcuacgagacaaaacaaaccggcuccgcuagcagcauggugaacgggguagugaggcuccucaccaagcccugggacgucgucccgauggugacccagauggcaaugacggacaccacaccauuuggacaacaaagaguauucaaggagaagguugacacaagaacccaagagccaaaggagggaacgaaaaaacucaugaagaucacagcagaguggcuauggaaggaauuggggaaagagaagacaccacgaaugugcacucgggaggaauucacacgaaagguccguuccaacgcagcacucggcgcaguguucacagacgaaaacaaauggaaaucugcacgggaagcagucgaagacggcagguucugggaacucgucgacagagagcgaaaccuucaccuagaaggcaaaugcgagacuugcguauacaacaugauggguaaacgcgaaaaaaaacuuggcgaauucggaaaggcuaaagguagucgagcaauaugguacauguggcugggagcacgguuccucgaguucgaagcacuaggauuccuaaacgaagaucacugguucagccgcggcaauagccugagcggaguugagggcgaaggacugcacagacuuggauauauacugagggaaguaggcaaaaaggagggcggggccauguacgcggacgauacggcagguugggacacacgcaucaccuuagaggaccuuaaaaacgaagaaaugguaacgaaccacaugaagggugagcacaaaaaauuggcggaagccaucuucaaacucacauaccaaaauaaggucguucggguacagcgcccuacuccgcggggcacagugauggacaucauuagcaggaaggaccagagagggaguggccaagucggaacauauggccuaaauaccuucacaaauauggaggcacaacuuauucgacaaauggagggcgaaggaauauucaaaagcauccaacaucucacggcaaccgaagagaucgcuguacaaaacuggcuugcuaggguaggacgcgagagacugagccgaauggcaauauccggagacgacugcgucguaaagccgauagacgaccgguucgcguccgcacucaccgcccuuaaugauaugggaaagguacgcaaggacauccaacaaugggaaccuucccgcggguggaacgacuggacgcaggugccauucuguagccaucacuuucacgaacuagugaugaaggacggucgagugcucguagugcccuguaggaaucaagacgaacugauugggcgagcacgcaucucgcaaggcgccggcuggucguuaaaagaaaccgcgugccugggaaaguccuaugcccaaauguggacucuaauguacuuccacaggcgggaccucaggcuggcagcgaacgcaauaugcagcgcagugcccucucauugggugccgacaagccgcacaaccuggucaauccacgcuaaacaugaauggaugaccacugaagacaugcuugcggucuggaaccguguuuggauccaggaaaacccauggauggaagacaaaacgccuguagaguccugggaagaaguaccuuaccucggaaagcgagaggaccaguggugcgggucgcuaauaggccucacauccagagccacgugggcgaaaaauauccaaaccgccaucaaucaaguuaggucccuaaucggcaaugaaggauacacagacuacaugccgagcaugaagcgauuuagacgggaagaagaagaagccggggugcuaugguaa

SEQ ID NO: 24821 - RNA, 9876 nt, Artificial Sequence
  derived and/or modified CDS sequence (opt11) from DENV-2__KF744403__SS-prME
accgccgggaugaucaucaugcugauccccaccgugauggccuuccaccucaccacccgaaacggggagccucacaugaucgucagccggcaggagaaaggcaaaagccugcuguucaagaccgaggacggggugaacauguguacccucauggcgauggaccugggggagcugugcgaggacaccaucaccuacaagugcccccuccugcgccagaacgagcccgaggacaucgacugcuggugcaacagcaccuccaccugggugaccuaugggaccugcaccaccacgggcgagcacagacgggagaagcggagcguagcccuggucccgcacguggggauggggcucgagacccgcaccgagaccuggauguccuccgagggcgccuggaagcacgcccagcggaucgagacguggauccugcgccaucccggguucacccugauggccgcuauccucgccuacaccauuggcacuacgaacuuucagcgggcccugaucuucauccugcucaccgcugucgcgcccuccaugaccaugaggugcaucgggaucagcaaccgagacuucguggagggcguuuccggcggguccugggucgacaucguacuggagcacgguuccugcgugaccacgauggccaagaacaagcccacccuggacuucgagcucaucaagaccgaggccaagcagcccgccacacugcgcaaguacugcaucgaggccaagcugacgaacaccaccaccgagagccggugcccgacgcagggggagcccucccucaaugaggaacaggacaagcgcuucgucugcaagcacaguaugguggaccgagguuggggcaacgggugcggccuguucgggaagggcgggaucgugaccugugcgauguucacguguaagaagaacauggagggcaagaucguccagcccgagaaccuggaguacaccaucgugaucaccccucacuccggcgaggagcacgccguggggaacgacaccgggaaacacgggaaggagaucaagaucaccccgcagagcuccaucaccgaggccgagcucacaggcuacgggaccguuaccauggagugcagcccccgcaccggccuggacuucaaugagauggugcugcugcaaauggagaacaaggccuggcuggugcaccggcagugguuccuggaucucccccugcccuggcuaccaggcgcugacacccaggguuccaacuggauccagaaggagacgcuugucaccuucaagaacccccacgcgaagaagcaggacgucgugguccugggcagccaggagggggccaugcacaccgcccugaccggagccacggagauccagaugagcuccggaaaccuccuguucaccggccaccugaagugccgccuucggauggauaagcugcagcugaaggguaugagcuacuccaugugcaccgggaaguucaagguggucaaggaaaucgccgagacgcagcacggaacgaucguggugcgcguccaguacgagggcgacggcagccccugcaagauccccuucgaaaucauggaucucgagaagcgacacgugcugggccgccugaucaccgugaacccgaucgugaccgagaaggacucccccgugaauaucgaggcggagccgcccuucggugacagcuacgugaucaucggcgucgagccggggcagcucaagcugaacugguucaaaaagggcagcagcaucggucagauguucgagaccacgaugcgcggcgccaagcggauggccauucugggcgacaccgccugggacuucgggucacucggcgggguguuuaccagcauaggcaaggccuuacaccagguguucggggcgaucuacggggcggccuucuccggagucuccuggaccaugaagauccugaucggggugaucaucacguggaucggcaugaacucccgcagcaccucccugagcgugucccucguccugguggggguggucacccuguaccucggaguggugguccaggccgacagcgggugcguagugucauggcggaacaaagaguugaagugcggcuccggcaucuucaucaccgacaacguccacacguggaccgagcaguacaaauuccagcccgagagccccuccaagcuggcgagcgccauccaaaaggcgcaccaggaggguauaugcggcauccgcuccgugacccggcuggagaaccugauguggaagcagauuaccccagagcugaaccacauccucagcgagaacgaggugaagcugacgaucaugaccggggacaucaagggcauaaugcacgccgggaagcgcucccugcggccgcagcccacggagcuccgcuacagcuggaagaccuggggcaaggccaagauacugucuacugagagccacaaucagaccuuccugaucgacgggcccgagaccgccgagugcccgaauacaaaccgggccuggaauucccucgaggucgaggacuacggguucggcguguucacgacuaacaucuggcugcgguuacgggagaaacaggacgccuucugcgacagcaagcucauguccgccgccaucaaggacaaccgagcggugcacgcggacaugggauacuggaucgagagcgcccugaacgacaccuggaagaucgagaaggccuccuucaucgaggucaagagcugccacuggcccaagucccacacccuguggagcaacggcgugcucgagucagagaugaucauccccaagaacuucgccggcccggugucacagcacaacuaccggccgggguaccacacccaaacggcgggccccuggcacuuggggaaacuggagauggacuucgauuucugcaagggcaccaccgucguggugacggaagacugcgggaaccgcggccccagcuugcggacgaccaccgccuccggcaagcugaucaccgaguggugcugccgcagcugcacgcugcccccacuccgguaccgcggggaggacggaugcugguacgguauggagauccggccacugaaggagaaggaggagaaccuggucuccagccucguaaccgccggccacgggcagaucgacaacuucucccugggcgugcugggcauggcccucuuccuagaggaaaugcugcgcacccgggucgggaccaagcacgcgauccuccugguggccgugagcuucgucacgcuaaucaccggcaacaugucauuccgggaccucgggcgcgugauggugauggucggcgcuacgaugacagacgacaucgggaugggcgugacguaccuggcgcugcucgcagcguucaagguucggcccaccuuugcggccggccugcugcuccgcaagcugaccagcaaggagcugaugaugaccacgaucgggaucguccuccugucccagagcaccauccccgagaccauccuugagcucacggacgcccuggcucuggggaugauggugcucaagauugugcggaaaauggagcgcuaccagcuggcgguaacgaucauggccauccuuugcgugccgaacgccgucauccuccagaacgccuggaagguguccugcaccauccuggccguggucagcgugagcccccugcuccugacaagcucccagcagaaggcagacuggauccccuuagccuugaccaucaaggggcugaaccccacggccaucuuccugaccacccuuagccggaccuccaagaagcgcuccuggccgcugaacgaggccaucauggcggugggcauggucagcauccuggccucaagccuccugaagaacgacauccccaugacgggcccccugguggccgggggccuccugaccgugugcuacguccugaccgggcgguccgcugaccucgagcuggaaaaggcugcggacgugcgcugggaggaccaggccgagaucagcggcuccagccccauacuguccaucaucaucagugaagacggguccaugagcaucaagaacgaggaggaggagcagacccucacgauccugauccggaccggccugcucgugaucucuggccuguucccggucagcauccccaucaccgccgccgccugguaccugugggaggugaagaagcagcgcgcagguguccucugggacguccccucaccuccgcccgugggcaaggccgagcuugaggacggggccuaccggaucaagcagaagggaauccugggguacagccaaaucggcgccggcguguacaaggaggggaccuuccacaccauguggcacgucacgcggggcgccgugcucaugcacaaggggaagcggaucgagcccuccugggcggacgugaaaaaggaccugaucagcuacggcgggggcuggaaacuggaaggugaguggaaggagggggaggagguccagguguuagcccuggaacccggcaagaacccccgcgccgugcagaccaagcccgggcuguuuaagaccaacgccggcaccaucggggccgucagccucgacuucagccccggcacguccgggagccccaucaucgacaagaaggggaagguggugggccuguacgggaacggcgucgugacccggaacggcuccuacgugagcgcaaucgcccagaccgagaaauccaucgaggacaaccccgagaucgaggaugacaucuuccgcaagaagcggcucaccauuauggaccuucacccgggggccggcaagacgaagcgcuaccuccccgccaucguccgggaggcgaucaagcgcgggcugcgaacccugauccuggccccgacccggguuguggccgccgagauggaggaggcccugcgcggccugcccauccgguaccagacccccgcgauccgcgccgagcauacggggcgggaaaucguagaccugaugugucacgccaccuucaccaugcgccuguuaucccccauccgggugccgaacuacaaccucaucaucauggacgaggcccacuucaccgaccccgccagcauugcggcacgcggcuacaucuccacgcggguggagaugggcgaggccgccgggaucuucaugaccgccacgccccccggcucacgcgacccguuuccccaguccaacgcgcccaucauggacgaggagcgggagauccccgaacgcagcuggaacucgggccacgagugggucaccgacuucaagggcaagacagugugguucgugccgagcaucaaggccgggaacgacaucgccgccugccugcgaaagaacggcaagaaggucauccaguuauccagaaagaccuucgacagcgaguacguuaagacccggaccaacgauugggacuucgugguuacgacagacauauccgagaugggcgcgaacuucaaggccgagcgcgugaucgacccccggaggugcaugaagcccguaauccucaccgacggggaagagcgggucauccuggccgggcccaugccggugacccacagcuccgccgcccagcgccgcgggcggauaggccgcaaccccaagaacgagaacgaucaguauaucuacaugggggaaccccuggagaacgacgaggacugcgcgcacuggaaggaggccaaaaugcuccuggacaacaucaacacgcccgagggcauaaucccgaguauguuugagcccgagcgggaaaagguggaugcuaucgacggcgaguaccgccugcgcggggaggcucgcaagaccuuugucgaccucaugcggcgcggcgaccugcccguguggcuagccuacaagguugccgccgaggggaucaacuacgccgaccggcgcuggugcuucgacggcauccggaacaaccagauccucgaggagaacguugaaguggagaucuggaccaaagaaggggagcgcaagaagcucaagccgcgguggcuggacgcccgcaucuacuccgacccccucgcccucaaggaguucaaggaauucgcggccggucggaagucacugacccucaacuugaucacagagauggggcgccugcccaccuucaugacccagaaggcacgggaugcccucgacaaccuggcaguccugcacaccgcugaggccgggggccgcgcguacaaucacgcccucuccgaacugcccgagacgcuggagauccuccugcugcucacccugcuggcgacggugacggggggcaucuuccuauuccugaugagcggccgggggaucggcaagaugacgcuggggauguguugcaucaucacggccuccauccuccugugguacgcccagauccagccucacuggaucgccgccagcaucauccuggaguucuuccucaucgugcugcugauccccgagcccgagaagcaacguacgccccaggacaaccagcucaccuacgucgugaucgcgauccugaccguggucgccgccaccauggccaacgagaugggcuuucuggagaagaccaagaaggaccucgggcugggcagcaucaccacccagcagcccgaguccaacauccuggacaucgaccuccggccugccagcgcguggacgcuauacgccgucgccaccaccuucaucacccccaugcugcgccacuccaucgagaacagcuccgugaacgucagcuugacggccaucgccaaccaagcgaccgugcugaugggccuggggaagggcuggccccucuccaaaauggacaucggggugccacugcuggcgauuggcugcuacagccaggucaaccccaucacccuaaccgccgcucugcugcuccugguggcgcacuacgcgauaaucgggcccggccugcaggccaaggccacccgcgaggcccagaagcgggcggccgccggcaucaugaagaaccccaccguggacgggaucaccgucaucgaccucgacccgauuccauacgaccccaaguucgagaagcagcugggccaggugaugcugcucgugcugugcgucacucaggugcugaugaugcgcacuaccugggcccucugcgaggcccugacccuggcgaccgggcccaucuccacguugugggagggcaauccggggcgguucuggaacaccaccaucgccgugagcauggcuaacaucuuccgcggcuccuaccuggccggcgccgggcuccuauucucuaucaugaagaacaccacgaacacccggcgcggcaccggcaacauaggcgagacccugggcgagaaguggaagucccggcucaacgcgcucggcaagagcgaguuccagaucuauaagaaguccggcauccaagaggucgaccgcacgcuggcaaaggaggggaucaagagaggcgagaccgaccaccacgccgugagccgcggauccgccaagcugcggugguucguggagcgcaacaugaucacgcccgaaggcaaagucguggaccucggcugcgggcguggcggguggagcuacuacugcggcgggcugaagaacgugcgcgaggucaagggccugaccaagggcgggcccggccacgaggagcccaucccuaugucuacguacggguggaaccucgugcggcugcagagcggcguggacgucuucuucacaccgcccgagaagugcgacacucugcucugcgacaucggggagagcucccccaacccgacgguggaggcgggccgaacgcugcgggugcuuaaccucgucgagaacuggcugaacaacaacacacaguucugcaucaaggugcugaacccuuacaugcccagcgugaucgagaagauggaggcccugcagcggaaguacggcggggcccucguccggaacccgcuaucccgcaacagcacccacgagauguacuggguauccaacgccagcggcaacauuguguccagcgucaacaugaucucucgcauguuaaucaaccgguucaccaugaaacauaagaaggccaccuacgagcccgacguggaccucgggaguggcacgcggaacaucgggaucgaguccgaggugcccaaccuggacaucaucggcaagcggauugagaagaucaagcaggagcacgaaaccagcuggcacuacgaccaggaccaccccuacaagaccugggcguaccacggcuccuacgagaccaagcagacggggagcgccuccagcauggugaacggcguggugcgccugcucaccaagccgugggacgucauccccauggugacccagauggccaugaccgacacgacccccuucgggcagcagaggguguucaaggaaaagguagacacccgcacccaggagcccaaggagggcacgaagaagcugaugaagaucacggccgagugguuauggaaagagcucggcaaaaagaagaccccgcggaugugcacccgcgaagaauucacgcggaaggugcgcucuaacgccgcgcugggggccaucuucaccgacgaaaacaaguggaaguccgcgagggaggccguggaggacucccgcuucugggagcuggucgacaaggagcggaaccuccaccuggagggcaagugcgagaccugcguguacaacaugauggggaagcgcgagaagaagcugggcgaguucgggaaggccaagggcucacgugcgauuugguacauguggcucggcgcccgcuuccuggaguucgaggcccugggguuccucaacgaggaccacugguucagccgggagaacucccugagcggcgucgagggggagggccugcacaaguuaggguacauccugcgcgacguuuccaagaaggagggcggcgccauguacgcggacgacaccgccgggugggacacgcggaucacccuggaggaccucaagaacgaggagauggugacgaaccacauggagggcgagcacaagaaacuggccgaggccaucuucaaguugacauaccagaacaaggucgugcgcgugcagcggcccacgccccgcgggacggucauggacaucaucagccgccgggaccagcgcggcuccggccagguuggcaccuacggccucaacacauucacgaacauggaggcccagcugauuagacagauggagggcgagggcgucuucaagagcauccagcaucucaccgcgaccgaggagaucgccguccagaacuggcucgcccgcguggggcgggaacgccuguccagaauggccaucagcggcgacgauugcgucgucaaaccccuggaugaccgcuucgccuccgcgcucaccgcccucaacgacaugggcaaggugcggaaggacauccagcagugggagccgagcaagggguggaacgacuggacccaggugcccuucugcucccaucacuuccacgagcugaucaugaaggacggccgcguccucguggugcccugcaggaaccaagacgagcugaucgggcgcgcuaggauuagccagggcgcaggguggucccuccgagagaccgccugucucggcaagagcuacgcccagauguggucccugauguacuuccaccggcgcgaccugcggcuugccgccaacgccaucugcagcgccguccccucccacugggucccgaccagccgcaccacguggagcauccaugcgaagcacgaguggaugaccaccgaggacaugcugaccguguggaaccggguuuggauccaggagaauccuuggauggaggauaagacccccguggaauccugggaggagaucccauaccugggcaagcgcgaggaccaguggugcgggagccucaucggccugacgucucgcgccaccugggccaagaacauccaaacagccaucaaccaggugcgcagccugaucgggaacgaggaguacaccgacuacaugccguccaugaagcgcuuccggcgcgaggaggaggaggcgggcguccucugguga

SEQ ID NO: 24822 - RNA, 9876 nt, Artificial Sequence
  derived and/or modified CDS sequence (opt11) from DENV-2__KF744406__SS-prME
accgccgggaugaucaucaugcugauccccacggugauggccuuccaccucaccacccggaauggggaaccacacaugaucgucucccggcaggagaaggggaagagccugcuauucaagaccgaagauggggugaacaugugcacccugauggcaauggaccuaggcgaauugugcgaggauaccaucaccuacaagugcccccuccuucgccagaaugagcccgaggauaucgacugcuggugcaacagcacuagcacaugggugacguaugggaccugcacaaccacgggugagcacaggcgcgaaaagcggagcguugcacugguaccccacguuggcauggggcucgagacucgcacugagaccuggauguccucggagggcgccuggaagcacgcccagcggauugagacuuggauccuacgccaccccggguuuacccugauggccgcgauacuugccuacacgaucggcacaacgaacuuccagcgggcucugaucuucauccugcuuaccgccgucgcgcccuccaugaccaugcgcugcaucgggaucagcaaccgggacuucgucgagggcguuucuggcgggucaugggucgacaucguacuggagcacggcuccugcgugacgacgauggcaaagaacaagcccacccuggauuucgagcucaucaagaccgaggccaagcagcccgccacccuaaggaaguauuguauagaggccaaacugacgaacacaaccaccgagagccggugcccgacacagggggaaccgucccugaacgaggagcaggauaagcgcuucgucugcaagcacucgaugguggacagggguuggggcaacggguguggcuuauucgggaagggcgggauagugaccugcgcgauguucacgugcaagaagaacauggagggaaaaaucguccagcccgagaaccuagaauacaccaucgugaucacgccccacuccggcgaggagcacgcuguaggcaacgacaccggcaagcacggcaaagagaucaagaucaccccgcagagcuccaucaccgaggccgagcucaccggcuacgggacggugacuauggagugcagcccacgcaccggccuggacuuuaacgaaauggugcugcugcagauggagaacaaagcauggcuggugcaccggcagugguucuuggaccucccccugcccuggcugccgggcgccgacacccaagggaguaacuggauccaaaaggagacgcucgucaccuucaagaacccccaugcgaagaagcaggacguggugguacugggcagucaggagggcgccaugcacaccgcccugaccggcgccacggagauccagaugagcuccgggaaucuccuuuucaccggacaccugaagugcaggcuccggauggacaagcugcaacugaagggcaugaguuacuccauguguaccgggaaguucaaggucgugaaagagaucgccgagacccagcacggcacgaucguggugcgcguccaguacgagggggacggcucccccugcaagauccccuucgagaucauggacuuggagaaacgccacguucugggccgccucaucaccgugaaccccaucgucaccgaaaaggauucccccguaaacaucgaggcggagccgcccuucggggacagcuauguaaucaucggcgucgaaccggggcagcucaagcuuaacugguucaaaaagggauccagcauugggcagauguucgaaacaacgaugcguggugccaagcggauggcuauccugggcgauaccgccugggacuucgggagccucggggggguguucaccagcaucggcaaggcauugcaccagguauuuggggcgaucuacggcgccgcauucuccggcgugagcuggaccaugaagauccuuaucggggucaucaucacguggaucggcaugaacucccggagcacuucgcuaagcgugucgcuugucuugguggggguggucacacuguaccucggggugguggugcaggccgacucggggugcgugguguccuggcguaacaaagaacuaaagugcggcagcggcaucuuuauaaccgacaacguccacacguggacggagcaguacaaguuccagcccgagagccccuccaagcucgcguccgccauacaaaaggcccaccaggaggggaucuguggcauccgcuccgucacccggcucgagaaccugauguggaagcaaauuacccccgagcugaaccacauccucagcgagaaugaagugaagcugacgaucaugaccggugacauuaagggcaucaugcacgcagggaagaggucccuccggccgcaaccuaccgagcuccgcuacagcuggaagaccuggggcaaggccaagauucuguccaccgagucgcacaaccagaccuuucugauugacggacccgaaacagcagagugccccaauacuaaccgugcuuggaacucacucgaggucgaggacuacggguucggcguguucacgaccaacaucuggcugcgcuugcgggagaagcaggacgccuucugugacagcaagcucauguccgcagccaucaaggacaaccgcgccgugcacgccgacaugggguacuggaucgagagcgcccuaaacgacacguggaagaucgaaaaggccucguucaucgaggucaagagcugucacuggcccaagucccacacccuguggagcaauggcguacuugaguccgagaugaucauccccaagaacuucgcaggccccgugagccagcauaacuauagaccgggguaccacacccagacggcggggcccuggcaccuggggaagcuggagauggacuucgacuucuguaagggcaccacuguuguggugacugaggacugcgggaaccgcggccccagccuccgaacgacgaccgccagcggcaagcugaucaccgaguggugcugccgcagcugcacucugcccccacuccgauaccgcggggaggacgggugcugguacgggauggagauccggccucugaaggagaaggaggagaaccuggucuccagccucgugacggccgggcacgggcagaucgacaacuucucccuuggugugcugggcauggcccucuuucucgaggagaugcugcgcacccggguugggaccaagcacgcgauccuccugguggccgugagcuucgucacgcugaucaccggcaauauguccuuccgagaccucgggcgugugauggugauggucggcgccaccaugaccgacgacaucgggaugggcgucacguaccuggcccugcucgccgcauucaaagugcggcccaccuucgccgccggacuuuuacugcguaagcugaccucgaaggagcugaugaugacgacgauagggaucguucuccugucccagagcaccauccccgaaaccauccuggaguuaaccgacgcccuggcccuggggaugauggugcucaagauagugcggaagauggagcgcuaccaacucgcugucacuauuauggcaauccugugcgugccaaacgcugucauucuccagaacgcauggaaggugagcugcacaauccuggcaguggugagcgugagcccccugcuauugaccucuucgcagcagaaggcggacuggauuccccuagcucucacaauuaaggggcugaaccccacggccauauuucugaccacucucagccggaccuccaagaagcgcagcuggccgcucaacgaggcaaucauggcggucggcauggucuccauccuugccagcucucuucugaaaaacgacauccccaugacgggcccccuuguagccgggggccuccugaccgugugcuauguccuaaccgggcgguccgccgaucucgagcuugagaaggccgcggacgugcgcugggaggaccaggcugagaucagcggguccucccccauccuguccauaaucaucagcgaggacggguccaugucuaucaagaaugaggaggaggagcaaacccugacgauccuuaucaggaccggcuuacucgugauauccggccuguuccccgucaguauccccaucaccgcugccgccugguaccugugggaggugaagaagcaacgcgcgggggugcucugggacgucccgagcccgccccccguuggcaaggccgaguuagaggacggggccuaccggaucaaacagaagggcauccugggguacagccagaucggcgcuggcguguacaaggaggggaccuuccacaccauguggcacgucacgcgcggcgccguucucaugcacaaggggaagcggaucgaaccguccugggccgacgugaagaaagacuugaucucuuacggcgggggcuggaaacuggagggggaguggaaggagggugaggagguccaggugcucgcccuggagcccggcaagaacccccgcgccgugcagaccaaacccgggcuguucaagaccaacgccggcaccaucggggccgucucccucgacuuuagccccggcacgagcggcucucccaucaucgauaagaaggggaaggugguaggccuuuacgggaacggcguagugacucggaacgguuccuaugugucugcgauagcccagaccgaaaaguccaucgaggacaaccccgagaucgaggacgauaucuuccgcaagaagaggcugaccaucauggaccugcaccccggggccggcaagacgaagcgcuaucuccccgccaucguccgggaagcgaucaagcgggggcugaggacgcugauccucgccccgacccgggucguggccgccgagauggaggaggcccugaggggcuuacccauccgguaccagaccccugcgauccgcgccgaacacacagggagagagauugucgaccucaugugccacgccacuuucaccaugcgccugcugucccccauccgggugcccaacuacaaccuaaucaucauggacgaggcccacuucaccgaccccgccagcaucgcggcacgcggcuacaucucgacgcggguagagaugggcgaggccgcggggaucuucaugacagccacgccgccaggaagccgggacccguucccucaguccaacgcucccaucauggacgaggagcgggaaauccccgagcgcagcuggaacaguggucaugagugggucaccgauuucaagggcaagacggugugguucgugccguccaucaaggccgggaaugacaucgcugccugccuccggaagaacggcaagaaggucauccagcugagccguaagaccuucgacucagaguacgucaagacccguaccaacgacugggacuuuguagucacgaccgacauuuccgagaugggcgcaaacuucaaggccgaacgcgugaucgacccccggcgcuguaugaaacccgugauccucacagauggagaggagcgggucauccuggccggacccaugccgguuacacacagcuccgcagcccaacgcagggggcggaucggacgcaaccccaagaaugagaacgaccaguacauuuacaugggugagccgcuggaaaacgacgaggacugcgcgcacuggaaggaagccaagaugcuccuggacaacaucaacacgcccgagggcaucauuccgagcauguucgagcccgaacgggagaaggucgacgcuaucgacggcgaauaucgccugcguggggaggcccgcaagaccuuuguggaccucaugcggagaggcgaccugcccguguggcuggccuacaagguggcggccgaggggauaaacuacgccgauaggcgauggugcuuugacggcauccggaacaaccagauccucgaagagaacgucgaaguggagaucuggacgaaggagggcgagcgcaagaagcugaagccgcgcuggcuggacgcccgcaucuacuccgacccccucgcgcugaaggaguuuaaggaauuugcugccggucggaagucccugacccucaaccugauaacugagaugggccgcuuacccaccuucaugacccagaaggcccgggacgccuuggacaaccuggcggugcuccauaccgccgaagccgggggccgugccuacaaccacgcccucuccgagcugccagagacgcuggagaucagucuucuguuaacccuccuggcaaccgugaccgggggcaucuuucuguuccucauguccggccguggcaucggaaagaugacgcuagggauguguugcaucaucaccgccagcauccugcucugguacgcccagauccagccgcacuggaucgcagccagcauuauccuggaguucuuccugaucgugcuccugauccccgagcccgagaagcagcgcacaccccaggacaaucagcugaccuacguugugaucgcgauccucacuguggucgccgccacgauggccaacgagauggguuuccucgagaagaccaagaaggaccuggggcucggcuccauuaccacccagcagccugagagcaacauccuggacaucgacuuacggcccgccuccgcauggacgcucuacgcuguggccaccaccuucaucacccccaugcugcgccauagcaucgagaacuccagcgugaacguuagccugacggccaucgccaaccaagcgacgguuuuaaugggccuggggaagggauggccccugagcaagauggacaucggggugccgcuccuggccauaggcugcuacucccaggucaaccccaucacccugaccgccgcucugcugcugcugguggcccacuaugcuaucaucggcccaggucugcaggcuaaggccacgcgcgaagcacagaagcgggcugccgccggcaucaugaagaaccccaccguggaugggaucaccgucaucgaccuggaccccaucccuuacgaccccaaguucgaaaagcaacucggccaggucaugcuguuaguccuuugcgucacccaggugcugaugaugcgcacuaccugggcccugugcgaggcccucacccuggcgaccgggcccaucaguacgcuuugggagggcaacccggggcgguucuggaacaccaccaucgccguguccauggcuaauaucuuccgcggcagcuaccuggccggcgccgggcugcuguucaguaucaugaaaaacaccacaaacacuagacgcggcaccgggaacaucggcgaaaccuuaggcgagaaguggaagucgcggcugaacgcgcucgggaaguccgaguuccagaucuacaagaagucagggauccaggaaguagaccgcacgcucgccaaagagggaauuaaacggggcgagaccgaccaccaugcggugucccgcgguagcgccaagcugcggugguucguggaaaggaauaugaucacccccgagggcaaggucguggaccugggcugcgggcgcggugguugguccuacuacugcggcgggcucaagaacgugcgcgaaguuaagggccugaccaagggcggucccggccacgaggagcccauuccgaugagcacuuacggauggaaccuugugcggcuccaaagcggcguggacgucuucuuuacgccgcccgagaagugcgacacccugcugugcgacaucggggaguccagccccaauccaaccguggaggcgggccgcacgcuccgggugcugaacuuagucgagaacuggcucaauaacaacacucaguucuguauaaagguguugaacccauacaugcccuccgugaucgaaaaaauggaagcccugcagaggaaguacggcggggcguuaguccggaacccgcucucccgaaacuccacccacgagauguacugggugagcaacgccuccggcaacauagugagcagugugaacaugaucagccgcaugcugauuaaccgguucaccaugaagcacaagaaggcaaccuacgagcccgacguggaccugggcucgggcacgcgcaacauagggaucgagagcgaggugcccaaccucgacaucaucggcaagcguaucgagaagaucaagcaggagcacgagaccaguuggcacuacgaucaggaccacccguacaagaccugggcauaccacggcagcuacgagaccaagcagaccggguccgcuaguuccauggucaacggugugguucgccugcugacgaaacccugggauguuaucccaauggugacccaaauggcaaugacggacacuacgcccuucgggcagcaacggguguucaaagagaaggucgauacccgcacccaagagccgaaggagggcacgaagaagcucaugaagauaaccgccgaauggcuguggaaggagcuggggaagaagaagacaccacgcaugugcacccgugaagaguucacccggaaggugcgcagcaacgccgcgcucggggcaaucuucacugacgagaauaaguggaaguccgcccgggaagccguggaggauagucgauucugggagcuggucgacaaggaaaggaaccugcaccucgagggaaagugcgagaccugcguguacaacaugauggggaagagggagaagaagcugggcgaguucgguaaggccaaggggagccgugccaucugguacauguggcugggcgcccgcuuccuagaguucgaggcgcugggguuccugaacgaggaccacugguucucccgggagaacagccucuccggcgucgagggugaaggccugcacaaacugggguacauacuccgagaugugucuaagaaagagggcggagccauguacgcggacgacaccgccgggugggacacuaggaucacccuggaggaucugaagaacgaggagauggugaccaaccacauggagggcgagcacaagaagcucgccgaggccauauucaaguugacuuaccagaacaagguugugcgcgugcagcggcccacgccucgcgggaccgugauggacauaaucucccgccgggaccagcgcggcagcggccaagugggcaccuacggccugaauacuuuuacgaauauggaggcccaacucauacggcagauggagggggaagguguguucaaguccauccagcaccugaccgcgaccgaggagaucgccguccagaacuggcuggcccguguuggccgggagcggcuaaguagaauggccaucuccggcgacgacugcguggucaagccguuagacgaucgcuucgccagugcguugaccgcccucaacgacauggggaaggugcgcaaagacauccagcagugggagccguccaagggcuggaaugacuggacgcaggugccguucugcagccaccacuuccacgagcuaaucaugaaggacggccgcguccugguggugccuugccgcaaccaggacgagcucaucgggcgcgcccggaucucccagggcgccggguggagccugcgcgagacggccugcuugggcaaguccuaugcgcagauguggagccucauguacuuucaccgccgcgaucuucggcuagccgcuaacgccaucugcuccgccguccccagccacugggugccgaccagccgcacuacaugguccauccaugcaaaacaugaguggaugaccacugaagacaugcucaccguguggaaccgggucuggauccaggagaaucccuggauggaggacaagacacccguggagagcugggaggagauccccuaccugggcaagcgugaagaccaguggugugggucccugaucggacucacgagccgcgccacgugggccaagaacauccagacggcuaucaaucaggugcggucccugaucgggaacgaggaguacaccgacuacaugccaagcaugaagcgcuuccggcgcgaggaggaggaggcgggaguccugugguga

SEQ ID NO: 24823 - RNA, 9876 nt, Artificial Sequence
  derived and/or modified CDS sequence (opt11) from DENV-2__KF744404__SS-prME
accgccgggaugaucaucaugcugauccccacugugauggccuuccaccuaaccacccgcaauggggaaccccauaugaucguuagccggcaggagaaggggaagucacuguuguucaagaccgaggacggggucaacaugugcacccuuauggcuauggaccugggugagcugugcgaggacacaaucaccuacaagugcccccuccugcgccagaacgagccggaggacaucgauuguuggugcaacagcaccagcaccugggugaccuacgggaccuguacaaccacgggcgagcaccggagggagaagcgcagcgucgcgcuggugccccauguaggcaugggacucgaaaccagaaccgagaccuggauguccucggagggggccuggaagcacgcccagcggaucgagacguggauccugcgccaccccggauucacccucauggcugcgauccucgccuacaccaucggcaccacgaacuuccagcgggcccucaucuuuauccugcucaccgcagucgcgcccuccaugacaaugcgcugcauugggaucucaaaucgggacuucguggagggcguuuccggcgggagcugggucgacaucgugcuugaacacggcagcugcguaaccacgauggccaagaacaagcccacccuggacuucgaauugaucaaaaccgaggccaagcagcccgccacccugcgcaaguacuguaucgaggccaagcuaacgaacaccaccacugagagccggugcccgacgcagggggagccgucgcucaacgaggagcaggacaagcgcuucgucugcaaacacagcaugguggaccggggcuggggcaacgggugcggccuguucggcaagggcgggauaguaaccugcgcgauguucacgugcaagaagaacauggagggcaagaucguccagccggagaacuuggaauacaccaucgugaucacuccccauagcggcgaggagcacgccguggggaacgauaccgguaagcaugggaaggagaucaagauaaccccucagucaucgaucacugaggccgagcucaccggcuaugggaccgucaccauggagugcagcccccgcacaggccuggacuucaacgagauggugcugcuccagauggagaacaaggccuggcuagugcaucggcagugguuccuggaccucccccugcccuggcugcccggcgccgacacccagggguccaacuggauccagaaggagacgcucgucacuuucaagaacccccacgcuaagaagcaggacguggugguccugggaucacaggagggugccaugcacaccgcacugaccggcgccacugagauucagaugagcagcggcaaccugcuguuuaccgggcaccugaagugccgccuucggauggacaagcugcagcugaaggguaugagcuacucuaugugcaccgggaaguucaaggucgucaaggagaucgcugagacccagcacggcacgaucguagugcgcguccaguacgagggggauggcucacccugcaagauccccuucgagaucauggaucuugaaaaacggcacguguugggccggcucaucaccgugaacccgaucgucaccgagaaagacucgcccguuaacaucgaagcggagccgcccuucggagacagcuacgugaucaucggcgucgagccggggcagcucaagcugaacugguuuaagaaaggcuccagcaucgggcagauguuugagaccacgaugcgcggcgccaagcgaauggcaauccucggcgacacagccugggacuucgggucccucggcgggguguucaccagcaucggcaaggcccuacaccagguguucggggccaucuacggcgcugccuucuccggaguaagcuggaccaugaagauccuaauaggggugaucaucacguggaucggcaugaacucccgcagcacuucccugucugugagccuagucuugguggggguggucacccuguaccucggcguagugguccaggccgacagcgggugcgugguguccuggcggaacaaggagcugaagugcggcagcgguaucuucauuaccgacaacguccacacguggaccgagcaguacaaguuccaacccgagagccccuccaaacuugcgucagccauccagaaggcccaccaggaagggaucugcggcauccgcuccgugacccgguuggagaaccuaauguggaagcagaucaccccggagcuaaaccauauccucucggagaacgaggugaagcugacgaucaugaccggggacauaaagggcaucaugcacgcugggaagagaucccugcggccgcaacccaccgagcuccgcuacagcuggaagacguggggcaaggccaaaauccugaguacggagagccauaaccagaccuuccugauagacggccccgaaacugcggaguguccgaauaccaaucgggccuggaacucccucgaggucgaggacuacggguucggcgucuucacaacuaacauuuggcugcgccugcgggaaaagcaggacgccuucugcgacagcaagcugauguccgccgccauuaaggauaaccgcgcaguccacgccgauaugggguacuggauugagagcgcguuaaacgacaccuggaagauugagaaggcuuccuucaucgaggucaagagcugccacuggccaaagucccacacccucuggagcaacgguguguuggaaucagaaaugaucaucccuaagaauuucgccgggcccgugagccagcacaauuaccgaccgggguaccauacgcagacggcgggccccuggcaccuggggaagcuggagauggacuucgacuuuugcaaaggcaccacggucguggugaccgaggacugcgguaaccgcggcccuagcuugcggacgaccaccgccagcggcaagcuaaucaccgaauggugcugccgaagcugcacgcugccaccccuccgguaccgcggggaagacgggugcugguacggaauggagauacggccccucaaggagaaagaggaaaaccuggucuccagccucgugaccgccggccacgggcagaucgauaauuucucccugggcgugcuuggcauggcccucuuccuggaggagaugcugcgcacacgcgucgggacaaagcacgcgauccuccugguagccgugagcuucgucacgcugaucaccggcaacaugucuuuucgggaccucgggcgcgugauggugauggucggcgccacgaugaccgacgacaucggaaugggcgugacguaccuggccuugcucgccgcguuuaaagugcggcccaccuucgccgcuggccugcugcucagaaagcugaccucuaaggagcugaugaugaccaccauugguaucguccugcugucccaguccaccauccccgagaccauacuugagcuaaccgacgcccuggccuuaggcaugaugguguugaagaucgugcggaagauggagcgcuaccagcuggcggucacgaucauggccauucugugcgugccgaacgccgucauccuucagaacgcguggaagguguccugcacaauccuggccguggugagcgugucuccccugcuccugaccagcagucagcagaaagccgauuggauaccccuggcccucacuaucaagggccugaaccccacugccaucuuccugaccacccucagcaggaccagcaaaaagagaucuuggccgcugaacgaagcgaucauggcggugggcauggucuccauacuggccagcagccuccuaaagaacgauauccccaugacgggaccuuuaguggccgguggccuucuaaccgugugcuacguacugacugggcgguccgccgaccucgagcucgagaaggcagcggacgugcgcugggaggaccaggccgaaaucagcggguccagccccauccuuuccaucaucaucagcgaggaugguuccaugagcaucaagaaugaggaggaggagcagacccuuacgauucugauccgaaccggccugcucgugaucuccggccuguuccccguaagcauccccaucaccgcagccgcuugguacuuaugggaggugaagaagcagcgcgcgggggugcucugggauguccccagucccccgcccgugggcaaagccgagcucgaggacggggccuaccgaaucaagcagaagggaaucuuaggguacagccagaucggcgccggcguuuacaaggaggggacguuccacaccauguggcaugucacgcgcggcgccgugcucaugcacaaggggaagcggaucgagcccuccugggcggacgugaagaaggacuuaaucucauacggcgggggcuggaagcuggagggagaguggaaggagggggaggagguccagguacucgcccuggagcccggcaaaaaccccagagcagugcagaccaagcccggucuguucaagacgaaugccgggaccauuggcgccgucagucucgauuucagcccgggcacguccggcagccccaucaucgacaagaaagggaagguggugggccuguauggcaacggcgucguaacccggaacggcuccuacgugagugccaucgcucagaccgagaaguccaucgaggacaacccggagaucgaggaugacaucuucaggaagaaacgguuaaccauuauggaccuccaccccggggcaggcaagacgaagcgcuaccucccagccaucguucgggaggcgaucaagcgcggucugcgcacucugauucucgcuccgacccgggugguggccgcggagauggaagaggcccuccguggccugcccauccgguaccagacccccgcuauucgcgcggagcacacggggcgggagaucguugaccucaugugucacgccaccuucaccaugcgcuuacugucccccauacgggugccgaacuacaaccuuaucaucauggacgaggcccacuucaccgacccagcguccaucgcggcccgcggcuacaucuccacgcggguggagaugggggaggcagccgggauuuucaugaccgccacgccgcccggcagucgcgacccuuucccccaguccaacgcgcccauuauggacgaggagcgggagauccccgagcgcagcuggaacuccgggcacgagugggucaccgacuucaagggcaagacgguuugguucgugccgagcaucaaggccggaaacgacaucgccgccugccuucggaagaacggcaagaaggucauccaauuaucccgcaaaacguucgacagcgaauacguaaagacccggaccaacgauugggacuucguggucacgacugacaucuccgagaugggggcgaacuucaaggccgagagagugauugacccccgucgcugcaugaagccggugauccuuaccgacggugaggagcgggucauacuggccggcccaaugccagugacccacuccuccgccgcccagcgccgcgggcggaucgggcgcaaccccaagaaugagaacgaccaguacaucuacaugggggagccacuggagaacgacgaggacugcgcgcacuggaaggaggcuaaaaugcuccuggacaacaucaacacgcccgagggaauaaucccgagcauguucgaacccgagagagagaagguggacgcgaucgacggcgaguaccgccugagaggggaggcccgcaagaccuucgucgaccuuaugcggcgcggcgaccuucccguauggcuggccuacaaaguagcugccgaggggaucaauuaugccgacaggcgcuggugcuucgacggcauccggaacaaccagauccucgaagagaacguagagguggagaucuggaccaaggagggggagcggaagaagcugaaaccgcgguggcuggacgcucgcaucuacuccgacccccuggcccugaaggaguucaaagaguucgcggccggacggaaaucucugacccucaaccugaucacggagaugggccgccuacccaccuucaugacccagaaggcccgggaugccuuagacaaucuggcgguacugcacaccgcggaagccgggggccgcgccuacaaccacgcccuguccgaacugcccgagacgcugcagaucagccuccugcuuaccuugcuugcgaccgugaccggcggcaucuuccuguuccucauguccggucgggggaucggcaagaugacccuggggauguguugcaucaucacggccagcauccugcugugguacgcccagauccagccacacuggauagccgccagcaucauccuggaguuuuuccugauugugcuccuuauccccgagcccgagaagcagaggacgccccaggacaaccagcucacuuaugucgugaucgcgauccucacggugguagccgcaacgauggccaacgaaaugggguuccuggaaaagacaaagaaggaccucggacuaggauccaucaccacacagcagccggagagcaauauccuugacaucgaccuacguccggcuuccgcguggacgcucuaugccguggccaccacguucaucacccccaugcugcgccacagcaucgagaacuccucugugaacguaucccugacggccaucgccaaccaggcgacaguacucaugggccuggggaaaggcuggccccugagcaagauggacaucggcgugccgcuccuggccauuggcugcuacucccaggucaaucccaucacccugaccgcggcacuccugcuacucguggcgcacuacgcuaucaucgggcccggcuuacaggccaaggcaacacgcgaggcccagaaaagagcggccgccggcaucaugaagaaccccaccguggacgggaucaccgucaucgauuuggacccgaucccuuacgaucccaaguuugaaaagcaguugggccaggugaugcugcugguguuaugcgucacccagguacuaaugaugcgcacgacaugggcccugugcgaggcccucacccuugccaccgggcccaucagcacguugugggagggcaacccggggcgguucuggaacacaacgauugccguguccauggccaauaucuuucgcgggagcuaccucgccggcgccgggcuguuauucucgaucaugaaaaacacgacgaacacccggcgcggaaccgggaacaucggcgagacccucggcgagaaguggaaaucccgacugaacgcguuggggaaguccgaguuccagaucuacaaaaaguccggcauucaggaggucgacaggacgcucgccaaggaggggaucaagcggggcgagaccgaccaccacgccguuucccgcgggagcgcuaagcugcgaugguucguggagcgcaauaugaucacccccgagggcaaggucguggaccugggcugcgggagaggagggugguccuacuacugcgggggccucaagaacgugcgcgagguaaagggccugacgaagggcgggccaggccacgaggagccuaucccaaugagcacguauggauggaaccuggugcguuugcagagcggcguugaugucuucuucacuccgcccgagaagugcgauaccuugcucugcgacaucggggaguccagccccaaccccacgguggaggcggguaggacgcuucgggugcugaaccugguggagaacuggcuaaauaauaacacacaguucugcaucaagguacuaaauccauacaugcccagcguaaucgaaaagauggaggcucugcagcggaaguacggcggggccuuaguccggaauccguuaagccgcaacuccacccacgagauguauuggguaagcaacgccuccggcaacaucgugagcucaguuaacaugauaagccguaugcugaucaaccgguucacuaugaagcacaagaaggccacauacgagcccgacgucgaccugggguccggaacgcguaacaucgggaucgaaucugaggugcccaaucuagacaucauaggcaaaagaauagagaagaucaagcaggaacaugagaccuccuggcacuaugaccaagaccaccccuacaagacuugggcauaucauggcuccuacgagaccaagcagacgggauccgcuagcuccauggucaacggagugguacgccuauugaccaagccuugggaugucauccccaugguaacccagauggccaugaccgacacgacccccuucgggcagcaacggguauuuaaggagaaggucgacacccgcacccaagagcccaaggagggcaccaagaaacucaugaaaauaaccgccgaguggcuguggaaggagcugggcaagaagaagaccccgcggaugugcacccgcgaggaguucacgcggaaggugcgcagcaacgccgcgcucggggccaucuucacagacgagaacaaguggaaguccgcccgggaggcuguggaggacagcagguuuugggaauuggucgacaaggagcggaaccuacaucucgagggaaagugugagacuuguguauacaacaugauggggaaacgagagaagaaacuuggugaguucgggaaggccaagggcagccgggcgaucugguacaugugguugggugcucgcuuccucgaguucgaagccuuaggguuccugaacgaggaccacugguucucccgggaaaauucauuguccggcguagagggggagggccuccacaagcuaggguacauccugcgcgaugugagcaagaaagagggcggcgccauguacgcagacgacaccgccgggugggacacgcggaucacccucgaggaccugaagaacgaggagauggugaccaaccacauggaaggggagcacaagaagcuggccgaagccaucuuuaagcugaccuaccagaacaaagucgugcgcgugcagcggcccacuccacgcgggaccguuauggacauaaucucccgccgggaccagaggggcagcggacaggugggcaccuacggucugaacaccuuuacaaacauggaggcgcagcucauccggcagauggaaggggagggcguguuuaagucgauccagcaccuuaccgcgaccgaagagaucgccguccagaacuggcuggcccgcguagggcgagagcgacucagccggauggcaaucuccggcgacgacugcguggucaaaccccuggacgaccguuucgccagcgcgcugacugcccucaacgacaugggcaaggugcggaaagacauccagcagugggagccguccaagggauggaacgacuggacccaggugccguucuguagccaccacuuccacgagcugaucaugaaagacgggcgcguccugguggugccaugccggaaccaggacgagcucaucgggcgagcccgcaucucccagggggccggguggagccuucgagaaacggccugccugggcaagagcuacgcacagauguggagucucauguacuuccaccggcgcgaccugagacuggccgccaacgccaucugcuccgccgucccuagccacugggugccgaccagccgcaccacguggaguauucacgcuaaacaugaguggaugaccaccgaggacaugcucaccguguggaaccggguauggauccaggagaaccccuggauggaggacaagacccccguggagagcugggaggagauuccauaccugggcaagcgcgaggaccaguggugcgggucccugauaggcuugacgagccgcgccaccugggccaagaacauccagaccgccauaaaccaggugcggucccugaucgggaaugaagaguacacggacuacaugccgagcaugaagcgcuuccggagagaggaggaggaagcugguguccugugguga

SEQ ID NO: 24824 - RNA, 9876 nt, Artificial Sequence
  derived and/or modified CDS sequence (opt11) from DENV-2__KF744407__SS-prME
accgcgggcaugaucaucaugcugauccccaccgugauggcauuccaccucaccacccggaauggggaaccccacaugauagucucccggcaggaaaaaggcaagagccugcuguucaaaaccgaagauggggugaacaugugcacccucauggcgauggaucugggcgagcugugcgaggacaccaucaccuacaaguguccccuucuacggcagaacgagcccgaggacaucgacugcuggugcaauagcaccuccaccugggugaccuacgggaccugcacgaccacgggcgagcacaggcgcgaaaagcggucggucgcccuggugccccaugugggcauggggcucgagaccagaaccgagacguggauguccagcgagggcgccuggaagcacgcccagcggaucgagacguggauucugcgccaccccgguuucacccugauggccgcaauccuggccuacacgaucggcaccacgaacuuccaacgggcccugaucuucauccuucucaccgccgucgcgccuuccaugaccaugcgauguaucgggaucucuaaccgggacuucguggagggcguguccggcgggagcugggucgacauagugcuggagcacggcuccugcgugaccacgauggccaagaacaagcccacucuggacuucgagcucaucaagacugaggccaaacacccugcgacccugcgcaaguacugcauugaagcuaagcugacgaacaccaccaccgcgagucggugccccacucaaggggagcccucccucaacgaggaacaagacaagcgcuuugucugcaagcauagcaugguggaccggggcuggggcaacgggugcggcuuguucgggaagggcgggauugugaccugcgccauguucacgugcaagaaaaacauggaaggcaaggucguucagcccgagaaucuagaguacaccaucgugaucacuccccauuccggggaggaacacgccguagggaaugacaccgguaagcaugggaaagagauaaagaucaccccgcaaagcuccaucaccgaggcugagcucaccggcuacggcacggugaccauggaaugcagcccccgcaccggccuugacuuuaacgagauggugcugcuccaaauggagaacaaggccuggcugguacacagacaaugguuccuggaccucccuuuacccuggcugccgggcgcggauacccagggguccaacuggauccagaaggagacgcucguaaccuucaaaaacccccacgccaagaagcaggauguggucgugcugggcagccaggagggggccaugcacaccgcccugaccggcgccaccgagauccagaugagcucagggaaccugcuauucacgggccaccuaaagugccggcucaggauggacaaacuucagcugaagggcaugagcuacuccauguguaccgguaaguucaaggucguaaaggagaucgcggagacccagcacgggacgaucgugguccgcgugcaguacgagggggacggaagccccugcaaaauccccuucgagaucauggaccucgagaagcgucacguacugggccgccugauuaccgucaacccgaucgucaccgagaaggacucucccgugaacauagaggccgagccucccuucggggacagcuacgucauaaucggcguggagccggggcagcucaaguuaaacugguucaagaaggggucuaguaucgggcaaauguuugagacaaccaugcgcggcgcgaagagaauggccaucuugggcgacacggccugggauuucgggagucugggcgggguuuuuaccagcaucgguaaggcguuacaucaagucuucggagccaucuacggcgccgccuucaguggcgugucauggaccaugaagauucucaucggaguaaucauuacguggaucgguaugaacucgcgcagcacauccuuaagcgucucccucgugcuuguuggggucgugacauuguaccuuggcgugaugguccaggcggauagcgggugcguggccuccuggaaaaacaaggagcugaagugcgguagcggaaucuucauaaccgacaacgugcauacauggaccgagcaguacaaguuccagcccgagucacccaguaaguuggccagcgccauacaaaaggcccaccaggaggggaucugcgguauucgcuccgugacccgccuggagaaccugauguggaagcagaucacccccgagcugaaccacauccucagcgagaacgaggugaagcugacgauaaugacaggggacauaaagggcauaaugcacgcggggaagcggucccuucgaccucaacccaccgagcuacgguacagcuggaagaccugggggaaggccaagauccuguccacggaaucccauaaccaaaccuuccugaucgacggcccugagaccgcggagugcccgaacaccaaccgcgccuggaacucccucgagguggaggacuacggguucgguguauucacuaccaacaucuggcugcggcugagagagaagcaagacgccuucugcgacagcaaacucauguccgcggccauuaaggacaaccgggccguccacgccgauauggguuacuggauugagagcgcguuaaacgacaccuggaagaucgagaaggcuuccuucaucgaggucaaaagcugccacuggcccaagucccauacccuguggagcaacggcgugcucgaguccgagaugauaauccccaagaacuucgcgggccccguuagccagcacaacuaucgcccgggguaccauacacagaccgccggucccuggcaccuggggaagcuggagauggacuucgacuucugcgagggcacgaccgugguugugaccgaagacugcgggaaccggggucccagccuccgcacgaccacagccuccggcaagcugaucacagaguggugcugccggucuugcacguugcccccgcuccgcuaccgcggggaggacggcugcugguacgggauggagauucgaccccugaaggagaaggaggagaaccuaguuuccagccucgucaccgcgggccacgggcagaucgacaacuucucccugggcgugcugggcauggcccucuuccuggaggagaugcugcggacccgcguggggaccaagcacgccaucuugcugguagccgugagcuucguaacgcuaauuaccggcaacauguccuuccgcgaccucgggcgggugauggugauggugggcgccacuaugaccgacgacaucgggaugggcgucacguaccuggcguuacucgccgccuucaaggugcggcccaccuucgccgcaggucuucugcuucggaagcugaccagcaaggagcugaugaugacaacuaucggcaucgugcuauugucacagagcaccauccccgaaaccauccuugagcucaccgacgcgcuggcccucggcaugaugguccucaagaucgugcgcaacauggagaaguaccaacuggccgugacgaucauggccaucuugugcgugccgaacgccgugauccuccagaacgcguggaaagucuccugcaccauccuagccguggugagcguuagcccccugcugcugaccagcucccagcagaaggccgacuggauuccccucgcgcucaccaucaaggggcuuaaccccacggcgaucuuccugaccacccugagccggaccagcaagaagcgcagcuggcccuuaaacgaggccaucauggccgucggcaugguaagcauccuggcaagcagccuccugaagaacgacauacccaugacgggaccacuggucgccggagggcuacugacgguuugcuacgugcugaccggacgguccgcggaccucgaauuggagaaggccgcagacgugcgcugggaagaacaggccgagaucagcggcuccagccccauccugucaauuaucaucagcgaggacgggucgaugagcaucaaaaacgaggaggaggagcaaaccuugacgauccugaucagaacaggccugcuugugaucaguggccuguucccggugagcauuccuaucaccgccgcggcaugguaccugugggaagucaagaagcagcgcgccggggugcucugggacgugcccagcccaccacccguuggcaaggcagagcuggaggacggggccuaccggaucaagcaaaaaggcauucugggguacagccagaucggcgcgggcguguacaaggaggggaccuuucacaccauguggcacgugacacgcggugcaguccucaugcacaaggggaagcggaucgagcccucgugggccgacgugaagaaggaccugaucagcuacggagggggcuggaagcuagaaggugaguggaaggagggggaggaagugcagguccucgcccucgaacccggcaagaacccccgcgcagugcagacuaagcccgggcuguucaagaccaacgcgggcaccaucggggccgugagccuugacuucagcccugggacguccgguagcccuaucaucgacaagaaggggaaggucguuggacuguacgggaacggcguggucacccggaacggcuccuacgugucugcuauugcccaaaccgagaaguccaucgaagacaaccccgagaucgaggacgacaucuuccggaagaagcggcuaaccaucauggacuuacaucccggggcagggaagacgaagcgcuaccuccccgccaucgugcgggaagcaaucaagagagggcugcggacacugauccucgcaccgacccgcgucguggccgcugagauggaggaggcacugcgcggccugccaaucagauaccagaccccagcaauucgugcagagcacacggggcgggagaucguagaccucaugugucacgccaccuucaccaugcggcuacugucccccauccgggucccgaacuacaaccucaucaucauggacgaagcgcacuucacggaccccgccagcaucgccgcccgcggcuacaucucaacucggguggaaaugggcgaggcggcggguaucuucaugaccgcaaccccucccggcagccgcgacccguucccgcaauccaacgcccccaucauggaugaggagcgggagauccccgagcgcuccuggaacuccgggcacgagugggugaccgacuuuaaggggaagacggucugguucgugccgucuauaaaggccgguaacgacaucgcugccugccugcguaagaacggcaagaagguuauccagcugucgcgcaaaaccuucgacagcgaguacgucaagacccggaccaaugauugggacuuugucguaacgacugacauauccgaaaugggugccaacuucaaggccgagagagucaucgauccccggcgcugcaugaagcccgugauccucaccgacggggaggagcggguuauccuagcaggccccaugccugucacccacucgucagccgcccagcgccgggggcgcaucggccgcaacccuaagaacgagaacgaucaguacaucuacaugggggaaccccuugagaaugacgaggacugcgcccacuggaaagaggccaagaugcuuuuagacaacaucaacacgcccgaaggcaucauaccgagcauguucgagcccgagcgggagaagguggacgccauugacggcgaguaccgccugcguggggaggcacgcaaaaccuucguggaccuuaugagaaggggcgaccugcccgucuggcuggccuacaagguggccgccgaggggauuaacuacgccgaucgccgcuggugcuuugacggcauccggaauaaccagauucuagaggagaacguggaggucgagauauggaccaaagagggggagcgcaagaaacugaaaccgcgauggcucgaugcgcggaucuacucagauccccucgcccucaaggaguucaaggaguucgccgccggccgaaagucgcugacccucaaccugauuacggagaugggcagacugcccaccuucaugacccagaaggcgcgcgacgcccucgacaaccuggccgugcugcauaccgcagaggccgggggucgcgcguauaaccacgcccucagugagcuccccgagacgcuggaaacgcuacugcugcucacccugcuggccacggucaccggcgggaucuuccucuuccugaugagcgggaaggguaucgguaaaaugacccugggcaugugcugcaucauaaccgcguccgugcuucuuugguacgcacagauccagccgcacuggaucgcggccuccauaauacuggaguucuuucucaucguucugcugauccccgagcccgagaagcagcggacaccccaggacaaucaacucacguacgucgugaucgccauccugacgguggucgcugccacgauggcgaacgagauggguuuccuggagaagaccaagaaggacuucgggcuuggcaguauagcuacccagcagccggagaguaacaucuuggacaucgaccuucgacccgccagcgccuggacguuauacgccguggcgaccacauucaucacccccaugcuccggcauuccaucgagaacagcuccguaaacguuucacugacggcaaucgcaaaccaggccaccguguugauggggcuggggaagggcuggccccuguccaagauggacauaggggugccgcucuuggcgaucggcugcuacagccaggucaaccccaucacccugaccgccgcgcuccuacuguugguggcccacuacgcgaucaucgggcccggccugcaggcgaaggccacccgugaggcacagaagcgggccgccgcgggcaucaugaagaacccuacuguggacgggaucaccgucaucgaccuggaccccaucccauacgaccccaaguucgagaagcagcucggacaggugauguuguuagugcucugcgucacccagguccugaugaugcgcacgacuugggcgcuuugcgaggcccucacccucgccaccggacccauauccacccugugggagggcaauccgggucgcuuuuggaacacgaccauagccgucagcauggcgaacauauuucggggcuccuaccucgcuggcgcgggguuacuguucagcauaaugaagaacaccacgaacacccgccggggcacaggcaacaucggcgagaccuugggcgagaaguggaaguccagacugaacgcccugggcaagagcgaguuccagaucuacaagaaaucggggauucaggagguagaccgcacacucgcgaaggaggggaucaagcgcggcgagaccgaccaccacgccgugagccggggguccgccaagcugcgcugguuuguggagcggaacaugaucacacccgagggcaaggucguugaucugggcugcggccgcggcggguggagcuacuauugcggcgggcucaagaaugugcgggagguuaagggccugacgaaggguggucccggccacgaggagcccaucccgauguccacguacggguggaaucuugugcgccuccagagcggcguugacgucuucuucacgccgcccgagaagugcgacacccugcuuugcgacauaggagagagcucccccaacccgaccguggaggccgggcguacguuacgcgugcucaaucugguagagaauuggcucaauaauaacacccaauucugcauaaagguacugaaccccuacaugcccagcgugaucgagaaaauggaagcccugcagcggaaguacggaggggcucuggugaggaacccgcuaucccggaacagcacccacgagauguauuggguguccaacgccagcggcaacaucgucuccagcgucaacaugaucucucgcaugcugaucaaccgguucaccaugaagcacaaaaaggcuaccuacgaacccgacguugaccuggggagcggcacgcgcaauauagggaucgaguccgaggucccuaacuuagacaucaucggcaagagaauugagaagaucaagcaagagcacgagaccagcuggcacuaugaccaggaccaucccuauaagaccugggccuaccacggcuccuacgagaccaagcagacggggagugcuuccagcauggucaacggcgugguucggcugcuuaccaagccgugggacgugaucccuauggugacccagauggcgaugaccgacacgaccccguucgggcagcagcgggucuucaaggagaaggucgacacccggacccaagagcccaaggaggguacgaaaaagcucaugaagauuaccgcugaguggcuguggaaggagcugggcaagaagaagacaccccgcaugugcacccgggaggaguucacgcgcaaggugcgguccaacgccgcccucggggccaucuucaccgacgagaacaaguggaaguccgcgcgcgaggccguggaagauagccgguucugggagcugguggacaaggagcgcaaccugcaucucgagggcaagugcgagaccugcguguacaacaugauggguaagcgggagaaaaagcugggcgaguucgggaaggccaagggcucucgugccaucugguauauguggcugggcgcccgguuucucgaguucgaggcccugggguuccugaacgaggaucauugguucagccgcgagaacucccucucaggcgucgagggggagggccugcacaagcugggguacauccuccgggauguguccaagaaagagggcggcgccauguacgccgaugacacagcaggcugggacacccgcauuacccuggaggaccugaagaacgaggagauggucacaaaccacauggagggcgagcauaagaagcuagcggaagcaaucuuuaaguugaccuaccagaauaagguagugcggguucagcgaccuacaccccgugggaccgucauggauauaaucagccgccgagaucaacgaggcuccggccagguggggacauacggccugaacaccuucacaaacauggaggcgcaacucauccgccagauggagggggagggcgucuucaagaguauccagcaccugaccgccaccgaggagaucgcuguacagaacuggcugacccggguggggcgggaacggcucucccggauggcgaucagcggcgacgauugcguggucaagccccuggacgauagauuugccucggcacugacggcccuuaacgacaugggcaaggugcgcaaggacauccagcagugggaaccgaguaagggguggaaugacuggacccaggugcccuucuguucccaucacuuucacgaguugaucaugaaggacggcaggguccugguugugccgugccgcaaccaggacgaacucaucggucgggcacgcaucucucagggcgcggguuggucccugcgggagaccgcgugccuggguaagucauacgcucaaauguggucccucauguauuuccaccgccgggaccugcgucuggcugcgaacgcuauauguagcgccguucccucccacugggugccgaccucacggacaaccuggaguauccaugccaagcaugaauggaugacaaccgaagacaugcucaccguuuggaaccgugucuggauccaagagaaccccuggauggaggacaagacgcccgucgaauccugggaggagaucccguaccugggcaagcgggaggaucaguggugcgguagccugauaggccucaccucccgcgccaccugggcgaagaacauccagaccgccaucaaccaagugcggagccugaucggaaacgaggaguacaccgacuauaugccguccaugaaacgcuuccgccgggaggaagaggaggcgggcguccugugguga

SEQ ID NO: 24825 - RNA, 9876 nt, Artificial Sequence
  derived and/or modified CDS sequence (opt11) from DENV-2__KF744399__SS-prME
acggcugguaugaucaucaugcucauccccaccgucauggccuuccacuuaaccacccgcaauggggaaccccacaugaucguaucacggcaggaaaaggguaagagcuuguuguuuaagacugaggacggugugaacauguguacccucauggcuauggaccugggcgaacugugcgaggacacuaucaccuacaaaugcccccuccugcggcaaaaugaaccggaggacaucgauugcugguguaacagcaccaguaccugggugacuuacgggaccugcacuaccacgggcgagcaccggcgcgaaaagcggagcgucgcucuagugccccacgucggcaugggucuggagaccaggaccgagaccuggaugagcuccgagggcgccuggaagcacgcccagcggaucgagacguggauucugcgccacccggguuucacccugauggccgcaauccuugcguacaccauuggcaccacgaacuuccagcgcgcccugaucuucauacuguugacggccguagcccccagcaugacgaugcgcugcauagggaucucgaaccgggacuucgucgagggcguguccggagggucuugggucgacaucguucucgagcacggcuccugugugacaacuauggccaagaacaagccuacguuagacuucgagcucaucaagaccgaggcgaagcaccccgccacccugcgcaaguauugcaucgaggccaagcugacuaacaccacgaccgagucucgauguccgacgcagggggaacccucacuuaacgaggagcaagacaagcgcuucguguguaagcacagcaugguagaccggggcuggggcaacgggugcggucuguucgggaaaggcgggaucgugacaugcgccauguucacgugcaagaaaaacauggaggggaagauaguccagcccgaaaaccuggaguauaccaucgugauaacgccccacuccggcgaggagaacgcagucggaaaugacaccggcaagcaugggaaggagauaaagguuacaccccagagcuccauaaccgaggcggagcuuaccggguacgggacggugacaauggagugcagcccccgcacagggcugggcuucaaugaaauggugcugcuccagauggagaacaaggccuggcuuguccaccggcagugguuucuugaucucccacugccguggcugccgggggccgacacccagggcuccaacuggauccagaaggagacgcucgucaccuucaagaacccgcacgcgaagaagcaggacguggucgugcuagggagccaggagggagcaaugcacacagcccugaccggggcaacggagauccaaaugagcuccggcaaccuucucuucaccggccaccugaagugcaggcuccggauggacaagcugcagcucaaggggaugagcuacuccaugugcacaggcaaguucaaggucgucaaagagaucgccgaaacccagcacgguacuaucgugguccgcguccaguacgagggcgacggcagcccaugcaaaauucccuucgagauaauggaucucgagaagcggcaugugcuggggcggcugaucaccgucaacccuaucguuaccgaaaaagacucgcccgucaacaucgaggcggagccacccuucggggacagcuacgucaucaucgggguugagcccggccagcucaaacuuuccugguucaagaagggaagcuccaucggccagauguucgagacaacuaugcguggcgccaagcgaauggccauccugggggacaccgccugggacuucgguagccucgggggcguguuuaccuccaucggaaaggccuugcaccaggucuuuggugcgaucuacggggcagccuuuagcgggguguccuggacuaugaagauauuaauaggcgugguuauaacguggaucgggaugaacucgcgcuccaccagccuguccguaagccucgugcuggucggcguggucacccuguaccucggggucauggugcaggccgacucuggcuguguugucagcuggaagaacaaggaguuaaaguguggcagcgggaucuucauaacggacaacgugcacacguggaccgaacaguacaaguuccagcccgagucccccuccaagcucgccagugccauccagaaagcgcaccaggaaggcaucugcgggauucgaagcguuacccgccucgagaaccugauguggaagcagaucacccccgaguugaaccacauccucucagagaacgaggucaagcugacgauuaugaccggcgacauaaaggggaucaugcacgccggcaagcggagccuccgcccgcagccaaccgaguuacgguacuccuggaaggccugggguaaggccaagauacugucuaccgagcugcauaaucaaacguuccucauagacgggcccgagaccgccgagugccccaacacuaaccgcgccuggaacagccuggagguugaagacuacggcuuugguguguucaccacgaacaucuggcugaaacucagggagaagcaggacgccuucugcgauaguaaacugaugagugccgcgaucaaggacaaccgcgccguccaugcagauaugggcuacuggaucgagagcgcccuaaaugauaccuggaagauagagaaggcguccuucauugaggugaaaucaugccacuggcccaagucucacacccuuuggagcaacgguguucuggagucagaaaugaucaucccaaagaacuuugcagggccaguaagccaacacaacuaucgaccugguuaccacacucagaccgccgggcccuggcacuuagggaagcucgagauggacuuugacuucugcaaagggaccaccgucguaguaacugaggacugcgggaaccgcggccccagccugcggaccacgaccgccuccgggaagcugaucaccgaauggugcugccgaucuugcacacucccgccccugcgguacagaggcgaagaugggugcugguauggcauggagauacggccacugaaggagaaggaggagaaccucgugaacucccuggugacagcggggcacgggcagaucgauaauuucagccugggaguguuagggauggcgcuguuccuggaagaaaugcuccgcacgcgggugggcacaaagcaugccauccugcuggucgccgucuccuuuguuacccucaucacgggcaacaugagcuucagggauuuaggccgcgugauggucauggugggggccaccaugaccgaugacaucggcaugggcgugaccuaccuggcccuacuggcggccuucaagguccggccuacuuucgcugccgggcugcuccugcggaaacuuacguccaaggagcucaugaugaccaccaucggcaucgugcuccuuucgcagucaacgauccccgagaccauccuggaacugaccgaugcccucgcgcuggggaugauggugcugaagaucguccggaaaauggagagguaccagcuggccgugacaauuauggcgauccucugcguccccaacgcaguaauccugcagaacgcauggaaggugagcuguacgauauuagcggucguguccgugucacccuuacugcugaccuccagccagcagaaagccgacuggauuccccuagcccucaccaucaagggccuuaauccgacugccaucuuucucacgacccugagucggaccagcaaaaagcgcaguuggccgcuuaacgaagcgaucauggccguggggauggugagcauuuuagcaucgagucugcugaagaacgacauucccaugaccgggccccuagucgccgggggccuacugacggucugcuacgugcuaacaggccggagcgccgaucuagaacuggagaaagcggccgacgugcgcugggaggagcaggccgagaucuccgggagcucccccauucucuccaucaucaucucugaggacggaagcaugagcaucaaaaacgaagaggaagaacagacccugaccauacucauccguaccgggcuccugguuaucucgggccuguucccggugucaauuccgaucaccgccgccgcaugguaccucugggaggugaagaagcagcgcgccggcgucuuaugggacguucccucgccgcccccaguggguaaggcugagcuggaagacggcgccuacagaaucaaacaaaaggguauccuuggguacucccagaucggcgcggggguauacaaggaaggcaccuuucauaccauguggcaugugacccgcggggcggugcuuaugcacaagggaaagcggcuggaacccagcugggcagacgucaagaaagaccucaucuccuacgggggcggcuggaagcuggagggugaguggaaggagggcgaggagguccagguguuggcccucgagccugggaagaauccccgcgccguccagacgaagcccggccuguucaaaacgaauaccgggaccaucggugccguguccuuggacuucuccccagguacgagcgggucacccaucaucgacaaaaagggcaaaguagucgggcuuuacggcaacggcgucgugacccggaacgggagcuacgucuccgcgaucgcccagaccgagaagaguaucgaagacaaccccgagaucgaagacgacaucuuucgcaagaagcgguugacaaucauggaucuccauccaggcgccggaaagacgaagcguuaucugcccgccaucguucgcgaggcgauuaaacgcggccuccggacccuaauccuagccccaacccgcgugguugccgcagaaauggaggaggcccucagaggacugccaauccgguaccagacccccgcgauccgcgccgagcacacgggccgugagauuguggaucugaugugccacgccaccuuuaccaugaggcuccugagccccauccgggugcccaauuauaauuuaaucauuauggacgaggcccacuucaccgaccccgccagcaucgcggcccgcggguacaucucgacgcgcgucgagaugggggaggcugcaggaauuuucaugaccgcaacgccgcccggaucccgcgacccguucccccagagcaacgcgcccaucauggacgaggagcgggaaauucccgaacggaguuggaacagcggucacgagugggugaccgacuucaaagggaaaacgguaugguucgucccaucgaucaaggccggcaaugauauagccgccugccuccggaagaaugggaaaaaggugauccagcuuagccgcaagaccuucgacuccgaguacgugaagacgcggacaaacgauugggauuucgucgugacgacagauaucagcgagaugggggcgaacuuuaaggcagagcgcgugaucgacccgcggaggugcaugaagcccgucauccugaccgacggcgaagagagaguuauccucgcagggccaaugccggugacccacuccuccgcugcccaacgccggggccgcaucgggcgaaauccgaaaaaugaaaacgaccaguacaucuacaugggcgagccccuggagaacgacgaggacugcgcgcacuggaaagaggccaagaugcuacucgacaacaucaacacgcccgagggcaucauaccguccauguucgaacccgagcgggagaagguugaugccauugauggggaauaccgccugcgaggcgaggcccgcaagaccuucguggaccucaugcggcgcggggaucuccccguguggcuggcauacaaagucgcugccgagggcauaaacuacgccgacagacgcuggugcuucgacgguauucggaacaaccagauccuugaggaaaacguggaggucgagaucuggaccaaggagggcgagcgcaagaagcucaaaccgcgguggcuagaugcucgcaucuacagcgacccccuggcccugaaggaguucaaggaguuugccgcaggcaggaagucccugacucugaaucucauaacggagauggggcgccugcccaccuucaugacccagaaggcccgggaugcccuggacaacuuggcggugcugcacaccgccgaggccggcgggcgcgccuacaaccacgcacugagcgagcuccccgagacgcuggagacacugcuccugcugacccuccuggcgaccgugacgggcgguauuuuccuguuccuaaugagugggaaggggaucgggaagaugaccuuggguaugugcugcaucaucaccgccagcguccugcucugguacgcucagauccagccgcacuggaucgccgccucaaucauccuggaguucuucuuaauagugcuccugauucccgagcccgagaagcagcggacaccccaggacaaccagcugaccuacgucgucaucgcgauccucacggugguggccgccaccauggccaacgagaugggguuucuggaaaagacgaaaaaggacuucggccugggcucgaucgccacucaacagccggagagcaacauccucgacaucgaucugcgccccgcguccgccuggacucuguacgccgucgccacuacuuucaucacccccaugcucagacacagcaucgaaaacuccagcgugaacgugucauugaccgccaucgcgaaccaagccaccguacugaugggucucgggaagggcuggccacugagcaagauggacaucggcgugccguuacucgccaucgguugcuacucccaagucaaccccauaacccugaccgcagcgcugcucuugcugguugcccacuaugccauuaucggccccggccuccaagcuaaggccacgcgcgaggcucagaagcgggccgcugcuggcaucaugaagaaccccaccguggacgguaucacgguuaucgaccuggacccgauccccuacgaccccaaguucgagaagcagcuggggcaagucaugcuccugguuuugugcgugacccaaguccucaugaugcgcaccaccugggcccugugcgaagcccugacccucgcaacaggccccauaagcacacuaugggaagggaacccuggacgcuuuuggaacaccaccaucgccguguccauggcgaacaucuuccgcggcagcuaccucgcuggggcgggccuccuguucuccaucaugaagaacaccacgaacacacgccgggggaccggcaacaucggcgaaacccugggggagaaauggaagagucgccuaaacgcucugggcaaguccgaguuccagaucuacaagaaaagcgggauucaggagguggaucggacacuggccaaggaaggcauaaaacgcggggagaccgaccaucacgccgucucccggggcagcgccaaacuccgcugguuuguggagaggaacauggugaccccugaaggcaaggucgucgaccugggaugcggccgugggggcugguccuacuacugcgggggccugaagaacguucgggaggucaagggccucaccaagggcgggccggggcacgaggagccaaucccaaugucuaccuacggguggaaccuggugcgucugcagucggguguggacgucuucuuuaccccgcccgagaaaugcgacacccuccuaugcgacaucggcgagaguagccccaauccgacagucgaggccggccggacgcugcgcguccucaaccugguggagaacuggcugaauaacaacacucaauucuguauuaagguucugaacccauacaugcccuccgucaucgagaagauggaagcccuccagaggaaguacggcggcgcccuggucagaaacccgcuaucgagaaauucaacccacgagauguacugggugagcaacgccuccgggaauaucgugucgagcgucaauaugauaagcagaaugcucaucaaccgguucacgaugaggcacaagaaggcgaccuacgagcccgacguggaccugggcuccgggacucgcaacaucgguauagagagcgagauuccgaaccuggacaucauaggcaagcgcaucgagaaaauaaagcaggaacacgagaccuccuggcacuacgaucaggaccaccccuacaagacuugggccuaccacggaagcuacgaaaccaagcaaacgggcuccgccagcuccauggugaauggugucgugcgacuccugaccaagccgugggauguuauccccaugguaacccagauggcaaugaccgacacaaccccauucgggcagcagcggguguucaaggaaaagguggauacccgcacccaggagcccaaggagggcacgaaaaagcugaugaagaucaccgccgaguggcucuggaaggagcuagguaagaagaagacaccccggaugugcacucgggaagaguucacgcggaaggucagaagcaacgcagcccugggcgccaucuuuaccgacgagaauaaguggaaguccgcccgagaggcuguggaggauucaagauucugggagcucgucgacaaggagcggaaccugcaccuggaggggaagugcgagacaugcgucuacaauaugaugggcaaaagggagaagaagcucggggaguucggcaaggcgaagggcucccgggcgauaugguacauguggcuuggagcccgcuuccuggaguucgaggcccucggcuuccugaacgaggaccauugguucucacgggagaacagcuuauccgggguggagggagaggggcuccacaaguuaggcuacaucuuacgggaggucagcaagaaagagggcggggcgauguacgccgacgacaccgccggcugggacacgcggaucacccucgaggaccucaagaacgaggagauggugaccaaccauauggagggagaacacaagaagcuggccgaggccaucuucaaguugacauaccaaaacaagguggugcgcguucagcgcccaacgccccgcgguacggugauggauaucaucucccggagggaccagagaggaucuggccaagugggcaccuacgggcugaacacauucacgaacauggaggcucagcugauccggcagauggagggcgaggggguguucaaguccauccaacaccugacggcaaccgaggagaacgccgugcagaacuggcuagcccgugucggccgggagagacuaagcagaauggccauauccggagaugauugcgucguuaaaccccucgacgaccgcuucgcgagcgcccugacggcccugaacgacauggggaagguacggaaggacauccagcagugggaacccucccgaggauggaaugacuggacucaagugccguucugcucccaccacuuucaugaguugauuaugaaggacgggcgggugcuaguagugcccugccgcaaccaggacgagcugauuggacgugcccgcaucucccagggggcggguuggagccucagagagaccgcuugcuuaggcaaguccuacgcucaaauguggagcuugauguacuuccauagacgggaccuccgccuggccgcgaacgccaucugcuccgcgguacccagccacugggucccgaccucccggaccacuuggagcauccacgcuaagaacgaauggaugacgaccgaagacaugcugacaguguggaaccgcguguggauccaggaaaaccccuggauggaggacaagaccccagucgagagcugggaggagauuccuuaccucggcaagcgcgaggaucaguggugcggcucccugaucgggcugacgucgagagccaccugggccaagaacauacagaccgcgauaaaccaaguacgcucccuaaucggaaacgaggaguacaccgacuacaugccgucuaugaaacgguucaggcgugaggaggaggaggcgggagugcugugguga

SEQ ID NO: 24826 - RNA, 9876 nt, Artificial Sequence
  derived and/or modified CDS sequence (opt11) from DENV-2__JX286516__SS-prME
accgccggcgugaucgucaugcugaucccgaccgccauggcguuccaccucaccacccgcaacggcgagccccauaugaucgugggccggcaggagaagggcaagucccuacuguucaagaccgaggacggcgugaacaugugcacccucauggccauagaccugggggagcuaugcgaagacaccaucaccuacaagugcccccuacugcgccaaaacgagcccgaggacaucgacugcugguguaauagcaccagcaccugggucaccuacggcaccugcaccaccacgggggagcaccggcgcgagaagcguuccguggccuuagugccccacguagggaugggccucgagacccgcacugaaaccuggaugagcuccgagggagccuggaagcacgugcagcggaucgaaacuuggauccugcgccacccgggcuucaccaucauggccgcgauacuggccuacaccauagggaccacgcacuuccagcgggcccucaucuucauccugcugacagccgucgcgcccagcaugaccaugcguugcaucggcaucuccaaccgggacuucgucgagggcgugucagggggcuccuggguggacaucguacucgagcacgggagcugcgugaccacgauggcaaagaacaagcccacccuggauuucgagcugaucaagaccgaggccaagcagcccgccacccuccgcaaguacugcaucgaggccaaguugacgaacacaaccaccgaaucccggugcccaacccagggcgagccuucgcugaacgaggaacaagacaaacgguucaucugcaaacacucuaugguugaccggggcuggggcaacggcugcgggcuguuuggcaagggaggcaucgugacgugcgcgauguucacgugcaagaagaacauggaggggaagaucgugcaacccgagaaucuggaguacaccaucgucaucacgccucacagcggggaggaacacgccgucggcaacgacaccgggaagcacggcaaggagaucaagauaaccccgcaaucgagcaccaccgaggccgaguuaacaggguacggcaucgugaccauggaguguagcccccguacuggccucgacuuuaacgagauggugcugcuacagauggaggauaaggccuggcucguccaccggcagugguuucuggaccugccccucccauggcugccgggggccgacacucagggcucgaacuggauccagaaggaaacgcuggugacuuucaagaauccccacgcgaagaagcaggacguggucgugcucgggucccaggagggcgccaugcacaccgcccugaccggggccacggagauccagaugagcagcggcaaccuccuguucaccggccaccugaagugccgccuacggauggacaagcuccaacugaaggggauguccuacucaaugugcacaggcaaguucaaaaucgucaaggagaucgcagaaacccagcacggcaccaucgugauccguguccaguaugagggcgacggaucccccugcaaaauccccuucgagaucacugaccuggagaagcggcacguuuuggggcgccugaucaccgugaauccgaucguuaccgagaaggacagccccgugaacaucgaggcggagccgcccuucggcgacucguacaucauagucgggguggagccgggccaacugaagcucaacugguucaagaagggcagcucuaucggccagauguuugagacgaccaugcgcggcgcuaagcggauggcaauacugggggacaccgccugggacuucggcagccucgggggcgucuucaccuccaucgggaaggcccuccaccaagucuucggagcgaucuacggcgccgccuucagcggaguguccuggacgaugaagauccugaucggcgucaucaucaccuggaucgggaugaacucacgcuccaccagccuguccgugagccuagugcucgucggcgucgugacccuguaucugggggccaugguccaggcggacuccggcugcaucgucaguuggaagaauaaggagcucaaaugcggcagugggauuuucaucacggacaacgugcacaccuggacugagcaguacaaguuucagcccgagucccccucuaagcuggccuccgccauccagaaggcccacgaggagggcaucugcgggauccggagcgucacccgccuggagaaccucauguggaagcagaucacgcccgagcuaaaccacauccuguccgagaacgaggugaagcucacaaucaugaccggcgauaucaaggguaucaugcaggcuggcaagcggagccugcgcccacaacccaccgagcugaaguacucuuggaagacguggggcaaggcgaagaugcucaguaccgagucccacaaccagaccuuccugaucgacgggccugaaaccgccgagugcccgaacacgaaccgggccuggaacagccuggaaguggaggacuacggcuucggggucuucaccaccaacaucuggcucaagcuacgcgagaagcaggacguauucugcgacuccaagcugaugucagccgccaucaaggacaaccgcgcggugcacgccgacaugggcuacuggaucgagagcgcacucaacgauaccuggaagauggaaaaggccagcuucaucgaggucaagucaugccacuggcccaagagccacacccugugguccaacggcguguuagagagcgagaugaucauccccaaaaacuucgccgggcccgugucccagcacaauuaccguccgggcuaccacacgcagaccgcggggcccuggcaccucgggaagcuggagauggacuucgacuucugcgaggggaccaccgucguggugacggaggacugcgggaaccggggacccagccugcgcaccaccacugccagcgggaagcucauaacggagugguguugccgguccugcacccuacccccgcugcgguaccggggggaggacggauguugguacggcauggagauccgcccccucaaagagaaggaggagaauuuagucaacucccuggugaccgccggacacggccaaaucgacaauuucucucucggcguguuagggauggcccuauuucucgaggagaugcugcggacuagagucgggacgaaacacgcgauccuccugguggcucugagcuucgugacccugauaaccgggaacauguccuuccgggaccucggccgcgucauggugauggugggggccaccaugacggaugacauuggcaugggcgucacuuaccuugcacugcucgccgcguucaaggugcgcccaacuuucgccgccgggcuguuguuacggaagcugaccagcaaagaacugaugauggccacuaucggcaucgccuugcucucccagucaaccuuacccgagacuauccucgagcugaccgacgcgcuggcccucgggaugauggcacugaagaucguccgcaacauggagaaguaccaacuggcggucacgaucauggccauuuccugcgucccgaaugcggugauccuccagaacgccuggaaggucucgugcaccauccuggcugccguguccgucagcccccugcuccugaccuccagccagcagaaggcugacuggaucccccuggcgcucacuaucaagggccugaaccccacggccaucuuccugacaacacucagccgaacuagcaagaagcgcuccuggccgcugaacgaggcgaucauggccguggggauggugagcauccuggcuuccagccuccugaagaacgacauccccaugacgggcccccugguagcgggcgggcuccugacugucuguuacgugcugaccggccggagcgccgaucuugaguuggagcgcgcagccgacgucaagugggaggaucaggcggagaucuccgggagcagucccaucuuaagcauaaccaucagugaggacggcucuauguccaucaagaacgaggaggaagagcaaacucucaccauccugauccggacuggccugcucgugauuagcggcguguuuccgguuucgauccccaucaccgcugccgccugguaccuaugggaagugaagaagcagcgggccggcguguugugggacguccccagcccgccgcccguggguaaggcggaacucgaggacggcgccuaccggaucaagcagcgcgguaucuugggcuacucccagaucggcgccgggguguacaaggagggcacuuuccacacgauguggcacgucacccgcggggcagugcugaugcaucgcggaaaacggaucgagcccagcugggccgacgugaagaaggaccucaucuccuacgggggcggcuggaaacuggagggggaauggaaggagggagaggaaguccagguacuggcacucgagcccggcaagaacccccgcgccguucagacaaaacccggcaucuucaagaccaacacggggaccaucggcgccgucucucuggacuucucccccggcaccagcgggucccccaucguggaccggaagggcaagguggucggguuguacggcaacggcguggucacccgcucuggggccuacgucuccgcgaucgcccagacggagaaaucgaucgaggacaaccccgagaucgaggacgacaucuuccggaagaagagacuuaccaucauggacuugcaccccggcgccgguaaaaccaagcgguacuuacccgcgaucgugcgcgaggccaucaagcggggccugcgcacccucauccuggcgccgacgcgcguggucgccgccgagauggaggaggcccugcggggacucccgauucgcuaccagaccccggcaauccgggcagagcacaccggccgcgagaucguagaccucaugugccacgcaaccuucacaaugcggcugcucagccccgugcgcguuccgaacuacaaccuuaucaucauggacgaggcgcauuucaccgaccccgccuccaucgccgcgcggggcuacaucagcacucgcguggagaugggggaggccgcuggcaucuucaugaccgcaacgccgcccggaucgcgcgauccuuuuccgcagagcaaugcgcccaucauggacgaggagcgcgagauccccgagcgguccuggaauucuggccacgagugggucaccgauuuuaaggggaagacggucugguucguuccguccaucaaggccggcaacgacaucgcagccugucugcgcaagaacggcaagaaagugauccagcucagccggaagacauucgacuccgaguacguuaagacgcgcgcuaacgacugggacuucguggugaccaccgauaucagcgagaugggagcgaacuucaaggcggagcgggucaucgacccucgccggugcaugaagcccgugauccugaccgacggugaggagcgcgucauacuggccggucccaugcccguaacgcacuccucugcugcccagcggcgcggccgcaucgggcggaauccaaagaacgagaacgaccaguauaucuacaugggcgagcccuuagagaacgacgaagacugugcgcacuggaaggaggcaaagaugcugcuggacaacaucaacacccccgagggcaucaucccguccauguucgagcccgagcgggagaagguggacgccaucgacggggaguaccgcuuacgcggcgaggcccggaaaaccuucguggaccugaugcgccgcggugaccugcccgucuggcucgccuacaagguggcggccgagggcaucaacuacgcagaccgcaaguggugcuucgacgggaucaagaacaaccagauccuggaggaaaacguggaggucgagaucuggacgaaggagggagagcggaagaagcuaaaaccgcgcuggcuagacgcucggaucuacagcgacccccuggcgcugaagggauucaaggaauucgccgccgggcgcaaaucccucacacugaaccugaucaccgagaugggccggcucccgaccuucaugacccagaaggcccguaacgcccuggauaaccuggccgugcuccacacggcagaaguagggggcaaggcauacacccacgcccugagugagcugcccgagacccucgagacccugcugcuccugacgcugcucgccgcggucaccggcggcaucuuccuguuccugauguccggcaaggggaucggcaagaugacucucgggaugugcugcaucauuaccgcaagcauccugcugugguacgcccaaauucaaccgcacuggaucgccgcauccaucauccucgaguuuuuccugaucguacuacucauuccggagcccgagaagcagcggacaccccaggacaaccagcuuacguacguugugaucgcgauccugaccguggucgccgcaaccauggcgaacgagaugggcuuccuggagaagaccaagaaggaccuaggcuucgggagcaucacgacccaggagagcgaauccaacauucuggacauagaccugcguccggccagugcguggacccuguacgcaguggccaccaccuucgugacgcccaugcuucggcacuccaucgaaaacagcuccgucaacgugagccucaccgccaucgcgaaccaggccaccgugcugaugggccuggggaaaggauggccccuuuccaagauggacaucggggucccccugcuugccaucggcugcuacagccaggugaacccgauuacgcuuaccgccgcgcugcugcuccugguggcgcacuacgcuaucaucggcccggggcugcaggccaaggccacgcgcgaggcccagaagcgggcggccgccggaauaaugaagaacccaaccgucgacgggaucacggugaucgaccucgagccgaucccguacgaccccaaguucgagaagcagcugggccaggugaugcuguugauccugugcgucacccaggugcugaugaugagaaccaccugggcccugugcgaggcccugacgcuggcgaccgggcccaucuccacccucugggagggcaaccccggccgguucuggaacacaacgaucgccgugagcauggccaacaucuuccgcgggucguaccuggccggcgccgggcuccuuuucucaaucaugaagaacaccaccaauacccgccgaggcacgggcaaugucggugagacccuaggcgaaaaguggaagucccgccugaacgcccucggcaagagcgaauuccagaucuacaagaaguccggcauccaggaaguagaccggaccuuggcaaaggaggggaucaagcgcggcgagaccgaccaccacgccgucagucggggcuccgccaagcugcgcugguucguugagcggaacauggugacaccggaagguaagguugucgaucucggcugcgggcgcggcggguggagcuacuacugcggaggccuaaagaaugugcgggagguaaaggggcuaaccaagggugggcccggccacgaggagcccaucccaauguccacuuauggguggaaucucguccgucugcagagcggcguggacgucuucuucacuccgcccgagaagugcgacacgcugcucugcgacaucggcgagagcucccccaaucccaccaucgaggcggggcggacgcugcgcguccugaaccucgucgagaacuggcugaacaacaacacccaguuuugcaucaagguucugaacccguacaugcccagcgugaucgagaagauggagaccuugcagcggaaguacggcggggcacugguucgcaacccccugucccgcaacagcacgcacgagauguacuggguuuccaacgcuaccggcaacaucgucagcucggugaacaugaucagccgcaugcugaucaaucgguucaccaugaagcacaagaaggccaccuacgagcccgacguugacuugggguccggcacgcgcaacaucggcauagagagcgagauccccaaccuggauaucaucgguaagcggaucgagaagauuaagcaggagcacgagaccuccuggcacuacgaccaggaccacccguacaagacuugggcuuaccacgguagcuacgagaccaagcagacgggguccgcgagcuccaugguuaacggcgugguuaggcugcugaccaagcccugggacgucgugccgauggugacgcagauggccaugaccgacacgacgcccuucggccagcaacgcgucuucaaggagaagguggauacccggacccaggaacccaaggaggggacgaagaagcuuaugaagaucaccgccgaauggcuguggaaggagcucggcaaggagaagacgccccggaugugcacccgggaggaguucacgcgcaagguccggucgaacgccgcccuaggggcgguauucaccgacgagaacaaguggaaguccgcccgcgaagccguggaggacggccgguuuugggagcugguggaccgcgagcggaaccuccaccuggaagggaagugcgagaccugcgucuacaacaugaugggcaagcgcgaaaagaaguugggcgaguucgggaaagccaagggcucucgggccauaugguacauguggcucggggccagguuccuggaguucgaagcccugggcuuccucaacgaggaccacugguucucccgggggaacagccugucuggcguggagggcgagggccugcaccgccucggcuacaucuuacgggaggucgggaagaaggagggcggggccauguacgccgacgacacggcgggcugggacacgcgcaucacccuggaggaucugaagaacgaggagauggugaccaaccacaugaagggcgaacacaagaagcucgccgaggcgaucuucaagcugaccuaccagaauaaagugguccgggugcagcgcccgacgccccgggggaccgugauggacaucaucucccgcaaggaucagcggggcuccggucaggucggaaccuauggccucaacaccuucacgaacauggaggcccaacugauccgccaaauggagggggagggcaucuucaaaucgauccagcaccugaccgccacagaagagaucgcggugcagaacuggcuagcccgcguggggcgggagcgccugagccggauggccauauccggcgacgacugcgucguaaagcccaucgacgaucguuucgccagcgcccugaccgcgcucaacgauauggggaaggugcggaaggacauccagcagugggaacccucucgcggcuggaaugacuggacgcaggucccguucugcagccaccacuuccacgagcuggugaugaaggacggccggguguuggucgugcccugccgcaaccaggacgagcucaucgggcgggccaggaucucccagggcgcagguuggagccugaaggaaaccgcgugccuggguaaguccuacgcccagauguggacccucauguauuuccaccgacgugaccugcgucuggcggccaacgccaucugcagcgccgugccaucccacuggguccccaccagccgcaccacguggucaauccacgcgaagcacgaguggaugacaaccgaggacauguuagccguguggaaccggguguggauccaggagaauccguggauggaggacaagacccccgucgagagcugggaggaggugcccuaccugggcaagcgcgaggaccaguggugcggcucccugaucggccucacaagccgggccaccugggccaagaacauccagaccgccaucaaccaggugcgcagccugaucgggaacgagggguacaccgacuacaugcccuccaugaagagguuccgccgcgaagaggaggaggcagggguccugugguaa

SEQ ID NO: 24827 - RNA, 9876 nt, Artificial Sequence
  derived and/or modified CDS sequence (opt11) from DENV-2__JX286518__SS-prME
accgccggcgugaucgucaugcugauccccacugccauggcuuuccaccucaccacccgcaacggugagccccauaugaucguuggccggcaggaaaaaggaaaaucucugcucuuuaagacugaggacggcguuaauaugugcacccugauggccauugaccucggugaguugugcgaggacaccaucacuuacaaguguccccuccugcgccaaaacgaaccagaggacaucgacugcuggugcaacagcaccucgaccuggguaaccuacggaaccuguaccaccacgggagagcacagacgcgagaaacgauccguggcccuggugccccaugucgggauggggcucgaaaccaggacggagaccuggaugaguuccgagggggccuggaagcaugugcagcggauugagaccuggauccugcgccacccaggcuucacaaucauggccgcgauccuggcauacaccauagggaccacgcacuuucagcgggcacucaucuuuauccugcugacugccguagcgcccuccaugaccaugcggugcaucggaaucucaaaucgcgacuuuguggagggcgugucugggggguccuggguggacaucgucuuagagcacggaucuugcgugacgacgauggcuaagaacaagccaacccuggacuucgagcugaucaagacugaggccaagcagccugccacccuucgaaaguacuguaucgaggccaaacugacgaacaccacuaccgagucccggugcccgacgcagggcgagcccagccugaacgaggagcaggacaagcgcuucaucugcaaacacagcaugguagaucggggaugggggaacggcugcggccuguuugggaagggggggauagugaccugcgcgauguucacaugcaagaagaacauggagggcaagaucgugcagcccgagaaucuggaauacaccaucgugaucacgccucacagcggggaggagcacgccgucggcaaugacaccggcaaacacggaaaggagaucaagauuaccccucaguccagcaccaccgaggcggagcugaccggguacggcaccguaaccauggagugcucucccagaaccggccucgacuucaacgagauggugcugcuucagauggaggacaaggcuuggcuuguccacagacagugguuccucgaccugccccuuccauggcugccgggcgcugacacacaaggcagcaacuggauucagaaagaaacccuggugacguucaaaaacccacacgcgaagaagcaggauguggucgugcuugggucccaggagggcgccaugcacacggccuuaacgggggcaacagagauccagaugaguucgggcaaccuccuguuuaccggucaccucaagugucgccugagaauggacaagcuccagcugaaggggauguccuacagcaugugcacaggcaaguucaagaucgugaaggaaaucgccgaaacgcagcauggcacgaucgugauacggguucaauacgagggcgacggcagucccuguaagauccccuucgaaaucaccgaccuggagaagcggcacgugcuggggcgcuugaucaccgugaacccgauagugacggagaaggacucgccaguaaacaucgaggcggagccgcccuucggcgacucguauauaauagugggagucgagccuggccaacuaaagcucaauugguucaaaaaagguagcuccaucggccagauguucgagaccacgaugaggggagcaaagcggauggccauccugggcgauaccgccugggacuucggaucucugggcggggucuucaccuccauugggaaggcccuccaucagguguuuggagcgaucuauggcgcagccuucagcggaguguccuggaccaugaagauccugaucggcguuaucaucaccuggaucgggaugaacucucgcuccaccagccugucggucagccuggugcucgucggcgucgugacgcuguaccucggggccaugguccaggcggauuccggaugcaucgugucauggaagaacaaggagcuaaaauguggauccgggauauuuaucacagacaacgugcacacuuggacugagcaauacaaguuccaacccgagagccccucaaagcuugcaucugccauacagaaggcucacgaggagggcauuugcgggauccguagcgugacgcgccuggagaaccucauguggaaacagaucaccccugaacugaaucauauccuguccgagaacgaggugaagcugaccaucaugaccggcgacauuaaggguaucaugcaggccggcaaacggagccugcgcccacagcccacggagcugaaauacucauggaagaccuggggcaaggcgaagaugcugucgacugagucccauaaccagaccuuucugaucgacggacccgaaacugccgaaugcccgaauaccaaccgagccuggaacucuuuggagguggaggauuacggauucggggucuucaccacuaauaucuggcucaaacugagagaaaagcaggauguguucugcgauagcaagcugaugucugccgccaucaaggacaacagagcgguucacgccgacaugggguacuggauagaaagcgcccucaacgacaccuggaagauggagaaggcuagcuucauugagguuaaauccugccacuggcccaagucccauacgcucugguccaacggcgugcuggagucugagaugaucauccccaagaacuuugccgggcccguuagucagcacaauuaucgaccgggcuaccacacccagacugcggggcccuggcaccucggaaagcuggagauggacuucgacuucugcgaggggacgacggucguggugacugaggacugcggaaacagaggccccagccugagaacgacaacggccagcggaaagcucaucaccgaguggugcugucgguccugcacccugccgccccuccgcuaccgcggcgaggacggcugcugguauggcauggaaauccgcccccucaaggagaaagaggaaaacuuggucaacagccuggugaccgcagggcacggccagaucgacaauuuuucccugggcguguuggggauggcuuuguuccuggaggagaugcugaggacuagagucggaacuaagcacgcgauacuucucguggcucuuucguucgugacccugauaaccgguaacaugucauuucgagaucugggccgcgucauggugaugguaggggcaacaaugaccgacgacauuggcaugggcgucaccuaccuggcucugcuggcggcguucaagguacgcccuaccuucgccgcuggauuacugcuccggaaacuaacaucgaaagagcugaugauggcuaccaucgggauagcccuccugucccagagcaccuuacccgaaaccauccucgagcuuacugacgcgcuugcccucgggaugauggcccugaagaucgugcgcaacauggagaaguaccagcuggcagugacgauaauggccauaaguuguguuccuaacgcaguaauccugcagaacgcauggaaggucagcugcacuauccuggccgccgugucaguuagcccccugcugcugacguccagccaacagaaagcugauuggaucccccuggcacucaccaucaaaggccugaaccccaccgccaucuuucucaccacccucucccggacuagcaagaagcguucauggccgcugaacgaagccauuauggccgucgggauggugagcauacuggcguccucguuauugaagaaugacauccccaugacaggcccacuugucgccggagggcugcugacuguuugcuacgugcugacgggccgguccgcagaccuugaguuagagcgagccgccgacgucaagugggaggaccaggcggagaucagcgggagcagccccauccugagcaucacuaucuccgaggacggcagcauguccaucaagaaugaggaggaagaacagacacucaccauucugauccggacgggccugcuugugaucagcggaguuuucccgguaucaauccccaucaccgccgccgcuugguaccugugggagguaaagaagcagcgcgcuggcgugcugugggacguccccagcccuccgccaguaggcaaggcagagcuagaggacggcgcguaccggauuaagcagcgcgggauccuggguuauucccagaucggcgccggcguguauaaggaggguacguuccauaccauguggcaugugacccgcggggccgugcucaugcaucgaggcaagcggauagagccguccugggccgacgugaagaaggacuuaaucuccuaugggggcgguuggaaacuggagggggaauggaaggagggcgaggagguccagguucuggcgcucgagcccggcaagaacccccgcgccgugcaaacaaagcccggcaucuuuaaaacuaacaccggaaccauaggugccguuagccuugacuucucccccggaaccuccgggucccccauuguggaucgcaagggcaaggugguuggucuguacgggaacggcgugguaacgcgcagcggcgcuuacgucuccgcgaucgcucaaacagagaaguccaucgaggauaacccugagaucgaggacgacaucuucagaaagaagcgcuuaaccauaauggaucugcacccgggugccgguaaaaccaagcgcuaccugcccgcuaucguucgcgaggccaucaagcgaggccugagaacgcugauauuagcuccgacccgcguggucgccgcugaaauggaggaggcauugagagggcuacccauccgauaccaaacccccgccauccgggcggagcacaccggcagggaaaucguggaccuuaugugccaugccacguucaccaugcggcuccucagccccguccgagucccgaacuacaaucugauaaucauggacgaagcgcacuuuacggacccggccucuaucgccgcgcguggcuacaucagcacaagaguggagaugggugaggccgccggcaucuucaugacagccacgccgccaggcucgcgggacccguuuccccaguccaacgcgccgaucauggacgaggagcgcgagauccccgagcggucuuggaauagcggccacgaguggguaacagauuuuaaggggaagaccgucugguucgugccgucgauaaaggccgggaacgacaucgcagccugccugagaaagaaugggaagaaggugauccaacucucccggaagacguucgacuccgaguacguuaagacccgggccaaugacugggacuucguuguaaccaccgacauaucagagaugggagcgaauuucaaggcggagcgggucauugauccccgccgcuguaugaaacccgugauccugacggacggcgaggagcggguuauccuggccgggcccaugccgguaacgcauuccagcgcggcacagcggcgcggacgcaucgggcgaaacccgaagaacgagaacgaccaguacaucuacaugggcgagccacuugaaaacgacgaggacugugcgcacuggaaggaagccaagaugcugcucgacaacaucaacaccccugaaggcaucaucccauccauguucgagccggagcgcgagaagguggaugccauagauggggaguaccgacuccgcggugaagcacggaagacuuucguggaccugaugcgccgcggcgaccugcccgucuggcucgcauaccgcguggcggccgaagggaucaacuacgccgaccggaaaugguguuucgaugggauuaagaacaaccagauucuggaagaaaacguggaagucgagauuuggacgaaggaaggcgagcgcaagaagcuuaaaccuagauggcucgacgcucgcaucuacagcgacccccuggcgcugaaggaguucaaggaauucgccgccggucggaagucccucacccugaaccuaauaaccgagauggggcgccuccccaccuucaugacgcagaaggcccggaacgcccuggacaaccuggcgguacuccacaccgccgaggugggggggaaggcauacacccaugcccugagcgagcuucccgaaacacucgagacacuguugcuccugacccugcuagccgcggugaccggcgguauuuuccuguuccugauguccgguaagggcaucgggaagaugacccucggcaugugcuguaucaucacugccucgaucuugcugugguacgcccaaauccagccgcacuggauugccgccucgaucauacucgaguuuuuccugaucgugcugcucauacccgagccagagaaacaacgcacaccccaggacaaccagcuuaccuacguagucauugcgauccugacggugguggccgcaacaauggccaaugagaugggguuccuugaaaagaccaagaaagaucugggauucggcucgauaaccacccaggagucagaguccaauauccuggacauagaccuccggccagcaucugcguggacccuguacgccguggcgacgaccuucgugaccccuaugcugcgccacucuaucgagaacuccuccgugaacgugagccucacggccauugcgaaccaagccacagugcugauggggcugggcaaaggguggccacuuagcaagauggauaucggcgucccccugcucgcuauugguugcuacucucagguaaacccgaucacccugacagcggcccugcugcuccugguggcacacuacgccauuaucggcccuggccugcaggccaaggccacccgugaggcccaaaaacgcgccgcggccgggaucaugaagaacccaacggucgacggcaucacgguaaucgaucucgaacccaucccguacgacccuaaguucgagaagcaacuagggcaggucaugcuccucauccugugcgucacgcagguguuaaugaugcggaccacaugggcccucugcgaggcccugacccuugccacaggccccauauccacccugugggaggggaaccccggucgcuucuggaacacgaccaucgccgucucaauggccaacaucuuccgcggcuccuaccuggccggggcgggccuccuguucagcaucaugaagaacacgaccaauacacggcgcgggacgggaaacguuggcgagacccugggcgagaaguggaagucgcgacugaaugcccucggcaagagcgaguuucagauuuacaaaaaguccggaauccaagaggucgaucggacgcuggccaaggagggcaucaagcgcggggaaacagaccaccaugccgucagccgcggcuccgccaagcugcgaugguucgucgagaggaacauggugaccccggagggcaaggugguugaccucgggugcggacgcgguggcugguccuauuacugcgggggcuuaaagaacguacgcgaggugaagggccugaccaagggcggcccaggucaugaggagccuauccccaugucgaccuacggcuggaaccucguacggcugcaaagcgggguggacguguucuucacgccgcccgaaaaaugugacacccuacucugcgacaucggcgagucauccccgaacccgaccauagaggcgggccggacccugcguguccugaaucucguggagaacuggcugaauaacaacacccaauuuugcaucaagguguugaacccauacaugccaagcgucauugagaaaauggagacgcuccagcgcaaguacggcggcgcccuggugcggaacccccugucgcguaacuccacacaugagauguacugggucuccaacgccaccgggaacaucguuagcuccgucaacaugauuagucguaugcuuauaaaccgcuucaccaugaagcauaagaaggccacguacgagccggacguggaccucgguagugguacaagaaacauuggcaucgaaucagagaucccuaaccuggacaucaucggcaagcgcauagagaagauaaagcaggaacacgaaacuuccuggcauuacgaccaagaccaccccuacaaaacaugggccuaccacgggagcuacgagacgaagcagaccggcuccgcgucguccauggucaacgggguggugcgcuugcucaccaagccgugggacgucgugccgauggugacccagauggccaugacggacaccacgcccuucggccagcagcggguguuuaaggagaaggucgacacucgcacgcaagagccgaaggagggcaccaagaagcugaugaagaucaccgcagaauggcuguggaaggaacuggguaaggagaaaacgccccggaugugcacccgcgaagaauucacgcggaagguaagaagcaaugcugcccugggcgcggucuucaccgaugagaacaaguggaaguccgcccgggaggccguagaggaugggcgguucugggagcucguugaucgcgagaggaacuugcaccuggagggcaagugcgagaccuguguguauaacaugauggguaagcgugagaagaagcugggcgaguucggcaaagccaaggggucacgcgcgaucugguacauguggcucggcgccagguuccuggaauucgaggcccugggguuccucaaugaggaccacugguucucccgcggcaacagccugaguggaguggagggcgagggccuacaccggcucggguacauccugcgugagguaggcaaaaaggagggcggugccauguacgccgaugacacggcggggugggacacccguauuacccuggaggaccucaagaacgaggagauggucaccaaccacaugaaaggcgagcacaagaagcuggccgaggccaucuucaagcuuacguaccagaacaagguggugcgcguacaacggccuacaccacggggcaccgugauggauaucaucucccgaaaagaccagcgcgggagcgggcagguggggacuuauggccucaacacguucaccaacauggaggcccaacugauccgccagauggaaggcgaggguauuuucaaauccauacaacaucugacagccaccgaagagaucgcugugcagaacuggcucgcccggguuggucgcgagagacuuagucgaauggccaucuccggggacgacugugucgucaagcccaucgacgaccgguucgcuagcgccuugacggcgcucaacgacauggguaaggugcgcaaagacauccaacaaugggagcccucccggggguggaacgacuggacccaggucccauucugcagucaccacuuucacgaacuggugaugaaggacggccgcguccuggucgugcccugccggaaccaggacgagcucaucgggcgagcccggauuucccagggggccggcuggucacugaaggagaccgccugccuggggaagagcuacgcccagauguggaccuugauguacuuccaccgccgggaccugcgccuagcggccaacgcuauuugcagcgccguucccucccacugggucccaaccagucggacgaccugguccauacacgcgaagcacgaguggaugaccacagaggacaugcucgccguguggaaccggguguggauacaggaaaacccguggauggaggauaagacgcccguagagucuugggaggaggugcccuaccugggcaagcgugaggaccaguggugcgggucucugauugggcuuacaagccgcgccaccugggccaagaauauccagaccgcuaucaaccaggugcggagccuuaucggcaacgagggguacaccgacuacaugccguccaugaagcgcuuccgccgggaggaggaggaggcggggguccugugguaa

SEQ ID NO: 24828 - RNA, 9876 nt, Artificial Sequence
  derived and/or modified CDS sequence (opt11) from DENV-2__JX286519__SS-prME
accgcaggcgucaucgucauguuaauccccacggccauggcauuccaccucacuacuaggaacggggaaccacauaugaucgucggccggcaggaaaaggggaagucccugcuguucaaaaccgaagacgggaucaauauguguacccuuauggccaucgaucuuggggagcuuugcgaggauacuauuacuuacaagugcccccucuugcgccagaacgagcccgaggacaucgauugcugguguaauagcacaagcaccugggugaccuauggaaccugcacuaccacgggggaacaccgacgcgagaaaagguccgucgcacuggugccccacguggggaugggucucgagacucgcaccgagaccuggaugucgagcgagggggccuggaagcacguacagcgcaucgagacuuggauacugaggcaccccggguucaccaucauggccgcgauccuggcguacaccauagggacgacgcauuuucaacgcgcccucaucuucauccugcugaccgccguggccccuagcaugacaaugcgcugcaucggcaucagcaaccgugacuucguggagggcgucagcgggggcucauggguggacaucgugcuggaacauggcagcugcguuacgacgauggccaagaacaagccuacccucgacuucgagcugaucaagaccgaggccaagcagcccgccaccuugcguaaauacugcauugaggccaagcugaccaauaccaccacagagucccggugcccuacacaaggcgaaccgagccugaacgaggagcaggacaagcgcuucauuugcaagcauuccaugguagaccggggcugggggaaugguuguggccucuuugguaagggcggcauagugacuugcgcgauguucacgugcaagaagaacauggagggcaagaucguccagcccgagaaucuggaguacaccauuguaauuacgccgcacagcggggaagaacacgcugugggcaacgacaccgggaagcauggcaaagagauaaaaaucaccccgcaauccucgacaaccgaggccgaacucacgggauacggcaccguaaccauggaaugcagcccccggaccggcuuggacuucaacgagauggugcuucugcaaauggaggacaaggccuggcuuguccaccggcagugguuucuggaccugccacucccguggcugccgggggcagacacgcaaggcagcaacuggauacagaaggagaccuuggucaccuuuaagaacccccacgcgaagaaacaggacguaguuguccucgggucgcaagaaggcgcaaugcacacggcacugacgggagccaccgagauucaaaugagcuccggcaaccuccuuuucacagggcaccugaagugucggcugcggauggacaaguuacagcugaagggaauguccuauucgauguguacgggcaaguuuaagaucguuaaggagaucgccgagacgcaacaugggacuaucgucaucaggguccaguacgagggcgacggaucacccugcaagaucccauucgagaucaccgaccuugagaaacggcacguguuggggcgccugaucacggucaacccgauuguuacggagaaggacagcccugucaacauagaggcagagccgcccuucggcgacuccuacaucaucguuggcguggagccgggucaacugaagcucaacugguucaagaaggggagcucgaucggucagauguuugagaccacaaugcgcggcgccaaacggauggccauacugggggauaccgcgugggacuucggcucccuaggcggcguuuucacguccaucgguaaggcuuugcaccaggucuucggagcgauuuacggcgccgcuuuuagcggggugaguuggacgaugaagauucugaucggcgugauuaucaccuggaucgguaugaacagccgaagcaccagccuguccgucagccuggugcucgugggcgucgugacacucuaucuaggagccauggugcaggcugacuccgguugcaucguauccuggaaaaacaaggagcucaaguguggcuccggaauauucaucaccgauaacgugcauaccuggaccgagcaguacaaauuccagccagaaagccccagcaaacuggcaagcgccauucagaaggcucaugaagaaggcaucuguggcauccggucagugacccgccuggagaaccucauguggaagcagaucacgcccgaacugaaucacauuuuguccgagaacgaggucaagcucaccauaaugaccggcgacauaaaaggcauuaugcaagccggcaaacggagccugcggccgcagccaacggaacugaaauauaguuggaagaccuggggaaaggcgaagaugcucagcaccgagucccacaaucagacauuccugaucgacgggccugagacugccgaaugcccaaacacuaaccgggccuggaacagccuggagguagaggacuacgguuuugggguguucacaaccaacaucuggcugaagcugcgagagaaacaggacgucuucugcgauucaaaacugaugucagcagccauaaaggauaaccgggccgugcacgccgauaugggcuacuggaucgagucagcacugaaugacaccuggaagauggagaaagccagcuuuaucgaggugaaguccugccacuggcccaagagccacacgcucuggucuaauggcguuuuagagucugagaugaucaucccgaagaauuuugcagggcccguuucccagcacaacuaucguccgggguaccacacccagaccgcuggucccuggcaccugggcaaacuugaaauggacuucgacuucugcgagggaacgacggucguugugaccgaggauuguggaaauagaggccccucucugcgcacaaccacagccagcgggaaacugaucaccgaguggugcugccggagcugcacccuucccccgcugagguaccggggcgaagacgggugcugguacgggauggaaauaagaccucucaaagagaaggaggagaaccuggugaauagccugguaacggcugggcacggucagaucgacaacuucucccucggcgugcugggcauggccuuguuccucgaagagaugcugcgcacacgcgugggcaccaagcacgcaauccugcuggucgcccugagcuucgugacccuaaucacugggaacauguccuuccgggaccucggccgcgugaugguaauggugggggccacgaugacugacgacaucggcaugggcgugaccuaccuggcacuguuagcugccuuuaagguccguccuaccuuugcugccgggcugcugcugcgaaagcugacaagcaaagagcugaugauggccaccaucggaaucgcgcucuugucccagagcacccugcccgagaccauccuggagcuaacggacgcgcuagcacucgggaugauggcccucaagaucgugcgcaacauggaaaaauaucagcuggccgucaccauuauggccaucucgugcgucccuaaugcugucauccuccaaaacgccuggaaggugucguguaccauccuggcggccgucuccgugagccccuugcuccugacuuccucccagcagaaggccgauuggaucccgcucgcccucacgaucaagggguuaaaccccacggccauuuuucugaccaccuugucccgcacuucuaagaaacgcuccuggccgcugaacgaggccaucauggccguggguauggucucgauccuggcguccucguugcuaaagaacgacaucccgaugaccgggccccugguagcaggcggauugcuuaccgucugcuacguguuaaccggcaggagcgccgaccucgagcucgaacgcgcggcugacguaaaaugggaggaccaggcugagaucuccggguccuccccaauccugucaaucacaaucuccgaagacggcagcaugagcaucaagaacgaggaagaggagcaaacacuaaccauacugauacggacuggccugcuugucaucucggggguguuuccagugucuauccccaucaccgccgcagccugguacuugugggaggucaagaagcagcgugccggcguccugugggacguucccagucccccaccagucgggaaggccgaacucgaggacggagccuaccggauaaagcagcgcgggauccuaggauacucccagaucggcgcaggggucuauaaagagggcaccuuucacaccauguggcauguaacccgcggagccguucugaugcaucgcggaaagcgaauagaaccuucaugggcagauguaaagaaggaccugaucucguaugggggcggauggaagcuggaaggggaguggaaggaaggcgaggaagugcagguccucgccuuggagcccgguaagaaucccagagcgguacagaccaagccgggcauuuuuaagacuaacacggggacgauaggcgccgugucgcuggauuucucccccggaaccucaggcucccccauugucgacaggaaggggaagguggucgggcuguacggcaauggcgucgucacucgcucuggugcauacgugagugcgaucgcccagaccgagaaaagcaucgaagauaaccccgagaucgaggacgacaucuucaggaaaaagcgccucacuaucauggaccugcaccccggcgccggaaaaaccaagagauaccuucccgccaucguccgggaggcgauuaaaaggggacugcguacacucaucuuagcgccaacccggguggucgccgccgaaauggaggaagcccugcggggucugccuauccgcuaccagaccccggcuauccgggcggagcacacaggccgcgagaucgucgaccugaugugccacgcgacauuuaccaugcggcuacucagcccggugcgagugccgaacuacaauuuaauuaucauggacgaggcccacuucaccgaucccgccucgaucgcggcccguggcuacaucuccacucgcgucgaaaugggagaggccgccggcaucuucaugacugccacgccgcccggcucucgggacccguucccccaaagcaacgcgccuaucauggacgaggagcgcgagauuccugagcgcuccuggaacucaggccacgagugggugacagacuucaagggcaagacugugugguucgucccguccaucaaagcaggcaacgacaucgcggcuugccugcgcaaaaauggcaagaaggugauccagcucagcagaaagacguucgacagugaguacgugaagacccgggccaacgacugggacuucgucgugaccaccgacaucucugagaugggggcgaacuucaaagcggagcgggugaucgacccccgccgcugcaugaagccgguuauccugacggacggagaggagcgugugauccucgcaggaccuaugccggugacucacuccagcgccgcucagcggcggggucgcaucggccggaaccccaagaaugaaaacgaccaauacaucuacaugggcgagcccuuagagaaugacgaggacugcgcgcacuggaaagaggccaaaaugcugcucgacaacauaaauacccccgagggcaucgucccauccauguucgagcccgagcgcgagaagguugaugcaaucgacggugaguauagguuaagaggggaagcccgaaagaccuucguggaucugaugcgccgcggagacuuaccgguguggcuggcguacaaaguggcggcagaggguaucaacuacgccgauagaaaauggugcuucgacgggauaaagaacaaccaaauccucgaggagaacguagaaguggagauauggacuaaagagggcgaacggaaaaagcugaagccacgauggcucgacgcgagaaucuacuccgauccccuggcgcugaaggaauuuaaggaguuugccgcgggcaggaaaucccucacccuuaaccugauuacagagauggggcggcuccccaccuucaugacucaaaaggcccgcucugcucuggacaaccuggccguauuacacaccgcugagguuggcggcaaggcguacacacaugcuuuauccgaguuacccgagacucucgaaacgcugcuacuccugacacuucucgccgcgguaaccggcggcauauuccuguuccugaugucagggaaaggcaucgggaagaugacgcugggcauguguugcauaaucaccgccuccauacugcugugguaugcccagauacaaccgcauuggaucgccgcgagcaucauccuggaguucuuccugauuguauugcucauccccgaaccggagaagcaacggacgccccaggacaaucagcugaccuacguugugauagcgauccugaccguggucgccgccacgauggcaaacgagaugggguuccuugagaagacgaaaaaggaucugggcuuuggaagcaucaccacccaggaguccgagagcaacauucuggacaucgaccucaggccggcguccgcguggacccuauaugccgucgccacgaccuuugugaccccaaugcuucgacacagcaucgaaaauagcagcgucaacgugagccucacugcgaucgccaaccaggccacgguucucaugggguugggcaaaggguggccccuaagcaaaauggacaucggcgucccucugcuggccauagggugcuacucccaggugaacccgaucacccugaccgcggcgcugcuacucuugguggcacauuaugccaucauaggccccggccugcaggccaaggcaacccgugaggcacaaaaacgggcggccgccgggaucaugaagaaccccaccgucgauggcaucaccgugaucgaccucgagcccauucccuacgauccgaaauucgaaaaacaguugggacaggugaugcugcucauucuuugugucacccagguguugaugaugcgcaccacgugggcccugugcgaggcccugacucuagcgaccggcccuaucagcacucucugggaagggaaccccggccgcuuuuggaacacgaccauagccguguccauggccaauaucuuccgcggaucguacuuggccggcgcgggccuccuguucucuaucaugaagaacacgaccaacacgcgccggggcaccggcaaugucggggagacauuaggggagaaguggaaguccaggcugaaugcccucggaaaaucagaguuccagauauacaagaagagugggauccaggagguugaccggacucuugcgaaggaggggaucaaacgcggggagacagaccaccacgccguaucucggggcucggcgaagcugcgcugguucgucgagcgcaacauggugaccccggagggcaagguagucgacuuagggugcggccgcgguggcugguccuacuauuguggcggcuugaagaacgugcgggaggugaaaggcuugaccaagggaggccccggucacgaggaacccaucccaaugaguaccuacggcuggaaccucguucgccugcagucugggguggacguauucuucacaccucccgagaaaugugacacccugcugugcgacaucggcgaauccagucccaacccgaccaucgaggcgggucggacccugagggucuuaaaccucguugagaauuggcugaacaacaacacgcaguucugcaucaaggugcugaacccguacaugccuuccguuauagagaaaauggaaacacuccagcggaaauacgguggggcccuggugcgcaacccgcugagccggaacucaacccacgagauguacugggugagcaaugccaccggcaauaucgucucuagcguaaauaugaucucaagaaugcuaaucaaccgguucacuaugaaacacaagaaagcgacguacgaaccugacguggaccucgggagcgguacgcgcaacauugguauagagagugagaucccgaaccuggacaucaucgggaagcggauugagaagaucaagcaggagcaugagacuagcuggcacuacgaccaggaucaccccuacaagacgugggccuaucacggaucauacgagacgaagcaaaccggcucggcguccagcauggucaacgggguggugcgccuguuaacgaagccuugggaugucgugcccauggucacgcagauggcgaugacggacaccaccccuuucggccaacagcgagucuuuaaggagaagguugacacccggacgcaggagcccaaagagggcacaaagaagcugaugaaaauaacugccgaguggcuguggaaggaacucggcaaggaaaagacgcccaggaugugcacgcgggaagaguucacacgcaaagugcggagcaacgccgcacugggugcgguguucaccgacgagaacaaguggaagucagcacgcgaggccguggaggacgggcgguucugggaacugguugaccgcgaacggaaccuccaccuggagggcaaaugcgaaaccugcgucuacaacaugauggggaaacgcgagaagaaacugggagaguucggcaaggccaaggggagccgggccauaugguacauguggcucggcgcccgcuuccuggaguucgaggccuuaggguuucucaaugaggaccauugguucagucgggguaacagccuguccggaguugagggcgagggcuugcaucgcuugggguacaucuuacgcgaggugggcaagaaggagggcggggccauguacgcggacgauacggcggggugggacacccgcaucacgcuggaagaccucaagaaugaggagaugguuaccaaccacaugaagggagagcacaagaagcuagccgaggccaucuucaagcucacguaccagaacaaggugguccguguccaacggccgacaccccguggcaccgugauggacaucauuagcagaaaagaccaacggggguccggccaggucgggacguacggacugaacacguucaccaacauggaggcccagcugaucagacagauggagggcgaggggaucuuuaagagcauucagcaucucacagccacggaggagaucgcgguacagaacuggcuagcacgcguggggcgggagagacucucccgcauggcgauuagcggggacgacugcguugucaagccuaucgacgaccgcuuugccucagcccugacggcuuuaaacgacaugggcaagguucggaaggacauccagcaaugggaaccaagccguggcuggaacgacuggacccaggugcccuucugcagccaccauuuucacgaacuugugaugaaggacggacggguauuggucgugcccugccgcaaccaggacgagcucaucggccgggcgcgcauaagccagggggccggcuggucacugaaagagaccgcuugcuugggcaaaucuuacgcccagauguggaccuugauguacuuccauagacgcgaccugagacuagcugcgaaugccaucugcuccgccguaccgucgcacuggguaccgaccucgcggacgaccuggucuauccacgccaagcaugaguggaugaccaccgaggacaugcuggcaguguggaaccgaguguggauccaagagaacccauggauggaggacaagacgccuguagagaguugggaggaaguaccguaccuaggcaaaagagaggaucaguggugcgggagccugauaggucucacgucacgggcgaccugggccaagaauauccaaacagcuauuaaccaggugagguccuugaucggcaacgagggauacacugacuauaugccaaguaugaagcgguuccgccgcgaggaggaggaggcgggcgucuuaugguag

SEQ ID NO: 24829 - RNA, 9876 nt, Artificial Sequence
  derived and/or modified CDS sequence (opt11) from DENV-2__KP188549__SS-prME
acugccggcgugaucgucaugcugauucccacagccauggcguuccacuugacgacccgcaacggggaaccccacaugaucguugggcggcaggagaaggggaagucccugcuguucaagaccgaggacggcguuaacauguguacgcucauggccaucgaccugggggagcugugcgaggacaccaucaccuacaagugcccccuccuacgacagaacgagcccgaagacaucgacugcuggugcaacucuacuagcacaugggucaccuacgggaccuguaccacaacuggcgagcaccggcgugagaagaggaguguggcucuggugccccacgucgggaugggccucgagacgaggaccgagaccuggaugagcuccgagggugcauggaagcacgugcagcggaucgagacguggauccugcgccacccgggcuuuaccaucauggcugcuauccuugccuacaccauugggacuacgcacuuucagcgggcacucauuuucauccugcugaccgcuguagcaccgagcaugaccaugcgcugcaucgguauaucgaaccgagacuuugucgaaggcgugagcgggggcuccuggguggacaucgucuuagagcaugguagcugugugaccacaauggccaagaacaagcccacgcuggacuucgagcugaucaagaccgaggcuaaacaacccgccacccuacgcaaguacugcaucgaggccaaacugacgaacacaaccaccgaaucccgaugcccgacgcagggcgagcccagccugaacgaggagcaggauaaacgcuucaucugcaagcacucgaugguggauagggggugggggaacggcugcggccucuucgggaaaggagggaucgugaccugcgcgauguucacgugcaagaagaacauggagggcaaaaucguucagcccgagaaucucgaguauaccaucguaaucacgccccacagcggggaggagcaugccgucggcaacgacacagggaaacacggcaaagagaucaagaucaccccgcagucuagcacaacagaagcagagcucacuggcuacgggacagugaccauggagugcagcccucggacgggccucgacuucaacgaaaugguucugcugcagauggaggauaaggccuggcucguccaccggcagugguuccuggaccugccgcuccccugguuaccgggcgccgacacgcagggcagcaauuggauacaaaaggagacgcuggugaccuucaagaacccccacgcgaagaagcaggacguggucgugcucgggucacaggagggggcaaugcacaccgcccugaccggggcgacugagauacagaugagcucgggaaaccuacucuucacgggccacuugaagugccgucugcggauggacaaacuucaacugaagggaaugaguuacagcaugugcaccgguaaauuuaaaaucgucaaggagaucgccgagacgcagcacgggaccaucgugauccgcguacaguaugagggagacggcucccccugcaaaauccccuucgagauaaccgaccuggaaaagagacaugugcugggucgguugaucaccgugaacccgauugugacggaaaaagacagccccguuaacaucgaggcggagccacccuucggcgacuccuacauuaucgugggcgucgagccggggcagcugaagcucaacugguucaagaaaggaaguuccaucggccagauguucgaaaccacaaugcgcggcgccaagcggauggccauucugggagacaccgccugggacuucggcucucucggggguguauucacgucuaucgggaaggcccuucaccaggucuucggagcgaucuacggcgccgccuucagcgggguauccuggacaaugaagauacugauaggcgucaucaucaccuggauugguaugaacagccgcuccaccagccuauccgugagccugguacucgugggagucgugacacuguaccugggagccaugguccaagcggacagcggcugcaucgugagcuggaagaacaaggagcucaagugcggcuccgggaucuucaucacggauaacgugcacaccuggaccgagcaguauaaguuccagcccgagagccccucaaagcuggccuccgccauacagaaggcgcacgaggagggcaucugugggauccguucagugacgcgccuggagaaccuaauguggaagcagaucacccccgaacugaaucacauccuguccgaaaaugaggugaagcucacaaucaugaccggagacauuaaggggauaaugcaggcgggaaagcggucucuucgcccgcaacccacggagcuuaaguacuccuggaagaccuggggcaaggcgaagaugcucagcaccgagucccacaaccaaaccuuccugauugacggccccgagaccgccgagugcccgaauaccaaccgggcuuggaauagcuuggagguggaggauuacggcuucgggguuuuuaccaccaauaucugguuaaagcugagagagaaacaggacguguucugcgauuccaagcugaugagcgcagccaucaaagauaaccgggcuguacacgcugacaugggcuacuggaucgaauccgcgcucaacgacacauggaagauggagaaagccucguucaucgagguaaagagcugccacuggccuaagucucacacgcugugguccaacggcgugcuggaaagcgagauggugauccccaagaauuucgccgggcccgucucucagcacaauuaucgcccgggcuaccacacccagaccgcagggcccuggcaucucggcaagcuagaaauggacuucgacuucugcgaggggaccacagugguggugaccgaggacugcgagaaacggggccccagcuugcgcacgacuacggccagcggcaagcucaucacugaguggugcugccgguccugcacccugcccccgcugcgguauagaggggaggacggcugcugguacgggauggagauccgcccgcugaaggagaaagaggagaacuuggugaacucccuggugaccgccggccacgggcagaucgacaacuucucccucggcguccuuggcauggcccuuuuccuagaggagaugcugcggacgcgcguggggaccaagcacgcgauacugcucgucgcacugagcuucgucacccucaucaccggcaacaugaguuuccgggacuuagggcgcgugauggugaugguuggcgccacgaugaccgacgauauuggcaugggggugaccuacuuggccuugcucgccgcguucaaggugagaccgaccuucgccgccgggcugcugcuccggaagcugacgagcaaggaacugaugauggcaaccaucgggaucgcucugcugucccagagcaccuuacccgagaccauccuagaacuuacggacgcccuggcccucggcaugauggcucugaagaucguccgcaacauggagaaguaccagcuugccgugaccaucauggccaucuccugugugcccaacgcgguuauccuccagaacgccuggaaagugagcugcaccauccuggccgccgugagugucagcccccugcuccugaccuccagccagcagaaggcggauuggaucccccuggcgcucacgaucaaggggcugaacccuaccgccaucuuccugaccacccucucccgcacaagcaagaagcgcuccuggccccugaacgaggccaucauggccgugggcauggucagcaucuuagcauccagccuccugaaaaaugacauccccaugaccggcccccugguggccgggggccuccugaccgugugcuauguccugaccgggcggucggccgaccuggagcuggagcgcgccgccgacgugaagugggaggaccaggcggagaucuccggcagcuccccaauccuguccaucacaaucuccgaggacgggagcaugagcaucaagaacgaggaggaggaacagaccuuaaccauucugauccggacaggccugcucgugaucagcggcgucuucccgguguccauccccaucaccgcggccgccugguacuugugggaggugaaaaagcaacgcgccgggguccugugggaugugcccagcccgccgcccguggggaaggcggagcucgaggacggugccuaccggaucaaacagcgcgggauccugggauacucccagauuggcgcaggcguuuacaaagaggggacguuccacaccauguggcacgugacccgaggugccgugcugaugcaccgcgggaaacggaucgagcccagcugggccgacgucaagaaggaccucaucuccuacggcggaggcuggaagcuggagggcgaauggaaggagggggaggaaguccaggugcucgcgcucgagcccggcaagaacccucgcgccguucagaccaagcccgggauuuucaaaacgaacaccggcacgaucggggccgugagccuggacuucuccccgggaaccagcggaucccccaucguggaucgcaaggggaaggucgugggccuguacggaaacggugucgucacccguucaggcgccuacgucuccgcgauagcccagacggagaaguccaucgaggacaaccccgaaauugaggacgauaucuuuagaaagaagcgccuaaccauaauggaucugcacccaggggccggcaagaccaagcgguaccugcccgccaucgugcgcgaggccauuaagcggggguugcgcacgcucauccuggcgccgacucgcguagucgccgccgagauggaggaggcccuccggggccucccuauacgcuaccagacccccgccauccgggcggagcauaccgggcgugaaaucguggaccugaugugccacgccacguucaccaugcggcugcucucucccguccgcgugccgaacuacaaucugaucaucauggacgaggcucacuucaccgaccccgccuccaucgcugcgcggggcuauauaagcacccgcguggagaugggggaggccgccgggaucuucaugacggccacgccgccuggcagucgggauccguucccccagagcaacgcgccuauaauggaugaggaacgugaaaucccggaacggucauggaacuccgggcaugagugggucaccgacuucaaggggaaaaccgugugguucgugccguccaucaaggccgggaacgacaucgcugccugccugcgaaagaacggcaagaaggucauacagcucagucggaagacguucgacuccgaauacgucaagacccgcgccaacgacugggacuucguggugaccaccgacaucagcgagaugggagccaauuucaaagcagagcggguuaucgacccacgccggugcaugaagcccgugauacuuacagacggcgaagaacgcgucauacuggccggccccaugccagugacucacuccagcgccgcccagcggcgcgggcgcaucggccguaaucccaagaaugagaacgaccaguacaucuauaugggggaaccccucgagaacgacgaggacugugcgcacuggaaggaggccaagaugcuacuggauaacaucaacacccccgaaggcaucauuccgagcauguucgaacccgagcgcgaaaaaguggacgccaucgauggcgaauaccgguuacguggagaggcccggaaaaccuuugucgaccucaugcgcaggggcgaccuacccguauggcucgccuacaagguggccgcugagggaauaaacuacgccgaccgaaaguggugcuuugauggcaucaagaacaaccagauccuggaggagaacguggagguggaaaucuggacgaaggagggagagcggaagaaacugaagccgaggugguuagacgcccggauauacagcgacccccuggcgcugaaggaguucaaggaguucgcugccggccguaaguccuuaacacugaaccugaucaccgagaugggcagguugccuacuuucaugacgcagaaggcgcgcaacgcccuugacaaccuggcggugcuccacaccgcugagguugggggcaaggccuacacccacgcccugucugagcuacccgaaacucucgagacgcugcuguuauuaacucuguuggccgcggugaccggagggaucuuccuuuucuuaauguccggaaaggggaucggcaagaugacccuggggaugugcugcauaaucaccgccagcauccuccugugguacgcccagauacaaccgcacuggaucgccgcguccaucauccucgaguucuuucugaucguccugcuuauucccgagcccgagaagcaacggacgccccaggacaaccagcugacuuauguggugaucgcaauccugaccgucguggcugccacgauggccaacgagaugggcuuucuagagaaaacaaagaaggaccucggguucggcagcaucacuacccaggaaagcgaguccaacauccuugacaucgaccugcgcccggccucagcguggacgcuauacgccguggcaacuaccuucguuaccccuaugcugcggcauuccaucgagaacagcuccgugaacgugagccucacggccaucgccaaccaagccacgguacugaugggccuggggaaggguuggccgcucagcaagauggacauagggguaccgcugcuagccaucggcugcuauagccaggugaacccuaucacccucaccgcggcccugcuccuccugguugcucauuacgcaaucauaggaccgggccugcaagccaaggccacacgcgaggcccagaaacgggcagccgcuggcaucaugaagaaucccacgguggacgggaucaccgucaucgaccucgagccaaucccguacgacccuaaguucgagaagcagcugggccagguuaugcuguuaaucuuauguguuacccagguguugaugaugcgcaccacuugggcccuuugcgaggcccugacccuggcgaccggcccuauuuccacccucugggagggaaaccccgggcgguucuggaacacaacuaucgccgucagcauggccaauauuuuccguggcucguaccuggccggcgcugggcuccuguuuagcaucaugaagaacaccaccaacacucgccggggcacgggaaacgugggcgagacccugggcgagaaauggaagucccgucugaaugcccucggaaagagcgaguuccagaucuacaagaaguccggcauccaggagguugaccggacacuggcuaaggaggggaucaagcgcggggagacggaccaccacgccgucagccgggguuccgccaagcugcgcugguuuguggaaagaaacauggugacgccggaggggaaagucguggaccucgguugcgggagagguggaugguccuauuacugcggcgggcugaagaacgugagagaggucaagggccugacgaagggcggccccggucacgaggagcccauccccauguccaccuacggauggaaccucguucgucuucaguccgggguagacguguucuuuacgccgccggagaagugcgacacgcuccucugcgacauuggugagagcagccccaacccuaccaucgaggcgggccggacccuaagagugcugaacuuaguggagaacuggcugaacaacaacacccaguucuguaucaagguccucaacccguacaugcccagcgucaucgagaaaauggagaccuuacaacggaaguacggaggggcacuggugcgcaacccccugucccggaacagcacccaugagauguacugggucucgaacgccacgggcaacaucgucucgagcgugaacaugaucagccgcaugcugaucaaccgguucaccaugaagcacaagaaggcuacguacgagccugacguggaucucggaucaggcacccgcaacaucgggaucgagagcgaaacacccaaucuggacauuaucggcaagcggaucgagaagaucaagcaggaacacgagacaucuuggcacuacgaccaggaccaccccuauaagacgugggccuaccacggcucguacgaaacaaagcagaccggguccgcgagcuccauggucaacggcgugguccgucugcucaccaagcccugggacguggugccgauggucacgcagauggccaugaccgacaccacccccuucgggcaacagcgcguguuuaaggagaagguggauacgcggacccaagagccuaaggaagguaccaagaaguugaugaagaucaccgccgaguggcuauggaaggagcuaggcaaggagaagacuccuagaauguguacacgggaggaguucacacgcaaaguccggagcaacgccgcccugggggcgguauucacagaugagaacaaguggaaguccgcuagggaggcaguugaggacggccgguucugggagcucgucgaccgcgagcggaaccuccauuuagaggggaagugcgagacgugcguguacaacaugaugggcaaacgcgagaagaagcugggggaguucggcaaagccaagggcucucgugcgaucugguacauguggcucggggcccgcuucuuagaguuugaggcacugggcuuccuaaacgaggaucacugguucucccgcgggaacagccugucgggcgucgagggagagggucugcaccgccucggcuacauccugcgggagguggggaaaaaggaaggaggggccauguacgcugacgacacggcgggcugggacacccgcaucacccuggaggaccucaaaaacgaggagauggugacgaaccauaugaagggggagcacaagaaacuugcugaggcgaucuucaagcugaccuaccagaacaaggucgugcgggugcagcgcccgacgccucgggggaccguuauggacaucaucagucgcaaagaccagcggggcagcggccagguugggacguacgggcucaacacauucacuaacauggaggcccagcugauucggcaaauggagggcgagggcauauucaaguccauccagcaccugacugccacggaagagaccgcggugcagaacuggcucgcacgcguagggcgggagcgccugucccggauggcgaucagcggugacgauugcguuguaaagcccaucgacgaccguuucgcaagcgcccuuacagcccucaacgacauggggaagguccggaaggacauccagcaaugggagcccucgcgcggcuggaacgacuggacucaggugccguucugcagccaccauuuucacgaauuagugaugaaggacgggcgggugcugguggugcccugccggaaccaggacgagcucaucggccgggcacggauuucccagggcgcgggguggagccuuaaggaaaccgccugccugggcaaguccuacgcccagauguggacacucauguacuuccaccggcgcgaucuacggcuggcagccaacgccaucuguagcgccgucccuucccacuggguccccaccagccgcacgaccugguccauccacgcgaagcacgaguggaugacgacagaggacaugcucgccguguggaaccgcguauggauccaggagaacccguggauggaagauaagacccccguugagucaugggaggaggugcccuaccuggggaaacgcgaagaccaguggugcggcucacuuaucggccuuaccagucgggccacgugggccaaaaacauccagacugccaucaaucagguccgcagcuugaucgggaacgagggcuacaccgacuacaugccguccaugaaacgguuccgucgcgaagaggaggaggcgggcguucugugguga

SEQ ID NO: 24830 - RNA, 9876 nt, Artificial Sequence
  derived and/or modified CDS sequence (opt11) from DENV-2__KP188550__SS-prME
accgccggcguaaucgugaugcugauacccaccgugauggcauuucacuugaccacccggaacggggagccccacaugauugugggccggcaggaaaagggaaagucccuacuguucaagacagaggacggcguuaacaugugcacccucauggcgaucgaccugggcgagcugugcgaggacaccaucaccuauaaaugcccccuccugcgccagaacgagcccgaggacaucgauugcuggugcaacucgaccagcacguggguuaccuaugggaccugcaccaccacaggcgagcaucggcgcgagaaacggucaguggcccuagucccgcacgugggcaugggucuagagacccggacagagaccuggaugagcagcgagggggccuggaaacacgugcagcggaucgagacauggauccugcgccacccgggguucaccaucauggcagccauucuugcguauaccauugggaccacgcacuuccagcgggcucuuauauucauccugcuaacggccgucgcccccagcaugaccaugcgauguauuggcaucagcaaucgugacuuuguggagggcguaagcggaggcuccugggucgacauuguccuggagcacggcucuugcgugaccaccauggcgaaaaacaagcccacucuggacuuugagcugaucaagacugaggcuaagcaacccgccacucuccgcaaguauugcauagaggccaagcugacgaacaccaccaccgagucccggugcccgacgcagggugagcccagcuugaacgaggagcaagacaaacgcuucaucugcaaacacuccauggucgaccggggauggggaaacggcugcgggcuguuuggcaagggcgggaucgugacgugugccauguucacgugcaagaagaacauggagggcaagaucguacaacccgagaaccuggaguauaccauugucaucacgccccauagcggggaggagcaugcggugggaaacgacacaggaaagcacggcaaggaaauaaagaucaccccgcagagcagcacuaccgaggcagagcugacggguuacggcacggugaccauggaaugcucgcccaggaccggccuugacuucaacgagauggucuuacuacagauggaggacaaagccuggcuuguacaccggcagugguuccuggaccugccgcucccauggcugccuggggcagacacgcagggcagcaacuggauccagaaggagacccuagugaccuuuaagaacccccacgccaaaaagcaggacgucgucguguuggggucucaggagggcgcgaugcacacggcccuuacgggugccaccgagauccagaugucaagcggcaaccuccucuuuacgggccaccugaagugccgccugcgcauggacaaguuacagcuaaaagggaugucguacagcaugugcaccgggaaguucaaaaucgucaaggagaucgccgaaacgcagcacgggaccaucgugauccgcguccaguacgaaggagacggcucccccugcaagauccccuuugagaucaccgaccuggagaagcggcacguccuggggcgccugaucaccgugaacccgauugucacggagaaggacagcccaguuaacauagaggccgagccgcccuucggcgacuccuacaucaucguggggguugagccuggccaguuaaagcuuaacugguucaagaaggggagcucgaucggccagauguuugaaacaaccaugcggggcgcgaaacgaauggccauacugggggacaccgccugggacuucggcagccucggaggaguguucacgucuaucgggaaggccuugcaucagguguucggggccauuuacggggcggccuuuagcggagucuccuggaccaugaagauacugaucggggugauuaucaccuggauagguaugaacagccgguccaccagccugagcgugucguugguccucgugggcguagucacucuguaccugggggccauggugcaggccgacagcggcugcaucgugagcuggaaaaacaaagaguugaagugcggcuccggaauuuucaucaccgacaacguccacaccuggacugagcaguacaaguuccaaccggagagccccagcaagcuggcuuccgccauacagaaggcacacgaggagggcauaugcgggauucggagcguaacgagacuggagaacuugauguggaagcaaauaaccccugaacugaaccacauucuguccgagaacgaggugaagcugacgaucaugaccggcgacauaaaagggaucaugcaggcgggcaagaggagccugcgcccucaacccacggagcugaaguacagcuggaagaccuggggcaaggcaaagauguugucgacugaaucccacaaccagaccuuucucaucgacgguccagagacggcggagugccccaacaccaaccgggccuggaauagccucgagguggaggacuacggcuucggaguuuucacuaccaauaucuggcucaagcuacgcgagaaacaagacguauucugcgauuccaagcugaugagcgccgcaauaaaggacaaccgggcuguucacgcggacaugggguauuggaucgagagugcccuaaaugacaccuggaagauggagaaggccagcuucaucgaagugaaaaguugccacuggcccaagagccacacgcugugguccaauggcgugcuagagagcgaaaugaucauccccaagaacuucgccgggccgguuucacagcacaacuaucgcccgggcuaccauacccagacagccgggcccuggcaccuuggcaagcuggagauggacuucgacuucugugaggggaccacggugguugucaccgaggacuguggcaaccggggccccagccugcgcacgacaacggcgagcggaaagcucaucacggaguggugcugccggaguugcacccugccaccucuccgauaccggggcgaagacgggugcugguacggcauggagauccgaccgcucaaagagaaggaagaaaaccuggugaacucgcuagugacagcugggcauggccagauugacaacuucucccucgggguccucgggauggccuuguuccucgaggagaugcugaggacgagagugggcaccaagcacgccauacugcucguggcgcugagcuucgucacccucaucaccgggaauauguccuuccgggacuuaggccgcgugauggugauggucggagccacgaugacugacgauaucggcaugggcguaaccuaucuggcccuccucgccgcguucaaggugcgccccacuuucgcggccggguuacuucuccggaagcugacuagcaaagagcugaugauggccaccauuggcaucgcccugcugucccaaagcacguugcccgagaccauacucgagcugacagaugcccuggcgcuaggcaugauggcucugaagauuguccgcaacauggagaaguaccagcuggccgugaccauaauggcaaucagcugugugccgaacgccgucauacuccagaacgcuuggaaaguaucgugcaccauccuggccgccguguccguaagcccccugcuccugaccagcagccagcagaaggccgauuggauaccccucgcgcugacgauuaaaggccugaauccaacggcuauauucuugacgacccucucccggacaagcaagaagcgcucuuggccgcucaacgaggcgauuauggccgugggaauggucagcauccucgcuagcucuuuauuaaagaacgacauccccaugaccggcccacucguggcgggcgggcuccugaccgugugcuacgugcugaccgggcggagcgcagacuuagaacuggagcgggccgccgacgugaagugggaggaccaggccgagaucuccggaagcucccccauccugagcauaacgauauccgaggacggaagcauguccauuaaaaacgaggaggaggagcagacccucacaauccugauccggacaggccugcuggugaucucgggugucuucccgguguccauccccaucaccgcggccgcgugguacuuaugggaggugaagaagcagagggccggcguccugugggacgugcccagcccgccgccaguggggaaggccgaguuagaggauggugcguaccgaaucaagcagcgcggcauccuggguuacucccagaucggugccggggucuauaaggaggggacguuucacaccauguggcacgugacacgcggggcugugcugaugcaccgcggaaaacggaucgagcccucaugggccgacguuaaaaaggaccucauuagcuacggcggcggcuggaagcuggaaggggaguggaaggagggcgaggaggugcagguacuggcucuagagcccgggaagaacccgagagcgguccagaccaagcccggcauauucaagacaaauaccgggaccauuggcgccgugagcuuggacuucucccccggcacuagcggguccccgaucguugacagaaaaggcaagguuguggggcuguacggcaauggcguggucacgcgaagcggggccuacguguccgcuaucgcgcagaccgaaaaauccaucgaggauaaccccgaaaucgaggacgacaucuuccggaagaagcgccugaccaucauggaccugcaccccggggccggcaaaaccaagcgauaucugcccgccaucgugcgcgaggcgaucaagcguggccuccgcacgcucaucuuggccccgacuaggguaguggcggccgaaauggaagaggcacugcgggggcuccccauccgauaccagacuccggccauucgggcggagcacaccggccgggagauaguggaccugaugugccacgcgacguucaccaugcggcugcucagcccaguccgcguuccgaacuacaaucugaucauaauggacgaggcccacuuuacagaccccgccaguaucgccgcaaggggauacaucagcaccaggguggagaugggugaggcagccggaaucuucaugacggccacgccacccgggucccgggauccguucccucagagcaacgcccccaucauggacgaagagcgagagaucccugagcguuccuggaauagcgggcacgagugggugaccgauuucaaggggaagaccgugugguucgugccgaguaucaaggccggaaacgacaucgccgccugccugcgcaagaacgggaagaaaguaauccagcucagccggaagacguucgacuccgaguacgugaagacccgcgccaacgacugggacuucguggucacuaccgacauaucggagaugggggccaacuucaaggcggagcgagucaucgacccuaggcggugcaugaaacccguaauccucacggauggcgaggaaagggucauccuggcaggacccaugccggucacccacagcuccgccgcccagcggcgcggcaggaucgggcggaaccccaagaaugagaacgaccaguauauauacaugggcgagccccucgagaacgacgaggacugcgcucacuggaaggaggcgaagaugcugcuggacaacaucaacacccccgagggcauuaucccguccauguucgagccagagcgcgagaagguggacgccaucgacggggaguaccgguuacgaggcgaggcccggaagacuuucgucgaccuaaugagacgcggggaccugcccguguggcucgccuacaagguagccgcggaggguaucaacuacgccgacagaaaguggugcuuugacgggaucaagaacaaccagaucuuggaagagaacgucgagguggagaucuggacaaaggaaggcgagcggaagaagcugaagccgcgcuggcucgaugcccggaucuacucggacccgcuggcccugaaggaauucaaggaguucgcggccggccgcaagucacugacccugaaccugauaaccgaaauggggcgguuacccaccuucaugacacagaaagcccgcaacgcccucgauaaucuggcugugcuccacacugcagaggugggcggacgggcccacacccacgcccugucggagcugcccgagacccucgagacgcugcugcuguuaacccugcucgcuaccgugacuggcggcaucuuccuguuccugauguccgguaaaggcaucgggaagaugacccuuggcaugugcugcaucaucacggccagcauccugcugugguacgcgcagauccaaccgcacuggaucgcagcuuccaucauccucgaguucuuucugauagugcuguuaauccccgaacccgagaagcagcgcacgccccaagacaaccagcugaccuacgugguuaucgcaauccugaccguuguggccgcgacgauggcuaaugagaugggauuccucgagaagaccaagaaggaccuaggcuuuggcaccaucacaacccaggagagcgagagcaacauucuggacaucgaccuccgaccggcuuccgccuggaccuuauacgccguggcgaccaccuucgucacuccgaugcugcgccacagcaucgaaaacuccagcgugaacgugucccuaaccgccaucgccaaucaggcgaccguccugaugggacugggcaagggguggccccucagcaagauggacaucggcguccccuuacuggcgaucgggugcuacucccaggugaacccgauaacccucacggccgcccugcugcuccuagucgcgcacuacgccauaauuggccccggccugcaggcgaaggccacacgggaggcccagaagcgcgccgccgcggguaucaugaagaauccuacuguggacggcaucacagugaucgacuuggaacccaucccguacgacccaaaguucgagaagcagcugggccaggucaugcugcuaauccugugcgucacucaggugcucaugaugcggaccaccugggcauugugcgaggccuuaacccuugccacgggccccaucucaacccucugggaggguaaucccggccgauucuggaauaccaccaucgccgucaguauggcgaacaucuucaggggcagcuaccuagccggcgcuggccucuuguuuuccauuaugaagaacacgaccaacacccggcgcggcaccggcaacgugggcgaaacgcugggagagaaauggaagagccgguugaacgccuugggcaaaucggaguuccagaucuacaaaaagagugguauccaagagguggaccgcaccuuagcgaaggagggaaucaagcgcggugaaaccgaucaccacgccguaagucgcggcagcgccaaacugcgaugguuuguggagcgcaacaugguaacuccggagggcaaagucguggaucucgggugcggcagaggggguuggaguuacuacugugggggccugaagaauguccgcgaggucaagggacugacgaagggcggccccgggcaugaggagccgaucccgaugagcaccuacggcuggaaucucgugcggcugcaaucagguguggacgucuuuuucacuccacccgagaagugugauacccuucucugcgacaucggcgagagcucacccaacccaaccaucgaggccggcagaacgcugcgggugcucaaccucguggaaaacuggcugaauaacaacacccaguucuguaucaaaguccugaauccguacaugcccuccguaaucgagaagauggagacccuccagcguaaauacgggggcgcgcuggugcggaaucccuugagcagaaacuccacucacgagauguacuggguguccaacgcgacggggaacaucguguccagcgugaacaugaucucccggaugcugauuaaucgcuuuaccaugaagcacaagaaggcuaccuacgagccggacgucgaccucggcagcgggacccguaacauagggaucgagagcgaaauacccaauuuagacauaaucggcaagcgaaucgagaagauuaagcaggagcacgagacgucguggcacuacgaccaggaccacccguacaagacaugggccuaucaugguuccuacgaaacuaagcaaaccggcagcgccuccagcauggucaacgggguaguccgccugcucacgaagcccugggacguggugccgauggucacccaaauggccaugaccgacacuacgcccuucggccagcagcggguguucaaggagaagguggacacccggacccaagagccuaaggagggcacuaagaagcugaugaagaucaccgcaaaaugguuguggaaggagcucgggaaggagaagacgccuaggaugugcacacgggaggaguucacccggaagguccgauccaacgccgcccugggcgccauuuucacggaugagaacaaguggaaaucugcccgggaggcgguggaggacggucgguuuugggaguugguggaccgggagcgcaaccuccaccuggaggggaagugcgagacaugcgucuacaacaugauggggaagagagagaagaagcuuggcgaguucggcaaggcgaaggggucccgcgcaaucugguacaugugguugggcgcccgguuccuggaauucgaggcgcuggguuuccugaacgaggaccacugguuuagccgcggcaauucccugucagggguggagggcgagggccuacacaggcucggauauauccugcgcgaagucggaaagaaagaaggcggcgccauguacgccgacgacaccgccgggugggacacccggauaacgcuggaggaccucaaaaaugaggaaauggugaccaaccacaugaagggggagcacaagaagcucgccgaggcgaucuucaagcugaccuaccaaaacaagguugugcgcgugcagcggccgacgccacggggcacugugauggauaucaucucucggaaagaccagcgcggguccggccagguggggaccuacggacucaacaccuucaccaacauggaggcccagcugauucgccaaauggagggcgaggggauuuuuaagaacauccagcaccugacggccaccgaggagaucgccgugcaaaacuggcucgcacgggugggacgcgagcggcugucucggauggccaucucuggggacgacugcguggugaagcccaucgaugaccgguucgccuccgcccugaccgcccucaaugauauggguaaagugcgcaaggacauucagcagugggaacccuccagaggguggaacgacuggacccaggucccauucugcagccaccacuuccaugagcuggugaugaaggacgggagggugcugguuguccccugccggaaccaagacgagcucaucggcagggcccgaaucucacaaggggcgggcuggagcuuaaaagagacugccuguuuggggaaguccuacgcccaaauguggacgcucauguacuuccaccgccgggacuugagacuggccgccaacgcgauuugcagcgccgugccuucccauuggguaccgaccagccggaccacgugguccauccacgcaaaacacgaguggaugacgacugaagacaugcucgcuguguggaaucggguuuggauucaggagaauccguggauggaggacaagacccccguugagagcugggaggagguccccuaccugggcaagcgggaggaccaguggugugggucccugaucggcuuaaccagccgagcgacgugggccaagaacauccaaacagcgauaaaucaagugcggucccugauuggcaacgaaggguacaccgacuacaugccaagcaugaaacgcuuccgccgggaggaggaggaagccggcguacugugguag

SEQ ID NO: 24831 - RNA, 9876 nt, Artificial Sequence
  derived and/or modified CDS sequence (opt11) from DENV-2__KP188553__SS-prME
accgccggcgugaucgucauguugauccccacugccauggccuuccaccucacuacccgcaacggggagccgcacaugaucgugggccggcaggaaaaagggaagucccuguuauucaagaccgaggacggcgugaacaugugcacucucauggccaucgaccugggggaacuaugcgaggacaccaucaccuauaagugcccacugcugaggcagaacgagcccgaggacaucgacuguuggugcaacagcaccagcaccugggucaccuacgguaccugcacaacaacgggcgaacaccggagagaaaagagauccguggcccuggugccccacgucgggaugggccucgagacccgcaccgagaccuggaugagcuccgagggugccuggaagcacgugcaacggauugaaacguggauccugcgccaccccgguuucaccauaauggccgcgauccuggcguacaccaucgggaccacgcacuuucagcgagcccucaucuucauccugcugaccgcaguggcgcccagcaugaccaugcgcugcaucggcaucucuaaccgggacuuuguugaaggggucagcggggguuccuggguggauaucgugcuugaacacgggagcugcgucaccaccauggccaagaauaagcccacccuagacuucgagcugauaaagaccgaggcuaagcagcccgccacacucaggaaguacugcaucgaggccaaguuaacgaacaccaccacugaguccaggugccccacgcagggcgagcccucgcucaaugaggagcaggacaaacgcuucauuugcaagcacuccauggucgaccggggcugggggaauggcugcggucuguuuggcaagggggggauugugaccugcgcgauguucacaugcaaaaagaacauggaggguaaaaucguccagcccgagaaucuagaguacaccaucgugaucaccccgcacagcggggaggagcacgccgugggaaacgauacugggaaacacggcaaggagaucaagauaaccccgcaguccagcaccaccgaggccgagcugacgggguacgguacugugaccauggaguguagcccccguacaggacucgacuucaacgagaugguguuacuucagauggaggacaaggccuggcugguacauaggcagugguuccuggaccugccgcugcccuggcuaccgggugccgacacucagggcagcaacuggauccagaaagagacccuggugaccuucaagaacccccacgcaaagaagcaggaugugguagugcucgggucccaagagggugcgaugcacaccgcgcuaacgggggccaccgagauccagauguccagcggcaaucuccuguucaccggucaucugaagugucgucugcggauggacaagcuccaguuaaaggggaugucguauagcaugugcaccgggaaguucaagauagucaaggagauugccgaaacgcaacacgggacgaucgucauacgcguucaauacgagggcgacggcagccccugcaagauccccuuugagaucacggaccuggaaaaacggcacguccucgggaggcugauaacugugaauccgauagugacugagaaggacagccccgucaacauagaggcggagccgccauucggcgacaguuauaucaucguagggguugagccgggccaguugaagcucaacugguuuaagaagggaagcuccaucggccagauguucgagaccacgaugcgcggcgccaagagaauggccauucugggggacacggccugggacuucggcuccuugggcggcgucuucacguccaucggaaaggcccuccaucaaguuuucggggcgauauacggggccgcuuucagcgggguguccuggaccaugaagauccugauuggcgucaucaucaccuggaucgggaugaacagccgcuccaccucacucuccguuagccuagugcucguggguguugugacguuauacuuaggggccaugguucaggcggacucaggaugcaucgugagcuggaagaacaaggaauuaaagugcggcuccgguaucuuuaucacagacaacgugcacacuuggaccgagcaguauaaguuccagccagagucgcccagcaagcuggcgagcgccauccagaaggcccaugaagaaggcaucugugggauccgaagcguaacucgccuggagaaccucauguggaagcagaucacucccgagcugaaccacauccucuccgaaaacgagguuaaacucaccaucaugacaggugacaucaaagggauaaugcaagcgggcaagcguagccugcgcccucagccuacugagcugaaguacuccuggaaaaccuggggcaaggcgaaaaugcucagcaccgagucccacaaucagaccuuucugaucgacggaccugagacugccgagugcccgaacaccaaccgggccuggaacucacuggagguggaagacuacggcuucgggguauuuacaacuaauaucuggcucaagcugcgcgaaaagcaggacguguuuugugacuccaaguugaugagcgccgcuauuaaggacaaccgggcggugcacgcugacaugggcuacuggauagaauccgcgcucaacgacaccuggaagauggagaaagccagcuuuauagagguaaaguccugccacuggccuaagagucacacgcugugguccaauggcguucuggagagcgaaauggugauccccaaaaacuucgcggggcccgucucccaacacaacuaccguccgggcuaccacacccagaccgcaggacccuggcaccugggcaagcuggagauggacuucgacuuuugcgaggggaccacggugguggucaccgaggacugcgagaagcggggccccagcuuaagaaccacuacagccagcggcaagcucaucacugaauggugcuguagauccugcacccugccaccgcugcgcuaccgcggggaggacggcugcugguacgggauggagauccgcccccucaaggagaaggaggagaaucuagugaacagccuggugaccgccggccacgggcagaucgacaacuuuucccucggaguucugggcauggcccuuuuucucgaggagaugcuacggacgcgaguggggaccaagcacgcuauccuacucguggccuuauccuuugugacgcugaucaccgggaauauguccuuccgggaccucgggcgcguuauggugauggucggagccaccaugaccgacgacaucgggaugggcgugaccuaccuggccuuacucgccgcauucaaggugcgcccuaccuucgccgccggccuucuacucagaaagcugaccagcaaggagcugaugauggcuaccaucgggauagcccuccugucccagagcacauuacccgaaacuauccucgagcugacggacgcgcuggccuuagggaugauggcccugaagaucguccggaacauggagaaguaccagcuggccgugaccauuauggcgaucaguugcgugccgaacgccgugauucuccagaacgccuggaaggugagcugcaccauacucgccgccguguccgucagccccuuauugcugaccuccagccagcagaaagcggacuggauaccccuggcucucacgaucaaggggcugaaccccacugccauuuuccugaccacccuuucccggacgagcaagaaacgcuccuggccgcugaacgaggccauaauggcggugggaauggugagcaucuuggccuccucucugcugaagaacgacauucccaugaccggaccccugguggccggaggccugcugacggugugcuacguccugaccgggcgcagcgccgaucucgagcuggagcgcgcagccgacgugaagugggaggaccaagcggagaucuccggcuccuccccuauucuaagcauuacaaucuccgaggacgggaguaugucaaucaagaacgaggaggaggagcagacccucaccauccugauccggaccggauuacucgugaucagcggaguguucccaguuuccauccccauuacagccgccgccugguaccugugggaggugaagaagcagcgcgccggcguccugugggaugugcccagcccgccgccggugggcaaggccgagcucgaggacggggccuaccggaucaagcagcgcggaauccucggcuacucccaaaucggcgcaggagucuacaaggaggggacguuccauaccauguggcacgucacgcggggcgcaguucugaugcaccgcggaaagcggaucgagcccucaugggcagacgucaagaaagaccuuaucucauacggcgguggguggaaguuagagggcgaauggaaagaaggggaggagguccaggugcuagcgcuugagcccggcaaaaaccccagggcgguccaaacaaagcccgggaucuucaagacuaacaccggcaccaucggggcagugucacuggacuucucaccuggcaccagcggcucucccaucguggaccguaaggggaaggucgucggccuguacgggaacggcguggucacgcgcagcggugccuacguguccgcgaucgcccagaccgagaagucgaucgaagacaaccccgagaucgaggacgacaucuuccggaagaagcgccugaccauuauggacuugcaccccggagccgggaagaccaagcgguaccugcccgccaucgugcgugaggccaucaaacgggggcugaggacgcucauccuggcucccacgagggucguggccgccgagauggaggaggcccugcggggccuccccaucagauaccagacccccgccauucgggcggaacacacggggcgcgagaucguggaucugaugugccaugccacguucaccaugcggcuacucagcccgguccgcgugccgaacuauaaccugaucaucauggacgaggcacacuucacggaccccgccucgauagcugcgcggggcuacaucucgacccgcguggagaugggcgaggcagccgggaucuucaugacggccacgccccccggaucgcgggauccauucccccagagcaaugccccuaucauggacgaggagcgcgaaauccccgagcguuccuggaacagcgggcacgaaugggucaccgacuucaagggcaagaccgugugguucguaccgagcaucaaggccgggaaugacaucgccgcuugucuacgcaagaacggcaagaaggucauccccuacagccggaagacuuucgacuccgaauaugugaagacccgcgcuaacgacugggacuucgucgucacgacagacaucagcgagaugggugccaacuucaaggcugagcgggugaucgacccccgacgcugcaugaagcccguaauucucacggacggggaagagcgcgucaucuuagccggcccgaugccagugacccauuccucagccgcacagaggcgcgggcgcaucggccguaaccccaaaaacgaaaacgaccaguacaucuacaugggcgagccccuugaaaacgacgaggacugcgcacacuggaaagaagccaaaaugcuccucgacaauaucaacacuccugaggguaucaucccauccauguucgagcccgaacgcgaaaaaguagacgccaucgacggcgaguaccggcugcgcggggaagcccggaagaccuuuguggacuugaugcgccggggcgaccugccgguguggcuggcauacaaaguggcagcggaggggaucaacuacgccgaccggaaauggugcuuugacggaaucaagaacaaccagauccucgaagaaaaugucgagguggaaauauggacgaaagagggggagcgaaagaagcugaagccccgcuggcuggacgcccggaucuacagcgauccccucgcccugaaggaguucaaggaguucgccgcgggucgcaagucccugacgcuuaaccugaucaccgaaaugggccgccugccuaccuucaugacgcagaaggcacgcaacgcucucgacaaccuggcgguccuccacaccgccgaggucgggggcaaggccuacacacacgcccucagcgagcuuccggagacccuggagacgcuauugcuguugacuuuacuggcugcggugaccgguggcaucuuccucuuccugauguccggcaaggggaucgguaagaugacucugggaaugugcugcaucaucaccgccagcaucuuacuaugguacgcccagauucagccccacuggaucgccgccuccauuauccuggaguucuuccucaucgugcugcugauacccgagcccgagaaacaacggaccccgcaggacaaccaacucaccuacguagugaucgcgauccugaccgucguggccgccaccauggccaacgagaugggauuccuggagaagacgaagaaggaccuaggguuuggcucaaucaccacccaggagucugaauccaacauccuggacaucgaccugcgccccgcuagugcguggacccucuacgcaguggccacgacauucgucacccccaugcuacggcacucaaucgaaaacagcucuguaaacgugucacugacugccaucgcgaaucaagccacagucuugaugggccuggggaaaggcuggccacuguccaagauggacauaggggucccguugcuugccaucggcuguuacagccagguuaaucccauuaccuuaaccgccgcccuccugcugcucgucgcccacuacgccaucaucgggccuggccugcaggccaaagccacccgcgaagcccagaagcgggcagccgccggcaucaugaagaacccaaccguggacgggaucaccgucaucgaccuggagcccauccccuacgaccccaaguucgagaaacagcugggccaggucaugcugcugaucuuaugugugacccaggugcugaugaugagaaccacgugggcccugugcgaggcccucacccuggcgaccggccccaucuccacccuaugggaaggcaacccggggcgguucuggaauacgaccauagccguaagcauggcuaauauauuccgcggcuccuaccucgcuggcgcggggcugcuguucagcaucaugaaaaacaccacaaacacgcgacgggggaccgguaaugugggggagacccucggcgagaaguggaagucccgacugaacgcucucgggaagagcgaguuucagaucuacaagaaguccggcauccaagagguggaccggacacucgcgaaggaggggauuaagcgcggcgagacggaucaccacgccgucagccggggguccgccaaacuccggugguucguggaacggaacauggugacccccgagggcaaggucguggaucuagguugugggcguggugguuggagcuacuauuguggcgggcucaaaaacgugcgggaggucaagggacugaccaagggcgggcccggccacgaggagcccaucccgauguccaccuauggguggaaccugguucgccuccaaucuggcguggacgucuucuucacgccgcccgagaaaugcgacaccuuacuuugugauaucggggagagcucgcccaacccgaccauugaggcgggacggacccuucgcguccugaaucugguggagaacugguuaaacaauaacacccaguucugcaucaaggucuugaaccccuacaugcccagcgugauagagaagauggagacgcugcagcggaaguacggcggggcccucgugcgaaacccucugucccguaacagcacgcacgagauguacuggguauccaacgcaacgggaaacaucgucucguccgugaacaugaucagccgcaugcuuauuaacagguucaccaugaagcauaagaaggccacguacgagccagacgucgaccugggguccggcacccgcaacaucggcaucgaguccgagacccccaaccuugacaucaucggaaaacgcaucgagaagaucaagcaggagcacgagaccucuuggcacuacgaccaggaccacccguacaagaccugggccuaccacggcagcuacgagaccaagcagaccggauccgcgagcaguaugguaaauggcgugguccgccuguuaaccaagccgugggacguagugcccaugguuacgcagauggcgaugaccgauacaacccccuucgggcagcagcgcguguucaaggagaaaguggacacgcgaacccaggagccuaaggaaggcaccaagaagcucaugaagaucaccgccgaguggcuuuggaaggagcugggcaaggagaagacgccgcgcauguguacccgggaggaauucacccgcaaaguccggucaaaugcugcccucggugcgguguuuacagacgagaacaaguggaaguccgcccgcgaggccguagaagacggacgguucugggaacuggucgaccgcgagcggaaucugcaucucgaaggcaagugugagacgugcguuuauaacaugaugggcaaacgcgagaagaagcuuggcgaauucggaaaggccaaagggagccgagcuaucugguacauguggcugggagcucgguuccuagaguucgaggcccugggguuccugaacgaggaccacugguucucccgggggaauucgcucagcggcgucgaaggagagggccugcaccgacugggcuacauccuccgggaggucgggaagaaagagggaggugccauguacgccgaugacacagcuggcugggacaccagaaucacccuugaagaccugaagaacgaggagauggugacaaaccacaugaaaggggagcacaagaaacuagcagaggccaucuucaagcugaccuaucagaacaaggucgugcgaguucagcgccccacgccccggggcacugugauggacaucaucucacgcaaggaccagagagggucuggacaaguggggacguacggacugaacaccuucaccaacauggaggcccagcugauaagacagauggagggcgaaggaauauucaaguccauccagcaccugaccgcgacggaggagaccgcggugcagaacuggcuggcccgcgucgggcgggagagacuaagccggauggccauuuccggcgacgauugcguggucaagccuaucgaugaccgguuugccagugcccugaccgcgcuaaacgauauggggaagguccgcaaagacauccagcaaugggagccaucccgaggcuggaacgacuggacacaggugccauucugcagccaccacuuccaugagcucgugaugaaggaugggcggguacucguugugcccugccgcaaccaggacgaacugaucggccgggcccguauaagucagggcgccggguggucgcucaaggagaccgccugucugggcaaaagcuacgcccagauguggacgcuaauguacuuccaucgaagggacuugcggcuggcugccaaugcgauuugcagcgccguccccucccacugggugccgacgucucgaaccaccugguccauccacgcgaagcacgaguggaugaccacggaggacaugcuugccguguggaaccgagucuggauccaggagaacccguggauggaggacaaaacccccguggagagcugggaggaggugcccuaucuugggaagcgcgaggaucaguggugcggcucgcugaucggucugaccagcagggccaccugggcaaagaauauccagaccgccaucaaccaggugcgcagccucaucggcaaugagggcuacaccgacuacaugccauccaugaagcgauuccgccgcgaggaggaggaggccggcgugcugugguaa

SEQ ID NO: 24832 - RNA, 9876 nt, Artificial Sequence
  derived and/or modified CDS sequence (opt11) from DENV-2__KP188556__SS-prME
accgccggcgugauagucaugcugauccccacggcgauggcguuccaccucaccaccaggaacggggaaccccauaugaucgugggccggcaagagaaagggaaaucccugcuguucaaaaccgaggacggagugaacaugugcaccuuaauggccauagaccugggggaauugugcgaggauacgaucaccuacaaauguccccuccugcgucagaacgagccggaagacaucgacuguugguguaacucgaccagcacauggguuacauacggcacgugcaccaccacaggggaacaccggcgcgagaaacgguccgucgcccugguuccgcacgucgguaugggucucgaaacccgcaccgaaaccuggaugagcucggagggggcauggaagcaugugcaacggaucgagacguggauuuuacggcacccuggcuucacaaucauggccgcaauucuggccuauaccaucgggaccacccacuuucaacgugcacucaucuuuauucuccugacggcagucgcgccgagcaugaccaugagguguaucggcaucucaaaucgggacuuuguggaggggguuagcgggggcuccuggguggacaucguccucgagcacgggagcugugugaccacaauggccaagaauaagcccacccuugacuucgagcugaucaagaccgaggccaagcagcccgcaacccuccgcaaguacugcaucgaagccaagcugacgaacacgaccaccgagagccguugcccgacgcaaggcgaaccuagcuuaaacgaggaacaggacaagcgauuuaucugcaagcacucaaugguggaccgggguugggggaacgguugcgggcuguucgggaagggcgggaucgugaccugcgcgauguucacgugcaagaagaacauggaggguaagaucguacaacccgagaaccuggaguacaccauugucaucacgccucacaguggggaggagcacgccgugggcaaugauacggguaagcacggcaaggagaucaagauuaccccgcaauccucgacgaccgaggcggagcucacggguuauggcaccgugaccauggagugcagcccucggaccgggcucgacuucaaugagauggugcugcugcagauggaagacaaggccuggcuuguccaccggcaaugguuucuggaucucccccuccccugguuaccgggggcugacacgcagggcagcaacuggauccaaaaggagacccucgugaccuucaaaaacccccacgccaaaaagcaggacguggucguacucgggucacaggagggagccaugcauaccgcccugacgggggcgaccgagauccagaugagcucgggcaaccugcucuuuaccggccaccugaagugccgccugcggauggacaagcuacagcugaaggggauguccuauucaaugugcacuggcaaguucaagaucgucaaagagaucgcggagacgcagcacgggaccauugugauacgcguucaguaugaaggggacggcucccccugcaaaauccccuucgaaaucacagaccucgaaaagcggcacguccucgggcgccugauaacggugaacccgaucgugacugagaaggacucacccgucaacaucgaggccgaaccgcccuuuggggacucuuacauaaucguggggguggaaccggggcaauuaaagcuaaacugguucaagaagggaagcucuaucggccaaauguucgagacgacaaugcggggugccaagcggauggccauccugggggauacggccugggauuucgguagucuagguggcgucuucacgagcaucgggaaggcccuccaccagguauucggcgcgauauacggggcggccuucagcgggguguccuggacaaugaaaauccugauuggcgucaucaucaccuggaucggcaugaacucgagaaguaccagccuauccgugagcuuggugcucguaggcgucguaacucuguaccugggagccaugguacaggccgauuccggcugcaucgugucguggaaaaacaaggagcucaagugcggcucaggaaucuucaucacagacaauguccacaccuggaccgagcaguauaaguuccagcccgaaagccccagcaagcuggccagcgccauacagaaggcacacgaggagggcaucugcgggauccggagcgugacgcgccuggaaaaccucauguggaagcaaaucacccccgagcugaaccacauuuuaucggagaacgaggugaaacucaccaucaugacgggcgauaucaaggggauaaugcaggcuggcaagcggagccugcgcccgcagccaacggaacugaaguacucuuggaagaccuggggcaaggcgaagaugcuuagcaccgagucccacaaccagaccuuccugaucgacgggcccgaaaccgcggagugcccuaacacaaaccgugccuggaacagccuggagguggaggacuauggauucggagucuuuacaacuaacauuuggcucaaacugagagagaagcaagacguguucugcgacuccaagcugaugagcgccgcgaucaaggacaaucgggcggugcacgccgauaugggcuacuggaucgaguccgcccucaacgacacguggaagauggagaaagccagcuucaucgaagucaaguccugccacuggccuaagagccacacguuauggagcaacggcgugcucgagagugagaugguuauccccaaaaacuucgccggacccguaucgcagcacaacuaucgcccgggcuaccacacacagaccgccgggcccuggcaucucggcaaguuagagauggacuuugacuucugugaggguaccacgguggugguaaccgaagacugcgagaagcggggccccucgcuacgaaccaccaccgccaguggcaagcucaucaccgagugguguugccggucaugcacccugccaccgcuacgcuaccguggggaggacggcugcugguacgggauggaaauuagaccgcuaaaggagaaggaggaaaacuuaguaaacagucuggugaccgccggccacgggcagaucgacaacuucucucuggggguccugggcauggcacuguuccucgaggagaugcugcggacacgcgugggaacgaaacacgcgauccugcucguggcccugagcuucgucaccuugauaaccggcaacauguccuucagggaucuggggcgcgucaugguaauggugggcgccacgaugaccgacgacauugggaugggcgugaccuaucuggcguuacuagccgcguuuaaggugaggcccaccuucgccgcgggccuguuacuccggaagcugacgagcaaagaacugaugauggccacgaucggaaucgcccugcugucucagagcaccuugcccgaaaccauucucgagcugacagacgcguuggcguuagguaugauggcgcuuaagauagucaggaacauggaaaaguaucagcuggcgguaacgauaauggccauuucgugugugccuaacgcggucauccuccagaacgccuggaaggugucguguacuauccuggccgccguguccgugaguccucuucugcugaccaguagccagcagaaggcggacuggaucccccuagcccugacgaucaagggguuaaaccccaccgcgaucuuccugacuacccucucccggacgucgaagaagcgcuccuggccacugaaugaggcgaucauggccgucggcauggucagcauccuggcguccagccuccugaaaaaugacauuccgaugaccggcccccugguggcagggggucuccuaaccgugugcuacguccuuaccggaagaagcgccgaccucgaguuagagcgcgccgcggacgugaagugggaggaccaggccgagaucuccgggucgucccccaucuuaagcaucacgauuuccgaagaugggagcauguccaucaaaaacgaggaggaggagcagacccucaccauccugauccggacaggccugcucgucauaagcggcgucuucccgguguccauccccauuacagccgccgccugguaccugugggaagugaagaagcagcgcgccgggguccuuugggaugugcccaguccgccgcccgugggaaaggcggaauuagaagacggggccuacagaauaaagcagcgcggcauccugggguacucgcaaaucggugccggcgucuacaaggaggggacguuccacaccauguggcacgugacccggggugcggugcugaugcaccguggcaaacggaucgagcccagcugggcagaugucaagaaggaccucaucuccuacggcgggggcuggaaacuggagggugaauggaaggagggggaagaaguccaggugcuagcgcucgaacccggcaagaacccucgcgccguccagaccaaaccagggaucuucaagacgaauaccggcacgaucggugccgugagccuggacuucuccccaggaaccagcggcagccccaucguggaccggaaggggaaagucgugggcuuauaugggaacggaguggugacgcgaagcggcgcguacguguccgccaucgcccaaacagagaaguccauugaggacaaccccgagauagaggacgacaucuuccgaaagaagcgccugaccauuauggacuugcaccccggggcaggaaaaaccaagagauaucugcccgccauugugcgugaggcaaucaagcgcggucugcgcacgcucauccuggcgccgaccagggucguggcggccgagauggaggaggcccugagaggcuuacccauccgauaccagacccccgccauccgagcggagcauaccgggcgcgagaucguugaccugaugugccaugccacguucaccaugcggcuguuaagccccguccgggugccgaacuacaaccugauuaucauggacgaggcacacuucaccgaccccgcguccaucgcagcccgcggauacauuucuacccgcguggaaaugggcgaggccgcgggaaucuucaugacggccacgccacccggcagccgggacccguucccacagagcaacgcgcccaucauggaugaggagcgcgagauucccgagcgguccuggaacagcgggcacgagugggucaccgacuucaaaggcaagaccgugugguucguuccaucgaucaaggccgggaacgacauugcugcaugcuuacgcaagaacggaaagaaggucauccagcucagucguaaaacuuucgacuccgaguacgugaagacacgcgccaacgacugggacuucguaguuacuacggacaucagcgagaugggggcaaacuucaaggcggagcgggugaucgaccccagaagguguaugaagcccgucauccuuacggauggggaggagcgggucaucuuagcaggccccaugccggugacccauuccuccgcggcccaaagacgugggcgcaucggccggaacccuaagaacgagaacgaucaauacaucuauaugggggaaccucuagaaaacgacgaagacugcgcgcacuggaaagaggccaagaugcuucuggacaacauuaacacucccgaagguaucaucccgucuauguuugagcccgagcgcgagaagguggacgccaucgacggggaguaucggcucagaggggaagccaggaaaacguucgucgaccucaugcgccggggcgacuuaccaguguggcuggcguauaagguggcggccgaggggaucaacuacgccgaucgcaaauggugcuuugacgguaucaaaaacaaccagauccuugaggagaacgucgagguggaaaucuggaccaaggagggagaaaggaagaaacugaagccgcgcuggcucgaugcucggauuuacucagauccccuggcguugaaggaguucaaggaguucgcagccggccgcaagucccucaccuuaaaccugaucacggagaugggccggcucccgaccuucaugacucagaaggcccgcaacgcccuggacaaccuggcgguccuccacacugcugaggucgggggcaaggccuacacccacgcccucagcgagcugcccgaaacccucgaaacgcugcuguugcugacucugcuggcggcggugaccggaggcaucuucuuauuccugauguccggcaaggggaucgguaaaaugacccuagggaugugcugcauaaucacugccagcaucuugcuuugguaugcccagauacagccgcacuggaucgccgccuccaucauccucgaguucuucuuaaucguucuccucauaccagaacccgaaaagcagcggacgccccaggacaaucagcugaccuacgucgugaucgcgaucuuaacggucguggccgccaccauggcgaacgagauggguuuccuugaaaagacgaagaaagaucugggguuuggcucgauuaccacccaagaaucagaguccaacauccuggacaucgaccucaggccggccagcgcguggacccuguacgccguagccaccaccuucgucacccccauguuacggcacaguauagagaacagcuccgucaacgugagccugaccgccaucgcgaaucaggccacuguccucaugggacucgggaagggcuggcccuuguccaagauggacaucggagugccccuauuggcaaucggcugcuacagccaggugaaccccaucacccucaccgcagcccuccugcuccugguggcgcacuaugcuaucaucggucccgggcuacaggccaaagccacccgugaggcccagaagcgggcggcagccggcaucaugaagaaccccacgguggacgggaucaccguaauagacuuggagccgaucccgcacgaccccaaguucgagaaacagcugggccaggucaugcugcucaucuugugcgucacccaggugcucaugaugcgcacaacaugggcccucugcgaggcccugacccuggcgaccgggcccaucaguacccucugggaaggcaaccccggcagguucuggaacacgaccaucgcagugagcauggccaacaucuuccgcggcuccuaccuugcuggugcgggucuccuuuuuagcaucaugaagaacaccaccaacacccgacguggcaccgggaacgugggagagacccugggggagaaguggaagucacgguuaaacgcgcucggcaagagcgaguuucagaucuauaaaaagagcgguauccaagagguggaccggacucuagccaaagaggggauaaaacgaggagagacggaucaucacgccgucucucgaggguccgccaaacuucgcugguucguggagcggaacauggugacccccgagggcaaggucguggacuuaggcugugggcgcggcggguggaguuacuauugcggcgggcugaaaaacgugcgggaggugaaggggcuaaccaagggaggccccggccacgaggagcccaucccuauguccaccuacggguggaaccuggugcgccugcagucgggcguggacgucuucuucacgccgccggagaagugcgacacccugcucugcgacaucggggagaguuccccgaaccccaccaucgaggcaggcagaacccugcgagugcugaaccucguggagaacuggcugaacaacaacacccaguuuuguaucaaggugcucaacccguacaugcccagcgugaucgaaaagauggagacccugcagcgaaaguauggcggggcccugguccgcaacccccugucccgaaacagcacccacgaaauguauugggucuccaaugcaaccggaaauauagugagcagugugaacaugaucucccgcaugcugaucaaccgguucacaaugaaacacaagaaggccacauaugagccggaugucgacuugggguccggcacccgcaacaucgggaucgaaucagagacgcccaacuuagacaucaucggcaagcggaucgagaagaucaagcaagagcacgagaccuccuggcacuaugaccaggaccaucccuacaaaacgugggccuaccacggaagcuacgagaccaaacaaaccggguccgccagcuccaugguaaacggcgugguucgauuguuaacaaagcccugggacguugugccgauggucacucagauggccaugacugauaccacccccuucgggcaacagcgaguuuucaaggagaaaguggacacgcggacucaggaacccaaggagggcacuaagaagcugaugaagaucaccgcagaauggcucuggaaggagcugggcaaagagaagacgccccgcaugugcacccgggaagaguucacccgcaaggugcggagcaacgcggcccugggggccguguucaccgacgagaacaaguggaaguccgcgagggaggccguggaagacggacgguuuugggagcuggucgaccgugagcgcaaccuccaucuggaggguaagugcgagacguguguguacaacaugaugggcaaacgcgagaagaaauugggagaguucggcaaggcaaaagggucgcgggcuaucugguacauguggcucggcgcccgauuccuggaguuugaggcguugggcuucuugaacgaagaccauugguuuagucgggggaacagccugagcggcgucgagggggagggccugcaccgccucggcuacauauuacgggagguagggaagaaagaagguggggcgauguacgcggaugacaccgcggguugggacacgcgcaucacacuggaggaccucaaaaacgaggaaauggugacuaaccacaugaagggggagcacaagaagcuagcugaggcuaucuuuaagcugaccuaucagaacaagguaguucgggugcagcguccgacgcccagaggaacagucauggacaucaucucccgcaaagaccaacgggggucaggccaaguggggacuuacggacucaacaccuucaccaacauggaagcccaauugauucgccagauggaaggcgagggaaucuucaaauccauccagcaucugacggccacagaggaaacagcggugcagaacugguuagcccgggucgggagggaacgccugagccguauggcuaucaguggcgacgauuguguagugaagcccauugaugaucguuuugcgagcgcccugacggcacucaacgauauggggaaggucaggaaggacauccagcagugggaaccgucucgaggcuggaacgacuggacacaggugccguuuugcucgcaucacuuccacgaguuggugaugaaggacgggcggguccugguggugcccugccgcaaccaggacgaguuaaucggucgggcuagaauuucccagggggcaggguggagcuuaaaggagaccgcuugccucgguaagaguuacgcccaaauguggacucucauguacuuccaccggcgcgaucugcgucuggcggccaaugcaaucugcucugccguccccucccauugggugcccaccagccgcacuaccuggaguauacacgcgaagcaugaauggaugacgaccgaggacaugcucgccguauggaaccgggucuggauccaagagaacccauggauggaggacaagaccccaguggagagcugggaggaaguaccuuaccucgguaagcgcgaggaccaguggugcggcucccugauugggcugaccucccgcgccacgugggccaaaaacauccagacggccaucaaccagguccgcagccugauuggaaacgagggcuauaccgauuacaugccguccaugaagcgguucagacgcgaggaagaagaggcgggggugcugugguaa

SEQ ID NO: 24833 - RNA, 9876 nt, Artificial Sequence
  derived and/or modified CDS sequence (opt11) from DENV-2__GU369819__SS-prME
accgccggcgucaucgucaugcugauccccaccgcuauggcguuucacuuaaccacccggaauggggagccucauaugaucguggggcgccaggagaagggaaagucccuccuguucaagaccgaagauggcguaaacaugugcacccucauggccaucgaccugggggagcugugcgaggacacaaucaccuacaagugcccccuacugcgucagaacgagcccgaggacaucgacuguuggugcaacagcaccagcacuugggucaccuacgggacaugcaccacgacgggcgaacaccggcgcgagaagcggucggucgcccuggugccccacgucgguaugggcuuagagacacggaccgagaccuggaugucuuccgaaggggccuggaagcaugugcaacgaaucgagacguggauccugcgucacccggguuucaccaucauggcugcgauccuagccuacaccauagggaccacgcacuuccagcgggcacucauauucauccuccugaccgccguggcucccucaaugacaaugaggugcaucggcaucuccaaccgggacuucgucgagggcgugagcgggggcuccuggguggacaucguccucgaacacggaagcugcgugaccaccauggcuaagaacaagcccacccuggacuucgagcugaucaagaccgaggcuaagcagcccgcaacccuacgcaaguacuguaucgaggccaagcugacgaacacuaccaccgagucgcggugccccacacagggagagcccagccugaacgaggagcaagacaaacgcuucaucugcaaacacuccaugguggaccgggguugggggaacgggugcggccuguucggaaagggcgggaucgugaccugcgcgauguuuacgugcaagaagaauauggagggcaaagugguacaacccgagaaccuggaauacacuaucgucauaacgccucacagcggagaggagcacgccgucggcaacgauaccgggaagcacgggaaagagauuaagaucacuccgcaaucuucaaucacugaggccgagcugacuggguacggaacugucacuauggagugcagccccaggacgggccuggacuucaacgagaugguccugcuccagauggagaacaaggccuggcucgugcaucgucagugguuucuggaucuuccgcuccccugguugccgggugccgauacccagggcuccaacuggauccaaaaggagacgcucgugaccuucaaaaacccccacgcaaagaagcaagauguaguaguguuagggucccaggagggcgcuaugcacaccgcgcucaccggagccacugagauccagaugagcagcggcaaccuucuguucaccggucaucugaagugucgcuuacggauggacaagcuccagcugaagggcaugucguacagcaugugcaccggcaaguucaagaucgugaaggagaucgccgagacgcagcauggcacgaucgugauccgcgugcaguacgaaggcgacggcucaccuugcaaaauccccuucgaaaucaccgaucuggagaagcggcacguguuggggcgccugaucaccgugaacccgaucgucaccgaaaaggacagccccgugaacaucgaggcggaaccucccuucggugacuccuacauaauaaucgggguagagccaggccagcugaagcuaaauugguuuaaaaaggggagcuccaucggacagauguucgagacgaccaugcguggcgccaagcggauggccauccugggggacaccgcaugggacuucggcagccucggaggcgucuuuaccuccaucgggaaggcccuccaccaaguguucggagccaucuacggcgccgcguucagugguguguccuggacuaugaagauccuaaucggcgucauuaucaccuggauagggaugaacagcaggagcacaucgcuguccgugagccucgugcucgugggcguugugacuuuguaccugggggcuauggucagagcugauuccggcugcgugguaagcuggaagaacaaagagcucaagugcggcuccgggaucuucaucacugacaacguccauacauggaccgagcaguauaaguuccagcccgaaucucccuccaaguuagccuccgccauucagaaggcccaugaggaggguaucugcgggauccggucggugacaaggcuggagaaccugauguggaagcagaucacgcccgaguuaaaccacauccugucggagaacgaggugaagcucacgaucaugaccggcgacaucaaagggaucaugcaggccggcaagcgcagccuccggccccagccgaccgaguuaaaguacuccuggaagacguggggaaaggcgaagauguugagcaccgagucccauaaccagacguucuuaaucgacgggccggagaccgcugaguguccgaacacgaaucgcgcuuggaacagccucgaggucgaagacuacggguucgggguguucaccaccaacauauggcucaagcugagggagaagcaggacguguucugcgacuccaagcugaugucagccgccaucaaagacaacagggcgguacacgccgacaugggcuacuggaucgaguccgcacucaacgacaccuggaagauggagaaggccagcuucaucgaggugaaguccugccacuggcccaagagccacacccuuuggagcaacggggugcuggagagcgagaugaucauucccaagaacuuugccgggcccgucucgcaacacaacuaccggccgggcuaccacacgcagacagcagggcccuggcaccucggcaaguuggaaauggacuucgaucuaugcgaggggaccaccguaguggugacggaggacugcggaaaucgcggccccagccuccggaccaccaccgccagcgggaagcugaucacagaguggugcugccgcuccugcacacuacccccucuccgguaccgcggcgaggacgggugcugguacggcauggaaauucggccacugaaagagaaggaggagaaccugguuaacagucuugugacagccgggcauggccagaucgacaacuucucccucggcguauuagggauggcccucuucuuagaggagaugcugcgcacucggaucggcaccaagcacgcuauucuccuuguggccguuagcuuugucacccugaucaccggcaacaugucguuccgagaccuggggcgcguuauggugauggugggggcuaccaugacggacgacaucggcaugggcgugaccuaucuggcgcuguuagcagcguucaaagugcggccaaccuuugccgcgggucugcuucuucgcaagcugaccucuaaggaacugaugauggcuacgaucggcaucgccuugcugucgcaaagcaccauccccgagacuauccuggagcucacagacgcccuggcacucggaaugaugguccucaagaucgugcgcaacauggagaaguaccagcuggccgugacgaucauggccauaucgugcgucccgaacgcggugauccugcagaaugcguggaaggugagcugcacgauccucgcugccgucuccgugucgccccuguuguuaaccuccagccagcagaaggcagacuggaucccucuggcgcugaccaucaaaggccucaacccuacggccauuuuccugaccacacuaucccgcaccagcaagaagagauccuggccgcucaaugaagccaucauggccguaggcauggugagcauccuggccucgucacuacucaaaaacgauaucccaaugacggguccccugguggcgggcggucuacucacuguuugcuacgugcugaccggccguagcgccgaccuugagcucgagcgugccgccgacgugaagugggaggaccaagccgagaucuccgggagcucucccauccugagcaucacaauaagugaggacggcagcaugagcaucaagaacgaggaggaggagcagacgcugaccauccucauccgcaccggccuguuggucauaagcgggguguuuccgguguccauacccaucacugcggcagccugguaccucugggaggucaagaagcagcgggccggcguucugugggacgugcccagcccgccgccagucgggaaggcugaacuggaggacggcgcguaccgcauaaaacaaaagggcauccucggcuacucccagaucggcgccgggguguacaaagagggcacuuuccacacgauguggcacgugacccgcggggccguucugaugcaccggggcaagcggaucgagccgagcugggcagacgugaaaaaggaucugaucuccuacgggggaggcuggaagcuagagggggaguggaaggagggcgaggaggugcagguccuggcccuagagcccggcaaaaacccgcgcgcggugcagaccaagccgggcauauucaagaccaacaccggcaccaucggcgccgugagccucgacuucuccccaggcacaagcggguccccgauugucgaucggaaagggaaggugguggggcuguacggcaacggcgucgugacccgcagcggggcguacgucuccgccauugcgcaaacugagaaguccaucgaggacaaccccgagaucgaagaugauaucuuccgaaagaagcgucugaccaucauggaucugcacccgggcgccgggaagacgaagcgguacuuacccgccaucguucgcgaggcuaucaagcgcggauugcgcacucugaucuuagcaccgacccgcgugguugcggccgaaauggaggaggcccugcgggggcuucccauccgcuaucagaccccggccaucaagaccgagcacacgggccgggagaucgucgaccucaugugucacgccacguucacuaugagacugcugucucccgugcgggugccgaacuacaaucucaucaucauggacgaagcgcacuucaccgacccugccuccaucgccgcccgcggauacauaagcacccggguugaaaugggggaggccgcggguauuuucaugaccgccacgccccccgggucccgugacccguucccgcagagcaacgcccccauaauggacgaggaacgggagaucccagagagaagcuggaacuccggccacgagugggucaccgacuucaaggggaagacuguuugguuugucccguccaucaaggccgggaacgauaucgccgccugccugcggaagaacggcaaaaaggugauacaacuaucccgcaagacuuuugauuccgaguacgugaaaacccgagcaaacgacugggacuucgucgugaccacggacaucucagaaaugggggccaauuuuaaggccgagcgcgugaucgacccgcggcgcuguaugaagcccgucauacucacggacggugaagagagggugauccuggcggggcccaugccuguaacccauaguagcgcagcccagcgccggggacgcaucggucgcaaccccaagaacgagaacgaccaguacaucuacaugggggagccccuggagaaugaugaagacugugcccauuggaaggaagccaagaugcuccuggauaacaucaacacccccgaaggcaucauacccuccauguucgagcccgagagagagaaggucgacgccaucgacggcgaguaucgccuccggggcgaggcccgcaaaaccuucguggaccucaugagacgcggagaccugcccguauggcuggcguacaagguagccgccgaaggcauaaauuacgcagaucggaaguggugcuucgauggcauaaagaacaaccaaauccuggaagagaauaucgagguggagaucuggacgaaagagggcgagcgcaagaagcugaagccacgguggcuggaugccagaaucuacucggauccccucgcgcugaaagaguucaaggaguucgccgcgggccggaagucacugacgcucaaccugaucacggagaugggacgcuugcccaccuuuaugacucagaaggcccggaacgcccuugauaaccuggccguucuccacaccgccgaggcgggcggacgcgccuacaaccaugcacugagcgaguugcccgagacccuggaaacccuccucuugcucacucugcuggccaccgugacgggggguaucuuucucuuucuuauguccgggagagggaucgggaaaaugacccugggcaugugcugcauuaucaccgccuccauccuccugugguacgcgcagauccaaccgcacuggaucgccgccuccaucaucuuggaguucuuucuaaucgugcugcugauccccgaaccagagaagcagcguacgccccaagacaaccagcucacauacgucguaaucgccauccugacggugguggccgcgaccauggccaaugagaugggguuccuggagaagacgaaaaaggaccucggucugggcagcaucacaacccaggaaagcgagaguaacauccuggacaucgaccuccgcccagccucugccuggacccuguacgcaguggcgacgaccuucguuacgccaaugcugcgccauuccaucgagaacagcuccgucaacgugagccucacugcaaucgccaaucaagcgacgguucugaugggucugggcaagggguggccgcuauccaagauggauaucggcgucccccugcuagcgaucgggugcuacagccaggugaacccaaucacccuuaccgccgccuuacugcuacugguggcccauuacgccaucaucggcccgggccugcaggccaaagccacccgggaggcucagaagcgcgcagccgcgggaauaaugaaaaaccccacggucgacggaaucaccgugauugaccuggagccgauaccguaugaccccaaauucgagaagcaguuaggacaggucaugcugcucauccuuugcgucacacaagugcugaugaugcggacaacuugggcccucugcgaggcccugacccuggccacagggcccauuuccacccucugggaggggaaccccggccgcuuuuggaauacgaccaucgccgugucaauggcuaauaucuuccggggcuccuaccuggccggggccggucuccuauucuccaucaugaaaaacaccaccaacacucgacgcgggaccgguaauauuggagagacccugggggaaaaguggaagagucgucugaaugcccucggcaagagugaauuucaggucuacaagaaguccgggauccaggaggucgacagaacgcuggcgaaagagggaauaaagcgcggggagacggaccaccaugcggugucacgagggucagccaagcugcggugguucgucgagcgcaacauggugaccccggaggggaagguggucgaccucgggugcggccgcggcggcuggagcuauuacugcgggggccugaagaaugugcgcgaagugaagggccugaccaagggcggccccgggcacgaggagcccauacccauguccacauacggcuggaaccucguccggcugcagucggggguugacguguucuuuacgccgcccgaaaagugugacacgcugcugugcgacaucggcgagagcuccccaaacccuacaauagaggcuggccggacccugcggguccugaaccucguagagaauugguuaaauaacaacacccaguucuguauaaaggugcugaacccguacaugcccagcgucaucgagaagauggaagcccuccagagaaaguaugggggcgcgcuugugcggaauccccugucacgcaacagcacgcacgagauguacugggugucuaacgcaaccgguaacaucgucagcuccguuaacaugaucagccggaugcugauuaaccgcuuuaccaugaaacacaagaaggccaccuacgagccugacguggaccucggcaguggaacucggaauaucggcaucgagagcgagauaccuaaccuggauauuaucggcaaacgcaucgagaagaucaaacaggagcacgaaacguccuggcacuacgaucaagaccaucccuacaagaccugggccuaucacgguagcuacgaaaccaagcagacagguuccgccagcuccaugguaaacgggguugugaggcugcugaccaagccuugggacguccugccgauggugacccagauggcgaugaccgacacgaccccuuucggccagcagcgggucuucaaggagaaggucgacacccgaacucaggagcccaaggagggcacgaagaagcugaugaagaucaccgccgagugguuauggaaagagcuggggaagaaaaaaacgccccguaugugcacccgcgaggaguucacgagaaaggugaggagcaaugccgcccucggcgccaucuucacggacgagaacaaauggaagagugcucgggaggccguggaggacgggcguuucugggaacucgucgaccgagaacgaaaccuucaccucgagggaaagugcgagaccugcguguacaacaugauggggaagcgggagaagaaacucggcgaguucggaaaggccaaagggagccgcgccaucugguacauguggcugggggcgcguuuccuggaauucgaggcucucggguuccuaaaugaggaccacugguucucacggggcaacagcuuaagcggggucgagggagagggccuccaucggcugggguacauccugcgggacgucggcaagaaggagggcggcgcuauguaugccgacgacaccgcugggugggacacgcgaaucacccucgaggaucugaagaacgaggagaugguuacuaaccacaugaagggugagcauaaaaaauuagcagaggcuaucuucaagcucaccuaccaaaacaaagucgugcgcgugcagcggccgacgccccgcggcacugucauggacauaauuucccggcgcgaccagcgcgguagcggccagguggguaccuaugggcuaaacaccuucacaaauauggaggcccagcugaucagacagauggagggggaggggaucuucaagucaauccaacacuuaacagccacagaggagauagcagugcaaaauuggcuggcgcggguuggccgggagcgccugucacggauggccaucuccggggaugauugcguggugaagccgaucgacgacagauucgccucugcacucaccgcccucaacgacaugggcaaagucagaaaggacauccagcagugggaaccgucccgcggguggaacgacuggacacagguaccguucugcagccaccacuuccacgaacugguuaugaaagacggacggguacucgugguuccuugucgcaaccaggacgagcugaucggcagagcacgcaucucccaaggggcgggcuggagccucaaggagaccgcgugccuugguaaguccuacgcccaaauguggacccuuauguacuuccaccggcgcgacuugcggcucgccgcgaacgccaucugcagcgcggugccgccccauugggugccaacuucccggacgacguggagcauccacgccaagcacgaguggaugaccaccgaggacaugcuggcgguguggaaccggguguggauacaggaaaaucccuggauggaggauaaaacccccguagaguccugggaggaggugcccuaucugggcaagcgcgaagaucaguggugcgggagcuugaucggccugacgucccgcgccaccugggccaagaacauccagaccgccaucaaccagguccgcagccugaucggcaacgaagaguacaccgauuacaugccgaguaugaagagauuccgccgcgaggaggaggaagccgggguucucugguga

SEQ ID NO: 24834 - RNA, 9876 nt, Artificial Sequence
  derived and/or modified CDS sequence (opt11) from DENV-2__JX649147__SS-prME
acggccggugugaucaucaugcugaucccaaccgcgauggcguuucaccucaccacccgcaauggggagccacauaugauuguagggcggcaggagaagggcaaaagccugcuguucaagacugaggacggcgugaauaugugcacccucauggccauagaccuuggggagcugugcgaggauaccaucacguacaaaugcccccuccuacgccaaagcgaacccgaggauauagacugcuggugcaauagcaccucaaccugggugaccuacgggaccugcaccaccacgggcgagcaccggcgggagaagcgcagcgucgcccuggugccccacgugggaaugggccucgagacccgaacugaaacauggauguccagcgagggggccuggaagcacgcccagcgaauugagacauggauccugcgccaccccggcuucaccaucauggccgccauucucgccuacaccauagggaccacgcacuuccaaaaagcccucauauuuauccuguuaaccgcggucgcccccuccaugacuaugcgauguaucggcaucagcaaccgcgacuucguggagggcgucuccggugggagcuggguggacaucguacucgagcacgguuccugcguaacuaccauggcaaagaacaaaccgacucuggacuucgagcuuaucaagaccgaggccaaggagcccgccacccuccggaaauacugcaucgaggcgaagcugacgaacaccaccaccgagagccgcugcccaacgcagggcgagcccucccuaaacgaggagcaggacaagcgguuuguguguaagcacucaaugguggaucgcggcugggggaacggcugcgggcuguucggcaagggugggauagucaccugcgccauguucacaugcaagaagaacauggagggcaagaucguccagcccgaaaaccuggaguacaccaucgucaucacgccccauuccggagaagagcacgcaguuggaaacgacacaggcaagcacggcaaggagaucaagaucaccccgcaguccuccauuaccgaggccgaacuaaccggguacgguacgguaaccauggaaugcagcccgcggaccggucucgacuucaacgaaauggugcuguugcagauggaggauaaggcuuggcucgugcaccggcaaugguucuuagaccugccccuccccugguugcccggagcggacacucagggguccaacuggauccagaaggagacgcucgugaccuucaagaacccucacgccaagaagcaggacguggugguccucgggucgcaagagggcgccaugcacacugccuugaccggggccacggagauccagaugucauccgguaaucuccuguucaccggccaccugaagugcagacugcgaauggacaaacuccaacugaaagggaugagcuacuccaugugcaccggcaaguuuaagauuguuaaggagaucgcggagacccagcaugggacgaucguaauccgggugcaguacgagggcgacggaucgcccugcaagauccccuucgagaucauggaccuggagaagcgucacgugcucggccggcugaucaccgucaacccgaucguaaccgagaaggauucccccguaaacaucgaggccgagccgccguucggcgacuccuacaucaucaucgggguagagccgggucagcuuaagcuuaauugguucaagaaagggaguagcaucggccaaauguucgagaccacgaugcgcggcgccaagcgcauggccauucugggcgacacggccugggacuuuggcucccugggcggaguguucacgagcaucgguaaggcgcuccaccaggucuucggugccaucuauggcgccgccuuuucuggggugagcuggaccaugaaaauccugauuggcgugaucaucacguggaucgguaugaacucccggucaaccucccugagugugucacugguccucgugggcgugaucacccuguaccugggggcaaugguccaagcugacucaggcugugugguaagcuggaagaacaaggaguuaaagugcggcagcggcauuuuuaucaccgauaacguccacacguggaccgagcaguacaaguuccaacccgaguccccauccaagcuggccagcgccauccagaaggcccacgaggagggcaucugcggcauccgcagcgugacccggcucgaaaaccucauguggaagcagauaacccccgagcucaaccacauccuuucggagaacgaagucaagcucacgaucaugaccggggauauaaaagggauuaugcaggcggguaaacgcucccugcggccgcagcccacugaguugaaguauagcuggaaaaccuggggcaaggccaagaugcucuccacagaaucccacaaccagaccuuccugaucgacgggcccgagaccgcugagugcccgaacaaaaaucgcgccuggaacucccuggagguagaggacuacggcuucgguguguucacgacgaauaucuggcucaaauugcgggagaagcaggacgucuuuugcgacagcaagcuuaugucggccgcgaucaaggacaaccgcgcgguccacgccgacaugggcuacuggaucgagagcgcccucaacgacacguggaagauggaaaaggccuccuucauagaagucaagagcugccacuggcccaagucccacacccuguggucaaacgguguccuggaguccgagaugaucauccccaagagcuucgcggggcccgugagccaacacaacuaccgaccagguuacuacacccagaccgccggacccuggcacuugggcaaacuggagauggacuucgacuucugcgagggaacgacagugguggucaccgaggacugcggcaaccgcggcccuucccugcggaccacgaccgcgagugggaaguuaaucaccgaguggugcugccgcucuugcacccugcccccauuacgauaccguggcgaggacggaugcugguacggcauggagauccggccccuuaaagaaaaggaggagaaccuggucaacagccuggugacggcggggcacggucaaaucgacaacuuuucccucggcguucuggggauggcgcuauucuuggaggaaaugcugcgcacccggguaggaaccaagcacgcgauucuccuaguggcugugagcuucgugacccugaucacgggcaacaugaguuuccgcgaccucggucgggugaugguaauggugggggcaaccaugaccgacgacaucggcaugggagugacuuaccuagccuuacuugcggcuuucaagguccgccccacguuugccgcuggccuccugcugaagaagcuuaccagcaaggagcugaugauggccaccauugggaucgcacugcucucacagaguaccaucccagagacgauccuugaguuaacagacgcccucgcccugggaaugauggugcucaagaucguuaggaauauggaaaaguaccagcucgcugucaccaucauggccaucaguugcgugccgaacgcgguaauccugcagaacgccuggaaggucagcuguaccauccuggccgcggugagcgugagcccccucuuacuaacauccagccagcagaaggccgacuggaucccucuugcccuaaccaucaaaggccugaauccuaccgccaucuuccucaccacgcugucccggacgagcaagaaacgcuccuggccguugaacgaagccauaauggccguagggauggugagcauccucgcaaguucacugcucaagaacgacauccccaugacugggccccuagucgccggcgggcugcugaccguuugcuaugugcuaacgggucggagcgccgaccuggagcuggagcgagccacugacgugaagugggaggaccaagccgagaucagcggcaguucccccauccuaucgaucaccaucagugaagauggcucuaugucaauuaagaaugaggaggaggagcagacgcugacgauccuuauccggacaggacuacuggucaucagcgggcuguucccgaugaguauacccauuaccgcggccgccugguaccucugggaggucaagaaacagcgcgccggggugcuuugggacgugcccagccccccgccaguggggaaggcugaacuggaagauggcgcguaccggaucaaacagaaggggauucucggcuauucccaaaucggcgcuggggucuacaaagaaggaacguuccacaccauguggcacgugacgcgcggggccgugcuuaugcaccgggggaagcgcaucgagcccagcugggccgacgucaagaaggaccucaucuccuacgggggcggcuggaagcucgaaggggaguggaaggagggcgaggagguccaagugcuugcccuggagcccgggaagaaccccagggcaguccagacaaagccggggcuuuucaaaacgaauaccgguacuaucggcgccguuucacuggacuucucccccggcacgagcgggucacccaucguagaccgcaagggcaaggucguggggcuguacggcaacggcguggugacccggagcggagccuacgugucagccaucgcacagaccgaaaaguccauugaggauaaucccgagaucgaggacgauaucuuccgcaaaaagcgcuugaccauaauggaccuacaccccggggccggaaagacaaagcgcuaccugcccgcgauugugcgggaagccaucaagcgcggccugcggacccucauccuggccccgacaagggucguggcagccgaaauggaggaggcacugcgaggccugccaauccgcuaccagacgcccgccauccgagcagagcacaccggucgggagaucguggaccugaugugucacgcgaccuuuaccaugcgucugcucagccccguacggguuccgaacuacaacuuaaucaucauggaugaggcccacuuuacggacccggccuccaucgcagcucgcggcuacaucagcacgcgaguagaaaugggggaggcggccggcaucuucaugaccgccacgccgccagguucgcgagacccuuucccccaaagcaacgccccuaucauggacgaggagcgggagauccccgaacguuccuggaauagcggccacgaguggguuacugacuucaaggggaagaccgugugguucguuccguccaucaaggcgggcaaugacaucgcggccugccuacggaagaacggcaagaaggucauccagcucagccgcaagaccuucgacuccgaguacgugaagacccggacuaaugacugggacuucgugguuacuacggauaucagugagaugggagccaacuucaaggccgagcgcgucaucgacccccggcgcugcaugaagcccgugauccugaccgacggagaggaacgcgucauccuggcggggcccaugccugugacgcacuccagcgccgcgcagagacggggccgcaucgggcggaaccccaagaacgagaacgaccaauacaucuauaugggcgagccccucgagaaugacgaggacugcgcacauuggaaggaggcuaaaaugcugcuggacaauaucaacacgccggagggcaucauaccgaguauguucgagcccgagcgcgagaagguagacgcgaucgacggcgaguaccgccugcgaggcgaggcccgcaaaaccuucgucgaccugaugcggcguggagaucugcccguguggcucgccuaccggguggcugccgagggcauuaauuacgcggacagacgguggugcuucgacggcgucaagaauaaccagauauuagaggagaacguggagguggagauauggacuaaagagggugaacgcaaaaagcugaagccccgauggcucgacgcccgaaucuacuccgacccucuggcgcugaaggaauucaaggaauucgccgcgggcagaaagagucucacgcugaaccuaaucacugagauggggcgccuccccacuuuuaugacccagaaggcccgggaugccuuagacaaccuggccguucuccacacggccgaggcgggcgggcgcgccuacaaucacgcacugucagagcugccugagacucuggagaccuuacuguugcuuaccuugcuugccacggugaccggcgggauauucuuguuccucaugagcgggaaaggcguggguaagaugacacucgggaugugcugcaucaucaccgcauccaucuugcugugguacgcucagauccagccgcacuggauagccgcuagcaucauccucgaguucuuccugaucguccugcucauccccgagccggaaaagcagcggacgccacaggacaaucagcugacguauguggucaucgcaauccugaccgugguggccgcuaccauggccaacgagaugggguuccucgagaagaccaaaaaggaccugggcuugggauccaucgcaacgcaagagccggaaagcaacaucuuagauaucgaccuccgacccgccuccgccuggacccuauacgcggucgcuaccaccuuugugacgcccaugcuccggcacagcaucgagaacucaagcgugaacguauccuugacagccaucgcaaaccaggcgacaguccugaugggauugggaaagggguggccgcugagcaagauggacaucggugugccacugcucgcaaucgggugcuauucccaggugaaucccauuacccugacggccgcccugcuccuccucaucgcccacuacgcgaucaucgggccuggcuugcaggcgaaggcuacccgcgaagcccagaaacgggccgcagccgggaucaugaagaaccccacgguggacggcaucaccgucaucgaccuggacccaauaccguacgaccccaaguucgagaaacagcugggccaggucaugcuccugauccugugcgugacacaggugcucaugaugcgcacgaccugggcccugugcgaggcccugacccuagccacgggccccaucagcacccugugggaggggaacccuggccgguucuggaacaccaccaucgcgguuuccauggcgaauaucuuccgcggguccuaccuggcuggggcgggccugcuguucuccaucaugaagaacacuaccaacacuaggcgggggacaggcaacaucggcgaaacacuuggggagaaguggaaaucccgacugaacgcgcucggcaagagugaguuccagaucuacaagaaauccgggauucaggaggucgauagaacccuggccaaggaaggcauuaagcgcggggagaccgaccaccacgccgugagucggggcagcgcaaagcuccgcugguucguugagcgcaacauggugacgcccgagggcaaggugguagaccugggguguggccguggaggcugguccuacuauuguggaggccugaagaacgugcgcgaggugaaaggauuaacgaagggcggccccgggcacgaggagcccauaccgauguccaccuacggguggaaccugguacgccugcaaagcgggguggacguuuuuuucacgccgccugaaaagugugacacgcuccugugcgacaucggcgaguccucaccaaauccgacaaucgaggccggccggacccugaggguacuauccuuagucgagaacuggcuaaacaacgacacccaguucugcaucaagguccucaaccccuacaugcccagcgucaucgagaaaauggaaacccugcagcggaaguacgggggcgcuuuaguaagaaacccgcugucccggaacagcacccacgagauguacugggucuccaacgccacugggaacauuguuuccuccgugaacaugaucagccgcaugcugauaaaccgguucaccaugaagcacaagaaagcgaccuacgagcccgacguggaccucggcuccgggacgcgcaacaucggcaucgaaagcgagaucccaaaccuggacaucaucgggaagcggaucgaaaagaucaaacaggagcacgaaacguccuggcacuaugaccaggaccaccccuacaagaccugggccuaccacgggagcuaugagacgaagcagaccggcucagcaaguuccauggucaacgggguggugcgccuccugacgaagccaugggacgucgugcccaugguuacccagauggccaugaccgauacaacacccuuuggccagcagcgcguauucaaggaaaagguggauacccggacccaggagcccaaggagggcaccaaaaaacugaugaaaaucacggcggaguggcucuggaaagagcuggguaaaaagaagacgccgcgcaugugcacccgggaggaauucacgcgcaaggugcgaagcaacgccgcccuaggcgccaucuucacggacgagaacaaguggaaguccgcgcgagaagccgucgaggacagccgguucugggagcucgucgacaaggagaggaaucugcaccuggaggggaagugcgagaccugcguguacaacaugaugggcaaacgggaaaaaaaacucggggaguuuggaaaggcgaagggcagccgugccauuugguacauguggcugggggcgcgguuccucgaguucgaagcccucggcuuccugaacgaggaucacugguucucccgcgagaacagcuuaagcggggucgagggcgaggggcuccacaagcugggcuacauucuccgggacgugagcaagaaggagggaggggcaauguaugcagacgacaccgccggaugggacacgcgcauuacgcucgaagaccugaagaaugaggaaauggugaccaaccacauggaaggggagcauaagaagcuggcugaggccaucuucaagcuaacuuaccagaacaagguugugcggguccagcgcccgacgccccgaggcaccgugauggacaucauuucccggcgggaccaacgcggcagcgggcagguuggcaccuaugggcugaacaccuucaccaacauggaggcccagcucauccgacaaauggagggcgaggggaucuucaagagcauccagcaccuaacagucaccgaggagaucgccgugcaagauuggcuggcccgcgugggccgcgagcggcugucuaggauggcgauuuccggggacgacugcgucgugaagccacuagacgaccgguucgccucugcccugaccgcuuugaaugacauggggaaagugcgcaaggacauacagcagugggagccgucccggggcuggaacgauuggacccaaguccccuuuugcagccaccacuuucaugagcucaucaugaaagacgggcgcgugcugguuguccccugccggaaccaggaugagcuuaucggccgagcccgcauuucccagggggcggguuggucgcuuaaggagacggcuugccuuggcaaauccuacgcccaaauguggagccugauguacuuccaccgccgugaccuccgccuugccgccaacgcgauaugcuccgccguaccaagccacugggugccuaccucgcggacaaccugguccauacacgccaagcaugaauggaugaccaccgaggacaugcugacuguguggaaccgcguuuggauccaggagaaccccuggauggaagauaagacccccguggagucuugggaggagguccccuaccucgggaagcgggaagaccaguggugcggcucucuuaucggucugaccagccgcgccacgugggccaagaacauccagaccgccaucaaccaagugcggucccucaucggcaacgaggaguacaccgacuacaugccuagcaugaaaagauuccggcgcgaggaggaggaagccggaguccugugguaa

SEQ ID NO: 24835 - RNA, 9876 nt, Artificial Sequence
  derived and/or modified CDS sequence (opt11) from DENV-2__KF704356__SS-prME
accgcgggcaugauuaucaugcugauacccaccguuauggcguuucaccucaccacccgaaacggggagccccacaugaucgucagccggcaggagaagggcaaaagucugcuauucaacaccggugacggggugcauaugugcacccucauggcgaugcaccugggggagcugugcgaggacacgaucaccuacaaauguccccuccugcggcagaacgagcccgaggacaucgacugcuggugcaacagcaccuccaccugggugaccuacggaaccugcaccaccacgggcgagcaccggcgcgagaagcggagcguagccuuagugccccacguggggaugggccucgagacacgcaccgaaacuuggaugaguagugagggggcauggaagcacgcccaacggaucgaaacguggauucuucgccacccugguuucacuaucauggcugcgauucuagccuacaccaucgggacgacccacuuccagcgagcgcugauuuucauccugcugacggccgucgcgcccuccaugaccaugcgcugcauaggcaucagcaaccgggauuucguggagggaguaagcggagggucuuggguggauaucgugcucgagcauggguccugcgugacaacuauggccaagaacaagcccacccuggaccuggaacucaucaagaccgaagccaaacagccggccacccugcgcaaguacugcaucgaagccaaacugacaaacacuaccaccgagucacgguguccgacgcagggggagcccucccucaacgaggagcaggacaagagguucgucugcaagcacagcaugguggaucggggcugggggaacggcugcgggcuguucggcaagggguccaucgugaccugcgcaauguuuaccugcaagaaaaucaugaagggcaaggucgugcagcccgaaaaccuggaguacacgaucgucaucacgccccauagcggcgaagaacacgccgucgggaacgacaccggcaaacacggaaaggagauuaaaaucaccccgcaguccagcaucaccgaggccgaguuaaccggcuacgggacagugaccauggagugcagcccccggaccggccuggacuucaacgagauggugcugcuccagauggaggacaaggccuggcugguccaccggcagugguuccuagacuugccccugcccuggcugccgggcgccgacacccagggaagcaacuggauccagaaggagacgcucgucaccuucaagaacccccacgcgaagaagcaggacgucgucgugcugggaagccaggaaggugccaugcacaccgcccugacgggcgccaccgagauccagauguccucugggaaugucuuauuuaccggccaccugaagugccgcuugcggauggacaagcuccaacugaagggcaugucguacuccaugugcacugguaaauucaaggucgugaaggagaucgcugaaacgcagcacggcacgaucgucauucgcgugcaguacgaaggggauggcagccccuguaagauccccuuugagaucauggacuuggagaaacggcacgugcucggccgccucauaaccgucaacccgaucgugaccggcaaggacucgcccgugaauaucgaggcggaaccgcccuucggggacuccuacaucaucauagggguagagccggggcagcugaaacugaacugguucaagaagggcagcuccaucggccagauguucgccaccacgaugcggggagccaagcguauggccauccuuggcgauaccgcaugggacuucgggagccucgggggcguguuuaccuccaucggaaaggcgcuccaccagguguucggggccaucuacggcgcagcuuucucaggggucucguggacgaugaagauccugaucggugugauaauuacguggauagggaugaacagccgcuccacgagccuguccgugagccugguccucgugggagugguaacacuguaccugggagugaugguacaagcggacuccggcugcgucgugagcuggaagaacaaggagcuuaagugcggcucggggauauucaucaccgacaacguacacacguggaccgagcaguacaaguuucagcccgaguccccuaguaagcuggccuccgcgauccagaaggcccacgaagagggcaucugcgggauccggagcgucacccgccuggagaaccucauguggaagcagaucaccccugaacugaaccacauucuauccgaaaacgaggugaagcucacgaucaugacaggagacaucaaggggaucaugcaagcuggaaagcgcagccugcgcccgcagcccaccgaacuuaaguacuccuggaagaccuggggcaaggcgaagaugcucucuacugaaucucacaaccagaccuucuuaaucgacgggcccgagaccgcggaaugcccgaacacuaaccgggccuggaauagccuggagguggaggauuacgguuucgggguguucacgaccaacaucuggcucaagcugcgcgaggagcaggacguauuuugcgauuccaagcugaugucagccgccaucaaggacaaucgggcggugcacgcggauaugggcuauuggaucgaguccgcccucaacgacacuuggaaaaucgagaaggcaucguucauugaagucaaguccugccacuggcccaagucacacacccugugguccaacggcgugcucgagagcgagaugauaauccccaaaaacuucgcaggacccgugagccagcacaacuaccguccgggcuaccacacccagacggcgggcccguggcaccucggcaaacucgagauggacuuugauuucugcgaagggaccacuguugugguaaccgaggacugcggaaauaggggaccgucccugcgcacgaccaccgccagcggaaagcucaucaccgaauggugcugccgguccugcacgcugccuccacuaagguaccguggcgaggacgguugcugguacggcauggaaauccguccucucaaggagaaggaggaaaaccuggucaacagccuggugaccgccggucacggccagaucgauaacuucucccuuggcgugcugggcauggcgcuguuucucgaggagaugcugcggacccgcguaggcacuaagcacgcuauccuauuaguggccgugagcuucgucacgcugaucacggggaacauguccuuucgcgaccugggccgcgugaugguaaugguuggggccaccaugacggacgacaucgguaugggugugacguacuuagcccugcuagccgcguuuaagguacgccccacguucgcagccgggcuccugcugcggaaacucaccagcaaggagcugaugaugaccacgaucgguaucguccugcucagccagagcacuaucccggagaccauucuggaguuaaccgacgcgcucgcccuggggaugaugguucugaaaauggugcgcaagauggagaaguaccagcucgccgucacgaucauggccauccugugcguuccuaacgccgucauccugcaaaacaccuggaagguaagcuguaccauacucgccguggucagcgugagcccccuguuccugaccagcucccaacagaaggcagacuggaucccacucgcguugacaaucaaaggccuuaacccaaccgccaucuuccucaccacccugucgcggacgaacaagaagcgcuccuggccgcugaacgaggccauuauggccguaggcauggucagcauccucgcguccagccugcugaaaaacgauauccccaugaccgggccccucguggccggugggcuguuaacagugugcuacguccucacgggacggucugccgaucuggagcuggagcgcgccgccgacgugaagugggaggaccaggcggagauaucagggagcuccccaauacuuagcaucacgaucuccgaggauggcagcaugucgaucaagaacgaggaggaagaacagacccugaccaucuugauccggacaggccuccugguaaucuccggucuguuuccugugaguaucccuaucaccgccgccgccugguacuugugggaggugaaaaagcagcgcgccggcgugcugugggacguacccuccccaccgccaguggggaaggcugagcuggaggacggagccuaccggaucaaacagaaggggaucuuaggguauucacagaucggcgccgguguguacaaggagggcacguuccauaccauguggcacgucaccagaggggccgugcugaugcauaagggaaagcggauagagcccagcugggccgacguaaagaaagaucugaucuccuacgguggcggcuggaagcucgagggggaguggaaggaaggagaggagguacaagugcuggcucuggaaccggggaagaauccgcgagccgugcagacaaagcccggacucuuuaaaacgaacgccgggacaauaggcgccgucagcuuagacuucucacccggcaccagcgggagccccaucaucgaccggaaggguaaggugguggggcuguauggcaacggcgucgugacccgcucuggggcuuacguaagugcgauagcacagacagaaaaguccaucgaggacaaucccgagaucgaggacgacaucuuccggaaacgaaagcucaccauuauggaccugcacccuggcgcugggaaaaccaaacgguaccugccagccaucguucgcgaggcgauaaagcggggccuccgcacccucauacuggccccgacgagagugguggcagccgaaauggaggaggcccugaggggcuuacccauucgcuaccagacccccgccaucagagccgagcacaccggccgcgagaucgucgacuugaugugucacgccaccuucacaaugcgccugcucagcccagugcgcgugccgaacuacaacuugauaaucauggacgaggcccauuucacagacccugcuuccaucgcggcccggggauacaucucuacccgcgucgaaaugggagaggcagccggcauauucaugaccgcuacgccacccggauccagagacccguuuccgcagagcaacgccccgaucauggacgaggagagagagauccccgaacgguccuggagcucuggucacgagugggugaccgacuucaagggcaagaccgugugguucguuccgagcauacgcgccggcaacgacaucgcugccugccugcggaagaacggcaagaaagugauccaacucucucguaaaaccuucgauagcgaguacgugaaaacgcggaccaacgacugggacuucguugugaccaccgacaucuccgaaaugggggcgaacuuuaaggccgagcgcgugauugacccuaggagaugcaugaagcccguuauccugacggacggcgaggagcggguaauauuagccggacccaugccggugacccacagcucagccgcgcagcggcggggccgcaucgggcgcaacccuaaaaaugagaacgaccaguacaucuauaugggugagccccucgaaaacgacgaagacugcgcgcauuggaaggaggcaaagaugcuacuggacaacauuaacaccccagagggcauaaucccgagcauguucgagcccgagcgggagaaggucgacgccaucgacggggaguaccgccuucgcggcgaggcgcgcaagaccuucguggaucugaugcgucgcggggaccuacccguguggcucgcuuaucgggucgccgccgaaggcaucaacuacgccgacagaagguggugcuucgacgggauaaagaauaaccagauccuggaagagaacguggaagucgagaucuggacaaaggagggcgagaggaagaagcugaagccgcgguggcuggacgcccgcauuuacagcgaccccuuagcccugaaggaguucaaagaguucgcggcugggcgcaaaucgcucaccuuaaaccugaucaccgagaugggacguuuaccgaccuucaugacgcagaaggccagggacgcccuggacaaccuggcgguucuccacacggccgaggcaggagggcgcgccuacaaccacgcccugucugagcuucccgagaccuuggagacccugcuguuguugacgcugcucgcgaccgugaccggcggcauuuucuuguucuugaugagcgggcgugggaucgggaagaugacccucggaaugugcugcaucaucaccgccuccaucuuguugugguacgcccagauccagccucauuggaucgcagcuagcaucauccuugaguuuuuccugaucgucuuacucauccccgagccagagaagcaacgaacgccucaggauaaccaguuaaccuacguggugaucgcgaucuuaaccgucguggccgccacaauggccaaugagaugggguuucucgagaagacgaaaaaggauuuaggacucggcagcaucaccacccagcaaccggaauccaacauacuagacaucgaccugcggcccgccagcgcuuggacccuguacgccguggccaccacguucgucaccccaaugcuccgacauucuauagaaaacagcuccgugaacgugucccucaccgcuaucgccaaccaggcgaccgucuugauggggcucggaaagggguggccccuguccaagauggacaucggggugccguuacucgcuaucgggugcuacagccagguuaauccaaucacacugaccgccgcccuauuccuccuggucgcacacuaugccauuauuggaccuggucuccaagcaaaggccacacgggaagcgcagaaacgcgcggcugccgggaucaugaaaaacccgaccguggacggcaucaccguaaucgaccucgacccgauccccuaugaucccaaguucgagaaacaacuggggcaagucaugcuacucgugcugugcguaacccagguucugaugaugcgcacuacuugggcccucugcgaagcccuuacccuggcgaccggaccgaucucuacccucugggaagggaacccgggccgguuuuggaacacgaccauagccgugucaauggccaacauuuuucgugguuccuaccuggccggagccggccuccucuucucgaucaugaagaauaccaccaauacgcggcgcgggacuggcaacaugggcgagacccugggggaaaaguggaagucccgacugaacgcucugggcaagagcgaguuucagaucuacaagaaauccgggauccaggaaguggaccgcaccuuggcaaaggagggcaucaaaaggggcgagacagaccaccaugccgucagccgcggcagugccaaguugcggugguucguggagcgcaacauggugacccccgagggaaaggucguggaccucgggugcggucgcgggggauggagcuacuacugugggggacugaagaacgugcgcgagguuaagggccucaccaagggcggcccugggcacgaggagcccaucccgaugucaaccuacggcuggaaccucguccggcugcaguccgggguggacguguucuucacgccgccagaaaagugcgacacacuacucugcgauauuggcgagucuuccccaaauccgaccguugaggcgggccgaacucugagggugcuaaaccucgucgaaaacuggcugaacaacaacacccaguucuguaucaaggugcugaaucccuacaugccgucugugaucgagaagauggaggcguuacagcgcaaguacgggggcgcucugguccggaacccgcugagccgcaacagcacccacgagauguacugggugagcaacgccucugggaauauugugucgagcgugaacaugaucucccggaugcuuauuaaccguuucaccaugaggcacaaaaaggccaccuucgagcccgacguggaccugggcagcggaacccguaacaucggcaucgagagugagauccccaaccuggacaucaucggcaagcgcaucgagaaaaucaaacaggaguaugagacgagcuggcacuacgaccaggaccaccccuacaagaccugggcguaccacggguccuacgagaccaaacagaccggaagcgcauccucuauggugaacgggguggugcgacugcucacgaagccgugggacguaguccccauggugacgcagauggccaugaccgacaccacgcccuucggacagcagcguguguuuaaagagaaggucgacacccgcacccaggagccgaaggaggguaccaagaagcugaugaaaaucacggccgaguggcuguggaaggaacucgggaagaagaagaccccgcgcaugugcacgcgggaggaguucacgcgcaagguccgguccaacgcggcguugggcgccaucuucacggacgaaaacaaguggaaguccgcccgcgaggccgucgaggacucccgcuucugggagcuaguggacaaggagcgcaaccuccaccuggaggggaagugcgagaccugcguauacaacaugaugggcaaacgggagaagaaacugggggaguucggcaaggccaaaggcagccgcgcgaucugguacauguggcucggggcccgguuccuggaguuugaggcccucggcuuucucaacgaggaccacugguucagccgugagaacucccugucaggggucgaaggcgagggguugcacaaacuaggcuacauccuucgggauguguccaaaaaggagggcggugcgauguaugcggacgacaccgccggcugggacacccgcaucacgcuggaagaccucaagaacgaggaaauggugaccaaccauauggagggggagcacaagaaacuggccgaggccaucuucaagcugaccuaccagaacaaggucgugcggguacagcgcccgacgccccgggggacgguuauggacaucaucagccgccgcgaccagcgggggagcggccagguaggcaccuacgggcucaacacguucaccaacauggaagcacagcugauccgccagauggagggcgagggggucuucaagaacauccaacaccuuacggucaccgaggagauagcgguccaaaauuggcuggcccgagugggcagagagcggcugagccgcauggccaucaguggugacgacugcgucgugaagccccuggaugaccgguucgccagcgcccucaccgcgcugaacgacauggggaaggugcgcaaggauauccagcaaugggagccaucccggggcuggaacgauuggacccagguuccguuuuguagccaccacuuucacgagcucaucaugaaggacgggcgugugcucgucguccccugccggaaccaagacgagcugauaggacgugcgcggaucucucagggggccggguggagccugcgcgagacggccugccucggcaaguccuacgcucagauguggagccugauguacuuccaucgccgcgaccugcgcuuggcagcuaacgccaucuguuccgccgugccuagccacugggugccgaccucacgcaccacuugguccauccacgccaagcacgaauggaugacgacggaggauaugcugaccguguggaaccggguguggauccaggagaaccccuggauggaagacaaaacccccgucgaguccugggaggagauacccuaccuggggaagagggaggaccaguggugcggcucacucauagggcugaccucucgcgcgacgugggcaaagaacauccagacugccaucaaccagguccggucccugaucggcaacgaggaguacacggacuacaugccuucgaugaagcgcuucagacgcgaggaggaggaagccggggugcucugguga

SEQ ID NO: 24836 - RNA, 9876 nt, Artificial Sequence
  derived and/or modified CDS sequence (opt11) from DENV-2__KF704355__SS-prME
acagccgggaugauuauuaugcuaaucccuaccgugauggcguuccaccucacgacccguaacggagagccgcacaugauagucaguagacaagagaagggcaagagcuuacucuucaagaccggcgacggcguuaacaugugcaccuuaauggcgauggauuuaggggagcugugcgaggauacuauuaccuacaaauguccuuuucuccggcagaacgaaccugaggacauugauugcuggugcaacuccacguccacgugggugaccuauggaaccugcacuacaacgggcgagcaccgcagagagaagaggagugucgcgcucgugccccacguggggaugggccucgagacccgcacugaaacauggauguccuccgagggagccuggaaacacgcacagcggaucgagacguggauacugcggcacccgggcuucacgaucauggcugcgauccucgccuacacuaucggcaccacucacuuucagcgggcgcugauauuuauacuccuuaccgccguagcgcccuccaugaccaugagaugcaucggcauuucgaaccgggacuucguggaaggggugagcgguggcuccuggguggacaucguuuuagagcacgggucuugcgugaccaccauggcaaagaacaagcccacccuagaccuggagcugauuaagacugaggcgaaacagccggcaacguuacggaaauauugcaucgaggccaaguugacuaacaccacaacugagucgcguugcccgacucagggcgaaccuucccuuaacgaggaacaggacaagcgauuuguuugcaagcauagcaugguggaccgggggugggggaacgggugcggcuuguucggcaagggguccaucgugacuugugccauguuuacgugcaagaaaaucaugaaggguaaggucguacagccggaaaaccuggaguauacgauagugaucacgccgcauagcggagaagaacaugcagucggcaacgacaccggaaaguacggaaaggagauuaagaucacaccucagagcaguauuaccgaggccgagcuuaccggguacgguacggugaccauggaguguagcccacguacuggcuuagauuuuaaugaaaugguccugcuucagauggaggacaaggcguggcucgugcaucgacagugguuucuggaccugccccuccccuggcugccgggagcggauacccaaggguccaacuggauucagaaagagacgcuggugaccuuuaagaacccucacgcuaagaagcaagacguggucguuuuaggcucucaggaaggggccaugcauacggcccugaccggagccacggaaauacagauguccucagggaacgucuuguucaccggccaccucaagugucgcuugcggauggacaaacugcagcucaaaggcaugagcuauucuaugugcaccgggaaguucaagguaguuaaagagauagcggagacccaacacggaacuaucgucauccguguucaauaugagggggauggcucccccugcaagauccccuucgaaauuauggacuuagagaagagacacguacugggcaggcucauaaccguuaauccuauaguuacagguaaggacagccccgugaauaucgaggcggagccgcccuucggugacucguacaucaucaucggaguggaacccggccaacugaagcuaaauugguucaaaaagggaagcucaaucggccagauguucggaaccacuaugcggggugccaaaagaauggcaauccucggcgauaccgccugggacuucgggucgcuuggcggcguauucaccuccaucggcaaagcccuacaccaaguguuuggcgcgauauacggggccgccuucagcggcguuagcuggaccaugaagauacuaacagggguaauuaucacguggaucgguaugaacagccgcuccacuucucugagugucucccugguccuaguggguguugucacgcuuuaccugggagugaugguccaagcggacucaggcugugucgucagcuggaagaauaaagagcugaagugcgguucgggcaucuuuauuacggacaacguccauaccuggacugagcaguacaaguuccaacccgagucccccucgaaacucgcgucggcuauccagaaggcgcaugaggaagggaucugcggcauccgcucagucacgcgccuggagaaccuaauguggaagcaaaucacucccgagcuuaaccauauacuuagcgagaaugaagucaaacugacuaucaugaccggggauaucaagggcaucaugcaggccgguaagagaucucuccgcccacagccuacggaguuaaaguauuccuggaaaacuuggggaaaggccaagaugcugagcaccgagucacacaaucaaacuuuccugauugacggccccgaaacagcggagugccccaauacgaaucgugcguggaacagucuggagguggaggacuacggguucggcgucuuuaccaccaacauuuggcugaagcuccgugagaagcaggacguguucugcgacuccaagcuuaugagcgcagccauaaaggacaaccgugcugugcacgcggauaugggcuacuggauugagucagcucugaacgacaccuggaagauagagaaggccuccuucauagaggucaagagcugccacuggccuaaaagccacacguuauggucaaauggcgucuuggaaucggaaaugauaauccccaaaaacuucgccggcccugucagccaacacaacuaccguccuggguaccacacucagacggcaggccccuggcaucuggggaaguuagagauggacuucgacuucugugaagguaccaccgugguggugacagaggauugcggcaaccgcgggcccucccugcgcacuaccacugcgagcggcaagcuaaucacggagugguguugccgaaguugcacccuaccaccccuccgauaccgcggggaggacggcugcugguacggaauggagauccgcccccugaaggagaaggaggagaacuuagucaacucucucgugacggcgggccacggccagaucgacaacuucagccuggggguucucggcauggcacucuuucuggaggaaaugcuccggacccgcgucggcacgaagcaugcaauccuguuagucgcagugagcuucgucacccugaucaccggcaauauguccuuuagagaucuggggcgagucauggugaugguaggagccacgaugaccgaugacauaggcaugggggucacguacuuagcccuccuggccgccuucaaagugcggccgacguucgcugccggcuugcuccugcgcaaacuaaccagcaaggagcucaugaugacaacuaucggcaucguccugcugucgcagaguacgauccccgaaaccauacucgagcucacggacgcccuggcucucggcaugaugguucugaagauggugcgcaaaauggagaaauaccagcuggcggucaccauuauggcgauccucugcgugccaaacgccgucaucuuacagaacgccuggaagguguccuguaccauccuggcugucgugagcgugagcccucucuucuuaaccuccucacagcaaaaggccgacuggaucccguuggcgcucacgaucaagggccugaaccccaccgcgaucuuucucacaacccuuagccggaccaauaaaaagcggucauggccgcucaaugaagcgauaauggccgugggcauggugagcauccuagcaucgucgcuccugaagaacgauauccccaugaccggaccccuuguggccggcggucuucugaccguaugcuacguccuaacugggagaagugccgacuuggaacuugaaagggccgccgacguaaagugggaggaccaggcggagaucagcggcucaagcccgauucugagcaucaccaucucagaagacgguucuaugucaaucaaaaacgaggaagaggaacagacacucaccauacugauccggaccgggcuuuuaguaaucuccggccuguucccggucuccauuccaaucaccgccgccgccugguaucugugggaggugaagaagcaaagagcugggguguuaugggacguccccucucccccuccagucggcaaggcagaacuggaggacggggccuaccggaucaagcagaaaggcauccuaggauacucccagauaggagccggcgucuacaaggagggaaccuuccacacaauguggcacguaacgcgcggcgccgugcucaugcacaaggggaaacgaaucgagcccucgugggcggaugugaagaaggauuuaaucuccuauggcggcgguuggaagcuggagggugaauggaaggagggggaagaaguccaggugcucgcgcuggagcccggcaaaaaucccagagccgugcaaacuaaacccgggcuguucaagacgaacgcaggcaccaucggggccgucucgcuugacuuuuccccuggcacaagcggcagucccaucaucgaccggaagggaaaggucgugggccuguacggcaacggcguagugacaagauccggugccuauguguccgcgaucgcccaaacggagaaaucaaucgaggauaaucccgagauugaagacgauauauuccguaagcgaaagcugacgaucauggaccuccaccccggagcagggaagaccaaacgcuaccugcccgccauagugcgggaggcuauuaaacggggacuccgcacccugauacuggcucccacgcgggucguggccgccgagauggaagaggcccugcgggggcugcccaucagguaccagacccccgcgauacgggcugagcauaccggccgagaaaucguggaccucaugugccacgccacauuuacuaugcggcugcugagccccguacguguucccaacuacaaccucaucaucauggacgaagcucacuucaccgaccccgccucgaucgcagcccguggguacaucaguacucgcgucgagaugggcgaagccgccgggaucuuuaugaccgccacgccgccugggagucgggacccguuuccccagaguaaugccccaauuauggacgaggaaagggagauucccgagagaagcuggagcuccgggcaugagugggugaccgacuuuaagggcaagaccguuugguucgugccgagcaucagagcaggaaacgauaucgcggcaugcuugcggaagaaugggaagaaagugauccaacugucccggaaaaccuucgacagcgaauaugucaagacacgcaccaacgacugggacuucgucguaacaacugacaucucagaaaugggcgcgaauuucaaggcagagagggugauagauccccggaggugcaugaaacccgucauucuaacggacggggaagaacggguuauccuggccgggccgaugccugucacccacaguagugcugcccagcgccggggaagaaucggucgaaacccuaagaaugagaacgaccaguacaucuacaugggcgagccccuggaaaacgacgaggacugcgcacacuggaaggaagcuaagaugcuccuggacaacaucaauacacccgaagggaucaucccgagcauguuugagccugagcgggaaaaggucgaugccauagacggagaguaccgucuccggggggaagcucgcaagaccuucguagaccucaugagaagaggggaucuacccguguggcuugcuuaucgugucgcagccgagggcauuaacuacgccgaucggcgguggugcuuugaugggaucaagaacaaccagauccucgaagagaacguggaagucgagaucuggacaaaggagggagagcgcaagaaacugaagccccgguggcuggacgcucgcauuuauuccgauccccucgcccucaaggaguuuaaagaguuugcugcggggaggaagucgcugacuuuaaauuugaucacggagaugggcagguugcccaccuucaugacacagaaggcacgggaugcccuagacaaccuggcggugcuucacacugccgaggccgggggccgcgcauacaaccacgcccucuccgaguuaccggagacccuggagaccuuacuguugcucacguugcuggcgacugugacaggcgggaucuuucuguuccuaaugagcggacgggggauuggcaaaaugacgcuagggauguguugcauuaucacagccucgaucuugcugugguacgcccagauccagccccacuggaucgccgccaguaucauacuggaguucuuccucaucguccugcugaucccugagccugaaaagcagcgcaccccacaggacaaucaguuaaccuauguagugaucgccauccuuacugucguagccgcaacgauggccaaugagaugggauuccuagaaaaaacgaaaaaggauuuaggacuugggagcauaaccacgcaacagccggaguccaauauauuggacaucgaucuccggcccgcuucggcauggaccuuauacgccguggcaacuaccuuuguuacuccuaugcugcgucacagcaucgagaauuccagcgugaacgucucucuaacagccauugccaaccaggcgacgguucugaugggccuugguaaaggcuggccccucaguaagauggacaucgggguaccgcugcuugccauaggcugcuacucacaaguuaacccaauaacccucacugccgcccuauuccucuuggucgcgcauuacgcuaucaucggcccgggccugcaggccaaagccacacgggaggcccaaaaacgcgcggccgcaggaaucaugaaaaaccccacgguggacggcaucacugugauagaccuggacccaaucccguaugaccccaaguuugagaagcagcucggucagguaaugcugcuaguauuaugugugacccagguccugaugaugagaaccacgugggcccugugcgaagcccucacacuggcaaccggacccaucaguacgcugugggaagguaaccccggucgguucuggaacacaaccaucgccgugagcauggccaacaucuuccgcgggucguaccuugccggcgcggggcugcuguuuagcauuaugaaaaauaccacaaacaccaggagaggaacgggaaacaucggggagacccucggcgagaaguggaaaagucgguuaaacgcgcugggcaaaucugaguuucagaucuacaaaaagagcgggauccaagagguggaccgcacccucgcuaaggaggguauaaagcggggcgagaccgaccaccaugcugugucccgcggcuccgccaagcuccguugguucguggagagaaacauggugaccccagaggguaaggugguagaccugggcugcgggcgggggggguggagcuacuauugcggaggccuaaaaaacgugagagagguuaagggauuaaccaagggcggcccgggacaugaggagcccaucccgauguccaccuacgguuggaaccugguuaggcuccaaagcgggguggacguuuucuucaccccgccugagaagugcgacacccugcugugugacaucggggagaguucgcccaacccgaccguggaggccgggcgcacucuccgagugcugaaccugguggagaacuggcucaacaacaauacacaguucuguaucaagguauugaacccuuauaugcccagcguaaucgagaagauggaagcacugcaacggaaguacggaggggcccucguacggaacccccuauccaggaacagcacgcacgagauguacuggguguccaaugcaagcgguaauauugugucaagugucaacaugauuucaaggaugcuaauaaaucguuuuacuaugcgucauaagaaggcaacauaugagcccgacguagaccuggguagcgguacacggaacaucggcaucgagucagagauccccaaucucgacaucaucgguaaacgcaucgagaaaaucaaacaggaauaugagaccagcuggcacuaugaccaagaucaccccuacaaaaccugggcauaccacggcucguacgaaacaaagcagacuggguccgcauccucgauggugaacggcgugguccggcugcuuacgaaacccugggaugugguacccaugguaacccagauggcuaugaccgauacuacgccauuuggccagcagcggguuuuuaaggagaaggucgacacccgaacucaggaaccgaaggaaggcaccaagaaauugaugaagauaacugcagaguggcuguggaaggagcugggcaagaaaaagaccccgcguauguguacgcgggaagaauucacccgcaaagugcgcucaaaugcugcucuaggagcaauauucacugacgagaauaaguggaagucggcccgcgaggccguagaggacucgagauucugggagcuggucgauaaggagcgcaacuugcaccuugaaggaaaaugcgaaaccugcguguacaacaugauggggaagagagagaaaaaacugggcgaguucggcaaggccaaagggucgcgcgcgaucugguauaugugguugggggccagauucuuagaguucgaggccuugggguuccugaaugaggaccacugguucucgcgcgagaacucccuaagcgggguugagggggagggacugcacaagcugggguauauccuccgagauguauccaagaaggaggguggggcuauguaugccgaugacacggcugguugggauaccaggaucacgcuugaagaucuuaagaacgaagagauggugaccaaccacauggaaggcgagcacaagaaacucgcggaggccaucuucaaacugaccuaucagaacaaggucgugcgggugcagcggcccacgcccagagggaccgucauggacaucaucagccgccgcgaccagcgcggcuccggucagguggggaccuacggguugaacacauucaccaacauggaggcgcaguugauuaggcagauggagggcgaggguguguuuaagaacauccagcacuuaacggucaccgaagaaaucgccguucaaaacugguuagcccggguaggcagagagaggcucagcagaauggccaucagcggagacgacugugucguuaaaccguuagaugaccgguucgcaagcgcccugaccgcccucaaugacaugggcaagguucggaaggacauucaacagugggagcccagccguggcuggaacgauuggacccagguccccuucugcucacaucacuuccaugagcucaucaugaaagacggccgcguuuuagugguccccugcagaaaccaagacgaacucaucgggcgcgccaggaucucgcagggcgcugguuggagccuccgcgagacugcaugccuggggaagagcuaugcccagauguggagccugauguacuuccaccggcgcgaucugcggcuagccgcuaacgccaucugcuccgcagucccaagccacuggguuccuaccucacgcaccaccuggagcauccacgccaagcaugaguggaugacgacagaggacauguugacaguuuggaaccggguguggauccaagaaaaccccuggauggaggacaagaccccaguggagagcugggaagagauacccuacuuggggaaacgcgaagaccaguggugcgggagucugauagguuugacaagccgcgcgacgugggcgaagaauauacagacggcaaucaaccaaguccggucccugauuggaaacgaggaguacaccgacuacaugcccagcaugaagagauuccgucgugaagaggaagaagcgggcgugcuaugguaa

SEQ ID NO: 24837 - RNA, 9876 nt, Artificial Sequence
  derived and/or modified CDS sequence (opt11) from DENV-2__KF704354__SS-prME
acugccgggaugauaauaaugcugauuccaacuguaauggccuuccacuuaacuacgcgaaacggggagccccacaugaucguuagcagacaggagaaagggaagagccugcuguucaagacagaagacgggguuaacaugugcacccucauggcgauggaccuaggagaacugugcgaagacaccauaacuuacaagugucccuuccuccgccagaacgagcccgaggacaucgacugcugguguaacagcaccuccaccugggugacuuacgggacuugcaccaccacgggcgagcaccggagagagaagcggagcgucgccuuggugccccacgugggaauggggcuugagacccggaccgaaaccuggauguccagugagggcgcguggaagcacgcucagcggaucgaaacguggauucugcgccaccccggauucaccaucauggccgcuauccuggccuacaccaucggcaccacgcauuuccagcgggccuuaaucuuuauucuauugacugccgucgcgccuagcaugaccaugcgaugcauugggaucagcaaccgggacuuuguagagggaguguccggcgggagcugggucgauaucguccuggaacacggauccugcgucaccaccauggcuaaaaacaagccgacccuugacuucgagcugaucaaaaccgaggccaagcaacccgcaacgcugcgcaaauacugcauagaagccaaguuaacuaauacgaccaccgaaagccggugcccuacgcagggggagccuucccugaacgaggagcaagacaagcgcuucgucugcaagcacagcaugguggaccgggguuggggcaaugggugcgggcuguucggaaagggaggcauaguaaccugcgcgauguucacguguaaaaagauuaugaaggggaaaguugugcagcccgagaaucuggaguacaccaucgugauaacgccccauuccggugaggaacacgcugucggaaacgacacuggcaagcacgggaaggagaucaagaucaccccgcagagcuccauuaccgaggccgagcugaccggauacggcacggugaccauggagugcagcccccgcacaggacuggacuucaacgagauggugcuucugcaaauggagaacaaggccuggcuuguccaucggcaaugguuccucgaccugccccugcccuggcuccccggagccgacacucaggggucaaacuggauccagaaggaaacauuagugaccuuuaaaaacccacaugccaagaagcaggacgucgucguccuuggcagccaggagggggccaugcacacggccuugacuggagcuacggaaauacagaugagcaguggcaacguccuguucaccggccaccuuaagugccgccuccggauggauaaacugcaauugaaaggcaugagcuacuccaugugcaccgggaaguucaagguggugaaagagaucgccgaaacccaacacgggacaauagucauccgcgugcaguacgagggugacgguagccccugcaaaauaccuuucgagaucauggaccucgagaagcggcacgugcugggcagacugaucaccguuaacccaaucgugacagggaaggacucucccgucaacauagaagcggagccacccuucggcgauagcuacaucauaaucggcguugagccgggccagcuuaaacugaacugguuuaaaaagggauccagcauaggccaaauguucgcgacaacaaugcguggcgccaaacgaauggccauccugggggacaccgccugggacuucgguuccuugggcggcguguucaccucgaucgggaaggcgcugcaccagguguucggcgccaucuauggcgccgccuucuccggggucagcuggaccaugaagauccugauuggaguuauaauaacguggaucgggaugaauucccgcucaacgucucuuagcguaucccuggucuuaguuggcguggucacccuguaucuagguguaauggugcaggcggacuccggcugcguuguguccuggaagaacaaggagcugaagugcggcagcgggaucuuuauuacagacaacgugcacacuuggacggaacaguacaaauuccagccagagucgcccuccaagcuggccucugcaauucagaaggcccacgaggaagguaucugugggauccggaguguaacccggcucgagaaccugauguggaaacaaaucacgcccgagcugaaccauauccucucugagaaugaggugaagcugacuaucaugaccggagacauuaaaggcaucaugcaagccggcaagcggagucugcggccgcagcccaccgagcucaaguauagcuggaagaccugggguaaagcgaagaugcugaguacggagucgcacaaucagaccuuccugaucgacggucccgaaaccgccgaaugcccgaacaccaacagagccuggaacuccuuggagguggaggacuacggcuuugggguuuuuacgacaaacaucuggcugaagcugcgugaggagcaagacgucuucugcgauagcaagcucauguccgcugcaaucaaagacaacagggcggugcacgccgacaugggcuacuggauugagagcgcccugaaugacacguggaagaucgagaaggccuccuucaucgaaguaaaaagcugucacuggccgaagucccacacacuuuggagcaacggcguuuuagagucugaaaugaucauacccaaaaacuucgcgggucccgugagccagcacaacuaccgcccugguuaccacacccaaacggcugggccguggcaccuggggaagcuggagauggauuuugacuucugcgagggcaccaccgucguggucaccgaggacugcgggaaccggggcccgagccuccgcacgaccacugccuccgggaagcugaucaccgaguggugcugcagaagcugcacgcugcccccgcucagguaucgaggcgaggacgggugcugguauggcauggagauccgcccccugaaagagaaggaggagaaccuggucaacagccucguaaccgcgggccacggccagaucgauaacuucucacucggagugcuggggauggcccucuuucuggaggagaugcuacggacccgagucgguaccaaacaugcgauacucuuaguggccguguccuucgucacgcugaucacugggaauaugagcuucagagaucucgggcgcgucauggugauggucggggccacaaugaccgacgacaucgggaugggcgugacguaccucgcccugcucgccgcguucaaagugcgccccaccuucgccgcagggcugcugcugaggaagcugacauccaaagaacucaugaugaccaccaucgggaucgugcugcugagccaauccacgauccccgaaaccauccuggaacuaacagacgcccuggcccuaggcaugauggugcuuaagauggugcgcaagauggaaaaguaccaguuggcagucacgaucauggccauucucugcgucccgaacgcggucauccuccaaaacacguggaaggugagcugcaccauccuggccguggucuccguuagcccccuuuuccuaaccuccagccagcagaaggcugauuggaucccuuuggcgcugacgaucaagggccucaaccccacagccaucuuccugacuacccugucuaggacgaacaagaagcgcaguuggccgcuuaacgaggccauaauggccgugggcauggucucgauuuuagcgucgucucugcucaagaacgacauccccaugaccgggccccuggucgccggaggacucuugacuguguguuacgucuugacaggccggagcgccgaccuggagcucgagcgcgccgcagaugucaagugggaggaccaggcggaaaucagcggguccagccccauucuguccauuacgaucagcgaagauggauccaugagcauaaaaaacgaggaggaggagcaaacgcugacgauccucauccggaccggccuucucgugaucuccggcuuauuuccggucaguaucccuaucacugccgcugccugguaccuaugggaggugaagaaacagcgcgcagggguacugugggacgucccaagcccgcccccuguggggaaggcggagcucgaggacggcgcuuacaggaucaagcaaaaggggauacugggguacucucagaucggcgccgggguguauaaggaggggaccuuccacaccauguggcacgugacccgaggggccgugcuaaugcacaagggcaagcggauugagccgucuugggccgacgugaaaaaggacuuaaucaguuaugguggcggcuggagacuugagggcgaguggaaggagggggaggagguucaggugcucgcgcucgagcccggaaagaaucccagggccguacagaccaagcccggccuguucaaaacgaacgcuggaaccaucggcgccgucagccuggacuuuucacccgguaccuccgggagccccaucaucgacaagaaggggaagguggucgggcucuacggcaacggcguagugacgcgauccggggccuacgugagcgcaauugcccagacggaaaaauccauugaggacaacccagaaaucgaggacgacauuuuucguaagcguaagcugaccauuauggauuugcaccccggcgccgggaagacgaaacgguauuugccggcgaucgugcgcgaggcgauuaagcggggccugagaacccuuauccuggcaccuacgcgggucgucgcugccgagauggaagaggcccucagagggcugcccauacgcuaccaaacgcccgcgauacgugccgagcacaccggccgcgagaucgucgacuugaugugccacgccaccuucacgaugagacuccugagccccguacgcgugccgaacuacaauuuaauaauaauggaugaagcccacuucacugaccccgccagcauugcugcccggggcuauauaaguacgcgggucgagaugggggaagccgcagggauauucaugaccgccacgccgccgggcagucgagacccguucccccagucuaacgcgcccaucauggacgaagagcgugagaucccggagcgguccuggucgucuggccacgaguggguuaccgacuuuaaagggaagaccgugugguucguaccgaguauuaaagccggcaacgacaucgccgccugcuugaggaaaaacggcaaaaaagugauccaacuuucgcggaagaccuucgauuccgaguaugugaagacacguacaaacgacugggacuucgucgugaccaccgacaucucagagaugggagcaaacuucaaggccgagagaguaaucgacccccgcaggugcaugaaacccgucauccuuacggacggcgaagagagagucauccuggccgggcccaugccgguaacccacuccucggcagcccagcgacgggggcggauagggcgcaaccccaagaaugaaaacgaccaauauaucuauaugggugagccacuagagaacgacgaggacugcgcucacuggaaagaggccaaaauguugcucgacaacaucaacacgcccgagggcaucaucccgucuauguucgagccagagcgcgaaaaggucgacgcgaucgacggggaguaccgauugcgcggcgaagcccggaagaccuucguggaucugaugaggcgcggggaccucccagugugguuagccuaccgcguggcggccgaaggcaucaacuacgccgaccggcgcuggugcuucgaugggaucaagaacaaccagauccuugaggagaacguggagguggagaucuggaccaaggaaggcgaacggaagaagcucaagccucgcuggcucgacgcucggaucuauucugauccacuggcccucaaagaguucaaggaguucgcugccggccguaagucccuuacccuaaaucuaaucaccgaaaugggacgccugcccacguuuaugacgcagaaagcccgcgacgcccuagacaaucucgcggugcugcacacagcagaggccggaggucgagcuuacaaccaugcccuuucagagcuccccgagaccuuggaaaccuuacucuuacugacgcuucuggcgacagugaccggcggcauauuucucuucuugaugucuggaaggggaaucggaaagaugacccugggcaugugcugcaucaucacagccucgauccugcucugguacgcccagauccagccgcacuggaucgccgccuccaucauccuggaguuuuucuugaucguccugcugauacccgagccggagaagcagcggacgccccaggauaaucagcuaacauacguagugaucgcgauccuuaccgucguggcugccacuauggcuaacgagaugggguuccuggagaagacgaagaaggaccugggcuggggcucgaucaccacccagcaaccggagagcaacauccuggacauugaccugcgcccugccucugcguggacccucuaugccguggccaccaccuuuguuacgcccaugcugcggcacucgaucgagaauucaagcguaaauguuucccugaccgccaucgccaaccaagccacaguccugauggggcucggcaaaggguggccccugagcaaaauggacaucggcgugcccuugcucgcaaucggcugcuacucccaagugaaccccauaacucugaccgccgcacuguuccuccuggucgcucacuacgcgaucaucggcccaggccuccaggccaaggccacgcgcgaggcccagaaacgcgcggccgccgggaucaugaagaaccccacagucgacggcaucaccgucaucgaccucgacccuauccccuacgacccuaaauucgagaagcagcuuggccaggucauguuauuagugcugugcguuacccagguccucaugaugaggaccaccugggcccucugcgaggcacugacacuggcgaccggcccgauuagcacauuaugggaggguaacccgggucgauuuuggaacacgaccauagccguguccauggccaacaucuuccgcggcagcuaccuugcuggugcuggacucuuguucaguauuaugaagaacaccaccaauacacgccgggggacagggaacaugggcgagaccuugggggaaaaauggaagagucgccugaaugcgcucgguaaguccgaguuccagaucuacaaaaaguccgggauacaggaaguggaccguacacuugccaaggaggggaucaagcgcggggagaccgaccaccaugccgucagccgaggcuccgcuaagcugcgcugguucguagagaggaacauggugacccccgaaggcaagguagucgaccuugggugcggacgcgggggcuggaguuauuacugugggggauuaaagaaugugcgggaggucaagggccugaccaagggcggaccagggcacgaggagcccaucccgaugagcaccuauggcuggaaucucgugcgccugcaaagcggggucgacgucuuuuucaccccgccggaaaaaugcgacacccugcucugcgacauuggggagucuagccccaauccgacgguggaagcgggucggacgcugcgcguguugaaccucguugagaauuggcugaacaacaacacccaguucugcauaaaggugcugaaccccuacaugcccuccguuaucgagaagauggaggcccuccagcggaaguacgguggggcgcuuguaaggaauccgcugagccggaauucaacgcacgagauguacugggugucgaacgcguccggaaauauugugagcucaguaaacaugaucagccgcaugcucauaaaccgauuuacuaugaggcauaagaaggcgacuuucgagcccgacguagaucugggcuccggaaccaggaauaucggcaucgaguccgaaauccccaacuuagacauuauaggcaagcggauugagaagauaaagcaagaauacgagacgagcuggcacuacgaccaggaccacccguacaagacaugggcguaccacgggucuuacgagaccaagcaaaccggcuccgccucauccaugguaaauggagucguacgguugcuuacgaaaccgugggauguggucccuauggucacccagauggcaaugaccgacaccacacccuucgggcagcaacggguauucaaagagaagguagauacucgaacacaggagcccaaggaaggcaccaaaaagcugaugaagauuacggcggagugguuguggaaagaacuaggcaagaagaagacgccacggaugugcacucgcgaggaguucacucggaaggugaggagcaacgccgcgcugggcgcuaucuucacggaugagaacaaguggaagucggccagggaggccguugaggacagcagauuuugggagcugguagacaaagaacgaaacuugcaucuggaggggaagugcgagaccugcguguacaacaugaugggcaagcgcgagaagaagcuaggggaauuuggcaaggccaagggcucgagggcaauaugguacauguggcuaggagcccgcuuccuggaguucgaagcacugggcuuccuuaacgaggaccacugguucagucgugaaaacagccuguccgggguggagggagaggggcugcacaagcucgguuacauccugcgcgacgucagcaagaaggagggcggagccauguaugcggacgacaccgccgggugggacacacgaaucacccuggaggaccucaagaacgaggagauggugaccaaccacauggagggugagcacaagaagcuggcggaggcgaucuucaaacuaaccuaccagaauaaggucguacguguucagcggccgacgccacgggggaccgucauggacauaaucuccaggagggaucaacgggggucaggccaggugggcaccuacgggcuaaauacguucaccaacauggaagcccagcugauucggcagauggagggcgagggaguguuuaagaacauccagcaucuuacgguaacagaggagaucgcggugcagaacugguuggcccgcgugggucgggagcgccugucccggauggcaaucucaggcgacgacugcguuguuaagccccuggacgaccgguucgccuccgcccugacagcgcugaacgacauggguaaggugcggaaggacauccagcaaugggagcccagccgaggguggaaugacuggacccaggucccauucugcucccaucacuuccacgagcucaucaugaaggacgggcgagugcucguuguccccugucgcaaccaggacgagcuuauuggccgggcccgcaucagccaaggggccggcuggucacugcgggagacugccugccucgguaaaaguuacgcgcaaauguggagucugauguacuuccaccggagagaccuaaggcucgccgcgaacgcgaucugcucggccgugccaucccacugggugccgaccucaagaaccaccugguccauccacgcuaaacacgaauggaugacaacggaggauaugcugacuguguggaaccgaguauggauacaagaaaaccccuggauggaagauaagaccccgguggaaaguugggaggagaucccguaccuggguaagcgggaggaucaauggugcggaagccuuaucgggcugaccuccagggcaacaugggccaagaacauucagaccgccaucaaccagguccguucacugauaggcaacgaggaguacaccgacuacaugccgucuaugaaaagauuucgcagggaggaggaggaggccggggugcucugguaa

SEQ ID NO: 24838 - RNA, 9876 nt, Artificial Sequence
  derived and/or modified CDS sequence (opt11) from DENV-2__KF704357__SS-prME
accgccggcaugaucaucaugcugauccccaccgugauggccuuucaucucaccacucggaauggcgagccgcacaugaucgucagccgccaggaaaagggcaagagccugcuguucaagaccggggauggcgugaacaugugcacacucauggcgauggaccugggggagcugugcgaggacaccaucaccuacaaguguccccucuuacggcaaaaugaacccgaagacaucgacugcuggugcaacagcacgucaaccugggugacguacgggaccugcaccacuacuggcgagcaccgacgcgaaaaacggucagucgcccuagugccccacguggguaugggccuggagacccgcaccgagacuuggaugucuagcgagggggccuggaagcacgcccaacggauugagaccuggaucuuacgccacccaggcuucacaaucauggccgcgauccuggcguacacgauagguaccacgcacuuccaacgggcccucaucuucauccuucugaccgccguagcccccuccaugaccaugcgcugcaucggcaucucuaaccgggacuucguggagggaguguccgggggaagcugggucgacaucguguuggaacacgggucgugcguuaccacgauggccaaaaacaagcccacccuggaccuggagcucaucaagaccgaagccaagcaacccgccacccugcgcaaguacugcaucgaggccaaguuaacgaacaccaccaccgagucucgaugcccgacgcagggcgaacccucccuaaacgaagagcaggauaaacgcuucgucugcaagcacagcaugguggaucggggcuggggaaauggcugcgggcuguucggaaaggggucuaucguaaccugcgcgauguucacgugcaagaagaucaugaagggcaagguagugcagcccgagaaccuugaguacaccaucgugaucacgccccacucuggcgaggagcacgccgucgggaacgacacuggcaagcacgggaaggagaucaagaucaccccgcaguccagcauuaccgaggccgagcucaccggcuacgggacggugaccauggaaugcagcccucggacaggccuggacuucaaugagaugguacuacuccaaauggaggacaaggccuggcuggugcaccggcagugguuccuggaucuccccuugccauggcugccgggagccgacacccaagguucaaauuggauucagaaggagacccucgugacuuucaagaacccccaugcgaagaaacaggaugucgucgugcuggggagccaagagggcgcgaugcacacggcccugaccggggcuacggagauccaaauguccagcgggaacguacucuucaccggucacuuaaagugccgccugcggauggacaaguugcagcugaaggguauguccuacagcaugugcaccgggaaauucaaggucgugaaggagaucgccgagacccagcacggcacaauugucauccgcgugcaguacgagggggacggcuccccaugcaagauccccuuugagaucauggacuuagagaaacggcacgugcuaggccgccugaucaccgucaauccgaucgucaccgggaaggacucccccgugaacauagaagcggagccgccauucggagacuccuacauaaucaucgggguggagccgggccaguuaaagcucaauugguucaagaaggggagcuccauaggccagauguucgcgacaacgaugaggggcgccaagcgcauggccauacugggagacaccgccugggauuuuggcagucucgggggcgucuucacguccaucgggaaggcgcuccaccaggucuucggcgcaaucuacggcgccgccuucaguggggucaguuggaccaugaagauauuaaucggcgugaucaucacguggaucgggaugaacagccguuccacuagccuguccguuagucugguccucgugggcgugguuacccuguaccuggggguaauggugcaggcggacucgggcugcgucgugagcuggaagaacaaggagcucaaguguggcagcgggaucuucaucacagauaacgugcacacguggacagaacaguacaaauuccagccugaguccccaucaaagcuagccuccgccauccagaaggcccacgaagaggggaucugcgggauccgaagcgucacgcgcuuagaaaaccucauguggaaacagaucacccccgagcugaaccauauccugagugagaacgaggugaagcucacgaucaugaccggggacaucaaagggaucaugcaggccggcaagcggagccugcgcccgcagcccaccgagcugaaguacuccuggaagaccugggggaaggcgaagaugcucagcacggagucccacaaccagaccuuccugauagacggacccgagacggccgagugcccgaacaccaaucgggccuggaacagccuugagguggaggacuacggauucggggucuucacgacaaacaucuggcucaagcugcgcgaggagcaggacguguucugcgacuccaagcuaaugagcgccgcuauaaaggauaaccgggccgugcacgccgacaugggcuacuggaucgaaagcgcgcucaaugacaccuggaagaucgagaaggccucuuucaucgaggucaaauccugccacuggcccaagucucacacccugugguccaacggcguucucgagucggaaaugaucauccccaagaacuuugcagggccugugucucagcacaacuaccgcccgggcuaccacacccagacggcggggccguggcaccucggaaaguuagagauggacuuugacuucugcgaagggacgacgguuguagugaccgaggacuguggcaaccggggcccuucccugcgcacgaccacugcgucugggaagcuaaucacagagugguguugucgcuccugcacguuacccccgcugcgcuaccggggcgaggacgggugcugguacggaauggagaucagaccccucaaggaaaaggaggagaaccuggucaacagccugguaacugccgggcacggucagaucgacaacuucucccucggggugcuggggauggccuuauuccucgaggagaugcugcggacuagagucggaaccaaacacgcaauccugcucguggcugugucuuucgucacucucaucacagguaacauguccuuccgggaccugggccgcguuauggucauggucggggcaaccaugaccgaugauaucggcaugggcgucacauaccucgccuugcuugcugcguuuaaggugcgcccaaccuucgcugccgggcuccuucugcggaagcuaaccuccaaggaguuaaugaugaccacgaucggcaucguccugcugucccagagcacuauaccagaaaccauccuugagcugaccgacgccuuagcccuagggaugauggugcuaaagaugguacgcaagauggagaaauaccaguuggcggucacgaucauggccauccugugcgugccaaacgccgucauccugcaaaacaccuggaaagugucuugcaccauccuugcaguggucagcgugucgccccuguuccugaccucaucccagcagaaggccgacuggaucccacucgcgcugacgaucaaaggccucaaccccaccgccauuuuccuaacaacucugucucggacaaacaagaagcgauccuggccgcugaacgaggcuaucauggccgucggcauggucucuauccucgcguccucucuucugaagaacgacauccccaugaccgggccgcucguggccggcgguuugcugacaguguguuacguccucaccggccggucagccgaccuggaacuggagcgcgccgccgacgugaagugggaggaccaagcggagaucuccggcagcucccccauccucucuaucacgauauccgaggacggaagcaugucaaucaagaacgaggaggaggagcagacccugacuauccugauccggacgggucuccuggugaucagcgggcuguucccggucucuauccccauuaccgccgccgcuugguacuuaugggaggugaagaagcagcgagcaggcgucuuaugggaugucccuucgccgccgcccgugggcaaggcggagcucgaggauggggccuaccggauaaagcagaaggggauccucggguacagccagaucggcgcggggguguauaaagagggcaccuuccacacgauguggcacgucacccguggggccguccucaugcauaaggggaagcgaauagaaccaagcugggccgacguuaagaaggaccugaucuccuacgguggcgguuggaagcuugagggcgaguggaaagagggcgaggagguccaggugcuggcccuggagccggguaagaaccccagagcaguccagacuaagccaggacuauucaagacgaacgccgggaccaucggcgcagucaguuuagacuucaguccuggcaccuccgggucucccauuaucgaucgaaagggcaaggugguggggcuguacggcaacggagucgugacccggagcggggccuacgucuccgcuauagcccagacggagaaauccaucgaggacaaccccgaaaucgaagacgacaucuuucggaagcgaaagcucaccaucauggaccugcaccccggcgccgggaagaccaaacgguaucugccagccaucgugcgcgaggcuauaaagcggggucugaggacccucauccuggccccuacgcgggugguggccgccgagauggaggaggccuugcgcgggcucccaauccgcuaccagacccccgcgauccgggccgagcacacaggccgcgagaucgucgaccugaugugucacgcgaccuucaccaugcggcugcucucccccgugcgcgugccgaacuacaauuugauaaucauggacgaggcccacuuuaccgacccagcuuccaucgcagcccggggauacaucagcacccgagucgagaugggggaggccgccggcaucuucaugaccgccacgccacccgguucccgggacccguucccccaguccaacgcgcccauuauggacgaggagcgugagaucccagagcgguccuggaguuccggccaugagugggucaccgacuucaaaggaaaaaccguaugguucguaccgagcauccgcgccggcaacgacaucgccgccugccuucggaagaauggcaaaaaggugauccagcucucccgcaagacuuucgacucggaguacgugaagacucggaccaacgacugggacuuuguagugaccaccgauaucuccgagaugggggcgaacuucaaggcggagcgggugaucgacccacggcguugcaugaagcccgucauccugacggacggugaagagcgggugauccuugcaggccccaugcccguaacacauagcucugccgcccagcgucggggccgcaucgggcgcaaucccaagaacgagaacgaucaguacaucuacaugggggagccccucgagaaugacgaggacugcgcgcacuggaaggaggcgaagaugcugcuggacaacaucaauacccccgagggcaucaucccgucgauguucgaacccgagcgagagaaggucgacgccaucgacggggaguaccgccuccggggcgaggcacgcaagaccuucgucgaccugaugagacgcggggacuuacccguguggcucgcguaccgggucgcggcugaggggaucaauuacgcggaccgccgcuggugcuucgacgggaucaagaacaaucagauuuuagaggagaacguggaggucgagauuuggacuaaagagggggagcgcaagaagcuuaagccgcgcuggcucgaugcccgcaucuacuccgaccccuuagcccucaaggaauucaaggaauuugcggccggacgcaagagucucacccugaaccugaucaccgagauggggcgccuccccaccuucaugacgcaaaaggcccgggacgcccuggacaaccuggcggugcuccacaccgcagaggcaggcggaagggccuacaaucacgcccuguccgaauuacccgagaccuuagagacccugcugcuccugacacugcucgcgaccguaaccgguggcauauucuuauuucuuaugagcgggcgggggaucgggaagaugacccucggcaugugcugcaucaucacggccucuauccuguugugguacgcccagauccagccacacuggaucgccgccagcauaaucuuggaguucuuccugaucguccugcucauccccgagccugagaaacagcgcaccccacaggacaaccagcugacguacguggugauugcgauccucacggucguugccgcuacaauggcgaacgagaugggguuccucgagaagacgaaaaaggaccugggccugggcagcaucaccacccaacagccagagagcaacauccucgauaucgaucugcggcccgccucugcguggacccuguacgcuguugccacgaccuucgucaccccgauguugcgccacuccauugagaauuccuccgugaacgucucgcugaccgccaucgcgaaucaggcaacggucuuaaugggacuaggcaaaggguggccgcugagcaagauggacaucggcgucccucugcuagcgaucgggugcuauagucagguuaaccccaucacccugaccgccgcccuguucuugcuggucgcgcauuacgccaucaucggccccggccugcaggccaaggccacccgggaggcccagaagcgagcggccgccgggaucaugaagaaccccacgguggacggcaucaccgugauugacuuggaucccauccccuaugaccccaaguuugagaagcagcuggggcagguuaugcugcucguccugugcguaacgcaggugcugaugaugcgcacgacgugggcccuuugcgaagccuugacccuagcgacaggccccaucuccacacucugggagggcaauccuggccgguucuggaauacgaccaucgccguuagcauggccaacaucuucagaggcucuuaucuggcuggugccggucuacuguucucaauaaugaagaacacgacaaauacgcggcgcgguaccgggaacaugggcgagaccuugggagagaaguggaagucccggcugaacgcgcugggcaagagcgaauuccagauuuacaagaagagcgggauccaggagguggaccgcacccuggccaaagagggaaucaagcgcggggaaacggaccaccacgcggucagccguggcucugccaagcugcggugguuuguagagcgaaauaugguaaccccugaggguaaggucguggaccucgggugcggccgcgggggcuggagcuacuauugcggggggcugaaaaacguacgggaagucaagggccugacuaagggcggacccggccacgaagagcccaucccgauguccaccuauggcuggaaccucguuagauuacagagcggcguggacgucuucuucacgccgcccgagaagugcgacaccuugcuaugcgacaucggcgagagcucccccaacccgaccguggaggccggucgcacccugcgcgugcugaaccucgucgaaaauuggcugaacaacaacacgcaauuuuguauuaaggugcugaaccccuacaugccuagcgugaucgagaaaauggaggcccuucagcgcaaguacgggggcgcgcugguccggaacccgcugucccgcaauagcacccacgagauguacuggguauccaacgccagcggcaauaucguuuccucugucaacaugaucucccggaugcugauuaaccguuuuaccaugcgccauaagaaggccacauucgagcccgacguugaccucggcuccgggacgcguaacaucggcaucgaaagcgagaucccaaaucucgacaucaucggaaaacgcaucgagaaaaucaagcaggaauacgagacgagcuggcacuacgaccaggaucacccauauaaaaccugggccuaccacgggagcuacgagacgaagcagaccgguagcgccuccucgauggugaacggggucgugagacuucucacgaagccaugggacguagucccuaugguaacccaaauggccaugacugacaccacgcccuucggccagcaacgcguguucaaggagaaagucgacacccggacccaagagcccaaggagggcacuaagaagcugaugaagaucacggcggaguggcuauggaaagagcucgguaagaagaagacuccgcgcaugugcacgcgggaggaguucacccgcaaggugcgguccaacgcagcgcugggagcaauuuuuacugaugagaacaaguggaaauccgcccgcgaggcuguugaggacucccgguucugggagcuggucgacaaagagcggaaucuccacuuggaggggaagugcgagaccugcguguacaacaugauggggaagcgugagaagaagcugggggaguucggcaaggccaagggaagucgcgcgauaugguacauguggcuuggcgcccgguuccuggaguucgaggcccugggcuuccucaacgaggaccacugguucagccgcgagaacucccugagcggggucgaaggcgaggggcuucauaagcucggcuauauccugcgugacguguccaagaaggaagguggggccauguacgcggaugacacugcuggcugggacacaaggaucacguuagaggaccucaagaacgaggaaauggugaccaaccacauggaaggggagcacaaaaagcuggcugaggccauuuucaagcucaccuaccagaacaaggucgugcgggugcaacgccccaccccacggggcacuguuauggacaucaucucucggcgugaccagcggggcuccggccagguuggcaccuacggucucaacaccuucacaaacauggaggcccagcuuauccggcaaauggagggcgaggggguguucaagaacauccaacaccugacugucacugaggagaucgcggugcagaacuggcucgcccggguaggccgcgagagacugagccgcauggccaucaguggcgacgacugugugguaaagccccuggaugaccgguucgccagcgcacugaccgcgcugaacgacauggggaaggugcgcaaggacauacagcagugggagccgucccggggcuggaacgacuggacccaaguacccuucugcucgcaccacuuccacgaacugauuaugaaggaugggcgcgugcucgugguccccugucggaaccaggacgaacugaucggccgcgcccggaucucccagggggcaggcuggucacugcgcgaaacggcaugccucggcaaguccuacgcccagauguggagcuuaauguacuuccaucggagagauuugcggcuagcggccaaugcaaucugcuccgcugugcccagucauugggugccgaccucccgaaccacauggagcauccacgccaagcacgaguggaugacuacggaagauaugcugacuguguggaaccggguguggauccaggagaauccauggauggaggacaagacccccguggaauccugggaggagauccccuaccuggggaagcgcgaggaccagugguguggcucccucaucgggcugaccagccgcgcgacuugggccaaaaacauccagaccgcaaucaaccaaguccgaucccugauaggcaacgaggaguauacggacuacaugccuucuaugaagcgcuuccggcgcgaggaggaagaagccggggugcucugguga

SEQ ID NO: 24839 - RNA, 9876 nt, Artificial Sequence
  derived and/or modified CDS sequence (opt11) from DENV-2__KF704358__SS-prME
accgccggcaugaucaucaugcugauccccaccgugauggccuuccaccucaccacccgaaacggggagccgcacaugaucgucagccggcaggagaagggcaagagccugcuguucaacaccggggacggcgugcacaugugcacgcucauggcgaugcaccugggggagcugugugaggacaccauuaccuauaagugcccccuacugcgccagaaugagcccgaggacaucgacuguuggugcaacucgacuuccaccuggguaaccuacggcaccugcaccaccaccggcgagcaccggagggagaagcggucggucgcccugguuccucacguggggaugggccucgaaacccgcacggagaccuggauguccagcgagggggcuuggaagcacgcucagcguaucgagacguggauccugcgccaucccggcuucacuaucauggccgcgauccuggccuauacuaucgggacgacgcacuuccagcgugccuugaucuucaucuuacugaccgccgucgcgcccuccaugaccaugaggugcaucggcaucucuaaccgggacuucguggaaggcguguccgggggcagcuggguagacaucgugcucgagcacggcuccugcgugacuacaauggccaagaacaagcccacccuggacuuagagcucaucaagaccgaggccaagcaaccagccacccuacgcaaguacugcaucgaagccaagcuuacgaauaccaccaccgaaagccggugccccacgcagggagagcccucuuuaaacgaggagcaggacaaacgcuucguuugcaagcauagcaugguggaccggggcuggggaaacggcugcgggcuuuucggcaaggguucgaucgugacaugcgcgauguucaccugcaagaagaucaugaagggaaagguugugcagcccgagaacuuagaguacaccaucguaaucaccccucacagcggcgaggagcaugcuguagggaacgacaccggcaagcacgguaaggagaucaagaucaccccgcaguccagcauaaccgaagccgaacucaccggcuacggaacaguuaccauggaguguagcccccggaccggcuuggacuucaacgagauggugcugcuccagauggaggauaaggcuuggcugguccaccggcagugguuccuggaccucccccugcccuggcuuccgggagccgauacccaggggagcaauuggauccagaaggagacgcucgugaccuucaagaacccgcacgcgaaaaaacaggauguggucgugcuggggagccaggagggggccaugcauaccgccuuaacuggcgcuacggagauccagaugaguucggggaauguucucuucaccggccaccugaagugccgccugcggauggacaagcuucaacugaagggcauguccuacagcauguguaccggcaaguucaaggucguuaaggaaaucgccgagacccagcacgggacuaucgucauccgcgugcaguacgagggggacggaucccccugcaagauccccuucgagauuauggaccuagagaagagacacguacugggccgcuuaaucaccgucaacccgaucgugacagguaaggacagccccgugaauaucgaggcggaaccgcccuucggcgacucauacaucauaaucggggucgagccggggcaacugaaguuaaacugguuuaagaaggggucauccaucggccagauguucgccaccacgaugcgcggcgccaaacggauggccaucuugggggacacugccugggacuucggcagccucgguggcguauucaccuccauuggcaaggcgcuccaccagguguucggcgcaaucuacggcgcugccuucagcggggucuccuggacuaugaaaauccugacgggagugaucaucaccuggauuggcaugaacagccgauccaccagcuuauccguuagccugguacucgugggcguggucacccuguaccugggggugauggugcaggcggacuccggcugcguggugagcuggaagaacaaggagcucaagugcggcagcgggaucuucaucacggacaacgugcacacauggaccgagcaguauaaguuccagcccgaaucacccagcaagcuggccuccgccauccaaaaggcccacgaagagggcaucugcgggauccggagcgucacccgccuggaaaaucucauguggaagcagaucacgccggagcugaaccacauccuguccgagaacgagguuaaacucacgauuaugaccggcgacaucaaggggauuaugcaggccgguaagcggagccugcgcccgcagcccaccgagcugaaguacaguuggaagaccuggggcaaggccaagaugcucucgacagagucccacaaucagaccuuccugaucgacgggcccgagaccgccgagugcccgaacaccaacagagccuggaauagccuggagguggaggacuauggcuucggagucuucaccacaaacaucuggcucaagcugcgcgagaagcaggacguguucugcgacuccaagcugaugagcgcggccaucaaggacaaccgggcggugcacgccgacaugggcuacuggaucgaauccgcucucaacgacacuuggaagaucgaaaaggccagcuucaucgaggugaaguccugccacuggcccaagagccacacccugugguccaacggcgugcuggagagcgagaugauuauacccaaaaacuucgccgggcccgugagccagcacaacuaccgcccgggcuaccacacgcagaccgcagggcccuggcaccucggcaagcuggagauggacuucgacuucugcgaggggacuaccgucguggucacggaggacugcggaaaccggggccccucccugagaaccaccaccgccagcgggaagcucaucacggaguggugcugccgguccugcacccugcccccgcugcgcuaucggggcgaggacgggugcugguacggcauggagauccgcccccucaaagagaaagaggagaaccuggucaacucacuggugaccgcugggcacggccagaucgacaacuucucgcucggcguucuggggauggccuuguucuuagaggagaugcugcggaccagggucggcacuaagcacgcgauccugcucguggccgugagcuucgucacacugaucaccgggaacauguccuuccgagaccugggccgcgugaugguuauggucggggccacaaugacggacgauaucggcaugggcgugaccuaccuugcgcugcuggccgcguucaaagugcgccccacauucgccgccgggcuccugcugcggaagcucaccagcaaggagcugaugaugacgaccauaggcaucguccuacucucccagagcaccauccccgagaccauccuggagcugacggacgcccuagcccuggggaugauggugcugaagauggugcgcaagauggaaaaguaccaacucgcggucacgaucauggccaucuuaugcgugccgaacgcugucauccugcagaauaccuggaaaguuuccuguaccaucuuagccguggucagcgugagcccccuguuccuuaccuccucccaacagaaggccgacuggaucccccucgcgcugaccaucaagggccugaaccccaccgccaucuuccucacgacauuaagccggaccaacaagaagcgcuccuggccauugaacgaggccauuauggccgugggcauggucagcauccucgcguccagucugcugaagaaugacaucccuaugaccggaccccucguggccggcgggcugcuuacugugugcuacguccucacgggccggagcgccgaccuggagcuggagcgcgccgccgacgucaagugggaggaccaggcugaaauauccgggagcucgcccauccuuagcaucaccaucucggaggacggcagcauguccaucaagaacgaggaggaggagcagacccugaccauccugauacguaccggccuccuggugauuucaggccuguuuccugucucaauccccaucacggcugccgccugguaccucugggaggugaagaagcagcgcgccggcgugcugugggacguccccuccccgccgcccguggggaaggcggaacuggaggauggcgccuaccggaucaagcagaaggggauccuugguuacucccaaaucggcgccggcguguacaaggaagguaccuuccacaccauguggcacgucacacgcggugccgugcugaugcacaagggcaagcguaucgagcccucgugggccgacgugaagaaggaccugaucuccuacggaggaggcuggaagcucgaaggggaauggaaggagggcgaggagguccaggugcuggcgcuggaaccuggcaaaaacccucgcgccgugcagacgaagcccggccucuucaagaccaacgccgggaccaucggcgccgucagccuggacuuuucccccggcaccucugggucccccaucaucgacaagaagggcaaggugguggggcuguacggcaacggcgucgugacgcgcagcggcgccuacgucuccgcgauagcccagaccgagaaguccaucgaggacaaucccgagaucgaagaugacauuuucagaaagcggaagcucacaaucauggaccugcacccgggcgccgggaagaccaagcgcuaccugccugccaucguccgggaggcaaucaagcgcggucugagaacacucauucuggccccgacgcgcgugguggccgccgagauggaagaggcccugcgggggcuccccauccgcuaucagacccccgcgauccgcgccgagcauaccggccgggagaucgucgaccugaugugccacgccacguucaccaugcgccuccugaguccugugcgggugccgaacuacaaccuaaucauaauggacgaggcccacuucaccgaccccgccagcaucgcggcccgcggcuacauuagcacccgggucgagaugggggaggccgccgggaucuucaugacggccacgccaccugggucccgcgacccguucccccaaagcaacgcgccuaucauggacgaagagcgggagauccccgagcgcuccuggagcuccggacacgagugggucaccgacuucaaggggaagacugugugguucgucccgucaauucgggccggcaacgacauagccgccugccugcgcaagaacggcaagaaggugauccagcucucccggaagacguucgacagcgaguacgugaaaacccgcacaaacgacugggacuucgucguuaccaccgacaucuccgaaaugggggcgaacuucaaggccgagcgggugaucgaccccagacggugcaugaagcccgucauccugacugacggcgaggaacgagugauacuggccgggcccaugccugugacccauagcuccgcggcccagcggcgcggccggaucgggcgaaacccgaagaacgagaacgaccaguacauauacaugggcgaaccccucgaaaacgacgaggauugcgcgcacuggaaggaggccaagaugcugcuggauaacaucaacacccccgaggggaucaucccgucuauguucgagccugagcgggaaaaaguggacgccaucgacggggaguaccggcuucguggcgaggcccggaagacguucguggaccugaugcgccgcggggaccugcccgugugguuggcauacagggucgcggcagaggguauaaacuacgcagacaggcgcuggugcuucgacgggaucaagaacaaucagauccuugaggagaauguggaggucgagauuuggacaaaggagggcgagcggaagaagcuaaagccgcgcuggcucgacgcccggaucuacuccgacccacuggcccugaaagaguucaaggaguuugcggccggccgcaagagccucaccuugaaccugauuaccgagaugggucgguugcccacguucaugacccagaaggcccgcgacgcccuggauaaccuggcgguguuacacaccgccgaggccggcgggagagccuacaaccacgcccugucggagcugcccgagaccuuggagacauugcugcuacugacccugcucgcgaccguaacgggaggcaucuuucuguuccugaugucuggccgcggcauaggaaaaaugacccucggcaugugcugcauaauaacggcguccauccuacugugguacgcacagauccaaccgcacuggaucgccgccagcaucauccucgaguucuucuuaaucgugcuacucauccccgagcccgagaagcagcggaccccccaggacaaccagcuuaccuacguggugaucgcuauucugaccgucguggccgccacgauggccaacgagaugggguuccucgagaagaccaagaaggaccugggccugggcaguaucacuacccagcagccggagucaaacauccuugacaucgaccugcgccccgccagcgcguggacccuguacgccguggccaccaccuucgucacccccaugcuccgccacuccaucgagaacagcuccgugaacgugagccugacggccaucgccaaccaggcgaccguccugauggggcucggcaagggguggccgcuguccaagauggacaucggcgugccgcugcucgccaucgggugcuacagccaggugaacccaaucacccugacugccgcccuguuccuccugguugcgcacuacgccauuaucggccccggcuuacaagccaaggccacgcgcgaggcacagaagagggcggccgccgguaucaugaagaaccccaccguggacggcaucaccgugaucgaccucgauccaauccccuacgaccccaaguucgagaagcaacuggggcaggucaugcugcucguacugugcgugacccagguacuaaugaugcgcacgaccugggcccucugugaggcccugacacuggcgacuggccccauuuccacgcucugggaggggaacccgggccgcuucuggaacaccaccauagccgugagcauggcuaacaucuuccggggcuccuaccuggcgggggccggccuguuguuuagcaucaugaagaacaccaccaacacccgccgggggaccggcaacaugggcgagacccugggugagaaguggaagucucgacugaacgcucucggcaaaagcgaguuccaaaucuacaagaaguccgggauucaggagguggaccggacccuggccaaggagggcaucaagcgcggggaaaccgaccaccacgccgucagccggggcagugccaagcugcgcugguucguggagcggaacauggugacccccgagggaaaggucguggaccucgggugcggcagagggggcuggucguacuacugugggggcuugaagaacguccgggaggugaaggggcugaccaagggcggccccggccaugaggagcccaucccaaugagcacguacggauggaaccucguccgccugcagagugggguggacgucuuuuucacaccgcccgagaagugugacacccugcucugcgacaucggcgagagcucgcccaacccgaccguggaggcgggccggacgcuucgcguccugaaucucgucgagaacuggcugaacaacaacacgcaguuuugcauuaaggugcugaaccccuacaugcccagcgugaucgagaagauggaggccuugcagcguaaguacgggggcgcccugguucgcaacccgcugucccggaacagcacccaugagauguacugggucuccaaugccagcgggaacaucguguccagcgucaacaugaucucucgcaugcugaucaaccgguuuaccaugcgccacaagaaggccaccuucgagcccgacguggaccucggcagcgguacgcgcaacaucggcaucgagucugagaucccuaaccuggacaucauaggaaagcggauagagaagaucaagcaggaguacgagaccagcuggcacuacgaccaggaccauccguacaagaccugggcguaccauggguccuaugagaccaagcagaccggaagcgccuccagcaugguaaacggggucgugcgccuguuaaccaagccgugggacgucguccccauggugacccagauggccaugaccgacacgacccccuucggccagcagaggguguuuaaggagaaggucgacacccgcacccaggagcccaaggagggcacgaagaagcugaugaagaucaccgccgagugguuauggaaggaacucgggaaaaagaagaccccgcggaugugcacccgcgaggaguucacgcggaagguucgcuccaacgccgcgcugggcgcgaucuucaccgacgagaauaaguggaaguccgcccgggaagccguugaagauucccgcuucugggagcucguggacaaggaaaggaaccuccaccuggaggggaagugcgagaccugcguguacaacaugaugggcaagcgcgagaagaagcugggggaauucggcaaggccaagggaagccgggcgauaugguacauguggcucggagccagguuccuggaguucgaggcccugggcuuccucaacgaggaccacugguucagccgggagaacucccugagcgggguugagggugagggccuucacaagcucggcuacauccugagggacguguccaagaaggagggaggggccauguacgcggacgacaccgccggcugggacacgcggaucacccuggaggaccucaagaacgaggagauggugaccaaccacauggagggggagcacaagaagcuggccgaggccaucuucaagcugaccuaccagaacaaggucguucgcgugcagcggcccacgccacgcggcaccgucauggacaucaucagccggcgcgaccaacgcggguccggccaggugggcacauaugggcucaacaccuucacuaacauggaggcccagcugauccggcagauggagggcgagggcguguucaagaacauccagcaucucaccgucaccgaggagauugcggugcagaacuggcucgcacgcgugggccgggagcgccugagccggauggccaucuccggcgacgacugcgucgugaagccccuggacgaccgcuucgccuccgcccucaccgcgcugaacgacauggggaagguccggaaagacauccagcagugggagccgucccgcggcuggaacgacuggacgcagguccccuucugcucucaccacuuccacgagcugauuaugaaggacgggcgggugcuagugguccccugccgcaaccaggacgagcugauuggccgggcccgcaucucccagggggccggcuggagcuuacgggagaccgccugccucggcaaauccuacgcccaaauguggucacugauguacuuccacaggagggaccugcgccucgcggccaacgcaaucugcuccgccgugcccagccacugggugccgaccucccggacgaccuggagcauccacgccaagcacgaguggaugacgacggaggacaugcugaccgucuggaaccguguuuggauccaggagaaccccuggauggaggacaagacccccguggagucaugggaggagauccccuaccuagggaagcgggaggaccaguggugugguucccucaucgggcuuacgagccgcgcgaccugggccaagaacauccagaccgccaucaaccagguccgcucccugaucggcaaugaggaguacaccgacuacaugccgagcaugaaaagauuccgccgggaggaggaggaggccggggugcugugguga

SEQ ID NO: 24840 - RNA, 9876 nt, Artificial Sequence
  derived and/or modified CDS sequence (opt11) from DENV-2__KF041232__SS-prME
acggcaggaguaauuaucaugcugauacccacugccauggcuuuccaucugaccacacgaaacggagaaccgcauaugauagucucuaaacaggaaaaagggaaaucauugcuguucaaaaccgaagacggaguuaacaugugcacccuaauggccauggaucuaggagaacuaugcgaagacacaauaacauacaauugccccuuauuacgccagaacgaaccagaagacauagacugcugguguaacgcaacaaguacaugggugacguacggcacauguacggcgacaggugaacacaggcgagagaaaagguccguugcccugguaccacauguuggcauggguuuagaaacccgaacagaaaccuggauguccagcgagggggcauggaaacacgcccagcguauugagacguggauccuaaggcaucccggguuuacaaucauggcggcgauccucgccuacaccaucggcacaacauacuuccaaagagugcuuaucuuuauccuacucacagcggucgcaccaucaaugacaaugcgcuguauuggaaucucgaaucgagacuucgucgaaggcgucagcggagguagcuggguagacauaguccuagaacacgguuccugcguaaccaccauggccaaaaacaaaccaacccuggauuuugaacuaaucaaaacagaagcaaaacaaccggccacacugagaaaauacuguauugaagccaaacucacaaacacuacgacggccuccagaugcccaacccagggugaaccaucccugaacgaagaacaggacaaaagguucguaugcaaacacagcauggucgaccgagggugggggaacggguguggacuauucggcaaaggcggaauuguaaccugcgccauguucacaugcaagaaaaacauggaagguaaaaucguccagcccgaaaaccuggaguacaccaucguagucaccccgcacaguggugaggaaaacgcaguaggaaaugacaccggcaaacacggaaaagaaauuaaagucacuccacaaucaucaauaacagaggccgaacuaacaggcuauggaaccgugacaauggaaugcagcccgcgaacgggccuggauuuuaaugagauggucuuacugcaaauggagaauaaggcuugguugguacaucgccagugguuccuagacuuaccacugcccuggcuuccaggcgccgacauacaagggucaaacuggauacaaaaggaaacgcuagugaccuucaaaaacccacaugcaaagaagcaggacgucguaguccuagggagucaagagggugcgaugcacacggcucuaacuggugcuaccgaaauccaaaugucgucaggcaacuuacuauucacagggcaccucaaaugcagacuucggauggacaaacuccaacuaaaagggaugucguacuccauguguacgggaaaguuuaaagucguaaaagagaucgcggaaacucaacacgggaccaucguaguuagaguccaguacgaaggcgauggaagcccgugcaagauaccguucgagauaauggaucuggaaaagcggcacguucuaggacggcuaaucacgguuaauccuaucgucacagaaaaagacagcccgguaaacauagaagccgagccuccauucggagacagcuacauaauaauagggguugagccgggacagcuaaaauuaaguugguucaagaaaggcucaucaauuggccaaauguuugaaaccacgaugcggggcgcaaaaagaauggccauccuaggagacacugcaugggacuucggcuccuuagggggaguauucacuagcauaggcaaagcguuacaccagguguucggcgcaauauacggcgcggcauucucggggguuucauggacaaugaaaauccucaucggaguggucauaacauggauaggaaugaacagucguaguacgucgcuguccgucucucucguccucguuggaguggucacguuguaccucggggcaauggugcaagcggacucgggaugugucguaucauggaaaaacaaagagcuaaaaugcgguucaggaaucuucaucacagacaacguccauacauggacagaacaauacaaauuccagccugaaucaccaucaaagcucgccucugccauacaaaaggcgcacgaagaggggaucugugguauacgaucggugacaagacucgaaaaccucauguggaagcagauaacccccgagcucaaucacauacuguccgaaaacgaggucaaacuguccaucaugacaggcgacauaaaaggcaucaugcaggccggcaagagaagucuaaggccgcagccaaccgagcugaaauacagcuggaaaacauggggcaaagccaagaugcuauccacagaaccccauaaccaaacauuccuaaucgacgggccggaaacggcagagugcccgaauacaaauagagcauggaacucccucgaaguggaggacuauggguuuggugucuucacgaccaauauaugguuaaaacuuaaggaaagacaagacguauucugcgauucgaagcugaugucggcagcaauaaaggauaaccgcgcuguacaugcagacaugggcuauuggauagagucagcacugaacgacacauggaaaaucgaaaaagccucuuucaucgagguuaaaagcugccacuggcccaagagccauacacugugguccaacggcguccucgaguccgagaugauuauacccaaaaauuuugccgggccugucucucagcacaauuaucgaccagguuaccacacgcagacugcgggcccuuggcacuuggggaaacuagaaauggacuucgauuucugcgaagggacaaccgucgucguaacagaagacugcggaaacaggggcccuagccucagaaccacaaccgcgucaggcaaacucaucaccgaauggugcugcagaagcugcacucuaccaccgcuacgauaucgaggggaagauggcuguugguacggaauggagauccguccccucaaagaaaaagaggaaaaccuaguaaauagcuuaguaacggcuggucauggacaaauagauaacuucagccucgggguccucgggauggcacuguucuuagaagagaugcuacgcacuagggucggaaccaagcacgccguucuacuuguggcggucucuuuuaugacccucauaacaggcaacaugucauuucgcgaucuagggcgcguaauggugaugguuggagcagcaaugaccgacgauauaggaauggggguaaccuaucuagcgcuccuggcggcauuuaaggugcguccaacauucgccgccggacuacuccugcgcaagcuaacaagcaaagaauuaaugaugaccacaauuggaaucgugcugcugagucaguccacaaccccagaaacgauacuugagcuaaccgaugcacucgcccuuggcaugaugauacucaaaaucguaagaaacauggaaaaguaccaacucgccgugacuauaauggcaauacugugcguccccaacgcggucauacuacaaaaugcauggaaaguauccuguaccauccucgcggcuguaagcgugagcccccuccuccuuacgucgagccaacagaaagccgacuggauaccgcuagcguugaccauaaagggacucaaucccaccgcuauauuucuaaccacccuuucuagaacaaacaaaaagcgcuccuggccgcugaaugaagcaauaauggcuguggguaugguauccauucucgcuucgagccugcucaaaaaugacauaccuaugaccgguccauuaguagcagggggcuuauuaacagucuguuacguucugacaggaagaagcgccgaucucgaacucgaaagagccgcggacguacggugggaagaccaagcagaaauauccggaucaucaccgauacucagcaucacaauuucggaggauggaagcaugucuaucaagaaugaggaagaagaacagacccuaacaaucuugauucgaaccggacuccuagugaucaguggcuuauucccaguauccauaccaauaacggccgccgccugguauuuaugggagguaaagaagcaaagggcaggaguuuuaugggacguacccaguccaccaccuguaggcaaagcggaacuagaggacggagcauaucgaaucaaacagaaggggauacucggcuacucccagaucggcgcaggggucuauaaggaaggcacauuccacacgauguggcacgucacacgaggagcaguucuaaugcacaaagggaagcgaaucgagcccucuugggcggauguccgaaaggaucugauaagcuacggaggcgguuggaaacucgaaggcgaguggaaagagggcgaagaagugcaaguacucgcccucgaaccgggcaagaacccaagggccguacaaacgaaacccggacuauucaaaacgaacaccggcaccaucggagccguuucacuggauuucagccccggaaccagcggaucacccaucgucgacaaaaagggaaagguggugggacuguaugggaacgggguagucacaaggagcgguacguauguguccgccauagcacaaacagagaaaagcauagaggacaacccagaaaucgaagacgacauauucagaaagaaaagguuaaccaucauggaccugcacccaggagcggguaagacaaagcgguaucucccagcaaucgucagagaagcuauaaaaagaggcuugcgcacacuaauccuagcaccgacccgagucgucgcagccgaaauggaggaagcgcugagaggacugccaauacgauaccaaacaccagcaauucgcgcagagcacaccggucgugaaauaguggaccucaugugccacgcgacauuuacaaugcgacuccugucgccagugcgcgugccaaacuacaacuuaaucauuauggacgaagcgcacuucaccgauccagcgagcaucgccgcgagaggguacauaucaaccagagucgaaaugggcgaggcagcagguauuuucaugaccgcgacacccccggggucgcgagacccguucccacaaagcaacgccccgauaauggacgaagaacgggagaucccggagcgcagcuggaacagcggccacgaaugggugacagauuucaagggaaaaacggugugguuugucccgucgaucaaagcagggaacgacauugcagcgugccuccggaaaaacggcaagaaagugauacaacuuucgagaaaaaccuucgacucugaauacaucaaaacacggacaaacgacugggacuucguaguaacaaccgacauaucggagaugggugcaaacuucaaagcagaacgaguaauagacccccggaggugcaugaaaccaguaauccuaacagauggugaagaacgcgucauccucgcaggucccaugccgguaacccacucuagugcggcccagaggcgggggcgaaucggcagaaaccccaaaaacgaaaaugaccaguauaucuacaugggagaacccuuggaaaaugaugaagacugcgcccacuggaaggaagcaaaaaugcucuuggauaacauaaacacccccgaggggaucaucccaagcauguuugaaccagagcgcgaaaaaguagaugccaucgacggagaguaccgcuugcgaggggaggcaagaaaaacauucgucgacuuaaugcgccgaggugauuugcccguguggcucgcauaccgugucgccgccgaggguauaaacuacgcugauagaagguggugcuucgauggcaucaagaacaaccaaaucuuggaagaaaacguugagguagaaauauggacaaaagaaggcgagcggaagaaacugaagccacgcuggcucgacgcacgcauauauagcgacccccuggcgcugaaagaguucaaggaguucgcggcgggacggaagagucuuacacuaaaccugaucaccgagauggggcgccugccaacuuuuaugacucaaaaggccaggaacgcccuugacaaucuagccguccuacauaccgcugaggcaggcggccgagcguacaaccacgcacuaagcgaguuacccgagacgcuugagacuuugcuccuucuuacgcuccuagccacggugacuggagggaucuuccucuucuuaaugucagguaaaggcauaggaaaaaugacguugggaaugugcuguauaaucaccgcuucgauacuucuuugguaugcccaaauucaaccacauuggauagccgccaguauuauacuugaguucuuccugaucguccuacucauacccgagccggagaagcagagaacgccacaggauaaccagcucacguacgugguaaucgcuauuuuaaccguagucgcugccaccauggcuaacgagaugggcuuccuugagaaaacuaagaaagacuucggacuggggagcauugccacacagcaaccagagagcaacauacuagacaucgaccugcgaccggcaagcgccuggacccuguacgccguagcaaccaccuuuauaaccccgaugcuacgacacucaauagaaaacaguuccguaaacguuucgcuaacggcaauagcaaaucaggccacaguauuaaugggccuagguaagggcuggccgcucucgaaaauggauauagggguaccacuuuuagcgaucgguugcuacucgcagguaaaccccauaacacuaacggccgcccuccuucucuuaguugcacacuacgcgauaaucggaccaggccuacaagcaaaagcgaccagagaagcgcagaagcgcgcggcggccggcaucaugaagaacccaaccguagacgguauaacuguaaucgaccuagacccaauccccuaugaccccaaguucgaaaagcaacucggacaaguaaugcuccuagucuugugcguaacacagguccucaugaugcgaacgaccugggcauugugcgaggcgcugacacucgccacaggaccgauauccacgcucugggaagggaacccagggagguucuggaacacgaccaucgcagugaguauggcgaauaucuuccgggguucauaccucgccggggccggacugcuauuuagcaucaugaagaauaccacaaacacccgacgaggcacagggaacaccggggagacgcugggagagaaauggaaaaaccgccugaauagucuuggcaaaagcgaguuccagauauauaagcgaagcggcauccaagagguggaccgcacccuggccaaggaaggcaucaagcgaggagaaacagaccaucacgcggucuccagaggcucagcgaaacugcggugguuuguugagagaaaccucgucacuccagagggcaagguaguagaccuaggaugcggcagaggcggaugguccuacuacuguggaggacucaaaaacgugagagaagucaagggccugacaaaagggggcccaggacacgaagaaccuauaccaaugucgaccuacggauggaaccuaguacguuugcaaagcgggguagauguauuuuucacaccgcccgaaaaaugcgacacgcuacucugugacaucggggaaagcaguccaaaucccaccgucgaagcagggcgcacguuacggguacuuaaccuaguggaaaacuggcuaaauaacaacacccaauucugcauaaaaguccuuaacccauacaugccaagcgucaucgagaagauggaaacacuccaaagaaaauacggaggcgcacucguacgcaacccacuguccagaaacagcacccacgagauguauugggucucgaaugcaagcggcaacauaguguccaguguaaacaugauaucgcgaaugcucauuaaucgguucaccaugcgacacaagaaagcgaccuacgagccagacguggaccucgguagcggaaccagaaacaucggcauugaaagcgagacgccuaaccuagacauuauaggcaagcgaaucgagaaaauuaagcaagaacaugaaacaagcuggcacuacgaccaagaucaccccuacaaaacgugggccuaccacgguuccuaugaaacuaagcaaacugggagugcaucgagcauggugaacggcguaguccgccuucuaacaaaaccgugggacguuauccccauggugacucaaauggcgaugacggacaccacacccuuugggcaacaacguguauucaaggaaaaaguagauacccggacgcaagagccuaaggaaggcaccaagaaacuuaugaaaaucacggcggaauggcuauggaaagaacucggcaagaagaaaacgcccaggaugugcacaagggaagaauuugcccgcaagguacgaagcaacgcggcauugggagcaauauucaccgacgaaaacaaguggaaaagcgcccgcgaagccguagaggacucccgguucugggaauuaguggacaaggaaagaaaucugcaccuggagggcaagugcgaaacuugcguauacaacaugaugggcaaacgugaaaagaagauaggggaguucgguaaggccaagggcucaagagccauaugguacauguggcuuggugcccguuuucucgaguuugaggcacucggguuccucaacgaggaccacugguuuagccgagaaaauucgcuaagcgguguagaaggugaaggacugcacaaacuuggauacauccucagggaaguaagcaagaaggagggaggagcaauguacgcggacgacacggcgggaugggacacccggauaacucucgaagaccucaaaaacgaagaaauggucacgaaccacauggagggcgaacacaagaaacucgcagaggcaaucuucaagcuaaccuaccaaaacaaggugguacgaguacagcgccccaccccucgggguacaguaauggauaucauaucaaggagagaccagcguggaagcggccaagucggaacauauggacucaacaccuuuaccaauaugggagcacaacugaucagacagauggaaggagaggggguuuucaaggggauucaacacuugaccgcaaccgaagaaguugcgguccaagacuggcuagcuagagucgguagagagcggcugucccgaauggcgauauccggugacgacugcguagucaaaccgcucgacgaucgauucgcaaacgcacuuacagcccuaaacgacaugggaaaaguacggaaagacauacaacaaugggagcccaguaggggauggaacgauuggacgcaggucccauucugcucacaccacuuucacgaacuaauaaugaaagacggucgcgugcuagucguacccugccgcaaccaagacgagcuaauagggagagcucgaaucucccaaggagcgggauggagccuccgugagaccgcaugccuuggaaaaucuuacgcccaaauguggucgcuaauguacuuccauaggagggacuuacgguuagccgcgaacgcaauaugcucagccguuccgagucacugggucccaacaagucguacaacauggagcauacacgcccgacacgaguggaugacaacagaagacaugcuaacgguauggaacagaguguggauacaggaaaauccauggauggaagacaaaacucccgucgaaucuugggaggagauucccuaccugggaaaaagggaggaucaaugguguggaagccucauaggccuaacuagccgcgcuacuugggcacgcaacauccaaacggcaauaaaccaggugcgcucacugauugguagcgaagaauacacggauuacaugcccagcaugaaacgcuuuaggcgcgaagaagaagaggcgggaguacucugguaa

SEQ ID NO: 24841 - RNA, 9876 nt, Artificial Sequence
  derived and/or modified CDS sequence (opt11) from DENV-2__KF041233__SS-prME
accgcgggcgugaucaucaugcuaauucccaccgcaauggcguuccaccucaccacccggaauggggagccccauaugauagucagcaagcaggagaaggguaagucucugcuuuucaagaccgaggacgggguaaacaugugcacccucauggcgauggaucugggcgaacugugcgaagacaccaucaccuacaacugcccccuccugcgccagaacgagcccgaagacaucgacugcuggugcaacagcacauccacaugggugaccuaugggaccugcaccgccacuggcgagcaccgccgugagaagcgcagcgucgccuuggugccucacgugggcauggggcucgagacccggacagagaccuggaugaguagcgagggcgcuuggaagcacgcgcagcgcaucgagaccuggauccugagacaccccggguucacuaucauggccgccauccuugcguacaccaucggcacaaccuacuuucaacgcgugcucaucuucauccugcugacggcgguggcacccuccaugacgaugcggugcaucggaaucuccaaccgggacuucguggagggcgucuccggcgggucguggguggacaucgugcucgaacauggcaguugcguuaccaccauggccaagaauaaacccacccuugacuucgaacugauuaagaccgaggcaaaacagcccgccacccuccgaaaguacugcaucgaggccaagcugaccaacaccaccaccgcgucucgcuguccgacccagggggagccuucccugaacgaggagcaggacaagcgguucguguguaagcacagcaugguagaccggggcuggggaaacgggugcgggcucuucggaaagggcgggaucgucacgugcgccauguucacgugcaaaaagaacauggagggcaaaaucgugcagccggagaaccucgaguauaccauuguagucacuccccacagcggcgaggagaacgcgguggggaacgacacgggcaagcacggcaaggagaucaaggugaccccucagucaagcaucaccgaagccgaacugaccggcuacggcacggucacgauggaguguagcccaaggaccggccucgacuucaacgagauggugcugcuccagauggagaacaaagcguggcucgugcaccgccagugguuccuggaucugccccuccccuggcugccgggcgccgacauccaaggguccaacuggauucagaaggagacccuggucaccuucaaaaacccgcacgccaagaaacaggacguggugguucuaggcagucaggagggggcuaugcauaccgcccugaccggcgccaccgagauccaaaugagcuccggaaaccuccuguucaccggacaccugaagugccggcugcgcauggacaagcuucagcucaagggcauguccuacuccaugugcaccgguaaguucaagguagucaaggagaucgcugagacacaacacggcaccaucguggugcggguucaguacgagggggacggaagccccugcaagaucccuuucgagaucauggaccuugaaaagagacacgugcucggccggcugauuaccgugaacccgaucgugacggagaaggacuccccaguuaauaucgaggccgagccgccuuucggcgacucuuacauuaucaucgggguggagccaggucagcucaaacuuuccugguucaagaagggcuccuccauuggucagauguuugagacaaccaugcgcggggcuaagcgaauggcuauccucggugauacugcgugggacuucgggagcuugggagggguguucacuuccauaggcaaggcccuccaccaggucuucggggccaucuacggcgcugcguucagcggaguguccuggacuaugaagauccugaucggggucgugauaaccuggauaggcaugaauucacgauccaccucguuguccgugagccugguucucgugggugugguaacgcuguaccugggcgugaugguucaggccgauuccgggugcgucguaagcuggaagaacaaggaacucaagugcggcagcggaaucuucauaaccgacaacguccacacuuggaccgagcaguacaaguuccagcccgagucccccaguaagcuggccgccgccauccagaaggcccacgaggagggaaucugcggcauccguagugucacacgccuggagaaccucauguggaaacagauuacccccgagcugaaccacauucuuagcgaaaacgaggugaagcucucgaucaugacuggggacaucaagggaaucaugcaggccgggaagaggagccugcggccacagccgaccgaacuaaaguacagcuggaaaacguggggcaaggccaagaugcucaguaccgagccccacaaucagaccuuccugauagacggcccagagaccgccgagugcccuaacacgaaccgugccuggaauucccuggaggucgaggacuacggauucggcgucuuuaccaccaacauauggcucaaacugaaggagcggcaggacgucuucugcgacucaaagcugaugucagcggccaucaaggacaaccgcgcuguucacgccgacaugggguacuggaucgagagcgcccucaaugacaccuggaagaucgagaaagcgucguucaucgaggucaagagcugccacuggcccaagucccacacgcuguggagcaacggagugcuggaguccgagaugaucauucccaagaacuucgccggcccaguuagccagcacaacuaucggcccgguuaccauacccagaccgccggcccauggcaccuagguaaauuagagauggacuucgauuuuugugaaggcaccaccgucguagugacggaggauugcgggaaccgcggccccagucugcggaccacaaccgcauccgggaagcucauaacugaguggugcugccgcagcugcacucugccgccccuccgguaccgcggagaagacggcugcugguacggcauggagauccguccccucaaggagaaggaagagaaccuggucaacucccucguuaccgcgggccacgggcaaaucgacaacuucagccuaggggugcuggggauggcgcuguuucucgaggagaugcugcgcacucgggucgggacgaagcacgccgugcuucucauugcaguguccuucaugacgcugaucaccggcaacaugaguuuccgcgaucugggucgggucauggugaugguaggcgccgcgaugaccgaugauauugggaugggcguuacguaccucgcccugcuugcugccuuuaaagugcgccccaccuucgcggcgggccuccuguuaagaaagcucaccuccaaggagcuaaugaugaccacuauagggaucguacuccucucacaguccaccaccccugagaccauucuggagcugaccgacgcccucgcccugggaaugaugauccuuaagaucguccggaacauggaaaaauaccaacucgcagugacuaucauggcaauccugugcguccccaacgcggugauauugcagaacgccuggaagguuagcugcaccauccucgccgccgucucugugagcccucugcugcuuacaaguucucagcagaaggcggacuggaucccccucgcccugacgaucaagggguugaacccgaccgcgaucuuccugaccacccugagucgcacgaacaagaagcggucguggccccucaacgaagccaucauggcuguugguauggucuccauccuggcauccuccuuacucaaaaaugauaucccaaugacgggcccucugguggccgggggucugcucaccgugugcuacguucugaccggucggagcgccgaccuggagcuagagcgcgccgcggacguaaggugggaggaccaagcggagaucagcggcuccagcccgauccugucaaucacgaucagcgaggacgggucaaugagcaucaagaacgaagaggaggaacagacccugaccauacucauacggacaggcuuacuggugaucuccggucuauuccccgucucuauccccaucacggccgcggccugguaucugugggaggugaaaaagcagcgcgccggggugcucugggacgugcccuccccgccccccgugggcaaggccgagcucgaggacggggcguaccggaucaagcagaaggggauccugggguacucccagaucggcgccggcguguacaaggagggaacuuuccauacuauguggcacgucacccgcggugcagugcuuaugcacaaagggaagcggaucgagccguccugggccgaugugcgcaaggaccuuauuagcuacggggggggguggaagcuggaaggagaauggaaagagggggaagagguccagguucuggcguuagagccaggcaagaacccccgggcggugcagacaaagcccgggcuguucaagacgaacaccggcaccaucggggccguaucccuagacuucucuccgggcaccuccgguagcccaaucguggacaaaaaggggaaagugguuggccucuaugggaacggcgucgugacgcgcucuggcaccuaugucucugcaaucgcgcaaaccgagaagucaaucgaggacaaccccgagauugaggacgacaucuuccggaagaagaaacugaccaucauggaccugcaccccggggccggcaagacgaagcgauauuugccggccauagugcgggaggccauuaagcgcgggcuucggacacugauccuggcucccacccgcguggucgcugccgagauggaggaggcgcuccgcgggcugcccauuagguaccagacccccgccauccgugccgagcacacgggucgggagaucguggacuugaugugccaugcaaccuucacaaugcgcuugcugagcccgguacggguccccaacuacaaccugaucaucauggacgaagcccacuucaccgauccugcuaguaucgccgcccguggcuauaucuccacgcggguggagaugggcgaggcggccgggaucuuuaugaccgccacgccgcccggcagcagggaccccuucccgcagagcaacgcgcccaucauggacgaggagcgagagauucccgagcgcucauggaacuccgggcacgagugggugaccgauuucaagggcaaaacgguaugguuugugcccagcaucaaggcugggaacgauauugccgccugccugcgcaagaacgggaagaaagugauccaguuaucccgcaagaccuucgacagcgaguacaucaagacccggaccaacgacugggacuucgucgucacgaccgacauauccgagaugggcgccaacuuuaaggcggagcgcguuauugacccacggcgcugcaugaagccugucauccucaccgacggggaggagaggguaauccucgcgggccccaugccagugacccacaguuccgccgcacagcgccggggucgcaucggccggaacccaaagaacgagaacgaucaguacauuuauaugggggagccccuggagaacgaugaggacugcgcccacuggaaggaagccaagaugcugcucgauaacaucaacacgccggaaggcaucauccccagcauguucgagcccgagcgcgagaagguagacgcgaucgacggugaauaucgccugcgcggggaggcccguaagaccuuugucgaccugaugcgccgaggcgaccucccgguguggcuagccuaccggguagccgcggaagggaucaauuacgccgaccgucgguggugcuucgacggcaucaagaacaaccagauccuggaagaaaacguugaggucgagaucuggaccaaggaaggggagcgcaagaaguugaagccacgguggcuggacgcacgcaucuauuccgauccccuggcucuaaaggaguucaaggaguucgccgcgggacgcaagagccucacccugaaccugaucacggagaugggccggcugcccacuuucaugacccagaaggcccggaacgcccuggacaaccucgccguacugcacaccgccgaggccggcgggagggccuacaaccacgcccugucggagcucccggagacgcuggagacccuucugcugcugacccuccuggccaccguuaccggugggaucuuccuguuccucaugagcgggaaggggaucgggaagaugacucuggggaugugcugcauaaucaccgccuccauccugcucugguacgcgcagauccagccccacuggauagcggcuucaaucauccuggaguucuuucugaucguccucuuaauccccgagccggagaagcagcggaccccgcaggauaaccagcuaaccuacgugguuauagccaucuuaacggucguagccgcaaccauggccaacgagaugggguuccucgagaaaaccaagaaggauuucggauuggguagcauugccacccaacagcccgaaagcaacauacucgacaucgaucugcgcccagccagcgcuuggacucuguacgcgguggccaccaccuuuaucacccccaugcuacggcauuccaucgagaacagcuccgucaacguuagccugacggccaucgcgaaccaggccaccguguuaaugggccucgguaaaggcuggccgcugucaaagauggacaucggggugccucugcucgcgaucggcugcuacagccaggugaaccccauuacccugaccgcagcccugcuccuucugguggcccacuacgcgaucaucgggcccggacuccaggccaaggcaacgcgcgaagcccaaaagcgggcugcggccggcaucaugaagaacccgaccgucgacgggaucaccgugaucgaccuggaccccauucccuacgaucccaaguucgagaagcagcuuggacagguaaugcuacugguccugugcgugacgcagguauuaaugaugcgcacgaccugggcccuaugcgaggcgcugacccucgcgaccgggccgaucuccacguugugggagggcaaccccggucgguuuuggaacaccaccaucgccgucucgauggccaauauuuuccgcggcuccuaccuggccggcgccgggcuccucuucagcaucaugaagaacacaacgaacacccgacgggguaccgggaacaccggugagacacuuggcgagaaguggaaaaaccggcucaauucccuggggaagucugaguuccagaucuacaagagauccgguauccaggaggucgaucggacccuugcgaaggaggggauaaagcgaggcgagaccgaccaccacgccguaucccgcgguuccgccaagcugcggugguucgucgagcgcaaucuggugacccccgagggaaagguuguugaucugggcugcgggcggggugguuggaguuacuacugcggggggcucaaaaacguccgggaggugaagggccugaccaagggagggcccggccaugaggagccgauacccauguccaccuacgguuggaacuugguccggcuccagagcggcguggauguguucuucaccccgcccgaaaagugcgacacccugcucugcgauauuggggaauccucaccgaaccccacaguagaggcgggcaggacucuucgggugcugaaccugguggagaacuggcucaauaacaacacccaguucugcaucaaggucuuaaaccccuacaugccgagcguuaucgagaagauggagacacugcagcgcaaauacggcggggcucuggugcggaaccccuuaucucgcaacagcacccacgagauguacugggucuccaacgcuucaggcaacaucguaucgagcguuaacaugauaucccguaugcugaucaaucgauucacgaugcggcacaaaaaggcuacguacgagcccgacgucgaccuggggagcggcacccgcaacaucgggaucgaauccgaaacccccaaccucgacauaauuggcaaacgcauugagaaaaucaagcaggagcacgaaacgagcuggcacuacgaucaggaccacccuuacaaaacuugggccuaccacggcuccuacgagaccaagcagaccggauccgccagcagcauggugaacggcgugguucggcugcuuacgaagcccugggacgugauucccauggugacacagauggcuaugaccgacaccacgcccuucggacagcagcgcgucuucaaggagaagguggacacccgcacccaggaaccgaaggaggggaccaagaagcuuaugaagaucacggcggaauggcuguggaaggagcuaggcaagaagaagacgccgcggaugugcacccgugaagaguucgcccgcaagguccgguccaaugccgcccucggagcuaucuucaccgacgagaacaaguggaagucugcgcgcgaggccgucgaggacucccgguucugggaacugguggacaaagagcgcaaccugcacuuagaaggcaagugcgaaacgugugucuacaacaugauggggaagagagagaagaagaucggcgaguucgggaaggccaagggaagccgcgcgauaugguacauguggcugggcgcacgguuucuggaguucgaggcccucggguuccuuaaugaagaccauugguucucccgcgagaacagccugagcggcgucgagggggaggggcuccacaagcugggguacauccugcgggagguguccaaaaaggagggcggggcaauguacgcggacgacacagcugggugggacacccgcaucacccuggaggaccuuaagaacgaagaaaugguuacuaaccacauggagggcgagcacaagaagcuagcggaggcaaucuucaaguugaccuaccagaacaagguggugagaguccagagaccaacuccccgggggaccguaauggacaucauaagccggcgggaucagcgcggcuccggccaggugggaacguauggccugaacacauuuaccaacaugggggcccagcugauccgacagauggagggugagggggucuuuaagggcauccagcaccucacggccacugaggagguggccgugcaggacuggcuggcgcgagucggccgcgagcgccuuagcaggauggcaauauccggcgacgacugcguagucaagccgcucgacgacagguucgccucggcccugaccgcgcugaacgacaugggcaaagugcgcaaggacauccaacagugggagcccagccggggguggaacgacuggacccaggugccauuuuguagccaucacuuccacgagcugaucaugaaagauggccgcgugcuugucgugcccugccggaaucaggacgagcugaucgguagggcccggaucucacagggcgccggcugguccuugcgcgagaccgccugccuggggaaaucuuacgcccagauguggagccugauguacuuccacagacgcgaccucaggcuggcggcgaaugccauauguuccgccgucccgagccacuggguucccacgagccgcacuacuuggagcauccaugccaggcacgaguggaugacuaccgaggacaugcugacaguguggaaccgcguguggauucaggagaaccccuggauggaagacaagacccucgucgagucaugggaggagauccccuacuuaggaaagagagaggaccaguggugcgggucauuaaucggccucaccucacgcgcaaccugggcccgcaauauacaaacggccauuaaccagguccgguccuugaucggauccgaagaguacaccgacuauaugccgucaaugaagcguuuccggcgcgaggaggaggaggccggugugcuaugguga

SEQ ID NO: 24842 - RNA, 9876 nt, Artificial Sequence
  derived and/or modified CDS sequence (opt11) from DENV-2__KF041234__SS-prME
accgcgggugugaucaucauguugaucccaacggccauggcguuccaucugaccacgcgcaacggggagccgcacaugauugucagcaagcaagaaaagggcaagagccugcuguucaagaccgaggacggcgugaacaugugcacccucauggccauggaccugggcgagcugugcgaggacacgauaacauauaacuguccgcuccuccgccagaaugagcccgaggacaucgacugcuggugcaacgccaccucaaccugggugaccuacggcaccuguacggccaccggcgagcaccgccgggagaaacgcuccgucgcgcuggugccccacgucgggaugggccuggagacccguaccgagaccuggaugagcagcgaaggcgcguggaagcacgcccagcgcaucgaaaccuggauccugcgccaccccggguucaccaucauggcugcaauccuggcguacaccaucgggacaacauacuuccagcgcguccucauauucauccugcugacugccguggcaccuaguaugaccaugcggugcaucgggaucuccaaccgcgauuucguggagggcgucagcggcggguccuggguggacaucgugcucgagcacggcagcugugucaccaccauggccaagaacaagcccacgcuggacuucgaacugaucaagaccgaggcgaagcagccagcgacccuccggaaguauuguauagaggcuaaguugacaaacacgacaacugccucccgaugccccacccaaggggagcccucgcugaaugaggaacaggacaagcguuucguguguaagcacucaaugguggaucgcggcuggggcaacggaugcggccucuuugggaaggguggcauuguuaccugcgccauguuuacgugcaagaagaacauggagggcaagauagugcagcccgaaaaucuggaguacaccaucguggucacuccacacucaggagaggagaacgccguggggaacgacacgggcaaacacgggaaggaaaucaaggugaccccgcaguccagcaucacugaggcagagcugacaggcuauggaaccgucacgauggaaugcagccccaggacugggcucgauuucaaugagaugguguuacugcaaauggagaacaaagcauggcuagugcaucgucagugguuccuggaccugcccuuacccuggcugccgggugccgacauccagggguccaacuggauccaaaaggagacacuuguuaccuucaagaacccgcacgccaagaagcaggacguggucgugcugggcucacaagaaggggccaugcacacugcgcuuaccggcgccaccgagauccagaugagcagcgggaaccuccuguucaccggccaccugaagugccggcucagaauggauaaguuacaacugaagggaauguccuacagcaugugcacagguaaguucaaggugaucaaggagaucgccgagacccagcacggcaccaucguggugagggugcaguacgagggggacggcuccccguguaagaucccuuucgagaucauggaucuggagaagaggcacgugcucggccgccucaucacagugaacccgaucgugacagagaaggacagccccgucaacaucgaagccgagccgcccuucggggacuccuacaucaucauuggcguggaaccgggccagcugaagcucagcugguucaagaaaggcuccuccauugggcagauguucgaaacgaccaugcgcggcgccaagcgcauggcgauauugggagacaccgccugggacuucgggucccugggcggaguguucacaagcaucggcaaggcccuccaccagguauuuggcgccaucuacggagccgcguucagcggcgugagcuggaccaugaagauccuuaucgggguggucaucaccuggaucggaaugaacagucggagcacgucccugagcgugucgcuggugcucgugggggugguaacgcuauaccugggcgucauggugcaagcagauucagggugcguggucucguggaagaacaaggagcugaaaugcggaagcggcaucuuuauuaccgacaacgugcacaccuggaccgagcaguacaaguuccagcccgagucacccagcaagcuugccagcgcaauccagaaagcgcacgaggaggggaucuguggcauucgcuccgugaccaggcuggagaaccuuauguggaagcagaucacccccgagcugaaccauauccugucagaaaaugaggugaagcucuccaucaugacuggggacaucaagggcaucaugcaggccgggaagcgcagucugcgaccccaacccaccgagcugaaguauuccuggaagacuugggggaaggccaaaauguuaagcacggagccgcacaaucagacguuccugauugacggcccggagacugccgagugccccaacacuaaucgcgcauggaacucccuggagguggaggacuacggguucgggguguucacuaccaacaucuggcucaagcugaaggagcgucaggacgucuucugcgacagcaagcucauguccgcggccaucaaggacaaccgcgccgugcacgccgacaugggguacuggauugagagcgcccucaacgacaccuggaagaucgaaaaggcgucuuucaucgaggucaagucaugccacuggcccaaaucccauacucuguggagcaacggcgugcuggaaagugagaugauuauccccaagaacuucgccgggccagucagccagcacaacuaccgacccggcuaccauacccagaccgccggcccguggcaccucgggaagcuggagauggacuucgacuuuugcgaaggcaccaccguggucgugaccgaggauugugggaaucgaggccccagccugcgcaccaccaccgccucgggaaagcucaucaccgaguggugcugccguagcuguacgcucccgccccuacgguaccgcggggaggacggcugcugguacgggauggagauccggccgcucaaggagaaggaggagaaccuggugaacucccuggucacggcggggcacgggcagaucgauaacuucagucucggggugcucggcauggcccuguucuuggaggagaugcuaaggacccgggucgggacuaagcacgcuguccugcucguggccgucuccuucaugacccugaucaccgggaacaugagcuuccgcgaccuggggcgggucauggucauggucggcgccgcgaugacggacgacaucgggaugggugucacguaccucgcccuccuggccgcauuuaaggugcgccccaccuucgcggcgggccuucugcugcgcaagcucaccuccaaggaguuaaugaugacaacuaucgggaucguccugcucagccaauccacuaccccggagaccauccuggaguuaacggacgcccuagcccuggguaugaugauucugaagauagucagaaacauggaaaaauaccaacucgcggugaccaucauggcgauccugugcguccccaacgcagugaucuugcagaaugccuggaaggugagcuguaccaucuuggcugccgucucugugagcccccugcugcucaccucuagccagcagaaggcggacuggauaccccuggcacugacgaucaaggggcuaaacccgaccgcaauuuuccugaccacgcugucucgcacgaacaagaagcggagcuggcccuuaaacgaggcgaucauggccguaggcaugguauccauacuggcgagcucucuccucaagaacgauaucccgaugacgggaccccugguggccgggggccugcucaccgucugcuauguucugaccgggcgcagcgccgaucuggaguuagagcgggccgccgacguucgcugggaagaccaggcggaaauaagcggcagcagcccaauccuuuccaucacgauuagcgaggacgggucgaugucaaucaagaacgaggaagaggagcagacccugaccauccucauacggaccggccugcuggugaucuccggccuguuccccguaagcaucccuauuacugccgccgccugguaccugugggaggugaagaaacagcgcgccggcgugcuuugggacguccccuccccaccgcccgugggcaaggcggaauuggaggacggcgccuaccgaauaaagcagaagggcauccugggguacagccagaucggcgccgggguguacaaggaggggacguuccacacaauguggcacgucacccgcggggccgugcugaugcacaagggaaagcggaucgagccguccugggccgacguccgcaaagaccucauaagcuacggcgggggcuggaagcuggagggcgaauggaaagagggggaggagguccaggugcuggcccuugagcccggcaagaacccucgggccguucagaccaagcccggccuguucaagacgaacaccggcaccaucggggccgucucccuggacuucucuccggggaccuccggcagccccaucguggacaagaagggcaaggugguugggcucuacgggaacggagugguaacgcgcuccggcaccuacgugagcgccaucgcccagaccgagaaguccauagaggacaaccccgagaucgaggaugacaucuuccggaaaaagcgcuugacgaucauggaucugcacccuggggccggcaagacgaagcgguaucugccggcuaucgugcgcgaggccaucaagcggggauuacgcacgcuuaucuuggcgcccacccggguggucgcugccgagauggaggaggcccuacgcggccugcccauccgauaccaaacccccgccauccgugcagaacacaccgggagagagaucguggacuuaaugugccacgcgaccuucaccaugcgacuucugagcccugugcgcguuccaaacuauaaccugauaauaauggaugaggcccacuucaccgacccggccucgaucgccgcccggggauacaucucaacgagaguggagaugggcgaagcggcagggauauucaugaccgccaccccgccgggcucccgggacccauucccucaguccaacgcccccauaauggacgaagagcgcgagauccccgagcggagcuggaacuccgggcacgaguggguaaccgacuuuaagggcaaaaccguaugguuugugcccagcaucaaggcgggcaacgacauagccgcuugucuccgcaaaaacggcaagaaagugauccaguugucccggaaaacuuucgauagcgaauacaucaagacccggaccaacgacugggacuucguaguaacgaccgacaucucggagaugggcgcgaauuucaaggccgagcgggugaucgacccccgcaggugcaugaagcccgucauccugaccgacggggaggagcgggugauccuugcggggccgaugcccguuacgcacuccuccgccgcccagcggcgcggucggaucggacgcaaccccaaaaacgagaacgaucaguauaucuacaugggcgaaccccucgagaacgacgaggacugcgcccacuggaaagaggcaaagaugcugcucgacaauauaaauacgccugaaggcaucauccccucaauguucgagccggaacgcgaaaaggucgacgcgaucgauggggaguacagacugcgcggggaggcgcggaagaccuucguugaccugaugcgccggggugaccucccgguguggcuggccuauagggucgcggccgaggggaucaacuacgcggaucggcgcuggugcuucgacgggaucaagaauaaccagauacuggaggagaacguggaggucgaaaucuggaccaaggagggggagcggaagaagcuaaaaccccgauggcuggaugcacggauauacuccgacccccuggcacucaaggaguucaaagaguucgccgcuggccgcaagagccucacccugaaucucauaacggagaugggccggcugccaaccuuuaugacgcagaaagcucgaaaugccuuggacaaccucgccgugcuucacaccgccgaggccggcgggcgugccuacaaucacgcucuguccgagcucccggaaacgcuggaaacacugcucuuacugacgcuccuggccaccgugaccggcgggaucuuucuguuucuaaugagcgggaaagggauaggcaaaaugacgcuggggaugugcugcauaaucaccgccagcauccugcucugguacgcgcagauccagccucacuggaucgccgccucaaucauacuggaguucuuccugauuguccuucuuauucccgagccugagaagcagcgcaccccucaggacaaccagcugaccuacguggugaucgccauacucacugucguggcugcgaccauggccaacgagaugggcuuccuggagaagaccaagaaggacuucggguuagguuccaucgccacacagcagcccgagucgaauauccucgauaucgacuugcggcccgccagcgccuggacacuguacgcgguggccacuaccuuuauuacccccaugcuccgccacucaaucgagaacucuucugucaacgugucuuuaacggccaucgccaaccaggcaaccguuuugaugggacucgggaagggcuggccgcuguccaaaauggacauaggcguuccccugcucgccaucggcugcuauagucaagugaaccccauuacccugacagccgccuuacucuuacuuguggcccacuaugcgauuaucgggccgggccugcaagcaaaggccacgcgggaggcccagaagcgugccgcugccggcaucaugaaaaacccgaccgucgaugggaucaccguuaucgaccuggaccccauacccuacgacccuaaguucgagaaacaauugggccaggugaugcuccugguccugugcguaacccagguguugaugaugcgaacgaccugggcccugugcgaggcccugacccucgccaccgggccgauuucgacgcugugggaaggcaaccccgggcgauucuggaacacuaccaucgcagugagcauggccaauaucuuccgcggcuccuaccuggccggcgcugggcuccuguuuaguaucaugaaaaacaccacgaacacccggcgcggcaccgggaacaccggcgagacucugggcgagaaguggaaaaaccggcucaacucccugggaaagucugaauuccaaaucuauaaacgauccgggauacaggagguggaucggacacuggcgaaggaggggauuaagcggggcgaaacugaccaccacgccgugagccgugggucggccaaguuaagaugguucgucgaacggaaccugguuacccccgagggcaaaguggucgaccugggcugcgggcgagggggauggagcuacuacugcggcgggcuaaagaacgugcgggaggugaaaggccugacuaagggcgggccaggucaugaggagccgauccccaugucaacauauggauggaaccugguccgccuccaguccggcgucgacguguucuuuacgccgccagagaagugcgacacccuguugugcgacaucggggaguccagcccgaaccccaccgucgaggccgguaggacucuccgcgugcugaauuuaguugagaacuggcucaacaacaacacccaguucuguaucaagguccugaacccguacaugccgucagugauugagaagauggagacccugcagcggaaguacgguggcgccuuggugcgcaauccgcuuucccggaacagcacccaugaaauguacugggucuccaaugcgagcgguaacaucgugucaagcgugaauaugaucuccaggaugcugaucaaucgguucacaaugcgccacaagaaggcuaccuaugagcccgacgucgaucuggggagcggcacccgcaacauagggaucgagucugagacacccaaccucgacauaaucggaaagcggauugagaagaucaagcaggagcacgagacgucguggcacuaugaccaagaccacccuuacaagaccugggccuaccacggcuccuaugagaccaagcagacagggagcgccuccagcauggucaacggcgugguccgccugcugacgaaacccugggacgugauccccauggugacccagauggccaugaccgacacgacgccuuucgggcagcaacgggucuucaaggagaagguggacacccgcacucaggaaccgaaagagggcacgaagaaacucaugaagaucacugcagaauggcuauggaaggaacuggguaagaagaaaacgccacgaaugugcacccgcgaggaauucgcccggaaggugcgcuccaacgccgcccuuggggcuaucuucacggacgagaacaaguggaaguccgcgagggaggccguugaagacucccgcuucugggagcugguggauaaggagcgggaccuucaccucgagggcaagugcgagacgugcguauacaacaugaugggcaagcgcgagaaaaagauaggcgaguucggaaaagccaagggcagcagagccaucugguauauguggcuaggcgcgcgcuuucuggaguucgaagcccucggguuccugaacgaggaccauugguuuucccgugagaacucauuaucaggcguagagggggagggccuccacaaguugggguacauccugcgcgagguguccaagaaggagggcggggccauguaugccgaugacacagccggaugggacacccggaucacccucgaggaccugaagaaugaggagauggucacuaaccacauggaaggcgagcacaagaagcuggccgaggccaucuucaagcuaacguaccagaacaaagucgugcgcguccaacggcccacgccccgcgggaccgugauggacauuaucagccggcgugaccaacgcggcuccggccaggucggcaccuacggacugaacaccuucaccaacaugggagcccagcugauucggcagauggagggcgagggggucuucaagggcauccaacaucucacagccacggaggaggucgccgugcaggacuggcuugcgagggucggccgggagcgccugucucggauggccaucuccggcgaugacugcguugugaagccgcucgacgaccgcuucgccaacgcucucaccgcccugaacgauaugggcaagguaagaaaggauauccagcagugggaaccaagcagggggugguccgacuggacccaggugcccuucugcagccaccacuuucaugagcucaucaugaaggacggacgggugcucgucguaccgugccguaaucaggacgaguuaaucggacgagcgcgcaucucgcaaggcgccggcuggagccuccgcgagaccgcgugccuggggaagucguacgcccagauguggagccuuauguauuuccaccgccgggaccucaggcucgccgcaaacgccaucugcagcgccgugccaagccacuggguccccacgucccgcaccaccugguccauacacgcccgccaugaguggaugacgaccgaggacaugcugacgguguggaaccguguguggauacaggaaaaccccuggauggaggacaagacccccguugagucuugggaagagaucccguaccucggcaagcgcgaggaccaguggugcggcucccugaucggccugaccagccgcgcuacuugggcccgaaacauccagacggcgaucaaccagguucgcucccuuaucgguagcgaagaguacaccgacuacaugccauccaugaaacguuuccggcgagaggaggaggaagcuggagugcuaugguga

SEQ ID NO: 24843 - RNA, 9876 nt, Artificial Sequence
  derived and/or modified CDS sequence (opt11) from DENV-2__KF041235__SS-prME
acagcaggcgugauaauaaugcugaucccuaccgccauggcguuccaccuuaccacacgcaacggggagccccacaugaucgugagcaagcaggagaagggcaaaucgcugcuauucaagaccgaggacggggugaacauguguacucucauggccauggaccugggcgagcugugcgaggauaccaucaccuacaauugcccccuccugaggcagaaugagcccgaggauauagacugcuggugcaacagcacaucuaccuggguaaccuacgggacgugcacagccaccggcgagcauaggcgggagaagcguagcgucgcacuggugccucacgugggcauggguuuggagaccaggaccgagacauggauguccagcgagggggccuggaaacacgcccagagaaucgagaccuggaucuugcggcaccccggguuuaccaucauggccgcuaucuuggcauacacgauaggcaccaccuauuuccaacgcguccucaucuucauacugcugacggcgguggccccuuccaugacaaugcggugcaucggcaucagcaaccgcgauuuuguggagggcguuuccggcgggagcuggguggacauaguacucgagcacggcucaugcguaaccacuauggcgaagaacaagccgacguuggacuucgaacuuaucaaaaccgaggcuaagcagcccgccacccuccggaaguacugcaucgaagcgaagcugaccaacacuacgaccgccagccgcugcccgacacagggggaacccucacuaaacgaagaacaggauaagcgguucguuugcaaacacagcaugguggaccgcggcugggggaauggcugcggccuuuucgggaagggcgggauugucacgugcgccauguucacuugcaagaagaacauggaggggaagaucgugcagcccgagaaccucgaauacacuauaguggucacaccccacucuggcgaagaaaacgccguugggaacgauaccggcaaacacgggaaagagaucaaagugaccccucaguccuccaucaccgaagccgagcugacuggcuaugggaccguaacaauggagugcucuccccggacgggccuagacuuuaacgagauggugcugcugcagauggagaauaaggcgugguuaguucaccgccagugguuccuggaccugccccucccguggcugccgggggccgacauccagggguccaacuggauccagaaggagacuuuaguuacguucaagaacccccacgcuaagaaacaagaugugguugugcuuggcagccaggagggggccaugcacacggccuugaccggcgcgaccgagauccagaugagcucugguaacuuauuguucaccggacacuugaagugccggcugcgcauggacaagcuccagcugaaaggcaugagcuauuccaugugcacugggaaguucaaaguggucaaggagaucgcugagacccagcacggcacuaucguagugcggguccaguacgagggggacgggagccccugcaagauccccuucgagaucauggaccuggagaaaagacauguccuuggccggcucaucaccgucaacccgauugucacagagaaggacuccccagucaacaucgaggcugagccgcccuucggggacuccuacaucauaaucgguguggagccaggccaacuaaagcucuccugguucaagaagggguccucuauagggcagauguucgagaccacuaugcgcggcgccaagcgcauggccaucuugggcgacaccgcuugggacuuugguagccugggcggggucuucacaucaaucgguaaggcccuacaccaaguguucggggccauauacggagccgcguucagcggagucuccuggaccaugaagauuuugaucggggucgugaucacuuggaucggcaugaacagcagauccacuagccuguccgugagccugguccucguggggguagucacgcuguaucugggcgugauggugcaggccgacuccgggugcgugguuaguuggaagaacaaggagcucaagugcggcagcgggauuuucaucaccgacaacgugcacaccuggaccgagcaguacaaguuccagccagagucccccagcaagcucgccuccgcaauccaaaaggcccacgaggaagggauuugcgguauucgcagcgucacgcggcuggagaaccucauguggaagcaaaucacccccgagcugaaccacauauuauccgagaacgaggugaaacuuaguauuaugaccggagauauaaaaggcaucaugcaagcggguaaacgcucgcuucggccgcagcccacugagcugaaguacagcuggaaaacguggggcaaggccaagaugcucuccaccgagccccacaaccaaaccuuucugaucgacggcccggagaccgccgaguguccuaacacgaaucgcgcuuggaacagccuggaaguggaggauuauggguucggcguauucaccaccaacaucuggcucaagcugaaggagcggcaggacguguucugcgacuccaagcucaugagcgcagcgauaaaagacaaccgcgcaguacaugccgacaugggcuacuggaucgagucugcccucaacgacaccuggaaaaucgagaaggccucguuuaucgagguuaaauccugucacuggcccaagagccacacgcugugguccaacggcgugcuggagucugagaugaucauccccaagaauuucgcgggccccgugagccagcacaauuaccgccccggguaccauacccagaccgccggcccuuggcacuugggaaaacucgagauggauuucgacuuuugcgaaggcaccaccguggugguaacugaggacugcgguaaccgcggccccucccugcggaccaccacggcgucaggcaagcucaucacggagugguguugccggucgugcacccugccgccccugcgguaccgcggcgaggauggcugcugguacgggauggagauccggccgcucaaggagaaggaggagaaccugguuaauagccucgugaccgccggucacgggcagauugacaacuucucgcugggcguguuggggauggcgcuguuccuugaagagaugcugcgaacccgcgucgggacgaagcacgccgugcuacucguggccgucuccuucaugacgcucaucaccggcaacauguccuuccgcgaccuggggcggguuauggugauggucggugccgccaugacggacgacaucggcaugggugucacauacuuggcguuacuugccgcuuuuaaagugcgccccacauucgccgccggacucuugcugaggaaguugaccagcaaggagcucaugaugaccacgauugggauaguccugcucucccagagcacgaccccggaaacuauucuggaacugacggacgcauuagccuuaggaaugaugauuuuaaaaauugugcggaacauggagaaguaucagcucgcggucaccaucauggccauucuguguguccccaacgcuguaauacuacagaacgcguggaaggucuccugcaccauccucgccgccgugucggugagcccccuguuacugacaagcagucagcagaaggccgacuggaucccauuagcgcugacgaucaaggggcucaaucccaccgcaauauuccugaccaccuugagccgcaccaacaagaagcggucguggccucucaacgaggccauuauggccgucggcauggugagcauacuggccagcagccuccuaaagaacgacaucccgaugacggggccccugguugccggcgggcuacucacagucugcuacgugcuaacgggucgcagcgccgaucuggaacucgagcgggccgccgacgugcgcugggaagaucaggccgagaucuccggguccuccccgauccugagcauuaccaucucagaagacgguagcaugucuaucaaaaacgaagaagaggagcagacccugaccauacucauccggaccggccugcuggucaucagcggccucuuuccgguguccauccccauuacagcggcggccugguaucugugggaggugaagaaacagcgcgccgggguucugugggacguccccagcccgccgcccgugggcaaggccgagcucgaggacggggcguaccgcaucaagcagaagggcauccugggguacucccagaucggcgcuggcgucuacaaggaggggaccuuccacacuauguggcacgugacgagaggggcagugcugaugcacaagggaaagagaaucgagccgaguugggcagacguccgcaaggaccuuaucuccuacggagggggcuggaagcuggagggcgaauggaaggagggggaggagguacaggugcuggcccuagagcccggcaagaacccgcgggcgguccagacuaaacccgggcuguucaagacgaacaccggcacgauuggggccgucagcuuggacuucuccccgggcacaagcggcuccccaaucguagauaagaaagggaagguggugggcuuauacgggaacggaguugucacgcgcagcggaacuuacguguccgccauagcccagaccgagaaguccaucgaggacaaccccgaaaucgaggaugacaucuuuaggaagaaaaggcuaaccaucauggaccugcacccgggagcgggcaaaaccaagcgguacuuaccggccaucgugcgcgaggccauaaagcgggggcugcgaacccuuauucuggcccccacgagggucguugccgcggagauggaggaggcucuccgaggccugcccauccgcuaccaaacucccgccauucgggcggaacacacgggucgcgaaaucguggaccuaaugugccaugccaccuucacuaugcgccuccuuagcccgguccgcgugcccaacuacaaucucauuauuauggacgaagcgcacuucaccgaccccgccuccauugccgcccggggcuauauuagcacacgcguggagaugggagaggccgcggggaucuucaugaccgcgacgccuccuggaucccgggaucccuucccccaaagcaacgccccgauuauggacgaggaacgugagauacccgagcguucauggaacagcgggcacgagugggucacagacuucaaggguaagacggugugguucgugccaucgaucaaggccggcaacgacauagcggccugucuccgcaagaauggcaagaaggucauucagcuaucgcggaaaaccuucgacucugaguacaucaagacccgcaccaacgacugggacuucguggugaccaccgacaucagcgagaugggggccaauuucaaggcugagcgggucaucgacccccgccggugcaugaagcccguaaucuuaacugacggcgaggagagggugauccucgccggacccaugccggucacgcacuccagcgcagcccagcggcgggggagaaucggucgcaaccccaagaacgagaacgaucaguacaucuacaugggagagcccuuagagaacgacgaggauugcgcccacuggaaggaggcgaagaugcuccuggauaauaucaacacgccggagggaaucauccccucaauguuugagcccgaaagggagaagguggacgccaucgacggcgaguaccggcuacgaggcgaggcuagaaagacuuuuguggaucugaugcgcagaggggaccuaccggucuggcuggccuaccgcguggccgcggaagggaucaacuaugccgacagacgcugguguuucgauggcaucaagaauaaccagauccuggaagagaacguggaaguggaaaucuggaccaaggagggggaacgcaaaaagcuaaagccgcgcuggcuggacgcgcggauuuacucggacccccuagcgcugaaggaguucaaggaguucgcggcaggccgcaagucccugacccuuaaucuaaucacggaaaugggaagacugccgacguucaugacccagaaagcgcgaaaugcccuggacaaucuggccgugcuacacacagccgaagccgggggucgggccuacaaccacgcccugagcgaacucccagagacgcuagagacauuacuccuguugacccuccuggccaccgucaccggagggauauuccuguuccucaugucaggcaagggcaucggaaaaaugacccuagggaugugcuguaucaucaccgccagcauucugcucugguaugcccagauccagccccacuggauagcggcauccaucauccucgaguucuuccugaucguguugcugauccccgagcccgagaagcagcgcacaccgcaggauaaccagcugaccuauguaguuaucgccauucugacagugguggccgcgacgauggcgaaugagaugggcuuccuggaaaagaccaagaaggacuuugggcugggaagcaucgccacccagcagcccgagaguaacauccucgauauagaucuacggcccgccuccgcuuggacgcuuuacgccguagcgaccaccuucaucaccccaaugcuccgucacagcaucgagaacuccucggugaacguaagccugacagcaaucgcaaaccaggccaccguccugaugggccucgggaagggauggccguuaucaaagauggauaucggggugccccuccucgcgaucggcugcuacagccaggugaaccccauuacccugacugcagcccuacuccugcuggucgcccacuacgccaucaucgggccuggccuccaggcgaaggcaacgcgggaggcccagaagcgugccgccgcgggaaucaugaagaaucccaccguggacgggaucaccguaaucgacuuggaccccauaccguacgaccccaaguucgaaaagcaguuaggccagguaaugcuccugguguuaugcgucacccaggucuuaaugaugcggacuacuugggcccuaugcgaggcccuuacucucgcuacugggcccaucaguacgcugugggaggggaaccccgggagauucuggaacaccacuauagccguguccauggcuaacauuuucaggggcagcuaccuagccggagccggguuauuauuuuccaucaugaagaacaccacgaacacccggaggggcacugggaauacgggcgagacgcugggcgagaaauggaagaacaggcucaauucauuggggaagucugaguuccaaauauauaagcgcaguggaauccaggagguggaucguacccuggccaaggaagggaucaagagaggugagaccgaccaccacgcgguuucccgcggaagcgccaagcuccgcugguucgucgagcggaaccuggugacgcccgaggggaagguuguugaucuggggugcgggcgcggggguugguccuacuacugcggcgggcuuaagaaugugagggaggugaagggccugacgaagggcggaccuggccacgaggagccgauccccaugagcacguacggguggaaccugguucgguuacaguccggcguagacgucuuuuucacacccccagagaagugcgacaccuuacugugcgacaucggggagagcagcccuaaccccacggucgaggcaggccggacacugcgcguguuaaaccuggucgaaaacuggcucaacaacaacacacaguuuugcaucaaagugcuaaauccguacaugccgagugugaucgagaaaauggaaacguugcagcggaaguacggcggggccuugguccgcaacccccucagccggaacuccacccacgagauguacugggugagcaacgccucgggcaacaucgugagcuccgucaauaugauuagccgcaugcuuaucaaccgguucacgaugcgccacaagaaggccaccuacgagcccgacguggacuuaggguccggcacccggaacaucgggaucgaguccgagacgccaaaccucgauaucaucggcaagcggaucgagaagaucaagcaggagcacgagacuucauggcauuaugaccaggaucacccguacaagaccugggccuaccacggaagcuacgagaccaagcaaaccgggucagccucguccauggugaacggugucgugcgacugcuaacgaagcccugggaugugauccccauggucacccagauggccaugaccgacaccacgcccuucgggcagcagcggguguuuaaggagaagguugacacgcgcacccaggagccgaaggagggcaccaagaaguuaaugaagauaacggccgagugguuauggaaagagcugggcaagaagaagacgccccguaugugcacccgcgaagaguucgcccggaagguacgcucaaaugcagcucucggggcaaucuucaccgacgagaacaaguggaaguccgcccgagaagccguggaggacucucgcuucugggagcuggucgacaaggagcggaaccuucaccuugagggaaagugcgagacgugcguguacaacaugauggggaagcgcgagaaaaagaucggcgaguucgggaaggccaagggaucccgugcuaucugguacauguggcuaggcgcccgcuuucucgaauuugaggcgcuuggcuuccugaacgaggaccauugguucagccgggagaacagccuuucaggcguggagggggagggccuccauaaauuggguuacauccugcgcgaggugagcaaaaaggaggguggcgccauguacgccgaugacaccgccgggugggacacccggaucacacucgaggaccugaagaaugaggagaugguuacaaaccacauggagggcgagcacaagaaguuagcagaggcgauauuuaagcugaccuaccagaacaaggugguccgcguucaacggcccacgccccgcggaaccguaauggacaucaucagucggcgcgaccagcgaggcagcggucaggugggcacguacggcuugaacacguucaccaacaugggggcccagcucauccggcagauggagggcgagggaguguuuaagggcauccagcaccucaccgccacugaagaaguggccguccaggacuggcuggcccgcguaggccgggagcgccugagccggauggcgaucagcggcgacgacugcguggucaagccgcucgacgaccgcuucgcuucggcccuuacggcgcugaaugacaugggcaaggugcguaaggacauacaacagugggagcccagccgcggguggaacgacuggacccaagugccuuuuugcagccaccacuuucacgagcugaucaugaaagacggaagaguccugguugugccuugccgcaaccaagacgagcugaucggccgggcccgcauaagccagggcgcggguuggagucuccgggagaccgccuguuuagguaagagcuaugcucagauguggucguuaauguacuuccaccgccgggaccuccgccuugccgccaacgcaaucugcagcgccgucccuagucauuggguacccacgagccggacuaccugguccauccacgcccgccacgaguggaugaccaccgaagacaugcugacgguguggaaccgggucuggauccaggagaaucccuggauggaggauaagacucccguggagagcugggaagagaucccguacuuggggaagcgcgaggaccaguggugugggagccugaucggccugacuucacgcgccaccugggcgcggaacauccaaacugccaucaaucaaguacgcagccuuaucgguagcgaggaguacaccgacuacaugcccuccaugaagcguuuccgacgggaggaggaggaggccggaguccucugguag

SEQ ID NO: 24844 - RNA, 9876 nt, Artificial Sequence
  derived and/or modified CDS sequence (opt11) from DENV-2__KF041237__SS-prME
acggcaggcgugaucaucaugcucauccccaccgccauggccuuccaucucaccacccgcaacggggagccccauaugaucgucagcaagcaggagaaggggaagucccuguuauucaaaaccgaggacggggugaacaugugcacucucauggcuauggaccugggcgagcuuugcgaagacacaaucacauacaacugcccccuccuccggcagaacgagcccgaggauauugacugcuggugcaacagcaccucuacguggguuaccuauggaaccuguacggccaccggagagcaccgcagggaaaagcgcagcguugccuuagugccucacgucgggaugggucucgaaacucggaccgagaccuggauguccucggagggugcguggaagcaugcgcaacgcaucgagacuuggauucuucgacaccccgguuucaccauaauggcugcaauacuggcauacacgauuggcaccaccuacuuccaacgaguccucaucuucauccuacugacggcuguggcccccucuaugaccaugcgguguauagggaucagcaaccgagauuucgucgagggcgucucaggcgggucauggguggacaucguguuggaacacggcucuugcguuaccaccauggccaaaaauaagcccacgcuggauuucgaguugauaaaaaccgaagccaaacagcccgccacccugcggaaguacugcauugaggcgaaacugaccaacacgaccaccgccagucgcugcccuacacaaggagagcccucccucaacgaggagcaggacaaaagguucguuugcaagcacaguaugguggaccgcgguuggggcaauggcugcggccucuucgggaagggcgguaucguaaccugcgcaauguucacgugcaagaaaaauauggagggaaagaucguucagcccgagaaucucgaguacaccauuguugucacgccccacuccggcgaggagaacgcgguggggaacgacacgggcaagcacgggaaggagaucaagguuacaccccagagcuccaucacggaagcggaguugacgggcuacgggaccgucacuauggaguguucaccacggacaggccucgacuuuaacgagauggugcuccugcagauggaaaacaaagcguggcucgugcaccgccagugguuccucgaccugcccuugccaugguuaccgggggcagacauucagggauccaacuggauccagaaggagaccuuaguaaccuucaagaacccccacgccaagaaacaggauguggucgugcucggcucgcaagaaggagccaugcauacggcgcugacgggcgcgaccgagauccagauguccucaggcaaccugcuguucaccggucauuuaaagugccgguugcgcauggauaagcuccaacugaagggcaugagcuacuccauguguaccgguaaguucaaaguggucaaagaaaucgccgagacucagcacggcaccaucguagugcggguccaauacgagggggacgggagccccugcaagauuccuuucgagaucauggaccucgaaaagcgucacguacucggccgccugaucacugugaaucccaucguuacggagaaggacuccccggugaauaucgaggccgaaccgccauucggagacucguacaucaucauuggcguggagccgggucagcugaaguuaucuugguucaagaaagguucuucuaucggacagauguuugaaaccacuaugcggggcgccaagcgcauggcuauccuuggagacacagcgugggacuucgggucgcugggcgggguuuuuacguccaucggcaaggcccuccaucaaguuuucggugcuauauacggagccgcguuuagcgggguguccuggaccaugaagauccucaucggggucgugaucacauggaucggcaugaacucacggucaacuagccuguccgugucccucguuuugguggggguugucacccuguaccugggagugaugguucaggccgacuccggcugcgucgugagcuggaagaacaaggagcuaaaguguggcagcggcaucuucaucaccgacaacgugcacacguggaccgagcaguacaaguuccaacccgagucuccgagcaagcuggccuccgcaauucagaaggcgcacgaagaggggaucugcggcauucgcagcgucacgaggcuugagaacuugauguggaaacaaaucaccccagagcugaaucacauccuauccgaaaaugagguuaagcucagcaucaugaccggggacauaaagggcaucaugcaggcgggaaagagaucgcuccguccgcagcccaccgagcugaaguacagcuggaagacgugggguaaggcgaaaaugcucuccaccgaaccgcacaaccaaaccuuucugaucgauggcccggaaaccgccgagugccccaacaccaauagggccuggaacucgcucgagguggaggacuacggcuucggggucuucacaacaaacauuuggcugaaacuuaaggagcggcaggacguauuuugcgacuccaaauuaaugucugccgcgaucaaggacaaucgcgccgugcacgcugauaugggguacuggauagagucggcucucaaugauaccuggaaaaucgagaaggccagcuucauagaagucaagaguugucacuggcccaagagccacacgcuguggaguaacggcguuuuagagagcgagaugauuauuccgaaaaauuucgcgggcccggugucacagcauaacuaccggccuggauaccacacucagaccgccggacccuggcaucucgguaaguuggagauggauuucgauuucugugagggcaccaccgucguaguaacggaagacugugggaaccgaggccccucacugcggaccaccaccgcgagcgguaaacucauuacggaguggugcugccggucgugcacccugccgccccuacgguaccgcggggaagaugggugcugguacgggauggagaucagaccgcucaaggagaaagaggagaaccuggucaauagccuugugacugcaggccacggccaaaucgacaacuucucccucggcgugcugggcauggcgcuguuccucgaggagaugcuacgaacccgggucgggacgaagcacgccgugcuguugguggcggucagcuucaugacccugaucaccggcaacaugaguuuuagagaccugggccgggugauggugauggucggcgcugccaugaccgaugacaucgggaugggcgugacguaucucgcccugcuugccgccuuuaagguacgccccaccuucgcugccggacuccuguugaggaaacucaccagcaaggaguuaaugaugaccacgaucgggauagugcuguugucccaaucaaccacgccggaaacuauccuggaauuaacggacgcuuuagcccugggcaugaugauacucaagauuguacggaacauggagaaauaccaacucgcugucaccaucauggcaauuuuaugcgugcccaacgccgugauccugcagaaugcguggaaagucucuugcaccauacucgccgcggugagcgucagcccccuguuacucacgucaucccagcagaaggccgacuggaucccccuagcuuuaacgauuaaggggcucaauccgacugccauuuuccugacgacacugagccgaacuaacaaaaagcgguccuggcccuugaacgaagccaucauggcugucgggauggugagcauacuugccucgucgcuccucaagaacgacauucccaugaccgguccccugguggcuggcggacugcucacgguuugcuacgugcugaccggacgaagcgccgauuuggagcuagaacgggccgccgacguacggugggaggaccaggccgaaauaucugggagcaguccaaucuuguccaucacgaucucugaggacgguagcauguccaucaaaaacgaagaggaggaacagacucugaccauccucauccgcacgggccuacuggucaucagcggucuauuccccguuucgauccccauuacggcggcugccugguaccugugggaggugaagaagcagcgcgcaggggugcuuugggaugugcccagcccgccgcccgugggcaaggccgaguuggaagacggggcguaccggaucaagcagaagggcauccugggguacucccagauaggagcgggcguguacaaggagggcaccuuccauacaauguggcacguuacccgcggggccguucugaugcacaaggggaagcggauugagccgaguugggccgacguccgcaaggaccucauuuccuacgguggaggcuggaaacuugaaggugaguggaaggaaggggaggaggugcagguacuggcccuugaacccggcaaaaauccgagagcgguccagacaaagcccggccuguuuaagacuaacacaggaacuauaggggcugucuccuuagacuuuucccccgguaccagcgggagccccaucgucgacaaaaaggggaaggucgugggccuguaugggaacggcgucguuacgcgcagcggcacguacguguccgcaaucgcccagaccgaaaaauccauagaggacaacccggagauagaggaugacaucuuccggaagaagagauugacaaucauggacuuacacccuggagcggggaaaaccaaacgcuaccugccggccauugugcgcgaagccauaaagagaggccuacgcaccuuaauacuggcccccacgcgggucguagccgcggagauggaagaggcucuccgcgggcugcccauccgcuaucagacccccgccauccgggcagagcacacuggccgcgagauuguggaccucaugugccacgccacauucacaaugcggcucuuaagcccgguucgcgugccaaacuacaaucuaauaaucauggacgaggcacacuucaccgacccggccagcauugccgcccggggauacauaagcacccgcguggaaaugggagaggcugcagggauuuucaugacggcuacgccacccggcucacgugacccauucccacagagcaacgccccgaucauggacgaagaacgagagauacccgaaagaucguggaacucugggcacgagugggucacagacuucaaaggcaagacggugugguucgugcccuccaucaaagcaggaaacgacaucgcagcaugccuccgcaagaauggcaagaaggucauccaacugagccggaagaccuucgauuccgaauacauuaagacccggaccaacgacugggacuucguggugacgacagacaucucugagaugggggcaaauuuuaaggccgaacguguaauagacccccgccggugcaugaagcccguaauccuaaccgacggcgaagaacgcgugauccucgcuggcccgaugcccguuacgcacuccagugcggcccaacggcgaggacggaucggacgcaaucccaagaacgagaacgaucaguauaucuacaugggggagccccuugagaacgacgaagacugugcccacuggaaggaggcaaagaugcuguuagacaacaucaacacgccggaaggaaucauucccuccauguucgaaccagagcgugagaagguugacgcaaucgacggcgaguaucggcugcgcggggaggcccgaaaaacuuucguggaccugaugcgucggggcgaccuaccggucuggcuggcuuacaggguggccgcggagggaaucaacuacgcugauagacgcuggugcuucgaugggaucaagaacaaccaaauccuggaggaaaauguugaaguugagaucuggaccaaggagggugagaggaagaaacucaagccacgcuggcuugacgcccggauuuacagcgacccccuggccuuaaaagaguucaaggaauuugcagccggacggaagucauugacccugaaccucauaaccgaaaugggaagacuacccacguucaugacccagaaggccaggaacgcccuggacaaccuagccguacugcacaccgcggaggcuggcggccgggcauacaaccacgcacucagugagcugccggaaacacuagagacucuacuccugcugacccuccuggccacugucaccgggggcaucuuccuguuccucaugaguggcaaggguaucggcaagaugacccuggggauguguugcaucaucaccgccagcauacugcucugguacgcccagauccaaccccacuggaucgcggccuccaucaucuuagaguucuuccugaucguccuccucauacccgaacccgagaagcagcgcacuccgcaggacaaccagcucaccuacguggucaucgccauccucacggugguggccgccaccauggcaaacgagaugggcuuccuggagaaaaccaagaaggauuucggguugggcagcaucgccacacagcaacccgagaguaacaucuuagacaucgaccuccggcccgcgucagcguggacgcuuuacgccgucgcgacgaccuuuaucacccccauguugagacauagcaucgagaacucuucgguaaacgugucccugacagccaucgccaaucaggccacgguccugaugggccucgggaaaggcuggccgcucagcaagauggacaucggggugccgcuucucgccaucggauguuauucucaggugaaccccaucacccugacugccgcccuccugcugcuagucgcccacuacgccaucaucgggccgggucuccaggcgaaggccacgcgggaagcucaaaaacgagccgcagcgggaauuaugaaaaacccgacaguagacgggaucaccgugaucgacuuagaccccauucccuaugauccaaaguuugaaaaacagcugggccagguuauguuacuggugcugugugugacccagguccucaugaugcgaacgacaugggccuugugcgaggcucugacccucgccacuggacccaucucaacccucugggaggggaaccccgggagauucuggaacaccacaauugccgucuccauggcuaacaucuucagaggcucuuacuuggccggggccggacucuuauucucgaucaugaagaacaccacgaacacccgcagaggcacuggcaacacuggagaaacgcucggcgagaaguggaagaaccggcuuaacucccugggaaaguccgaauuucagauuuacaagcgcagcgggauacaagaaguggauaggacuuuggcaaaagaggggaucaaacggggagagacggaucaucacgcggucucacgggggagcgccaaacuaaggugguucguggagcggaaccuggucaccccggaggguaaggucguggaccuggguugcgggagaggugggugguccuacuacugcggagggcucaagaaugugcgugagguaaaaggccugacgaagggagggccuggacacgaggagccuauccccaugucgaccuacgguuggaaccucgugcgguuacaauccggcguugacgucuucuuuacgccgccugaaaagugcgacacgcugcugugcgacaucggagagucaagccccaaccccacgguggaagccggaaggacccuucgcguuuuaaaccuugucgagaacuggcucaacaacaauacccaguucuguaucaaggugcugaacccauacaugccuuccguuaucgagaaaauggaaacgcugcagcggaaguacggcggagcccugguucgcaaccccuuaagccgaaacucgacccacgaaauguauuggguaaguaacgccuccggcaacaucgugagcuccgucaacaugaucagccgcaugcugauaaaucgguuuacgaugcgccacaagaaggcuaccuacgagccagacguggaccuuggguccggaacccgcaauauuggcaucgagucggaaacccccaaccucgacaucaucggcaagcgcaucgagaagaucaaacaagagcacgagacaucuuggcacuacgaccaagaccacccuuacaaaacgugggcauaccacggcagcuaugagaccaaacaaaccggauccgcuagcuccaugguuaacgguguugugcgccugcucacuaagcccugggacgugaucccuauggucacgcagauggccaugaccgacaccacccccuucgggcaacaacgcguguuuaaagaaaaaguugacaccagaacccaagaaccgaaggaaggcaccaagaaacuaaugaagaucacggcagaguggcuguggaaggagcuagguaagaagaagaccccaaggaugugcacccgcgaggaguucgcgcgcaaaguccgcagcaacgcugcucuuggugccauuuucaccgaugaaaauaaguggaagucugcccgggaagcugucgaagacucgcgguucugggaacuggucgacaaggaacggaacuuacauuuggaaggcaagugcgagacaugcguauauaacaugauggggaagcgugagaagaaaauaggcgaguucggcaaggccaaggggagucgggcuauaugguacauguggcugggcgcucgcuuucuggaguucgaagcccucggguuccugaaugaggaccacugguucaguagagagaauagccucagcggcguggagggggaggggcuccacaaacuuggauauauccugcgcgaagucagcaagaaagaagggggcgccauguacgccgaugauaccgcugggugggauacccgcaucacacucgaggaccuuaaaaacgaggagauggugacgaaccacauggagggagagcacaagaaacuagccgaggccauauucaagcucaccuaccaaaacaaagugguccgcguccagcggccgacgccccgcgggaccguuauggauaucauaaguagacgugaccaacgcggaucagggcaggucggcacuuacggccugaacacauucaccaauaugggggcccaguuaauccgacaaauggagggugaggguguguucaagggcauccagcauuugaccgccacagaagagguggcaguccaggacuggcuggcgcgagucggcagagaacgacuguccaggauggccaucagcggugacgacugcguggugaaaccgcucgacgaccgcuuugccucugccuugaccgccuuaaacgacaugggaaaggugcgcaaggauauucagcagugggaacccucacgcggguggaaugacuggacccaggugccguucugcagccaucauuuccacgagcucauuaugaaggauggccgggugcuagucgugcccugccggaaucaggacgagcugaucgggcgugccaggaucagccagggcgcuggcuggucccugcgcgagaccgccugccugggcaagagcuacgcccagauguggaguuuaauguauuuccaccgccgggaccuaagacuugcagcuaacgcaauauguagugccgucccgucccauugggugccuacaucucguaccaccugguccauacacgccggccacgaguggaugacaaccgaggacaugcucacgguguggaacagagucuggauccaggaaaaucccuggauggaggacaaaacccccguugagagcugggaggagaucccguauuuggggaagcgagaggaccaaugguguggcagucugaucggacucaccuccagagcgacgugggccaggaacauucagacggccauuaaccaggugcggagcuuaauuggauccgaggaauacaccgacuacaugcccagcaugaaacguuucaggcgcgaggaggaggaggccggcguucugugguaa

SEQ ID NO: 24845 - RNA, 9876 nt, Artificial Sequence
  derived and/or modified CDS sequence (opt11) from DENV-2__KM217156__SS-prME
acagcaggggugaucaucaugcugauccccaccgccauggcguuccaccucacaacuaggaauggggagccccacaugaucgucagcaagcaggagaagggcaagagucuauuguucaagacugaggacggggugaauaugugcacccucauggccauggaccugggcgaacugugcgaggacaccauuaccuauaacugccccuugcuccggcagaaugagccggaggacaucgacugcuggugcaacgcgaccuccaccugggugaccuacggaaccugcaccgccaccggugagcaccgccgggagaagcgguccgucgcccuuguaccccacgugggcaugggucucgagacccguaccgagaccuggaugagcuccgaaggcgcguggaagcacgcgcagcgcaucgagaccuggauccugcggcacccgggguucacaaucauggccgccauccuggcguacaccaucggcaccaccuacuuccaacgcguucucaucuucauccugcugacggccguggcucccagcaugaccaugcgguguaucggaaucuccaaccgcgacuucguggaaggcguuagcgguggguccuggguggacaucgugcucgagcacgguagcugugucaccaccauggccaagaacaagcccacgcuggacuucgagcuaaucaagaccgaggccaagcagcccgcgacccuccggaaguacugcaucgaggccaagcugacaaacacuaccaccgccucccgcugcccgacccagggcgagcccagccugaacgaggagcaggacaagcgguucgugugcaagcacagcaugguugaccggggcuggggcaacgggugcggccucuucgggaaagggggcaucgucacgugcgccauguucacgugcaagaagaacauggagggcaagaucguucagccugagaaccuggaguacaccaucguggucacgccccacagcggcgaggagaacgcaguuggcaaugacacugggaagcacgggaaggagauuaaggugaccccgcaguccaguaucaccgaggcggagcugaccggcuacgggaccgucacgauggagugcagcccccggaccggccuggacuucaacgagauggugcugcugcagauggagaauaaggccuggcucgugcaccgccaaugguuccuggaccugccucugcccuggcuuccgggcgccgacauccaggggagcaacuggauccagaaggagacccuggucaccuucaagaacccccacgcaaagaagcaggacguggucguacucggcagucaggagggcgccaugcacacggcgcugaccggcgccaccgagauccagaugagcucuggaaacccccuguucaccggccaccucaagugccggcugcggauggacaagcugcagcugaagggcauguccuacagcaugugcacggggaaguucaaggucgucaaggagaucgccgagacccagcacggcaccaucgucgugaggauccaguacgaaggggacgguucccccugcaagaucccguuugagaucauggaucuggaaaagcgccacguccugggccgccucaucaccgugaacccuaucgugacggaaaaggacucucccguuaacaucgaggccgagccucccuucggggacuccuauaucaucaucggcguggaacccggacagcugaagcugagcugguucaagaagggcuccagcaucgggcagauguucgagaccaccaugcgcggcgccaagcgcauggcgauccucggcgacacugcgugggacuucgggucccugggcgggguguucaccagcauaggcaaggcucugcaccagguauucggugccauauauggugcggccuucuccggcgugagcuggaccaugaagaucuuaaucggggucgucaucaccuggaucggcaugaacagcaggagcaccuccuuaagcgugucccugguccuaguggggguggugacgcucuaccugggcgucaugguccaggccgacagcgggugcguggucuccuggaagaacaaggagcugaagugcggcucugguaucuuuuucacugacaacgugcacaccuggaccgagcaguacaaguuccagcccgaaagccccucuaagcucgccagcgcgauccagaaggcgcacgaggaggggaucugcggcauccgcuccaucaccaggcuggacaaccugauguggaagcagauaacccccgaacucaaccacauccugagcgagaacgaggugaagcuaaguaucaugaccggggacauuaagggaauuaugcaggccgggaagcgcagccuccggccccaaccuaccgagcugaaguacuccuggaagaccugggguaaggccaagaugcugagcaccgagccgcauaaccagaccuuccuaaucgacggccccgaaaccgcccagugccccaacacgaaccgcgccuggaacucgcuggaggucgaggauuauggguucggcguauucaccaccaacaucuggcugaagcucaaggaacggcaggacguguucugcgacagcaaguuaaugucagcggccaucaaggacaaccgcgccguccacgccgacaugggauacuggauagagagcgccuuaaacgacaccuggaagauagagaaggcguccuucaucgaagucaagagcugccacuggcccaagucccacacgcucuggagcaacggcgugcuggaguccgaaaugaucaucccgaagaacuucgccggccccgugagccaacacaauuacagacccggguaccacacccagaccgccggccccuggcaccuggggaagcucgagauggacuuugacuuuugcgaggggaccaccguuguggucacggaagacugcgggaaucgcggcccgagcuugcggaccaccaccgccuccggcaagcugaucacggaguggugcugccguagcugcacccucccaccacuccgguaccgcggagaggacggcugcugguacgggauggagauacggccccugaaggagaaggaggagaaccuugugaacucucuggugaccgcuggacacgggcagaucgacaacuucagccugggaguccucggcauggcccuguuccuggaggagaugcuccggacccggguggggacgaagcacgcagugcugcuggucgccguguccuucaugacccucaucacgggcaacaugagcuuuagggaccugggccgugucauggugauggugggcgccgcgaugaccgacgacaucgggaugggggugacguaccuggcccuacuggccgccuucaagguccgccccaccuucgccgcgggccugcuccugagaaaacuuaccuccaaggagcucaugaugaccacgaucgggaucgugcugcugagccaguccaccacccccgagaccaucuuagagcugacggacgcccuggcccucgguaugaugauacugaagaucgugcggaacauggagaaguaccagcuggccgucaccaucauggccauccucugcgugcccaacgccgucauccuccagaacgccuggaaaguuagcugcacaauccuggccgccguguccgucagcccccuccugcucacuucuagccaacagaaggcugacuggauuccgcucgcccugacgaucaaggggcugaauccaaccgccaucuuccugaccacccuguccagaacgaauaagaaacgcagcuggccgcugaacgaggccaucauggcugugggcaugguguccauacucgcgucgucccuucugaagaacgacauccccaugacgggcccccucgucgccgguggccugcugaccguguguuacgugcucaccggacgcagcgccgaccuggaguuggagcgggcagccgacguucggugggaggaccaggccgagaucagcggcuccagccccauccucuccaucacgaucagcgaggacggguccaugagcaucaagaacgaggaggaggaacagacgcugaccauccugaucagaacggggcuccuggugauuuccggccuguuccccgugucaaucccuaucacggccgccgccugguaccucugggaggucaaaaagcagagagccggugugcugugggacgugccgagcccgccgcccgucggcaaggcggagcuggaggacggggccuacagaaucaagcaaaagggcauucucggguacagccagaucggcgcaggcguguacaaagaggggaccuuccacaccauguggcacgugacccgcggcgccguccugaugcauaaggggaagcgaaucgagcccuccugggcagaugugcgcaaggaccuuauuagcuacggcgggggcuggaagcuagagggcgaguggaaggagggggaggaggugcaaguucuggcgcuggagcccggaaagaacccccgggccgugcagacgaagcccggccuguucaagacgaacaccggcaccaucggggccgugucccuggacuucagcccugguaccuccggcagccccaucgucgacaagaagggaaagguggugggccuguacgggaacggcgucgugacgcgcuccggcaccuacgugagcgccaucgcgcagaccgagaaguccaucgaggacaaccccgagaucgaggacgacaucuuccggaagaagcgccucaccauaauggauuuacacccgggagcgggcaagacgaagcgguaccugccggccaucguucgagaggcgaucaagcggggccugcggacccucauccucgcccccacccggguuguugcggccgagauggaggaggcccugcgcggccuccccauccgguaccagaccccggccauccgggccgagcacacggggcgcgagaucgucgaccugaugugccacgcgaccuucaccaugcgauuacucagccccgugagagugcccaacuauaaccugaucaucauggacgaggcccacuuuaccgaccccgccagcauagccgcccggggcuacaucuccacgcgcguugagaugggcgaggccgcugggauauucaugacagccaccccgcccggcagccgggauccuuucccgcaguccaacgccccgauaauggacgaggagcgcgagauccccgagcgaagcuggaacuccgggcacgaguggguaaccgacuuuaaaggcaagacggugugguucgucccuagcaucaaggcagggaacgauauugccgccugccugcgcaagaacggcaagaaggugauccagcucucucggaagaccuucgacagcgaguauaucaagacgcgcaccaaugacugggacuucguggucacgaccgacauauccgagaugggcgccaauuucaaggccgagcgggucaucgacccccgccgguguaugaaaccggugauccugaccgacggggaggagcgcgugauacuggccggucccaugccagugacccacucguccgccgcccagcggcgcgggcggaucggccgcaacccgaaaaacgaaaacgaccaguacaucuacaugggggagccgcucgagaacgacgaggauugcgcacacuggaaggaggccaaaaugcugcuggacaacaucaacacucccgagggcaucaucccaagcauguucgagccugagcgcgagaagguggacgccaucgacggugaguaccggcuccguggggaggccagaaaaaccuucgucgaccugaugcgccguggcgaccugcccguguggcucgccuaccgcguggccgccgaggggaucaacuacgcggaccggcgcuggugcuucgacggcaucaaaaacaaucagauccuggaggagaacgucgagguggagauuuggaccaaggagggggagcggaagaaguuaaagccccgcuggcucgacgcccggaucuacucggacccccuggcccugaaggaguuuaaggaguuugcggccgccagaaagagccuuacccugaaccugaucacugagaugggccggcucccgaccuucaugacccagaaggccagaaacgcccuggacaaccuggccguccuccacacagcggaggccggcggccgggccuacaaccacgcucuguccgaguugccagagacgcucgagacccugcugcuccugacccugcucgccaccguaacgggcgggauuuuccuguuccugaugagcggcaaaggcaucggaaagaugacgcucggcaugugcugcauaaucaccgcguccaucuuauugugguaugcucagauccagccucacuggaucgccgcaagcaucauccucgaguucuuucugaucguucugcucauccccgaaccagagaaacagcguacgccccaggacaaccaguugaccuacgucgugauagccauccugacgguggucgcggcuaccauggccaacgagaugggguuccucgagaagaccaagaaagacuucggucugggguccaucgccacccagcagcccgagagcaacauucuggacaucgaccuccggcccgccagcgcuuggacccuguacgccguggccaccaccuucaucacgccgaugcugcgacacuccaucgagaacagcucggugaacgugagcuugacggccaucgcgaaccaggccaccgugcuuaugggccugggcaaaggguggccccucuccaagauggacaucggcgugccccuucuggccaucgggugcuacagccaggucaaccccaucacgcucaccgccgcgcugcugcuauuaguggcgcacuacgcaauuaucggcccggggcugcaagccaaggccucccgggaggcccagaagcgcgcggccgcgggcaucaugaagaaccccacggucgacggcaucaccgucaucgaccucgaccccauucccuaugauccgaaguuugagaaacagcugggccagguuaugcugcuaauccugugcgugacccagguccugaugaugcggacuacgugggcccucugcgaggcccugacccuugcgaccggccccaucagcacccucugggaggggaaccccggcagguuuuggaacacgaccaucgcuguguccauggccaacauauuccgcgguucguaccuugccggcgcgggacuccucuucuccaucaugaagaacaccaccaacacgcggcgcggaaccgggaacacuggggagacccugggggagaaguggaagaaccgggugagccugcucgguaaguccgaguuccagaucuacaagcgcagcggcauccaggaagucgaccgcacgcuggccaaggagggcauuaaacgcggggaaaccgaucaccacgccgugucccguggcucagcgaagcugcgcugguucguugagcggaaccucgucacgcccgaggggaaggugguggacuugggcugcggccgcgggggcugguccuacuacugcgggggccugaagaacgucagagaggugaaaggacucaccaagggcggcccggggcacgaggaacccauccccaugagcacguacggcuggaaccuggugcgccuguugaccggggccgacgucuucuucacgccacccgagaagugcgacacccugcugugcgacaucggagaaucuagccccaaccccacggucgaagcggggcguacccuccgcgugcugaaccuggucgagaacuggcucaauaacaacacccaguucugcaucaaagugcugaacccguacaugcccucugugaucgagaagauggaaacgcugcagcguaaguauggcggcgcccuggugcgcaacccccucucccggaacaguacccacgagauguacuggguguccaacgccagcgggaacaucguguccagcguuaauaugauuuccagaaugcugaucaaccgguucacgaugcgccauaagaaggccacauacgaccccgauguggaucugggcagcgggacgcgcaacaucgguaucgagucagagaccccgaaccucgacaucaucgggaagcguaucgagaagaucaagcaagagcacgagacgagccgccacuacgaccaggaccacccguauaaaaccugggcuuaucauggcuccuacgagacuaagcagaccggcagcgcguccucgacggugaacggggucgugcgacuccugaccaagcccugggacgugaucccgaugguaacacagauggccaugaccgacacgaccccguuuggccagcaacgcguguucaaagagaaaguagacacaagaacccaggagccgaaggaggggaccaagaagcucaugaagaucaccgcggaguggcuguggaaggaacugggcaagaagaagacaccccgcaugugcacucgggaggaguucgcccgcaagguccguucgaacgccgcgcucggcgccaucuucacggacgagaacaaguggaagucggcgcgagaggccguggaggacucccgguucugggagcugguggacaaggaacgcaaccugcaccucgaggggaagugcgagaccugcgucuacaacaugauggguaaacgggaaaagaagaucggggaguucggcaaggcgaagggaagccgcgccaucugguauauguggcugggcgcacguuuccuggaguucgaggcccucggcuuccugaacgaggaccacugguucucccgcgagaacagccugagcgggguggagggggaggggcuccacaagcugggauacauccugcgggaggucuccaagaaggaaggcggggcgauguacgcggaugacacggccggcugggacacccgcaucacguuggaggaccuuaagaacgaggagauggugacgaaccacauggagggagagcauaagaagcuggccgaggccaucuucaagcucaccuaucagaacaaggugguccgggugcaacgccccaccccgcggggcacggugauggacaucaucagucgccgcgaccagcgggguaguguacaggugggcacuuacgguuuagguaccuucacuaacaugggcgcccagcugauucgccaaauggagggugagggcguguucaaggggauccaacaccucacggcgaccgaggaggucgccgugcaggacuggcucgccagaguaggccgcgagcggcugagccgaauggccaucuccggcgacgacugcgucguuaagccacucgacgaccgauucgcauccgcgcugaccgcccucaacgacauggggaaggugcgcaaggauauccagcagugggagccauccaggggcuggaacgacuggacccagguccccuucugcagccaccacuuccacgagcucauaaugaaggacgggcgcgugcuggucgucgccugccggaaccaggacgagcugaucggccgcgcccgcaucucccagggugccggcuggagccuccgcgagacggcgugccuggguaaauccuacgcgcagauguggagccugauguacuuccaccggcgcgaccucaggcuggccgccaacgcgaucugcuccgccgugccgagccauuggguucccacaucccgcaccaccuggucaauccacgccggacacgaguggaugaccacagaggacaugcugaccgucuggaaccggguguggauccaggaaaaccccuggauggaggacaagacccccguggaauccugggaagagaucccuuaccucggcaagcgcgaggaccaauggugugggagccugaucggccugaccagccgcgccacgugggcccggaacauccagacggcgaucaaccagguaagaucccucaucgggucggaggaguacaccgacuacaugcccuccaugaagcgguucggccgcgaggaggaggaagccggcgugcuaugguga

SEQ ID NO: 24846 - RNA, 9876 nt, Artificial Sequence
  derived and/or modified CDS sequence (opt11) from DENV-2__KX380809__SS-prME
accgccggaaucaucaucaugaugauccccaccgugauggccuuccaccugaccacccguaacggggagccacacaugaucgugucacgacaggagaagggcaagagccuccuguucaagaccgagaacggggugaauauguguacccugauggcgauggaucucggcgaguuaugcgaggacaccaucaccuacaacugcccgcuccuccgacagaacgaacccgaggacauagauugcuggugcaauagcaccagcaccugggugaccuacgggaccugcaccgccaccggcgagcaccggcgagagaagcgcagcgucgcccugguuccccacgugggcauggggcuggagaccagaacugagacguggaugucgagcgaaggcgcuuggaagcacgcucagcgaaucgagacguggguccuccgccaccccgguuuuaccgugauggcggccauccuggccuacaccaucggcaccaccuacuuucagcgagugcugaucuucauccuccuaaccgccgucgcgcccuccaugacaaugcgcugcaucggaauuagcaaccgggacuuuguggaggggguguccggugggucaugggucgacaucgugcuggagcacggcaguugcgugaccaccauggccaagaacaagccaacgcuugacuucgagcugauaaagaccgaggccaaacaccccgccacccugcgcaaauacugcaucgaggccaagcucaccaacacgaccaccgcaagccggugcccgacccagggggagcccucccucaacgaagagcaggacaagcgcuucguuugcaaacacaguaugguggaccggggcugggggaacgggugcggccuguucgggaagggcgggauugugacuugcgccauguucacgugcaaaaagaacauggagggcaaaaucguccagcccgagaaccuggaguacacuaucgugaucacgccccauuccggagaggaaaacgccguggggaacgacaccggcaagcacgggaaggagaucaaggugaccccgcaaagcuccaucacagaggccgaacuaaccggcuacgggaccgcgacuauggagugcagcccccgcaccggccuggacuuuaacgagauggugcuccugcagauggagaacaaagcgugguuggugcaccggcaaugguuccucgaccugcccuugcccuggcucccgggagccgacacccaaggguccaacuggauacagaaagagacccuugucacguucaagaauccccacgccaagaagcaggacguggucgugcucggcagccaggagggagcaaugcacaccgcccucaccggcgcgaccgagauccaaaugagcuccgggaaccugcuguuuaccggccacuugaagugccgcuuacgaauggacaagcugcagcucaaggggaugucguauuccauguguacugggaaguucaagguggucaaggagaucgccgagacccagcacggcaccaucgugauccgcgugcaguacgagggcgauggcagccccugcaagauccccuucgaaauuauggaccuggagaagcggcacguccugggccgucucaucacggugaacccgauagucaccgagaaggauuccccgguaaauaucgaggccgagccgcccuucggagauagcuauaucauuaucggcguggagccggggcagcugaaacuguccugguuuaagaagggcucguccauagggcagauguucgagacaacuaugcgcggcgccaaacggauggccauacuaggggacacggcgugggacuucggcagccugggcgguguguucaccagcaucgggaaggcccugcaccaggucuuuggugccaucuacggggccgcauuuagcggcguguccuggaccaugaaaauccugaucgggguggucaucaccuggaucggcaugaauagccgauccaccagccugucugugagccugguucuagucgggauagucacgcucuauuugggugugaugguccaggcugacucugggugcguggugucguggaaaaauaaagaacugaagugcgggucaggcaucuucaucaccgacaacgugcacaccuggacugagcaguauaaguuccagccggaguccccaagcaagcuugccagugcuauccaaaaagcucacgaggaagguauaugcgguauccguucagugacccgccuggagaaucugauguggaaacaaauaacccccgagcucaaccacauccuguccgagaaugaggugaagcugaccaucaugacgggugacaucaaggggaucaugcaggcggggaaacggagccuucgcccucaacccaccgagcuuaaguacuccuggaaggcguggggaaaggccaaaaugcugagcaccgagcuucauaaucacacuuuccuaaucgacggccccgaaacagccgagugcccaaacacgaaccgggccuggaacucccuugaggucgaggauuacggguucggcgucuucaccacgaacaucuggcucaagcugaaggaacgccaggacgucuucugcgacagcaagcuaaugucagcggccauaaaggacaaccgggccguccacgccgacaugggguacuggauagagucggcccucaacgauacguggaagaucgagaaggcguccuucaucgaggucaagagcugccacuggcccaagucccauacacuguggagcaacggcguguuagaguccgagaugaucauucccaagaacuucgcaggcccugugagccagcacaauuaccgcccgggcuaccauacccagacugccggcccguggcaccucgggagacuggagauggauuucgacuucugcgaggggaccacugucgugguuaccgaggacugugggaaccgcggucccagccugcggaccaccacggccagcggcaagcucaucaccgaguggugcugucgcagcugcacccucccgccgcugcgguaccgcggggaggacggcugcugguacgggauggaaaucagaccacucaaagagaaggaagagaaccuggugaacucccuggugaccgcgggccaugggcagaucgacaauuucagccucgggguccugggcauggccuuguuccucgaggagaugcugcgcacgcggguugggacuaagcacgccauauugcugguggccgucuccuucgugacgcugaucaccggaaacaugucauuccgcgauuugggccgcgugauggucauggugggggcaacgaugaccgacgacaucgggaugggcgugaccuaccucgcucugcuggccgcguucaaggugaggcccaccuuugccgcuggccuccugcugagaaagcucacgucuaaggagcucaugaugaccacgaucgggaucgugcugcucagucagucaacgaucccagagacgauccucgagcugaccgacgcgcucgcccugggcaugauggugcugaagauaguccggaacauggaaaaguaccagcucgccgugacaauuauggcuauccuguguguaccgaacgccgugauccugcagaacgcguggaagguuagcugcaccauccucgccguaguguccgucagcccccuguuacucacuucuagccagcagaaagccgauuggaucccccuggcccucacaaucaaaggucuaaaccccacagcgaucuuccugaccacgcugucccggaccagcaaaaagcggucuuggccgcuuaacgaggccaucauggccgucggcauggugagcauccuggccuccagccuccucaagaacgacauccccaugacaggcccccuuguggcgggcggccugcuuaccgucuguuauguccugacugggcgcagcgcggaccuagagcucgaacgggccgcagaugucagaugggaggagcaagccgagaucaguggaagcucccccauccugagcaucaccauauccgaggacgguagcauguccaucaagaacgaagaggaggagcagacccugacuauccucauacguacgggccuguuggucaucuccggccucuucccaguauccaucccgaucaccgcagcggccugguaccugugggaagugaagaagcaacgcgccggcguccugugggacgugccguccccgccucccgugggcaaggccgagcucgaggacggggccuaucggaucaagcagaagggcauccuggguuacucccagaucggcgcuggagucuauaaggaagggaccuuccauacaauguggcacgugacccggggcgccgugcugaugcacaaggggaaacguaucgagcccagcugggccgacgucaagaaggaccucaucuccuacggagguggcuggaagcuggagggcgaguggaaagagggggaggagguacaggugcuggcccuagagcccggcaagaacccccgcgccguccagacgaagcccgggcuguucaaaaccaacacgggcacaaucggggcgguaagccuggacuucagcccaggcacgucgggcucccccaucguggacaagaagggaaaggucgucggcuuauacgggaacggcguggucacccggagcggcacuuauguuuccgccaucgcccagacugagaagagcaucgaggacaaccccgagaucgaggacgacauauuccggaagaagcggcucacgaucauggaccugcaucccggggccggaaagaccaagcgcuaccugcccgcgauugugcgggaggccaucaagcgcgggcucagaacccugauccuugccccaacccgcgucguggcugccgaaauggaggaggcgcuccgcggccucccuauccgguaccagacgcccgcaauccgcgccgagcauaccggacgggaaaucguagaccugaugugccacgccaccuucacaaugcgccuauugagcccuauccgggucccgaacuacaacuugaucaucauggacgaggcccacuucacggaucccgcguccaucgccgcccgcggcuacaucagcacccgggucgagaugggugaggccgccgggaucuucaugaccgcgacgccgcccggcucccgugacccguucccccagucaaacgcccccauuauggacgaggaacgggagaucccugagcgcuccuggaauagugggcacgaaugggugacggacuuuaagggcaagacugugugguuugugccgucgaucaaggccgggaacgacaucgccgcgugcuugcggaagaaugggaagaaagugauccaacugagcaggaagaccuucgacuccgaguauaucaagacuaggacgaacgauugggacuuugucgugaccaccgauauaagcgagaugggagccaacuucaaggcugagcgcgugauugacccgcggcgaugcaugaagcccgucauccugaccgacggggaggagcgggugauccucgcagggcccaugccggugacucacuccagcgccgcgcagcgcagagggcgcgucggccgcaacccgaaaaaugagaacgaccaauacaucuacaugggggagccacuggaaaaugacgaggacugcgcacacuggaaggaagcuaagaugcuguuagacaacaucaacacccccgagggcaucaucccguccauguuugagcccgaacgggagaagguugacgcgaucgacggggaguaccgccuucgcggugaggcccgcaagaccuucguggaccugaugcggcgcggagaccuccccguauggcuagcuuaccggguggccgccgaagggaucaacuacgccgacagacguuggugcuucgauggcgucaagaacaaccagauacuggaggagaacguggaggucgagaucuggaccaaggagggggagcgcaagaaacucaagccucgcuggcuugacgcgcgaaucuacagcgacccccucgcgcucaaggaauucaaggaauucgccgccggccgcaagucccugacucuaaaccuaaucaccgaaauggggcgccuccccacguucaugacccagaaggccaggaacgcucuggacaaccucgccguccugcacacggccgaggccgguggccgcgccuacaaucacgcgcugagcgagcuacccgaaacccuggagacgcugcuccugcugacccuccuggccacagugaccggaggcauauucuuguuccugauguccggcaaggguauaggaaagaugacccugggcaugugcuguauaauuacggcgucuauccugcucugguacgcccaaauccagccgcauuggaucgcagcaucaaucauccuggaguuuuucuuaaucguucugcugauccccgagcccgagaagcagcggacgccgcaggauaaccaacuuacguacguggugauagcgauccuaaccgucgucgccgccaccauggccaaugagaugggcuuccuagagaagacgaagaaggacuucggacuuggcagcauuacaacccaacagccggacagcaauauccucgacaucgaccuacggcccgcauccgcuuggacccuguaugccguggccacaacguucaucacccccaugcuccgucacaguaucgagaacuccagcgucaacgucucccugacugccaucgcgaaccaagccaccgugcugaugggccucgggaagggcuggcccuugagcaaaauggacaucggggugccgcuacuugccauuggcugcuacucccaggucaacccuaucacucucaccgcugcgcuguuacuguuaguggcacacuacgccaucaucggaccgggcuugcaggccaaggccacccgcgaagcgcagaagcgggccgcugccggcaucaugaagaucccgaccguggacgggaucacagucaucgaccuugaccccauccccuacgacccgaaguuugagaagcaacucggccaggugaugcuccuagugcugugcgugacccaagugcucaugaugcgcaccacgugggccuugugcgaggcgcugacguuggccacggggcccauaagcacacugugggagggcaaccccggucgcuucuggaacaccacgaucgccguguccauggccaacauuuuucggggaagcuaccuggccggcgcgggacuucuguucuccaucaugaaaaacaccgccaacacccgacgcggcacuggaaauacgggcgagacccugggcgagaaguggaagaaucgccucaacgcccucggcaagagugaguuccagaucuacaagaagagcggcauccaggagguggaccggacccuggccaaagaggggaucaagcgcggcgagaccgaccaccacgcggugucuagggggucagccaagcuccgcugguucguggagcggaaccuggucacgcccgaggggaaggucguggaccuaggcuguggccgcgggggauggagcuacuacugcggcgggcucaagaacguaaaggaggugaagggccuaaccaagggcgggcccggccacgaggagcccaucccgaugaguaccuacggguggaaccuggugcggcuccagagcggcgucgacguuuucuucaccccgccggaaaagugcgacacgcugcugugcgauaucggggaguccucacccaacccgaccguggaggccggaaggacccuucggguccucaaccuaguagagaauuggcuaaacaacaacacccaguucugcaucaaagugcuuaaccccuacaugcccagcgucauugaaaaaauggaggcccugcaacgcaaguacggcggggcccuggugcguaacccacugucgcggaacucgacccacgagauguacuggguauccaacgcgucgggcaacauaguguccagcgugaacaugaucucccgaaugcugauaaacagauucacgaugaagcacaagaaggcuaccuacgagccugacguggaccuggggagcggcacccggaacauagggaucgaguccgagacccccaaccucgacauuaucggcaaaagaaucgagaagauuaagcaggaacaugagacauccuggcacuacgaccaggaccaccccuacaaaaccugggcuuaccacggcuccuaugagaccaagcagacuggguccgcauccagcauggucaacggagugguccgccugcugacgaagccgugggacguuauccccauggugacccaaauggccaugacggacacuacccccuucgggcaacaacgaguguucaaggagaagguggacacccgcacacaggagcccaaggagggcaccaagaagcucaugaagaucacggccgaauggcuguggaaggaguuaggcaagaagaagaccccgcggauguguacacgggaggaguucacccggaaggugcgcuccaacgccgcccucggugccauuuucacggaugagaacaaguggaaguccgcccgggaagcagucgaggauuccggcuucugggagcugguggacaaggagagaaaccugcaccuagaggggaagugcgagaccugcguuuauaacaugauggggaagcgggagaagaagcugggggaguucgguaaggcgaaggguucacgagccauaugguauauguggcuaggggcccgguuucucgaguucgaggcgcugggcuuccuuaacgaggaccauugguucuccagagagaacagccucagcggcgucgagggugaggggcugcacaagcugggcuacauccuccgggauguguccaaaaaagagggcggggccauguacgccgacgauacagccgggugggacacccgcaucacacuggaggaccugaaaaacgaggagaugguuaccaaccacauggagggggagcaccggaaacucgccgaggcgaucuuucgccuuaccuaucagaacaagguuguacgggugcaacgccccacuccgcgcgguacagugauggacauuaucagccgccgggaccagcgcgggagcggccaggucgugaccuacggccugaacacauuuaccaacauggaggcacagcucauccggcagauggagggggagggcguguucaagagcauccagcaucugaccguaaccgaggagaucgccgugaagaacuggcuggagcggguaggccgcgaacgccucucccgcauggccauuaguggcgaugacugcguggucaaaccccuggacgacagguucgccuccgcgcugaccgcacucaaugacaugggcaagguucggaaggacauccagcagugggagccuagccggggguggaacgacuggacccagguacccuucugcucccaccacuuccacgagcugaucaugaaagacgggcgcgugcuggucguaccuugucggaaccaggacgagcucauugggagagcgaggaucagccagggggcuggcuggucccugcgggagacggccugccugggcaaaagcuaugcgcagauguggagcuugauguacuuccaccggcgcgaccugcgacuggccgccaaugccaucuguagcgccgugcccucccacugggucccgacgagcaggaccaccuggucuauucaugcgacccacgaguggaugacgaccgaggacaugcugaccguguggaaccggguguggauccaggagaaccccuggauggaggacaagaccccggucgagagcugggaagagauccccuauuugggcaagcgcgaggaccaauggugcgggagccugaucggccucacgucccgggccacuugggcgaagaauauccaaaccgccauuaaccaggugagaagcuuaaucgggaacgaggaguacacagacuauaugccguccaugaaacgguuccgucgcgaggaagaggaagcuggcguguugugguga

SEQ ID NO: 24847 - RNA, 9876 nt, Artificial Sequence
  derived and/or modified CDS sequence (opt11) from DENV-2__KX380810__SS-prME
acagccggcauuauaaucaugaugauccccaccgugauggcguuccacuuaacaacucgcaacggcgaaccccacaugaucgugagcaggcaggaaaagggcaagagucuccuguucaagacggagaacgggguuaauaugugcacauuaauggcgauggaccucggugagcugugcgaggauacuaucaccuacaacugcccccugcuccgccagaacgagcccgaggacauugacugcuggugcaauagcaccagcaccugggugacguacgguaccugcaccgcuaccggcgagcaccggcgcgagaagaggagcguggcccuggugccccacguggggauggggcuggagacccgcacggagaccuggaugaguagcgagggcgccuggaagcacgcccagcggauugaaaccugggugcuccgccacccuggguucaccguaauggccgccauccuggccuauacgaucggcacuaccuacuuccaacgggugcugauuuucauucuccugacugccguagcccccucgaugaccaugcgcugcaucgggaucagcaacagagacuucguggagggggugucgggcggcagcugggucgacaucguucuggaacacggcuccugcguuaccaccauggccaagaacaagccgacacuggacuucgagcugauaaaaaccgaggccaagcaucccgccacccugcggaaguauugcaucgaggccaagcugacgaacacgaccaccgcuucacgguguccgacccagggggagcccucccugaacgaggagcaggauaaacgcuuugucuguaagcacagcaugguggaucggggcugggggaacggguguggccuguucgggaaagggggcaucgugacgugcgcaauguuuaccugcaagaagaacauggaaggcaagauuguccagcccgaaaaucucgaauauaccaucgugaucacgccccacuccggggaggaaaacgccgucggaaaugacacaggcaagcacgggaaggagaucaaggucaccccgcagucguccaucaccgaggcugaauugacaggcuacgggacugccacgauggaaugcagcccucgcacggggcucgacuucaacgaaauggugcugcugcagauggaaaauaaggccuggcucgugcaccggcagugguuucucgaucuuccauuacccuggcugccgggcgccgacacccaagggucgaacuggauucagaaggagacgcugguaacguucaagaauccacaugccaaaaagcaggacguggucgugcuaggcagccaggaaggggccaugcauacggcccucaccggagcgacagagauccaaaugagcuccgggaaucugcuguuuaccggccaccuaaagugccgucuacguauggacaaauugcagcucaagggcaugucauacaguaugugcaccgggaaauucaagguggucaaggagauagccgagacccagcacggcaccaucgugauacgcguacaguacgagggggacggcagccccuguaaaauccccuucgagaucauggaccucgagaagcgucauguccucggccgccucauuacggugaacccgaucgugacagggaaggacucccccgucaacaucgaggccgaaccgcccuucggcgauagcuacaucaucauugggguggagccaggccagcuuaagcuguccugguucaagaaggggagcuccaucggccaaauguucgagaccacaaugcgcggcgccaagcggauggccauccucggggauacugcgugggauuucggguccuugggaggggucuucacuucuauagggaaggcccugcaucaggucuucggggcaaucuacggagccgcguucuccggcgugagcuggaccaugaagauccuuaucggcgucgucaucaccuggaucgggaugaauagucgguccacgagccuguccgugucucugguucuggucggcaucguaacccucuaccugggggugaugguccaagccgacuccggcugcguggugucguggaagaacaaggagcugaaguguggcuccgggaucuucaucaccgacaacguccauaccuggacggagcaguacaaguuccagcccgagucccccucgaagcucgccucggcuauccagaaagcucaugaggaagguaucugcgggaucaggagcguuacccgcuuggaaaaccugauguggaagcagaucacaccugagcucaaccauauccuguccgagaaugaggugaagcucacgauaaugacgggggacaucaagggaaucaugcaggcgggcaagcggagccuccgcccgcagcccaccgagcugaaguacuccuggaaagccuggggcaaggcaaagaugcugagcaccgaacuccauaaccacaccuuccugaucgacgguccagaaacggccgagugcccuaacaccaaccgagcauggaacucccuggaggucgaagacuacggcuucgggguguuuaccacaaacauauggcucaagcugaaggagcggcaggacguguuuugcgacaguaaacugaugucggcggccauaaaggacaaccgggcuguccacgccgacaugggcuacuggaucgagucugcucucaaugauacuuggaagaucgagaaggcguccuuuauagaagucaagagcugucauuggcccaagucucacacccuguggucuaacggcgugcuggaguccgagaugauaauccccaagaacuucgccgguccagugagccagcacaacuaccggcccggcuaccacacccaaaccgcagggccuuggcaucucggccggcuggagauggacuucgacuuuugcgaggggacgacgguggugguaacugaggacugcgguaaccgcgggcccucacugagaacaaccacggccagcgggaaacuuaucaccgaguggugcugccgcucgugcacccugcccccgcugcgguaccgcggcgaggacgggugcugguacggcauggagaucagaccccucaaggagaaggaggagaaccugguaaauucucuggucaccgcggggcacggccagaucgauaacuucagucucggaguucugggaauggcccuguuccucgaggaaaugcuccgcacgcgggugggcaccaagcacgccauccugcucguggcugucuccuuugugacccugaucaccgggaacauguccuuccgcgaccucggccgugugauggucauggucggagccacaaugacggaugacauuggcaugggcgugacauaccucgcgcugcuggccgcuuucaaagugcgacccaccuuugccgccgggcuccugcugcgcaagcuaacgaguaaggagcugaugaugacgaccaucggcaucgugcuucucagccaguccacaauacccgagacaauauuagagcugacggacgcgcuggccuuagggaugaugguguugaagauaguccgaaacauggaaaaguaccaacuugccguaacuaucauggccaucuugugugucccgaacgccgugauucugcagaaugcguggaaggugagcugcaccaucuuggcagucguguccguuucgccacugcugcucacuuccucccagcagaaggccgacuggaucccgcuggcacugaccaucaagggcuugaaucccacggcgaucuuccugaccacacugagccgaaccucaaagaagcguuccuggccacucaacgaagccaucauggccgucggcauggugucaauccuggccucgagcuuguuaaagaacgacauccccaugacugggccucugguugccggcgggcugcucacagucugcuacguucugacgggccgcagcgcggaucuggagcuugagcgggccgccgacgugcguugggaggagcaggccgagauauccgggagcucccccaucuugucgaucaccaucuccgaggauggaagcauguccaucaagaacgaggaggaggagcagacucugaccaucuuaauccggaccggccugcuggucaucucuggguuguucccgguguccauccccaucaccgccgcggccugguaccugugggaggugaagaagcagcgcgccggcguccugugggacguaccgagcccgccuccuguggggaaggccgagcucgaggacggcgccuaccggaucaagcagaagggcauccucggcuacucacagauaggagcaggggucuacaaggagggcacuuuccacaccauguggcacguaacccguggggcagugcugaugcacaagggcaagcgaaucgagcccagcugggccgaugucaagaaggaucucaucuccuacggcgggggcuggaagcuggagggggaguggaaagagggcgaggagguccaggugcuggcccucgaacccgggaagaacccccgcgcuguccagacgaagcccggccuguucaagaccaacaccggaaccaucggcgcggucagcuuagacuucucccccggcacgaguggaucccccauaguggacaagaagggcaaggucguggggcucuacggcaacggaguggucacccggagcggcaccuauguuucggcuaucgcccagaccgagaagaguaucgaggacaaccccgagaucgaggacgacaucuuccgcaaaaagcggcugacgaucauggaccugcaccccggcgccgggaagacaaagcguuaccuucccgcuaucgugcgggaggccaucaagaggggccuccgaacguuaauacuggccccgacccgggucguggcagcggaaauggaggaggcccuccgcggucugcccauacgguaccagacgcccgccauccgcgcggaacauaccggccgggagaucguggaccucaugugucaugccaccuucaccaugcgccugcuaagccccauacgggucccuaacuacaaccucauuauuauggaugaggcccauuucacagacccagcguccaucgccgcccgcggcuacaucagcacccgggucgaaaugggugaggcagccggcaucuucaugaccgcgacgccaccagggagucgugauccguucccccaguccaacgcccccauuauggacgaggaacgggagaucccagagcgcuccuggaacagcggccacgaaugggugacggacuuuaaggggaagacggucugguuuguacccagcaucaaggcaggaaacgacaucgccgccugccuccggaagaaugggaagaaggugauccagcugagccggaagaccuucgacucggaguauauuaagacucggacgaacgacugggauuucgucguuaccaccgacaucagcgagaugggggcgaacuucaaggccgagcgcgugaucgaccccaggcgcugcaugaagcccgucauccugaccgacggugaggaacgggucauccucgccgggcccaugccgguuacgcacuccuccgccgcgcaacgccgggggcgaguagggcgcaacccgaagaacgagaacgaccaguacaucuacaugggcgaaccgcuugagaacgaugaagacugcgcccacuggaaggaggccaagaugcugcucgauaauauuaacacccccgagggcaucauaccuaguauguuugagccagagcgggagaagguggacgcuauagacggggaguaccgccuccgcggcgaggcgcgcaaaaccuucguggaccucaugcggcgaggagaccucccggucuggcuggccuaccguguggcugccgagggcaucaacuaugcugaccgccgguggugcuucgacggggucaagaacaaccagauccuugaggagaacguggagguagagaucuggacaaaggagggagaacgcaagaaacucaagccgcgguggcuggacgcucgcaucuacagcgacccccuggcgcugaaggaguucaaggaguucgccgccggccggaagucccugacacugaaccucaucacggagauggggcgccugccgaccuucaugacccagaaggcucggaacgcccuggacaaccucgccguccugcauacggcagaagccggugggcgcgccuacaaccaugcgcugagcgaacuccccgagaccuuggagacccugcuccugcugacccuccucgccacagugaccggcggcaucuuucuauuccucaugagcgggaaaggcauagggaaaaugacccuaggcaugugcugcaucaucaccgccagcauccugcucugguacgcccagauccagccgcacuggauagccgcgagcauuauccuggaguuuuuccugaucgugcucuugauccccgagcccgagaaacagcggacgccccaggacaaccagcugacguacgucgugauugcgauccucaccguggucgccgccaccauggcaaacgagaugggguuccuggagaagaccaagaaggauuucggcuugggcuccaucacgacucaacagccugacagcaauauccuggacauagaccugcgacccgcauccgccuggacccuguacgcggucgccaccaccuucaucacccccaugcuccggcacagcaucgagaacaguucugucaacguuuccuugacggccaucgcgaaccaggccaccgugcugaugggucugggcaagggauggccccugaguaagauggacaucggcgugccgcuguuggcuaucgggugcuacucccaggucaaccccaucacucugacagccgcgcuacuccuacugguggcccacuacgccaucauugggcccggccuccaggccaaggccacccgcgaggcgcagaagcgggccgccgccggcauaaugaagaucccugccgcggacaucggcaccgucaucgaccuggauccaauccccuacgacccaaaguucgaaaagcaguuagggcaggucauguugcuggugcugugcagcacccaggugcucaugaugcgcaccaccugggcacugugcgaggcccugaccuuagccacggggcccaucuccacacugugggagggaaaccccggccgcuuuuggaacaccaccaucgccgucagcauggcgaacaucuucaggggcuccuaccucgccggagccggauugcuguucagcauaaugaagaacacggcaaacacccgccgggggacaggcaacacgggcgaaacgcucggggagaaauggaagaaccgcuuaaacgcgcucggcaaguccgaguuccagauauacaagaaguccgguauucaggaaguagaccggacacuggccaaggagggcaucaaacgcggagagacagaccaucacgcugugagucgcggcagcgccaaacuaaggugguucguggagcggaaccuggugacucccgaaggcaagguugucgaccugggguguggccguggcggaugguccuacuacugcggagggcucaagaacgugaaggagguuaagggccugacgaaaggcggccccggacacgaagaacccaucccgaugagcaccuacggcuggaaccugguccggcuucaguccgggguggauguauucuucacgccgcccgagaagugcgacacucugcugugcgacaucggcgagagcagccccaacccgacgguugaggccggacggacccugcggguguugaaccugguggagaacuggcucaauaacaauacgcaguuuugcaucaaggugcugaacccguacaugcccagcguaaucgagaagauggaggcguugcagagaaaguacggaggggcccuggugcgaaacccacucagccgcaacuccacccacgagauguauugggucucgaacgcuuccgggaacauagugagcuccgugaacaugaucagccggauguuaauuaaccgcuucaccaugaagcacaagaaggccacguacgagccagaugucgaccucggcuccggcacccggaacaucggcaucgagucugagacgccaaaccucgacaucaucgguaagagaaucgagaagaucaagcaggagcacgagacguccuggcacuaugaucaggaccacccauauaaaacgugggccuaccacggaucguaugagaccaaacagacgggcuccgcgagcuccaugguuaacggggugguaaggcuacuuaccaagccaugggacguaauaccuauggugacgcagauggcgaugacagauacgacaccauucggccagcagagggucuucaaagaaaagguugacacacgcacccaggaacccaaggagggcacgaagaagcugaugaagauaaccgcagagugguuguggaaggagcuggggaagaagaagacgccucgcauguguacccgcgaggaguucacccggaaggugcgcagcaaugccgcccugggggcgaucuucacagacgaaaacaaguggaaauccgcccgagaggccgucgaagacagcggguucugggagcugguggacaaggagcgaaaccugcacuuagaggggaagugcgaaacaugcgucuauaacaugauggggaagcgggaaaagaagcugggcgaguucgggaaggccaagggcucccgggcgauaugguacauguggcugggcgcccgguuccucgaguucgaagcucugggguuuuugaacgaggaccacugguucagccgcgagaacagccucuccggcgucgaaggggagggccugcauaagcugggcuauauacucagggacgugucgaagaaagagggaggcgcuauguacgccgaugauacugcgggcugggacacgcgcauuacccuggaggaccugaagaaugaggagauggucacaaaucacauggaaggugagcaccggaaauuagccgaggcuaucuuucgccugaccuaccagaacaagguggugcgaguccagcgccccacgcccagggggacggugauggacaucauaucccgccgggaccaacggggcagcggccagguugugacguacgggcuuaacaccuucaccaauauggaggcccagcuaauccgccagauggagggcgaggggguguucaaguccauccaacacuuaacagugacugaggagaucgcagucaagaacuggcuggagagagugggccgcgaacggcuaagccgaauggcgaucuccggcgacgacugcgugguaaaaccccuggacgaccgguucgccucugcauuaacagcccuaaacgauauggggaaggugcgcaaggacauacagcaaugggagccgucccgggguuggaacgacuggacccaggugcccuucugcagccaccacuuucacgagcugaucaugaaggacgggcgcguccugguggugcccugcagaaaccaggacgagcucaucggucgcgcccggaucucccaaggagcggguuggagccugcgcgagaccgccugccuggguaaguccuacgcacagauguggagccucauguacuuccaccggcgcgaccugcgucucgcggccaaugcgauaugcucggccguccccagccauugggucccaaucucccggacgaccuggagcauccacgccacgcacgaguggaugaccacagaggacaugcucacgguguggaaccgggucuggauccaggagaaucccuggauggaggacaagacccccguggagagcugggaggagauccccuaccuggggaagcgugaggaccaauggugcggcuccuugaucgggcucaccagccgugccacaugggcgaagaacauacagacggccaucaaccaggugcgcucccugauugguaacgaggaguacacggacuacaugccguccaugaagcgcuuucggcgcgaggaggaggaggccggcgucuugugguga

SEQ ID NO: 24848 - RNA, 9876 nt, Artificial Sequence
  derived and/or modified CDS sequence (opt11) from DENV-2__KX380811__SS-prME
accgcgggaaucaucauaaugaugauccccaccgugauggccuuccaccugacaacucggaacggugaaccccacaugaucgucagccgccaggaaaagggcaagagccuccuguucaagaccgagaacggugugaacaugugcaccuugauggcgauggaccuuggcgagcuaugcgaagacaccauaaccuauaacugcccccugcuccgccagaacgagcccgaggacaucgacugcuggugcaacuccaccagcaccugggugaccuacgggaccugcaccgccacaggcgagcaccggcgcgagaaacggagcgucgcccuggugccccacgugggcaugggucucgagacccgcacagaaaccuggaugagcagcgagggcgccuggaagcacgcccagcggaucgagaccuggauccuccgccaucccggguucacgaucauggcggccaucuuagccuacacuaucggcaccacguacuuccagcggguacugaucuucauacuccugacggccgucacccccuccauggcuaugcgaugcaucgggaucagcaaccgggacuucguugagggcgucuccggcgggagcuggguggauaucgugcuggagcacggcuccugugucaccaccauggcaaagaacaagcccacgcucgacuucgagcugauaaagaccgaggccaagcaccuggccacccuccggaaguacugcguggaggccaagcugaccaacacgaccaccgcgucgcggugucccacccagggggagcccucucugaacgaggagcaggacaagcgcuucgugugcaagcacagcaugguugaccgggguuggggcaacgggugcggccucuucgggaagggagggaucgugacgugcgccauguucacguguaaaaagaacauggagggcaaggugguccagcccgagaaucuggaguacaccaucgugauuaccccccauuccggcgaggagaacgcaguggggaacgacacaggcaagcacgggaaggagauuaaggucacgccccagagcuccaucaccgaagccgagcugacgggauacgggaccgugacgauggagugcucaccgagaaccggucucgacuucaacgagaugguccugcugcagauggagaacaaggccuggcugguucaucgccagugguuccuggaccugccucuccccuggcugccaggcgcggacacucagggcucuaacuggauccagaaggagacgcuggugacguucaagaacccgcacgccaagaagcaggacgugguggugcucggcagccaggaaggggcaaugcacaccgcgcucaccggcgccacggaaauccagaugagcucggggaacuuacuguucacuggccaucugaagugccgccugcgcauggauaaguuacagcugaaggggaugagcuacuccauguguaccgguaaguucaaagucgugaaggagaucgcggagacccagcacggaaccaucguaauccgcguccaguacgagggggacggcagcccauguaagauccccuucgagaucauggaccuggagaagcggcacgugcucgggaggcugaucacggugaacccuaucguaaccgaaaaggacagcccugugaacauagaggccgagccgcccuuuggggacagcuacaucaucaucggcguggagccugggcaacucaaacuuucuugguucaaaaaaggcagcaguaucgggcagauguucgagaccacuaugcgcggcgccaagcggauggcaauccugggggacacggcgugggacuucgggagccuggggggaguguucacauccaucggcaaggcgcugcaccagguguucggggcaauauacggcgccgccuucucgggcgugucguggacaaugaagauccucaucggggucgucaucacguggaucgguaugaauucgcgcuccacgagccuguccguaagccugguccucgucgggguggucacccuguaccugggcgugauggugcaagcggacucagggugcgucgugagcuggaaaaacaaggagcucaagugcggcagcggcaucuucauaaccgacaacgugcacaccuggacggagcaguauaaguuccagccggagucucccagcaagcuggccuccgccauucagaaggcccacgaggaggggaucugcggcauccggucagugacccgccuggagaaucucauguggaagcagaucacccccgaguuaaaccacaucuugacggagaacgaggugaagcucacuaucaugaccggggacaucaagggcaucaugcaagccggcaagcggucccuucgcccccaaccgaccgaacugaaauacagcuggaaagcguggggcaaggccaaaaugcucuccaccgagcugcacaaccacacguuccugaucgacggccccgagaccgccgaguguccaaacacaaaccgggcauggaacagcuuggagguugaggacuacggguucggagucuucaccaccaacauauggcugaagcugaaggagaggcaggauguguucugcgauaguaaccugaugagcgcagcaaucaaggauaaccgggcugugcacgccgauaugggguauuggauagagagugcacucaacgauaccuggaaaaucgagaaggccagcuucaucgagguaaaguccugccacuggccuaagagccacacccugugguccaacggcguuuuagaguccgagaugaucauccccaaaaacuucgcgggcccggugucgcagcacaacuaccgccccggguaccacacccagaccgccggcccguggcaccugggucggcuggagauggacuucgacuucugcgaggggacuaccgucguggugaccgaggacugcgggaaccgcggcccaucgcugcggaccacgaccgccagcggaaagcugaucacugaguggugcugucgcuccugcacacugccgccccuccgguaccgcggggaggacggcuguugguacgggauggagauccggccgcugaaggagaaggaggagaaccugguuaauagccucgugacggccggccacgggcagaucgacaacuucucccugggcgugcugggcauggcgcucuuccuggaagagaugcugcgcacccggguagggacaaagcaugcgauccuccugguggccgugaguuucguaacacugauaacaggcaacauguccuuccgcgacuuggggcgcgugauggugauggucggugcgaccaugaccgacgacaucggaaugggagugaccuacuuagcccugcucgcggccuucaagguccggccuacguuugccgccggucugcugcuccgaaaacugacgucgaaggagcugaugaugaccaccaucgggaucguccuccugucccagagcacgauccccgaguccauccuggagcucaccgacgcccuagcacuggguaugauggugcucaagauuguccggaauauggagaaauaccagcuggcaguaaccaucauggccaucuuaugcguacccaacgccgucauacuccagaacgcauggaaggugagcugcacuacgcuggccguggucuccgugagcccgcugcuacugaccuccucgcagcagaaggccgacuggaucccccuggcccucacuaucaaggggcugaaccccaccgcuaucuuccuuaccacccucucccgcaccuccaaaaagcgguccuggccccugaaugaggcgaucauggccgugggcaugguuagcauccuggccucaagccuccugaagaacgauaucccgaugaccgggccccugguggcggggggccuccugacugugugcuauguccuuaccgggagaucugcugaccucgagcuggagcgggcggcagacgugcgcugggaggagcaagccgagaucuccggcagcucccccauccugagcaucaccaucuccgaggacggcagcaugucaaucaagaaugaggaggaggagcagaccuugacgauccugauccguaccggccugcucguaaucagcggccuauuccccguguccauaccgaucaccgccgcggcgugguaccugugggaagugaagaagcagcgugccggcguacucugggacguccccucgccgccgcccgugggcaaggccgagcuggaagacggggccuaccggaucaaacagaagggcaucuugggcuacagucagauaggggccggcguguacaaagaggggaccuuccacaccauguggcacgucacucgcggcgcggugcucaugcauaaggggaagcgaauugagcccaguugggcugacgugaagaaggauuuaaucucuuacgguggggguuggaagcuggagggcgaguggaaggagggugaggagguccaggugcucgcacuggagccgggcaagaauccgcgcgccgugcagacgaagcccggccuguucaagacgaacaccggaacgaucggggccgugagucucgacuucucccccggcaccagcggcuccccuaucguggacaagaaggggaagguggucggacuguaugggaacggcguggugaccagaagcggcacauaugucuccgcuaucgcccagacggagaaguccaucgaggauaacccggagaucgaggacgacaucuucaggaagaagcggcugaccauaauggaccugcacccgggcgccggcaaaaccaagcgcuaccuccccgccauugugcgggaggcgaucaagcggggacugcggacccugauccucgcccccacgcgcguugucgccgccgagauggaggaggcccugcgcggccugccgauccgguaccagaccccggcgauccgcgccgagcacaccgggcgggagaucguggaccucaugugccacgcuaccuucacgaugcgucuguuaucaccuaucagggugccaaacuacaaccucaucauuauggacgaggcccacuuuaccgauccggccaguaucgcggcccgcggcuacauaagcacccgggucgaaaugggcgaggccgccgggaucuucaugaccgccacgccgccaggcucccgagaccccuucccgcagagcaacgcgcccaucauggacgaggagcgcgagaucccugagcgcaguuggaacagcgggcacgagugggugaccgauuucaagggcaagaccgugugguucgugcccuccaucaaggccggaaacgauaucgccgcaugucugcggaagaacggcaagaaggugauccagcugagccgcaagacguucgacuccgaguauaucaagacgcgaaccaacgacugggacuuuguggucaccaccgacaucagcgagaugggcgcgaacuucaaggccgagcgcgugaucgauccacggcgcugcaugaagccagugauccucacggacggggaggagcggguaauccuggccggccccaugccggugacucacuccagcgcugcacagcgccguggccgcgugggcaggaacccgaagaacgaaaacgaccaguacaucuacaugggagagccccuugagaacgacgaggacugcgcccacuggaaggaggccaaaaugcuccuggacaacaucaacacgcccgagggcauaauucccuccauguucgagccagagcgggagaagguggacgccaucgacggagaguaucgccuacgcggggaggcccgcaagaccuucguggaccucaugcggcgcggcgaccuacccguguggcuggccuaccgaguggcggccgaggguaucaacuacgccgaccgccgauggugcuucgacggcgugaagaacaaccaaauccucgaggagaaugucgagguggaaaucuggacgaaagagggagagcgcaagaagcugaagccccgguggcuagacgccagaauuuacagcgacccgcucgcucugaaggaguucaaggaguuugcggcuggucggaaaucacuuaccuugaaccugauaaccgaaaugggccgccugccuaccuucaugacacagaaggcgaagaacgcacucgacaaccuggcgguccugcacaccgccgaggcugggggccgggccuacaaccacgcccugagcgaacugcccgagacccucgagacccuccuacugcucacgcugcuggcaaccgucaccgggggcauauuccucuuccugaugucaggcaaggggauaggcaagaugacccuggggaugugcugcaucaucacugccucuauccuccugugguaugcgcagauccagccccacuggaucgcagccuccauaauccuggaguucuuccucaucgugcuguuaauaccggagcccgagaagcagcgcacgccccaggauaaccaguuaaccuacguggugaucgcgauucuuaccgugguggccgccaccauggcgaacgagaugggcuuccuggagaagacgaagaaggacuucgggcucggcagcauuaccacccaacagcccgaaagcaacauccuggacauugaccugcgcccggccuccgcguggacccucuacgccguagccacgaccuucaucacgcccaugcugcgccacagcaucgagaauuccucggugaacguauccuugaccgcuaucgccaaucaggcgacggugcugaugggccuggggaaaggcuggccccugagcaagauggacaucgguguuccccuccuggccauuggcugcuauucacaggugaaccccauuacccugaccgccgcccuccugcugcucguagcgcacuaugccaucaucgggcccggccugcaggccaaggccacccgugaggcccagaaacgcgcggccgccgggaucaugaagauccccacgguggacgggaugaccgugaucgaucuggacccuaucccguacgaccccaaauuugagaagcaguuagggcaaguaaugcugcuggugcucugcgugacgcagguccuaaugaugcggacaaccugggcccuuugcgaggcccuaacacuggcuaccgggcccaucagcacccugugggagggcaaucccgggcgcuucuggaauacaaccaucgccguguccauggcgaauauauuucgcggcaguuaccucgccggugcggggcugcuguucucaauuaugaagaauacggcgaacacccggcgcggcacggggaacacuggcgagacccuaggggagaaauggaagaaccgacugaacgcccugggcaagucagaauuccagaucuauaagaaguccggcauucaagagguggaucguacccucgccaaggaagggaucaagcggggcgagacggaccaccacgccgucucacgcggguccgcgaaacugcgaugguucguggagcgcaaccuggucacaccggagggcaaggucguggaccucggcugcgggcggggcggguggagcuacuacugcggcgggcucaagaauguuaaggaggucaagggcuugaccaagggcgggcccggucacgaggagcccauacccauguccacuuacggguggaaccuggugagacugcagagcggcguggacgucuucuucacgccgcccgagaagugcgacacccugcucugcgacauaggggaguccagcccaaaccccaccguggaggcgggacgaacgcugcgcgugcugaaccucguugagaacuggcugaacaacaacacccaguucugcaucaagguacugaacccguacaugccuagcgugaucgagaaaauggaggcccugcagcggaaauacggcggggcccucgugcggaacccccucucccggaacucgacgcacgagauguacuggguuagcaacgccagcggcaacaucguguccagcguaaacaugauaucccgcaugcugaucaaccgguucaccaugcgccacaagaaagcgaccuacgagccggauguggaccucgggagcgguacccggaauaucgggauagagagugagacgcccaaccuggacaucaucggcaagcgaaucgaaaagaucaagcaggagcacgagaccagcuggcacuacgaccaggaccaccccuacaaaaccugggccuaccacggcuccuacgagaccaagcaaacggggagcgccuccagcauggugaacggcgucgugcgccuguuaaccaaaccuugggacgugaucccgaugguuacccaaauggccaugaccgacacgacccccuucgggcagcagcggguguucaaagagaaggucgacacccgcacccaggagcccaaggagggcacaaagaaauuaaugaagaucacggccgaguggcuguggaaagagcucggcaagaagaagacaccccggauguguacccgggaggaguucacgaggaaggugcguuccaacgccgcccugggugccauauuuaccgaugagaacaaguggaaguccgcucgggaggccguggaagauuccgguuucugggagcuggucgacaaggaacgaaaccugcaccuggagggaaagugugagacaugcgucuacaacaugaugggcaaacgugagaagaagcugggggaguucggcaaggcgaagggcucgcgggccauaugguauauguggcugggcgcccgguuccuggaauucgaggcccuaggcuuccucaaugaggaccauugguucucccgcgagaacagccuuuccgggguggagggcgaggggcugcacaagcugggcuacauccugcgggacguguccaagaaggaaggcggugcaauguacgccgacgacacagccggcugggacacgcguaucacccuugaggaccucaagaaugaggaaauggugaccaaccauauggaaggggagcacaagaagcuggccgaggcaaucuucaagcugacguaccagaacaaggugguccgggugcagcgcccgacgccccgggguaccgugauggauaucauuagccgccgggaccagcgaggguccggccaagucgugaccuacggccucaacaccuucacgaacauggaggcgcagcugauccggcagauggagggagaagggguguucaaaagcauacagcagcugacugucaaagaagagaucgccgugaagaauuggcucauccgagugggacgcgagcggcucucccgcauggccaucagcggcgacgacugcgucguaaagccccuggacgaccgguuugccuccgcccucaccgcccuuaacgacaugggcaaggugcgcaaggacauccaacaaugggagcccagccggggguggaacgacuggacccaggucccguuuugcucccaccauuuccacgagcugaucaugaaggauggcagggucuuggucguccccugccggaaccaggacgagcugaucggucgcgcccggauaagccagggcgccgguuggucccugcgagagacggcuugccucggcaagagcuacgcccagauguggucccugauguacuuucaccggcgcgaccugcgucucgcggcuaacgcaaucugcagcgccgugcccucccacuggaucccgaccagccgcaccaccugguccauccacgccacucacgaguggaugacgaccgaggacaugcucaccguuuggaaccgggucuggauccaggagaacccguggauggaggacaagacuccugucgagagcugggaagagaucccguaccugggcaagcgugaggaccaguggugcgggagccucauaggccugacgucccgggcgaccugggcgaagaacauccagaccgccaucaaucaggugcggagccugaucgggaacgaggaguacaccgacuacaugcccuccaugaaacgguuccgccgcgaggaagaggaggccggcgucuugugguga

SEQ ID NO: 24849 - RNA, 9876 nt, Artificial Sequence
  derived and/or modified CDS sequence (opt11) from DENV-2__KX380813__SS-prME
acggcgggcaucaucaucaugaugauccccacggucauggccuuccaccugaccacccgcaacggggagccccacaugaucgucagccgacaggagaagggcaagagccuccuauucaagaccgagaauggggugaacaugugcacccugauggccauggaccuuggcgagcugugcgaagacaccauaaccuacaacugcccccugcuccgccaaaacgagcccgaggacaucgacuguuggugcaauucaacuuccaccugggucaccuacgggacgugcaccgcaaccggcgagcaccggcgcgagaagcguagcgucgcccuggucccccacgucggcaugggucuggagacccgcaccgagaccuggauguccagcgagggcgccuggaagcacgcccagagaaucgaaacguggauccuccgccaccccgguuucaccaucauggcggccauccuggccuacacgauaggcacaacuuacuuucagcggguccugaucuuuauccuccugacggcggugaccccuucaauggcgaugcgcuguaucggcaucucuaaccgggacuuuguggagggcguuuccggggguuccuggguggacaucgugcuggagcauggaucguguguaaccaccauggcgaagaacaagccgacacucgauuucgagcugauuaagaccgaagccaagcaccuugccacccucaggaaguacuguguggaggcgaagcugacgaauacgaccacagcgagcaggugccccacccagggcgagccaagucugaacgaggaacaagacaaacgcuucgugugcaagcauagcaugguggaccgggguuggggcaacggauguggccucuucgggaagggcgggaucgugacgugcgccauguucacgugcaaaaagaacauggaaggcaaaguaguucaacccgagaaucuggaguacacuaucgugauaacgccccauuccggcgaggagaacgccguggggaacgacacgggcaagcacgggaaggagaucaaggucaccccucagagcuccaucacugaggcggaguuaacggguuacgggaccgugaccauggaaugcagcccgcgaaccggccucgacuucaacgagauggugcugcugcagauggagaacaaggccuggcucguccaccggcagugguuccuggaccugcccuugcccuggcuacccggagccgacacccagggauccaacuggauccagaaggagacccuggugacguucaaaaacccgcacgcaaagaaacaggacgucguggugcuugguucccaggagggggcaaugcacacggccuugacgggcgccaccgagauccagaugucuuccggcaaccuccuauuuacgggccaucucaagugucgcuuacggauggacaaguuacaacugaaaggcaugucuuacucgauguguacggggaaguucaaggucgucaaggagagcgcggagacccagcacggcaccaucguuauccgcguccaguacgaaggggacggauccccaugcaagaucccuuucgaaaucauggaccuggagaagagacacgugcuggggaggcugaucacggugaaccccaucguaaccgagaaggacagcccggugaacauugaggccgaaccgcccuucggggacuccuacaucaucauuggcgucgaacccgggcagcugaaguugagcugguuuaagaagggcagcagcaucgggcagauguucgagaccaccaugcguggugccaagcgcauggccauccugggcgacacagccugggauuucgggucacuggguggugucuucaccagcaucggcaaggcgcuucaucaaguguucggugccaucuacggcgccgcguuuagcggggugagcuggaccaugaagauccugaucggggucgugaucaccuggauagggaugaauucccgcuccacgagccugagcgugucccugguccuugucgggguggugacccuguaccugggcgugauggugcaggcggauucugggugcgucgugagcuggaagaacaaggagcucaaaugcggguccgguauauucaucaccgauaacgugcacacguggacggagcaguacaaguuccagcccgagagcccaagcaagcuggcgucggccauacagaaggcacacgaagaggggaucugcggcauccggucaguuaccagauuggagaaccucauguggaagcaaaucacccccgaauuaaaucauauccugaccgagaacgaggugaaauugacgaucaugacgggugacauuaagggcauuaugcaggccgggaagcggacuuugcgcccccagccgaccgaacugaaguacagcuggaaggcuuggggcaaggccaaaaugcuuuccacggagcugcauaaccacacguuccuuaucgacggucccgagacggcggagugccccaauacaaaccgggccuggaauucacucgaaguugaggacuacggguuuggcgucuucacgaccaauaucuggcugaagcuaaaggagcggcaggacguauucugcgacuccaagcucaugagcgccgcgauaaaggacaaccgagccguccacgcggacaugggguacuggaucgaauccgcccugaacgauaccuggaagauugagaaggccucauucauugaggucaaauccugccacuggccuaagagccacacacugugguccaacggcgugcucgagagcgagaugaucauccccaagaacuucgccgggccggugucccaacacaacuaccgccccggguaccacacccaaacagcgggcccguggcaccuggggcgacuggaaauggacuucgacuucugcgagggcaccaccguuguagucacugaggauugcgggaaccggggccccagccuccguacgaccacagccaguggcaagcugaucaccgaguggugcugucgcucaugcacgcuuccuccccuccgguaccgcggggaggacggcugcugguacgggauggaaaucaggccgcugaaggaaaaggaagagaaccuuguuaauagccucgugaccgccggccacggacaaauugacaacuucucccuaggcgugcugggcauggcccucuuccuagaagaaaugcugcgcacccgggucggaaccaagcacgccauccugcuugucgccgucagcuucguuacgcugauuaccggcaacauguccuuccgugauuuagggcgcgugaugguuauggucggcgccaccaugaccgaugacaucgggaugggggugacuuaucuggcguuacucgcggcauucaagauccggcccaccuucgccgccggccuccugcucagaaagcugaccagcaaggagcugaugaugaccacuaucgggaucgugcucuuaucccagagcaccauccccgaguccauccuggagcucaccgacgcgcucgcucugggcaugaugguccucaagaucgugcggaauauggagaaguaccagcuugcagucaccaucauggccauacugugcgugcccaaugccgugauccuccaaaaugcuuggaaggucagcugcacgacucuggccgugguguccgucucaccgcuccuccuaacguccagccagcagaaggcugacuggauaccgcuggcgcucacuauuaaagggcucaauccgacggccaucuuccugaccacccucagucggaccagcaagaaacggagcuggcccuugaacgaggcgaucauggccgugggcauggugagcauccuggcuuccucgcuccugaagaaugacaucccaaugacggguccccuggucgccgguggccuccucacaguguguuacguccugaccgggcguucggccgaccucgaacuggaacgggcggccgauguccgcugggaggagcaggccgagaucaguggcagcucacccauccuguccaucaccauauccgaggaugguagcauguccaucaagaacgaggaggaagagcagacccucaccauccugauccggaccgggcugcucgugauuucaggcuuauuccccguguccauaccgaucacggcggccgcgugguaucuaugggaggucaagaagcaacgcgccggaguacucugggacgugcccucuccgccucccguaggcaaagcggaacuggaagauggagccuaccguaucaaacagaagggcauccugggguacucgcagauuggcgccggcguguauaaggagggcaccuuccacacgauguggcacgugaccaggggcgcgguucucaugcauaaggggaagaggauugagccaagcugggccgaugucaagaaggaccugaucuccuacggcgggggcuggaagcuggagggugaauggaaggagggggaagagguccagguccuugcccuggagcccgggaagaacccgcgcgcggugcagaccaagcccgggcuguuuaagacuaauacgggcaccaucggggccguaagucucgauuuuucccccggcacuagcggcucccccauaguagacaagaaggggaagguggugggccuguacgggaauggcgucgugacccggagcgggacguacguauccgcuaucgcucaaacggaaaaguccaucgaagauaacccggagaucgaggaugacaucuuuaggaagaagcggcugacgaucauggacuugcacccuggggcagggaagaccaagcgcuacuuacccgccaucguccgggaggcgaucaaacgcggccugcggacgcugaucuuagcccccacgcgcguuguugccgcggagauggaggaggcucugcggggacugccgauccgguaccagacccccgcaauucgcgccgagcacacggguagagagauugucgaucucaugugccacgccacguucacuaugcgacuucugagcccaauucggguacccaacuacaaccugauuaucauggacgaggcucauuuuacagacccggccuccaucgcagcccgcggauauaucagcacgaggguggagaugggcgaggccgcggggaucuucaugacugccacgccgcccggcagcagagacccuuucccgcagaguaacgcgccaaucauggacgaggaaaaagagauccccgagcgcuccuggaacagcggccacgagugggucacagacuucaagggcaagacugugugguucguucccaguauaaaagccgguaaugacaucgccgcgugccugcgcaagaacggcaaaaaggucauccaacugagccggaaaacguuugacuccgaguacaucaagaccagaacaaacgauugggacuucgugguaaccacggacaucagcgagaugggcgcgaacuucaaggccgagcgagucaucgauccgcgccggugcaugaagcccgugauccuuaccgacggggaggagcgcgugauccuggcgggcccaaugccggucacgcacucaucagccgcacagcggcgcgggcgggugggucgcaacccuaagaacgaaaacgaucaauacauuuacaugggggagccccuggaaaacgaugaagauugcgcacacuggaaggaggccaagaugcuccuugacaauaucaacaccccggagggcauuauccccuccauguucgaaccggagcgggagaaaguggacgccaucgacggggaguaccgacuccgcggggaggcccggaagacuuuuguugaccuaaugcgccggggcgaucugcccguguggcuggccuaucgcgucgcggccgaggggauaaacuacgccgacaggcgcugguguuucgacggcgugaagaacaaccagauccucgaggagaacguggaggucgagauuuggaccaaggagggggagcggaagaagcucaagccuagauggcuggacgcccggaucuacagcgacccgcuggcccugaaagaguucaaggaguucgcagcgggccggaagagucugacucucaaccugauuaccgagaugggccggcugcccacguucaugacccagaaggcuaagaacgcccucgacaaccuggcaguacugcacacggccgaggccgggggacgagccuacaaccaugcccucagugagcuuccggagacccuggaaacgcuccugcuguuaacccugcuggcaaccgugaccggugggaucuuccucuuccugaugaguggcaaggggaucggcaagaugacccucgggaugugcugcaucaucaccgccagcaucuugcugugguacgcucagauucaaccccacuggaucgcggccuccaucauccuggaauucuuccucauaguacugcugaucccggagcccgaaaagcagagaacgccccaggacaaccagcuuaccuacguagucaucgcuauccuaacagucguugccgcuacuauggcuaacgaaaugggcuuucuggagaagacaaagaaggacuucgguuugggcagcaucacgacccagcagccggagagcaacauuuuggacaucgaccugaggcccgccuccgcuuggacgcucuaugccguugccacgacauuuaucaccccaaugcugcgccacucgaucgagaacuccucgguaaaugugagccucacagccaucgcaaaccaggcuacaguccucaugggccuggggaagggguggcccuuaagcaagauggacaucggagugccccuccuggcgauuggaugcuacucccaaguaaacccgauuacccugaccgccgcccuccuauuacucguggcgcacuacgcuauaaucggucccgggcuccaggccaaggccacgcgagaggcccaaaaacgggcugccgcgggcauaaugaagaaccccaccgucgacgggaugaccgugaucgaucuggaccccauucccuacgaccccaaauucgagaagcagcucggccaggugauguugcuaguccucugcgucacccaagugcuuaugaugcgcacgacgugggcgcugugcgaagccuuaacccuggcgacgggccccaucucaacgcuuugggagggcaaccccggacgguucuggaacaccacgaucgccguauccauggcgaacaucuuccgcggaagcuaccucgccggggccggacuauuauucuccaucaugaagaacacugcaaacacgcgccggggcaccgggaacaccggcgagacccucggagagaaguggaagaacagacuuaacgcccuuggcaagagugaguuccaaauuuacaagaaguccgggauacaagagguggacagaacccucgccaaggaggggaucaagaggggcgaaaccgaucaccacgccgugucaagggggagugcuaagcugcggugguucguugagcgcaaccugguaaccccggagggcaaaguugucgaucugggcugcgggcgcggcggguggagcuauuacugcggcgggcugaagaacgugaaggaagugaaaggccugaccaaaggcgggcccggccaugaggagccgauacccaugucuacauacggguggaaccucguccggcugcaaagcggcgucgacguguucuucaccucccccgagaagugcgacacucugcucugcgauaucggugaguccagcccgaacccgaccguagaggccggcagaacccugcgagugcugaaccucguggagaauuggcugaacaacaacacgcaguucugcaucaaggucuuaaacccuuauaugccauccgugaucgagaagauggaggcccugcaacgcaaguacggcggcgcucucgugcgcaauccuuugagccgcaacucuacacacgagauguauuggguaucaaaugccuccggcaacaucgugagcuccgugaacaugaucagccggaugcugaucaaccgauucaccaugcggcacaagaaagcgacguacgagcccgaugucgacuugggguccggcacgcguaacaucgguaucgaaagcgagacgccgaaccuagacauaaucggaaagcggauagagaagauaaagcaggagcacgagaccagcuggcacuacgaucaggaccaccccuacaaaacgugggccuaccacgggucuuacgagacgaagcagaccgggagugccagcucuaugguaaacggcgugguccgcuuacucacgaagccgugggacgugauuccaauggugacccagauggccaugacggauacaaccccguucgggcagcaacgcguuuucaaagagaaaguugacacgcguacgcaggaacccaaggagggcaccaagaagcugaugaaaaucaccgccgaauggcuguggaaggagcucggcaaaaagaagacgccacggaugugcacccgggaggaguucacccgcaagguucggagcaacgcggcacugggggccauuuucaccgacgaaaauaaguggaaguccgcacgcgaggcgguggaagauagcggcuucugggaacugguggacaaggagcggaaccuccaccuggaggggaagugcgagaccugcguauauaauaugaugggcaagcgugaaaagaagcuaggggaguucggcaaggcgaaggguucccgagcgauaugguauauguggcucggggcgcgauuccuagaguucgaggcacugggcuuccucaacgaggaucacugguuuucucgggagaacagcuuauccgggguggaaggcgaagggcugcauaaguugggcuacaucuugcgcgacgugagcaaaaaagagggcggggcgauguacgccgacgauacagccggaugggacacaagaauuacucuggaggaccucaagaacgaggagauggucaccaaccauauggagggggagcacaaaaagcuggcggaggccaucuucaagcugacguaccagaacaagguggugcgcguccaacggccuaccccgcgcggcaccguuauggacauuaucucccgucgugaccagcggggaagcgggcagguggucaccuacggccucaacacguucaccaacauggaagcgcagcugauacgccagauggagggagagggcguguucaagucuauacagcaguuaacgguuaaggaggagauagccguuaaaaauuggcuuauccggguggggagagagaggcugucacggauggccaucucgggggacgacuguguggucaagccccuggaugaccgcuuugccagcgcucuaaccgcucugaacgacaugggcaaggugagaaaggauauccagcagugggagcccagccgcggauggaacgauuggacccaggugcccuucuguucacaucacuuccacgagcucaucaugaaggacggacggguccucgucguuccuugccguaaccaggacgagcuuaucggccgcgcccgcauuucgcagggggcaggguggagccugcgagagaccgccugucucggaaagucuuacgcccagauguggagucugauguauuuccaucgucgggaccugcgccucgcggcuaacgcaauaugcuccgcgguccccagccauuggauuccgaccucccggacuacuuggagcauccaugccacgcacgaguggaugacuaccgaggacaugcugaccguguggaauagaguguggauccaggagaaucccuggauggaggacaagacgccggucgagagcugggaggaaaucccuuaccugggcaagagggaggaccaaugguguggaucccugaucggucuuacgagccgagcuaccugggccaagaauauccaaaccgccauuaaccaggugcggucccugaucggcaaugaggaguacacggacuacaugccgagcaugaagagguuccggagggaggaggaagaggccggcgugcucugguga

SEQ ID NO: 24850 - RNA, 9876 nt, Artificial Sequence
  derived and/or modified CDS sequence (opt11) from DENV-2__KX380814__SS-prME
acugcgggcauaaucaucaugaugauuccgaccguuauggccuuccaccucaccacccgcaacggugagccucacaugaucgucagccggcaggagaagggaaagagccuccuguucaagaccgagaacggcgugaacauguguacccucauggcgauggaccucggcgagcugugcgaggacaccaucaccuacaacuguccccugcuccgccagaacgagccugaggacaucgacugcugguguaacucaaccuccacgugggugacauaugggaccuguaccgcaacgggugagcaccggcgcgagaagaggagcgucgccuuggugccccacgugggcaugggucuggaaaccagaaccgaaaccuggauguccuccgagggcgccuggaaacacgcccagaggaucgagacauggauccuccgccaucccggguuuacaaucauggcggccauuuuggccuacacaaucggcaccaccuacuuccagcggguccugaucuucauccuucugacggccgugacccccuccauggcgaugcggugcauuggaauuagcaaccgggacuucguagaaggcgucuccggcgggaguugggucgacaucgugcuggaacacggcuccugcguuacgacaauggccaagaacaagccgacucucgacuucgagcucaucaagaccgaggccaagcaccuggcaacacuccgcaaguacugcguggaggccaagcugaccaacaccaccacugccagucggugccccacucagggggaacccucgcugaacgaggagcaggacaaacgcuucguuugcaaacacagcaugguagacaggggcuggggcaacgggugcggcuuguuugggaagggagggauugugacgugcgcgauguucacgugcaagaagaacauggagggcaaggugguccaaccggagaaccuggaguauaccaucguuaucacaccccacuccggugaggagaacgccguggggaacgacacggggaaacacgggaaggaaauuaaggucacgccacaguccuccaucaccgaggccgaguugaccggguacgggaccgugacgauggagugcagcccgcgcaccggauuagacuucaacgaaaugguguugcugcagauggagaacaaagcuugguuaguccaccggcagugguuucuggaccuuccccuccccugguugcccggcgcggacacccaaggaagcaacuggauucagaaggaaacccuagugacguucaagaacccgcaugccaaaaaacaggacgucguggugcuaggcagccaagaaggcgcuaugcauaccgccuugaccggcgcaacggaaauccagaugagcuccgguaaccuacuuuucaccggccaccugaagugccgccugcguauggacaagcuccagcugaagggcaugagcuacucgauguguaccgguaaguucaagguugucaaggagauagcggaaacccagcacggcaccauugugauccgcguccaauacgagggggacggaagccccugcaaaauacccuucgagaucauggaucuggaaaagcgacacguccucggccgccugauaacggugaacccaaucgucaccgaaaaggacuccccuguuaacaucgaggccgaaccgccuuucggggacagcuauauaaucaucggcguagagccagggcagcuuaagcucuccugguuuaagaagggcagcuccaucgggcaaauguuugagaccaccaugcgaggcgccaaacggauggcuauucugggcgacacggcuugggacuucggaagcuugggcggcgucuucaccuccaucggcaaagcccuccaccaaguguucggggccaucuauggcgccgccuucagcggcguguccuggacuaugaagaucuuaaucggagucgucaucaccuggaucggcaugaauagucgcuccacgagccugagugugagccuggugcucguggggguggucacccuguaucugggcgugaugguacaggcagacuccgguugugucgugucauggaagaacaaggagcuaaagugcggaagcggaaucuucaucaccgacaacgugcacaccuggaccgagcaguacaaauuccagccggagucacccucaaagcuggccagcgcuauccagaaggcccacgaggaagggaucugcggaauucggagcgucaccaggcuagagaaccucauguggaagcagaucacgcccgagcugaaccacauccugaccgagaacgaggugaaacucaccauuaugaccggggacaucaagggcaucaugcaggcggggaaacguacccugcgcccccaaccaaccgagcugaaauacagcuggaaggcuugggggaaggccaagauguugagcacugagcugcacaaccauaccuuccugaucgauggccccgaaacagccgagugccccaacaccaaucgugccuggaauagucucgagguggaggacuacggguuuggcgucuucacgacgaacaucuggcugaagcugaaggagcgccaggauguguucugugacagcaaguugaugagcgccgccauaaaggacaaucgagcaguucacgcagacaugggguacuggauugaaagcgcccugaacgacaccuggaagauugagaaggcaaguuuuaucgagguaaaaucuugccacuggccgaagagucacacccuguggucgaacggugugcucgaaucugagaugaucaucccaaagaauuucgcgggccccguaagccagcacaacuaccgccccggguaccacacccaaacggccggcccuuggcaccuggggcggcuugagauggacuuugacuucugcgagggcaccaccgucgugguaaccgaggacugcgggaaccgugggccgucccugcggacgacuaccgccagcgggaagcugaucaccgaguggugcugccgcucuugcacgcuaccgccccuccgauaccgcggggaggaugguugcugguacgggauggagauccggccgcugaaggagaaggaggaaaaccuugucaacucccuagucaccgccggucacggacagaucgauaacuucagccugggcguguuagguauggcucuauuucuggaggagaugcugcggacccgggucgggacuaagcaugcaauccuccucguggccguguccuuugucacacugauaacugguaauaugucuuuccgcgaucucggucgagugauggugauggucggcgcuaccaugaccgacgacaucgggaugggcgugacguaccuggcccuccucgcggcuuuuaaaauccggcccaccuuugccgcaggccuuuuacuucgcaagcugacuuccaaggaguugaugaugaccacgaucggcauagugcuccugucgcaaucgacaauucccgagucuauauuagaacucaccgacgcccuggccuuaggcaugaugguucucaaaaucgugcggaacauggagaaguaucaguuggccguuaccaucauggccauccuuugcgugcccaacgcggugauccuccagaacgccuggaagguauccugcacgacccuugcgguggugucaguuuccccucugcuccuaaccagcagucaacaaaaggccgacuggaucccucuggcccucaccaucaaggggcugaaccccacggccaucuucuugaccacccucagccgcaccuccaagaagcggagcuggccccugaacgaagcgauuauggcagugggcaugguguccauccuggccuccucccuccugaaaaaugauauaccgaugacgggcccccuggucgccgggggccuccugaccguuugcuacguacugaccggacgcucagcggaccucgagcuggagcgggcggccgaugugcgaugggaggaacaggcagagaucagcggcuccuccccgauccuguccaucacgaucagcgaggacggguccaugucaauuaagaacgaggaggaggaacagacguuaaccauccugauccggacaggcuugcugguaaucucaggucuguuccccgugagcaucccgaucaccgcggcugcgugguacuugugggaaguaaagaaacagcgcgcggggguguuaugggauguccccucucccccgcccguaggcaaggcugagcuggaagacggggccuaccguaucaagcagaaaggaauccuagguuauucccagaucggagccggcguguacaaggaggggacauuccacaccauguggcacgugaccaggggcgcgguccugaugcacaaagggaagcggauagagcccuccugggcggacgugaagaaggaccugaucagcuacggcggaggcuggaagcuggagggcgaguggaaggaaggggaggagguacaggucuuagcccuggagccuggcaagaauccgcgugccguacagaccaagcccggucuguucaagacaaacacgggcaccaucggggccgucucgcuagacuuuucacccgggacauccgggagccccaucgucgauaagaaagggaagguggugggccuguacgggaacggaguugucaccaggaguggcacuuacgugucagcgaucgcccagacggaaaagucaaucgaggacaacccggaaaucgaggacgacaucuuccgcaagaaaagacugaccaucauggaccugcaccccggggcaggcaagaccaagcgcuaccucccggccauuguccgugaagcgaucaagcgcgggcuacggacacugauccucgcccccacccgcguuguggccgccgagauggaggaggcacugcgcggacugccgauccgguaccagacccccgcgauccgcgccgagcacaccggacgggagauuguagaccucaugugccacgcaacguucaccaugcgccugcugagucccauccgggugccuaauuacaaccucaucaucauggacgaggcccacuucacggacccugccucuauagcggccagaggcuauaucucuacccgggucgaaaugggcgaggccgccgggaucuucaugacggccaccccgcccggcagccgcgacccuuucccgcaauccaacgcgcccaucauggaugaggaaaaggagauccccgagcggaguuggaauucggggcacgaaugggucaccgacuucaagggcaagacagugugguucgugcccagcaucaaggccgggaacgacaucgcagccugccugcgcaagaacggcaagaagguaauccagcuaucccguaagacguucgacucggaguacaucaagacccgcaccaacgacugggacuucguggugaccacggacauauccgagaugggcgcuaacuucaaggcggaacggguaaucgacccgcgccggugcaugaagcccgugauccucaccgacggggaggaacgcgugauccuugcgggccccaugccggucacccacucauccgccgcccagcgccgcgggcggguaggccgaaacccgaagaacgagaacgaucaguacaucuacaugggcgaaccccuugagaacgacgaggacugcgcgcauuggaaggaggccaagaugcuccuggacaacaucaacacacccgagggcaucauccccagcauguucgagccggagcgcgagaagguugacgccaucgacggcgaguaccggcugcgcggggaggcccggaagacguucgucgaccuaaugcgacggggggaccugcccguauggcuggccuacagaguugcggccgagggaaucaauuacgccgaccggcgcuggugcuucgacggcgugaagaacaaccagaucuuggaggagaacguggagguagagaucuggaccaaggagggggagcggaagaagcucaagccccguuggcuggacgcccggaucuacuccgacccgcucgcccugaaggaguuuaaggaguucgcggccggccgcaagucgcugacccucaacuuaaucaccgagaugggccggcugcccacauucaugacacaaaaggccaaaaacgcccucgacaaucuggcgguucugcacaccgcggaggccgggggccgcgccuacaaccacgcccucagcgagcugccugagacacuagagacgcuccuguugcucacccugcuggcgaccgucacugggggcaucuuccucuuccugaugagcggcaaagggaucggcaagaugacucuggggauguguugcaucaucacagcaucaauacugcugugguacgcccagauccagccccacuggauugccgccagcaucauccuggaguucuuucuaaucguccugcuuaucccggagcccgaaaaacagcguacgccccaagacaaccagcucaccuaugugguuaucgcuauccugacuguuguggcggccacuauggccaacgaaaugggcuuuuuagagaagacgaaaaaagacuuugggcucggaucuaucaccacccagcagcccgagagcaauauacuggacaucgaccugagaccggccagcgcguggacgcuauacgccguugccaccaccuucauuaccccaaugcugcggcacucgaucgaaaacaguuccgucaacgugagccugacggccaucgccaaccaggcgaccguuuugaugggucuggggaagggcuggccccuguccaagauggacaucggggucccccuccuagccaucgguugcuacucacagguaaacccaauaacccugacugccgcgcuccugcuguugguggcgcacuacgccaucaucggucccggccugcaggccaaggccacgcgcgaggcccagaagcgggcagcagccgggaucaugaagaacccgaccguugaugguaugaccgucaucgaccuggaccccauccccuaugaucccaaguucgaaaagcaacucggacagguuaugcuccuaguccucugcgugacccaggugcugaugaugcgcacaacuugggcccugugcgaagcccucacccucgcaaccgggcccaucuccacgcugugggagggcaauccgggcagauucuggaacaccacgaucgcggugagcauggcuaacaucuucagaggcuccuaccucgccggcgccgggcuguuguucagcaucaugaagaacaccgcuaacacgcgccggggcaccgguaacaccggugagacccucggcgaaaaauggaagaaccgccucaacgcgcuugggaaguccgaguuccagauauacaaaaaguccggcauccaagagguggaccggacguuagcgaaggaggggaucaagcggggagagacagaccaccaugcaguaagccgggggucagccaagcugaggugguucgucgagcgaaacuuagugaccccggagggaaaaguggucgaccugggcugcggucgcgggggguggucguacuacugcggcgggcugaagaacgugaaagagguaaaggggcugaccaagggggggcccgggcaugaggagccaaucccgaugagcacguacggguggaacuuagugcggcugcaauccggaguggaugucuucuucacaaguccggagaagugcgauacccugcucugcgacaucggggagagcucgcccaaccccaccguggaggccggccgcacucugcgggugcucaaccucguggaaaacuggcugaacaauaacacgcaguucugcauuaagguccuuaaccccuacaugccguccgugaucgagaagauggaggcccugcaacgcaaguacggcggggcccucgugcggaacccccugucccgcaacagcacacacgaaauguacuggguguccaacgcaucgggaaauauaguguccagcgugaacaugaucucccggaugcuuaucaaccgcuuuaccaugaggcacaagaaggcgaccuacgagcccgacgucgacuugggcagcggcacgcgcaacaucggaaucgaauccgagaccccgaaccuggauaucaucggcaagcgaaucgagaagauuaagcaggagcacgagaccuccuggcauuacgaccaggaucaccccuacaagaccugggcguaucauggcuccuaugagacgaaacagacaggaagcgccuccagcauggucaacggggugguccgccugcuaacgaagcccugggaugugauacccauggugacacagauggccaugacggacaccacgccuuucggucagcagcgcgucuuuaaggagaagguugauacgcggacgcaagagcccaaagaaggcacgaaaaaacucaugaagaucacagccgaguggcuguggaaggagcucggcaagaagaaaacgccccggauguguacgcgagaagaguucacccgcaagguccgguccaacgcggcccugggcgccaucuuuaccgacgagaacaaauggaaguccgcacgcgaggccguggaggauagcgguuucugggagcuggucgacaaggagcggaaccuccaucucgaagggaagugcgaaaccugcguguacaacaugaugggcaagcgcgagaagaagcugggggaguucgggaaggcgaagggaagccgggccaucugguacauguggcucggcgcccgcuuccucgaguucgaggcuuuaggcuuccuuaacgaggaccacugguucucccgggaaaacagccugagcgggguggaaggcgagggucuucacaagcucggcuauauccucagagacguguccaagaaggagggcggagcuauguacgccgacgacacggccggcugggacaccagaaucacuuuggaggaccugaagaacgaggagauggucacgaaccauauggagggagagcauaagaaacuggcugaggccauuuucaagcugacuuaccagaacaagguagugcgcguccagcggcccaccccuaggggcacggucauggacaucauaagcaggcgcgaccagcgggguuccggacaaguggucaccuacggucucaacacguucacuaacauggaggcccagcugauccggcagauggagggggagggcguguucaagucaauacagcagcuaaccgugaaggaagagaucgccgugaaaaauuggcucauccgggucgggcgagagcgccugucccggauggccaucagcggugacgacugcguggucaagccccuggacgaccgcuucgccuccgcucucaccgcgcuuaacgacaugggcaaggugcgaaaggauauccagcagugggagcccucccgcggguggaacgauuggacccaagugcccuucugcucucaccauuuccacgaacuuaucaugaaagacggccggguccucguagugcccugucgcaaucaagacgagcugaucggacgggcccggaucucccagggcgccggguggucccugcgugagaccgcaugccucggcaagagcuacgcacaaauguggucccuaauguacuuccaccgccgggaccugagacucgcagccaacgccaucugcagcgccgucccaucccacuggauucccaccagccggaccaccugguccauccaugcuacccacgaauggaugaccaccgaggacaugcugaccguauggaaccgcguauggauccaggaaaaccccuggauggaggacaagacgccaguugaaucgugggaggagaucccguaucugggcaagcgugaggaucaguggugcggaucucucaucgggcuuaccucacgagcgacaugggccaagaacauccagaccgccauuaaccaagugcggagcuuaaucgggaacgaggaguacacggacuacaugcccuccaugaaacgcuuccgucgcgaggaggaagaggccggcgugcucugguag

SEQ ID NO: 24851 - RNA, 9876 nt, Artificial Sequence
  derived and/or modified CDS sequence (opt11) from DENV-2__KX380807__SS-prME
acugcaggcaucauuaucaugaugauuccgacagucauggcguuccaucugacuacccggaacggggagccucacaugaucgucagccggcaggagaagggcaagagccuccuuuuuaagaccgagaacggggugaacauguguacguuaauggccauggaccucggcgaguugugugaagauaccaucacuuacaacuguccccugcuccggcagaacgagcccgaggacauugacugcuggugcaacagcaccagcacuugggugacguacgggacaugcacugcuaccggcgagcaccggcgggaaaagcgaagcguagcccuggcgccccacgucggcaugggucuggagacgcggacugagaccuggauguccucagaaggcgccuggaaacacgcgcaacggauugagaucuggguguugcgccaucccggguucaccaucauggcugccauacuggccuacacgaucggcaccaccuacuuccagcggguucugaucuucauauugcugacagcgguggcucccuccaugacgaugagauguauagggaucagcaacagagauuucguugagggcguguccggcgggagcuggguggacaucguccuggaacacggcuccugcgucaccaccauggccaagaacaagcccacccucgacuucgagcugaucaagacggaggcaaagcacccugccacccuucgcaaguauugcaucgaggcaaagcucacuaacaccacgacugcgagccggugcccgacccagggcgaacccucccuuaacgaggagcaggacaagcguuucgugugcaagcauuccaugguggaccggggcuggggcaauggguguggucuguucgguaagggagggaucguaaccugcgcgauguuuacuugcaagaaaaacauggaaggcaagaucgugcagcccgagaaccucgaauacacuaucgucauuacaccccacuccggcgaagagaaugcugucgggaacgauaccggcaagcacgggaaagagaucaaggugaccccgcaaucauccaucaccgaggcggaguuaaccggguacggcacagucacgauggagugcagcccccgaacuggccuggacuuuaacgagaugguucuccugcagauggaaaacaaggcguggcugguccacaggcagugguucuuagaccugccccugccguggcucccaggcgccgacacccagggguccaauuggauucaaaaggaaacgcuggugaccuucaagaacccccacgccaagaagcaggacguagugguccuggggagccaggagggggccaugcacacggcccucaccggagcaacagagauccagaugagcuccgggaaccugcuguucaccggccaccucaagugccgcuuacggauggauaagcugcagcucaaaggcaugagcuauucuaugugcacggggaaauucaagguugugaaggaaaucgccgagacgcagcaugguaccauaguaauucgcguacaguacgagggcgauggcucgcccugcaagaucccuuucgagaucauggaccucgaaaagcgucacgugcugggccgacucauuacggucaauccgaucgugacagagaaggauucacccgugaacaucgaggcggagccgcccuuuggggacucauacaucaucaucggugucgagccggggcagcugaaguuaucuugguucaagaagggcucauccaucggucagauguucgagacaaccaugcgcggagcaaaacgcauggcaauacucggugacaccgcgugggacuuugguagccucggcggggucuucacgagcaucgguaaggccuugcaccaaguguucggggccauauacggggccgcguuuucaggcguauccuggaccaugaaaauccucaucggggucguaaucaccuggaucggaaugaacagccgcaguaccucguuguccgucucauuagugcugguuggugucgugacguuauaccugggcgugaugguccaggccgacucggggugcguggugagcuggaagaacaaggagcugaaaugcggcuccggcaucuucaucaccgacaacguccacaccuggaccgagcaguacaaguuucaacccgaguccccuuccaagcucgccuccgcaauacaaaaggcccacgaagaggggauuugcggaauccggagcgugacgagauuggagaaccugauguggaaacagauuacccccgagcucaaucacauccuguccgaaaacgaagugaaguuaacaaucaugacgggggauaucaagggcaucaugcaagcggguaaacggucccuccgcccgcagccuacggagcuaaaguacuccuggaaagccugggguaaggccaaaauguuguccacagagcuccacaaccacaccuuccugauagauggaccggaaaccgcugaguguccgaacacgaaccgggccuggaacucccuggagguugaggacuacggguucggcguguucacaaccaacaucuggcucaaguuaaaggagcgccaggauguauucugcgauaguaagcugaugagcgcggcuauuaaagauaaccgggccguccacgcggacaugggcuacuggaucgagagcgccuugaacgauaccuggaaaaucgaaaaagcguccuucaucgagguaaagagcugccacuggcccaagucccacacucuuuggucuaacggcgugcuggagucagaaaugaucauacccaaaaacuucgcaggcccagucagucaacauaacuaccgcccgggguaccacacacagaccgccggccccuggcaccuugggcggcuagagauggacuucgacuucugcgaaggcaccaccgucgugguuacggaagacugcgguaaccgcgggcccucacugcggaccacuaccgccucaggcaagcucauaacggaguggugcugccgcagcugcacgcuacccccgcugagauaccgcggggaggacggcuguugguacggcauggagauccggccccucaaggagaaggaagaaaaccugguaaacucccuggugaccgcgggccacggucagauagacaacuuuucacucggcguacugggaauggccuuauuccucgaggaaaugcuccgcacccggguggggacgaagcaugccauccuguugguagcggucuccuucgugacccuuaucaccggcaacaugaguuuccgcgaccugggacgcguuauggucaugguuggcgcuacgaugacggauaacaucgggaugggugugacuuaccucgcguugcuugccgccuucaaaguccggcccaccuucgcagccgggcuacugcugcgcaaguuaacuuccaaggagcugaugaugacgacgaucgggauuguucugcuaucccagucuaccaucccagaaaccaucuuagaguugacggaugcgcucgcuuugggcaugauggugcugaagaucgucagaaauauggaaaaguaucagcucgccgugacaauaauggccauccuguguguaccuaaugcugugauccugcagaacgcguggaaggucagcugcacuauccuagcggucguuucugugagcccuuugcugcugacuuccagccagcagaaagccgacuggaucccccuggcccuuacuaucaaggggcucaauccaacggcgaucuuucugaccacccugagccgcacguccaagaagcggucguggccgcucaacgaggccaucauggccgucgggauggugaguaucuuggcauccucauuacuaaagaacgacaucccgaugacggggccccugguggccgggggccuguugaccgucugcuacguccugacagguagaagcgcugaccuggaauuagaaagggcggcggacgugagaugggaggaacaggccgagaucuccggcagcucccccauccuaagcaucacgaucagugaggacggcucgaugucaaucaagaacgaggaagaggagcagacacucaccauccucauccggaccggccuccuggucaucuccggcuuguucccgguguccauucccauaacggccgcggccugguaccugugggaggugaagaagcagcgagcugggguucugugggacguccccagcccgccgcccguaggcaaagccgaacuugaggacggggcuuaccggaucaagcagaagggcauccucgguuacucccagaucggcgcuggcgucuacaaggaggggaccuuccacaccauguggcacguaacccgcggagccgugcugaugcacaaggggaagcgcaucgagcccagcugggcagacgugaagaaggaccucaucucuuauggcgggggcuggaagcuggagggcgaguggaaagagggggaagagguccagguauuagccuuggaacccggcaagaacccccgcgccguacagaccaaaccagggcuguucaaaacuaacaccggcaccaucggggccgucagccuggacuucucccccggcaccagugguagccccauuguggacaagaaggggaaggucgucggccucuacggcaacggcguggucacgcggagcggcaccuacguguccgccaucgcgcagaccgaaaaguccaucgaggacaaccccgagaucgaggacgacauauuccgcaaaaagcgguuaaccaucauggaccugcacccaggggccgguaaaacgaagcgcuaccugcccgcgauugugcgcgaggccauaaagcgcggacuccggacccugauucuggcaccgacccgcgucguggccgccgagauggaggaggcucuccguggccuaccgauucgguaccagacccccgccauccgcgccgagcacacggggagggagauaguggaccugaugugccacgccacauucacaaugcgccuccucaguccgauccggguaccaaacuauaaccugaucauuauggaugaagcccauuuuaccgaccccgcguccauugccgcccgcggcuacauaagcaccagggucgagaugggcgaggcagccgguaucuucaugaccgcgacgccgccuggcucacgcgaccccuucccccaaagcaacgcuccgauuauggacgaagaaagagagauacccgagcgcuccuggaacagcggccacgaguggguuaccgauuuuaagggcaagacugugugguucgugccgucaaucaaggccgguaacgacauagccgcgugccuccggaagaacggcaagaagguuauccaacuaagccgcaagacauucgacuccgaguacaucaaaacccguaccaaugacugggauuuugucgugacaacggacaucagcgagaugggcgccaacuucaaagcagaaagagucauugacccucggcgcugcaugaagcccgucauccugacugacggggaagaacgggugauacuggccggccccaugcccgugacccacuccagcgcagcucaacgccgggggcgcgucggccgcaaccccaaaaaugaaaacgaccaguacaucuacaugggggagcccuuagagaacgacgaggacugcgcccacuggaaggaggcuaagaugcugcucgauaacaucaacacgcccgaggggaucaucccuuccauguucgagcccgagcgcgagaagguggacgcgguugacggcgaguaccgccugcggggcgaggcccgcaaaacauucgucgaccucaugaggcggggcgaccucccgguguggcuggcguacaaggucgccgccgaagggauaaacuacgccgaccggcgcuggugcuucgacggcgugaagaacaaccagauauuagaggaaaaugucgagguagagaucuggaccaaagagggcgagaggaagaagcucaaaccuagguggcuugaugcccgaaucuauagugaccccuuagcucucaaggaguucaaagaguucgccgcggggcgcaagucccugacccuuaaccucaucacggagaugggccgcuugccuaccuucaugacccagaaggcccgaaacgcgcuggacaaccucgcagugcugcacaccgccgaagccgggggccgggcguacaaccacgcgcugagcgagcuuccggagacgcuggaaacccuacuccuguuaacucuccuggccaccgugacaggcgguauuuuucuguuucuuauguccggaaaggggaucggaaagaugacccuggggaugugcugcaucaucacggcaagcauucuguuaugguacgcccagauccagccgcacuggaucgccgcaucaaucauacuggaguucuuccugaucguacuccugauacccgagcccgagaagcagcgcacgccccaggauaaccagcugacguacgugguuaucgccauccugacggucguggcugcaacuauggccaacgagaugggcuuucuggagaagaccaagaaggacuucggguugggcaguaucaccacucagcagccggagucaaacauccucgacaucgaccugcggccggcuucggccuggacccuauacgccguggcaaccaccuucaucacacccaugcuccgccacuccauugagaacuccagcgucaacgugucacugaccgcaaucgcgaaucaggccaccgugcucaugggccucggaaagggcuggccccucagcaagauggacaucggugucccccuguuagccaucggcugcuacucccaggugaaccccauuacccugacggcugcucuacucuuauuaguggcccacuacgcgaucauugggccgggacuccaggcuaaggccacgcgggaggcgcagaagcgcaccgccgccggaaucaugaaaaucccggccgcucuaaucgucaccgugaucgaccuggacccgauccccuacgaccccaaauucgagaagcaauugggccaggugaugcugcuggugcucuguagcacccaggugcuuaugaugaggaccaccugggcguuaugcgaagccuugacccuggccacggggcccaucaguacccucugggaggggaacccgggccgcuucuggaacaccaccaucgccgugagcauggccaacaucuuccgggggucauaccucgcgggcgcgggccuacucuucucaaucaugaagaacacggccaauaccaggcgugguaccggcaacaccggggagacgcucggggagaaauggaagaaccgacugaacgcgcugggcaagucggaguuccagaucuauaagaaaucagggauacaggagguugaucgcacccucgcaaaggagggcauaaagcgcggggagacugaucaccacgccguauccagaggcucggccaagcugagaugguucguggagcgcaaccuggucaccccagaggggaagguuguggaccuaggcugcggccgcggcgggugguccuacuacugcggcgggcucaagaacgucaaagaaguaaagggguuaacgaaaggagggcccgggcacgaggagcccauuccgaugagcaccuauggauggaaccucgugcgguugcaguccggggucgacguguucuucacgccgccugagaaaugcgacacccugcucugcgacauuggcgagagcagccccaacccgacgguggaggcggggcggacccugcgcguccuaacucucguugagaacuggcugaacaacaacacccaguucuguauaaagguucucaaccccuacaugcccuccgucauugagaagauggaagcccugcagcggaaguaugggggcgcucucgugcguaacccgcucagccggaacuccacgcaugagauguacugggugagcaacgccuccgggaacaucgugagcagugugaauaugauaucacgcaugcugaucaaccgguucacgaugaggcacaagaaggcgaccuacgagcccgacguggacuuaggcucggggacccggaauaucgguaucgagagcgagacccccaaucucgauauuaucgggaagcgcaucgagaagauuaagcaggagcacgaaacgucuuggcacuaugaccaggaucaccccuauaagaccugggccuaccacggcagcuaugagaccaaacagaccgguucugccagcucuauggucaaugggguugugcgcuuacucacaaagccaugggacgucauccccauggucacucagauggcgaugacggacacuacgccuuucggacaacaacgaguguucaaggaaaaggucgacacccgcacccaggagcccaaggaggggaccaagaaacugaugaaaaucacggccgaguggcuauggaaggagcuaggcaagaagaagacuccucgcaugugcaccagagaagaguucacccggaaggugcgaucaaaugccgcacugggcgcgaucuuuacugacgagaauaaguggaaaagcgcacgggaggcugucgaagacagcggguucugggagcuggucgacaaggaacgcaaccuccaccuggagggcaagugcgagacaugcguauacaacaugauggggaagcgggagaagaaguugggcgaguuugguaaggccaagggcucccgcgccaucugguauauguggcugggugcacgguuccuggaguucgaggcccucggguucuuaaacgaggaccacugguucucccgcgagaacucccuuuccggcgucgagggagaaggccugcacaaauuaggguacauccugcgggacgugucgaagaaggagggcggagccauguacgccgacgacaccgcuggaugggacacacggaucacguuggaggaccucaaaaacgaggagauggucacuaaccacauggagggcgagcauaagaaacuugcggaggccaucuucaaacugacuuaucagaacaaaguaguuagaguccagcgacccacgccccgagggacagucauggacaucaucucucggcgggaccagcguggaagcggccaaguugugacguacggccucaacacguucaccaacauggaggcccagcugauccggcagauggaaggagagggagucuucaagucgauacagcaacugaccgccaccgaggagaucgccgugaagaacugguuaguacgcgucggccgcgagcgucugagcaggauggcgaucuccggugacgacugcgucgugaagccccuggacgacagguuugccagcgcgcucaccgcauugaacgauaugggcaagguacgcaaggacauucagcaaugggagccgucccgggguuggaacgacuggacccaggugccauucugcucccaccacuuccaugagcuuaucaugaaggauggccgcgugcucgucgugcccugcagaaaccaggaugagcugaucggccgcgcccggaucucccagggggcgggauggagccugcgagagacggccugucucgguaaaagcuaugcccagauguggucauugauguacuuccaccggagagaccuccggcucgccgccaacgcuauuugcuccgcuguaccgagccacuggguaccuaccagucgcacuacuuggucaauucaugccacacacgaauggaugaccaccgaggacaugcugaccgucuggaaucggguguggauacaagagaaccccuggauggaggauaaaaccccggucgagagcugggaggagaucccguaccugggcaagcgcgaggaccaguggugcggcucccucaucgggcuaacuagccgugcuacuugggcgaaaaacauacagacugccauuaaccaggugcguucccugaucggcaacgaggaauacaccgacuacaugccgagcaugaagcgguucaggcgggaagaggaggaggcagggguccucugguaa

SEQ ID NO: 24852 - RNA, 9876 nt, Artificial Sequence
  derived and/or modified CDS sequence (opt11) from DENV-2__KX380815__SS-prME
acugccgggaucaucaucaugaugauacccaccgugauggccuuccaccuaacuaccaggaacggggaaccucacaugaucgucagccggcaggaaaagggcaagagucuccuauuuaaaacugagaauggcgucaacaugugcacccuuauggcgauggaccucggggagcuuugcgaggacaccauuaccuacaacugcccccugcuccggcagaacgagccggaggacaucgacugcuggugcaauagcacguccacaugggugaccuauggcaccugcaccgcaaccggagagcaccggcgggagaagcggagcgucgcccuggugccccacgugggcaugggguuagagacuaggaccgaaaccuggauguccagcgagggcgccuggaagcacgcccagcggaucgagaccuggguccugcgccacccgggauucacgaucauggccgccauccuggccuacacaaucggcaccaccuacuuucaacgggugcugauauucauauuguuaacggcgguggcgccguccaugaccaugagaugcaucgggauaagcaaccgggacuucguagaaggcgugagcggcggcucuuggguggacaucguccuugagcacgggucuugcgugacaaccauggccaagaacaaaccaacucuagacuucgaacugaucaaaaccgaagccaagcaccccgccacccugcgcaaguacugcaucgaggcaaagcuuaccaacaccaccaccgcgagccgcugcccgacacagggagaacccucccugaacgaggagcaggacaagcgcuucgugugcaaacacucaauggucgacaggggcuggggaaacgggugcgggcuguucgggaagggcgggauuguaacgugcgccauguucacgugcaagaagaacauggaggggaaaaucgugcagcccgagaaccucgaguauaccaucgucauaacuccccacuccggcgaggaaaacgccguggggaacgacacgggcaagcaugggaaggagaucaagguaaccccgcagagcuccaucaccgaagccgagcuaacgggcuacgggacggucaccauggagugcagcccccgcaccggccuggacuuuaacgagaugguacuccuccagauggaaaacaaggccuggcuugugcauagacagugguuccucgaccugccacugcccugguuaccgggcgcggacacccagggguccaacuggauccaaaaggagacccuggucacguucaaaaacccccacgccaagaagcaagacguuguaguauuaggcucacaggaaggcgccaugcacacugcucuuaccggcgcgaccgagauccagauguccagcgggaaccugcuuuucacgggucaccucaagugccgacugcgaauggacaagcuccaguuaaaaggcaugucguacuccaugugcaccgggaaauucaaaguggugaaagagaucgcggagacccagcacggcacaauugugauccggguacaguacgaaggggacggcagccccugcaagauucccuucgagaucauggaucuggagaagcggcacguccugggccgccucaucacgguaaacccaaucgugaccgaaaaggacucccccgucaacaucgaggcagagccgcccuucggugacagcuacauuaucauuggcgucgagccggggcagcugaagcuguccugguucaagaagggcagcuccaucgggcaaauguucgaaaccaccaugcgcggcgccaaacggauggccauucucggagacacagccugggacuucgguagccucggcggaguguucaccuccaucggaaaggcgcugcaccaggucuucggggccaucuacggugccgccuucagcggcgucucauggaccaugaagauccugauagguguggucauaaccuggaucggcaugaacagucggucgacgagccuguccgucagcuuggugcuggucgggguggugacgcuuuaccuggguguuauggugcaggcggacuccgggugcguggucagcuggaagaauaaggagcugaagugcggcagcgggaucuucaucaccgauaacgugcauaccuggaccgaacaguacaaauuccagccagagucucccucgaagcuugcauccgccauccagaaggcacacgaagaggggaucugcgggauccggucggugaccagauuggaaaaucugauguggaagcagaucacgcccgaguugaaccacauauugaccgagaacgaaguuaagcugacgauaaugaccggggacaucaagggcaucaugcaggcuggaaaacggucccuccgcccucagccaaccgaguugaaguacagcuggaaggcguggggaaaggcaaaaaugcugucuaccgagcuccacaaucauacguuucugaucgauggcccggaaaccgcugagugcccgaacaccaacagagccuggaacucacuggagguagaggacuacgguuucggaguguucaccacgaacaucuggcuuaagcucaaggagcgucaggacgucuccugugacagcaagcuaauguccgcggcgaucaaggacaaccgggccgugcacgcugacaugggcuacuggaucgaaagcgcccugaaugacacauggaagaucgagaaggccaguuucauagaggucaagucgugccauuggccuaagucccacacccuguggagcaacggcguccuggaguccgagaugaucaucccuaagaauuucgcgggacccgugagccagcacaacuaccgcccgggguaucacacccagaccgcaggccccuggcaucucggacggcuggagauggacuuugacuucugugagggcacgaccgucgucgugacggaggacugcggaaaccgcggccccagccugagaaccacgaccgcuuccgggaaacucaucaccgaguggugcugucgcagcuguacccuccccccgcugcgguaccgaggggaagacgguugcugguacgggauggaaaucagaccccucaaggagaaggaggagaaucuugugaauucccuugucacggccggccauggccagaucgacaauuucucacucgggguccuaggcauggcgcuguuucucgaagagaugcugaggacccggguggggaccaagcacgccaucuugcuugucgccguaucuuuugucacccugaucacagguaauaugagcuuccgcgaucugggacgcgucaugguaauggugggcgccaccaugaccgacgacauugggaugggcgucacuuaccucgcccugcuggcggccuucaagguucggcccacauucgcggcaggcuuacugcugcgcaagcucacgagcaaggaacugaugaugacaaccaucgggauaguguugcucagccagaguaccauaccggagaccauccuugaacugaccgacgccuuagcgcugggcaugaugguccugaaaaucgugcguaacauggagaaguaccaacucgcagucaccauaauggcaauucugugcgugccgaacgcugugauccugcagaacgccuggaaagucagcugcacgacccuggccgugguguccgucucgcccuuacuccuaaccucgagucaacaaaagacggacuggauaccccuggcccugacgaucaaagggcuuaaccccaccgccaucuucuuaaccacucuuucccgaaccagcaagaagcgguccuggcccuugaacgaggcgaucauggcaguggguauggucagcauccuggcuuccucuuuccugaaaaacgacauccccaugacaggcccccucguagcuggggggcugcugacggugugcuacgugcucaccgggcggagcgccgacuuagagcuggagcgggccgccgacauucggugggaagagcaggccgaaaucucgggcaguuccccgauccucuccaucacgaucuccgaggaugggagcauguccauuaagaacgaggaggaggagcagacauuaaccauccuuauccggaccgggcuccuggucauuagcggccuguuuccugugagcauccccaucaccgccgccgccugguacuuaugggaggugaagaagcagcgugcgggggucuugugggacguccccagcccgccucccgucggcaaggccgagcuggaagacggggccuaccggauaaagcagaagggcauccucgguuacucccagaucggcgccggagucuacaaggaggggacguuucacacuauguggcacgugacucgcggcgccgugcugaugcacaagggcaagcguaucgagcccagcugggcggacgucaagaaagaccugaucuccuacggugggggcuggaagcucgagggcgaguggaaggagggugaggaaguccaggugcuagcucuugagccgggcaagaacccccgcgccguucagaccaaacccggccucuuuaagacgaacaccggcaccaucggggccgugucucuggacuucucccccggcaccagcggaucccccaucguggacaagaaggggaagguagugggcuuauaugggaacggcguugucacgagaagcggcacguacguguccgccaucgcgcagaccgagaagaacaucgaggacaaccccgagaucgaggaugacaucuuccguaagaagcggcucacuaucauggaucuucacccaggggcaggcaagacgaagcguuaucugcccgcgauaguccgagaggccaucaagcgcgggcuccggacccugauccucgcgccgacccgcgucguggccgccgagauggaggaggccuugcgcggccucccaaucagguaccaaacgcccgcuauccgcgcggagcacacggggagagagaucguggaucugaugugccacgccaccuucaccaugcgccugcucagcccgauccgagucccgaacuacaaccugaucaucauggacgaggcccacuucaccgauccagcgagcaucgccgcgcgcgguuacaucuccacgcggguagaaaugggcgaggccgccgguaucuucaugaccgccacuccgcccggcuccagagacccguucccccaguccaaugccccgaucauggacgaggagcgggagauccccgagcgcucguggaauuccgggcacgaguggguaaccgacuucaagggcaaaacggucugguucguaccguccaucaaagcggggaaugacauagccgccugccugcggaaaaacggcaagaaggugauucagcucucccgcaagaccuucgacagcgaguacgucaagacccggaccaaugacugggauuucguggugacuaccgacauuuccgagaugggcgccaacuucaaagcggagcgcguaauagacccccggcgguguaugaagcccgugauccugaccgacggcgaggagcgggugauucuggcuggccccaugccggucacccacuccucggccgcucagcgccgagggcgcgugggcaggaaccccaagaacgagaacgaucaguauaucuacaugggggagccgcucgaaaaugacgaggacugcgcacacuggaaggaggcgaagaugcugcuggacaacaucaacacgcccgagggcaucaucccaagcauguucgagcccgaacgggagaagguggaugcuaucgauggcgaauaccgccuccgcggugaggcccgcaaaacguucgucgaccugaugcggcgcggcgaccugccaguauggcucgccuaccgggucgccgccgagggcauaaauuacgcagaccgcaggugguguuuugacggcgucaagaauaaccagauccuggaggagaauguggagguugagaucuggaccaaggagggggaacguaaaaagcugaaaccgcgguggcucgacgcccgcaucuacuccgacccccuagcccucaaagaguucaaggaauucgccgcggggcgcaagagccucacucugaaccugaucacggagauggggcgucuccccaccuuuaugacucagaaagcccggaacgcccuggacaaccuugccgugcuccauacugcggaggccgggggccgugccuacaaccacgcauuauccgagcugcccgagacgcucgagacccugcugcuccugacccugcucgccacuguaaccggaggcaucuuucucuuccugaugagcggcaaggggaucggcaaaaugacgcuagggaugugcugcaucgucaccgcguccauucugcugugguacgcccagauucagccacauuggauugccgcaagcaucauucucgaauucuuucugaucguacugcucaucccagaacccgagaagcagcggacgccacaagauaaccaacuaaccuacguggucaucgcaauccuaacggugguagcggcgaccauggccaacgaaaugggguuccucgagaagaccaagaaggacuucgggcugggcucaaucaccacacagcagccggagagcaacauccuggacauugaccuccgccccgccagcgcauggacccuguacgcagucgccaccaccuucauaacgcccaugcugcggcacucuaucgagaacucaucggugaacgugagccucacugccauugccaaccaagcuaccguucuaaugggcuuggggaagggguggcccuuguccaagauggacaucggaguuccgcugcuggcgaucggcugcuauagucaggugaaccccaucacucucacugcugcacugcugcuccuggucgcccauuacgcaauuaucggucccggccugcaggccaaggcgacccgcgaagcacagaagagagccgcggccggcaucaugaagauccccgcggcguugauuaugaccgucaucgaccuggacccgaucccuuacgaccccaaguucgagaaacaacucggccaggugaugcuacuuguccuuuguuccacacagguucucaugaugcgcacgaccugggcucugugcgaggcccugacccuggcuaccggucccaucagcacucugugggaggggaacccgggccgcuucuggaacaccaccaucgcaguguccauggccaacaucuucagaggguccuaccuggccggcgcgggcuuacuguuuaguaucaugaagaacacggccaacacucgccggggaaccgguaacacuggggagacccugggagagaaauggaagaaccagcucaacgcgcuaggcaagucugaauuccaaaucuacaagaagagugggauccaggaggucgaccgcacgcuggcaaaggagggcaucaaacgcggggagacugaccaccacgcagugucgcgugggucugccaagcuccggugguuuguggagcgcaaccucgucaccccggaggggaaggugguggaccuagguugcggccgcggagguuggagcuacuauugcggcgggcucaagaacgucaaggagguuaaggggcugacaaagggcgggcccgggcacgaggagcccaucccgauguccaccuauggcuggaaccugguuagauuacagagcgggguggacgucuuuuucacgccgcccgagaagugcgacacccugcugugcgauauuggcgagucgagccccaacccgacgguggaagcggggagaacccuccgcguccugaaccugguggagaacuggcuuaacaacaacacccaguucugcaucaaggugcugaaccccuacaugcccagcguuaucgagaagauggaggcccugcagaggaaguacggaggcgcccuggugcggaacccucucucccggaacucaacccacgaaauguacuggguguccaacgcaagcgguaauauagucuccagcgugaacaugaucagucgcaugcugaucaaccgauucacgaugcgccacaagaaggcaaccuacgaacccgacguggaccugggaagcgggacucggaacaucggcaucgagucagaaguccccaaccucgacauuaucgggaagcguaucgaaaagauuaagcaggaacacgaaaccagcuggcacuacgaccaagaccaccccuacaagaccugggccuaccauggcuccuacgagaccaagcagacgggcagcgccuccagcauggugaacggggugguccgucuccuaaccaagccgugggacgugauccccaugguuacccagauggccaugaccgacacgacccccuucggacaacagcggguauucaaagagaagguggacacacgcacccaggagccuaaagaggggacgaagaaguugaugaagauaaccgcggaguggcuguggaaggaacugggcaagaagaagacccccagaaugugcacccgcgaggaguucacacggaagguccgaucgaacgcagcacucggggccaucuucacggacgagaacaaauggaaguccgcucgggaagcgguggaggacagcggauucugggagcugguggacaaagagcguaaucugcaccucgagggaaagugcgaaaccugugucuauaacaugauggggaagcgagagaagaaacugggcgaguucgguaaggcgaagggcagccgugcaaucugguacaugugguuaggagcccgguuccuggaguucgaagcgcucggguuccuuaacgaggaucacugguucucccgcgagaacagucucagcggugucgagggggaggggcugcacaaguugggguacauccuccgggacgugucuaagaaagagggcggugccauguacgccgacgauaccgcagguugggacacgcgcaucaccuuagaggaccugaagaacgaggagauggucacuaaucacauggagggcgagcacaaaaagcucgccgaagcgauuuuucggcucaccuaucaaaacaaggucguuaggguucaacggccaacgccccgugggaccgugauggauaucaucucucggcgcgaucagagggggagcggccagguggucaccuacgguuuaaacacguuuacgaacauggaggcccagcucauccgccagauggagggagagggugucuucaaaaguauccagcaccugacagccaccgaggagauagccgugaagaacuggcuggucaggguaggcagggagagacugucccggauggccaucagcggggaugacugcguagucaagccccucgacgaccgcuucgcgaacgcccuuacggcccucaaugacauggggaagguacggaaggauauucaacagugggagccgucccgcggcuggaacgacuggacccaggugcccuucugcagccaccacuuccacgaacugaucaugaaggacggccggguccuggugguacccugccgcaaccaggacgagcucaucggccgggcucggaucucccagggggcaggguggucccugcgggagaccgcgugccugggcaaguccuaugcccaaauguggagccucauguacuuccacaggcgggaucuucgccuagccgccaacgccauuugcuccgccguacccucacacugggugccgacauccagaaccaccuggagcauccacgcuacucacgaguggaugaccaccgaagacaugcugaccguauggaaucgcgucuggauccaggagaaccccuggauggaagacaagacacccguggagagcugggaggaaauacccuaccuggguaagcgggaggaccaauggugcgggagccugaucgggcucacaagccgcgccaccugggccaagaauauccagaccgcgaucaaccaggugcgcuccuuaaucggcaacgaggaguacacggacuacaugccgucaaugaagcgcuuucgccgugaggaggaggaggccgggguccugugguga

SEQ ID NO: 24853 - RNA, 9876 nt, Artificial Sequence
  derived and/or modified CDS sequence (opt11) from DENV-2__KX380816__SS-prME
accgcaggcaucauaaucaugaugauccccaccgugauggccuuucaucugaccacgcgcaacggggagccccauaugaucgucagccggcaggaaaagggcaaaucccuccuuuucaagaccgagaacggggugaauaugugcacccugauggcgauggaccucggcgaguuaugcgaagauaccaucaccuacaacugcccucugcuccgccagaaugaacccgaggacauugacuguuggugcaacuccaccuccaccugggugaccuacgggacuugcacagccacaggcgaacaccggcgagaaaaacgcagcgucgcccuggugccccacgugggcauggggcuggagacccgcaccgagaccuggauguccagcgagggcgccuggaaacacgcccagcggaucgagacauggauccuccgccacccaggguucaccaucauggcggccauucuagccuacaccaucggaacaaccuacuuccagcggguccugaucuucauucuuuuaacggccgugacuccuuccauggcgaugcgcugcaucggaaucagcaaccgggacuucguggagggcgucuccggcggcucuuggguugacauugugcuggagcacggcuccugugucaccacuauggccaagaauaagcccacguuggacuucgagcugaucaagaccgaggccaagcaccuggcaacgcuccggaaguacuguguggaagccaagcugacaaacaccacgaccgcgagccggugccccacccaaggggagccuucccugaacgaagagcaagacaagcgcuucguuugcaagcacucgauggucgaccgaggcuggggcaacgggugcggacucuucgggaagggagggaucgugacgugugccauguucacgugcaagaagaacauggagggcaaggugguacagccggagaaccuggaguacaccaucgugaucaccccucacuccggggaggaaaacgcgguagggaacgacacggguaagcacggcaaggagaucaaggucacgccccagucuucaaucaccgaggccgagcugaccggcuauggaaccgugacaauggagugcucaccgcgcaccggccucgacuucaaugagauggugcuguuacaaauggagaauaaggccuggcugguccaccggcagugguuccuggaccucccccuccccuggcugcccggcgcggauacccaaggguccaacuggauccagaaggagaccuuagugacguucaaaaacccgcacgcgaagaagcaggacgucguggugcucggcagucaggaaggggccaugcacaccgcccugaccggcgccaccgagauccagaugagcuccgggaaccuccuguucacgggccaucuaaagugcaggcugcggauggauaagcuccaguugaagggcaugagcuacuccaugugcacggggaaguucaagguagugaaggagaucgcggagacccagcacggcacuaucgugauccgaguccaguacgagggugacggaucacccugcaaaauccccuucgaaaucauggacuuagagaagcggcacgugcucggucgccugaucaccgugaaccccaucgucacggagaaagacagccccgugaacaucgaggccgagccaccauucggggacagcuacauuaucauuggaguggaaccgggucagcugaaacuaucuugguucaagaaaggcagcuccaucgggcagauguucgaaaccaccaugcgcggcgccaagcggauggcuauccugggggacacggcuugggacuucgggagccugggcggggucuuuacguccaucggcaaggcacuccaccagguguucggggccaucuacggcgccgccuucagcgguguguccuggaccaugaagauccugaucggggucgugaucacauggaucgggaugaacagccgcucgacgagcuugucagugagccugguccuggugggaguugucacccuuuaccugggcgugaugguucaggcggacuccgggugcguugugagcuggaagaauaaggaguugaagugcggcagcgggaucuucaucaccgacaacgugcacaccuggacggagcaguacaaguuccagccggagucucccucaaagcuggccagcgccauccagaaagcccacgaggaagguaucugcggcauccggagcgucacccgccuggagaaccugauguggaagcagaucacacccgagcugaaucauauauugacugagaaugaggugaagcucacgaucaugaccggggacaucaagggcaucaugcaggccgggaagagaacgcugcgaccccagccgacagagcuuaaguauuccuggaaagcguggggcaaggccaagaugcuaagcacugagcugcacaaccauaccuuccugaucgacggccccgagaccgccgagugcccuaacaccaaccgggcguggaauucccucgagguggaggacuauggcuucggcguuuucacgacuaacaucuggcugaagcugaaagagcgccaagacguguucugcgacagcaaacugauguccgccgcgaucaaagacaaucgggccgugcacgccgacaugggguacuggaucgaguccgcccugaacgacacguggaagaucgaaaaggcguccuucaucgaggucaagucuugccacuggccuaagucccauacccuguggagcaacggcguacuagaguccgagaugaucauccccaagaacuucgcgggccccgugagccaacacaacuaccggccaggauaccacacccagacggccggcccuuggcaccuggggcggcuggagauggauuucgacuucugcgaaggcacgacagucguggugaccgaagacuguggcaaccgcggucccucccuccggacgacaaccgccuccggcaaauugaucaccgagugguguugccgcaguuguacccugccgccccuccgguaccgcggggaagacggcugcugguacgggauggagauccggccgcugaaagagaaggaggagaaccuggucaacagucucgugacggccggccacgggcagauugacaauuucagucugggugugcugggcauggcccucuucuuagaggagaugcugcgcacccgggucggcaccaaacacgcaauccuccugguggcugugucuuuugucacgcugaucaccggcaacaugagcuuccgcgaccucgggcgcgugauggugauggucggcgccacgaugaccgacgauauugggaugggcgugacguaccuggcccugcucgcggccuucaaaauccggccaaccuucgccgccgggcugcuguuacgcaagcuuaccuccaaggagcugaugaugaccacgaucgggaucgugcugcugagccaguccaccauccccgagagcauccuggagcucaccgacgcucuggcgcugggaaugaugguccucaaaaucgugcggaacauggagaaguaccagcuggcggucaccauaauggccauccugugugugcccaacgccgugaucuuacagaaugcguggaaagucagcugcacgacccuggcaguggugagcgucuccccgcugcuccugaccuccucgcagcagaaggccgauuggaucccacuggcccucaccaucaagggucugaaccccacggccaucuuccugaccacccucagccgcaccuccaagaagcggagcuggccccugaacgaagcgaucauggccgugggaaugguauccauccuggccagcucccuccugaaaaaugauaucccgaugacgggcccccuggucgccgggggccuccugaccgugugcuaugugcucaccggccgcagcgccgaccuugagcuggagcgggcggccgacguacgcugggaagagcaggccgagaucagcggguccagccccauccuguccaucaccaucagcgaggacggguccaugagcaucaagaaugaggaggaggagcagacgcucaccauccugauccggaccggccuguuggugaucucaggccuguuccccgugucaaucccgaucaccgcggccgcuugguaccugugggaaguaaagaagcagcgcgccggggugcucugggacgugcccaguccuccgcccgucggcaaggcagagcuagaggauggggcguaucggaucaagcagaagggcauucuggguuacucccagaucggcgccggaguguacaaggaggggaccuuccacaccauguggcacguaacccgcggcgcgguacucaugcacaaggggaagcggaucgagcccuccugggccgacgugaagaaagaccugaucagcuacggcgggggcuggaaacuagaaggcgaguggaaggagggagaggaagugcagguccucgcccuugagcccggcaagaacccccgcgccgugcagaccaagcccgggcuguucaaaacgaacacgggcaccauuggggccgugucccucgacuuuagcccuggaacauccgguagccccaucgucgacaaaaaggguaagguggugggccuguacgggaacggcguuguaacccgcuccggcacguacgugagcgcgaucgcccaaaccgagaaguccaucgaggacaacccggagaucgaggacgacaucuuccgcaagaagaggcugaccaucauggaccugcaccccggagcuggaaagacuaaacgcuaucuccccgccaucguccgggaggcgaucaagcgcgggcugcggacgcugauccucgcccccacccgcgugguggcggccgagauggaggaagcccugcgcggccugccgauacgguaccagaccccagcgauccgcgcugagcacaccgggcgggagaucgucgaccucaugugccaugccacguucacuaugagacugcuuagccccauaagggugccaaacuacaaccucaucaucauggacgaggcccauuucaccgacccggccagcaucgcggcccgcggcuacaucuccaccagaguggagaugggcgaggccgccgggaucuuuaugaccgccaccccgcccggcucccgcgaccccuucccgcaguccaaugcgcccaucauggaugaggagaaggagaucccagagcggucauggaacuccgggcacgaaugggucacggacuucaaagggaaaaccguaugguucguccccagcaucaaggcggggaacgacaucgccgcaugucugcggaaaaacggcaagaaagucauccagcugucccggaagacguucgacucagaauacaucaaaacacguacgaacgauugggacuucguggugaccacggacaucuccgaaaugggcgcgaauuucaaggccgagagggugaucgacccgcgccggugcaugaaacccgugaucuugaccgacggggaggagagggugauccuggccggccccaugcccguuacccauucauccgccgcccagcggcgcgggagggucggccguaauccgaagaacgaaaacgaucaauauaucuacaugggggagcccuuggagaacgacgaggauugcgcgcacuggaaggaggccaagaugcuuuuggacaacaucaacacccccgagggcaucauccccaguauguucgagccagagcgcgagaagguggaugcuaucgacggcgaguaccgguuacgcggggaagcccguaagacguucguggaccucaugcgccggggcgaccugcccguguggcuggccuauagagucgcagccgaggggaucaacuacgccgaccggcgcuggugcuucgacggcgugaagaacaaccagauccucgaggagaacgucgaggucgagaucuggacuaaagagggggagcggaagaaguuaaagccccgcuggcuggacgcccggauauacuccgacccgcuggcccugaaggaguucaaggaguuugcggccgggagaaagagccuaacccucaaccugaucacggaaaugggccggcugccuacguucaugacccagaaggccaagaacgcccuagacaaccucgcggugcugcacacagccgaggccggaggucgcgcguacaaccacgcccucucagagcuacccgagacccuggagacgcuccuucugcuuacccugcuggcgaccgugaccggaggcaucuuccucuuccugaugucuggcaaggggaucggcaagaugacguuggggaugugcugcauaaucacggccuccauccugcuguggcacgcccagauccagccccacuggaucgcugcaagcaucauccuggaguucuuucucaucguccuguuaaucccugagcccgaaaagcagcggacgccccaggacaaccagcuaacguacguggugauagcgauccugaccgucguagcggccacgauggccaacgagaugggcuuccuggagaagaccaagaaggacuuugggcuagggaguaucaccacccagcaaccggagaguaacauccuagacaucgaccugcgccccgccagcgcguggacgcucuacgccguggccaccacguucaucaccccaaugcugcggcacagcaucgagaacaguucugucaacgugagccugaccgccaucgcgaaccaggcgaccgugcugaugggucuggggaagggcuggccccuguccaagauggacauaggagucccgcuccuagccaucggcugcuacagccaggugaacccgaucacccuaaccgccgcccuccugcugcucguggcgcauuacgcaaucaucgggcccggccugcaggcaaaggcuacgagggaagcccagaagcgggcggccgcuggcaucaugaagaaucccaccgucgacgggaugaccgugaucgaccuggacccuaucccguacgaucccaaguuugagaagcaguuaggccaggugaugcugcugguccucugugugacucaggugcugaugaugcgcacgacaugggcccugugcgaggcgcucacacuggcgaccggacccaucuccacacugugggagggcaaccccgggcgguucuggaacaccaccaucgccgucagcauggccaacaucuuccgcggcaguuaucucgcuggcgccgggcugcuguucagcauaaugaagaacaccgcgaacacgcgccggggcaccgggaacaccggcgagacccucggggagaaguggaagaacagacugaaugcccuggggaaguccgaguuccagaucuacaagaaguccggcauccaagagguggaccguacucucgccaaagaggggaucaagagaggggaaaccgaccaccacgccgugagccggggaucggcgaagcugcgcugguucgucgagcgcaaccuagugacuccggagggcaagguggucgaccuugggugugggcgcggcgguugguccuacuacugcggaggguugaagaacguuaaggaggugaagggccuuaccaagggcgggcccggccacgaggagcccauccccaugagcacuuaugguuggaaccucgucagacugcaguccgguguggacguguucuucaccaguccggagaagugcgacacucugcucugcgauaucggggaauccagccccaaccccaccgucgaggcaggacgcacccuucgggugcugaaccuuguggagaacuggcugaacaauaacacucaauucugcaucaagguccugaaccccuacaugccgagcgugauagagaagauggaggcccuccagcgcaaguacggcggggcccucgugcggaauccauuaagucguaacucgacacacgagauguacugggucucgaacgccagcggcaacaucgugucaagcgugaacaugaucucccggaugcugaucaaccgcuucaccaugcggcauaagaaggccaccuacgaacccgacgucgaucuugguagcggcacgcgcaacaucgggauugaguccgagacccccaaccuggacaucaucggcaagcggaucgagaagaucaagcaagagcacgagaccucauggcacuaugaccaggaccaccccuauaagacuugggccuaccauggcuccuacgagacgaagcaaacugggagcgccuccagcaugguaaauggcgugguccgccugcucaccaaacccugggacgugauacccauggugacucagauggccaugacggacaccacccccuucgggcagcagcgaguuuucaaggagaagguggacaccagaacccaggagccaaaggagggcaccaagaaacugaugaagaucaccgccgagugguuauggaaagaguugggcaagaagaaaacacccagaauguguacgagagaggaguucacccgcaaagucaggucgaacgcggcccugggugcaauauucacggacgagaacaaguggaaguccgcccgcgaggccguggaagacaguggauucugggagcucguggauaaggagcggaaccuccaccuggaggggaagugcgagaccugcgucuauaacaugaugggcaagagggagaagaagcugggggaguucgggaaggcgaaagguagccgggccaucugguacauguggcucggugcucgauuccuggaguucgaggcccugggcuuucucaacgaggaccacugguucucccgcgagaacucacugagcgggguggagggagagggccugcacaagcucggcuauauccugcgcgacgugagcaagaaggaggggggggcgauguacgccgacgacacugccgggugggacacgcguaucacccuggaggaccugaagaacgaggagauggucaccaaccauauggagggggagcacaagaagcuggccgaggccaucuucaagcugacguaccaaaacaagguggugcggguccagagacccaccccgcgcggcaccgugauggacauuaucagcagacgcgaccagcggggguccggccaaguggucaccuacggucucaacaccuucacuaacauggaggcgcagcugauccgccagauggagggcgagggaguuuucaagagcauacagcagcuuaccgucaaagaagagaucgcaguuaagaacuggcuuauccgcguggggcgcgaacgccuguccaggauggccauaagcggcgacgacugcguggucaaaccucuggacgaccgcuucgccagugcccucaccgcccugaacgacaugggcaaggugcggaaggacauccagcagugggagcccagcaggggguggaacgacuggacucaggugccguucugcucccaccacuuccacgagcugaucaugaaagacggccggguccucguggugccgugccgcaaccaggacgaacugaucgguagggcaaggaucucacagggcgcaggguggucgcugcgagagaccgccugccucggcaaaucuuaugcgcaaauguggucgcugauguacuuucaucgccgggaccugagacucgcggccaacgcgaucugcucggccgucccaucccacuggauacccaccagccgcaccacuuggucaauccacgccacccacgaauggaugaccaccgaggacaugcugaccguguggaaucguguguggauacaggagaaucccuggauggaggacaaaacgccgguugaaaguugggaggagauccccuaccugggcaagcgggaggaucaguggugcgggucccuaauagggcuaacaucccgagcgaccugggccaagaacauacagaccgcgaucaaucaggugaggagccugauagggaacgaagaauacacggacuacaugcccuccaugaagcgcuucaggagagaggaggaggaggcgggcgugcuaugguga

SEQ ID NO: 24854 - RNA, 9876 nt, Artificial Sequence
  derived and/or modified CDS sequence (opt11) from DENV-2__KX380817__SS-prME
acggcgggaauaauuaucaugaugauccccacugugauggccuuccaccugaccacacgaaacggugagccccacaugaucgucagucggcaggagaagggcaaaagccuccucuucaagaccgagaacggggugaauauguguacacugauggcaauggacuuaggcgaguuaugcgaagacaccauuaccuacaacugcccccugcuccgccagaaugagcccgaggacaucgacugcuggugcaacagcaccaguaccugggugaccuaugggaccuguaccgccaccggcgagcacagacgcgagaagcggagcguggcccugguuccccacgucggcaugggguuagagaccaggacggagaccuggauguccagcgagggggccuggaagcacgcccagcggaucgagacguggaucuugcgccacccgggguuuacgaucauggcggccauccuggccuacaccaucggcaccaccuacuuucagcggguccugaucuucauccuccugacggccgugacccccuccauggcgaugcgcuguaucgggaucuccaaccgggauuucguggaggggguauccggcgggucauggguggacaucgugcuggaacacggcaguuguguaaccaccauggccaagaacaagcccacucucgacuucgagcuuaucaagaccgaggcuaagcaccuggcuacacuacgcaaguacuguguggaggccaagcucaccaacacgaccacugcuagccggugcccgacccagggggagcccagucugaacgaggagcaggacaagcgcuucgugugcaagcacagcauggucgaccguggcugggggaacgggugcggccucuucggaaagggcgggaucgugacgugcgcgauguuuacauguaaaaaaaauauggagggcaaggugguccagcccgagaaccuggaguacaccaucguaaucacgccgcacaguggugaagagaacgccgucgggaacgacacuggcaagcacgggaaggagaucaagauuacuccccagagcaguaucaccgaggccgagcugaccggauaugggacuguaacuauggagugcucgccgcgcaccggccucgacuucaaugaaauggugcugcugcaaauggagaacaaggccuggcucgugcaucggcagugguucuuagaccugccccuccccuggcuaccaggcgcggacacacagggguccaacuggauccaaaaggagacccuggucacuuucaagaacccgcacgcuaaaaagcaagacguugucguccuuggcagccaagagggggccaugcacacggcccugacuggcgccaccgagauccaaaugagcucugggaaucuccuguucacgggccaccugaagugccgccugcggauggacaagcuccaacugaaaggcaugagcuacucuauguguaccgguaaguucaagguggucaaggaaaucgcggagacccaacacggcaccaucgugauccgcgugcaauacgagggagacggcucuccuuguaaaauccccuucgagaucauggaucuggagaagaggcacguacucggccgccugauaacuguaaauccgaucgugaccgagaaagacuccccggucaauaucgaggcggagccgcccuuuggggacucauacaucauuaucggaguagagcccgggcagcugaagcucucaugguucaagaagggcagcuccauugggcagauguucgagaccacuaugagaggcgcaaagaggauggccauccugggagacacggccugggacuucggcagcuugggcgggguguucaccuccaucgguaaggcgcuccaccaggucuucggggccaucuacggcgccgccuucagcggcguguccuggacgaugaagauccucaucgggguggugaucaccuggaucgggaugaauagccgguccacgagccugucgguaucucuggugcucgucggcguagucaccuuauaccugggcgucauggugcaggcggacuccgggugcgugguuagcuggaagaacaaggagcucaaguguggcuccggcauuuucaucacagacaaugugcacacguggacggagcaguauaaguuccaaccggaauccccaagcaaguuagcuucagccauccagaaggcccacgaggagggaaucugcggcauuaggagcgugacccgccuagagaaccugauguggaaacagaucacccccgagcugaaccacauccucaccgagaacgagguuaagcucacgaucaugacuggggacaucaagggcaucaugcaggccgguaagcggucccugcgcccccaaccgaccgaguugaaauauagcuggaaggcuuggggcaaggccaagaugcucuccacggagcuacacaaccacacguuccugaucgacggccccgagaccgccgaaugccccaacaccaaccgugcauggaacagccucgaggucgaggacuauggcuucggcguguucaccacgaacaucuggcugaagcugaaggagcgccaggacgucuucugugacaguaagcucaugagcgcagcaaucaaggacaaccgggccguacaugccgauaugggauacuggauagaguccgcccugaacgacaccuggaagaucgagaaggccagcuucaucgaggugaaguccugccauuggcccaaaagccacacccuguggucuaacggaguacucgagagcgagaugaucaucccuaagaacuucgccggcccagugucccagcacaauuaccgccccggguaucauacccagaccgccggcccguggcaccuggggcggcuggagauggacuuugacuuuugcgagggcacgacuguggucgugacggaagacugcgggaaccgcggccccagccuccggaccacgacagcguccggcaagcuuaucaccgaguggugcugcaggaguuguacccugccgcccuuacgguacaggggggaggauggcugcugguaugggauggagauccguccccuaaaggagaaggaagaaaaccuagugaauagccucgucacggccggccacgggcagaucgacaacuucagccugggugugcugggaauggcccucuucuuggaggaaaugcugcgcaccagaguggggaccaaacacgccauccuccuggucgcaguguccuucgugacccuuauaacuggcaacaugucauuccgcgaccucgggcgggugaugguaauggucggugcgaccaugacggacgauaucggcaugggcgucaccuaccuggcccugcucgcggccuucaaggugaggccuacuuucgccgccggacugcugcuccgaaaguugaccagcaaggaacugaugaugaccaccauagggauagugcuccugucucagaguacgauccccgagagcauccuggaguugaccgacgcccuagccuuggggaugaugguccucaaaaucgugcgaaauauggagaaguaccaguuggccgucaccaucauggcaaucagcuguguccccaacgccgugauccuacagaacgccuggaaggucaguugcacgacgcuagccguugugagcguguccccgcugcugcucaccucuucccagcagaaggcagauuggaucccccuggcccugaccaucaaagggcucaacccgaccgccaucuucuuaacgacacugagccgcaccuccaagaaacggagcuggcccuugaacgaggcgaucauggccguaggcauggucuccauccuggccagcagccuccuuaagaacgauauaccgaugaccggcccccugguggccgggggccugcucacagugugcuacguguuaaccgggcgauccgcugaccuggaacucgagcgggcagccgacguccgcugggaggagcaggccgagaucagcgguuccucccccauccuaaguaucaccaucucugaggacggguccauguccauaaagaaugaggaagaagagcagacgcugacaauuuugauccgcaccggccugcuggucaucuccgggcuuuuccccgugagcauaccgaucaccgccgccgcgugguaccugugggaagucaagaaacagcgcgcagggguacugugggacgugcccucuccgccgccggugggcaaggccgagcucgaggacggggccuaccggaucaagcagaagggcauccugggguacagccagaucggcgccggcguguacaaggagggcacuuuccauaccauguggcacgugacgcgcggugcgguccugaugcacaaggggaagcggaucgagccuuccugggccgacguuaagaaggaccucaucagcuacggcgggggcuggaagcuggagggugaguggaaggagggggaggagguccagguccuggccuuagagccuggcaagaacccgcgcgccguacagacaaagccugggcuguucaaaaccaauaccggcacgauuggcgccgugucccucgauuucagccccggcaccuccggcagccccauagucgacaaaaaggggaagguggugggccucuacgggaacggagucgugacgagauccggcacguacgugagcgcgaucgcccagacagagaaguccaucgaggacaauccggagauagaggacgauaucuucaggaagaaacgguugaccauaauggaccugcaucccggggcuggcaaaaccaagcgcuaccugccagccauaguucgggaggcgauaaagcgcggacuccggacccuuaucuuggccccaacgcgcgugguggccgcagagauggaggaggcccucagaggcuuaccgauccgguaccagacaccugcgauccgcgccgagcacaccggucgggagaucgucgaccugaugugccacgcgaccuucacgaugagauuguugucgcccauccgggugcccaacuacaaucugaucaucauggacgaagcucacuucaccgacccggccagcauagcggcccgcggcuacaucucuacgcggguggaaaugggagaggccgccggcaucuucaugaccgccacgccgcccggaucuagagaccccuuuccccaguccaacgcgcccaucauggacgaggagcgggagauacccgaacgcagcuggaacuccgggcacgagugggugaccgacuucaaagggaagaccgugugguuugugcccagcaucaaagccgguaacgacauugccgccugccuucggaaaaacggaaagaaggucauccagcugucccggaagaccuucgacagcgaauacaucaagacacggaccaacgacugggacuuugugguuacuacagauauaagugagaugggugcgaauuucaaagccgagcgcgucaucgacccgcggcgaugcaugaaacccgugauuuuaacggacggugaggagcgggugauccucgccggcccgaugcccgugacccacagcucagcugcccaacgccggggccgcguggggcgcaacccgaagaacgaaaacgaccaguacaucuacaugggggagccccuggagaacgacgaggacugugcucauuggaaggaggccaaaaugcugcucgacaacaucaacaccccugaggguauuauucccagcauguucgaacccgagcgggagaagguagacgccaucgacggcgaguaccgucuucggggagaggcccgcaagaccuucgucgacuuaaugagacgcggugaucuccccguguggcuggccuaccgggucgcggcagaggggaucaacuaugccgacagacgguggugcuucgacgggguuaaaaacaaucaaauccuggaagaaaacguggaggucgagaucuggacgaaggagggugagcgcaagaagcucaagccucgguggcucgaugcccgcaucuacuccgauccgcuagcccucaaggaguucaaggaguucgcggcaggcagaaagucccugacucugaaccucauuaccgagaugggccgccuucccaccuuuaugacgcagaaggcgaagaaugcgcuggacaaccucgcgguacugcacaccgccgaagccggcggccgagcuuacaaccaugcccugucugagcugcccgaaacccuggagacgcugcucuugcuuacacuacuggcuaccguuaccggaggcauuuucuuauuccucaugagcggcaaggggauuggcaagaugacucugggaauguguugcaucauuaccgccucuauccuguugugguaugcccaaauucagccccacuggaucgccgccagcaucaucuuggaguuuuuccuaaucguccucuugaucccggagcccgagaagcagcgcacgccccaggacaaccagcugaccuacguggugaucgcaauccucaccgucguggccgccaccauggccaacgagauggguuucuuggagaaaacgaagaaggauuucggacugggcagcaucacuacccagcagccggaguccaauauccucgauaucgaccugcggccggccagcgcguggacucuguaugcaguggccacgacauucauaacccccaugcuucggcacucuauugagaacagcuccgucaacgugagccugaccgccauugccaaccaagcgacgguguugaugggccucgggaagggcuggccccugucuaagauggacaucggcgucccccugcucgccaucggcuguuacagccaggugaaccccaucacucugacggccgcccuacuccuguuagucgcccacuacgccauaaucgggccuggguugcaggccaaggcaacccgggaagcccaaaagcgcgcggcggccggcauuaugaagaaccccacggucgacgggaugaccgugaucgacuuggacccuaucccguacgacccaaaguucgaaaagcaguuaggccaaguaaugcuccucguccuaugcgugacccaggugcuuaugaugcggaccacuugggcccugugugaagcacuaacccucgcuacggggcccauauccacccucugggaggggaacccagggcgguucuggaacacgacuauugcgguuagcauggccaacaucuuucgcggaucauaccuggcuggcgccgguuuacuguucucgauaaugaagaacacagcaaacaccagacgcggcacggggaacaccggcgagacgcugggugagaaguggaaaaaccggcucaacgcccuggggaagucagaauuccaaaucuacaaaaaauccggcauccaagagguugaucgcacccuggcgaaggaggggaucaagcggggcgaaacugaucaccaugccguguccagaggcagcgccaaacuccguugguucgucgagcgcaaccuggugaccccggaggggaagguggucgaccuggggugcgggcggggaggguggucuuauuacugcggcgggcucaagaacguaaaggaagugaaagggcugaccaagggcgguccgggccacgaggagcccaucccgaugagcaccuacggcuggaaccugguccgccugcaaucuggcguggacguguucuucacgccucccgaaaagugugacacccugcugugugacaucggggaaagcucgcccaaccccacggucgaggcgggccggacccugcgcgugcuaaaccugguugagaacugguugaacaauaacacgcaguucuguauaaaaguucugaauccguacaugcccucagugaucgagaagauggaggcccugcaaagaaaguauggcggcgcccuggugcgcaauccucucagccggaacucgacucaugaaauguauugggucucgaacgccuccggcaacauagugagcucggugaacaugaucagccgcaugcugauaaaccgguucacuaugcgccacaagaaggcgaccuacgagccggacgucgaccuggggucuggcacgcggaacaucgggaucgagagcgagacgcccaaccucgacaucauugggaagcgcaucgagaagaucaaacaggaacacgaaaccuccuggcacuaugaccaggaccauccuuacaagaccugggccuaccacgguagcuacgagaccaagcaaacggggucugcuagcuccauggugaacggcgugguccgccugcugaccaagccaugggacgucaucccgauggugacccagauggcgaugacugacacgacccccuuugggcagcagcggguguucaaggagaagguggacacccgcacccaagagcccaaggagggcaccaagaagcuaaugaaaauuaccgccgaguggcuguggaaggagcugggcaagaagaagacgcccagaaugugcacgcgcgaggaauuuacgcggaagguccgcagcaacgcggcguugggggccaucuucaccgacgaaaacaaauggaaguccgcccgggaggcgguggaggacagcggcuucugggaguugguggaucgcgagcggaaccuacaccucgaggggaagugcgagacaugcgucuauaacaugauggggaagcgcgagaagaagcugggggaauucgggaaggcgaagggcucccgggcuaucugguauauguggcuaggggcccgcuuuuuagaguucgaggcacugggcuuccugaacgaggaccacugguuuucaagagagaacagccucucagggguggagggcgagggccugcacaagcugggcuacauucuccgcgaugucagcaaaaaggagggaggggcgauguacgcugacgacaccgccggcugggacacaagaaucacacuggaggaccugaagaacgaggagauggucaccaaccacauggagggggagcacaagaagcucgccgaggccauuuucaaguugaccuaucagaacaagguggugaggguccaacgaccuacgccccgcggcaccgugauggacaucauaucccggcgcgaccagcgggggagcggccagguagucaccuacggccucaacaccuucacuaacauggaggcacagcucaucagacagauggaaggggaggguguguucaagucgauucagcagcugaccgugaaggaggagaucgcgguaaagaauuggcugaucagagugggucgggagcgcuugagccggauggccauauccggggacgauugcguuguuaagccccuggaugacagguucgccagcgcccuuaccgcguugaaugacaugggaaaggugcguaaggacauccagcaaugggaacccagccgcggguggaacgacuggacccaagugccguucuguagccaucauuuccaugagcugaucaugaaggacggccguguccucgucgugcccugccgcaaccaggacgagcucaucggccgggcgcggaucucccagggcgccggguggagccucagagagaccgccugccugggaaagagcuacgcccagauguggagccuaauguacuuccaccgccgcgaccugcgccuggcggccaacgccaucugcuccgccguccccagccauuggauccccaccucccggacgacauggagcauccaugccacccacgaguggaugacgaccgaagacaugcucacaguguggaaccgcgucuggauccaagagaacccguggauggaggacaaaacccccgucgagaguugggaggagauccccuaccugggcaagcgggaggaccaguggugcgggucccuaaucggccucacgagccgcgcaaccugggcaaagaacauccagacggccaucaaccaagugcgcucccugaucgggaacgaggaguacaccgacuacaugcccagcaugaagcgguuccggcgggaggaggaagaggccggggugcugugguaa

SEQ ID NO: 24855 - RNA, 9876 nt, Artificial Sequence
  derived and/or modified CDS sequence (opt11) from DENV-2__KX380818__SS-prME
accgccgggaucaucauaaugaugauccccacugugauggccuuccaccugaccacccggaauggggagccccacaugauagugagccgucaggagaaggguaagagccuccuguucaagacggagaacggugugaacaugugcacccucauggcgauggaccuaggcgagcugugcgaggacaccaucaccuauaacugcccacugcuccggcagaaugagcccgaggacaucgacugcuggugcaacagcaccucuaccugggugaccuacggcaccugcacggccaccggcgagcaccggagggagaagcggagcgucgcccuagugccccacgugggaauggggcuggagacccgcacugagaccuggaugagcagcgaaggcgccuggaagcacgcccaaagaaucgaaacguggguccuccgccauccuggguuuaccaucauggcggccauacuggcauacaccauaggaaccaccuacuuccagcggguguugaucuucauccuacugacagccguggcgcccuccaugaccaugcgcugcauugggaucagcaaucgggauuucgucgaggguguguccggcgggagcuggguggauaucguccuggaacacggcuccuguguaaccaccauggcgaagaacaagcccacgcucgacuucgagcugaucaaaaccgaggccaaacaccccgccacccugcgcaaguacuguaucgaggccaaacucaccaauacgaccaccgcgagccggugcccaacccagggggagcccuccuuaaacgaggagcaggacaagcgcuucguguguaagcacagcauggucgaucgcggcuggggcaacgggugcgggcuguucgggaagggcgggauagugaccugcgccauguucacgugcaagaagaacauggaaggcaagauugugcaacccgagaacuuggaauauaccaucgucaucaccccgcacuccggagaggaaaacgccguggggaacgacacgggcaagcacgggaaggagaucaagguaacgccgcagagcucuauaacugaggccgagcugacgggguacgggaccgucacgauggagugcuccccccgcaccggccuggauuucaacgagaugguacuacugcaaauggagaauaaggccuggcuggugcaccggcagugguuccuagaccucccccugcccuggcucccgggcgcggacacccaaggaucaaacuggauucagaaggagacccuggucacguucaagaacccccacgcuaagaagcaggacguggucguacugggcagccaggaaggggccaugcacaccgcccuuaccggcgccaccgagauccagaugagcucggggaaccuccuguucacgggccaccuuaagugccgcuugcggauggacaagcugcagcucaaaggcaugaguuacucgaugugcaccggcaaguucaaaguggucaaggagaucgccgagacccagcacggcaccaucgugauccgcgugcaguacgagggggacggcagccccugcaagauccccuucgagaucauggaucuggagaagcggcacguccugggucggcugaucacggugaacccgaucgugacggaaaaggacucccccgucaacaucgaggccgagccgccuuucggagacagcuacaucaucaucggcguggagccggggcagcuaaagcugucuugguucaagaagggaaguuccaucgggcagauguucgagaccaccaugcgcggugccaagcggauggccauccucggcgacacggccugggacuucgggagccugggcggaguguucaccucgaucggcaaagcgcugcaccaggucuucggggccaucuacggcgccgccuucagcggcguguccuggaccaugaagauccucaucggggucguaaucacguggaucggcaugaacagccgcuccacgucucuguccgugagccuggugcuggugggggucgugacccucuaucugggcguaauggugcaagcggacuccggaugcguggucagcuggaaaaauaaggagcugaaaugcggcucaggcaucuucauaaccgacaacgugcauaccuggacggagcaguacaaauuccagcccgagucccccucuaagcucgccucggccauucagaaagcccacgaggaagggaucugcggcauccggagcgugacccgacuggagaaccugauguggaagcagaucacccccgagcucaaccacauccugaccgagaacgaggugaagcugacgaucaugacgggggacaucaagggcaucaugcaggccgggaagcggucccuccgcccccagcccaccgagcugaaguacagcuggaaggcguggggcaaggccaaaaugcuguccacugagcuccacaaccacacguuccugaucgacggccccgagaccgccgaaugccccaauacuaaccgggcguggaacagccuggaaguggaagacuacggguucggaguguuuaccacgaacaucuggcucaagcugaaggagcgccaggacguguccugcgacagcaagcugauguccgccgcgauuaaggacaaccgggccgugcacgcugauaugggguacuggaucgagagcgcgcucaacgacaccuggaaaaucgagaaggccuccuucaucgagguuaaauccugccacuggcccaagucccacacccuguggagcaacggcguguuggaguccgagaugauuauucccaagaacuucgccggccccgugagccagcauaacuacaggcccggcuaucacacccagaccgcuggccccuggcaccucggccggcuggagauggacuucgacuucugcgagggcacgaccguggucgugaccgaggacugcggcaaccgaggccccagccugcggacaacuacggccuccggcaagcucaucaccgagugguguugccgcagcuguacccugccaccguugcgguaccgcggggaggacggcugcugguaugggauggagauccggccccucaaggagaaggaggagaaccuggugaacucccuggucacggccggccauggucagaucgacaacuucagccucggcguucugggcauggcgcucuuucucgaggagaugcuacggaccagaguggggaccaaacacgccauccugcucgucgcgguuuccuuugugacgcugaucaccggcaauaugagcuuccgcgaccugggccgcgucauggugauggugggagcgacuaugacagaugacaucgggaugggggucaccuaccucgcccugcuggcggccuuuaaggugcggcccaccuucgcagccggucuccugcugcgcaagcucaccuccaaggagcuaaugaugaccaccaucgggaucguguugcucagccaguccaccauucccgaaaccauuuuggaauuaaccgaugcccucgcguuagguaugaugguccugaagaucgugcggaacauggaaaaguaccagcucgccguaaccauaauggcuauccugugugugccgaacgcggugauccugcagaaugcauggaaagucuccugcaccacccucgcggugguguccgucagcccccugcuucucaccuccagccagcagaagaccgauuggaucccccuggcccugacgaucaaggggcucaaccccaccgccaucuuccugaccacccugagccgcacgagcaaaaagcggucguggccgcucaacgaggccaucauggcgguuggcauggugagcauacuggccuccagcuucuugaagaacgacauccccaugaccgggccgcucgucgccgggggccugcugaccguuuguuacgugcucaccgggcgcagcgccgaccuggaguuagaaagagccgcagacauccgaugggaagagcaggccgagaucagcggcagcucccccauacuuagcaucacaaucuccgaagacgguagcauguccaucaagaacgaggaggaggaacagacccugacaauccugauccggacgggccuccuggugauuagcggcuuauucccgguguccaucccgaucacugccgccgccugguaccucugggaggucaagaagcaacgcgcgggggucuuaugggacguccccagcccgccgcccgugggcaaggccgaauuagaggacggugccuaccgaaucaagcagaagggcauccucggauacagccagaucggcgccggggucuacaaagaggggacguuccacaccauguggcacgugacccgcggagccgugcucaugcauaaggguaagcggaucgagcccagcugggcggacgucaagaaggaccugaucuccuacgggggcggcuggaagcucgagggcgaguggaaggagggggaggagguccaggugcucgcccuagagcccgggaagaaccccagagccguccagacgaagcccggccuguucaagacgaacacaggaaccaucggggcagugagccuggacuuuuccccuggcaccucaggguccccaaucguggacaagaaagggaaagucgugggccuguacgggaacggcguugucacgcggagcggaaccuaugugucggccauugcgcagacugagaagaacaucgaggacaauccggaaaucgaggacgauaucuuccgcaagaagcggcucaccaucauggaccugcaccccggggccggcaagacgaagcgcuaccugccggccaucgugagagaggccaucaagcgcgggcugaggacccucauccuggcgccgacccgcgucguggcagccgagauggaagaggcacugcgcggccuacccauccguuaccagacccccgcgauccgcgcugaacacaccgggcgggaaaucgucgaccugaugugucaugccacauucaccaugcgucugcuaucccccauccggguuccgaacuauaaccugaucaucauggaugaagcgcauuucaccgacccugccagcauugccgcucgcggcuacaucuccacgcgggucgagaugggcgaggcugccgggaucuuuaugaccgccacgccacccggcagccgcgacccguuuccgcaguccaacgcccccaucauggaugaggaacgggagauccccgaacgcagcuggaacuccggucacgagugggugaccgacuucaagggcaagacuguaugguucgugcccagcaucaaggcggggaacgacauugcugcaugccugcggaagaauggcaagaaggugauccagcucucccgcaagaccuucgacagcgaguacgucaaaacccgcaccaacgacugggacuucgucgugacgaccgacaucuccgagaugggcgccaacuucaaggcggagcgcgucaucgacccacggaggugcaugaagcccgucauccugacagacggggaggagcgggugaucuuggccggccccaugccggucacccacagcuccgccgcccagcggagaggacgagucggcagaaacccaaaaaaugagaacgaccaguauaucuacaugggagagccccucgagaacgacgaggauugcgcacauuggaaggaagcgaagaugcugcuggacaacauuaacacgcccgaaggcaucaucccgagcauguucgagccagagcgggagaagguggacgccaucgacggcgaguaccgacuccguggggaggcccgcaagacauucgucgaccugaugcggcgcggcgaccugcccguguggcucgccuaccgggucgccgcggaagggaucaauuacgccgaucgacgcuggugcuucgacggugugaagaacaaccagauccuggaggagaacguggagguugagaucuggacuaaggagggggagcgcaaaaaacugaagccgcgguggcucgacgcucgcaucuacagugacccccuggcccugaaggaguucaaagaguuugccgcggggcgcaagagcuuaacccugaaccucauaacggagauggggcgccuucccaccuucaugacccagaaggcccggaacgcccuggacaauuuggcggugcuccauacagcggaggccggggggcgcgccuacaaccacgcccugagugaguugcccgagacgcucgagacccugcuguugcugacacugcucgcuaccgugaccgggggcaucuuccucuuccugaugagcggcaagggcaucggcaaaaugacgcucgguaugugcugcauaguuaccgcguccauucugcugugguacgcccagauccaaccgcacuggaucgcugccagcaucauacucgaauuuuuccugaucgugcugcucauccccgagcccgagaagcagcggacgccgcaagacaaccagcugacauacguggucaucgccauccugacggugguggcggccaccauggccaacgagaugggcuuccucgagaaaacgaaaaaggacuuugggcugggcuccaucaccacgcagcagccggagagcaacauccucgacaucgaccuccgcccugccagcgccuggaccuuauacgcggucgccaccaccuucaucacucccaugcuucggcacuccaucgagaacagcuccgugaacgugagccugacggccaucgccaaccaggccacaguccugaugggcuuggguaagggauggccccuauccaagauggacaucggggugccgcuguuagcgaucggcuguuacagccaggugaaccccauaacgcugacggccgcccugcugcuccucguggcccacuacgcgaucauugggccgggccugcaggcgaaggcuacccgggaggcccagaagcgggccgcggccggaaucaugaagauucccgccgccgauauugggcgcgugaucgaccucgacccgaucccuuacgaccccaaguucgagaagcagcuaggccaggugaugcugcucguccugugugugacccaggugcugaugaugcgcaccacgugggcacucugugaggcgcucacccuggccaccggaccaauuuccacucucugggagggcaacccggggcgguuuuggaacaccaccauugccguuagcauggccaacaucuuccgcggcuccuaucuggccggugcugggcuccucuucagcaucaugaagaacacggccaacacccgcaggggcacggggaacaccggcgagacccugggcgagaaguggaagaaccagcugaacgcccucgggaaguccgaguuucaaaucuacaagaagaguggaauccaggagguggaccggaccuuggccaaagaaggcaucaagcgcggcgagacggaccaucacgcggugucccggggaagcgcaaagcugagaugguucgucgagcggaaccucgucacccccgagggcaagguggucgaccugggcugcgggcgcggcggguggucauacuacuguggcggccugaagaauguaaaggaggugaagggcuuaaccaagggcggucccggccacgaagagcccauccccaugagcaccuacggguggaaccugguccggcuucaauccggcguggacguguucuuuacgccgcccgagaaaugugacaccuugcugugcgacauaggggaaagcuccccaaacccgacgguggaggcuggacgcacucugcgggugcucaaccugguggagaacuggcugaacaauaacacucaguucugcauuaagguccuuaaccccuauaugcccagcgugaucgaaaagauggaagcccugcaacgcaaguauggcggggccuuggugcggaacccgcucucacgcaauuccacgcaugagauguauuggguuagcaacgccagcgggaacaucgugagcuccgugaauaugaucagccggaugcucaucaaccgguuuaccaugcggcacaagaaggccaccuacgagcccgaugucgaccuggggagcggcacccgcaacaucggcaucgagagcgaggugcccaaccuagacaucauuggcaagcgcaucgagaaaaucaaacaagagcaugagacgaguuggcauuaugaccaagaccaccccuauaagaccugggcuuaccacggcaguuacgagacaaagcagaccgggucggccuccuccauggugaacggcgucgugaggcuccucacgaagccgugggacguuauccccauggucacccagauggcuaugaccgacaccacgcccuucgggcagcagcgcguguucaaggagaaggucgacacccggacccaggagcccaaagagggcaccaagaagcugaugaagaucacggcggaguggcucuggaaagagcugggcaagaagaagaccccucgcaugugcacccgggaggaauucaccagaaaggugcggagcaacgccgcccugggggccauuuuuacugacgaaaauaaguggaaauccgcccgcgaggcggucgaggacagcggcuucugggaacucgucgacaaggagaggaaccugcaccuggagggaaagugcgagacaugcguguauaacaugaugggcaaaagggagaagaagcucggggaguucggcaaagcaaaggguucccgggcuaucugguauauguggcugggggcccgcuuccuggaguucgaagcgcucggcuuccugaacgaggaccacugguucagccgagagaacucccugagcgggguggaaggagaggggcuccacaagcugggcuacauacuccgcgacgucagcaagaaggagggcggcgccauguacgccgacgacaccgcgggcugggacacuaggaucacgcuugaggacuugaagaacgaggagauggugacgaaccacauggagggggagcacaaaaagcuggccgaggcgauuuuccgccucacuuaccagaacaaggucguccgggugcagcgccccacgccccggggaacggugauggauauuaucucccgccgggaccagcgcggcagcggccagguugugacguacggccugaauaccuucaccaacauggaggcccagcugauccgacagauggagggagagggcguguucaaguccauccagcauuuaacggccacugaggagaucgccgucaagaacuggcuggugcgggucggccgcgagcggcugagccgcauggccaucuccggcgacgacugcguagugaagccucucgacgaccgguucgcgaaugcccugacagcccugaacgacaugggcaaggugaggaaagacauccagcaaugggagccgagccggggguggaacgacuggacucagguacccuucugcagccaccacuuccaugagcucaucaugaaggauggucgcgugcucgugguccccugccggaaccaggacgagcugaucgggcgcgcccgaaucagccagggcgccggguggucccuccgcgagacggcgugccugggcaagucauacgcccagauguggucccuuauguauuuccaccgccgcgaccuccggcuggcugccaacgccauuugcagcgcggugccgucccacugggugccgacaagccgcaccaccuggucaauccacgcaacccacgaguggaugacgaccgaggauaugcugacggucuggaaccggguguggauccaggagaacccuuggauggaggacaagacccccguggagagcugggaggagauccccuacuuaggcaagcgcgaggaccaauggugcgggucccugaucggccugacgagcagggccacuugggcuaaaaacauccaaacugcaaucaaccagguccgcagccuuaucgggaaugaggaguacacggacuauaugccguccaugaagcgcuuccggcgcgaggaggaagaggccggcguucugugguga

SEQ ID NO: 24856 - RNA, 9876 nt, Artificial Sequence
  derived and/or modified CDS sequence (opt11) from DENV-2__KX380819__SS-prME
accgccgggaucaucauaaugaugauuccaaccgugauggccuuccaccugacgacccguaauggcgaaccccacaugaucgucagucgucaggagaagggcaagagcuuacuguucaagaccgagaacggggugaauaugugcacccugauggccauggaccucggugaguugugcgaggauaccaucaccuacaacuguccucugcugaggcagaacgaacccgaagauaucgacugcuggugcaacagcaccaguacaugggucaccuacgggacgugcaccgccaccggcgagcaucgucgugaaaagagaagugucgcauuagucccccacguugggauggggcuggaaacacggacggagacguggauguccagcgaaggugccuggaaacacgcucagcgcaucgaaaccuggguucuacgccacccaggguucaccgugauggcggcgauacuggccuacacgauaggcacuacguacuuccagcguguucugauauuuauccucuuaaccgcugucgcgcccuccaugaccaugcgaugcaucgggaucagcaaccgggacuucguggaggguaucuccggcggcucuugggucgacaucguccuggagcacggcucgugcgucaccaccauggccaaaaauaaacccacgcuagacuucgagcugaucaagacggaggccaaacacccagcgacgcugcgcaaauacuguaucgaggcuaagcuaacuaauacuaccaccgcgucccggugcccgacccaaggagagccaucccugaaugaggagcaagacaagcgcuucguuugcaagcacagcaugguggaccggggcuggggcaacgggugcggccuauucgggaagggcgggaucguuacgugugccauguucacguguaagaagaauauggaggggaaaauuguucagccagaaaaccucgaguacacaauagucauaacaccccacuccggagaggagaacgccguggggaaugacacgggaaagcacgguaaggagauaaaaguaaccccgcagucgaguauuaccgaggcggagcuuaccggguacgggaccgcaacgauggagugcucucccaggaccgggcuagacuucaacgagauggugcuccugcagauggagaacaaggcguggcuggugcaucggcaaugguuccucgaccuuccauuacccuggcucccaggggcagacacucagggguccaacuggauacagaaagagacgcucguaacauucaagaacccccacgccaagaaacaggaugucgucguuuuaggaucacaggagggggccaugcacaccgcccucacuggcgcgaccgagauccagaugaguuccggaaaucugcuguuuacaggucaccucaagugccgacuaaggauggacaaguuacagcuaaagggcaugagcuacuccaugugcacagggaaguucaaaguaguuaaggagauagcugagacucagcacggcacgaucguaauccgggugcaauacgagggggacggcucuccauguaagauccccuucgagaucauggaccucgagaagaggcacgugcuuggcaggcucaucacaguuaauccgauuguuaccgaaaaggacucccccgugaauaucgaagccgaaccacccuucggggauucauacaucaucaucggagucgagccggggcaacucaaacuuuccugguucaagaagggcucguccauagggcagauguucgaaacgacgaugcgcggcgccaagcggauggccauccuaggcgacacggcgugggacuucggaagccugggcggcguguucaccagcauuggcaaggcgcugcaucaagucuucggggccaucuauggcgcggcguucagcggcgucuccuggacuaugaagauccucaucggggucgugaucaccuggaucgggaugaacagccgguccacgagccuguccgucagccugguucuggugggcauuguuaccuuauaccuaggcguaauggugcaggcagauucggguugugucguaagcuggaaaaacaaggaacugaagugcggcagcgggauauucaucacggacaacguccacacuuggacggaacaauacaaauuccagcccgaaucccccagcaaacuagccuccgccauucaaaaggcccaugaggaaggaaucuguggcauccgguccguaacccgccuggagaaucuaauguggaagcagaucacccccgagcuaaaucacauccugucugagaacgaggugaaacuuacgaucaugacgggcgacaucaaggguaucaugcaggcgggcaagcguucgcuccgcccucaacccaccgagcugaaguacagcuggaaggccugggguaaggcaaagauguugagcaccgagcugcacaaccacaccuuccucaucgacggccccgagacagccgaaugcccgaacaccaaccgagccuggaauagccucgagguggaagacuauggguucggaguauucaccacaaacaucuggcucaaacugaaggaacgccaggacguauuuugcgacagcaagcugaugucggcugccaucaaggauaaccgggcggugcacgccgacaugggguauuggauagagagcgcauuaaacgacacguggaagaucgagaaggcguccuucaucgaggugaagucaugucacuggccuaagucccacaccuuauggaguaacggugugcuggagagugaaaugauuaucccuaagaacuucgcagggccgguuagccagcacaacuaccgcccaggguaccacacccagaccgcgggccccuggcaccucggacgucuggaaauggacuucgauuucugcgaaggaacuacgguaguggugaccgaagacugugggaaccgugggccaucucugcggaccaccacggccuccggaaaacugaucaccgaguggugcugucgcagcugcacgcugcccccauuacgguaccgcggggaggacggguguugguacgguauggagauccggccgcucaaggaaaaggaggagaauuuggucaauucccugguuacggccggccacgggcagaucgauaacuucagucucgggguacuaggcauggcccuguuccucgaggaaaugcugcggacccgggucgggaccaaacacgccauucuauuaguggccgugucuuucguuaccuuaaucacggguaacaugagcuuccgcgacuuggggagggugauggugauggucggcgccacgaugacagaugacaucgggauggguguuacauaccuagcccugcuggccgccuuuaaggugcgaccuaccuuugcugccgggcuacucuugcguaaacucaccucuaaggaguuaaugaugaccaccauuggaaucguacugcuaagccagucaaccaucccugagaccauccuagaguuaaccgaugcgcucgcccugggcaugauggugcugaagauuguucguaacauggaaaaauaccagcucgcggugacgauaauggccauccugugcgugcccaaugcuguuauucuacagaacgcauggaaggugagcuguaccauccucgccgucgucucgguaagcccgcuguuacuuacgucgucucagcagaaagccgacuggauaccgcucgcuuuaacgaucaaggggcuaaaucccaccgccauauuccugaccacucuaagccgcaccagcaagaagcgauccuggccgcuaaacgaggcgauuauggcugugggaauggucucgauccuggccuccagcuuacucaagaacgacauacccaugacaggaccccugguggcagggggucuccugaccguauguuauguccugacuggucgcagcgcggaccuggagcuggagcgggcggccgacguccggugggaggagcaagccgagaucaguggcagcuccccuauccuaagcaucaccaucuccgaggacgggagcauguccaucaagaacgaggaggaggagcagacccuaaccauucucauacgaacgggccuacuugucauaagcggucucuucccggugagcauuccgaucacggcugcugcuugguaccugugggaggugaaaaagcaacgcgccggaguguugugggacguccccuccccaccacccguuggcaaggccgaacucgaggacggggcuuacaggaucaagcagaagggcaucuuaggauacucccagauaggcgcgggaguguacaaagaggggacguuccacaccauguggcacgucacccgcggggcggugcugaugcacaaggguaagcggauagagcccagcugggccgaugugaagaaggaccuaaucucuuacggcggaggguggaaacuggagggggaauggaaggagggggaagagguacagguguuagcacucgagcccggcaagaacccucgcgccguucagaccaagccgggacuguucaaaaccaacaccggcacaaucggggcgguuagccuugauuuuucccccgguacgagcgguucacccauuguggacaagaagggcaagguggucgggcuuuacgggaacggcguggugacccgauccggcaccuacgucucugccaucgcacagaccgagaaaaguauugaggacaaccccgaaaucgaggacgacauauuucguaagaaacggcuaacgaucauggaucugcaucccggggcaggcaaaaccaagcgcuaccugccugcgaucguacgagaggccauaaaacgcggccuccgcaccuuaauacuggcccccaccagagugguagccgccgagauggaggaggccuugcgcggacuccccauucgguaccagacgcccgccauccgcgcggaacacacggggcgagagauaguagaccugaugugccacgcaaccuucaccaugagacucuugagccccauccggguuccgaauuacaaccugaucaucauggacgaagcccauuuuacggaucccgcgaguaucgccgcccgggguuacaucagcacacgggucgagaugggagaggcugcugggaucuuuaugaccgccacgccgcccgggucccgcgauccauucccccagagcaacgcgcccauuauggacgaggaacgcgagauccccgagcguucguggaacuccgggcacgaaugggugacggacuucaagggcaaaaccgugugguuuguuccauccaucaaggccgggaacgacaucgcagccugucugcggaaaaacggcaagaaagugauucaguugagccgcaaaacuuucgauagugaguacauaaagacucgaaccaacgauugggacuuugugguaacuacggauaucagcgaaaugggcgcuaauuucaaggccgagcgcgugaucgacccucggcgcugcaugaagccugugauacugaccgauggagaggagagagucauccuugccggucccaugccgguuacgcacaguagcgccgcgcagagacgagggagggugggacgcaaccccaaaaacgagaacgaccaguauaucuacaugggggagccccuggagaacgacgaagacugcgcacacuggaaggaggccaaaaugcugcuggauaacauaaauacccccgaagggauuauaccguccauguuugagccugagagggagaagguggacgcuaucgacggcgaguacagacugcguggggaagcccgcaaaaccuucguggaucugaugcggcgcggugaccuccccguguggcuagcguaucgugucgccgccgaggguaucaacuaugccgaccgccgguggugcuucgacggcgucaagaacaaccagauccucgaagagaauguggagguggagaucuggaccaaggagggcgagcgcaagaagcucaagccccgguggcuggacgcucgcauauacagcgaccccuuagcccuuaaagaguucaaggaguuugcggccggccggaagucgcugacccugaauuugaucaccgaaaugggccgccugccgaccuuuaugacccagaaggcccggaacgcguuggacaaccucgcgguccugcacacggccgaagcgggaggcagggccuacaaccacgcacuaucggagcuccccgaaacccuggagacccugcuccugcuuacccuccuggccaccgucaccggaggcaucuucuuauuccucauguccggcaaagggaucggcaagaugacccuggggaugugcugcauuaucacggccagcaucuugcuuugguacgcgcaaauccagccgcacuggauugcagcauccauaauccuugaguucuuccuaauuguccuccugaucccagagcccgagaagcagcgaacgccgcaggacaaucagcugacuuauguggucaucgccauccucaccguggucgccgccaccauggccaacgagaugggcuucuuagaaaagaccaagaaggacuucgggcuaggaagcaucacgacccagcagccagauagcaacauuuuggacaucgaucugcgcccugcgagugcguggacccuguaugcggucgccacgacguucaucacacccaugcucagacacuccauagagaacucgagcgugaacgugucccugacugcaaucgcuaaucaggccaccguuuuaaugggccucgggaagggauggccccuuagcaaaauggacauuggugucccccuccuggccaucgguugcuauucccaggugaaccccauaacgcuaacagccgcacugcucuugcuggucgcccacuacgccaucaucggacccgggcuacaggccaaggccacccgcgaggcgcagaagcgggcagccgcaggaauaaugaaaauaccugcagcgcugaucggccgcguaaucgaccuugacccuauccccuaugaccccaaguucgagaagcagcucggccagguuaugcugcugguccucugugugacccaggugcugaugaugcguacgaccugggcccugugcgaggcccucacccuggcgaccgggcccaucaguacccugugggaaggcaacccgggccgcuuuuggaacaccaccaucgcagucuccauggccaauaucuuccgcgggagcuaccucgcgggcgcggguuuacuauucuccaucaugaaaaauaccgccaauacgcggagagguaccgggaauacaggagaaacucucggugagaaguggaaaaaccggcuaaaugcgcuggguaagagcgaguuccagaucuauaagaaaagcgguauccaggagguagaccgcacgcucgccaaggaggguaucaaacgaggugagacagaccaccaugccguuucgcgcggcagugcgaaacuucggugguucguagagaggaaccucgugacuccagaggggaagguggucgaccucggcuguggaagaggagggugguccuacuacugcggcgggcuaaagaacgugaaggaagugaagggacugacgaagggcgggccuggccacgaagaacccauaccgaugucaacguacggguggaaccucguccgccugcagagcggcguggacgucuucuucacaccgcccgaaaagugugacacacuucucugcgacauuggcgaaucaagccccaacccgaccgucgaggccggccgaacgcugcgcguccuuaaccucgucgagaacuggcugaacaacaacacccaguucugcaucaaggugcugaaccccuauaugccaucuguaaucgagaagauggaggcacuucaacguaaauacggcggagcccucgugcgcaauccgcugucccggaacagcacccacgaaauguacugggucuccaacgccagcgggaacaucguguccucagugaacaugaucucccgcaugcugaucaacagguucaccaugaagcacaaaaaggcuacguacgagcccgauguugauuuagggucaggcacaaggaacaucggaaucgagucagagacccccaaccuggacauuaucggcaaacgaauagagaaaaucaagcaggaacacgagaccaguuggcacuaugaucaggaccaccccuacaaaaccugggccuaucacggcucauaugaaacuaagcagacggggucagcgucuaguaugguuaacggugugguccggcugcucacaaagccaugggacgugauccccauggugacgcaaauggccaugacggauacgacucccuuuggucaacaacgcguuuuuaaggaaaagguggacacacggacgcaggagccuaaggagggcaccaagaaacuuaugaagaucaccgcggaguggcucuggaaagaacuggguaagaagaaaaccccgcggaugugcacgcgggaggaguucacccgcaaggugcgcucaaacgccgcgcugggcgccaucuuuaccgacgagaacaaguggaagucugcacgcgaggcggucgaagacagcggcuucugggaacugguggacaaggagcgaaaccugcaucuggaggggaaaugcgagacuugcguauacaacaugaugggcaagcgcgagaagaagcuaggugaguucgggaaagccaagggcucacgggcgauaugguacaugugguugggcgcccgcuuccucgaguucgaggccuugggcuuucucaacgaagaccacugguucagcagagagaacucgcuuagcggggucgagggggaggggcuacacaaauugggcuacauacuucgagaugugucuaagaaggagggcggagccauguaugccgacgacacggcaggcugggacaccagaaucacucuggaggaccuaaagaacgaagagauggucaccaaccacauggaaggggagcaccgcaaauuagcagaagccaucuucaggcugacuuaccagaacaaaguggugagaguccagcggcccacaccucggggcaccgucauggauauaauuucccgaagagaucaaagagggagcggccaggugguaacuuacggccucaacacguucaccaacauggaggcccagcuaauccgacagauggaaggggaaggcguguucaagagcauucaacaucugaccgugaccgaggagaucgcugucaagaacuggcucgagcggguggggcgggaaaggcugucccgaauggcgaucagcggagaugacuguguugucaagccccuugacgauagauucgccuccgcccucacugcgcugaacgacauggggaaggugcggaaggacauucagcagugggagccaagccgaggcuggaacgacuggacgcaggucccguuuugcucccaucacuuccacgagcuuauaaugaaggacggcagaguguugguggugcccugccgcaaccaagacgaacuaaucggucgggcgcgcauaagccagggagcgggauggucccugcgggaaaccgccugccucggcaagucguacgcccagauguggucacuuauguacuuucaccgccgggacuugcggcucgcagcuaacgcgaucugcagcgccguccccagucacuggguucccauuagccggacgaccuggagcauucaugcuacccacgaguggaugaccaccgaggacauguuaacugcguggaacagaguauggauacaggagaacccguggauggaggacaagacucccgucgagucgugggaagagauaccuuaccugggaaaacgugaagaucaauggugcgggagccuuauuggccugaccagcagggcuaccugggccaaaaauauucaaaccgccaucaaucaggugcgcucgcugaucgggaacgaggaauacaccgacuacaugccguccaugaaaagauuccgccgggaagaagaggaagcuggggugcuaugguga

SEQ ID NO: 24857 - RNA, 9876 nt, Artificial Sequence
  derived and/or modified CDS sequence (opt11) from DENV-2__KX380821__SS-prME
acagccggcauaaucauuaugaugauccccaccguaauggcauuccaccuuaccacgcgcaauggggaaccccauaugauuguaucccggcaagaaaaggggaaaucccuccuguucaagaccgaaaacggggugaacauguguacccugauggcgauggaccucggugagcugugcgaggacaccaucaccuacaacugcccacuuuuacgccaaaacgagcccgaagacaucgacugcugguguaacagcaccuccaccugggugaccuacgggacuuguaccgcgaccggcgagcacaggcgcgagaaacggagcguugcccuggugccccacguuggcauggggcuggagacucggacggaaaccuggaugagcagcgaaggcgccuggaagcacgcgcagcguauagagacuuggguacuccggcaccccggcuucaccgucauggccgccauccuggccuacacgaucgggaccaccuauuuccagcgggugcugaucuucauccuccugacggccgucgcgcccuccaugacuaugcgcuguaucgggaucagcaaccgggacuucgucgagggcguguccggagggaguugggucgacauugugcuggaacacggcucgugcgugaccaccauggccaagaacaaaccuacgcucgauuucgagcugaucaagacggaggccaagcaccccgccacccugcguaaauauugcauugaggccaagcucaccaacacgaccacagcgagcagaugcccgacgcagggggagcccuccuugaacgaggagcaggacaaacgcuucguaugcaagcauagcaugguugaccgugguugggggaacggcuguggccuguucggcaagggcgggaucgugacgugugcgauguuuaccugcaagaagaacauggaggggaagaucgugcagcccgagaaucucgaauacacaaucgugaucacgccucacuccggggaggaaaaugccguggggaaugacaccgggaaacaugggaaggaaaucaagguuacaccacagagcagcaucaccgaggcagagcugaccgguuacgggaccgccacuauggaguguucaccccggaccggccuggacuuuaaugaaauggugcuccugcagauggagaauaaggcuuggcuggugcaccggcaaugguuccucgaucugcccuuaccauggcucccgggcgcggacacucaaggcuccaacuggauccagaaggagacacugguaacguuuaagaacccucacgcgaagaagcaggacgugguugugcugggcagucaggagggggcgaugcacaccgccuuaaccggcgcgaccgagauccagaugagcuccgggaacuuacuguuuacugggcaccucaagugucgcuuaagaauggacaagcuccagcucaagggcaugucguauuccaugugcaccggcaaguucaagguuguuaaggagaucgccgagacgcagcaugguacgaucgugauacgggugcaguacgagggcgacgggagcccuugcaaaauccccuuugagaucauggauuuggaaaagcggcauguccugggccgccucaucacgguaaacccgaucgucaccgagaaggacagcccugucaacauagaggcggagccgcccuuuggggacagcuacauaaucaucgggguggagccagggcaacugaaauuguccugguucaaaaagggaucuucgauugggcagauguucgagaccaccaugcgcggcgccaagaggauggccaucuugggggacacggcgugggacuuugggagccuaggagggguguucaccuccaucggaaaggccuuacaucagguguucggcgccaucuacggcgccgcuuucagcgguguguccuggaccaugaagauccucaucggcgugguaaucacguggaucggcaugaacagccguuccacguccuuguccgucucccuggugcuugucgggguggucacacucuaccuuggcgucaugguucaggccgacagcgggugcguggucaguuggaagaacaaggaguugaagugcgggagcgggauauucaucaccgacaacgugcacaccuggacggaacaauacaaauuccaacccgagucccccuccaagcucgcauccgccauccaaaaagcccaugaggaggggauaugcgggauccggagcgucacccggcucgagaaccugauguggaagcagaucacccccgagcucaaccacaucuugacggaaaacgagguaaaacucaccaucaugaccggggacauaaagggcaucaugcaagcggggaaacggacccuccgcccgcaaccgaccgagcugaaguacuccuggaaggccuggggcaaggccaagaugcugagcacggaguuacauaaucacacguuccugaucgacggcccugagaccgccgagugcccgaacaccaaucgugcguggaacucccuggagguggaggacuacggguuuggcguguucacgacuaacaucugguuaaagcugaaggagcgccaagacgucuucugcgauagcaagcugauguccgcggccauuaaagacaacagggccgugcacgcugauaugggguauuggaucgagagcgcccucaacgauaccuggaagaucgaaaaggcgucguucaucgaggucaagaguugccacuggccuaagucccacacccuguggucgaauggagugcuggagagugaaaugaucauucccaagaauuucgcgggucccgugagccaacauaacuaccgcccgggguaccacacccagacugcgggccccuggcacuuggggcgacuggagauggauuucgacuucugugaaggcacgaccgugguaguuaccgaggacugcgguaaccgaggacccagcuugcggacgaccacugccucuggaaaacucaucaccgaguggugcugucgcagcugcacgcugcccccgcugcgcuaccgaggagaggacggcugcugguacgggauggaaauccggccccucaaggagaaggaggagaaccugguuaauucccuggucacugcgggccaugggcagauagacaacuucucucuaggcguacugggcauggcccuauuuuuagaggagaugcugcguacucggguaggaaccaagcaugccauccuauuggucgccguguccuuugucacgcugauaacuggcaacaugagcuuccgcgaucuugggcgcgucauggucauggucggcgccacuaugacagacgauaucgggaugggagucacguaccuggccuuauuggcugcguucaagauccggccgacuuucgcagccggccugcuacugcggaagcucacgagcaaggagcucaugaugacaacgaucggaaucgugcuguugagccaaucgacaaucccggagagcaucuuagagcugaccgacgcgcuugcccuaggcaugauggugcugaaaauagugcggaauauggagaaguaccagcucgcugugaccaucauggccaucuugugugucccgaacgcagugaucuugcagaacgcguggaagguauccuguacgacccucgcaguugugagcguuagcccccuacugcucacaagcucccagcaaaaggccgacuggaucccgcuagcccugacaauaaaaggucugaaccccacagcgaucuuucugacaaccuugagccggaccagcaagaagcguuccuggccacuuaaugaggcgaucauggcagucgggauggugucuauccuggccagcuccuugcugaagaacgacauuccaaugacuggcccccugguggcagggggccuguugaccguauguuacguucugaccgggcgcucagcggaccuggagcucgagagggccgccgacgugcgcugggaggaacaggccgaaaucagugggagcagcccaauccucuccauuaccauaucggaggacggguccaugaguaucaaaaacgaagaagaggaacaaacccuuaccauccucauucguaccggucuucuggugaucuccggacucuucccggugaguauccccaucaccgccgcggccugguaccugugggaggugaagaaacagcgcgccgguguccugugggacgugccaucaccgccgccgguuggcaaagcagagcuugaggauggggcuuaccggaucaaacaaaagggaauccugggguauucacaaaucggcgcgggugucuacaaggaggggaccuuccacacgauguggcaugugacccgcggcgccguguugaugcacaaagguaaacgcaucgaaccaucgugggccgacgucaagaaggaccucauaucauacggcggcggguggaaguuagaaggcgaguggaaggagggggaggagguccagguguuggcccucgagcccgggaagaauccccgugccgugcagaccaagcccggacucuucaagacgaacacggggaccauaggggcgguaagucuagacuucuccccugggaccuccggcucacccaucguagacaaaaagggcaagguuguaggccucuacgggaacggaguugugacgcgguccgggaccuacgugagcgccaucgcccagacagagaaguccaucgaggacaaccccgagaucgaggaugacaucuuuagaaagaaacggcuaacuaucauggaccuucacccaggggccggaaaaacuaagcgcuaccugcccgccaucguacgggaggcuaucaagcgcggacuccggacgcugaucuuggcuccgacacgcgucguggccgcggagauggaggaggcgcuccgcggacuaccuauucgguaccaaacccccgcaauaagagccgaacacaccgggcgggagaucguggaccugaugugccaugccacguucacuaugcgccuucuaagcccaaucagggucccgaauuauaaucugaucauuauggacgaggcccacuucacagaucccgcauccauugccgcccguggcuacaucucuaccagaguggaaaugggggaggccgcggggauuuucaugacggcgacacccccuggcagccgcgacccguuuccacagaguaaugcccccaucauggacgaggagaaagagauccccgaacgaucguggaacuccgggcaugagugggugaccgauuucaagggcaaaacugucugguucgugccgucgaucaaggcggguaacgacaucgccgccugccuucgcaagaacgguaagaaggugauacaguugucccggaagacguucgacagcgaguacauaaagacgcgcaccaacgacugggauuucgucgugaccacagacauauccgagaugggcgccaacuucaaggcugaacgcguuaucgauccccgccguuguaugaagccagucauacuuaccgacggggaggagcggguaauccucgccggccccaugcccgugacccacucguccgccgcgcagcgacgaggucgggucggucgcaaccccaagaacgagaaugaccaauacaucuauaugggcgagccccuagagaacgacgaagacugugcccacuggaaggaggccaagaugcuguuggacaacaucaacaccccggagggcauaaucccgucaauguuugagccggaacgcgagaaaguggacgccaucgacggcgaguaccggcugcgcggagaggcccguaaaacguucguggaccugaugcgcagaggcgaccucccgguuuggcucgcguaccgcgucgccgcagaagguauaaacuacgcugaucggaggugguguuuugacggcgucaaaaacaaccaaauccuggaagagaacgucgagguugaaaucuggaccaaagagggggaacggaagaagcuaaagccgagauggcuggaugcccggaucuacagugaccccuuggcgcucaaggaguucaaggaguucgccgcuggccgcaagucacugacucugaaccucaucacugagaugggacgucugccuaccuucaugacacagaaagccaaaaacgcgcuugacaaccucgccguccugcacaccgcggaagcugggggccgcgccuauaaccaugcgcucuccgagcuuccggaaacccuggagacacugcuccugcugacccuccuugcaaccguaaccgguggcaucuuucuguucuuaaugaguggcaaagggauuggcaagaugacccuugggauguguugcauuauaacggccuccauacuacucugguaugcccagauccaaccacacuggaucgccgcgagcaucauccuggaguucuuccugaucguguuacucauuccggaaccugagaaacagagaacuccccaggauaaccagcugaccuacguagugauagccauccucaccguggucgcggccacgauggccaacgagauggguuuccucgagaagacuaagaaagacuucggacuagggagcauaacgacccagcagccggaaagcaauauccucgacaucgaccugcgaccagcgucggcuuggacgcucuaugccguagccacaaccuucauuacccccauguugcggcacuccaucgagaacagcuccgucaacgucagcuugacggccaucgcgaaccaggccaccgugcugaugggcuuaggaaaaggcuggccacugagcaagauggacaucggagugccgcugcucgccauuggcugcuauucccaggucaacccaaucacccugacagcagcucugcuucugcugguggcccacuacgccaucauagguccuggucugcaagccaaggccacgcgagaagcacagaaacgcgcggcugccgguaucaugaagaacccaacugucgauggaaugacagucaucgaccuggacccgauccccuaugaccccaaauuugagaagcagcugggacaagucauguuauuaguacugugcgucacccaggugcuuaugaugcgcacgaccugggcccugugcgaggcgcugacguuggcuacagggcccaucucaacgcugugggagggcaacccgggccgcuucuggaacacgaccaucgccgugagcauggcaaacaucuuccguggguccuacuuagcgggggcgggucuacuguucagcauuaugaagaacaccgccaacacucgccggggcacugggaacacaggcgagaccuuaggcgagaaguggaaaaaccgacuaaacgcccuggggaaguccgaguuccagaucuacaagaaguccggcauccaggaagucgaccggacgcuagcgaaggaagggaucaagcgcggcgaaaccgaccaccacgcgguguccagagggagugcaaagcuccgcugguuuguggaacggaaccuggucacccccgagggcaaaguaguggaucuuggcugcgggcgcggcgggugguccuacuacugcgguggacucaagaacgugaaagaagugaagggccugacaaaaggcgggccuggccacgaggagccuauccccaugucuacguauggguggaaccuggugcgacuccaaaguggugucgacguguucuucacgccgccggaaaaaugcgauacccugcuaugugacauuggcgagucgucccccaacccgaccguugaggcggggcgcacccugagggucuuaaaccuuguggagaacuggcucaacaacaacacacaguuuugcaucaaagugcugaaccccuacaugcccagcgucaucgagaagauggaggccuuacagaggaaguaugguggggcucugguucggaauccucucucaagaaauuccacccaugagauguacugggugucgaacgcguccggcaacaucgucagcuccguuaacaugauuagcaggaugcuuauaaaccgcuucaccaugcgucacaagaaggccaccuacgagcccgacguggaucuggggucaggcacgcgcaacauuggaauagagagcgagacaccgaaccuagacauaaucggcaaacggauagagaaaaucaagcaggagcacgaaaccucauggcacuacgaucaggaccaccccuacaagaccugggccuaccaugguaguuacgaaacgaagcaaaccggguccgccagcuccaugguuaacggcguuguccgccugcugacuaagccgugggaugucauacccauggugacccaaauggccaugacggacaccacccccuucgggcagcaacgcgucuucaaggagaaggucgauacccggacgcaggagcccaaggagggcacaaagaagcugaugaagauaaccgcggaauggcucuggaaggagcugggcaaaaagaaaaccccgcgcauguguacgcgggaggaguucacccgcaaggugcggucaaaugccgcgcuaggggccauauucaccgacgagaauaaauggaaguccgccagggaggcggucgaagacagcggcuucugggagcucguugacaaggagcggaaccugcacuuggaggggaagugcgagaccugcguguacaacaugaugggcaaacgggagaagaagcugggugaguucggcaaggccaagggaucgcgugcuaucugguauauguggcugggugcccgcuuccucgaguuugaagcgcuuggcuuucugaacgaggaccacugguuuagccgggagaacagccucuccggagucgagggagaagggcugcacaagcucggguacauccuacgcgacguaagcaagaaagaaggaggggcaauguaugccgacgauacggccgguugggacacccggauuacgcuggaggaccucaagaaugaggaaauggugaccaaccacauggaaggggagcacaaaaagcuggcugaggcgauauuuaagcugacguaucagaacaaggucgugcgcgugcagcggcccacgccccgcggcacugucauggacaucaucucccggcgcgaccagcgggguagcggccaagugguaaccuacggccugaacacguucacgaacauggaggcccaguugauucgccagauggaaggggagggcguuuucaaaucaauccagcagcuuacaguaaaagaggagaucgccgugaagaacugguugauccgggucgggagagaacgccucagcagaauggccauuuccggcgacgacugcguuguaaagccgcuggaugaucgcuucgcgagcgcacugacugcucucaaugacaugggcaagguucggaaggacauacagcagugggagccuucccguggguggaacgacuggacacagguucccuucuguagccaccacuuccacgaacuaauuaugaaggacggccgggugcugguagugcccugucgcaaccaggacgaguuaaucgggcgggcacguaucucccagggcgccggguggagucugcgggagaccgccugucugggaaaauccuacgcgcagauguggagccucauguacuuccacaggcgcgaccugcgccuugccgccaaugcuauuuguuccgccgugccuagccauuggaucccaaccucuaggaccaccuggagcauccacgcgacgcaugaguggaugacgaccgaggacaugcucacggucuggaaccgcguguggauccaagaaaaccccuggauggaggacaagacgccugucgagagcugggaggagauucccuaucugggcaagagggaagaucaguggugcgggucccugaucggccucaccagccgugcaaccugggccaagaacauccaaaccgcuaucaaccaagugaggucccugaucgggaacgaggaguacacggacuacaugcccagcaugaagcgcuuccggcgcgaggaggaggaggcaggcguauuaugguga

SEQ ID NO: 24858 - RNA, 9876 nt, Artificial Sequence
  derived and/or modified CDS sequence (opt11) from DENV-2__KX380822__SS-prME
acagcggggaucaucaucaugaugauccccaccgugauggcuuuccaucugaccacccggaacggugagccccacaugaucguuagccggcaagagaaagguaaaagccuccuguucaaaacggaaaacggggucaacaugugcacccuuauggcgauggaccuuggggagcugugcgaggacacgaucaccuacaacugcccccuguugcgccagaacgaaccggaggauauagacuguuggugcaacagcaccagcacaugggugaccuauggcacaugcaccgcgacgggcgagcaccggcgcgagaaaaggucggucgcacuugugccccacguggguauggggcuagagacgcgcaccgagacguggauguccagcgagggcgcuuggaaacaugcccaacggaucgaaaccuggguccucagacacccuggguucacgguaauggcagccauccuggcuuauaccauaggcaccacguacuuucaacggguccuaaucuuuauacucuugacggccgucgcgcccuccaugaccaugcgcugcaucgggauaagcaaccgagacuucguugaaggcguguccggagggagcugggucgacauagugcuggagcacgguuccugcgugaccaccauggcuaaaaacaagccgacgcuagacuucgaguugaucaagaccgaggccaagcaccccgccaccuuacgcaaguacugcaucgaggccaagcucaccaacacgaccacggcgagccgguguccgacccagggggagcccucccugaacgaggagcaagacaaacguuucgucugcaaacacagcaugguggaccggggcuggggcaacggguguggccuguucgggaagggagggaucgugacgugcgcgauguuuacgugcaagaaaaacauggagggaaagauuguccagcccgagaaccucgaguauacuaucgugauaacaccccacuccggggaggagaaugccguggggaacgauacgggcaagcacgguaaggagaucaaaguuacuccgcagagcuccaucacagaggcagagcugaccggcuacgggacggccacaauggaaugcagcccccgaacaggccuggauuuuaacgaaaugguccuucugcaaauggaaaacaaggcgugguuagugcaucggcagugguucuuagaccugccccugccauggcucccgggcgcagacacccaggguuccaauuggauccagaaggagacuuuagucacguucaaaaacccacacgccaagaagcaagacgugguuguguuaggcagccaggagggggccaugcacaccgcucucaccggcgcgaccgagauucagaugagcucagggaaucugcuguucacgggccaccucaagugccgccugcggauggacaaguuacaauugaaagggaugagcuacuccaugugcaccgggaaguuuaagguggucaaggagaucgcggagacccagcauggcaccauagugauucgcguccaguacgagggggacggcucacccuguaaaaucccuuucgagaucauggaccuugagaagcggcacguucuggggcgccucaucaccgugaacccgaucgugacagagaaagauaguccaguuaacaucgaggccgagccucccuucggagacagcuacauaauuaucggcguggagccgggccagcuaaagcuguccugguucaagaagggcuccucuaucgggcaaauguucgagaccaccaugcguggcgcaaagcguauggccauucuaggcgacacggcgugggacuucgggagccuaggaggcguguucaccucgaucggcaaggcauugcaccaagucuucggggccauuuacggcgccgcguuuucuggcgucuccuggaccaugaagauacucauaggcgucgucaucaccuggaucggcaugaauagccgcuccacgucccuauccgugagccuggugcucgucggaaucgugacccuauaucuaggagugaugguccaggccgacucgggguguguaguaaguuggaagaacaaggagcugaagugcggcucagggaucuucaucacggacaacguccacaccuggacggagcaguacaaguuccagccggaguccccgucuaagcucgccuccgccauccagaaagcgcacgaggaggggauuugcgggauacggagcgugacccgccuggagaaccuuauguggaagcagauuacccccgaacucaaccauauucugucggagaacgagguuaagcugaccaucaugacgggggacaucaaggggaucaugcaggcagggaagcggagcuuacgcccucagccuacugagcuuaaauacucauggaaggcguggggcaaggccaagaugcugagcaccgagcuccacaaccacaccuuccucaucgauggccccgagaccgccgagugccccaacacaaaccgagccuggaacagccuugaggucgaggacuacgguuucggcguguucacuaccaacaucuggcucaaguugaaggagcgccaagacguguucugugauucaaaguugauguccgcggccauuaaagauaaccgggccgugcacgccgauaugggguauuggaucgagagcgcccucaacgacacguggaaaauagagaaggcguccuuuauagaggucaagagcugccacuggcccaagucccacacccuguggagcaacggcguccucgaguccgagaugaucauacccaagaauuucgccggccccgugagccagcacaacuaccgcccgggguaccacacacagaccgccggucccuggcaucucgggcggcuggagauggacuucgacuuuugugaggggaccacggugguagucaccgaagacugcggaaaccguggccccaguuugcggaccaccacggccuccgguaaguugaucaccgagugguguugcagaucaugcaccuuaccgccacuccguuaccgcggggaggacggcugcugguacgggauggagauucggccccucaaggagaaggaggagaaucugguuaacucccuggugacagcgggccauggccaaauagacaacuucagcuugggcguccugggcauggcuuuauuccuggaggagaugcugcgcacgcgaguggggaccaagcaugccauccugcucguggccgucaguuucgugacccugaucaccgggaacaugagcuuccgcgaucuggggcgcgugauggugauggugggcgccacgaugaccgacgacaucgggaugggcgugaccuaccuggcgcuguuggcugcguucaaggugcggcccacguucgccgcaggccuccugcugcgcaaacuuacguccaaggaacugaugaugaccaccaucgggaucgugcugcucagccaaucuaccauccccgagacgaucuuggagcugaccgaugcccuggcacugggcaugauggugcugaagaucguccggaacauggaaaaguaccagcucgccguuaccauuaugacgauacuaugcgucccuaaugccgugauccuccaaaacgccuggaagguaagcugcacuauccucgccgucgugagcgugagcccccugcugcucaccuccucgcagcagaaggccgacuggaucccccucgcccugacaaucaaggggcucaaccccacggccaucuuccucacaacccugucccgcacguccaagaaacggucguggccgcucaacgaggcgauuauggccgucggcauggugagcauucuggccucaucucugcucaagaaugacauaccuaugaccgguccucugguagccgggggccugcuaacggugugcuacgugcugacggggcgcagcgccgaccuggagcucgagcgugcggcggacgugcgcugggaggagcaggccgagaucuccgggagcucgccaauccugucgaucaccaucuccgaggacgggagcauguccaucaagaacgaggaagaagaacagacccugacgauucucauccggaccggucuucuaguuaucagcggccuauuuccgguguccauucccaucaccgcagcggcaugguaccuaugggaggugaagaaacagcgcgcugggguccugugggacgugccuagucccccgcccguggggaaggcagagcucgaagauggggccuaccggauuaagcaaaaggggauccucggcuacucccagaucggugccgguguguacaaggaagggacguuucacaccauguggcauguaacucgcggugccgugcucaugcacaaagggaagcgcauagagcccagcugggccgacgugaaaaaggacuuaauuucguacggcgggggauggaagcuggaaggggaguggaaagagggggaggaaguucaggugcuagcccucgagcccggcaagaacccccgcgccguccagacuaagccagggcuauucaagacgaacaccggcacgaucggggccgucagccuggauuucucccccggaaccucaggauccccgauaguggacaaaaaggggaaggucgugggacucuacgggaacggcguggucacucggucuggcaccuaugugucugcgaucgcccagacggaaaaguccauugaggacaacccugagauagaggacgacaucuuccgcaagaaacggcugacgaucauggaccugcaccccggugccggcaagacaaagcgcuaccugccggccauagugcgggaggccauaaaacgcgggcuacggacccuuauccuggccccgacucgcgucguagccgccgaaauggaggaggcccugcgcggccuuccuauacgguaccagacccccgcgauacgcgccgaacacaccggucgggaaauaguugaucugaugugccacgcaaccuuuacgaugcgccuccuaagcccgauacgggugccuaauuacaauuuaaucaucauggacgaggcacacuucaccgacccggcgaguaucgcggcccgcggcuacauaagcacccgcguggagaugggcgaggcagcaggaaucuucaugacagccacgccacccggcuccagagauccauucccccagagcaacgcgccgauaauggacgaggaacgggaaaucccagaacgcucguggaacagcggucacgagugggugaccgacuucaaggguaagacuguaugguucguuccguccauaaaggccgggaacgauaucaccgcgugccuacggaaaaacggcaagaaagugauucagcugagccggaagaccuucgacagcgaguauaucaagaccagaacaaacgacugggauuucguugucaccacggauauaagcgagaugggcgccaauuucaaggcggagcgcgugaucgacccucggcgcugcaugaagcccgucauccugaccgauggggaggagcgggugauacucgccggcccuaugccggugacacauaguagugcugcccagcgccggggacggguaggucgcaacccuaagaaugagaacgaucaauacauauauaugggggagccccuggagaacgacgaagacugcgcgcacuggaaggaggcuaaaaugcugcucgacaauaucaauaccccagaagguaucauccccuccauguuugagcccgaacgggagaaaguggaugcaaucgauggcgaguacagacuacggggcgaggcgaggaaaacguucguggaccugaugcggcgaggcgaucuccccguauggcuggccuaccggguggccgcugaagggaucaauuacgccgaccggaggugguguuuugacggcgucaagaacaaccagauucuggaggagaacguagagguggagaucuggaccaaggaaggggagcguaagaagcugaagccgcgcuggcuggaugcccgcauuuacagcgacccccuugcccucaaggaguuuaaagaguucgccgccggccggaagucccugacacugaacuuaaucaccgagaugggccgccuccccacauuuaugacucagaaggcccggaacgcccuggacaaccuggccguccuacacaccgcggaagccgggggacgcgcguacaaccacgcacuaagcgagcucccugagacccuugagacgcugcuccucuuaacccuacuggccacggucacgggcggcauauuccuguuccucauguccggcaaagggaucggcaagaugacccuggggaugugcugcauuaucaccgccagcauccuguugugguacgcccagauccagccacacuggaucgcugccucaaucauccuggaguucuucuuaaucguucuccuaauccccgagcccgagaaacagcgcacgccccaggacaaucagcugacauacgucguaauagccauccuaaccguggucgcggcgaccauggcgaacgaaaugggcuuccuggaaaagaccaaaaaggauuucgggcugggcagcaucaccacgcagcagccagauagcaacauccucgauaucgaccuccgccccgcaucggcauggacccuguacgcgguugccacaacuuucaucacccccaugcuccggcauagcaucgaaaacuccagcguaaacgucucccugacggccaucgcaaaccaggcgacgguacugaugggccuggggaaaggcuggccccuuucuaagauggacaucggggugccgcugcuagcgaucggcugcuacucucaggucaaccccaucacccucaccgccgcccugcuccugcugguggcccacuacgcuaucauugggccgggccuccaggccaaggcgacgcgagaggcccagaagcgggcggcugccggcaucaugaaaauccccgcagccgacgguaugaccguaauagaccuggacccgauucccuacgacccaaaguucgagaagcagcugggucaggucaugcuccuggugcugugcgugacccaaguauuaaugaugcgcaccaccugggcccugugcgaggcacugaccuuagccaccgggccaaucagcacucugugggagggcaacccugggagauucuggaauacgaccauagcgguguccauggccaacauuuuccggggcagcuaccuggccggcgcgggacuccuauuuagcaucaugaagaacacggccaauacgcgacggggcacggggaacaccggcgagacccugggagagaaauggaagaaccgccugaacgcucuggggaagucggaguuccagaucuacaagaaguccgggauucaggagguggaucguacccuggccaaggaggggaucaagcgcggcgagacagaucaccacgcggugagccgggggagcgccaagcuccgcugguucguagagcggaaccuggugacccccgaggggaaagucguugaccugggcugcggacgcggcggguggagcuacuacugcggcgggcuuaagaacgugaaggaaguaaagggccugaccaagggcgggccgggccacgaggaacccaucccaauguccaccuacggcuggaaccuggugcggcuccaaagcggcguggacgucuucuucacgccgcccgagaagugcgacacgcugcugugcgacaucggggaguccucacccaacccgaccguugaagccggcagaacacuccgagugcugaaccuuguugagaacuggcucaacaacaacacucaguucuguaucaaggugcucaaucccuacaugccgucugugaucgagaaaauggaagcccugcagcgcaaguacggcggggcccugguucggaacccucucucgcgcaacaguacgcacgagauguacuggguaucaaacgccuccgggaacauagugucaagcgucaacaugaucucgcguaugcugaucaaucgcuucaccaugaaacauaagaaggcaaccuaugaaccugacguagaccugggaagcggcacccggaacaucggcaucgagucagagacgcccaauuuagacaucauuggaaagcgcauagaaaagaucaagcaggaacaugagaccagcuggcacuacgaccaagaucaccccuacaagacgugggccuaccacggcuccuacgagaccaagcaaacuggaucggccucuagcaugguuaacggagucguccgcuugcugacgaaaccuugggacgugauccccaugguaacccagauggcaaugacggacacgacccccuucgggcagcaacgggucuuuaaggagaaaguggauacucgcacccaagaacccaaggaagggacgaagaaauuaaugaagauuaccgcggaauggcuguggaaagagcugggcaagaagaagaccccgcggauguguacccgugaggaguucacgagaaagguccgcucaaacgccgcgcucggggccaucuucacugacgagaacaaauggaaguccgcccgggaggcuguggaggacuccggcuucugggagcuggucgacaaggagcgcaacuuacaccucgagggaaaaugcgaaacaugcguguacaacaugauggguaagcgggagaagaagcucggggaguucggaaaggcgaaaggaucgcgcgccaucugguacauguggcugggagcccgguucuuggaguucgaggcguugggauuccugaacgaggaccacugguucagucgggagaacagcuugagcgggguggaaggcgaagggcugcacaaguugggcuacauccuccgggacguguccaagaaggagggaggggccauguaugccgacgacaccgccggcugggacacccgcaucacccuggaggaccugaagaacgaggagauggugaccaaccacauggaaggggagcaucggaagcuggccgaggcgaucuuccgccugaccuaccagaacaagguuguccgugugcagcgcccgacaccgcgggggacugugauggacaucaucagccgacgggaccagagaggguccggccaggucgugaccuacggccugaauaccuucacaaacauggaggcccagcucauacggcaaauggagggggagggcguguuuaaaagcauccagcaucugaccguuaccgaggagaucgccgugaagaacuggcuggagcguguagggagggagcgguuaagccgcauggccaucucuggcgaugacugcguagugaaaccccuggaugaucgguuugccuccgcccugacggcccuaaaugacaugggaaaggugcgcaaggauauccagcagugggaaccaagccguggguggaacgacuggacgcagguucccuucugcucccaccacuuccacgaacuaaucaugaaggacggccgcgugcuagucgugcccugccggaaccaggacgagcuaauugggagagcccgaaucagccagggcgccggguggucguugcgcgagaccgcaugccuugguaaaagcuacgcacagauguggucccucauguacuuccaccggcgcgacuuacggcuggccgcaaacgccaucugcuccgcggugcccucccacugggugcccaccagccgcacgacuuggucgauacacgccacgcacgaguggaugaccaccgaggacaugcucaccguauggaaccggguguggauccaggagaaccccuggauggaggacaaaacgccaguugaguccugggaggagaucccuuauuuaggcaagcgcgaggaccaguggugugggucccuuaucggccucacguccagagcaaccugggccaagaacauccagaccgccaucaaucaaguucggagccugaucgguaacgaggaguacacggacuauaugccguccaugaagcgauuccgacgcgaagaggaagaggcgggagugcugugguga

SEQ ID NO: 24859 - RNA, 9876 nt, Artificial Sequence
  derived and/or modified CDS sequence (opt11) from DENV-2__KX380828__SS-prME
accgcgggcguuaucaucaugcugauccccaccgccauggcauuccaccucacaacccgcaacggggagccccacaugaucguuagccggcaagagaagggcaagagccugcuguucaaaaccgaggacggggucaacaugugcacccucauggcaauggaccugggcgagcugugcgaggacaccaucaccuacaacugcccacuacuacgccagaaugaacccgaggacaucgacuguuggugcaauagcacaucgaccugggugacauacgggacgugcaccgcuaccggcgagcaccggcgagagaagcggagcgucgcccugguuccccacgugggcaugggucucgagacccgcaccgagacuuggaugaguagcgagggcgccuggaagcaugcacagcggaucgagaccuggauccugcgccaccccggguucacgaucauggcugccaucuuggccuacaccauugguaccaccuacuuucagcgggucuuaaucuucauccugcugacggcgguggcgcccaguaugaccaugagaugcaucgggaucagcaaccgagacuucguggagggcgucuccggcgggagcuggguugacaucgugcucgagcaugggucuugcgucacgaccauggccaagaauaagcccacguuggacuucgaacugaucaagacggaggccaagcagcccgccaccuugcgcaaguacuguaucgaagcuaaguugaccaacaccaccaccgcuagccggugcccgacccagggagaaccgucccugaacgaagagcaggacaagcgcuucgugugcaagcauagcaugguggaccggggcuggggcaauggaugcggccucuuuggaaagggcgggaucgucacgugcgccauguucacgugcaagaaaaauauggagggcaagaucgugcagcccgagaaucuggaauacacaauaguggucacaccccauuccggcgaggagaacgccguggguaaugacacagggaagcacgggaaggagaucaaggugaccccgcagagcuccauaaccgaggccgagcugacuggauacgggaccgugaccauggagugcagcccccgcaccggauuagacuucaacgagauggugcuacugcagauggagaauaaagcguggcucguccaucggcaaugguuccuggaccugccccuccccuggcugccgggcgccgacacucaggguuccaauuggauucagaaggagaugcuggucaccuucaagaacccacacgcuaagaagcaagacguggucguucucggcagccaggagggggccaugcacacagcccucaccggggcuacugaaauccagaugucguccgggaaucuccuguucaccggacaccugaaaugccgccugcggauggacaagcuacagcuuaagggcaugagcuacuccaugugcacgggaaaguucaagguugucaaggaaaucgccgagacccagcacggcaccauuguugugagaguccaguaugagggggauggcagccccugcaagauacccuuugagaucauggaccuggagaagcggcacgugcucggccgccugaucaccgugaaccccaucgucacggagaaggacuccccagugaacaucgaagcggagccgcccuucggggacagcuauauaaucaucggcguagagccggggcaacugaagcucuccugguucaagaagggcagcaguaucgggcagauguucgagaccaccaugcgcggcgccaagcggauggccauccugggagacaccgcgugggacuucggaagccugggcggggucuucacguccaucgguaaggcccuccaccagguauuuggggccauuuacggggccgcguucagcggcguuuccuggaccaugaagauccugaucggcgucgucaucaccuggauuggcaugaacagccgcuccaccagccuguccgugucacucguccucgugggcguggucacguuauaccugggcguaauggugcaggccgacucggggugcgucgugagcuggaagaauaaggagcucaagugcggcagcggaaucuucaucaccgauaacguucacacauggaccgagcaguauaaauuccagcccgagucacccagcaaacuggcgagugccauccagaaggcccacgaggagggaaucuguggaauccggagcguaacccgacuggagaaucucauguggaagcagaucacccccgagcucaaccauauucugucggagaacgaagugaagcucaccaucaugaccggagacaucaaagggaucaugcaggcggggaagcguagccugcgcccgcaacccacggagcugaaguauuccuggaagaccuggggcaaggccaaaauguuauccaccgaaccccacaaccagaccuuccuaaucgacggcccggagacagccgaaugccccaauaccaacagagccuggaacucccuggagguggaggacuauggguucggcgucuucaccaccaacaucuggcucaaacugaaggagcgacaggacguguucugcgacagcaaguuaauguccgccgcgaucaaagacaacagggccguucaugccgauaugggguacuggauugagagcgccuuaaacgacacguggaagauagagaaggccuccuucaucgaggucaaaagcugccacuggcccaagucccacacccuguggagcaacggcgugcuggaguccgagaugaucauccccaagaacuucgccggcccggucagccagcauaacuaccgccccggguaccacacccaaaccgcaggcccuuggcaccucgggaagcuggaaauggacuuugacuucugcgagggcaccacggucguugugacagaggacugcgggaaucggggccccagccugaggaccaccacggcuucgggcaagcuuaucaccgaaugguguugccggagcugcacccucccgcccuugcgcuacaagggggaagacgggugcugguacgggauggaaauccggccccucaaggagaaggaggagaaccuggucaacucccugguuaccgcuggucaugggcagauugauaacuucucuuugggcguccugggcauggcgcuguuccucgaggagaugcugcgcacgagagucgggacgaagcacgccgugcugcuaguggccgucuccuucaugacccucaucacgggcaacaugagcuuccgcgaccuggggagagugauggucauggucggugccgcgaugacggacgacaucgggaugggcgugacuuaccucgcccugcuugccgcuuucaagguucgcccaacguucgcugccggccuccugcugcgcaagcucaccuccaaggaacugaugaugaccaccaucgguauaguccugcucagccaguccaccaucccggagaccauacuggagcugacggacgcgcucgcccugggcaugaugauccucaagaucguucggaacauggagaaguaccaacucgcagucaccauaauggccauccuaugcgcccccaacgcaguuauucuccagaacgccuggaaggugagcuguaccauccucgccgucguguccguaagccccuuacugcucaccuccagccagcaaaaggcagacuggaucccccuggcucugacgaucaaagggcucaacccgaccgcgaucuuccugaccacccugucccgcaccaacaagaagcggucguggccccucaacgaggccauaauggccgucggcaugguguccauccucgcgagcucccuguuaaagaacgacauccccaugaccggccccuuaguugccggcgggcugcucacagucugcuacguguuaaccgggcgcagcgcagaccuggagcucgagcgggccgccgacgugcgcugggaggaccaagccgaaaucucggggucgagcccuaucuuaucgaucacgaucucugaggacgggucgaugagcauuaagaacgaagaggaggagcagacccugaccaucuuaauccggaccggccugcugguaauuuccggccucuucccagugagcaucccuaucacggccgcugccugguaccugugggagguuaaaaagcagcgcgccgggguccuuugggacgugcccuccccgccaccggugggcaaggcugagcucgaggacggggcguaccggauaaagcagaagggcauccuuggguacagccaaaucggcgccggcgucuacaaggaggggaccuuccacacaauguggcacgugacccgcggcgccgugcugaugcauaaggggaaacguaucgagccguccugggccgacguccgcaaggaccuaaucagcuacggggguggcuggaagcuggaaggcgaguggaaggagggggaggaagugcaggugcuggcccucgagcccgggaaaaacccgcgggcaguccagaccaagcccgggcuguucaagacgaacacuggcaccaucggggccgucucccuggacuucagcccgggaaccuccggcagccccaucguggacaaaaaggggaaggucgugggccucuacgggaacggcguggucacgcgcuccggcaccuacgugagcgccaucgcccagaccgagaaguccaucgaggacaaccccgagaucgaggacgacaucuuccggaagaagcgccugaccaucauggaucugcaccccggggcgggcaaaacgaagcgguacuugccggcuaucgugcgcgaggcgaucaagcgggggcuucgcacccugauccuugcucccacacgugucguagccgccgaaauggaagaggcccuccguggccugcccauacgcuaccagacacccgccaucagagccgagcauacagggcgcgagaucguggaccugaugugccaugccaccuucacaaugcggcuccuuagcccggucagggugccgaacuacaaccugaucaucauggacgaagcgcacuuuacugaccccgcgagcaucgccgcccggggcuacaucuccacgcgcguggagaugggcgaagccgcugggaucuucaugaccgccacuccgcccgggagccgcgaccccuucccccaguccaaugcccccauuauggacgaggagcgggaaauccccgagcggagcuggaacuccggacacgaaugggucaccgacuucaagggcaagacggugugguucguacccagcaucaaagcgggaaacgacaucgcggccugccucagaaaaaauggcaaaaaggucauccaguuaucacggaaaaccuucgauuccgaguacaucaagacccgcaccaaugauugggacuucguggugacgaccgacaucagugagaugggcgccaacuucaaagccgagcgcgucaucgacccccgccggugcaugaagcccgugauacugacagacggggaggagcgcgugaucuuggccggcccgaugcccgucacccacagcucagccgcucagcggcgcggccggauaggccguaaucccaagaacgagaacgaucaauacauuuacaugggagagccccucgagaacgacgaagacugcgcccacuggaaggaggccaagaugcuacucgacaacaucaacacgccggaggggaucauccccaguauguuugagcccgagcgcgaaaagguggacgccaucgacggggaguaccggcugcgcggggaggcgcguaagacauucguagaguugaugcgccggggugaccucccgguuuggcuggccuaccggguggccgccgaggggaucaacuacgccgaccggcgcuggugcuucgacggcauuaagaacaaccagaucuuggaggaaaacguugagguggagaucuggaccaaggagggggagaaaaagaaacucaagccccgguggcuggaugcgcgcaucuacuccgaccccuuagccuugaaggaguucaaggaguucgccgccggcaggaagagccuuaccaugaaccugauaacggagaugggacgccucccaaccuucaugacucaaaaggcuaggaacgcccuggacaaccuggccgugcuccacacugccgaggccgggggccgcgcguacaaccacgcccuuagcgagcugccggagacucuagagacucugcuucuccuaacccugcucgccaccgucaccgggggcaucuuucuguuucucaugucaggcaaggggaucggcaagaugaccuuagggaugugcuguauaaucacugccuccauucugcugugguacgcacagauucagccccacuggaucgcggccaguaucauacucgaguucuuccugaucgugcugcucauccccgaacccgagaagcagcggaccccacaggacaaccagcugacuuacguggucaucgccauccugacgguuguggccgccaccauggcgaacgagaugggcuuucucgaaaagaccaagaaggacuucggauuaggcuccauugucgcccagcagccagagucaaacaucuuagacaucgaccuccgcccugccagcgccuggacacuguacgccguggcgacaaccuuuaucacccccaugcugaggcacuccauagagaacagcagugugaacgucagccucacugccauugccaaccaggccacggugcugaugggccuggggaagggguggccgcucuccaagauggacaucggaguaccccugcuggcgaucggcugcuacagccaggucaaccccaucacacuuacugccgcccugcugcuccugguggcacacuacgccauaaucgggccaggccugcaagcuaaggcaacccgcgaggcccagaagcgggccgccgccggcaucaugaagaucccgacgguagacgggauuaccguuauagaccucgaccccaucccguacgacccaaaguucgaaaagcagcugggccaggugaugcugcuggugcugugcgucacccaggugcugaugaugcgcaccacuugggcccugugcgaggcccugacccuggccacuggcccgaucucaacccuaugggaggguaaccccggccgcuucuggaauacgaccaucgccguguccauggcgaacaucuuccguggcucauacuuagcuggagccgggcuccuguucagcaucaugaaaaacaccaccaacacgcgccggggcacggggaacacgggcgagacccugggcgagaaguggaaaaaccgccuaaacucccuuggcaaguccgaguuccagaucuacaagagauccggaauccaggaggucgaccgaacgcuggccaaagaaggaaucaagcggggcgagaccgaccaccacgccgugagccgcgggucagccaagcuucggugguucguggagcgcaaccucgucacgcccgagggcaaggugauggaccuggguugcgggcggggcggauggagcuacuacuguggcgggcugaagaacguacgcgaggucaagggccucaccaagggugggcccggccacgaggagccgaucccgauguccacauacggguggaaccuggugcgguuacagagcggcguggaugucuuuuuuacgccccccgagaagugugacacccucuuaugcgacaucggcgaguccucaccgaaccccaccguagaggcaggccgcacccugcgggugcucaaccuggucgagaacuggcugaacaacaacacccaguucugcaucaaaguucuuaacccuuacaugccgagcgugaucgagaagauggagacucugcagcgcaaguacgguggggcccugguccggaacccccugucccgcaacagcacacacgaaauguauuggguuucaaacgcaagcggaaacaucguguccagcguaaacaugaucucccggaugcucaucaaccgcuucaccaugagacacaaaaaggcgacguacgagccggacguggaccuggguucgggcacccgcaacaucgguaucgaguccgagacccccaaccuagacaucaucggcaagcgcaucgagaagaucaagcaggagcacgaaaccuccuggcacuacgaccaagaccacccguacaagacaugggccuaccacggcuccuacgagaccaagcagaccgggagcgccuccaguauggugaacggcgucgugaggcuccugacgaagcccugggaugugauccccauggucacgcagauggcgaugaccgacaccacccccuucgggcagcagcgcgucuucaaggagaagguagacacgcggacccaggagccgaaagagggaaccaagaagcugaugaagaucaccgcugaguggcucuggaaggaacugggcaagaagaagacgccccgcaugugcacucgggaggaguucacacgcaaaguucggagcaacgcggcccugggggccauauucaccgacgagaacaaguggaaguccgccagagaggcgguggaggacuccagguucugggagcuagucgacaaggagcgcaaccugcaccuggagggcaagugcgagacgugcguguacaacaugauggggaagcgggagaagaagaucggcgaguucgggcgcgccaagggcagccgggccaucugguacauguggcugggcgccagauuccuggaguucgaggcgcugggguucuuaaacgaggaccacugguucucacgggagaacucauugagcggcguggagggggaaggccugcacaagcucggguacauccugcgcgagguauccaagaaggagggcggcgcuauguacgcggaugacaccgccggaugggauacccggaucaccuuagaggaccucaagaacgaggagaugguaacgaaccacauggagggggaacacaaaaagcuggccgaggccaucuucaagcugacguaucagaauaaagugguccgcguacagcggcccacgccacgggggaccgugauggacaucaucagccggcgcgaccaacgcggcuccgggcagguuggcacauaugggcugaacaccuucaccaacaugggggcgcagcugauccggcagauggagggcgaggggguguucaagagcauccagcaccugacgacuaccgaggagguggccguccaggacuggcucgcgcgcgugggcagagaacgccugagucggauggccaucagcggcgacgacugcguggucaagccccuugacgaccgcuucgccagugcguugaccgcccugaacgacaugggcaaggugcguaaggauauccagcagugggagcccagcaagggguggaacgauuggacccaggugcccuuuugcucccaccacuuccacgaacugaucaugaaggacggucgcgucuuagucgugcccugccggaaccaggacgagcugaucggccgcgcccggaucagccagggggccggcuggucccugcgcgaaacggcgugccucggcaaguccuacgcucagauguggagucugauguacuuucaccgccgcgaccugcgucucgccgccaaugccauuuguagugccgucccgucccacuggguccccaccagccgcacgacaugguccauccacgcgcggcacgaguggaugaccacggaggacaugcugaccguguggaaccgcgucuggauccaggagaacccguggauggaggacaagacccccguggaaagcugggaggaaaucccguaccuggggaagcgggaggaccaauggugcggcagccucauugggcugaccagccgcgccacgugggccaagaacauccagaccgccaucaaucaagugaggagccugaucggguccgaggaguacaccgacuacaugcccagcaugaaacgguuccggcgggaagaggaggaagcgggggugcucugguga

SEQ ID NO: 24860 - RNA, 9876 nt, Artificial Sequence
  derived and/or modified CDS sequence (opt11) from DENV-2__KX380829__SS-prME
accgcgggcgucauaaucaugcugaucccgacggccauggcguuccaccucaccacccgcaacggggagccccacaugaucguuagccggcaggaaaagggcaaaagccuccuguucaagacagaggacggggugaacaugugcacccuaauggcaauggaccugggcgagcugugcgaggauaccaucaccuacaacuguccccuccuccgccaaaacgaacccgaagauaucgacugcuggugcaacaguaccucaaccugggucaccuauggcaccuguacggccaccggcgagcaccggagggagaagaggagcguggcccuggugccucacgugggcauggggcucgagacccgcaccgagaccuggauguccagcgaaggcgccuggaagcacgcgcagcggaucgagacguggauccugcgccaccccggguucacgaucauggccgccauccuggccuacaccauaggcaccaccuauuuccagagggugcucaucuuuauccugcugacggcggucgcacccuccaugacaaugcgcugcaucggaaucucgaaccgcgacuucguggagggugucucgggcgggagcuggguagacaucgugcucgaacacggaagcugcgucaccaccauggcaaagaacaaacccacucuggacuucgagcugaucaagaccgaggccaagcagcccgccaccuuacgcaaguacugcauugaggcgaagcugaccaacaccacaaccgccuccaggugcccgacccaaggagagccuucccuuaacgaggagcaggacaaacgguucgugugcaagcacagcaugguugaccggggcuggggcaacgggugcggccucuucgguaagggcgggaucgucacgugugccauguuuacguguaagaagaacauggagggcaaaaucgugcagcccgaaaaccuggaguacaccaucguggucacaccccacuccggcgaggaaaacgccguugggaacgacacgggcaaacacggaaaggagauaaaggugacuccgcaaagcuccaucaccgaggcagagcuuaccggguacgggaccgugacaauggagugcagcccccgcacuggucucgacuucaacgagaugguucugcugcagauggagaacaaagcguggcucgugcaccggcagugguuccuggaccuuccucuccccuggcugcccggcgcugacacgcaagggucaaauuggauccagaaggagaugcuagucaccuuuaaaaacccacaugccaagaaacaggacguuguagugcucggaagccaggagggugccaugcacacggcccugaccggcgccacggagauccagaugucaagcgguaaccuccuguucaccggacaccugaagugcaggcugcggauggacaagcuccaguuaaaggggaugagcuacuccaugugcacggggaaauucaaaguugucaaggagaucgccgagacccagcacggcaccauaguggugcgcguucaguacgagggggacggaagccccugcaagauucccuucgagaucauggauuuagaaaagcgucacgugcucggccgccugauuacugugaauccgauagucacugagaaggacucccccgugaacaucgaggcagagccacccuucggcgacuccuacauuaucauagguguggaaccggggcaacugaaacucuccugguucaagaagggcagcuccaucgggcaaauguuugaaaccaccaugagaggcgccaagcggauggccauucucggcgacaccgcgugggacuucggcucacucgguggcgucuucacuuccaucggaaaggcacuccaccagguguucggggcgaucuacggugccgcuuucagcgguguguccuggaccaugaagauccugaucgggguugugaucacguggaucggcaugaacagccgcuccaccagccuguccgugucacugguccucguggggguggucacgcuguaccuaggcgugauggugcaggccgauuccgggugcgucguguccuggaagaacaaggagcucaagugcggcagcggcaucuucaucaccgauaacgugcacaccuggacagagcaguacaaguuccagccugaaucccccagcaagcuggccuccgcaauacaaaaggcccaugaggaggggaucugcgggauccgguccgucacgcgccuggagaaccucauguggaaacagaucacccccgagcugaaccacauccuguccgagaacgaggucaaacucaccauuaugaccggggacaucaagggcaucaugcaggcgggaaaacggucacugaggccgcagccgacggagcugaaguacuccuggaagaccuggggcaaggccaagaugcugagcaccgagccccacaaccagaccuuccugaucgacggcccugagacggccgaaugccccaacaccaaccgugccuggaacucccuagagguagaggauuacggguucggcgucuucaccaccaacauauggcuuaagcucaaggagcgccaggacguuuucugcgacagcaagcugaugucggccgcgaucaaggacaaucgggccgugcacgccgacaugggguacuggaucgaaagcgcccucaaugauacguggaaaaucgagaaggccuccuucaucgagguuaagagcugccacuggcccaagucccacacccuguggagcaauggcgugcuggaguccgagaugaucauccccaagaacuucgcgggcccggugagccagcauaacuaccgccccggauaucacacccagaccgccggccccuggcaccucggaaagcuggagauggacuucgacuucugcgagggcaccacugucguggugaccgaggacugcgggaaucggggccccagccugcggaccaccacggcuuccggaaaacucaucaccgagugguguugccggagcugcacccuaccgccccugcguuacaagggggaggauggcugcugguacgggauggaaauccgaccccucaaggagaaggaggagaaccuggucaacucccuggugaccgccggccacgggcagaucgacaacuucagccucggggugcugggcauggcuuuauuccucgaggagaugcugcgcacgcgggucgggacgaagcacgccgugcuacucguggcaguguccuucaugacacugaucaccggcaacaugagcuuccgcgaucuggggcgggugaugguuauggucggcgccgcuaugaccgacgacaucgggaugggggugaccuaccucgcgcuccuagccgccuucaaagugaggcccacauucgccgccggccuccugcugcgcaagcucacguccaaggagcugaugaugacgacaauagggaucgucuugcucucucagucgaccaucccggagaccauccuggagcucacggacgcucucgcccugggcaugaugaucuuaaagaucguacggaacauggagaaguaccaacucgccgucacuaucauggccauacugugcgcccccaaugcggugauccugcagaacgccuggaaggugucguguacaauccucgcuguuguguccgugucgcccuugcugcuaaccuccagccagcagaaagcagacuggaucccccuugcgcugacgauuaagggccucaacccgaccgccaucuuccugaccacccugucccgaacuaacaagaaacggagcuggccacucaacgaagccaucauggccgucggaaugguguccauacuggccuccuccuuacucaagaacgacauacccaugaccgguccccuuguggccggcgggcugcugaccgucugcuacgugcugaccgggcgcucggccgacuuggagcuagagcgggccgccgacguucgcugggaggaccaggccgaaaucucaggguccagcccgauccugucuauaacgaucagcgaggauggguccaugagcaucaagaacgaggaggaggagcagacucugaccaucuugauccggaccggccugcuggucauuuccggccucuuccccgugagcauacccaucacggcggcggcaugguaccucugggaggugaagaaacagcgcgccggggucuugugggacgugcccagcccgccgcccgugggcaaggcagagcucgaggauggggcguaccgaaucaagcagaagggaauccucggauacucucagaucggcgccggcguguauaaggaggggaccuuccauaccauguggcaugugacaagaggcgcagugcuaaugcacaaggggaaacggauugagccuuccugggcugauguccgcaaggaccucaucagcuacggcggcggcuggaagcucgagggugaguggaaggagggggaggagguccaggugcuggcgcucgagccugggaagaaccccagggcgguccaaaccaaacccgggcuguucaagacgaacacgggcaccaucggggccguaucccuggacuucagcccgggaaccuccggcagcccgaucguggacaagaaggggaaggucguuggccucuacggaaacggcgugguuacgcgcagcggcacauacgugagcgcgaucgcccagaccgagaaguccaucgaggacaaccccgagauugaagacgacaucuuucggaagaaacgcuuaaccauaauggacuuacaccccggcgcgggcaagacgaagcgguaccugccggcaaucgugcgcgaggcuaucaagcgaggacuccgcaccuuaauccuggcacccacacguguaguugccgcggagauggaggaggcccuccgcggccugcccauacgcuaucagacccccgccauccgggccgagcauacgggcagggagaucguggaccugaugugccacgccaccuucaccaugaggcuccugaguccgguccgagugccgaacuacaaccugaucauuauggacgaggcgcacuucaccgaccccgccagcaucgccgcacggggcuacaucuccacccgcguggagaugggcgaggcggcagggaucuucaugaccgccacaccgcccggaagccgggaccccuucccacaauccaacgcccccauaauggacgaagaacgcgagaucccugagcgguccuggaacuccgggcacgagugggugaccgacuucaagggcaagacggugugguucguucccucuaucaaggccggaaacgacaucgccgccugccuccgcaagaacggcaagaaaguaauccagcugucucguaagacguucgacagcgaguacaucaagaccaggaccaacgacugggacuucguugugacgaccgacaucuccgagaugggcgcuaacuucaaggccgagcgggugauugauccccgccggugcaugaagcccgugauccugaccgacggugaggagcgcgugauccucgccggcccgaugccggucacucacagcucagccgcucaacggcgcggacggauaggccgcaaccccaaaaacgagaacgaccaguacaucuacaugggcgagcccuuagaaaacgacgaggacugcgcccacuggaaggaggcaaagaugcugcucgacaacaucaacacgccggagggcaucaucccaagcauguucgagcccgagcgcgaaaagguggacgccauugacggcgaguaucggcugcgcggggaggcgcggaaaacguuuguggaacugaugcgccgaggcgacuugccggucuggcuagccuaccggguggcagccgaggggaucaacuacgccgaucggcgcuggugcuucgacgguaucaagaacaaucagauccuggaggagaacgucgagguggagauauggacaaaagagggcgaaaagaaaaagcucaagccgcgcuggcuggacgcgcggaucuacuccgacccccuggcccugaaggaguucaaggaguucgccgccggccgcaagagccugaccaugaacuuaauaacggagaugggccgccuccccaccuucaugacccagaaagcgcggaacgcccuggacaaccuggcggugcuccacaccgccgaggccgggggccgugcguacaaccacgcccuguccgagcugcccgagacgcucgagacccugcuucuccugacccugcucgccacaguaaccgggggcaucuuccuguuccugaugagcggcaaggggaucggcaagaugacccucgggaugugcugcaucauaaccgcguccauacugcugugguacgcccagauccagccucauuggaucgcggccaguaucauucucgaguuuuuccugaucgugcugcugaucccagagcccgagaagcagcggaccccgcaggauaaccagcucaccuacguggugaucgccaucuuaacggugguggcugcuaccauggcgaacgagaugggcuuccuagagaagaccaagaaggacuuuggucugggcuccaucgucgcccagcagcccgagagcaacauccuggauauugacuuacgucccgccagugcuuggacccuguacgccguugcgacgaccuuuaucacccccaugcugcggcacuccaucgagaacagcuccgugaacgucagccucaccgcuauugccaaucaggcgacggugcugaugggccuugguaagggauggccccuuuccaagauggacaucggugugccccuauuggcgaucggcugcuacagccaggucaaucccaucaccuugaccgccgcucugcugcuacugguggcccacuacgccauuaucgggccaggccuccaggcgaaggccacccgcgaggcccagaaacgggccgcggcugguaucaugaaaaacccgacgguggaugguaugaccgucaucgaucucgaccccauccccuacgacccuaaauucgagaagcagcugggccaggugaugcugcucguacugugcgucacccaggugcugaugaugcgcaccacgugggcccuaugcgaggcccucacccuggccaccgggccgaucuccacccuuugggagggcaaccccgggagauucuggaauacgaccaucgcagugagcauggccaacaucuuucgcggcuccuaccuggcgggcgccgggcuccuguucuccaucaugaagaacacgaccaacacgcgccggggcaccgguaacaccggugagacccugggcgaaaaguggaagaaccgccugaacucccuuggcaagagcgaguuucagauauacaagcgguccgggauccaggaggucgacaggacgcuggccaaggaggguaucaagagaggcgagaccgaccaccacgcggucagccgcggauccgcuaaacugcgaugguucguggagcgcaaccucgucacccccgagggcaaggugauggacuugggcugcgggcgggguggguggagcuauuacugcggcgggcugaaaaacgugcgagaagugaagggccucaccaagggcgggcccggccacgaggagccaauccccauguccacuuacggguggaaccuggugcggcugcagagcggcguagacgucuucuucacgccgcccgagaagugcgacacccuccugugcgauaucggggaguccuccccgaacccgaccguggaggccggcagaacgcugcgggugcucaaccuggucgagaauuggcuuaacaauaacacucaguuuugcaucaagguucucaacccguacaugccgagcgugaucgagaaaauggagacgcugcagcgcaaguauggcggggcucugguccggaacccccugucccgcaauagcacucacgagauguauuggguguccaacgcuucaggcaauaucgugagcagugucaacaugaucucccggaugcucaucaaccgcuucaccaugcggcacaaaaaggccaccuaugagcccgacguagaccucggguccggcacccgcaacaucgggaucgaguccgagacccccaacuuagacaucaucgggaagcgcaucgagaaaaucaagcaggagcacgagaccagcuggcacuacgaccaggaccaccccuacaagacgugggccuaccacggcuccuacgagaccaagcagaccgggagcgcaagcagcauggugaacggcgucguacggcuccugaccaagccaugggaugugauccccauggucacacagauggccaugaccgauaccacucccuucgggcagcaacgcguauucaaagaaaagguggacacgcggacccaggagccgaaggaaggcaccaagaagcugaugaagaucacagccgaguggcucuggaaggagcugggcaagaagaaaacgccccguaugugcacccgggaggaauuuacgcgcaaaguccgguccaacgcggcccugggggccaucuucaccgaugagaacaaguggaaguccgcccgcgaggccgucgaggauucccgguucugggaacucgucgacaaggagcgcaaucugcaccuagagggcaaaugcgagaccugcguguauaacaugauggggaagcgggagaagaagaucggggaguucgggcgcgcgaagggcagccgggccaucugguacauguggcucggcgcacgcuuccuggaguucgaggcccugggguuccucaacgaggaccacugguucucgcgggagaacagccugucggguguagaaggcgagggccugcacaagcucggguacauccuacgugaggucucuaagaaggagggcggcgccauguacgccgacgacaccgccgguugggacacucggaucaccuuggaagacuugaagaaugaggagauggugacgaaucacauggagggcgagcacaagaagcuagcagaagccaucuuuaagcugacuuaccagaacaagguugugcgcgugcagcgacccacgccccgggggaccgugauggacaucauaagccggcgggaccaacggggcucagggcaggucggcacguacggccucaacacuuuuaccaacaugggggcgcagcugauacggcagauggagggcgaggggguguucaagaguauccagcaccugaccacgacagaggagguggcggugcaggacuggcucgcacgagugggcagggaacgccugucccgcauggccaucucuggcgacgacugcguggucaagccgcuggacgaccgcuucgccuccgcgcucaccgcccugaaugacaugggcaaggugcgcaaggauauccagcaaugggagccgucaaagggcuggaaugacuggacccaggugcccuucugcucccaucacuuccaugagcugaucaugaaggacgggcgcguccucguggugcccugccggaaccaggacgagcuuaucggacgcgcccgaauuucacagggagccggcuggucccugcgcgaaacggccugccuuggcaagaguuacgcgcagauguggucccucauguacuuccacagacgugaccugaggcucgccgccaacgccaucugcuccgccgucccgucccacugggugccaacaagccguaccaccugguccauccacgcgcggcacgaguggaugaccaccgaggacaugcugaccguauggaaccgcgucuggauccaggagaaucccuggauggaggauaagacucccguggagagcugggaggaaaucccguaccuggguaaaagggaggaccaguggugcggcucucucaucgggcugaccucccgcgccacaugggccaagaacauccagaccgcuaucaaccaggugcguagucuuaucggaagugaggaguacaccgacuacaugccaagcaugaaacgguuccgccgcgaggaggaggaggcgggggugcucugguaa

SEQ ID NO: 24861 - RNA, 9876 nt, Artificial Sequence
  derived and/or modified CDS sequence (opt11) from DENV-2__KX380830__SS-prME
accgcagggaucaucaucaugaugauccccaccgucauggccuuccaccugacuacaagaaacggggagccccacaugaucgugagccggcaggagaagggcaagagccuccuguucaagacagagaacggggugaacaugugcacacugauggcuauggaccucggcgaauugugcgaggauaccaucaccuacaacuguccccugcuccgccagaacgagccggaggacauagacugcuggugcaacagcaccagcaccugggugaccuacgggaccugcacggccaccggcgagcaccggcgcgaaaagcgaagcgucgcccucgugccccacgugggaauggggcuggagacccgcaccgagaccuggauguccagugagggcgccuggaagcacgcccagcggaucgagaccuggguccuacgccaccccggguucaccgugauggcggccauccucgccuacacuaucggcaccaccuacuuccagcggguacugaucuucauccuccugaccgccgucgcgcccuccaugaccaugcgcugcaucgggaucagcaaccgggauuucguggagggcguguccggcggaagcuggguggacaucgugcuggagcacggcuccugcgugaccacuauggccaagaacaaacccacgcucgauuucgagcugaucaagaccgaggccaagcaccccgcaacccugcgcaaguacuguaucgaggccaagcucaccaacacgacuaccgcgagccggugcccgacccagggggagcccucccugaacgaggagcaagacaagcgcuucgucuguaagcacagcaugguggaccggggauggggcaacgggugugggcuguuugggaagggcgguaucgugacgugcgcgauguuuacguguaagaagaacauggagggcaagaucguccagccagagaacuuagaguacaccaucgugaucacgccccacuccggcgaggagaaugccguggggaacgacacgggcaagcacgggaaggagaucaaagucaccccgcaguccuccaucaccgaggccgagcucaccgguuacgggaccgccacgauggagugcagcccccguacuggccucgacuucaacgagauggugcuccugcagauggagaacaaggcguggcuggugcaccggcagugguuccucgaucugccccugcccuggcucccgggcgccgacacacagggguccaacuggauccagaaggagacgcuggucacguucaagaauccccacgccaagaagcaggacguggucgugcugggcagccaggagggggccaugcacaccgcccuaaccggcgcgaccgaaauccaaaugagcagcgggaaccuccuguucacgggucaccucaagugccgauugcggauggacaagcugcaacucaagggcaugagcuacuccaugugcaccgggaaguucaagguggucaaggaaaucgccgagacccagcacggcaccaucgugauccgcgugcaguacgagggggaugggagccccuguaagauccccuucgagaucauggaccuggagaagcggcacgucuuaggccgucuuauuacggugaauccgauugugaccgagaaggacucccccgucaacaucgaggccgagccgcccuucggggacagcuacaucaucaucggaguggagccagggcagcugaagcucuccugguucaagaaaggcaguuccaucgggcagauguucgagacgaccaugcgcggcgccaagcggauggccauucuuggcgacacggcgugggacuucgggagccugggcgggguguuuaccuccaucggcaaggcccugcaccaggucuucggggcuaucuacggagccgcauucagcggcguguccuggacaaugaagauccucaucggggugguuaucaccuggaucggcaugaauagccgcuccacgagccugagcgugagccugguccuggucgggaucgugacucucuaccugggcguaaugguccaggccgacuccgguugcguggugucguggaagaacaaggagcugaagugcggcagugguaucuucaucaccgauaacguccacaccuggacggagcaguauaaguuccagccggagucccccagcaagcucgccagcgccauccagaaggcccacgaagaggggaucugcggaaucaggagcgugacccgucuggagaaccucauguggaagcagaucacccccgagcuaaaucacauccuguccgagaacgaggugaagcugaccaucaugacgggggacaucaagggcaucaugcaggcggggaagcggagccuccgcccgcagcccaccgagcugaaauacuccuggaaggcuuggggcaaggccaagaugcugagcaccgaacuacauaaccacaccuuccuaaucgacggccccgaaacagccgagugcccgaacaccaaccgggccuggaacucccuagaggucgaggacuauggguucggaguauucacuaccaacaucuggcucaagcugaaggagcgucaggacguguucugcgacagcaagcugauguccgcagcaauuaaggacaaccgggccguccaugccgacaugggauacuggaucgagagcgcccucaacgacacguggaaaaucgagaaggcguccuucaucgagguaaagucgugccacuggcccaagucccacacccucuggagcaauggcgugcuggaguccgagaugaucaucccuaagaauuucgccggccccgucagccagcacaacuacaggcccggguaucacacccaaaccgccggccccuggcaccuaggucgccuggaaauggacuucgacuucugcgaaggaaccacggugguggucaccgaggauugcgggaaccgcggccccagccugcggaccaccacggcuuccggcaagcucaucaccgaguggugcugccgcagcugcacccugcccccgcugcgguaccgcggggaagacggcuguugguacgggauggagauucggccacucaaggagaaggaggagaaccuggugaauucccuggugacugcuggccacgggcagaucgauaacuuuucccucggcguccugggcauggcacuguuccucgaggagauguugcgcacgcggguggggacgaagcacgccauccugcucguggccgugucauucgugacccugaucaccgggaacaugagcuuucgcgaccugggccgugugauggucauggugggggcaacgaugaccgacgacaucgggaugggcgugaccuaccuggcgcugcuggccgccuucaagguccggcccaccuucgcggcaggccugcugcugcgaaagcucacgagcaaggaacugaugaugaccaccaucgggauugugcugcuuagccaguccaccauccccgaaacgauccuggagcuuaccgacgcgcucgcccuuggcaugauggugcugaagaucguccggaacauggagaaguaccagcucgccgugacgaucauggccauccuuugcgucccgaacgccgugaucuuacagaacgcguggaaggugagcugcaccauccucgccguaguguccgugagcccacugcuacucacguccagccaacagaaggccgacuggaucccccuggccuuaaccaucaaggggcucaaccccaccgcgaucuuccugaccacgcugagccgcaccagcaagaaacggagcuggccgcucaacgaggccaucauggccgucggcaugguaucgauucuggcuuccagccugcucaagaacgacauccccaugaccggcccccugguggcagggggccugcucaccgucuguuacgugcucacggggcgaagcgcggacuuggagcucgagcgggccgcugacguccgcugggaagaacaggcggagaucuccgggagcucccccauccugagcaucaccaucuccgaggaugggagcaugucuaucaaaaacgaggaggaggagcagaccuugacaaucuugauccggacgggccugcucgucaucagcggccuauucccgguguccauccccaucaccgccgcggccugguaccugugggaggugaagaagcaacgcgcagggguccugugggacgugcccagccccccgcccgugggcaaggccgagcuggaggacggggccuaccggaucaagcagaaggguauccugggguacucucagaucggcgcgggugucuacaaggaggggaccuuccacaccauguggcacgucacccggggcgccgugcugaugcacaaggggaagaggaucgaacccagcugggcagacgugaagaaggaccucauauccuacggcgggggcuggaaacuugagggcgaguggaaggagggggaagagguccaggugcuagcccucgagcccggaaagaacccccgcgcaguacagacuaagcccgggcuguucaagaccaacaccggcacaaucggugcggugagccuggacuucucccccggcacgagcggcucccccauaguggauaagaaggggaaggucgucggucucuacgggaacggggugguaacgcggagcggaaccuacguguccgccaucgcacagaccgagaaguccaucgaggacaaccccgagaucgaggacgacaucuuccgcaaaaagcggcugaccaucauggaccuacaccccggggcgggcaaaaccaagcguuaccugcccgcgauaguacgggaggccaucaagcgugggcuccggacccugauccuagcccccacccgagucguggccgccgagauggaggaggcgcuccgcggccugcccauccgguaccagacccccgccauccgcgccgagcacaccgggcgggagaucguggaccugaugugccacgccaccuucaccaugcgccugcugagccccauccggguccccaauuacaaccucaucauuauggacgaggcccacuucacggaccccgcguccaucgccgcccgcggcuacauaagcacccggguggagaugggcgaggccgcugggauauucaugaccgcgacgccgcccggcucccgcgacccguucccccaaagcaacgcccccaucauggacgaagagcgggagaucccugagcgguccuggaacagcgggcacgagugggugacggacuucaagggcaagaccgucugguucguaccguccaucaaagccgggaacgacauagccgcgugccugcggaaaaacggcaagaaggugauccagcugucucgcaagaccuuugacuccgaauacaucaagacccguacgaacgacugggacuucgucgugaccaccgacaucucugagaugggcgccaacuucaaggccgagcgcgugaucgacccccggcgcuguaugaagccagucauccucaccgacggcgaagagcgggugauccucgccgggccuaugccggugacucacuccucagccgcacaacgccgggggcgugucggccggaaccccaagaaugagaacgaccaguacaucuacaugggggagccccuagagaacgacgaggauugcgcccacuggaaagaggccaagaugcugcucgacaacaucaacacccccgagggcaucaucccguccauguuugagcccgagcgggagaagguagacgcaaucgacggcgaguaccgccugcgaggggaggcccgcaaaaccuucguggaccuuaugcggagaggcgaccuccccgucugguuggccuaccggguggccgccgaggggaucaacuacgccgaucgccggugguguuucgauggggucaagaacaaccagauccuggaggagaacguggagguggaaauauggaccaaggagggggagcgcaagaagcucaagccgcgguggcuggacgccagaaucuacagcgacccccuggcgcucaaggaguuuaaggaguucgccgccggccggaagucccugacguuaaaccucaucaccgagaugggccgccugcccaccuucaugacccagaaggcucggaacgcgcuggauaaccucgccguccugcauacggccgaggccgguggccgagccuacaaccaugcgcuaagugagcuccccgagacccuagagaccuuacuccugcugacccuccuggccacggugaccgggggcaucuuccuguuccucauguccggcaaggggaucggcaagaugacccuggggaugugcuguauuauaaccgccagcauucuccucugguacgcccagauacagccgcacuggauagccgcgaguauaauccuggaguucuuccugauagugcuucugaucccugagcccgagaagcaaaggacaccccaggacaaccagcugacguacgucgugaucgccaucuugaccguggucgccgccaccauggccaacgagaugggcuuccuggagaagacuaagaaggacuucgggcugggcagcaucacgacccagcagccggacagcaacauacucgacaucgaccugcgccccgcguccgccuggacccuguacgccguggccacuacguucauuacccccaugcugcggcacucuaucgagaacuccucagugaacgucucccugacggcaaucgcgaaccaggcaaccguacugaugggauugggcaaggguuggccccuaucgaagauggacaucgggguuccgcuccucgccauuggcuguuacucccaggucaaccccaucacgcuuaccgccgcgcugcugcugcucguggcucacuacgccaucaucgggcccggccuccaggccaaggccacacgcgaggcgcagaagcgcgccgccgccggcaucaugaagauacccgccgcggacggaaugaccgugaucgaccuggaccccaucccauacgaccccaaauucgagaagcagcuggggcaggucaugcuccuggugcugugcgugacgcaaguacuuaugaugcgcaccaccugggcccugugcgaggcccugacccucgccacggggcccaucaguacccugugggagggcaaccccggacgcuucuggaacaccaccaucgccguguccauggccaacaucuuccgcgggagcuaccuggcgggcgccgggcuccuguucuccaucaugaaaaacacagccaacacccgccggggcaccgggaacaccggcgagacgcugggcgagaaauggaagaaccgccucaacgcgcugggaaagagcgaguuccagaucuacaagaaaucgggcauccaggaaguggaccggacccuagcuaaggaggggaucaagcgcggggagaccgaccaccacgccgucagccgagguuccgcaaagcuccgcugguucguggagcggaauuuggugacuccggagggcaaggucguggaccuggggugcggucgcgggggguggagcuacuacugcggggggcuuaaaaaugugaaggaggucaagggcuugacgaagggcggucccggccacgaggagcccaucccgauguccaccuacggguggaaccuggugcggcuccagagcggcguggacgucuucuucacaccgcccgagaagugcgacacccugcugugcgacaucggagaguccagcccaaacccaacgguggaggccggccgcacccuccgggugcuuaaccuggucgagaacuggcugaacaacaacacccaguucugcauuaagguacugaaccccuacaugccuagcgugaucgagaagauggaggcgcuacaacgcaaguacggcggggcccuggucagaaacccucucucccgcaacagcacccaugagauguacuggguguccaacgccagcggcaauaucgucuccaguguuaacaugaucucccggaugcugaucaaucgcuucaccaugaagcacaagaaggccacguacgagcccgacguggaccuggggagcgggacccggaacaucgggaucgaguccgagacccccaaccucgacaucaucgggaagcgcaucgagaagauuaagcaggagcacgagaccucauggcauuacgaccaggaccaucccuacaagacgugggccuaucacgguuccuaugagaccaagcagacggggagcgcguccagcauggugaacggcgucgugcggcugcugaccaagccaugggacgugauccccauggucacgcagauggccaugaccgauaccacccccuucgggcagcagcgaguguucaaggaaaagguggauacgcgcacccaggagcccaaggagggaaccaagaagcugaugaagauaaccgccgaguggcuguggaaggagcugggcaagaaaaagacgccgcggaugugcacccgcgaggaguucacccggaagguccgcuccaacgccgcccuuggggcgaucuucaccgacgagaacaaguggaagucugccagagaggccguagaggauaguggcuucugggagcuggucgacaaggagcgcaaccuucaccucgaggggaagugcgaaacgugcguguacaacaugaugggcaagcgggagaagaaguugggggaguuugggaaggcaaagggcagccgcgcgauuugguacauguggcugggggcccgguuccucgaauucgaggcccuuggcuuccugaacgaggaucacugguucucacgugaaaauagccucagcgggguggagggcgaggggcugcauaaacugggguacauccuccgggacgucuccaagaaggagggcggggccauguacgccgacgacaccgcgggcugggacacccgcaucacucuggaagaccugaagaacgaggagaugguaacgaaccacauggagggggagcaccggaagcucgccgaggccaucuuccgccugacguaccagaacaaggugguccgggugcagcgccccacaccccggggcaccgugauggacaucaucagccgccgugaccagcgcggguccggccaggucgugacguacgggcugaacaccuucaccaacauggaagcgcagcucauccgccagauggagggggagggcguguucaaaucgauccagcaccugacggucaccgaggagaucgccgugaagaacuggcuggagcggguggggcgugagcggcucucccgcauggcgaucucgggcgacgacugcguggugaaaccacuggacgaucgguucgccagcgcgcugaccgcccucaacgauaugggcaaggugcgcaaggacauccagcagugggaaccaagccggggauggaacgacuggacccagguccccuucugcucccaccacuuccacgagcugaucaugaaggacggccgcguguuaguggucccgugucggaaucaggacgagcucaucgggcgcgcccggaucagccagggcgcaggcuggucccugcgugagaccgccugccugggcaagagcuacgcccagauguggucccucauguacuuucaccggcgcgaucugcggcuggccgccaaugcgaucugcagcgccgugcccucccacuggguucccauuagccgaacgacgugguccauccacgccacgcaugaguggaugaccaccgaggacaugcucacggucuggaaccggguguggauccaagagaaccccuggauggaggacaagacccccguggagagcugggaggagauccccuaccugggcaagcgggaggaccaguggugugggagccugaucggcuuaaccucccgggccacaugggcgaagaauauccaaacggccauuaaccaaguccgcagccugaucgggaacgaagaguacaccgacuauaugccguccaugaagcgcuucaggcgcgaggaggaagaggccggcgugcugugguga

SEQ ID NO: 24862 - RNA, 9876 nt, Artificial Sequence
  derived and/or modified CDS sequence (opt11) from DENV-2__KX380831__SS-prME
accgcgggcaucaucaucaugaugaucccaacggugauggcuuuccaccugaccacccggaacggggagccgcacaugauagucagccggcaggagaagggcaagagccuucuguucaagaccgagaacggugugaacaugugcacccucauggcgauggaccuaggggagcugugcgaagacaccaucaccuacaacugcccccugcucaggcaaaacgagcccgaggacaucgacugcuggugcaacagcaccuccaccugggugaccuacgggaccugcaccgccaccggggagcaccggcgcgagaagcggagcgucgcccuggucccccacgugggcauggggcuggaaaccagaaccgagacauggaugagcagcgagggggcauggaagcacgcccagcggaucgagaccuggauccuccgccaccccggauuuacaaucauggccgccauucuugccuacaccaucggcaccacuuacuuccaaagagugcucaucuucauccuccugacggccgugacccccuccauggcgaugcgcugcaucgggauaagcaaccgugacuucguggagggcgucuccggcggguccuggguggacauugugcuggagcacggcuccugugugacaacuauggccaagaacaagcccacguuagauuucgaacugaucaagaccgaggccaagcaucuggcuacccucagaaaguacuguguggaggccaagcugaccaacacgacaaccgcgagccggugcccgacccagggggaacccucccugaacgaggagcaagacaagcgauucguguguaagcacagcaugguagaccgaggcuggggcaacgggugcggucucuucgggaagggcgggauugugaccugcgccauguucacuugcaaaaaaaacauggagggcaagguuguacagcccgagaaccucgaguacacuaucgugaucacgccccauagcggcgaggagaacgccguggggaacgacacaggcaaacacgggaaggagaucaaggucacgccacagucgucuaucaccgaggccgaacugacaggcuaugggaccgucacgauggaaugcagcccccgcacaggacucgauuucaaugagaugguccugcugcaaauggagaacaaggccuggcucguccaccggcagugguuccuggaccugcccuugcccuggcugccgggcgccgacacccagggguccaauuggauccagaaggagacgcuagugaccuuuaagaacccgcaugcaaagaagcaggacguugucgugcucggaucccaggagggggccaugcacaccgcccuaaccggagccaccgagauccagaugucauccgggaaccuccuguucacggggcaccugaagugccgccugcggauggacaaacuccagcugaaaggaaugagcuacagcaugugcaccgggaaguucaaagucgugaaggagaucgcggagacucagcacggcacaaucgugauccgcguccaguacgagggggacggaagccccugcaagauccccuucgagaucauggaucucgagaagcggcacgugcuaggccgccugaucacggugaaccccaucgucacggaaaaggacucuccggucaauaucgaggccgagccgccuuucggggacucauacauuaucauugguguggaaccggggcaacuaaaacuauccugguucaagaagggaagcuccaucgggcagauguucgagaccaccaugcguggcgccaaacggauggccauccugggcgauacggccugggauuucgggagccugggcggggucuucaccuccaucggcaaggcgcuccaccagguguucggggccaucuacggugccgccuucucgggaguuuccuggaccaugaagauccugaucggggucgugaucaccuggaucggcaugaacucacgcaguacaagccuguccgugucccugguguuaguggggguggucacacuguacuuaggcguaauggugcaggcggacuccgguuguguugugagcuggaagaacaaggagcucaaauguggaucaggcaucuucaucaccgacaacgugcacaccuggacggagcaguacaaauuucagccggaaucccccagcaagcuggccuccgccauccaaaaggcccacgaggaggggaucugcggcaucagaagcgucacccgccuggaaaaccucauguggaagcagaucacccccgagcugaaccacauccugaccgagaacgaggugaagcucaccaucaugaccggggauaucaagggcaucaugcaggccgggaagcggucccugcgcccccagccgaccgagcugaaguacagcuggaaggcauggggcaaggccaagaugcuauccacugaguuacacaaccacacguuccugaucgaugguccugagaccgccgagugccccaacaccaaccgggccuggaacucacucgagguggaggacuauggguucggcgucuucaccacgaauaucuggcugaaguuaaaagaacgccaagacguguucugcgacuccaaccucaugagcgccgcgaucaaggacaaccgggccgugcacgccgacaugggguauuggaucgagagugcccugaacgacaccuggaagaucgagaaggcaagcuucaucgaggucaaguccugccacuggccgaaaagccacacgcugugguccaacggcguacucgagagcgaaaugaucauccccaaaaacuucgcgggccccgugucccagcacaacuaccgccccgguuaccacacccaaaccgcggggccguggcacuuggggcgguuagagauggacuuugacuucugcgagggcacgaccgucgugguaaccgaagacugugggaaccgcggccccagccuccggacgaccaccgccagcggcaagcucaucaccgaguggugcugccgcuccugcacccugccgccgcuccguuaccgcggggaagacggcugcugguacgggauggagauccggccgcugaaggagaaggaggaaaaccuggucaacagccucgugacggccggccacgggcaaaucgacaacuuuucacugggggugcugggcauggcccucuuccuggaggaaauguugcgaacccgugucgggacuaagcacgccauccuccugguagccgugagcuucgucacccugaucacgggcaacauguccuuccgcgaccuagggagggugauggugauggucggcgccacgaugaccgacgacaucgggaugggugugacauacuuagcccugcucgcugccuuuaaggugaggcccacguucgccgccggacugcuacuccgcaagcugaccagcaaggagcugaugaugaccaccaucgggaucguccuccucucccagagcacgaucccggaguccaucuuagaacucaccgacgcacuggcguugggcaugaugguucucaagauaguccggaacauggagaaguaucagcuggccgugaccaucauggccauacuguguguccccaacgcggucaucuugcagaaugccuggaaggugucguguaccacgcuggcgguggucucagugagcccucugcuccugaccuccagccagcagaaggccgacuggaucccguuagcccucacuauuaaggggcugaaccccaccgccaucuuccugaccacccucuccaggaccuccaagaaacgguccuggccauuaaacgaggcgaucauggccgugggcauggucucgauccuggcauccagccuccugaagaacgacaucccgaugaccggcccccugguggccgggggucugcugacaguuugcuauguguuaacugggcgcagcgcugaccucgaguuggagcgggcggccgacgugcgcugggaggaacaggcagagaucuccggcagcucccccauccugagcaucaccaucuccgaggacggaagcauguccaucaagaacgaggaggaggagcagacccucacuauccugauccggaccggccugcucguuaucagcggucuguuccccguauccauccccauuaccgccgcugccugguaccugugggaagugaagaaacagcgcgcggggguccucugggacguccccaguccgccgcccgugggcaaggccgagcuggaggacggggcauauagaaucaaacagaagggcaucuuaggguacucccagaucggcgccggcgucuacaaggaggggacauuucacaccauguggcaugugacgcgcggcgcggugcucaugcacaaggggaagcggaucgagcccucuugggccgacgugaagaaggacuugaucuccuacggcgguggcuggaagcucgagggcgaguggaaggagggggaggagguccaggugcucgcccuggaacccggcaagaacccgcgcgccgugcaaaccaaaccgggucuguucaaaaccaacaccggcacgaucggagccgucagccucgacuucuccccuggcaccuccggcucccccaucguggacaagaaggggaaggucgucggccuguacgggaacggcgugguaaccagaaguggcaccuacgucuccgcgaucgcccagaccgagaaguccauugaggacaacccggagaucgaagacgacaucuuccgcaagaagcggcugacuaucauggacuuacaucccggggcuggcaagacgaagcgcuaccuccccgccauagugcgggaggcgaucaagcgcggccugcggacccuuauccuagcucccacgcgcguggucgcggcugagauggaggaggcucugcgcggccugccgauccgguaucagaccccagccauacgagccgagcacaccgggagggagaucgucgaccucaugugccacgccaccuuuacgaugcgccugcucagucccauccgggugccuaacuacaaccucaucaucauggacgaggcccauuuuaccgaccccgccuccauugcagcucgcggauacauaagcacccgugucgagaugggcgaggccgccgggaucuuuaugaccgcgacgccacccggcucccgcgaccccuucccgcaaagcaacgcgcccaucauggacgaggagcgugagauccccgagcgauccuggaauagcgggcacgagugggugaccgacuucaagggcaagaccgugugguucguccccuccaucaaggccgggaaugacauugccgcuugccugcggaagaacggaaagaaggugauacagcugagccgcaagaccuucgacuccgaguauaucaagacgcggaccaaugacugggacuucgugguuacaaccgacaucuccgagaugggcgcgaacuucaaggcagagcgcgugaucgauccacggcgcugcaugaagcccgugauucucacggacggggaggagcgggucauccuggccggccccaugcccgugacccacuccucagccgcgcagcgcagggggcgcgucgggcgcaacccgaagaacgagaacgaccaguacauuuauaugggggagccccuggagaaugacgaggacugcgcgcacuggaaagaagccaagaugcuccuggacaacaucaacaccccggagggaauaauccccuccauguucgagccagagcgggaaaaggucgacgccaucgacggcgaguaccgccugcgcggggaggcccgcaagaccuucguggaccucaugcggcgcggcgaccucccaguuuggcuggccuaccgcguggcggccgaagggaucaacuacgccgacagacgauggugcuucgacggcguuaaaaauaaccagaucuuggaagagaacgucgagguggagaucuggacaaaggaaggggaacggaaaaagcugaagccccgcuggcuugaugcccgcaucuacagcgacccgcuugcacucaaggaauucaaggaguuugcagccgggcggaagucccugacucucaaccucauaaccgagaugggacgccugccuaccuucaugacgcagaaagccaagaacgcacucgacaaccuggcggugcuucacaccgccgaggcugggggccgggccuacaaccaugccuuaucugagcugcccgagacccuggagaccuuacugcugcucacgcugcuggcaaccguaaccgggggcaucuuccucuuucugaugaguggcaaggggauaggcaagaugacccucgggaugugcugcauuaucaccgccagcauccuccucugguacgcgcagauucagccccauuggaucgccgccuccaucauccuggaguucuuucugaucgugcugcugaucccugagcccgagaagcagcgcacaccccaagacaaccaguuaaccuacgugguuaucgcgauacugacgguuguggccgcaaccauggcuaacgagaugggcuuccuggagaagacgaaaaaagacuucggacucgggagcaucaccacgcaacagcccgagagcaacauccuggacaucgaccugcggccggcaagugcguggacacucuacgccgucgccacaacguucaucacccccaugcugcgccacagcaucgagaacuccagugugaaugugagccugaccgccaucgccaaucaggcgacggucuuaaugggccuggggaagggcuggccucugucaaagauggacaucggggugccccucuuagccauaggcuguuacucacaggugaacccgaucacccugacggcggcccuacuuuugcucguggcucacuacgccaucaucgggcccggacugcaggcaaaggccaccagagaggcccagaagcgcgcggccgccggcaucaugaagaaccccacgguggacgggaugaccgucaucgaccuggaccccauuccguaugaucccaaguucgaaaagcaacucggccaggucaugcuguuagugcucugugucacccagguccugaugaugcggaccacgugggcccugugcgaggcccucacacuggccaccgggcccaucagcacucugugggaggggaaccccgggcgcuucuggaacacuaccaucgccgugucaauggccaacaucuuccgcggcaguuacuuggccggugccgggcuucuguuuagcaucaugaagaacaccgccaauacccggcgcggaacggggaauaccggcgagacccucggcgaaaaguggaagaaccggcugaacgcccuggguaaaucagaguuucagaucuauaagaaguccggaauccaggagguggaccgcacccucgccaaggaggggaucaaacgaggcgagacggaccaucacgcagugucucgaggguccgcgaagcugcggugguucgucgagcgcaauuuggugaccccggaagggaaggucgucgaccucggcugcgggcggggcggauggagcuacuacugcgggggucugaagaaugugaaggaggucaagggccugacaaagggcgggccuggccacgaagagcccauccccauguccacuuacgguuggaaccucgugcgccugcagagcggaguggacgucuucuucacgccgccugagaaaugcgacacacugcucugcgacaucggggaguccuccccgaaucccaccguagaggccggccguacucugcgcgugcugaaucucgucgagaacuggcugaauaacaacacccaguucugcaucaaggugcugaacccauacaugccuucugugaucgagaagauggaggcccugcagcggaaguacgguggggcccucguccgcaauccccugucccggaauagcacgcaugagauguacugggugagcaaugccagcggcaacaucguguccagugucaacaccaucucccgcaugcugauaaaccgauucaccaugcgccacaagaaggcgaccuaugagccggacguggaccucgggagcgggacgcggaacaucgguaucgaguccgagacccccaaccuggacauuaucggaaaacgcaucgagaaaaucaagcaggagcacgaaacuagcuggcacuacgaccaggaccaccccuacaagaccugggccuaccauggcuccuacgagacgaagcagacugggagcgccagcucaauggucaauggcgucgugcgccugcuaaccaagcccugggacgugaucccgauggucacccagauggcgaugacggacacuacaccauucgggcagcagcggguguucaaggagaagguugacacccguacgcaggagcccaaggagggcaccaagaaacugaugaagauaacggccgaguggcuguggaaggagcucggcaagaagaagaccccccggaugugcacgcgcgaggaguucacccggaagguacgcuccaacgcggcacuaggugccaucuucacugacgagaacaaguggaagucggccagggaagccguggaggacuccggcuucugggagcuggucgacaaagaacgcaaucuucaccuggaagggaagugcgagaccugcguguacaacaugaugggcaagcgagagaaaaagcugggagaguucggcaaggccaagggcagccgcgccaucugguacauguggcucggggcgcgauuccuagaguuugaggcguuaggauucuugaacgaggaccacugguucagucgcgagaacagccugagcgggguggagggcgaggggcugcacaaacucggcuacauccugcgggacgucuccaagaaggagggcggggcaauguacgccgacgauacggcgggcugggacacgcgcaucacccuggaggaccugaagaaugaggagaugguaaccaaucacauggagggugagcacaagaagcuggccgaggcgaucuucaaacugacguaucagaacaagguuguccgggugcagcgcccgacaccccgggggaccgugauggacaucauuagccgccgggaccagcgcggguccggccaggucgugacguacggccucaauaccuucaccaacauggaggcucaacugauccggcagauggagggggaaggcguguuuaagagcauccagcagcugaccgucaaggaggagauugccgugaagaacuggcucauucgcguggggcgcgaacggcugucacgcauggccauauccggcgacgacugcgucgugaagccccuggacgacagauucgccuccgcccucaccgcgcugaacgacaugggcaaggugcgcaaggacauccagcagugggaacccagccggggguggaaugacuggacgcaggucccuuucugcucucaccacuuccacgagcugaucaugaaggacggccgcgugcuggugguccccugccggaaccaggacgaacugaucgggagagcccggaucucccagggcgcuggguggucccugcgcgaaaccgccugccugggcaaaagcuacgcccagauguggucccugauguauuuccaccgacgugaccugcgucucgcggccaacgcgauuugcagcgccgugccgucccacuggaucccgacuagccgcacgaccugguccauucacgcgacgcacgaguggaugaccacagaggacaugcuuacaguguggaauagggucuggauccaggagaacccguggauggaggacaagacgcccguggagagcugggaggaaauccccuaccugggcaagcgcgaggaccaguggugcgggagccucauaggcuugaccagucgggcgaccugggccaagaacauucaaaccgccaucaaccaggugcgcagccugaucgguaacgaggaguacacugacuacaugcccuccaugaagagguuccgccgcgaggaggaggaagcaggcguccucugguga

SEQ ID NO: 24863 - RNA, 9876 nt, Artificial Sequence
  derived and/or modified CDS sequence (opt11) from DENV-2__KX380808__SS-prME
accgcuggaaucaucaucaugaugaucccuaccgugauggcguuccaccuuaccaccaggaacggggaaccccauaugauagucagcaggcaggaaaagggcaagagccuccuguucaagaccgaaaauggggugaacaugugcacccuaauggcaauggaccucggugaguuaugcgaggacaccaucacuuacaacugcccccugcucaagcaaaacgaaccggaggauaucgacugcugguguaacucaaccagcacuugggugaccuacgggaccugcaccgcgacaggggaacaccgccgagagaagcgcagcgucgcauuagugccgcacgugggaaugggccuggagacccggaccgagacauggauguccagcgagggcgcuuggaagcacgcccagcgcaucgagaccuggguguuacgccaccccggguuuaccauaauggcggccauccucgccuacaccaucgggaccaccuacuuccagcgcgugcugauuuucauccuccugacagccaucgcgcccucaaugacaaugcggugcaucgggauaagcaaccgcgacuucguggagggcgucuccggugggagcuggguggacauaguacuggagcacgguuccugcgugaccacaauggccaagaacaaaccuacucucgacuuugagcugaucaagacggaggcaaaacaccccgccacccugagaaaguacuguaucgaggccaaacucaccaacacgaccacugcgagccgcugccccacccaaggggagcccucucuaaacgaggagcaagacaaaagguucguguguaagcacucaaugguggaccgaggcuggggcaacgguugcggccuguucgggaagggcgggaucgucacgugugccauguuuacgugcaaaaagaacauggagggcaagaucguccagcccgagaaccucgaauacaccaucgugauaacgccacacuccggggaggagaacgccgucggcaacgacacaggcaagcacgggaaggagaucaaggugaccccacagagcaguaucacugaggccgagcugaccggcuacgggacggucacgauggagugcagcccccgcacaggccuggacuucaacgagaugguccuccuucagauggagaacaaggccuggcuggugcacagacagugguuccucgaccugccacugcccugguuaccgggggcugacacccagggauccaacuggauccaaaaggagacccuggucaccuuuaagaacccccaugccaagaagcaggacgucgugguccugggcagccaggagggggcgaugcacaccgcccucaccggcgccaccgaaauacaaaugucuuccgggaaccuacuguucacuggccaucugaagugccggcuacgcauggacaagcugcagcuuaaaggcaugagcuacuccaugugcacugggaaguucaagguggugaaagagauagcugagacccagcacggcacuaucgucauccgaguucaguacgagggggacggcagccccugcaaaauccccuucgagaucauggaccuagagaagcgccauguucugggccgucucaucacggucaacccaauugugaccgagaaagauuccccggugaacauagaggcggagccgcccuuuggcgacagcuauauuaucauaggggucgaaccggggcaacuuaaguugaguugguucaagaagggcaguuccaucgggcagauguucgagaccaccaugcgcggcgccaagaggauggccauccuuggcgacacggcaugggacuucggaagccuaggagggguuuucaccuccaucggcaaggcgcuucaccagguguucggggcuauauacggcgccgcuuucuccggcgucagcuggaccaugaagauauuaaucggggugguuaucaccuggaucggcaugaacagccgcuccaccagcuugucugucagucugguguugguaggcgucgugacccucuaucugggaguuauggugcaggcugacuccgguuguguggugucauggaagaacaaggagcugaaguguggcagcggcauauucaucaccgacaacguacacaccuggacagagcaauauaaguuccagcccgaaucccccucuaaacuagccuccgccauccaaaaagcacacgaggaggggaucuguggcauacgaagcgugacgcggcuggagaaccugauguggaagcaaaucacccccgagcucaaccacauccuguccgagaacgaggugaagcugaccaucaugacgggggauaucaagggcaucaugcaggccgggaagcggucgcucagaccgcagcccacugaacuuaaguacuccuggaaagcguggggaaaggccaagaugcuuucgaccgagcuacauaaccacaccuuccugaucgauggcccagagacggcugagugccccaacaccaaucgcgcauggaacucccuggaagucgaggacuacggguucggcguuuucacuaccaacauuuggcucaagcugaaggaaagacaagauguuuucugcgauucuaagcuaauguccgcugcgaucaaggacaaucgcgcgguucaugccgacaugggguauuggauagaaagugcccucaacgacacguggaagaucgagaaggcauccuucauagaaaucaagucgugucacuggcccaaaucacauacccuguggucaaacggcguacuggagucagagaugaucauacccaagaacuucgcgggccccguaagucagcacaauuaccggccgggguaccacacccagacggccgggccuuggcauuuggggcgguuagagauggacuucgacuucugcgagggcacuacaguagugguaaccgaggacugcgggaacagaggccccucucugcgcacaaccacugccuccgggaagcugauaacugaguggugcugccgcagcugcacccugcccccgcugcgguauagaggggaagacgguugcugguacgggauggagauccgcccccucaaggagaaggaggagaacuuagucaacuccuugguaacugccggucaugggcaaauugacaauuucucccucggcgugcugggcauggcgcucuuucuagaggagaugcuucggacgcgcgucgggacgaaacacgccauucugcucguagccguguccuucgugacccugauuaccggaaauaugagcuuccgggacuuggggcgcgugauggugauggucggcgccacgaugaccgacgauaucgggaugggcgugaccuaccucgcccuguuagcggccuucaaggugaggcccaccuucgccgcaggccuacugcugcggaaacuuacguccaaggagcugaugaugaccaccaucgggaucguccuccucagucagaguaccauacccgagacgauccuugagcuaacugacgcccuggcgcucggcaugauggugcuuaagaucgugcgcaauauggagaaguaccaacucgccgucaccaucauggcuauacugugcgugcccaaugccgucauccuacaaaaugccuggaaggugagcugcaccacgcucgcggugguuuccgugagcccccugcuccucaccuccagccaacagaaggccgacuggaucccccuugcgcuaaccaucaaggggcucaaccccacugccauuuucuuaacuacgcugucccggaccaguaagaagcgcuccuggccgcugaacgaggcgaucauggccgugggcauggugucuauccuggccuccucccugcuuaagaaugacaucccaaugaccggcccguugguggccgggggccuucucacggugugcuacguccugaccggucgaucagccgaccuggaguuagagagagcggcagacguucgcugggaggagcaggccgagaucaguggcagcagcccaauccugucaaucaccaucuccgaggauggaucgauguccauuaagaacgaggaggaggaacagacccugacaauccucaucaggacuggauuacuuguuaucagcggccucuucccggucucgauccccauuaccgccgccgcgugguaccucugggaggugaaaaagcaacgggcagggguacuuugggacguccccagucccccgcccgucgggaaggccgagcucgaggacggggcuuaccgcaucaaacaaaagggaaucuuggguuacucccagauuggcgccggcguguacaaggaggggaccuuccacaccauguggcacgucacccggggcgcuguccugaugcauaaggggaagcgaauagagcccucuugggccgaugugaagaaagacuugaucuccuacggcgggggauggaagcuagaaggcgaguggaaggaaggagaggagguccaaguacucgcucucgagcccggcaagaauccucgggcuguccaaaccaagccaggccucuucaagaccaacaccgggacuauaggggcuguuagccuugacuucucgccaggcacgagcggcucccccauaguugacaagaaggggaaggucguaggccucuacgggaauggcgugguaacccgcucuggcacguacgucagugcgaucgcccagacggagaaaucaauugaagacaaucccgagaucgaggaugacauauucagaaagaagcgcuugaccauaauggaucugcaccccggugccggaaagaccaagcgguaccugcccgcuauugugcgcgaagcuaucaagcgggggcuccgcacccucauccuggcccccacgcggguugucgccgcagaaauggaggaggcccuucgcgggcuccccauccgcuaccaaacccccgcuauccgggcagaacacaccgggcgcgagaucguggauuuaaugugucacgccaccuucacgaugaggcuucugagcccuauccgagugccgaauuacaaccugaucaucauggacgaggcccacuuuaccgacccggccuccaucgcugcucgaggauacaucagcaccagaguggaaaugggcgaagcggccgggaucuuuaugaccgccacgccgccggguuccagagacccguucccccagagcaacgccccaaucauggaugaagaacgcgagauccccgaacgguccuggaacaguggucacgagugggugacagauuuuaagggaaagaccgugugguucgucccguccaucaaggccggcaaugauaucgccgccugccugcgcaagaacggcaagaaggucauccagcugagccgcaagacuuucgauacggaguacaucaagacuaggacuaacgacugggacuucguggucaccacggauaucucagaaaugggcgcuaacuuuaaggccgaacggguaaucgaccccagaaggugcaugaaaccggugauccugacugauggggaggagaggguuauccucgccgggcccaugccgguuacccacagcuccgccgcccagcggcgggggcgggugggccgaaaucccaagaaugagaacgaucaguacauauacaugggggagccccuggagaaugacgaggacugugcgcacuggaaggaggcaaagaugcugcucgauaacaucaacacucccgagggcaucaucccgaguauguucgagcccgagcgcgagaaggucgacgcuaucgauggcgaguaccggcugcggggcgaggccagaaagacguucguggaccugaugcggcggggcgauuuacccguguggcuggccuaccgcgucgcagcggaagguaucaauuacgccgacaggagauggugcuucgacggcguuaaaaacaaccagauccuggaagagaacguugagguagagaucuggaccaaggagggggaacguaagaaguugaagccgcgcuggcuggacgcaagaaucuauuccgacccccuggcccucaaagaguucaaggaguucgcggcuggcagaaagagccucaccuuaaaccucaucaccgagaugggccggcugccuacauucaugacucaaaaggcuagaaacgccuuagacaaccucgcggugcugcacacggccgaggcugggggccgggcuuacaaucacgcccugagugagcuccccgaaaccuuggagacgcugcuacugcucacccuccuggcaaccgucacuggcggcauuuuccuguucuugaugagcggcaaagggaucggcaaaaugacccucgggaugugcugcauaauuacugcgucuauccuguugugguaugcccaaauucagccgcacuggauugccgcaagcaucauucuagaguucuuucugauaguccuacugauccccgagcccgagaaacaaagaacaccccaggacaaccagcugaccuacgugguaauugccauccucaccgugguggcagccaccauggccaacgagaugggcuuccuggaaaagacuaagaaggacuucggccugggcucuaucacaacccagcagccggagagcaacauacucgacaucgaccugcggcccgcuagugcguggacccuguacgccguagccaccaccuucauaaccccgaugcuccgccacaguauugagaacagcuccgugaacgugucucucacggccaucgcaaaccaggcgaccguccugauggggcuagguaagggcuggccauuauccaagauggauauuggggugccgcugcucgcgaucgguuguuacagccaagugaaccccaucacccugaccgccgcccuucuccuguuggucacgcauuacgcgaucaucgggccuggccuccaggccaaggccacuagagaggcccagaagcgcgccgcggccggcaucaugaagauacccacagucgacgggauuaccgugaucgaccuagaccccaucccguacgaccccaaguucgagaagcagcugggccaggucaugcuccuggugcugugcguuacgcagguccucaugaugcguaccaccugggcgcugugcgaggccuuaaccuuagccaccggucccauauccacgcuaugggaggggaacccggggcgcuucuggaacaccaccauagcgguaagcauggccaacaucuucagaggcucuuaccucgccggcgccgggcuacucuuuucaauuaugaagaacacggccaauacacggcgcggcacagggaacaccggcgaaacgcugggagaaaaguggaaaaaccggcucaacgcacuugggaagucggaguuccagauauacaagaagucgggaauccaggagguggaccgaacccuugcaaaagaggggaucaagcggggugagaccgaccaccacgccguaucacgcggcagcgcaaagcucaggugguucguggagcgcaaccugguaacccccgaggguaaggucguggaccuggguugugggcgagguggcugguccuauuacugcggcgggcucaagaacgucaaggaggucaagggccugacgaaggguggaccgggccacgaggagcccaucccaaugagcaccuacgguuggaaccuggugaggcuccaaucagguguggacgucuucuucacaccacccgagaagugcgauacccugcugugugacaucggagagagcagccccaauccgaccguggaggcuggcagaacguuacgcgugcugaaccuggucgagaacuggcucaacaacaauacucaguucugcaucaaggugcuuaaccccuacaugccaucugugauagaaaagauggaggcccugcagcggaaguacggaggggcccucguccgcaacccgcucucucgaaacuccacucaugagauguacugggugaguaaugccucgggcaauaucgugagcuccgucaauaugaucagccgcauguuaauaaaccgguucaccaugcgccacaagaaggcaacguacgaaccggacgucgaccugggguccggcacccggaacauuggaaucgagucagagacccccaaccucgacauaaucggcaagcgcauagagaagaucaagcaggagcacgagaccuccuggcauuacgaccaggaccaccccuacaagacgugggcguaccacgguagcuacgaaaccaaacagaccggcuccgccagcagcauggugaacggggucguucgccucuugaccaagccgugggacguaauccccaugguuacgcagauggccaugacggacaccacccccuucgggcagcagcggguauuuaaggaaaagguggauacgcgcacccaagagccuaaggagggcaccaagaagcucaugaagaucacugcugaaugguuguggaaagaauuaggcaagaagaagacgccucggaugugcacgagagaggaguucacacgaaagguacgcagcaacgccgcgcucggagccaucuucaccgacgagaacaaguggaaguccgcccgggaggccguagaggacagcgguuucugggagcuggucgacaaggagcggaacuuacaccucgagggcaaaugcgaaacgugcguauacaauaugaugggaaaacgggagaagaaacucggcgaguuuggcaaggccaaaggcucccgcgcaaucugguauaugugguuaggggcacgguuccuagaguucgaggcguugggcuuucuuaacgaggaccacugguucagccgcgagaacucccucuccgggguggagggcgaggggcugcauaaacugggcuacauccuaagggaugucagcaagaaggagggcggagccauguacgccgacgacaccgccggaugggacacgaggauaacucuagaggaucugaagaacgaggagauggugacgaaucauauggagggagagcacaagaaacucgccgaagcgauauuucggcuuacauaucagaauaaagugguucgcgugcagcguccaacucccaggggcaccgugauggacaucaucucccgacgagaucaacgggggagcggccagguggugacguacgggcugaacaccuucaccaacauggaggcccaguuaauccgccagauggagggagagggccucuucaaguccauucaacaucugaccgucacagaggagaucgcggucaagaacuggcugguaagaguagggcgggaacgcuugagccggauggccauaucuggggaugauugcgucguuaagccccuggacgaccgcuucgccagcgcgcucacagcucucaacgacauggggaagguucgaaaggacauccagcagugggagccgucgcgcggguggaacgacuggacucagguccccuuuugcucacaccacuuccacgaacugaucaugaaggacggcagagugcucguggucccgugcaggaaccaggacgaacugaucggacgggcgcgcauuucgcagggcgcgggguggucacugagggagaccgcgugucugggcaagagcuacgcucagauguggagccugauguauuuccaccgccgggaccugcgccucgccgcaaacgcaaucugcuccgccguuccuucgcacugggugccgaccucccggaccaccuggucgauucacgcaacccacgaauggaugacuacggaggacaugcuuacugucuggaaucgaguguggauccaggagaaucccuggauggaggacaagacccccguugaguccugggaggagauccccuaccugggcaagcgugaagaccaguggugcgggagccugauuggccugaccagccgcgccaccugggcgaagaauauccagaccgcgaucaaccaggucaggucgcuuaucgggaacgaggaguacaccgauuacaugccgagcaugaaacgcuuccgccgcgaggaggaggaggccggggugcucugguaa

SEQ ID NO: 24864 - RNA, 9876 nt, Artificial Sequence
  derived and/or modified CDS sequence (opt11) from DENV-2__KX380832__SS-prME
accgccgggauaaucaucaugaugaucccgaccgugauggccuuccaucugaccacccggaacggugagccccacaugaucgucagccggcaggagaagggcaagagucugcuguucaagacggagaacggggugaacaugugcacccugauggcgauggaccucggggagcuaugcgaggauaccauaaccuacaacugcccccugcuuaggcagaacgagccugaagacaucgacugcuggugcaacaguaccagcaccugggugaccuacgggaccugcaccgcgaccggagagcaccgucgcgagaaacggagcguugcccuggugccgcacgugggcauggggcuggagacgcgcacagagaccuggauguccuccgagggcgcguggaagcacgcacagcggaucgagaccuggguccuccgccaccccggauuuacggugauggcggccaucuuagccuacaccaucggcaccaccuacuuccagcgggugcugaucuucauccuccugacggccgucgcgcccuccaugaccaugcgcugcaucgggaucagcaaccgggacuucguggaaggaguguccggcgggagcuggguugacauugugcuggagcacggcucuugcgugaccacaauggccaagaacaagcccacucucgacuucgaacugauaaagaccgaggccaagcauccggccacacugcgcaaguacugcauagaggcgaagcucaccaacacgaccacagcgagcagauguccgacccagggagagcccucccugaacgaggagcaggauaagcgcuuugucuguaagcauagcaugguggaccggggcuggggcaacgggugcggccuguucgggaagggcgggauaguaaccugcgccauguucacaugcaagaagaauauggaggggaagauaguccagcccgaaaaccuugaguacacaaucguuaucacgccccauuccggcgaggaaaacgccguugggaacgacacggggaagcacgggaaggagaucaaagucaccccgcaaagcuccauaaccgaggccgagcugaccggcuacggaaccgccacgauggagugcucgccacgcaccggcuuggacuucaacgagauggugcugcuucagauggagaacaaagcguggcuggugcaccggcagugguuccucgaccugccccugcccuggcucccgggcgccgacacucaggggucaaacuggauccaaaaggagaccuuagucacguucaaaaacccccacgcaaagaagcaggacguggucgugcugggcucacaagagggggccaugcacaccgcccuuaccggcgcgaccgagauccagaugagcuccgggaaccuucucuucacgggccaccucaagugccgccugcggauggauaagcugcagcucaagggcaugagcuacuccaugugcaccgguaaauucaaggugguuaaggagaucgccgagacccagcacggcaccauagugauccgagugcaguacgagggggacggcucuccaugcaagauccccuucgaaaucauggaucuggagaaacggcauguccugggccgcuugaucacggugaacccgaucgucaccgagaaggacucccccgucaacaucgaagccgaaccgcccuucggggacucauacauuaucaucggcguagagccugggcaacugaaguuauccugguucaagaagggcagcagcauugggcagauguuugagaccacuaugcggggcgccaagcggauggcaauccucggagacacagcaugggacuuugggagccugggcgggguguucaccuccaucggcaaggcccugcaccaggucuucggggcaaucuacggagccgcuuucagcggcgugucauggacuaugaagauccucaucgggguggucaucaccuggaucggcaugaacagucgcucaacgucucucuccgugagccuggucuuagucgggauaguaacccucuaccuagguguaaugguccaggccgacuccgguuguguggugagcuggaagaacaaggagcugaagugcggcagcggcaucuucauuaccgacaacguccauaccuggacggagcaguacaaguuccaacccgagucccccagcaaguuagccuccgcgauccagaaggcgcacgaggaagggaucugcgggauccggagcgugacccgccuugagaaccugauguggaagcagaucacccccgagcucaaccacauccugucugagaacgaggugaaacucaccaucaugacgggggacaucaagggcaucaugcaggcggggaagcggagccuccggccgcagcccaccgagcucaaguacucauggaaagccuggggcaaggccaagaugcugagcaccgagcuccacaaccacaccuuccugaucgacggacccgagaccgccgagugcccgaacacgaaccgggccuggaacucacuggagguugaggacuacggguucgggguguucaccacgaacaucugguuaaagcuuaaggagcgccaggacgucuucugcgacucaaagcugauguccgcggccaucaaggacaaccgggccguccacgccgacaugggguacuggaucgagagcgcccucaacgauacuuggaagaucgagaaggccuccuucaucgaggugaagagcugccacuggcccaagucccacaccuuguggucaaauggcgugcuggagucugagaugaucauacccaagaauuucgccggacccgucagccagcacaacuaucguccgggguaccacacucagaccgccggccccuggcaucucgggcggcuggagauggacuucgacuucugcgaaggcaccacggugguggucaccgaagacugcgggaacagaggccccagccugcggaccacuacggccuccgguaagcucaucacggaguggugcugucgcuccugcacacuccccccccugcgguaccgcggggaagacgguuguugguacgguauggaaauucgcccccucaaggagaaggaggagaaccuggugaacucccuggugacagcgggccacgggcagaucgacaacuucagccucgguguccugggcauggcccuguuccucgaggagaugcuucgaacgcggguggggaccaagcacgccauucugcucguggcggucucguucgugacccugaucaccggcaacaugucguuccgcgaccuggggcgcgugaugguaauggugggcgccaccaugacugacgacauuggaaugggcgugaccuauuuagcacugcuggccgccuucaagguccggcccaccuuugccgccggccuccuacugcgcaaacucacguccaaggagcugaugaugaccaccaucgggauagugcuacucagccaguccacuauccccgagacgauccuggagcugaccgacgcgcuugcccugggcaugaugguguugaagaucguccggaacauggagaaauaccaacucgccguaaccaucaugaccauucugugcgucccaaacgcugugauacugcaaaacgccuggaagguguccuguacgauucucgcgguaguguccguguccccccugcugcucaccuccagccagcagaaggcggacuggaucccccuggcccugacgaucaagggucucaacccgaccgccauuuuccugacgacccugagccguacaagcaagaagagaaguuggccgcucaacgaggcgaucauggccgucggaauggugagcauucuggccuccagccuguugaagaacgacauccccaugaccggcccacugguggcagggggccugcucacgguuugcuacgugcuaacagggcgcagcgccgaccuggaacucgagcgggcggccgacgugcgcugggaggagcaggccgagaucagcgggagcucccccaucuuaaguaucaccauuuccgaggacgggagcauguccaucaaaaacgaggaggaggagcagaccuuaacgauucucauccggaccggccugcuagucaucagcggacucuucccgguauccauccccaucaccgccgccgcaugguaccugugggaggugaagaagcagcgcgccgggguacugugggacgugcccagcccuccgcccgugggcaaagcggagcucgaggacggggcuuacagaaucaagcagaaagguauucuaggguacucccagauaggcgccggcgucuacaaggaggggacguuccacaccauguggcacgugacgcgcggcgcggugcugaugcauaaggguaaacgaaucgaaccgagcugggccgacgucaagaaggaucucaucuccuacggcgggggcuggaagcuggagggcgaguggaaggagggggaggagguacagguguuggcccuggagcccggcaagaacccccgcgccguccaaaccaagcccgggcuguucaagacaaacaccggcacgauaggagccgugucgcuagacuucucccccggcaccucagggucccccauuguugacaagaaagggaagguagugggcuuguacgggaacggcgugguaacccggagcggcaccuaugugucagcaaucgcccagacagaaaaguccaucgaggacaaccccgagaucgaggacgauaucuuccgcaagaagagacucaccaucauggaccugcaccccggggccgguaagacuaaacgcuaccuacccgccauugugcgggaggccaucaagcgcgggcuccggacucugauucuggccccgacucgcgucguggcagccgaaauggaggaggccuugcgcggccugccgauucgguaccaaacucccgcaauccgcgcagagcacaccggacgggagaucguugaccugaugugccaugcgacuuucacgaugagacuccugagcccgauacggguaccgaacuacaaccugaucauaauggacgaggcccacuucaccgaccccgccuccauagcugcccgcggcuauaucuccacccggguggagaugggcgaggccgcugguauuuucaugaccgcuacgccgcccggcucccgcgacccauucccucagagcaacgcucccauaauggacgaggagcgugagauccccgagcgcuccuggaacuccgggcacgaaugggugaccgauuucaagggcaagacagucugguucgugccguccaucaaggccgggaacgacauuaccgccugccuccggaagaacggcaagaaggugauacagcucagccgcaagacguuugacuccgaguacaucaagacccggaccaaugacugggacuucguagucacaacggacaucagcgagaugggcgcaaacuucaaggcggagcgcguuaucgacccucggcgcugcaugaagcccguuauacugaccgacggggaggagcgggugauacucgccggccccaugccggugacccauuccucugccgcacagaggcggggacguguaggccgcaaccccaagaacgagaaugaccaguacaucuacaugggggagccacuggagaacgacgaggacugcgcccauuggaaggaggcgaagaugcucuuggauaacaucaacacacccgagggcaucaucccguccauguucgagccagagcgggagaagguggacgccaucgacggcgaguaccgccugcgcggugaagcccgcaagaccuuuguagaccugaugcgacgcggugaccucccagucuggcuggccuaccggguggccgcggaggggaucaacuaugccgaccgcagauggugcuuugacggagucaagaacaaucagauccuggaagagaacguggagguggagauauggaccaaggagggggagcgcaagaaguugaagccgcguuggcuggacgccaggauauacagcgauccccuggcccucaaggaguucaaggaauucgccgcgggccggaaaucccugacccugaaccucaucaccgagaugggccgccuuccgacguucaugacccagaaggcccggaacgcgcuugacaaccucgcaguccuccacacugcggaggccgggggccgcgccuacaaucacgcccugagcgagcuccccgagacccuugagacucugcuccuacuaacccuccuggcgaccgugacaggcggaaucuuccuguuccucauguccggcaagggcaucggcaagaugacuuuagggaugugcuguaucaucacggcgagcaucuugcucugguacgcccagauccagccgcacuggaucgccgccaguaucauccuggaguucuuccugaucgugcucuugaucccagagccagagaagcagcggacgccgcaggacaaccagcugaccuacgucgugaucgccauccucacggugguagcggccacuauggcgaacgagaugggcuucuuggagaagaccaaaaaggacuuugggcugggcagcauuacaacccagcagccggauagcaacaucuuggacauagaucugcgccccgcuucagccuggacucuguacgcgguagccacuaccuucaucaccccgauguuacggcacagcaucgagaacaguagcgugaacgucucccugacugccaucgccaaccaagccaccguacugaugggacucgggaaggguuggccgcucagcaagauggacaucggcgugccgcugcucgcgaucggcugcuacucgcaagucaaccccaucacguugacugccgcccuucuccugcugguggcccacuacgcaaucaucgggcccggcuugcaggccaaggccacacgcgaggcccagaagcgggcagcggccggcaucaugaagauccccgccgccgacggcaucacagugaucgaccuggacccgauacccuacgaccccaaguucgagaagcagcugggccaggucaugcuccugguacugugcgugacccagguccucaugaugcggaccaccugggcauuaugcgaagcacugacccucgcuaccgggccuaucagcacgcugugggagggcaacccgggucgcuucuggaacacgaccaucgcagucuccauggccaacauauucagaggcagcuaccuggccggcgccggguugcuauucuccaucaugaagaauaccgccaacacccgccgggguacggggaacaccggcgagacucuaggcgagaaguggaagaaccgccugaacgcccugggcaagagcgaguuccaaauauauaagaagucaggcauucaggagguggaucggacacuggccaaggaggggaucaagaggggcgagacggaccaccacgcggucucucgggguuccgcaaaacuccgcugguucguggagagaaaccugguuacccccgagggaaaggucguggaccugggcugugggcgcgguggguggaguuacuacugcggcgggcuuaagaacguaaaggaggucaagggccugaccaagggggggcccggccacgaggagccuauuccgauguccacguacggguggaaccugguccgucuacagucaggcguggauguauuuuuuacgccgcccgagaagugcgauacgcugcucugugacaucggggaauccagccccaauccgaccguggaggccggccgcacuuuacgggugcugaaccuggucgaaaacuggcucaacaacaacacccaauucuguaucaaggucuuaaaccccuacaugccgagcgugaucgagaagauggaggcucugcagcggaaauacggcggggcccuggucagaaacccccuuucccgcaacucaacgcacgagauguacugggugagcaacgcgagcggcaacaucguguccagcguaaauaugaucucccggaugcugauaaaccguuucaccaugaagcacaagaaggccaccuacgagccggacguugaccuggggagcggcacccggaacaucgggauagaguccgagacgcccaaccucgacaucauugggaagcgcaucgagaagaucaagcaggaacacgagaccagcuggcacuacgaccaggaucaccccuacaagacaugggcguaccacggcucguacgagaccaagcagacgggaucugccuccagcauggugaauggggucgugaggcugcugaccaaaccgugggaugucauccccaugguuacccagauggccaugaccgacacgacccccuucgggcagcagcguguuuucaaggagaagguggacacccgcacccaagaaccuaaggagggcacgaagaagcucaugaagaucaccgccgaguggcuguggaaagagcucgggaagaagaagaccccccggaugugcacccgggaggaguucacgcggaagguccgcuccaacgccgcccuaggugccaucuucacugacgagaacaaguggaagucggcccgggaggcgguugaggacuccggcuuuugggaacuggucgauaaggaacgcaacuuacaucucgaggggaagugcgagaccugcgucuauaacaugaugggcaagcgggagaagaaacugggggaguuuggcaaggcaaagggcagccgugccauuugguacaugugguugggcgcacgguuucucgaguucgaggcgcugggcuuccugaacgaggaccacugguucagucgcgagaacucucucagcgggguggagggugaggggcugcacaagcugggcuacauccuccgggacgucuccaagaaggagggcggggcgauguacgccgacgauaccgccggcugggacacgcguaucacccuggaggaccuuaagaacgaagaaauggugaccaaccacauggagggggagcaccggaaguuggccgaagcgauuuuccgccugaccuaccaaaauaaaguggugcggguucagcgcccuacgccccggggcacggugauggacauaauuucucgccgggaccagcggggguccggccaggucgugaccuacggccugaacaccuucacgaacauggaggcccagcucauucggcagauggagggggagggcguguucaagagcauccagcaccugaccgucacagaggagaucgccgugaagaacugguuagagcggguugggcgugaacggcugucacgcauggccaucagcggcgacgacugcgucgugaagccccuggacgaccgguuugcgagugcgcugacagcacucaaugacauggggaaggugaggaaggacauccagcagugggagcccagccguggguggaaugacuggacucagguccccuucugcucccaccauuuccacgaguuaauuaugaaggauggccgggugcuggugguccccugccggaaccaggacgagcucaucgggagggcacggauuagucagggcgccggguggucccugcgcgagaccgccugccuaggcaagucauacgcgcagauguggucccucauguacuuccaccggcgcgaccugcgguuggccgccaacgcaaucugcagcgccguacccucccacuggguuccgacaagccgcaccaccugguccauccacgccacgcacgaauggaugaccaccgaggauaugcucaccgucuggaaccggguguggauccaggagaaccccuggauggaagacaagacacccguggagucuugggaggagauccccuacuugggcaagcgcgaggaccaguggugcgggagccugaucggccucaccucccgggcgaccugggccaagaacauccagaccgccaucaaucagguccgaagccugaucgggaacgaggaguacacggacuauaugccgagcaugaagcgcuuccggcgcgaggaggaagaggcaggcguacugugguga

SEQ ID NO: 24865 - RNA, 9876 nt, Artificial Sequence
  derived and/or modified CDS sequence (opt11) from DENV-2__KX380833__SS-prME
acugcagggaucaucaucaugaugauccccaccgugauggccuuucaccugacuacacggaacggggagccucacaugaucgugagccggcaagagaagggcaagagccuccuguuuaagaccgaaaauggggugaacauguguacccugauggcgauggaccucggcgagcugugcgaggacaccaucaccuacaacuguccccugcuccgccagaacgagcccgaggacaucgacugcuggugcaacaguaccagcacuugggugaccuacgggaccuguaccgccaccggggagcaccggcgcgagaaacggucagucgcccugguaccccauguaggcauggggcuggagacccgcaccgagaccuggauguccagcgagggggccuggaagcacgcucagcggaucgagaccuggguucuccgccaccccggguucaccguuauggcggccauccuggcuuacaccaucggcacgacuuauuuccagagaguguugaucuucauccuccugaccgccgucgcgcccuccaugaccaugcgcugcauugggauaagcaaccgagacuucguggagggcguguccggcgggagcugggucgacaucgugcuggagcacggcuccugcgucaccaccauggccaagaacaagcccacgcucgauuuugaguuaaucaagaccgaggccaagcaccccgccacccugcgcaaguacuguauugaggccaagcuaaccaacacgaccaccgcgagccggugcccgacccagggugagccaucccugaacgaggagcaggacaagcgcuucguauguaagcacagcaugguggaccggggcuggggcaacgggugcggccuguucgggaaaggcgggaucgugaccugugccauguuuacgugcaagaagaacauggaaggcaaaaucguccagcccgagaaccucgaguacaccaucguuaucacgccacacuccggcgaggagaacgccguggguaacgacacgggcaagcacgggaaggagauaaaggucaccccacagaguuccaucaccgaagcugaacugaccggcuacgggaccgccacgauggagugcagcccccguaccggccuggacuucaacgagauggugcuccugcagauggagaacaaggcuuggcugguacaccggcagugguuccuagaccugcccuuacccuggcucccgggcgccgacacccagggcuccaauuggauacagaaggagacucugguaacguucaagaacccccacgccaagaagcaggacguggucgugcugggcucucaggagggggcaaugcauaccgcccucaccggcgcaaccgaaauccagaugagcuccgggaaucugcuauuuacgggccaccuaaagugccgccugcggauggacaagcuccagcucaagggcaugagcuacaguauguguaccgggaaauucaagguggucaaagagaucgcugagacacagcaugggaccaucguuauccgcgugcaguaugagggggauggcagucccugcaagauccccuucgagaucauggaccuggagaaacggcacguccugggccgccugaucacggugaauccaaucgugaccgagaaggacucccccgucaacaucgaggccgagccgcccuucggcgacagcuacauaauuaucggcguggagccggggcagcugaagcugucuugguucaagaagggcagcucgauugggcagauguucgagaccaccaugcgcggcgccaagcggauggcuauccucggcgacacggcgugggacuucgguagccugggagggguguucaccucuaucggcaaggcccugcaccaagucuucggggccaucuacggcgccgcguucucuggcguguccuggacaaugaaaauucucaucgggguaguuaucacuuggaucggcaugaauagucgcuccacgagccugagcgugagccuggugcuggucgggaucgugacccucuaccuuggcgugaugguccaggccgauuccgggugcguagugucauggaagaauaaggagcugaagugcggcagcggcauuuuuauaaccgacaacguacacacuuggacggagcaguauaaguuucagcccgagucccccagcaagcucgccuccgcgauccagaaggcccacgaggaggggaucugcggcauccggagcgugaccagacuggagaacuuaauguggaagcagaucacgccugagcucaaccacauucugagugagaacgaggugaagcugaccaucaugacgggggacaucaagggcaucaugcaggcggggaagcggagccugcgaccgcagcccaccgagcugaaguacuccuggaaggccuggggcaaagccaaaaugcuaagcaccgaacuccacaaccacaccuuccuuaucgacggcccugaaacggccgagugcccgaacaccaaccgggccuggaacucccuggaggucgaggacuacggguuuggcguguucaccaccaacaucuggcucaagcugaaggagcgccaggacguguuuugcgauagcaagcugauguccgcggccauuaaggacaacagagccguccacgccgacauggguuacuggauagagagcgcccuuaacgacacguggaagaucgagaaggcguccuuuauagaggucaaaaguugccacuggcccaagucccacacccuguggagcaacggcgugcuagagucggagaugaucauccccaagaacuucgccggccccgugagccagcacaauuaccgcccaggguaccacacccagaccgccggcccuuggcaccuugggagacuggagauggauuucgacuucugcgaaggaaccacaguaguggucaccgaggacugcgggaaccgcggccccucccuacggacaaccacggcguccggcaagcucaucacggaguggugcugccgcagcugcacccugccaccccugcgguacagaggugaggauggcugcugguacggcauggagauccgaccucucaaggagaaggaggagaaccuggugaacucccuugugaccgcaggccacgggcagaucgacaacuucagccuaggcguccugggcauggcccuguuccucgaggaaaugcugaggacgcggguagggaccaagcacgccauccugcucgucgccgucuccuucgugacccugauuaccggcaacaugagcuuccgugacuuggggcgagugauggucauggugggcgccacgaugaccgaugacaucgggaugggagucacauaccucgcgcugcuggccgccuucaagguccggcccaccuucgccgccggccuccugcugcgcaagcucacauccaaggagcugaugaugacaaccaucgggauagugcugcugucacagagcaccauccccgaaacuauacuggaacugaccgacgcuuuagcccugggcaugauggugcugaagaucguccggaauauggagaaguaccagcucgcggugacgauaauggcuauccugugcgucccgaacgccgugauccugcagaacgcguggaaggugagcugcaccauccucgcgguuguguccgugagcccccugcuccucaccaguucccaacagaaggccgacuggaucccccuggcccucaccaucaaagggcucaacccgaccgcaaucuuccugaccacccugucccgcaccagcaaaaagcgaucguggccgcucaacgaggccauuauggccgucggcaugguauccauccuggccuccucccugcucaagaacgacauccccaugaccggcccccugguggccgggggccugcucaccgucugcuacgugcugaccggucgcagcgcggaccuagagcucgagcgggccgccgacgugcgcugggaggagcaggccgaaaucucaggaagcucccccauccugagcaucaccaucuccgaggaugggagcauguccaucaagaacgaggaggaagagcagacccugaccauucucauccggacgggccugcuggucauaagcggccucuucccggugaguauccccaucaccgccgcggccugguaccugugggaggugaaaaagcagcgcgccgggguccugugggacguccccucucccccgcccgucggcaaggcagagcucgaggacggggccuaccggauuaagcagaagggcauccuuggguacucccaaaucggcgcgggcgucuacaaggaagguaccuuccacaccauguggcaugugacccgcggcgccgugcugaugcacaaggggaaacggaucgagccgagcugggccgacguuaagaaggaccucaucuccuacggcgguggcuggaagcuggaaggcgaguggaaggagggggaggaggugcaggugcuggcccucgagcccgggaagaacccucgggccguccagacgaagccggggcuguucaagaccaacacggggacgaucggugcuguaucucuggacuucagucccggcacgagcgggucccccaucguggacaagaaggggaaggucgugggccucuacgggaacgguguggucacacggucaggcacuuacguauccgccauugcacagaccgagaagucgauugaggacaacccggagaucgaggacgauauuuuccgcaagaagcgauugacgaucauggaccugcaccccggggccggcaagaccaagcgcuaccugcccgcgaucguucgggaggccaucaagcgcgggcuccggaccuuaauacuggccccuaccagagucguggccgcagagauggaggaggcacugcgcggccugcccauucgguaccaaacccccgcuauuagggccgagcacacagggagggagaucguggaccucaugugccacgccaccuucaccaugaggcuccugagccccauccgagucccuaacuacaaccugaucaucauggacgaggcccacuucacggaccccgcguccaucgccgcccgcggcuacauuagcacccggguggagaugggagaggcggccgggaucuuuaugaccgcgacgccccccggcucccgcgacccguucccccagagcaacgcccccaucauggacgaggaacgggagauccccgagcgcuccuggaacuccgggcacgagugggugaccgacuucaaaggcaagaccgucugguucgugcccuccaucaaggccgggaacgacaucgcagcgugccuccggaagaacggaaagaagguaauccagcugagcaggaagaccuuugacuccgaguacaucaagacccggacgaacgacugggauuuugucgucaccaccgauaucagcgagaugggcgccaacuucaaggccgagcgcgugauugacccucggcgcugcaugaagcccgucauccucaccgauggggaggagcggguaauccucgccgggcccaugcccgugacgcacuccagcgccgcgcagaggcgggggcgggucggccgcaacccaaaaaacgagaacgaccaguacaucuauaugggggagccccuggagaacgacgaggacugcgcucacuggaaggaggcaaaaaugcuacucgauaacaucaacaccccggaaggcaucaucccgucuauguucgagcccgagcgggagaagguggacgccaucgacggcgaauaccgccuucgaggugaggcccgcaagacuuucguggaccugaugcggcggggcgaccuccccgucugguuagcguaccggguggccgccgaggguaucaacuacgccgaccgccgguggugcuucgacggcgucaagaacaaccagauccuggaggagaacguggagguagagauauggaccaaggagggggagcgcaagaagcucaagccgcgguggcuagacgcccgcaucuacagcgacccccuggcgcucaaggaguucaaagaguucgccgccggccggaaguccuuaacgcugaaccucaucaccgagaugggucgccugcccaccuucaugacccagaaggcccggaacgcgcuggacaaccucgcaguccuccacacggccgaggccgggggccgcgccuacaaccacgcgcugagugagcuccccgagacccuggagacccugcuccugcugacccuccuggccacggugaccgggggcaucuuccuguuccucauguccggcaaagggaucggcaagaugacccuggggaugugcugcaucaucaccgccucaauccuguugugguacgcccaaauccaaccgcacuggaucgccgcguccaucauccuagaguuuuucuuaaucguucucuugauccccgaacccgagaagcagcggacaccccaggacaaccagcugacguacgucguuaucgccauccucaccguggucgccgcaaccauggcuaacgagaugggcuuccuggagaagaccaagaaggacuuugggcugggcagcaucacgacccagcagccggacagcaacauccucgacaucgaccugcgccccgcguccgccuggacccuauaugcuguggccaccacguuuaucacucccaugcuccggcacucuaucgagaacuccagcgugaacgucucccugaccgccaucgcgaaccaagccaccguguugauggggcucgggaagggcuggccccugagcaagauggacaucgggguaccgcugcucgccaucggcugcuacucccaggucaaucccaucacgcugaccgcggcgcugcuccugcugguggcccauuacgccaucaucgggcccggccuccaggccaaggcuaccagggaggcgcaaaagcgggccgccgccggcaucaugaagauccccgccgcggaugggaucaccgugaucgaccuugacccuauacccuacgaucccaaguucgagaagcagcugggccaagucaugcuccucgugcuuugcgugacgcaagugcucaugaugcgcaccaccugggcgcugugcgaagcccugacccucgccacggggcccaucagcacguuaugggagggcaacccgggacguuucuggaacaccacgauagccguguccauggcgaacaucuuccgggguagcuaccuggcaggcgccggccuccuguucuccaucaugaagaacacggccaacacccgccggggcaccgggaacacaggagagaccuuaggcgaaaaauggaagaaccgccuaaacgcauuaggcaagagcgaauuccagaucuauaagaaguccggcauccaggagguggaccggacccuggcaaaggaggggaucaaacgcggcgagaccgaccaucacgccgucucgcggggauccgccaagcuccgcugguucguagagcggaaccuggugacccccgagggcaaggucguggaccugggcugcggucgcggcggguggagcuacuacugcggcggccucaagaaugugaaggaggucaagggccuuacgaagggcgggcccggccacgaggagcccaucccgauguccaccuacggguggaaccuggugcggcuccaaagcggcguggacgucuucuucacaccgccggagaagugcgacacccugcugugugacauaggggagucuagccccaacccgacgguggaggccgggcgcacccuccgggugcugaaccuggucgagaacuggcucaacaacaacacccaguucuguauuaagguacugaaccccuacaugcccagcgucauugagaaaauggaggcgcugcagagaaaguacggcggugccuuaguacggaacccgcugucccgcaacagcacccacgagauguacuggguguccaacgccagcggcaacaucguguccucggucaacaugaucucccggauguuaauaaaccgcuucaccaugaagcacaagaaggccacguacgagcccgacguggaucuggggagcggcacccggaacaucggaaucgaguccgagacccccaaccucgauaucaucggcaagcgcauagaaaagaucaagcaggagcacgagaccagcuggcacuacgaccaggaccaucccuacaagacgugggcguaucacggcuccuacgagaccaagcagaccggcagcgcguccagcauggugaacggcgucgugcgccugcugaccaagccgugggacgugauccccauggucacgcagauggccaugaccgacaccacccccuucgggcagcagcggguguuuaaggaaaagguggauacacgcacccaggagcccaaggagggcaccaagaagcucaugaaaaucaccgcggaguggcuguggaaagagcugggcaaaaagaagacgccgcggaugugcacccgggaggaguucaccaggaagguccggagcaacgccgcccucggggcuauuuucaccgacgagaacaaguggaaguccgcccgggaggccgucgaggauuccggguucugggagcugguagacaaggagcgcaaccugcaccucgaggggaagugcgaaacgugcguguacaacaugaugggcaagcgggagaagaaguugggggaguucggcaaggccaaggguagccgcgcgaucugguacauguggcugggggcccgguuccucgaguucgaagcacugggauuccucaacgaggaccacugguucucccgcgagaacagccucagcgggguggagggcgaggggcugcacaaguugggcuacauccuccgggacgucuccaagaaggaggggggggccauguacgccgacgacaccgcgggcugggacacccgaauuacccuggaggacuugaagaacgaagagauggugacgaaccauauggagggggagcaccggaaacucgccgaagccauauucagacugaccuaccagaacaaggugguccgggugcagcgccccacgccccggggcaccgugauggacaucaucagccgccgggaccagcgcggguccggccaagucgucacguacggccugaacaccuucaccaacauggaggcucagcucauccgccagauggaaggggagggaguguucaagagcauccagcaccugaccgucacggaggagauagccgugaaaaauugguuggagcggguugggcgcgagcggcucucccgcauggcgaucagcggcgacgauugugucgugaagccccuggacgaccgguucgccuccgcccugaccgcucucaacgacaugggcaagguccgcaaggacauccagcagugggagccgagccggggguggaacgacuggacccaaguccccuucugcucccaccacuuccacgagcugaucaugaaggacggccgcgugcuggugguccccugccggaaccaggacgagcucaucgggcgcgcacggaucagccagggcgcgggcuggucccugagagaaaccgcuugucugggcaagagcuacgcccagauguggucccucauguacuuccaucggcgcgaccugcgucuggccgccaacgcgaucugcagcgccgugcccucccacugggugccgaucagccgcacgaccugguccauucacgccacccacgaguggaugacgaccgaggacaugcucacggucuggaaucggguguggauccaggagaacccauggauggaggacaagacccccguggagucaugggaggagauucccuaucugggcaagcgugaggaccaguggugcggaagccugaucggccuuaccucccgggccaccugggcgaagaauauucagacggccauaaaccaggucagaagccugaucgggaaugaggaguauacugacuacaugccguccaugaagcgcuuccggcgagaggaggaggaggcuggcgugcugugguga

SEQ ID NO: 24866 - RNA, 9876 nt, Artificial Sequence
  derived and/or modified CDS sequence (opt11) from DENV-2__KX380834__SS-prME
acggcggguaucaucaucaugaugauccccacugugauggccuuucaccugaccacgcgaaacggcgagccccacaugaucgucagccgucaggagaagggcaagucucucuuguucaaaacugagaacgggguaaacaugugcacccugauggcgauggaccucggcgaacugugcgaggacaccaucaccuacaacugccccuugcuccgccaaaacgagcccgaggacaucgacugcugguguaacagcacaagcaccugggugaccuaugggaccugcacugccaccggcgagcaccgucgcgaaaagcggagcgucgccuuggugccccacgugggcaugggguuggagacccgcaccgagaccuggaugagcuccgagggcgccuggaagcacgcccagcggaucgaaaccuggaucuugcgccaucccggguucacgaucauggcggccauccuggccuacaccaucgguaccaccuacuuccagcgggucuuaauuuucauucuccuuacagccgugacgcccuccauggcuaugcgcuguauagggauuagcaaccgggacuucguggaaggcguguccggcgggagcuggguggauaucguacuggagcacggcuccugcgucaccacuauggccaaaaacaagccuacucuagacuucgaacugaucaagaccgaggccaagcaccuagccaccuugcgcaaguacugcguggaagccaagcugaccaauacgaccaccgcaagccggugcccgacccaaggggagcccucccugaacgaggagcaagacaagcgcuucguguguaagcacagcaugguugaucggggcuggggcaauggauguggccuauuugggaagggcgguauugugacgugcgccauguucacguguaagaagaacauggagggcaagguggugcagccggagaaccuggaguacaccauugucauuaccccccauuccggcgaggaaaaugcuguggggaacgacacggguaagcacgguaaagagauuaaggucacgccccagagcuccauuaccgaggccgaguugaccggcuacgggaccgugacuauggagugcagcccgcgcaccggccucgacuucaacgagauggugcugcugcagauggagaauaaggccuggcucguacaccggcagugguuccuggaccugccccuucccuggcugcccggcgcggauacucaagggucaaacuggauccagaaggagacucuuguuacguuuaaaaacccacacgcgaagaagcaggacgucguggugcucggcagccaggagggggccaugcauaccgcucucacuggcgcuaccgagauccagaugagcucagggaaucuucuguucacggggcaccugaagugccgucugcggauggauaagcuccagcugaagggcaugucauauuccaugugcaccgggaaguucaagguuguuaaggagauagcggagacccaacacggaaccaucgugauccgcgugcaauacgagggggacggcagccccugcaagauacccuuugagaucauggaccuggagaagcggcaugugcucggccgccuuauuacggugaacccgauagucaccgagaaagacuccccggugaacauagaggccgaaccgccauucggggacagcuacauaaucaucgguguggagcccgggcagcugaagcucuccugguuuaagaaaggcagcucaaucggccagauguucgaaaccaccaugcgaggugccaagaggauggccauacugggugacacggccugggacuucgggagccuagggggugucuucaccucuauaggcaaagcacuccaccagguguucggggccaucuacggcgcggccuucagugguguauccuggaccaugaagauccugaucggggucgugauaaccuggauagguaugaacucgcgcuccacaagccuguccguaucucugguccucgucgggguggucaccuuauaucuuggcgugaugguucaggcggauucagggugcguggugaguuggaaaaacaaggagcugaagugcggaagcggaaucuucaucaccgauaacgugcacacauggacggagcaguauaaauuccagccagagucccccagcaagcuggccuccgccauccaaaaggcacacgaggaagggauuugcggcauacgaagcgucacucgccuggagaaccuuauguggaaacaaauaaccccggagcugaaccacauccugaccgagaacgaagugaagcugacgaucaugacuggagacaucaagggcaucaugcaggccggaaaacgaucccugcgcccgcagcccaccgagcuuaaguauagcuggaaggccuggggcaaggcuaagaugcuauccaccgagcugcacaaucacacguuccugaucgauggaccugagacggccgagugccccaacacgaaccgggccuggaacucacucgagguggaagacuacggguuuggcgucuucacuacgaauaucuggcugaagcuuaaagagcgccaggacguauuuugcgacuccaaccucaugucggcggcgaucaaggacaaccgggcggugcacgccgauaugggcuacuggauugaauccgcccugaacgacaccuggaagauagagaaggccagcuuuaucgaggugaagucaugccacuggcccaaaagccacacacuguggucaaacggcgugcucgaguccgagaugaucauacccaagaauuucgcgggccccguuucccagcacaacuaccgccccggguaccacacccaaacggccggcccguggcaccuggggcggcuagagauggacuucgacuucugcgagggcacgacuguuguggugaccgaggauugugguaaccgcggacccagccuccggaccacgaccgcgaguggcaagcugauaacggaguggugcugcagguccugcacucugcccccgcucagauaucgcggggaggacgguugcugguaugggauggagauacggccacugaaggaaaaggaagaaaaccuggucaauagccucguuacggccggucaugggcaaauagacaacuucagucugggcguacugggcauggcccucuuuuuagaggagaugcuacgcacacgggucgggaccaaacacgcaauucuccugguggccgugucuuucguuacccugaucacggggaacaugaguuuccgcgaucucgggcgcgugauggugauggucggggccaccaugaccgacgacauagggaugggcguuacuuaccucgcccuguuagcggccuucaaggugcggccaacguucgccgcgggccuccugcugcgaaagcugaccagcaaggagcugaugaugaccacaaucgggaucguccuccugucccaaaguacgauccccgagagcauccucgaacucacagacgccuuggcgcugggcaugaugguguuaaaaaucguacggaacauggagaaauaucagcuugcagugaccaucauggcaaucuugugcguuccaaacgcaguaauccugcagaacgccuggaaggugaguuguaccacgcuggcgguggucuccgugagcccgcugcuccugaccuccagccaacagaaggccgacuggaucccccuggcccucaccaucaagggccugaacccaacggcaaucuucuugacgaccuuaucccgcaccucuaagaagcgguccuggcccuuaaaugaggcuauuauggcaguagggauggucucgauccuggccuccagccuccugaagaacgacaucccgaugaccggccccuugguugccggcgggcuuuugaccguguguuacguccugacugggcgcagugcggaccucgagcucgagagggcggcagacguacgcugggaagagcaggccgagaucuccggcaguuccccgauauuaucuaucaccaucuccgaggacgggucaaugucaaucaaaaacgaggaggaggagcagacucuuacgauccugauccggacgggccugcuggugaucuccggccuguuccccgucuccaucccgaucacagcggccgcgugguaccugugggaggugaagaagcaacgcgccggggugcucugggacguccccuccccuccgcccguaggcaaggccgagcuggaggauggggccuaccggauuaagcagaaagggauccugggcuacucccagauaggcgccggcguuuacaaggaggggaccuuucacaccauguggcacgucacgcgcggcgcgguccugaugcacaaggggaagcggaucgagcccagcugggccgacgugaaaaaggaccugauuuccuacggggggggcuggaagcuugagggagaguggaaggagggggaggagguccaagugcucgcccuugagcccggcaagaacccgcgcgccgugcagaccaagccuggacuguucaagaccaacacuggaacaauuggggcugucagccucgacuucucccccggcaccagcggcucccccaucguagacaagaagggcaagguugucggccuguaugggaacggcguggugacccggagcggcaccuacguaucagcgaucgcccagacggagaaguccaucgaggacaacccggagauagaggacgacaucuuccgcaagaagcggcucaccaucauggaccugcaucccggggcgggcaagaccaaacgcuaccuccccgcuaucgugcgugaagcaauaaagcgcgggcugcggacccugauccucgcacccacgcgcgucgucgccgccgagauggaagaagcccugcggggccugccaauccgauaccaaacacccgcgauccgcgcggagcacaccggucgagagauaguggaccuuaugugccacgccaccuucacgaugcgccuacugucacccauccgcgugcccaacuacaaccucaucauuauggacgaggcccacuucaccgaccccgccuccaucgcggcccgaggcuacauuagcacccgggucgagaugggcgaggcagccgggauauucaugacugccacgccgccaggcucccgggaucccuucccgcagagcaacgcccccauaauggacgaggagcgggagauacccgagcguuccuggaacagugggcaugaaugggugacagacuuuaagggaaagaccgugugguucguccccuccaucaaagccggcaacgacaucgcugccugucugcggaaaaacgggaagaagguaauucagcugagucggaagaccuucgauucagaguacaucaagacgcggaccaacgacugggacuucguggucacgaccgacaucagcgagaugggcgcgaacuuuaaggccgagcgcguaaucgacccacggcgcugcaugaagcccgucauccuuacggacggcgaggagcggguuauucuggccggcccaaugcccgugacgcacagcagcgccgcccagcgccggggucgcgugggccgcaacccgaagaacgagaacgaccaguacaucuacaugggagagccccuggagaacgacgaggacugcgcgcauuggaaggaggccaagaugcuccucgacaacaucaacacccccgagggcauuauuccaaguauguucgagccggagcgggagaaggucgacgcgauagauggagaauaccgcuugcgcggggaggcccgaaagaccuucguagaucucaugcggaggggcgaccugcccgucugguuagccuaucggguggccgccgaggggaucaacuacgcagaccgccgguggugcuucgacggcguuaagaacaaccagauucucgaagagaacgucgagguggagaucuggaccaaggagggggagcgcaagaagcugaaaccucgguggcuggacgccaggaucuacagcgauccccucgcgcucaaggaguucaaggaguuugcggccggccggaagucccuuacucucaacuugauaaccgaaauggggcgccugcccacauucaugacgcagaaggccaagaacgcccucgacaaccuggcgguguugcauaccgccgaggccgggggcagagcauacaaucacgcccucagcgagcugccugagacgcuggagacccuccugcuauuaacgcugcuggcgaccgucaccgguggcaucuuccucuuccugauguccgggaaagggauagguaagaugacccuggggaugugcugcaucaucaccgccagcaucuuacugugguacgcccaaauccagccacacuggaucgcagccuccaucauccuggaguucuuccucaucguccugcugaucccggagcccgagaagcagcgcacgccgcaggacaaccagcucaccuauguagucauagcgaucuugaccguagucgccgccacgauggccaacgagaugggcuuccucgaaaagacuaagaaagacuucgggcuaggcucaaucacaacccagcagcccgagagcaacauucuggauaucgaucuccggccggcaucagcguggacccucuacgccguagccacuaccuuuaucaccccuaugcuacgccauucaaucgagaacuccucagugaacguguccuuaaccgcaaucgccaaucaggcgacgguacucaugggccuggggaagggcuggccccugucgaagauggacaucggggugccccuuuuagcuaucggcugcuacucccaggugaauccgaucaccuuaaccgccgcgcuccuucugcucgucgcgcauuacgccaucaucggccccggccuacaggcaaaggccacgagagaggcccagaagcgcgcagccgccggcauaaugaagaaccccacggucgacgggaugaccgugauugaccuggaccccaucccguacgaccccaaguuugagaagcaauuaggccagguuaugcuguuggugcucugcguuacccagguccugaugaugcggaccaccugggcccugugcgaggcccucacucuggcgaccgggccaaucucaacgcugugggaggggaaccccgggagauucuggaacacgacgaucgccguguccauggcgaacauauuucgcgguagcuaccucgccggcgcaggucuacuguucagcaucaugaagaacaccgcaaacacccggagagggacggguaauacgggggaaacccucggcgagaaguggaagaaccgacugaacgcccugggcaaaucagaguuccaaauauacaagaaguccggcauccaggagguggaccgcacccucgcaaaggaggggaucaagcggggcgaaacggaccaccacgccgucucucgcggguccgcuaaauugcggugguucguggaacgcaaccugguuacgccggagggcaagguuguggaccucggcugcgggcggggcggguggucauacuauugcggcggacugaagaacgugaaggaggucaaaggccugaccaagggugggccaggccacgaggagcccauccccauguccaccuacggauggaaccucgugcgccuccagagcggcguagacgucuucuucacgccgccggagaagugcgacacacugcucugcgacaucggcgaguccagcccaaaucccacaguggaggccggucggaccuuacgcgugcugaacuuggucgaaaacuggcucaacaacaacacucaguucuguauaaagguguugaacccguauaugccuagcguaauugagaagauggaagcucugcaacggaaguacggcggggcccuuguccgcaacccccucucccggaacagcacgcaugaaauguacuggguguccaacgccucuggcaacaucguauccagcgucaacaugaucucccgcaugcugaucaaccgguucacuaugcgccacaagaaggcgacguacgaaccggacguggaccuggggucaggcacacggaacaucgggauugagagcgagacgcccaaccuggacaucauaggaaagcgcaucgagaagaucaagcaggagcacgaaaccagcuggcauuacgaccaggaucaccccuacaagaccugggccuaccauggcuccuacgagaccaagcagaccgggagcgccuccagcauggugaacggcguggugaggcuucucaccaagccaugggacguuaucccgauggugacccagauggccaugaccgacacuacuccauuugggcaacagcggguguucaaggagaaaguggacacccgcacucaggaacccaaggaaggcaccaagaagcugaugaagaucaccgccgaauggcuguggaaggagcucggcaagaaaaagacucccaggaugugcacccgcgaggaguucacccggaaagugcgcucaaaugcggcacuuggggccauauucaccgacgagaacaaguggaaguccgcccgagaggccguggaggacuccggcuucugggagcuugucgacaaggagaggaaucuccaccuggaggggaagugcgagaccugcguguacaauaugaugggcaaacgggagaaaaaacugggggaguucggcaaagcgaagggcagccgcgcgaucugguacauguggcucggcgcccgguucuuagaguucgaggcccuugguuucuuaaacgaggaccacugguucucacgcgaaaacagccugagcgggguagagggcgaggggcugcacaagcugggcuauauacugcgggaugucagcaagaaggaggggggggcgauguacgccgaugacaccgcgggcugggauacgaggaucacccucgaagaucucaagaaugaagagaugguaaccaaccacauggaaggggagcacaagaagcuggccgaggccaucuucaagcucacuuaccagaacaaggugguccgagugcaacgcccgacgccccggggcaccgucauggacaucaucagccgccgcgaucagcgcggguccggccaagucgugaccuacggccuaaacacguucacuaacauggaggcgcagcugauccggcagauggaaggcgagggcguuuucaagaguauucagcaacugacugucaaggaggagauugccgugaagaacuggcucauucgcguggggcgggagcggcucucccgcauggcgaucagcggagacgacugcgucgugaagccccuugacgaccgcuucgccagugcccucacagcacugaacgacaugggcaaaguuagaaaggauauccagcaaugggagcccagccggggguggaacgacuggacccagguaccguuuugcucccaccacuuccaugagcuuaucaugaaggacggccgcguccucguaguccccugccggaaccaggacgagcugauuggucgcgcucggauaucucagggcgcgggguggagccugcgcgagaccgcuugccucggcaagagcuacgcacagauguggucccugauguauuuccaccggcgcgaccugcggcucgcagccaacgcaaucugcucggccgugcccucccacuggaucccaaccagccgcaccacaugguccauccacgccacucacgaguggaugacuaccgaggacaugcucaccguguggaaccgggucuggauccaggagaacccguggauggaggauaagacccccguggaaucuugggaggaaauacccuaccuggggaagcgcgaggaccaauggugugggagccucaucggucugacgucccgggcgaccugggccaagaauauccagacugccauuaaccaggugcgcagccugaucggcaacgaggaguacaccgacuacaugccauccaugaaaagauuccgucgcgaggaggaggaggcuggcguguuaugguag

SEQ ID NO: 24867 - RNA, 9876 nt, Artificial Sequence
  derived and/or modified CDS sequence (opt11) from DENV-2__KX380835__SS-prME
acugccgggaucaucaucaugaugauccccaccgugauggccuuccacuuaaccacccggaacggggaaccccauaugaucguuagucggcaggaaaaaggcaagagccugcuguucaagaccgaaaacggggugaacaugugcacccugauggcgauggaccucggcgagcugugcgaggacaccauaaccuacaacugcccccuccuccgccagaacgagcccgaggacaucgacugcuggugcaacagcacgagcaccuggguuaccuacgggaccugcacggccaccggcgaacaccgucgcgagaagcgguccgucgcacuggugccccacguggggaugggucucgagacucgcaccgagaccuggauguccagcgagggcgcguggaagcacgcccagcggaucgaaacauggguccuccgccaccccggguucaccguaauggcggcuauccuggccuacaccaucggcacaaccuacuuccagcgcgugcugaucuucauucugcugaccgcggucgcacccuccaugaccaugcgaugcaucgggaucaguaaccgggauuucguagaaggcguguccggcggcaguuggguagacaucguacuagagcacggcuccugugugaccacaauggccaagaacaagcccacgcucgauuucgagcugauuaagaccgaggccaaacaccccgcuacucugcgcaaguacugcaucgaggcaaaacucaccaauacgaccaccgcgucccgaugccccacgcagggagagccgucccugaaugaggagcaggacaagcgauucgucugcaaacacucaaugguggaccggggcuggggcaacggguguggccucuucgguaaaggcgggauaguuacgugcgcaauguucacaugcaagaagaacauggagggcaagaucgugcagcccgagaaucucgaguauacgaucgugaucacgccgcacuccggcgaggagaacgccguggggaacgacacggguaagcacgggaaagagaucaaagucacgccacagagcuccauaaccgaagccgagcugacgggcuacgggaccgcaacgauggagugcagcccacggaccggguuggacuuuaacgaaauggugcugcuucagauggagaacaaggcuugguuagugcaccggcaaugguuccucgaccugccucugcccuggcucccgggagccgacacccagggcaguaacuggauacagaaggagacccuggucacuuucaagaacccccacgcuaaaaagcaggauguggucgugcuggggagccaggagggagccaugcacaccgcacuuaccggggcaacugagauccagaugagcucggggaaccugcuguuuacgggccaccucaaaugcagacugcggauggacaaacugcagcuuaagggcaugagcuacuccaugugcaccgggaaguuuaagguggucaaggagaucgccgagacacagcacggcaccauagugauacgcguacaauacgaaggggauggcagccccuguaagauccccuucgaaaucauggaccuagaaaagcggcacgugcugggccgccucaucacggugaacccgaucgugacagaaaaggacuccccgguaaacaucgaggccgagccgcccuucggagauagcuacauaaucauuggcguggagccggggcagcugaaacuuuccugguucaagaagggcagcuccaucggucagauguucgagacaaccaugcgcggcgccaagcgcauggcuauccucggugauacggccugggacuuuggcucccugggaggugucuucaccuccauaggcaaggcccugcaccaggucuucggugccaucuacggcgccgcauucuccggaguguccuggaccaugaagauccucauugggguagucaucaccuggaucgguaugaacagcagguccaccagucuuuccgucagccugguacugguuggcaucgucacccucuaccugggagugauggugcaagcugacuccgggugcguggugaguuggaagaacaaggagcugaagugcgguuccgguaucuucaucaccgacaacguccacaccuggacggagcaguacaaguuccagcccgaaucaccgagcaaacucgcgagugccauccagaaggcccaugaggaggggaucugcgguauccggagcgugacccgucuugagaaccugauguggaaacagaucacccccgaacucaaucacauucuguccgaaaacgaggugaagcugacaauuaugacuggggacaucaagggcaucaugcaggcggggaagcggagccugcggccgcagcccaccgaacugaaguacuccuggaaagccuggggcaaggccaaaaugcugagcaccgaguuacauaaccauaccuuccugauugacggaccagagacggccgagugcccgaacaccaaucgggcuuggaacucccuggaggucgaggacuacggguucgggguguucaccaccaacaucugguuaaagcugaaggagcgccaggacguguucugugacaguaagcugauguccgcggccaucaaggacaaccgggcgguucaugccgacaugggguacuggauugagucugcccuuaacgacacguggaagauagagaaagcguccuucaucgaggucaagucgugccacuggccaaagagccacacccuguggaguaauggcgugcuagaguccgagaugaucauccccaagaacuucgccggcccugugagccaacacaacuaccggccgggguaccacacgcaaacggccggccccuggcaccucgggcgacucgaaauggauuucgacuucugcgaaggcaccacggugguggucaccgaggacugcgggaaccggggacccucucuuagaacaaccacggcgucuggcaagcucaucaccgaguggugcugucgcagcuguaccuuacccccgcugcgguacagaggggaggacggcugcugguacggaauggagauccguccccucaaggagaaggaggaaaacuuggugaacucucuggugaccgcuggccacgggcagaucgacaacuucagccucggagugcugggcauggccuuguuucucgaagaaaugcugcgaacucgcgugggcaccaagcacgccauccugcugguggccgucucauucguuacccugauuacgggcaacaugagcuucagagacuuggggcgagugaugguaauggugggcgccaccaugacugacgauaucgggaugggcgugaccuaccucgcguugcuggccgccuucaagguucgacccaccuucgccgccggccuccugcugcguaagcucacguccaaggagcugaugaugaccaccaucgggaucgugcugcucagccagucgaccaucccagagacgauccuugagcugaccgacgcacucgcccucggcaugaugguguugaagaucguccggaacauggagaaauaucagcucgccgugacgaucauggccauccugugcgucccgaacgccgugauccugcagaacgcauggaagguuucuugcacuauacuugccgucguguccgugagcccgcugcugcucacauccagccagcagaaggccgacuggaucccccuggcucugaccaucaaagguuugaaccccaccgcgauuuucuugacuacgcugucaagaaccaguaagaagcgguccuggccgcucaacgaggccaucauggcagucggcaugguaagcauccuggcauccagccuucuuaaaaaugacauuccuaugaccggcccccugguggcugggggccugcucacuguuuguuacgugcugacggggagaagcgcggaccucgagcucgaacgggccgccgacguacgcugggaggagcaggcagagaucagugggagcucccccauccugagcauaaccaucuccgaggacgggagcauguccaucaagaacgaggaggaggaacaaacauugaccauccucauccgaacgggccuguuagucauuucgggccucuucccaguuuccauccccaucaccgccgcugccugguaccugugggagguaaagaagcagcgcgccggcgugcugugggacguccccucaccgccgcccguaggcaaagccgagcucgaggacggggccuaccggauaaagcagaaagggauccugggguacagucagaucggcgcgggcguguauaaggagggaacguuccacaccauguggcacgugacuagaggcgcgguacugaugcauaaggggaaacggaucgaacccagcugggcugacgugaaaaaggaccuaauaaguuacggaggaggcuggaagcuggagggugaguggaaagagggggaagagguccaagugcuggcgcucgaacccgguaagaaccccagagccguccagacgaagcccgggcuguucaaaacgaauacuggcacuaucggugcagugagccuggauuucuccccggggacuagcggcuccccuaucguggauaagaaagguaaggucguggggcucuacggcaacggcguggucacccgguccgguacauacguuuccgccaucgcccaaacggagaaguccauugaggacaauccagagaucgaagacgacaucuuccguaagaagagauugacuauaauggaccugcaccccggagccgguaagaccaagcgcuaccugcccgcgaucgugcgggaggcuaucaagcggggucuccggacccugauccuggcccccacccgcgucguggcggccgaaauggaagaggcgcuccgaggcuuaccaauccgauaccagacgccggccauccgcgcugaacacaccgggcgggagaucguggaccuaaugugccacgcgacauucacaaugcgccuccugagcccaauacgggucccaaacuacaaccugaucaucauggacgaagcccacuucacggaccccgcguccaucgcagcgcgcggguacauuuccacccggguagagaugggcgaggcggcugggaucuucaugaccgcgacaccgcccggaagccgcgacccguucccccaaucaaacgcccccaucauggacgaagagagagagauucccgaaagauccuggaacagcgggcacgaguggguaaccgauuuuaagggaaagacuguaugguucgugcccagcaucaaagcugggaacgacaucgccgcaugccuccggaaaaauggcaaaaaggugauccaacuuagcagaaagaccuucgacagcgaauacaucaaaaccaggaccaacgacugggauuucguggugaccacugacaucagcgagaugggcgccaacuuuaaggcggagcgcguaaucgacccucggagaugcaugaaacccguaauccugacagacggcgaagaacgcgugauacuagccggucccaugccggugacucacucaucugccgcucagcgucguggccgcgucggccggaauccgaagaaugagaacgaucaguauaucuacaugggggagccucuggagaacgacgaggauugcgcccauuggaaggaagcaaagaugcugcuugauaacaucaacaccccugagggcauaauaccauccauguucgagccggaacgggagaagguggacgcaauagacggcgaguaccgacuacgcggcgaagccaggaagacauucguugacuuaaugcggcgcggcgacuuaccagucuggcuggccuaccguguggcagcugaggggaucaacuacgccgaccgacgguggugcuuugacggggucaagaacaaccaaauccuggaggagaacguggagguagaaaucuggaccaaggaaggagaacggaagaaacuuaagccucgcuggcuggacgcccggaucuauuccgacccccuggcgcucaaggaguucaaggaguucgccgcagggcggaagucccugacgcugaaucucaucaccgagaugggacgccugcccacuuucaugacccagaaagcacggaacgcgcuggacaacuuagccgugcugcacacggccgaggccggagggcgagccuacaaccacgcgcugucggaacucccugagacccuggagacuuuacuccugcuuaccuuacuggcaacugugacgggcggcaucuuccuguuccucauguccgguaaggggaucggaaagaugacucuggggaugugcugcaucauuaccgccuccauccugcucugguacgcccagauccagccacacuggauugcagcguccaucauccucgaguucuuucugaucgugcuccuaaucccugagccagagaagcagcggacgccccaggacaaccagcucacguacgucgugaucgccauucucacuguggucgccgccaccauggccaacgagaugggcuuccuggagaagaccaagaaggacuucgggcugggcuccaucacuacacagcagccggacagcaacauccucgauaucgacuuacggccugcuuccgccuggacucuguacgcgguggccaccacguucaucacccccaugcuccgacauagcaucgaaaacucgagcgucaacguuucgcuaacugccaucgcgaaccaggcgaccguucugaugggucucgguaaagguuggccucugagcaagauggacauaggggugccgcugcucgccauuggcugcuacucccaggucaaccccaucacguuaaccgccgcgcuucuccuguuaguggcucacuacgcaauaaucgggcccggcuugcaagccaaggcuaccagggaggcgcagaagagggcagccgcaggcauaaugaaaaaccccaccguggacggcaugacaguaaucgacuuagauccgauccccuacgaccccaaguucgagaagcagcucggccagguuaugcuucuggugcugugugucacccaggugcucaugaugcgaacaacaugggcccucugcgaggcccugacauuagccacggggcccauuagcacccugugggagggcaacccggggagguucuggaacaccacgaucgccguguccauggcaaacauauuccggggcagcuaccuggccggcgcggggcuccuguucuccaucaugaaaaauaccgccaacacccgccggggcaccgguaacacgggcgagacccuuggugagaaguggaagaaccgacucaacgcuuuaggcaaguccgaguuccagaucuauaaaaaguccggaauccaagaggucgaccgaacccuggccaaggaggggaucaagcgcggcgagaccgaccaccacgcggugucacggggaucggccaaacugcgcugguucguagagcggaacuuggucacgcccgagggcaaggugguggacuuaggcugcgggcgggguggguggagcuacuauuguggcgggcuaaagaaugucaaggaggugaagggccugaccaaaggcggcccgggccacgaggagcccaucccgaugaguacguacggguggaacuuaguaagacuccaaagcggggucgacgucuucuucacuccgcccgaaaagugcgacacguugcugugcgacaucggggaguccucuccuaauccgaccguggaggcagggagaacgcugcggguccugaacuugguggagaacuggcucaauaacaacacucaauucugcaucaaggugcuaaacccuuacaugccauccgucauugaaaagauggaagccuuacagcgcaaauacggaggggcuuuagugaggaacccgcuuucccggaacaguacacacgagauguacuggguuuccaaugccucgggcaacauagucuccucagugaacaugauuucccggaugcugaucaaccgguucacgaugaagcacaagaaagccaccuacgagcccgauguggaccuggggagcggaacacggaauaucgggaucgagagugagacccccaaccucgacauuauaggcaaaaggaucgagaagaucaaacaggagcacgagacaaguuggcauuacgaccaagaccaccccuacaagaccugggccuaucacggcuccuacgagaccaaacaaaccgguagugccuccucuauggucaacgguguggugcgccuucugacgaagccgugggacgucauucccauggugacccagauggccaugacagacaccacaccguucgggcagcagcggguguucaaggagaaggucgacacccgcacccaggaaccaaaggaaggaaccaagaaauugaugaagaucacggcggaauggcuauggaaagaacugggcaagaagaagaccccgcggaugugcacccgcgaagaguucacgcggaaggugcgguccaacgccgccuuaggugccaucuucacggaugagaacaaauggaagucugcccgggaggcgguggaagacucuggauuuugggaacugguggacaaagagcgaaaccugcaccucgaaggaaagugcgagaccuguguguauaacaugauggguaagcgggagaagaaacugggggaguucggcaaggccaagggcagccgcgcaauuugguauauguggcugggagcacgguuucucgaguucgaggcgcugggcuuccuuaacgaggaucacugguucucuagggagaacagccucagcggugucgagggcgagggcuuacacaagcugggcuacauucuccgggaugucuccaagaaagagggcggggcgauguacgccgacgauaccgccgguugggacacucgcaucacucuggaggaccugaagaacgaggagauggugaccaaucauauggagggagagcaucggaaacuugccgaggcgauuuuucgccucacauaccagaacaaggucgugcgggugcagcguccgacgccccggggcacggucauggacauuauuagcagacgugaccagcgcggcagcggccaaguggugaccuacggccugaacaccuuuaccaacauggaggcccagcucauucgacagauggagggagagggcguuuucaagaguauacagcaccugacuguaaccgaggaaaucgcggucaagaacuggcuggaacgggucgggcgcgaacggcucuccaggauggccaucagcggcgacgacugcguggugaagccacuggacgaccguuuugccagugcucugaccgcgcucaaugauaugggcaaagucagaaaggauauccagcagugggagccaagccggggguggaaugacuggacccaagugcccuuuugcucacaccacuuccacgagcucauuaugaaggacggccguguccucgucguacccugccguaaccaagacgagcucaucgggagggccagaauuagccaaggcgccggguggucccuacgcgagacugcgugucugggcaagagcuacgcccagauguggucccucauguacuuccacagaagagaccugcggcuugccgccaaugcaaucugcagcgcugugccaucccacugggucccuaucucucguaccaccugguccauccacgcgacacaugaguggaugacaacggaggauaugcugacuguguggaaccggguguggauccaggagaaccccuggauggaggauaagacaccggucgagagcugggaagagauaccauaucugggcaagagagaagaucaguggugugguagccugaucggccucaccucccgggccacgugggccaagaacauccagaccgccaucaaccaagugcgcagcuuaaucgguaacgaggaguacaccgacuacaugccguccaugaagagauuccggcgcgaggaggaggaggcgggcguguugugguag

SEQ ID NO: 24868 - RNA, 9876 nt, Artificial Sequence
  derived and/or modified CDS sequence (opt11) from DENV-2__KX380836__SS-prME
accgcugggaucaucauaaugaugauaccaaccgugauggccuuccacuugacuacucgcaauggggaaccgcacaugauugugagccggcaggagaagggcaaaagccuccuguucaagaccgagaauggggugaacaugugcacccugauggcgauggaccucggugagcugugcgaggacaccaucaccuacaacugucccuuacuaaggcagaacgagcccgaggacaucgacugcuggugcaauagcacuagcaccugggugacguacgguacuugcaccgcuacgggcgagcaccggcgcgagaagcggagcgucgcccugguaccccacgugggcauggguuuagagacccgaaccgagaccuggaugucaucugagggcgccuggaaacacgcgcaacggauagagaccuggguacuccgucaccccgguuucaccgugauggcagccauccuggccuacaccaucgggaccaccuacuuucagcggguguugaucuucauccuccugaccgccgucgcgccuuccaugaccaugcgcugcaucgggaucucuaaccgggacuucguggagggcgucucuggcgggaguugggucgacauuguccuggagcacggcuccugcgugaccacuauggccaagaacaagcccacgcucgacuucgagcugaucaagaccgaggcgaagcacccagccacccugaggaaguacugcaucgaggccaagcucaccaacacgacuaccgcuagccggugcccgacacagggcgaacccucccugaacgaggagcaagauaagcgcuucgucugcaaacauagcaugguggaccgaggcuggggcaacgggugcggcuuguucgggaaaggcgggauagucacgugugccauguucacaugcaagaagaacauggaggggaagaucguccagccggaaaaccucgaguacacaaucgugauuacaccccacuccggcgaggaaaaugccguggggaacgacacgggcaagcacgguaaggagaucaaggucaccccgcagagcagcaucaccgaggccgagcugaccggauacgggaccgcuacgauggagugcagcccaagaacaggcuuagacuucaacgagauggugcuccugcagauggagaacaaagcguggcuggugcacagacagugguuccucgaccugccacugcccuggcucccuggcgccgacacgcagggguccaacuggauccaaaaggagacccugguaacauucaagaacccccacgccaagaagcaggacguggucgugcugggcagccaggagggggccaugcacaccgcccucaccggcgcgaccgagauacagaugucgagugggaaccugcuguucacgggccaccucaagugccgccugcggauggauaagcugcagcucaaaggcaugagcuacuccaugugcaccgguaaguuuaagguggucaaagagaucgccgaaacccagcacggcaccaucgugauucgcgugcaguacgagggggacggaucacccugcaagauccccuucgagaucauggaccuggagaagagacacguccugggccgccuaauuacggugaacccgaucgugacugagaaggacucccccgucaacaucgaggcggaaccgcccuucggggacagcuacaucaucaucggcguggagccggggcagcugaagcuguccugguucaaaaaggggagcuccaucgggcagauguuugaaaccaccaugcgcggcgcgaagcggauggccauccucggcgacaccgcgugggacuucgggagccugggagggguguuuaccucaaucggcaaggcccugcaccaagucuucggggcaaucuacggcgccgcguucagcgggguuuccuggaccaugaagauccucauagggguggucauaacauggauuggcaugaacagccgaucgacgagccuguccgugagucuggugcuggucgggaucgugacccucuaccugggcgugaugguccaggcugacuccgggugcguggugucuuggaagaacaaggagcuaaagugcgggagcggcaucuucauaaccgacaacguccacaccuggacggaacaauauaaguuucagcccgagucccccaguaagcucgccuccgccauccagaaggcacacgaggaggggaucugcggcauacguagcgugacccgccuagagaaccugauguggaaacagaucaccccugagcucaaccacauccuguccgagaaugaggugaagcucacgaucaugacgggggacaucaagggcaucaugcaggcggggaagcggagccuccgcccgcagcccaccgagcuuaaguacuccuggaaggccuggggcaaggccaagaugcugagcaccgagcuccacaaccauaccuuccugaucgacggccccgagaccgccgaauguccgaacacaaaucgggccuggaacucccuggagguagaggacuacggauucggcguauucaccaccaacauauggcucaaacuuaaggagcgccaggacguguucugcgacagcaagcugauguccgcggcaauuaaggacaacagagcaguacacgccgacaugggguacuggauagagagcgcucuuaacgacacauggaagaucgaaaaggcgucauucauagagguaaagucgugccacuggcccaagagccacacccuuuggagcaauggaguccuggaguccgagaugauuauccccaaaaauuucgccggccccgugagccagcacaacuaccgcccgggguaccacacacaaaccgccggcccauggcaccucgggcggcuggagauggacuuugacuucugugaaggcaccacuguggugguuaccgaggacugcgggaaccgcggcccuagccugcggaccaccacggcguccgguaagcucaucaccgaauggugcugccgcagcugcacccugccgccgcuccgguaccgcggggaggacgguugcugguacgggauggagaucagaccccucaaggagaaggaggagaaccugguaaacucacuggugaccgcggggcacgggcagaucgacaacuucagccuaggaguccugggcauggcacuguuccuggaggaaaugcugagaacucgggucgggaccaagcaugccauacugcucguggccgucagcuucgucacccugaucaccggcaacaugucguuccgcgaccugggcagggugaugguuauggugggcgccacgaugaccgacgacauugggaugggcgugacuuaccucgcgcuguuggccgcauucaagguccggcccacuuuugccgcuggccuccugcugcgcaagcucacguccaaggagcugaugaugaccaccaucgggauagugcuguugucacaauccacuauccccgagacgauccuagaacugaccgacgcacucgcccuggguaugauggugcuuaagaucguccggaacauggagaaguaccagcuggcugugaccaucauggccauccugugcgucccgaacgccgugauccugcagaacgcguggaaggugagcugcacgauccucgccgucgucuccgugagcccccugcugcucacaaguucucagcaaaaggccgauuggauccccuuagcccucaccaucaaggggcucaacccgaccgcgaucuuccuaacuacuuuaucccgcaccagcaagaagcgauccuggccgcucaacgaggccaucauggccgucgggaugguuagcauacuggcauccagccugcuuaagaacgacauccccaugacuggcccccugguggccgggggccugcugacagucugcuacgugcugacggggcgcagcgcggaccuugagcucgagcgggccgcugacgugcgcugggaggagcaagccgagaucuccggcagcuccccgauccugagcaucaccaucuccgaggacgggagcauguccauuaagaacgaggaggaggagcaaacacugaccauccugauccggacgggccuguuggucaucagcggacucuucccgguaagcauccccauuaccgccgccgccugguaccucugggaagugaagaagcagcgcgcagggguacugugggacgugccuagcccgccgcccgucggcaaggccgagcucgaggacggugccuaucggaucaagcagaagggcauccugggauauucccaaaucggcgcgggcgucuauaaggaggggaccuuccacaccauguggcacgugacucgcggcgcugugcugaugcacaaggggaagcggaucgaaccaagcugggccgaugucaagaaagaccucaucucauacggcggaggcuggaagcuggagggcgaauggaaggagggagaggagguacagguccuggcccucgagcccggcaagaacccccgcgcgguccagacgaagcccgggcuguucaagaccaacaccgguaccauuggggcggugucucuggacuucucccccgggacgagcggcucccccaucguggacaaaaaggggaaagucguaggccucuaugggaauggcguggucacccgaagcggcaccuauguguccgcgaucgcccagacugagaaguccaucgaggauaaccccgagaucgaggacgacauuuuccgcaagaagcgacugacgaucauggaccugcaccccggggccggaaagaccaagcgcuaccuacccgcgaucgugcgggaagcgauaaagaggggacucagaacccugauccuggccccgacccgcgucguggcagccgaaauggaagaggcgcuccguggccuacccauacguuaccagacgcccgccauccgcgccgagcacacugggcgagaaaucguggaccucaugugccacgccaccuucaccaugcgccuccugaguccgauccggguaccgaacuacaaccugauuaucauggacgaggcccacuucacggaccccgcguccauugccgcgcgcggcuacaucagcacccggguggaaaugggugaggccgccgguauauucaugacagcgacaccgcccggcucccgcgacccguucccccagagcaacgcccccaucauggacgaggagagagaaauccccgagcgcuccuggaauagcgggcacgagugggucaccgacuucaaaggcaagaccgucugguucgugccguccaucaaagcagguaacgacaucgccgcgugccuccggaagaacggcaagaaggugauccagcugagccgcaagaccuucgacuccgaguacaucaaaacccguacgaaugacugggacuucgucgugaccaccgacaucagcgagaugggcgccaacuucaaagccgaaagagugaucgaccccaggcgcugcaugaagcccguuaucuuaacagacggggaggagcgggugauccuugccggaccgaugcccgugacacacuccucugccgcgcagcgccgggggcgugucggccgcaauccgaagaacgagaacgaccaguacaucuacaugggggagccccuggagaacgacgaggacugcgcccauuggaaggaggccaagaugcugcucgauaacaucaacacccccgaaggcaucaucccguccauguucgagccagagcgggagaagguagaugcaaucgauggcgaguaccgccugcggggcgaggcccgcaagaccuucguggaccugaugcgccggggcgaccuccccgucuggcuggcguaucgggucgccgccgaagggaucaacuacgccgaccgccgguggugcuucgacggcgucaagaacaaccagauccuggaggagaauguggagguggagaucuggaccaaggagggggagcggaagaagcucaagccgcgguggcuggacgcgcggauauacagcgacccccuggcacucaaggaguucaaggaguucgccgccggacggaaaucccugacgcugaaccugaucaccgagaugggucgccuccccaccuucaugacccaaaaggccaagaacgcgcuggauaaccucgccguccugcacacggccgaggccggagggcgggcuuacaaccaugcgcugagcgagcuccccgagacccuggagacccugcuccugcugacccuccuggccacugugaccgggggaaucuuccuguuccucauguccggcaaagggauuggcaagaugacccuggggauguguugcauaaucaccgcuagcauccuccucugguacgcccagauccaaccgcacuggaucgccgcgaguaucauccucgaguucuuccugaucguccuccuaauacccgagccggagaaacagcgcacuccccaggacaaccagcugacguacguugugaucgcaauccucaccguggucgccgccacaauggccaacgagaugggguuccuggagaagacgaagaaggacuucgggcugggcuccaucacgacccagcagccugagucaaacauccucgauaucgaccuacgccccgcguccgcuuggacccuguaugcaguggccaccacguucaucacccccaugcuuagacacagcaucgagaacuccagcgugaacguuucccugaccgcuauagcgaaucaagccaccgugcuuaugggccucgggaagggcuggccccugagcaagauggacaucggggugccgcugcucgccaucggcugcuacucccaggugaacccgaucacgcugaccgcggcgcuacuccugcugguggcccacuacgccaucaucggacccggccuccaggccaaggccacccgggaggcgcagaagcgcgccgccgccggcaucaugaagaaucccaccgucgacgggaugacggucaucgaucuggacccgaucccauacgaccccaaguucgagaagcaguuaggccaggugaugcuucugguccuuugcgucacccaaguccucaugaugcggaccaccugggcacugugcgaggcgcugacacucgccaccgggcccaucaguacccuuugggagggcaacccggggcgcuucuggaacaccacuaucgccgugagcauggccaacaucuuccgcggcagcuaccuggcaggggcugggcuacuguucaguaucaugaagaacaccgccaacacccggcgcggcaccgggaacacgggugagacacugggcgaaaaguggaagaaucggcucaacgcccugggcaaaagcgaguuccagaucuacaagaaguccggcauacaggaggucgaccguacccuggcuaaggaagggaucaaacggggcgagaccgaccaccacgcggugagccgcggguccgcuaagcucaggugguucguggagcgcaaccucguaacgcccgaaggcaaggugguggaccucggcugcgggcggggcggguggagcuacuauugcggcgggcucaaaaacgucaaggaggugaagggccugaccaagggagggccaggccacgaggagccuaucccgauguccaccuacggguggaaccuggugcgcuugcaaucaggcgucgacguguucuucacgccgcccgagaagugcgacacgcuucugugcgacaucggggagagcagccccaacccgaccguagaagcaggccguacccuccgcguccuuaaccuuguggagaacuggcucaauaacaacacccaauucugcaucaaggugcugaauccuuacaugcccagcgucauagaaaagauggaggcgcuacagcggaaguacggcggggcccuggugcgcaauccgcugucccggaacagcacccacgaaauguacuggguguccaacgcgagcgggaacaucgucucuagcgugaacaugauuucccgcaugcugaucaaccgguucacgaugaaacacaagaaggccaccuacgagccagacguagaccuggggucaggcacacgcaacaucgguaucgaaucagagacccccaacuuggacaucauuggcaagcggaucgagaaaaucaaacaggagcacgagacgagcuggcacuacgaccaggaccaccccuacaagaccugggccuaccacggguccuaugaaaccaagcagaccgggucugccuccaguauggugaauggcguggugcgccugcugacgaagccgugggacguuauccccaugguaacgcagauggcgaugaccgacaccacacccuucggccagcagcgcguguucaaggagaaggucgacacccggacccaggaacccaaggagggcaccaagaagcugaugaagaucacggcggaguggcuguggaaggagcugggcaagaagaagaccccgcgcaugugcacccgggaggaguucacccgcaaggugcgguccaacgcagcacucggggcuaucuucacagacgagaacaaguggaagagugcccgcgaggcggucgaagacuccggauucugggagcugguugacaaggagaggaaccugcacuuagagggcaagugcgagaccuguguguacaacaugauggggaagcgcgagaaaaagcugggggaguucggcaaggccaaaggcucucgggccaucugguacaugugguugggggcacgcuuucucgaguucgaggcgcugggauuccugaaugaggaccacugguucagucgggagaacucauugagcggggucgagggcgaggggcugcauaagcugggauacauccuccgcgauguguccaagaaggaggguggggccauguacgcggacgauacagcgggcugggauaccaggauaacgcuggaggaccugaagaacgaggagaugguuaccaaccauauggagggggagcaccgcaaacucgccgaagcgauauuucggcugaccuaccaaaauaaggucgugcgggugcagcgaccgacgccccgagggacggucauggacauaaucucgcggcgcgaccagcggggguccggccagguggugaccuacgggcugaacaccuucacaaacauggaggcccaauuaauccgccaaauggagggggagggcgucuucaagagcauccagcaccugacggugaccgaggagaucgcagucaaaaacuggcuggaaagagucgggcgggagcgcuugucccggauggccaucuccggcgacgacugcguggugaagccccuggacgaccgauucgccuccgcgcugaccgcccugaacgauaugggcaagguccggaaggacauccagcagugggagccgucgcgcggauggaacgacuggacccaagugcccuuuuguucccaccacuuccacgaguugaucaugaaggacggucgagugcuggucgugccgugccgcaaccaggacgaacuuaucgggcgggcccgcaucagucagggcgccggguggucccugcgggagacggccugccuuggcaaaucuuacgcccagauguggucccucauguacuuccaccgccgugaccugcgccuggccgccaacgccauuugcagcgcugugcccucccacugggucccgaucagccggaccacuuggucaauccacgcgacccacgaauggaugaccacggaggacaugcugaccguguggaaucgcguauggauccaggaaaaccccuggauggaggacaaaacccccgucgagagcugggaggaaaucccguaccucgguaagcgggaggaccaguggugcgggagccugaucgggcuaaccucccgagccacgugggccaaaaacauccagaccgccaucaaccaggugcggucacuaauagggaacgaggaguacaccgacuacaugccguccaugaagagguuccgccgggaggaggaggaggcgggcguucuuugguga
